United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 26

SEQ ID NO: 958333 - RNA, 14 nt, Mycobacterium avium subsp. paratuberculosis
ccagcggaucggcg

SEQ ID NO: 958334 - RNA, 17 nt, Mycobacterium avium subsp. paratuberculosis
ccagcggaucggcgguc

SEQ ID NO: 958335 - RNA, 22 nt, Mycobacterium avium subsp. paratuberculosis
ccagcggagcguucuccacccg

SEQ ID NO: 958336 - RNA, 19 nt, Mycobacterium avium subsp. paratuberculosis
ccagcgcguagagcaucag

SEQ ID NO: 958337 - RNA, 14 nt, Mycobacterium avium subsp. paratuberculosis
ccagcgcguagucg

SEQ ID NO: 958338 - RNA, 17 nt, Mycobacterium avium subsp. paratuberculosis
ccagcgcguagucggcg

SEQ ID NO: 958339 - RNA, 20 nt, Mycobacterium avium subsp. paratuberculosis
ccagcgcguagucggcgucg

SEQ ID NO: 958340 - RNA, 24 nt, Mycobacterium avium subsp. paratuberculosis
ccagcgcguagucggcgucggcca

SEQ ID NO: 958341 - RNA, 14 nt, Mycobacterium avium subsp. paratuberculosis
ccagcggcacgaag

SEQ ID NO: 958342 - RNA, 19 nt, Mycobacterium avium subsp. paratuberculosis
ccagcggcacgggcaccga

SEQ ID NO: 958343 - RNA, 16 nt, Mycobacterium avium subsp. paratuberculosis
ccagcggcagcacguc

SEQ ID NO: 958344 - RNA, 23 nt, Mycobacterium avium subsp. paratuberculosis
ccagcggcagcacguccccgggc

SEQ ID NO: 958345 - RNA, 18 nt, Mycobacterium avium subsp. paratuberculosis
ccagcggcagcagcacca

SEQ ID NO: 958346 - RNA, 20 nt, Mycobacterium avium subsp. paratuberculosis
ccagcggcagcagcaccagc

SEQ ID NO: 958347 - RNA, 23 nt, Mycobacterium avium subsp. paratuberculosis
ccagcggcagcagcaccagcgug

SEQ ID NO: 958348 - RNA, 17 nt, Mycobacterium avium subsp. paratuberculosis
ccagcggcagcggcguc

SEQ ID NO: 958349 - RNA, 21 nt, Mycobacterium avium subsp. paratuberculosis
ccagcggcagcgccagcggga

SEQ ID NO: 958350 - RNA, 15 nt, Mycobacterium avium subsp. paratuberculosis
ccagcggccacaccg

SEQ ID NO: 958351 - RNA, 21 nt, Mycobacterium avium subsp. paratuberculosis
ccagcggccacaccggggcca

SEQ ID NO: 958352 - RNA, 12 nt, Mycobacterium avium subsp. paratuberculosis
ccagcggcaggu

SEQ ID NO: 958353 - RNA, 14 nt, Mycobacterium avium subsp. paratuberculosis
ccagcggcaggugg

SEQ ID NO: 958354 - RNA, 18 nt, Mycobacterium avium subsp. paratuberculosis
ccagcggcaucgccgcca

SEQ ID NO: 958355 - RNA, 20 nt, Mycobacterium avium subsp. paratuberculosis
ccagcggcaucgccgccaag

SEQ ID NO: 958356 - RNA, 21 nt, Mycobacterium avium subsp. paratuberculosis
ccagcggcaucgccgccaagg

SEQ ID NO: 958357 - RNA, 14 nt, Mycobacterium avium subsp. paratuberculosis
ccagcggcgccgaa

SEQ ID NO: 958358 - RNA, 14 nt, Mycobacterium avium subsp. paratuberculosis
ccagcggcggcccu

SEQ ID NO: 958359 - RNA, 14 nt, Mycobacterium avium subsp. paratuberculosis
ccagcggcggccuu

SEQ ID NO: 958360 - RNA, 19 nt, Mycobacterium avium subsp. paratuberculosis
ccagcggcccucccccgag

SEQ ID NO: 958361 - RNA, 12 nt, Mycobacterium avium subsp. paratuberculosis
ccagcggcgcgc

SEQ ID NO: 958362 - RNA, 14 nt, Mycobacterium avium subsp. paratuberculosis
ccagcggcgcgccg

SEQ ID NO: 958363 - RNA, 14 nt, Mycobacterium avium subsp. paratuberculosis
ccagcggcgccggg

SEQ ID NO: 958364 - RNA, 21 nt, Mycobacterium avium subsp. paratuberculosis
ccagcggcgaugcccacagcc

SEQ ID NO: 958365 - RNA, 22 nt, Mycobacterium avium subsp. paratuberculosis
ccagcggcgaugcccacagcca

SEQ ID NO: 958366 - RNA, 12 nt, Mycobacterium avium subsp. paratuberculosis
ccagcggccguc

SEQ ID NO: 958367 - RNA, 14 nt, Mycobacterium avium subsp. paratuberculosis
ccagcggccgucgc

SEQ ID NO: 958368 - RNA, 19 nt, Mycobacterium avium subsp. paratuberculosis
ccagcggccagcccgcggc

SEQ ID NO: 958369 - RNA, 20 nt, Mycobacterium avium subsp. paratuberculosis
ccagcggccccggcucgggc

SEQ ID NO: 958370 - RNA, 22 nt, Mycobacterium avium subsp. paratuberculosis
ccagcggccccggcucgggcca

SEQ ID NO: 958371 - RNA, 13 nt, Mycobacterium avium subsp. paratuberculosis
ccagcggccgcag

SEQ ID NO: 958372 - RNA, 14 nt, Mycobacterium avium subsp. paratuberculosis
ccagcggccgcagc

SEQ ID NO: 958373 - RNA, 15 nt, Mycobacterium avium subsp. paratuberculosis
ccagcggccgcagcg

SEQ ID NO: 958374 - RNA, 19 nt, Mycobacterium avium subsp. paratuberculosis
ccagcgccgagaucgcggu

SEQ ID NO: 958375 - RNA, 21 nt, Mycobacterium avium subsp. paratuberculosis
ccagcgccgagaucgcggugg

SEQ ID NO: 958376 - RNA, 16 nt, Mycobacterium avium subsp. paratuberculosis
ccagcgccgccagccg

SEQ ID NO: 958377 - RNA, 13 nt, Mycobacterium avium subsp. paratuberculosis
ccagcgccgccag

SEQ ID NO: 958378 - RNA, 18 nt, Mycobacterium avium subsp. paratuberculosis
ccagcgccgccaucgccu

SEQ ID NO: 958379 - RNA, 21 nt, Mycobacterium avium subsp. paratuberculosis
ccagcgccgccaucgccucgu

SEQ ID NO: 958380 - RNA, 15 nt, Mycobacterium avium subsp. paratuberculosis
ccagcgcgaucgccg

SEQ ID NO: 958381 - RNA, 21 nt, Mycobacterium avium subsp. paratuberculosis
ccagcgcgcagaacaccaccg

SEQ ID NO: 958382 - RNA, 22 nt, Mycobacterium avium subsp. paratuberculosis
ccagcgcgcagaacaccaccgc

SEQ ID NO: 958383 - RNA, 17 nt, Mycobacterium avium subsp. paratuberculosis
ccagcgcccgcgcgugg

SEQ ID NO: 958384 - RNA, 14 nt, Mycobacterium avium subsp. paratuberculosis
ccagcgcccgggcg

SEQ ID NO: 958385 - RNA, 21 nt, Mycobacterium avium subsp. paratuberculosis
ccagcgcccgauucgcggcca

SEQ ID NO: 958386 - RNA, 13 nt, Mycobacterium avium subsp. paratuberculosis
ccagcgcccgcgc

SEQ ID NO: 958387 - RNA, 14 nt, Mycobacterium avium subsp. paratuberculosis
ccagcgcccgcgcg

SEQ ID NO: 958388 - RNA, 15 nt, Mycobacterium avium subsp. paratuberculosis
ccagcgcccgcgcga

SEQ ID NO: 958389 - RNA, 16 nt, Mycobacterium avium subsp. paratuberculosis
ccagcgcccgcgcgau

SEQ ID NO: 958390 - RNA, 16 nt, Mycobacterium avium subsp. paratuberculosis
ccagcgcccccagcgg

SEQ ID NO: 958391 - RNA, 20 nt, Mycobacterium avium subsp. paratuberculosis
ccagcgcccccagcggggca

SEQ ID NO: 958392 - RNA, 22 nt, Mycobacterium avium subsp. paratuberculosis
ccagcgcccccgacaggcccac

SEQ ID NO: 958393 - RNA, 15 nt, Mycobacterium avium subsp. paratuberculosis
ccagcgccaugccgc

SEQ ID NO: 958394 - RNA, 19 nt, Mycobacterium avium subsp. paratuberculosis
ccagcgccaugccgccgac

SEQ ID NO: 958395 - RNA, 13 nt, Mycobacterium avium subsp. paratuberculosis
ccagcgcgccgau

SEQ ID NO: 958396 - RNA, 14 nt, Mycobacterium avium subsp. paratuberculosis
ccagcgcgccgauc

SEQ ID NO: 958397 - RNA, 16 nt, Mycobacterium avium subsp. paratuberculosis
ccagcgcgccgcccag

SEQ ID NO: 958398 - RNA, 17 nt, Mycobacterium avium subsp. paratuberculosis
ccagcgcgccgcccagc

SEQ ID NO: 958399 - RNA, 14 nt, Mycobacterium avium subsp. paratuberculosis
ccagcgcgccgccg

SEQ ID NO: 958400 - RNA, 18 nt, Mycobacterium avium subsp. paratuberculosis
ccagcgcgccgaucgccc

SEQ ID NO: 958401 - RNA, 14 nt, Mycobacterium avium subsp. paratuberculosis
ccagcgcgccgcac

SEQ ID NO: 958402 - RNA, 19 nt, Mycobacterium avium subsp. paratuberculosis
ccagcgcgccgcacagccg

SEQ ID NO: 958403 - RNA, 23 nt, Mycobacterium avium subsp. paratuberculosis
ccagcgcgccgcacagccggcgg

SEQ ID NO: 958404 - RNA, 17 nt, Mycobacterium avium subsp. paratuberculosis
ccagcgcgcgaucgccg

SEQ ID NO: 958405 - RNA, 22 nt, Mycobacterium avium subsp. paratuberculosis
ccagcgcgcgaucgccggugcg

SEQ ID NO: 958406 - RNA, 13 nt, Mycobacterium avium subsp. paratuberculosis
ccagcgcgcgauc

SEQ ID NO: 958407 - RNA, 20 nt, Mycobacterium avium subsp. paratuberculosis
ccagcgcgcgaucagcgccg

SEQ ID NO: 958408 - RNA, 13 nt, Mycobacterium avium subsp. paratuberculosis
ccagcgcgccggc

SEQ ID NO: 958409 - RNA, 14 nt, Mycobacterium avium subsp. paratuberculosis
ccagcgcgccggcc

SEQ ID NO: 958410 - RNA, 17 nt, Mycobacterium avium subsp. paratuberculosis
ccagcgcgccggccagc

SEQ ID NO: 958411 - RNA, 21 nt, Mycobacterium avium subsp. paratuberculosis
ccagcgcgccggccagcagca

SEQ ID NO: 958412 - RNA, 15 nt, Mycobacterium avium subsp. paratuberculosis
ccagcgcgccgccga

SEQ ID NO: 958413 - RNA, 14 nt, Mycobacterium avium subsp. paratuberculosis
ccagcgcggcggcc

SEQ ID NO: 958414 - RNA, 23 nt, Mycobacterium avium subsp. paratuberculosis
ccagcgcggcggccaccucggcg

SEQ ID NO: 958415 - RNA, 21 nt, Mycobacterium avium subsp. paratuberculosis
ccagcgcggcggccagcucgg

SEQ ID NO: 958416 - RNA, 15 nt, Mycobacterium avium subsp. paratuberculosis
ccagcgcggcggcgc

SEQ ID NO: 958417 - RNA, 21 nt, Mycobacterium avium subsp. paratuberculosis
ccagcgcggcggcgccgucgc

SEQ ID NO: 958418 - RNA, 13 nt, Mycobacterium avium subsp. paratuberculosis
ccagcgcggucgc

SEQ ID NO: 958419 - RNA, 23 nt, Mycobacterium avium subsp. paratuberculosis
ccagcgcggucgccaccaccagc

SEQ ID NO: 958420 - RNA, 14 nt, Mycobacterium avium subsp. paratuberculosis
ccagcgcggcgguc

SEQ ID NO: 958421 - RNA, 21 nt, Mycobacterium avium subsp. paratuberculosis
ccagcgcggcggucgcgcgcc

SEQ ID NO: 958422 - RNA, 22 nt, Mycobacterium avium subsp. paratuberculosis
ccagcgcggcggucgcgcgccg

SEQ ID NO: 958423 - RNA, 12 nt, Mycobacterium avium subsp. paratuberculosis
ccagcgcggcgu

SEQ ID NO: 958424 - RNA, 13 nt, Mycobacterium avium subsp. paratuberculosis
ccagcgcggcguc

SEQ ID NO: 958425 - RNA, 14 nt, Mycobacterium avium subsp. paratuberculosis
ccagcgcggugaag

SEQ ID NO: 958426 - RNA, 15 nt, Mycobacterium avium subsp. paratuberculosis
ccagcgcggugagca

SEQ ID NO: 958427 - RNA, 16 nt, Mycobacterium avium subsp. paratuberculosis
ccagcgcggugagcag

SEQ ID NO: 958428 - RNA, 22 nt, Mycobacterium avium subsp. paratuberculosis
ccagcgcggugagcagcaugcc

SEQ ID NO: 958429 - RNA, 17 nt, Mycobacterium avium subsp. paratuberculosis
ccagcgcggugcccagc

SEQ ID NO: 958430 - RNA, 19 nt, Mycobacterium avium subsp. paratuberculosis
ccagcgcggugcccagcca

SEQ ID NO: 958431 - RNA, 17 nt, Mycobacterium avium subsp. paratuberculosis
ccagcgcgguggccagc

SEQ ID NO: 958432 - RNA, 17 nt, Mycobacterium avium subsp. paratuberculosis
ccagcgcgccgccgaug

SEQ ID NO: 958433 - RNA, 13 nt, Mycobacterium avium subsp. paratuberculosis
ccagcgcggcggc

SEQ ID NO: 958434 - RNA, 21 nt, Mycobacterium avium subsp. paratuberculosis
ccagcgcggugucgacgucgg

SEQ ID NO: 958435 - RNA, 20 nt, Mycobacterium avium subsp. paratuberculosis
ccagcgcggugugcggcggc

SEQ ID NO: 958436 - RNA, 21 nt, Mycobacterium avium subsp. paratuberculosis
ccagcaucggaugccggggca

SEQ ID NO: 958437 - RNA, 18 nt, Mycobacterium avium subsp. paratuberculosis
ccagcaucgccgcggugc

SEQ ID NO: 958438 - RNA, 14 nt, Mycobacterium avium subsp. paratuberculosis
ccagccacaccgcc

SEQ ID NO: 958439 - RNA, 24 nt, Mycobacterium avium subsp. paratuberculosis
ccagccacaccgccgcggcggugg

SEQ ID NO: 958440 - RNA, 12 nt, Mycobacterium avium subsp. paratuberculosis
ccagccacagcc

SEQ ID NO: 958441 - RNA, 13 nt, Mycobacterium avium subsp. paratuberculosis
ccagccacagccg

SEQ ID NO: 958442 - RNA, 14 nt, Mycobacterium avium subsp. paratuberculosis
ccagccacgccgac

SEQ ID NO: 958443 - RNA, 22 nt, Mycobacterium avium subsp. paratuberculosis
ccagccacgccgacaccgucgc

SEQ ID NO: 958444 - RNA, 20 nt, Mycobacterium avium subsp. paratuberculosis
ccagccacuccaccaccggc

SEQ ID NO: 958445 - RNA, 14 nt, Mycobacterium avium subsp. paratuberculosis
ccagccaccguggc

SEQ ID NO: 958446 - RNA, 18 nt, Mycobacterium avium subsp. paratuberculosis
ccagccauacugacgccg

SEQ ID NO: 958447 - RNA, 23 nt, Mycobacterium avium subsp. paratuberculosis
ccagccauacugacgccggucgc

SEQ ID NO: 958448 - RNA, 16 nt, Mycobacterium avium subsp. paratuberculosis
ccagccaguccgccgc

SEQ ID NO: 958449 - RNA, 13 nt, Mycobacterium avium subsp. paratuberculosis
ccagccccaccac

SEQ ID NO: 958450 - RNA, 14 nt, Mycobacterium avium subsp. paratuberculosis
ccagccccaccacc

SEQ ID NO: 958451 - RNA, 16 nt, Mycobacterium avium subsp. paratuberculosis
ccagccccaccaccgc

SEQ ID NO: 958452 - RNA, 20 nt, Mycobacterium avium subsp. paratuberculosis
ccagccccaccaccgccacc

SEQ ID NO: 958453 - RNA, 16 nt, Mycobacterium avium subsp. paratuberculosis
ccagcccagccgccag

SEQ ID NO: 958454 - RNA, 12 nt, Mycobacterium avium subsp. paratuberculosis
ccagcccagcgc

SEQ ID NO: 958455 - RNA, 19 nt, Mycobacterium avium subsp. paratuberculosis
ccagcaccugaccgucggc

SEQ ID NO: 958456 - RNA, 17 nt, Mycobacterium avium subsp. paratuberculosis
ccagcaccugcucgaug

SEQ ID NO: 958457 - RNA, 20 nt, Mycobacterium avium subsp. paratuberculosis
ccagcaccugcucgaugcgc

SEQ ID NO: 958458 - RNA, 18 nt, Mycobacterium avium subsp. paratuberculosis
ccagcaccuggcgcaccg

SEQ ID NO: 958459 - RNA, 22 nt, Mycobacterium avium subsp. paratuberculosis
ccagcaccuggcgcaccgccgc

SEQ ID NO: 958460 - RNA, 22 nt, Mycobacterium avium subsp. paratuberculosis
ccagcaccuucagcgggcgcag

SEQ ID NO: 958461 - RNA, 17 nt, Mycobacterium avium subsp. paratuberculosis
ccagcaccuucgggccg

SEQ ID NO: 958462 - RNA, 22 nt, Mycobacterium avium subsp. paratuberculosis
ccagcacgaaggccgccggguc

SEQ ID NO: 958463 - RNA, 16 nt, Mycobacterium avium subsp. paratuberculosis
ccagcaccucgcggca

SEQ ID NO: 958464 - RNA, 15 nt, Mycobacterium avium subsp. paratuberculosis
ccagcaccucggcga

SEQ ID NO: 958465 - RNA, 18 nt, Mycobacterium avium subsp. paratuberculosis
ccagcaggucgaaggcgg

SEQ ID NO: 958466 - RNA, 20 nt, Mycobacterium avium subsp. paratuberculosis
ccagcaggucgaaggcggcc

SEQ ID NO: 958467 - RNA, 22 nt, Mycobacterium avium subsp. paratuberculosis
ccagcaggucgaaggcggccgc

SEQ ID NO: 958468 - RNA, 23 nt, Mycobacterium avium subsp. paratuberculosis
ccagcagguagaucgccagcgcc

SEQ ID NO: 958469 - RNA, 16 nt, Mycobacterium avium subsp. paratuberculosis
ccagcagguccgccgg

SEQ ID NO: 958470 - RNA, 18 nt, Mycobacterium avium subsp. paratuberculosis
ccagcagguccgccggug

SEQ ID NO: 958471 - RNA, 15 nt, Mycobacterium avium subsp. paratuberculosis
ccagcacgacgccgc

SEQ ID NO: 958472 - RNA, 19 nt, Mycobacterium avium subsp. paratuberculosis
ccagcacgaucccgccgcc

SEQ ID NO: 958473 - RNA, 15 nt, Mycobacterium avium subsp. paratuberculosis
ccagcacgaucgggu

SEQ ID NO: 958474 - RNA, 14 nt, Mycobacterium avium subsp. paratuberculosis
ccagcacgaugacg

SEQ ID NO: 958475 - RNA, 19 nt, Mycobacterium avium subsp. paratuberculosis
ccagcacgaugacgaccgg

SEQ ID NO: 958476 - RNA, 20 nt, Mycobacterium avium subsp. paratuberculosis
ccagcacgaugacgaccggg

SEQ ID NO: 958477 - RNA, 15 nt, Mycobacterium avium subsp. paratuberculosis
ccagcacgacaccga

SEQ ID NO: 958478 - RNA, 16 nt, Mycobacterium avium subsp. paratuberculosis
ccagcacgacaccgac

SEQ ID NO: 958479 - RNA, 18 nt, Mycobacterium avium subsp. paratuberculosis
ccagcacgacaccgacga

SEQ ID NO: 958480 - RNA, 19 nt, Mycobacterium avium subsp. paratuberculosis
ccagcacgacaccgacgac

SEQ ID NO: 958481 - RNA, 15 nt, Mycobacterium avium subsp. paratuberculosis
ccagcacgaccccgc

SEQ ID NO: 958482 - RNA, 19 nt, Mycobacterium avium subsp. paratuberculosis
ccagcacgaccccgcccac

SEQ ID NO: 958483 - RNA, 22 nt, Mycobacterium avium subsp. paratuberculosis
ccagcaguguccagucggccgu

SEQ ID NO: 958484 - RNA, 23 nt, Mycobacterium avium subsp. paratuberculosis
ccagcaguguccagucggccgug

SEQ ID NO: 958485 - RNA, 18 nt, Mycobacterium avium subsp. paratuberculosis
ccagcagugccaacacgg

SEQ ID NO: 958486 - RNA, 23 nt, Mycobacterium avium subsp. paratuberculosis
ccagcagugccaacacggcggcg

SEQ ID NO: 958487 - RNA, 21 nt, Mycobacterium avium subsp. paratuberculosis
ccagcagugccaccaccacgg

SEQ ID NO: 958488 - RNA, 15 nt, Mycobacterium avium subsp. paratuberculosis
ccagcagucgugacg

SEQ ID NO: 958489 - RNA, 23 nt, Mycobacterium avium subsp. paratuberculosis
ccagcagucgugacgcggcgucg

SEQ ID NO: 958490 - RNA, 15 nt, Mycobacterium avium subsp. paratuberculosis
ccagcaggucgucga

SEQ ID NO: 958491 - RNA, 16 nt, Mycobacterium avium subsp. paratuberculosis
ccagcaggucgucgac

SEQ ID NO: 958492 - RNA, 20 nt, Mycobacterium avium subsp. paratuberculosis
ccagcaggucgucgacgucc

SEQ ID NO: 958493 - RNA, 21 nt, Mycobacterium avium subsp. paratuberculosis
ccagcagguccauggccuuga

SEQ ID NO: 958494 - RNA, 15 nt, Mycobacterium avium subsp. paratuberculosis
ccagcaguccggcgg

SEQ ID NO: 958495 - RNA, 23 nt, Mycobacterium avium subsp. paratuberculosis
ccagcaguuuguccugcucggcg

SEQ ID NO: 958496 - RNA, 24 nt, Mycobacterium avium subsp. paratuberculosis
ccagcaguuuguccugcucggcga

SEQ ID NO: 958497 - RNA, 18 nt, Mycobacterium avium subsp. paratuberculosis
ccagcauaaggauuuucg

SEQ ID NO: 958498 - RNA, 22 nt, Mycobacterium avium subsp. paratuberculosis
ccagcaguucguccacgcuggc

SEQ ID NO: 958499 - RNA, 23 nt, Mycobacterium avium subsp. paratuberculosis
ccagcauccgcuggugcgcgccg

SEQ ID NO: 958500 - RNA, 17 nt, Mycobacterium avium subsp. paratuberculosis
ccagccgaucgcggugc

SEQ ID NO: 958501 - RNA, 19 nt, Mycobacterium avium subsp. paratuberculosis
ccagccgaucgcggugcug

SEQ ID NO: 958502 - RNA, 15 nt, Mycobacterium avium subsp. paratuberculosis
ccagccgaugcgccc

SEQ ID NO: 958503 - RNA, 21 nt, Mycobacterium avium subsp. paratuberculosis
ccagccgaugcgcccgcgcca

SEQ ID NO: 958504 - RNA, 15 nt, Mycobacterium avium subsp. paratuberculosis
ccagccgcaccgcga

SEQ ID NO: 958505 - RNA, 12 nt, Mycobacterium avium subsp. paratuberculosis
ccagccgcacga

SEQ ID NO: 958506 - RNA, 21 nt, Mycobacterium avium subsp. paratuberculosis
ccagcccgggaaagcggguga

SEQ ID NO: 958507 - RNA, 13 nt, Mycobacterium avium subsp. paratuberculosis
ccagcccggcgug

SEQ ID NO: 958508 - RNA, 16 nt, Mycobacterium avium subsp. paratuberculosis
ccagcccggcgugcag

SEQ ID NO: 958509 - RNA, 15 nt, Mycobacterium avium subsp. paratuberculosis
ccagcccggcgacga

SEQ ID NO: 958510 - RNA, 13 nt, Mycobacterium avium subsp. paratuberculosis
ccagcccggcccc

SEQ ID NO: 958511 - RNA, 14 nt, Mycobacterium avium subsp. paratuberculosis
ccagcccggcccgu

SEQ ID NO: 958512 - RNA, 19 nt, Mycobacterium avium subsp. paratuberculosis
ccagcccggcccgucgagc

SEQ ID NO: 958513 - RNA, 12 nt, Mycobacterium avium subsp. paratuberculosis
ccagcccggccg

SEQ ID NO: 958514 - RNA, 16 nt, Mycobacterium avium subsp. paratuberculosis
ccagcccggccgccga

SEQ ID NO: 958515 - RNA, 23 nt, Mycobacterium avium subsp. paratuberculosis
ccagccggcccgcaucgcggcga

SEQ ID NO: 958516 - RNA, 14 nt, Mycobacterium avium subsp. paratuberculosis
ccagccggccgacg

SEQ ID NO: 958517 - RNA, 19 nt, Mycobacterium avium subsp. paratuberculosis
ccagccggccgacgcggcc

SEQ ID NO: 958518 - RNA, 14 nt, Mycobacterium avium subsp. paratuberculosis
ccagccggccgagc

SEQ ID NO: 958519 - RNA, 17 nt, Mycobacterium avium subsp. paratuberculosis
ccagccgcccagcaucg

SEQ ID NO: 958520 - RNA, 15 nt, Mycobacterium avium subsp. paratuberculosis
ccagccgccgcgaca

SEQ ID NO: 958521 - RNA, 14 nt, Mycobacterium avium subsp. paratuberculosis
ccagccgccggcca

SEQ ID NO: 958522 - RNA, 15 nt, Mycobacterium avium subsp. paratuberculosis
ccagccgccggccac

SEQ ID NO: 958523 - RNA, 19 nt, Mycobacterium avium subsp. paratuberculosis
ccagccgccggccaccagg

SEQ ID NO: 958524 - RNA, 13 nt, Mycobacterium avium subsp. paratuberculosis
ccagccgccggcg

SEQ ID NO: 958525 - RNA, 14 nt, Mycobacterium avium subsp. paratuberculosis
ccagccgccggcuc

SEQ ID NO: 958526 - RNA, 16 nt, Mycobacterium avium subsp. paratuberculosis
ccagccgccggcucag

SEQ ID NO: 958527 - RNA, 19 nt, Mycobacterium avium subsp. paratuberculosis
ccagccgccggcucagcgg

SEQ ID NO: 958528 - RNA, 20 nt, Mycobacterium avium subsp. paratuberculosis
ccagccgccggcucagcggc

SEQ ID NO: 958529 - RNA, 16 nt, Mycobacterium avium subsp. paratuberculosis
ccagccgccgguccag

SEQ ID NO: 958530 - RNA, 14 nt, Mycobacterium avium subsp. paratuberculosis
ccagccgcauucgg

SEQ ID NO: 958531 - RNA, 18 nt, Mycobacterium avium subsp. paratuberculosis
ccagccgcauucggugag

SEQ ID NO: 958532 - RNA, 19 nt, Mycobacterium avium subsp. paratuberculosis
ccagccgcauucggugagc

SEQ ID NO: 958533 - RNA, 14 nt, Mycobacterium avium subsp. paratuberculosis
ccagccgcaggugc

SEQ ID NO: 958534 - RNA, 16 nt, Mycobacterium avium subsp. paratuberculosis
ccagccgcaggugcag

SEQ ID NO: 958535 - RNA, 17 nt, Mycobacterium avium subsp. paratuberculosis
ccagccgcagcaggcac

SEQ ID NO: 958536 - RNA, 14 nt, Mycobacterium avium subsp. paratuberculosis
ccagcccgcgggcg

SEQ ID NO: 958537 - RNA, 16 nt, Mycobacterium avium subsp. paratuberculosis
ccagcccgcgggcggc

SEQ ID NO: 958538 - RNA, 16 nt, Mycobacterium avium subsp. paratuberculosis
ccagcccggccagcac

SEQ ID NO: 958539 - RNA, 17 nt, Mycobacterium avium subsp. paratuberculosis
ccagcccggccagcggc

SEQ ID NO: 958540 - RNA, 19 nt, Mycobacterium avium subsp. paratuberculosis
ccagcccggccagcggcau

SEQ ID NO: 958541 - RNA, 12 nt, Mycobacterium avium subsp. paratuberculosis
ccagcccgcgcc

SEQ ID NO: 958542 - RNA, 14 nt, Mycobacterium avium subsp. paratuberculosis
ccagcccgcgccag

SEQ ID NO: 958543 - RNA, 14 nt, Mycobacterium avium subsp. paratuberculosis
ccagcccgcgccga

SEQ ID NO: 958544 - RNA, 15 nt, Mycobacterium avium subsp. paratuberculosis
ccagcccgcgccgag

SEQ ID NO: 958545 - RNA, 19 nt, Mycobacterium avium subsp. paratuberculosis
ccagcccgcgcgagcgcag

SEQ ID NO: 958546 - RNA, 17 nt, Mycobacterium avium subsp. paratuberculosis
ccagcccgcccagcgcc

SEQ ID NO: 958547 - RNA, 15 nt, Mycobacterium avium subsp. paratuberculosis
ccagcccgccgaacc

SEQ ID NO: 958548 - RNA, 13 nt, Mycobacterium avium subsp. paratuberculosis
ccagcccgccgcg

SEQ ID NO: 958549 - RNA, 18 nt, Mycobacterium avium subsp. paratuberculosis
ccagcccgccgcguccgg

SEQ ID NO: 958550 - RNA, 14 nt, Mycobacterium avium subsp. paratuberculosis
ccagcccgccgggc

SEQ ID NO: 958551 - RNA, 12 nt, Mycobacterium avium subsp. paratuberculosis
ccagcccgccgu

SEQ ID NO: 958552 - RNA, 14 nt, Mycobacterium avium subsp. paratuberculosis
ccagcccgccgucg

SEQ ID NO: 958553 - RNA, 15 nt, Mycobacterium avium subsp. paratuberculosis
ccagcccgccgucgg

SEQ ID NO: 958554 - RNA, 16 nt, Mycobacterium avium subsp. paratuberculosis
ccagcccgccgucggc

SEQ ID NO: 958555 - RNA, 14 nt, Mycobacterium avium subsp. paratuberculosis
ccagcccgaugccg

SEQ ID NO: 958556 - RNA, 18 nt, Mycobacterium avium subsp. paratuberculosis
ccagcccgaugccgccga

SEQ ID NO: 958557 - RNA, 16 nt, Mycobacterium avium subsp. paratuberculosis
ccagcccgagcaccag

SEQ ID NO: 958558 - RNA, 17 nt, Mycobacterium avium subsp. paratuberculosis
ccagcccgagcaccagc

SEQ ID NO: 958559 - RNA, 18 nt, Mycobacterium avium subsp. paratuberculosis
ccagcccgagcaccagcg

SEQ ID NO: 958560 - RNA, 21 nt, Mycobacterium avium subsp. paratuberculosis
ccagccccgggaaccagccca

SEQ ID NO: 958561 - RNA, 17 nt, Mycobacterium avium subsp. paratuberculosis
ccagccccucgccgggc

SEQ ID NO: 958562 - RNA, 19 nt, Mycobacterium avium subsp. paratuberculosis
ccagccccagcacgaugac

SEQ ID NO: 958563 - RNA, 17 nt, Mycobacterium avium subsp. paratuberculosis
ccagcccccgcgggucg

SEQ ID NO: 958564 - RNA, 14 nt, Mycobacterium avium subsp. paratuberculosis
ccagccccaccggc

SEQ ID NO: 958565 - RNA, 14 nt, Mycobacterium avium subsp. paratuberculosis
ccagcgcaccgggc

SEQ ID NO: 958566 - RNA, 18 nt, Mycobacterium avium subsp. paratuberculosis
ccagcgcaccgggcccgc

SEQ ID NO: 958567 - RNA, 15 nt, Mycobacterium avium subsp. paratuberculosis
ccagcgcagguacgc

SEQ ID NO: 958568 - RNA, 13 nt, Mycobacterium avium subsp. paratuberculosis
ccagcgcaggucc

SEQ ID NO: 958569 - RNA, 14 nt, Mycobacterium avium subsp. paratuberculosis
ccagcgcagcacug

SEQ ID NO: 958570 - RNA, 14 nt, Mycobacterium avium subsp. paratuberculosis
ccagcgcagcgacc

SEQ ID NO: 958571 - RNA, 20 nt, Mycobacterium avium subsp. paratuberculosis
ccagcgcagcgaccuggucc

SEQ ID NO: 958572 - RNA, 15 nt, Mycobacterium avium subsp. paratuberculosis
ccagcgcagcgccuc

SEQ ID NO: 958573 - RNA, 21 nt, Mycobacterium avium subsp. paratuberculosis
ccagcgcagcgccucggcggc

SEQ ID NO: 958574 - RNA, 22 nt, Mycobacterium avium subsp. paratuberculosis
ccagcgcagcgccucggcggcc

SEQ ID NO: 958575 - RNA, 23 nt, Mycobacterium avium subsp. paratuberculosis
ccagcgcagcgccucggcggccc

SEQ ID NO: 958576 - RNA, 22 nt, Mycobacterium avium subsp. paratuberculosis
ccagcgagaccgcuugcggcuc

SEQ ID NO: 958577 - RNA, 15 nt, Mycobacterium avium subsp. paratuberculosis
ccagcgagaagucgc

SEQ ID NO: 958578 - RNA, 21 nt, Mycobacterium avium subsp. paratuberculosis
ccagcgagaagucgcucagcg

SEQ ID NO: 958579 - RNA, 20 nt, Mycobacterium avium subsp. paratuberculosis
ccagcgacucggccaggaug

SEQ ID NO: 958580 - RNA, 22 nt, Mycobacterium avium subsp. paratuberculosis
ccagcgacggcaggucggugcg

SEQ ID NO: 958581 - RNA, 14 nt, Mycobacterium avium subsp. paratuberculosis
ccagcgacggccgg

SEQ ID NO: 958582 - RNA, 12 nt, Mycobacterium avium subsp. paratuberculosis
ccagcgcacaca

SEQ ID NO: 958583 - RNA, 15 nt, Mycobacterium avium subsp. paratuberculosis
ccagcgcacacaccg

SEQ ID NO: 958584 - RNA, 21 nt, Mycobacterium avium subsp. paratuberculosis
ccagcgcacacaccguaccga

SEQ ID NO: 958585 - RNA, 15 nt, Mycobacterium avium subsp. paratuberculosis
ccagcgcaaccgcgg

SEQ ID NO: 958586 - RNA, 23 nt, Mycobacterium avium subsp. paratuberculosis
ccagcgcaaccgcggcggcggcc

SEQ ID NO: 958587 - RNA, 18 nt, Mycobacterium avium subsp. paratuberculosis
ccagcgcaacggcgucga

SEQ ID NO: 958588 - RNA, 19 nt, Mycobacterium avium subsp. paratuberculosis
ccagcgcaacggcgucgac

SEQ ID NO: 958589 - RNA, 18 nt, Mycobacterium avium subsp. paratuberculosis
ccagcgacgccagcggca

SEQ ID NO: 958590 - RNA, 20 nt, Mycobacterium avium subsp. paratuberculosis
ccagcgacgccaugucgaug

SEQ ID NO: 958591 - RNA, 21 nt, Mycobacterium avium subsp. paratuberculosis
ccagcgacaacagcacgaaca

SEQ ID NO: 958592 - RNA, 12 nt, Mycobacterium avium subsp. paratuberculosis
ccagccgggugg

SEQ ID NO: 958593 - RNA, 17 nt, Mycobacterium avium subsp. paratuberculosis
ccagccggguggcccgc

SEQ ID NO: 958594 - RNA, 16 nt, Mycobacterium avium subsp. paratuberculosis
ccagccggucaucgcg

SEQ ID NO: 958595 - RNA, 17 nt, Mycobacterium avium subsp. paratuberculosis
ccagccggucgccgggc

SEQ ID NO: 958596 - RNA, 21 nt, Mycobacterium avium subsp. paratuberculosis
ccagccgggguagggcggcgg

SEQ ID NO: 958597 - RNA, 22 nt, Mycobacterium avium subsp. paratuberculosis
ccagccgggguagggcggcggg

SEQ ID NO: 958598 - RNA, 16 nt, Mycobacterium avium subsp. paratuberculosis
ccagccggcggugcag

SEQ ID NO: 958599 - RNA, 22 nt, Mycobacterium avium subsp. paratuberculosis
ccagccggcucuuggcgaccuc

SEQ ID NO: 958600 - RNA, 18 nt, Mycobacterium avium subsp. paratuberculosis
ccagccgggccgagcgcg

SEQ ID NO: 958601 - RNA, 19 nt, Mycobacterium avium subsp. paratuberculosis
ccagccgggccgagcgcgc

SEQ ID NO: 958602 - RNA, 23 nt, Mycobacterium avium subsp. paratuberculosis
ccagccgggccgagcgcgccgcc

SEQ ID NO: 958603 - RNA, 13 nt, Mycobacterium avium subsp. paratuberculosis
ccagccgggcggc

SEQ ID NO: 958604 - RNA, 14 nt, Mycobacterium avium subsp. paratuberculosis
ccagccgggcggcc

SEQ ID NO: 958605 - RNA, 16 nt, Mycobacterium avium subsp. paratuberculosis
ccagccgggcggccag

SEQ ID NO: 958606 - RNA, 13 nt, Mycobacterium avium subsp. paratuberculosis
ccagccggcgcac

SEQ ID NO: 958607 - RNA, 14 nt, Mycobacterium avium subsp. paratuberculosis
ccagccggcgcacc

SEQ ID NO: 958608 - RNA, 14 nt, Mycobacterium avium subsp. paratuberculosis
ccagccggccgcug

SEQ ID NO: 958609 - RNA, 13 nt, Mycobacterium avium subsp. paratuberculosis
ccagccggccggc

SEQ ID NO: 958610 - RNA, 16 nt, Mycobacterium avium subsp. paratuberculosis
ccagccggccggccga

SEQ ID NO: 958611 - RNA, 17 nt, Mycobacterium avium subsp. paratuberculosis
ccagccggccggcgaag

SEQ ID NO: 958612 - RNA, 19 nt, Mycobacterium avium subsp. paratuberculosis
ccagcguggcgaacgcgac

SEQ ID NO: 958613 - RNA, 21 nt, Mycobacterium avium subsp. paratuberculosis
ccagcguuuggccugcggcaa

SEQ ID NO: 958614 - RNA, 17 nt, Mycobacterium avium subsp. paratuberculosis
ccagcguuuccagcgcc

SEQ ID NO: 958615 - RNA, 20 nt, Mycobacterium avium subsp. paratuberculosis
ccagcguuuccagcgccggc

SEQ ID NO: 958616 - RNA, 22 nt, Mycobacterium avium subsp. paratuberculosis
ccagcguuuccagcgccggcac

SEQ ID NO: 958617 - RNA, 17 nt, Mycobacterium avium subsp. paratuberculosis
ccagcguucgucgccgg

SEQ ID NO: 958618 - RNA, 21 nt, Mycobacterium avium subsp. paratuberculosis
ccagcguucgucgccggugag

SEQ ID NO: 958619 - RNA, 13 nt, Mycobacterium avium subsp. paratuberculosis
ccagcucccacga

SEQ ID NO: 958620 - RNA, 15 nt, Mycobacterium avium subsp. paratuberculosis
ccagcucccacgacg

SEQ ID NO: 958621 - RNA, 16 nt, Mycobacterium avium subsp. paratuberculosis
ccagcucccacgacga

SEQ ID NO: 958622 - RNA, 18 nt, Mycobacterium avium subsp. paratuberculosis
ccagcucccaggacgcgg

SEQ ID NO: 958623 - RNA, 20 nt, Mycobacterium avium subsp. paratuberculosis
ccagcucccaggacgcggug

SEQ ID NO: 958624 - RNA, 14 nt, Mycobacterium avium subsp. paratuberculosis
ccagcuccacgcgu

SEQ ID NO: 958625 - RNA, 17 nt, Mycobacterium avium subsp. paratuberculosis
ccagcuccagcagcccg

SEQ ID NO: 958626 - RNA, 20 nt, Mycobacterium avium subsp. paratuberculosis
ccagcuccagcagcccgggc

SEQ ID NO: 958627 - RNA, 13 nt, Mycobacterium avium subsp. paratuberculosis
ccagcucagcgcg

SEQ ID NO: 958628 - RNA, 15 nt, Mycobacterium avium subsp. paratuberculosis
ccagcucaccggcca

SEQ ID NO: 958629 - RNA, 16 nt, Mycobacterium avium subsp. paratuberculosis
ccagcucaccggccag

SEQ ID NO: 958630 - RNA, 14 nt, Mycobacterium avium subsp. paratuberculosis
ccagcucaccggga

SEQ ID NO: 958631 - RNA, 20 nt, Mycobacterium avium subsp. paratuberculosis
ccagcucgcgaagcgcgaug

SEQ ID NO: 958632 - RNA, 13 nt, Mycobacterium avium subsp. paratuberculosis
ccagcucgcguuc

SEQ ID NO: 958633 - RNA, 22 nt, Mycobacterium avium subsp. paratuberculosis
ccagcucgagcaucacgaaccc

SEQ ID NO: 958634 - RNA, 18 nt, Mycobacterium avium subsp. paratuberculosis
ccagcucgaggccgcggg

SEQ ID NO: 958635 - RNA, 14 nt, Mycobacterium avium subsp. paratuberculosis
ccagcucgaugccg

SEQ ID NO: 958636 - RNA, 12 nt, Mycobacterium avium subsp. paratuberculosis
ccagcucgaacc

SEQ ID NO: 958637 - RNA, 22 nt, Mycobacterium avium subsp. paratuberculosis
ccagcucgccgauguggcgggc

SEQ ID NO: 958638 - RNA, 12 nt, Mycobacterium avium subsp. paratuberculosis
ccagcucgccgc

SEQ ID NO: 958639 - RNA, 16 nt, Mycobacterium avium subsp. paratuberculosis
ccagcucgccgccgac

SEQ ID NO: 958640 - RNA, 12 nt, Mycobacterium avium subsp. paratuberculosis
ccagcuccgggu

SEQ ID NO: 958641 - RNA, 20 nt, Mycobacterium avium subsp. paratuberculosis
ccagcuccucggccagcacc

SEQ ID NO: 958642 - RNA, 17 nt, Mycobacterium avium subsp. paratuberculosis
ccagcuccucggggaug

SEQ ID NO: 958643 - RNA, 15 nt, Mycobacterium avium subsp. paratuberculosis
ccagcucgaacaccg

SEQ ID NO: 958644 - RNA, 18 nt, Mycobacterium avium subsp. paratuberculosis
ccagcucgaacaccgucg

SEQ ID NO: 958645 - RNA, 21 nt, Mycobacterium avium subsp. paratuberculosis
ccagcucgaacaccgucgagg

SEQ ID NO: 958646 - RNA, 14 nt, Mycobacterium avium subsp. paratuberculosis
ccagcucgaccgcg

SEQ ID NO: 958647 - RNA, 16 nt, Mycobacterium avium subsp. paratuberculosis
ccagcucgaccgcggc

SEQ ID NO: 958648 - RNA, 17 nt, Mycobacterium avium subsp. paratuberculosis
ccagcucgaccgcggcg

SEQ ID NO: 958649 - RNA, 18 nt, Mycobacterium avium subsp. paratuberculosis
ccagcucgaccgcggcga

SEQ ID NO: 958650 - RNA, 20 nt, Mycobacterium avium subsp. paratuberculosis
ccagcucgaccgcggcgaug

SEQ ID NO: 958651 - RNA, 21 nt, Mycobacterium avium subsp. paratuberculosis
ccagcucgaccgcggcgaugg

SEQ ID NO: 958652 - RNA, 13 nt, Mycobacterium avium subsp. paratuberculosis
ccagcucgacgac

SEQ ID NO: 958653 - RNA, 18 nt, Mycobacterium avium subsp. paratuberculosis
ccagcucgacgacuucgg

SEQ ID NO: 958654 - RNA, 13 nt, Mycobacterium avium subsp. paratuberculosis
ccagcucccgggc

SEQ ID NO: 958655 - RNA, 18 nt, Mycobacterium avium subsp. paratuberculosis
ccagcucccgggcggcgc

SEQ ID NO: 958656 - RNA, 20 nt, Mycobacterium avium subsp. paratuberculosis
ccagcucccgggcggcgccg

SEQ ID NO: 958657 - RNA, 14 nt, Mycobacterium avium subsp. paratuberculosis
ccagcuccgccacc

SEQ ID NO: 958658 - RNA, 23 nt, Mycobacterium avium subsp. paratuberculosis
ccagcuccgccacccugcgcacc

SEQ ID NO: 958659 - RNA, 17 nt, Mycobacterium avium subsp. paratuberculosis
ccagcuccgccgacacc

SEQ ID NO: 958660 - RNA, 13 nt, Mycobacterium avium subsp. paratuberculosis
ccagcuccgcggc

SEQ ID NO: 958661 - RNA, 14 nt, Mycobacterium avium subsp. paratuberculosis
ccagcuccgcggcc

SEQ ID NO: 958662 - RNA, 16 nt, Mycobacterium avium subsp. paratuberculosis
ccagcuccgcggccag

SEQ ID NO: 958663 - RNA, 20 nt, Mycobacterium avium subsp. paratuberculosis
ccagcuccggcaacgaggcc

SEQ ID NO: 958664 - RNA, 16 nt, Mycobacterium avium subsp. paratuberculosis
ccagcucggcggccau

SEQ ID NO: 958665 - RNA, 18 nt, Mycobacterium avium subsp. paratuberculosis
ccagcugauucgcggugg

SEQ ID NO: 958666 - RNA, 20 nt, Mycobacterium avium subsp. paratuberculosis
ccagcugauucgcgguggcg

SEQ ID NO: 958667 - RNA, 16 nt, Mycobacterium avium subsp. paratuberculosis
ccagcugauuguugac

SEQ ID NO: 958668 - RNA, 22 nt, Mycobacterium avium subsp. paratuberculosis
ccagcugauuguugacggugac

SEQ ID NO: 958669 - RNA, 14 nt, Mycobacterium avium subsp. paratuberculosis
ccagcugcccacca

SEQ ID NO: 958670 - RNA, 23 nt, Mycobacterium avium subsp. paratuberculosis
ccagcugcccaccagcaggucga

SEQ ID NO: 958671 - RNA, 14 nt, Mycobacterium avium subsp. paratuberculosis
ccagcugcacccac

SEQ ID NO: 958672 - RNA, 20 nt, Mycobacterium avium subsp. paratuberculosis
ccagcugcaccggggccggc

SEQ ID NO: 958673 - RNA, 22 nt, Mycobacterium avium subsp. paratuberculosis
ccagcugcaccggggccggcgg

SEQ ID NO: 958674 - RNA, 14 nt, Mycobacterium avium subsp. paratuberculosis
ccagcugaacacga

SEQ ID NO: 958675 - RNA, 18 nt, Mycobacterium avium subsp. paratuberculosis
ccagcugaacacgaaccc

SEQ ID NO: 958676 - RNA, 19 nt, Mycobacterium avium subsp. paratuberculosis
ccagcugaacacgaacccg

SEQ ID NO: 958677 - RNA, 22 nt, Mycobacterium avium subsp. paratuberculosis
ccagcugaacacgaacccggcg

SEQ ID NO: 958678 - RNA, 12 nt, Mycobacterium avium subsp. paratuberculosis
ccagcucgucga

SEQ ID NO: 958679 - RNA, 15 nt, Mycobacterium avium subsp. paratuberculosis
ccagcucgucgagcc

SEQ ID NO: 958680 - RNA, 18 nt, Mycobacterium avium subsp. paratuberculosis
ccagcucgucgagccggc

SEQ ID NO: 958681 - RNA, 23 nt, Mycobacterium avium subsp. paratuberculosis
ccagcucgucgagccggccggac

SEQ ID NO: 958682 - RNA, 21 nt, Mycobacterium avium subsp. paratuberculosis
ccagcucggcgcugucggcgg

SEQ ID NO: 958683 - RNA, 20 nt, Mycobacterium avium subsp. paratuberculosis
ccagcucggucagccgggcg

SEQ ID NO: 958684 - RNA, 21 nt, Mycobacterium avium subsp. paratuberculosis
ccagcucggucagccgggcgg

SEQ ID NO: 958685 - RNA, 23 nt, Mycobacterium avium subsp. paratuberculosis
ccagcucggucagccgggcggcc

SEQ ID NO: 958686 - RNA, 16 nt, Mycobacterium avium subsp. paratuberculosis
ccagcucggcggccgg

SEQ ID NO: 958687 - RNA, 17 nt, Mycobacterium avium subsp. paratuberculosis
ccagcucggcggccggg

SEQ ID NO: 958688 - RNA, 20 nt, Mycobacterium avium subsp. paratuberculosis
ccagcucggcggccgggugu

SEQ ID NO: 958689 - RNA, 14 nt, Mycobacterium avium subsp. paratuberculosis
ccagcucggcccgc

SEQ ID NO: 958690 - RNA, 16 nt, Mycobacterium avium subsp. paratuberculosis
ccagcucggucgcggu

SEQ ID NO: 958691 - RNA, 17 nt, Mycobacterium avium subsp. paratuberculosis
ccagcucggucgcgguc

SEQ ID NO: 958692 - RNA, 16 nt, Mycobacterium avium subsp. paratuberculosis
ccagcucggugaucac

SEQ ID NO: 958693 - RNA, 20 nt, Mycobacterium avium subsp. paratuberculosis
ccagcucggugaucugcacc

SEQ ID NO: 958694 - RNA, 22 nt, Mycobacterium avium subsp. paratuberculosis
ccagcucggugaucugcaccag

SEQ ID NO: 958695 - RNA, 14 nt, Mycobacterium avium subsp. paratuberculosis
ccagcucggugaug

SEQ ID NO: 958696 - RNA, 23 nt, Mycobacterium avium subsp. paratuberculosis
ccagcucggugaugaucgccggg

SEQ ID NO: 958697 - RNA, 21 nt, Mycobacterium avium subsp. paratuberculosis
ccagcucggugcgcauggcgu

SEQ ID NO: 958698 - RNA, 20 nt, Mycobacterium avium subsp. paratuberculosis
ccagcucguccagcgugccg

SEQ ID NO: 958699 - RNA, 15 nt, Mycobacterium avium subsp. paratuberculosis
ccagcucgucgccga

SEQ ID NO: 958700 - RNA, 16 nt, Mycobacterium avium subsp. paratuberculosis
ccagcucgucgccgac

SEQ ID NO: 958701 - RNA, 18 nt, Mycobacterium avium subsp. paratuberculosis
ccagcucgucgccgacca

SEQ ID NO: 958702 - RNA, 18 nt, Mycobacterium avium subsp. paratuberculosis
ccagcucguugccggcgg

SEQ ID NO: 958703 - RNA, 19 nt, Mycobacterium avium subsp. paratuberculosis
ccagcucguugccggcggc

SEQ ID NO: 958704 - RNA, 21 nt, Mycobacterium avium subsp. paratuberculosis
ccagcucguugccggcggcca

SEQ ID NO: 958705 - RNA, 22 nt, Mycobacterium avium subsp. paratuberculosis
ccagcucguugccggcggccag

SEQ ID NO: 958706 - RNA, 16 nt, Mycobacterium avium subsp. paratuberculosis
ccagcucucgagcaca

SEQ ID NO: 958707 - RNA, 15 nt, Mycobacterium avium subsp. paratuberculosis
ccagcugccgcgacu

SEQ ID NO: 958708 - RNA, 15 nt, Mycobacterium avium subsp. paratuberculosis
ccagcugcgcgccgg

SEQ ID NO: 958709 - RNA, 18 nt, Mycobacterium avium subsp. paratuberculosis
ccagcugcgcgccggcgg

SEQ ID NO: 958710 - RNA, 15 nt, Mycobacterium avium subsp. paratuberculosis
ccagcugcccgccga

SEQ ID NO: 958711 - RNA, 16 nt, Mycobacterium avium subsp. paratuberculosis
ccagcugcccgccgac

SEQ ID NO: 958712 - RNA, 18 nt, Mycobacterium avium subsp. paratuberculosis
ccagcugcccgccgacgc

SEQ ID NO: 958713 - RNA, 20 nt, Mycobacterium avium subsp. paratuberculosis
ccagcugcccgccgacgccc

SEQ ID NO: 958714 - RNA, 23 nt, Mycobacterium avium subsp. paratuberculosis
ccagcugcgaaucgucggcgaug

SEQ ID NO: 958715 - RNA, 17 nt, Mycobacterium avium subsp. paratuberculosis
ccagcugcgacagcacg

SEQ ID NO: 958716 - RNA, 20 nt, Mycobacterium avium subsp. paratuberculosis
ccagcugcgacagcacgggc

SEQ ID NO: 958717 - RNA, 16 nt, Mycobacterium avium subsp. paratuberculosis
ccagcuggagaggccc

SEQ ID NO: 958718 - RNA, 18 nt, Mycobacterium avium subsp. paratuberculosis
ccagcuggagaggcccgg

SEQ ID NO: 958719 - RNA, 19 nt, Mycobacterium avium subsp. paratuberculosis
ccagcuggagaggcccggc

SEQ ID NO: 958720 - RNA, 20 nt, Mycobacterium avium subsp. paratuberculosis
ccagcuggauggcgcccagc

SEQ ID NO: 958721 - RNA, 20 nt, Mycobacterium avium subsp. paratuberculosis
ccagcugcggaucgggcgug

SEQ ID NO: 958722 - RNA, 21 nt, Mycobacterium avium subsp. paratuberculosis
ccagcugcggaucgggcgugg

SEQ ID NO: 958723 - RNA, 21 nt, Mycobacterium avium subsp. paratuberculosis
ccagcugcggguugcgggcca

SEQ ID NO: 958724 - RNA, 17 nt, Mycobacterium avium subsp. paratuberculosis
ccagcugggaggcgcac

SEQ ID NO: 958725 - RNA, 19 nt, Mycobacterium avium subsp. paratuberculosis
ccagcuguugacgggccgc

SEQ ID NO: 958726 - RNA, 20 nt, Mycobacterium avium subsp. paratuberculosis
ccagcuguugacgggccgcg

SEQ ID NO: 958727 - RNA, 21 nt, Mycobacterium avium subsp. paratuberculosis
ccagcuguugacgggccgcgg

SEQ ID NO: 958728 - RNA, 22 nt, Mycobacterium avium subsp. paratuberculosis
ccagcuguugacgggccgcggc

SEQ ID NO: 958729 - RNA, 19 nt, Mycobacterium avium subsp. paratuberculosis
ccagcuucaccggucgggc

SEQ ID NO: 958730 - RNA, 20 nt, Mycobacterium avium subsp. paratuberculosis
ccagcuggguggucaccagc

SEQ ID NO: 958731 - RNA, 21 nt, Mycobacterium avium subsp. paratuberculosis
ccagcuggguggucaccagcg

SEQ ID NO: 958732 - RNA, 15 nt, Mycobacterium avium subsp. paratuberculosis
ccagcugggccagcg

SEQ ID NO: 958733 - RNA, 17 nt, Mycobacterium avium subsp. paratuberculosis
ccagcugggccagcgcg

SEQ ID NO: 958734 - RNA, 18 nt, Mycobacterium avium subsp. paratuberculosis
ccagcugggccgccagcc

SEQ ID NO: 958735 - RNA, 14 nt, Mycobacterium avium subsp. paratuberculosis
ccaggauccgauga

SEQ ID NO: 958736 - RNA, 20 nt, Mycobacterium avium subsp. paratuberculosis
ccaggauccgaugacgcugc

SEQ ID NO: 958737 - RNA, 14 nt, Mycobacterium avium subsp. paratuberculosis
ccaggauccgcacc

SEQ ID NO: 958738 - RNA, 16 nt, Mycobacterium avium subsp. paratuberculosis
ccaggauccgcccgcc

SEQ ID NO: 958739 - RNA, 18 nt, Mycobacterium avium subsp. paratuberculosis
ccaggauccgcccgccgg

SEQ ID NO: 958740 - RNA, 15 nt, Mycobacterium avium subsp. paratuberculosis
ccaggaucaccggga

SEQ ID NO: 958741 - RNA, 17 nt, Mycobacterium avium subsp. paratuberculosis
ccaggaucacgcggcgg

SEQ ID NO: 958742 - RNA, 18 nt, Mycobacterium avium subsp. paratuberculosis
ccaggaucacgcggcggg

SEQ ID NO: 958743 - RNA, 23 nt, Mycobacterium avium subsp. paratuberculosis
ccaggacucgggguugacccggc

SEQ ID NO: 958744 - RNA, 16 nt, Mycobacterium avium subsp. paratuberculosis
ccaggacgucggccgg

SEQ ID NO: 958745 - RNA, 21 nt, Mycobacterium avium subsp. paratuberculosis
ccaggacgguuucugccggcc

SEQ ID NO: 958746 - RNA, 23 nt, Mycobacterium avium subsp. paratuberculosis
ccaggacgguuucugccggccgc

SEQ ID NO: 958747 - RNA, 13 nt, Mycobacterium avium subsp. paratuberculosis
ccaggagcaccug

SEQ ID NO: 958748 - RNA, 17 nt, Mycobacterium avium subsp. paratuberculosis
ccaggagcaccugcgcg

SEQ ID NO: 958749 - RNA, 14 nt, Mycobacterium avium subsp. paratuberculosis
ccaggaccgggacg

SEQ ID NO: 958750 - RNA, 18 nt, Mycobacterium avium subsp. paratuberculosis
ccaggaccgggacgacgg

SEQ ID NO: 958751 - RNA, 19 nt, Mycobacterium avium subsp. paratuberculosis
ccaggaccgggacgacggc

SEQ ID NO: 958752 - RNA, 20 nt, Mycobacterium avium subsp. paratuberculosis
ccaggaccugaccgaacagc

SEQ ID NO: 958753 - RNA, 16 nt, Mycobacterium avium subsp. paratuberculosis
ccaggacgcgaccggc

SEQ ID NO: 958754 - RNA, 18 nt, Mycobacterium avium subsp. paratuberculosis
ccaggacgcgaccggcca

SEQ ID NO: 958755 - RNA, 12 nt, Mycobacterium avium subsp. paratuberculosis
ccaggacgcggu

SEQ ID NO: 958756 - RNA, 22 nt, Mycobacterium avium subsp. paratuberculosis
ccaggaugaccgcccaggaccc

SEQ ID NO: 958757 - RNA, 13 nt, Mycobacterium avium subsp. paratuberculosis
ccaggaugacgcc

SEQ ID NO: 958758 - RNA, 16 nt, Mycobacterium avium subsp. paratuberculosis
ccaggaugacgccgaa

SEQ ID NO: 958759 - RNA, 17 nt, Mycobacterium avium subsp. paratuberculosis
ccaggaugagcugggcg

SEQ ID NO: 958760 - RNA, 16 nt, Mycobacterium avium subsp. paratuberculosis
ccaggaucucgcgggc

SEQ ID NO: 958761 - RNA, 17 nt, Mycobacterium avium subsp. paratuberculosis
ccaggaucugcagcacg

SEQ ID NO: 958762 - RNA, 18 nt, Mycobacterium avium subsp. paratuberculosis
ccaggaucugcagcacgc

SEQ ID NO: 958763 - RNA, 17 nt, Mycobacterium avium subsp. paratuberculosis
ccaggaucugggugagc

SEQ ID NO: 958764 - RNA, 19 nt, Mycobacterium avium subsp. paratuberculosis
ccaggaucuugucggcggc

SEQ ID NO: 958765 - RNA, 20 nt, Mycobacterium avium subsp. paratuberculosis
ccaggaucuugucggcggcc

SEQ ID NO: 958766 - RNA, 14 nt, Mycobacterium avium subsp. paratuberculosis
ccaggaucgggauc

SEQ ID NO: 958767 - RNA, 20 nt, Mycobacterium avium subsp. paratuberculosis
ccaggauucccgaccccgcc

SEQ ID NO: 958768 - RNA, 20 nt, Mycobacterium avium subsp. paratuberculosis
ccaggauuccgucggcggcc

SEQ ID NO: 958769 - RNA, 18 nt, Mycobacterium avium subsp. paratuberculosis
ccaggauucucagcagcg

SEQ ID NO: 958770 - RNA, 21 nt, Mycobacterium avium subsp. paratuberculosis
ccaggauggggaaguccgggu

SEQ ID NO: 958771 - RNA, 16 nt, Mycobacterium avium subsp. paratuberculosis
ccaggauguacccgca

SEQ ID NO: 958772 - RNA, 19 nt, Mycobacterium avium subsp. paratuberculosis
ccaggaugucgacgacacc

SEQ ID NO: 958773 - RNA, 22 nt, Mycobacterium avium subsp. paratuberculosis
ccaggaugucguccucggucag

SEQ ID NO: 958774 - RNA, 18 nt, Mycobacterium avium subsp. paratuberculosis
ccaggauguucaccccgg

SEQ ID NO: 958775 - RNA, 20 nt, Mycobacterium avium subsp. paratuberculosis
ccaggauguucaccccggcg

SEQ ID NO: 958776 - RNA, 21 nt, Mycobacterium avium subsp. paratuberculosis
ccaggauguucaccccggcgc

SEQ ID NO: 958777 - RNA, 22 nt, Mycobacterium avium subsp. paratuberculosis
ccaggauguucaccccggcgcg

SEQ ID NO: 958778 - RNA, 14 nt, Mycobacterium avium subsp. paratuberculosis
ccagcuucgggcgc

SEQ ID NO: 958779 - RNA, 15 nt, Mycobacterium avium subsp. paratuberculosis
ccagcuucgggcgcg

SEQ ID NO: 958780 - RNA, 22 nt, Mycobacterium avium subsp. paratuberculosis
ccagcuucgggcgcgcgcgcca

SEQ ID NO: 958781 - RNA, 15 nt, Mycobacterium avium subsp. paratuberculosis
ccagcuucucggcgu

SEQ ID NO: 958782 - RNA, 17 nt, Mycobacterium avium subsp. paratuberculosis
ccagcuugaagcccucg

SEQ ID NO: 958783 - RNA, 20 nt, Mycobacterium avium subsp. paratuberculosis
ccagcuugaagcccucgucg

SEQ ID NO: 958784 - RNA, 21 nt, Mycobacterium avium subsp. paratuberculosis
ccagcuugaagcccucgucga

SEQ ID NO: 958785 - RNA, 22 nt, Mycobacterium avium subsp. paratuberculosis
ccagcuugaagcccucgucgaa

SEQ ID NO: 958786 - RNA, 16 nt, Mycobacterium avium subsp. paratuberculosis
ccagcuugaccacccg

SEQ ID NO: 958787 - RNA, 14 nt, Mycobacterium avium subsp. paratuberculosis
ccaggaacacggcu

SEQ ID NO: 958788 - RNA, 19 nt, Mycobacterium avium subsp. paratuberculosis
ccaggaaccacaccccggc

SEQ ID NO: 958789 - RNA, 17 nt, Mycobacterium avium subsp. paratuberculosis
ccaggaaccaccggaag

SEQ ID NO: 958790 - RNA, 18 nt, Mycobacterium avium subsp. paratuberculosis
ccaggaaaaccagcgacg

SEQ ID NO: 958791 - RNA, 22 nt, Mycobacterium avium subsp. paratuberculosis
ccagcuugucguagcggcgcca

SEQ ID NO: 958792 - RNA, 23 nt, Mycobacterium avium subsp. paratuberculosis
ccagcuugucguagcggcgccac

SEQ ID NO: 958793 - RNA, 16 nt, Mycobacterium avium subsp. paratuberculosis
ccagcuuuccggccgc

SEQ ID NO: 958794 - RNA, 18 nt, Mycobacterium avium subsp. paratuberculosis
ccagcuuuccggccgccu

SEQ ID NO: 958795 - RNA, 14 nt, Mycobacterium avium subsp. paratuberculosis
ccagcuugucgauc

SEQ ID NO: 958796 - RNA, 15 nt, Mycobacterium avium subsp. paratuberculosis
ccaggaagccggcga

SEQ ID NO: 958797 - RNA, 17 nt, Mycobacterium avium subsp. paratuberculosis
ccaggaagccggcgacg

SEQ ID NO: 958798 - RNA, 17 nt, Mycobacterium avium subsp. paratuberculosis
ccaggaacgcgcccggc

SEQ ID NO: 958799 - RNA, 18 nt, Mycobacterium avium subsp. paratuberculosis
ccaggaagaacccggcgu

SEQ ID NO: 958800 - RNA, 19 nt, Mycobacterium avium subsp. paratuberculosis
ccaggaagaacccggcgug

SEQ ID NO: 958801 - RNA, 20 nt, Mycobacterium avium subsp. paratuberculosis
ccaggaagaacccggcgugc

SEQ ID NO: 958802 - RNA, 13 nt, Mycobacterium avium subsp. paratuberculosis
ccaggaagaacuc

SEQ ID NO: 958803 - RNA, 22 nt, Mycobacterium avium subsp. paratuberculosis
ccaggaagacguaggcggccag

SEQ ID NO: 958804 - RNA, 18 nt, Mycobacterium avium subsp. paratuberculosis
ccaggaaggcgaccgcgu

SEQ ID NO: 958805 - RNA, 19 nt, Mycobacterium avium subsp. paratuberculosis
ccaggaaggucccggucag

SEQ ID NO: 958806 - RNA, 18 nt, Mycobacterium avium subsp. paratuberculosis
ccaggaaguacaccaccg

SEQ ID NO: 958807 - RNA, 15 nt, Mycobacterium avium subsp. paratuberculosis
ccaggaccgcgcgcc

SEQ ID NO: 958808 - RNA, 18 nt, Mycobacterium avium subsp. paratuberculosis
ccaggaccgcgcgccggc

SEQ ID NO: 958809 - RNA, 20 nt, Mycobacterium avium subsp. paratuberculosis
ccaggaccgcgcgccggcca

SEQ ID NO: 958810 - RNA, 17 nt, Mycobacterium avium subsp. paratuberculosis
ccaggaccagcgggucg

SEQ ID NO: 958811 - RNA, 14 nt, Mycobacterium avium subsp. paratuberculosis
ccaggacagcguca

SEQ ID NO: 958812 - RNA, 20 nt, Mycobacterium avium subsp. paratuberculosis
ccaggacagcgucagccccg

SEQ ID NO: 958813 - RNA, 20 nt, Mycobacterium avium subsp. paratuberculosis
ccaggacaggaugcguucgg

SEQ ID NO: 958814 - RNA, 16 nt, Mycobacterium avium subsp. paratuberculosis
ccaggaaguagccggc

SEQ ID NO: 958815 - RNA, 19 nt, Mycobacterium avium subsp. paratuberculosis
ccaggaaguagccggccag

SEQ ID NO: 958816 - RNA, 17 nt, Mycobacterium avium subsp. paratuberculosis
ccaggaauucgggcacc

SEQ ID NO: 958817 - RNA, 15 nt, Mycobacterium avium subsp. paratuberculosis
ccagggcgacgccgc

SEQ ID NO: 958818 - RNA, 14 nt, Mycobacterium avium subsp. paratuberculosis
ccagggccucggcg

SEQ ID NO: 958819 - RNA, 15 nt, Mycobacterium avium subsp. paratuberculosis
ccagggccucggcga

SEQ ID NO: 958820 - RNA, 12 nt, Mycobacterium avium subsp. paratuberculosis
ccagggccgggc

SEQ ID NO: 958821 - RNA, 22 nt, Mycobacterium avium subsp. paratuberculosis
ccagggccgggcgugcccggcg

SEQ ID NO: 958822 - RNA, 23 nt, Mycobacterium avium subsp. paratuberculosis
ccagggccgggcgugcccggcgc

SEQ ID NO: 958823 - RNA, 15 nt, Mycobacterium avium subsp. paratuberculosis
ccagggcgcggcgca

SEQ ID NO: 958824 - RNA, 16 nt, Mycobacterium avium subsp. paratuberculosis
ccagguauucaucgcg

SEQ ID NO: 958825 - RNA, 20 nt, Mycobacterium avium subsp. paratuberculosis
ccagguauucaucgcggccg

SEQ ID NO: 958826 - RNA, 21 nt, Mycobacterium avium subsp. paratuberculosis
ccagguauucaucgcggccgc

SEQ ID NO: 958827 - RNA, 17 nt, Mycobacterium avium subsp. paratuberculosis
ccagguaggcguugauc

SEQ ID NO: 958828 - RNA, 20 nt, Mycobacterium avium subsp. paratuberculosis
ccagguacuccucgaagaac

SEQ ID NO: 958829 - RNA, 14 nt, Mycobacterium avium subsp. paratuberculosis
ccagguaguagcgc

SEQ ID NO: 958830 - RNA, 17 nt, Mycobacterium avium subsp. paratuberculosis
ccagguagauggugauc

SEQ ID NO: 958831 - RNA, 20 nt, Mycobacterium avium subsp. paratuberculosis
ccagguagauggugaucgac

SEQ ID NO: 958832 - RNA, 17 nt, Mycobacterium avium subsp. paratuberculosis
ccagguacgcgacgggc

SEQ ID NO: 958833 - RNA, 24 nt, Mycobacterium avium subsp. paratuberculosis
ccagguacugaucaccgcgcucgg

SEQ ID NO: 958834 - RNA, 21 nt, Mycobacterium avium subsp. paratuberculosis
ccagguacacguagcggucca

SEQ ID NO: 958835 - RNA, 22 nt, Mycobacterium avium subsp. paratuberculosis
ccagguacacguagcgguccag

SEQ ID NO: 958836 - RNA, 21 nt, Mycobacterium avium subsp. paratuberculosis
ccagggcguggaacgcgucgc

SEQ ID NO: 958837 - RNA, 16 nt, Mycobacterium avium subsp. paratuberculosis
ccagggcucgugcagc

SEQ ID NO: 958838 - RNA, 18 nt, Mycobacterium avium subsp. paratuberculosis
ccagggcucgugcagccg

SEQ ID NO: 958839 - RNA, 19 nt, Mycobacterium avium subsp. paratuberculosis
ccagggcucgugcagccgg

SEQ ID NO: 958840 - RNA, 21 nt, Mycobacterium avium subsp. paratuberculosis
ccagggcucgugcagccggcg

SEQ ID NO: 958841 - RNA, 15 nt, Mycobacterium avium subsp. paratuberculosis
ccagggcggcgccgg

SEQ ID NO: 958842 - RNA, 16 nt, Mycobacterium avium subsp. paratuberculosis
ccagggcggcgccggc

SEQ ID NO: 958843 - RNA, 18 nt, Mycobacterium avium subsp. paratuberculosis
ccagggcggcgccggcac

SEQ ID NO: 958844 - RNA, 14 nt, Mycobacterium avium subsp. paratuberculosis
ccagggcggcgccg

SEQ ID NO: 958845 - RNA, 12 nt, Mycobacterium avium subsp. paratuberculosis
ccagggcggugg

SEQ ID NO: 958846 - RNA, 14 nt, Mycobacterium avium subsp. paratuberculosis
ccaguacaccgcga

SEQ ID NO: 958847 - RNA, 18 nt, Mycobacterium avium subsp. paratuberculosis
ccaguaccagcggccguc

SEQ ID NO: 958848 - RNA, 19 nt, Mycobacterium avium subsp. paratuberculosis
ccaguaccagcggccgucg

SEQ ID NO: 958849 - RNA, 22 nt, Mycobacterium avium subsp. paratuberculosis
ccaguaccagcggccgucgcgc

SEQ ID NO: 958850 - RNA, 17 nt, Mycobacterium avium subsp. paratuberculosis
ccagguucagcccggcg

SEQ ID NO: 958851 - RNA, 18 nt, Mycobacterium avium subsp. paratuberculosis
ccagguucagcccggcgc

SEQ ID NO: 958852 - RNA, 23 nt, Mycobacterium avium subsp. paratuberculosis
ccagguucagcccggcgcugcgc

SEQ ID NO: 958853 - RNA, 20 nt, Mycobacterium avium subsp. paratuberculosis
ccagguucaggcccgcgccg

SEQ ID NO: 958854 - RNA, 15 nt, Mycobacterium avium subsp. paratuberculosis
ccagguucgccgccc

SEQ ID NO: 958855 - RNA, 16 nt, Mycobacterium avium subsp. paratuberculosis
ccagguucgcgccgau

SEQ ID NO: 958856 - RNA, 14 nt, Mycobacterium avium subsp. paratuberculosis
ccagguuccggugu

SEQ ID NO: 958857 - RNA, 20 nt, Mycobacterium avium subsp. paratuberculosis
ccagguucuccggcccgcuc

SEQ ID NO: 958858 - RNA, 21 nt, Mycobacterium avium subsp. paratuberculosis
ccagguguagaccacgaucug

SEQ ID NO: 958859 - RNA, 18 nt, Mycobacterium avium subsp. paratuberculosis
ccagguguccggcccgau

SEQ ID NO: 958860 - RNA, 16 nt, Mycobacterium avium subsp. paratuberculosis
ccagguggcccgaccc

SEQ ID NO: 958861 - RNA, 20 nt, Mycobacterium avium subsp. paratuberculosis
ccagguguuguccgguaggc

SEQ ID NO: 958862 - RNA, 16 nt, Mycobacterium avium subsp. paratuberculosis
ccaggugggcgcgcag

SEQ ID NO: 958863 - RNA, 15 nt, Mycobacterium avium subsp. paratuberculosis
ccaggugggcggcca

SEQ ID NO: 958864 - RNA, 15 nt, Mycobacterium avium subsp. paratuberculosis
ccagguggggcacgg

SEQ ID NO: 958865 - RNA, 16 nt, Mycobacterium avium subsp. paratuberculosis
ccagguggggcacggg

SEQ ID NO: 958866 - RNA, 17 nt, Mycobacterium avium subsp. paratuberculosis
ccagguggggcacgggc

SEQ ID NO: 958867 - RNA, 17 nt, Mycobacterium avium subsp. paratuberculosis
ccagguggcgccuccgc

SEQ ID NO: 958868 - RNA, 16 nt, Mycobacterium avium subsp. paratuberculosis
ccaggucggcgugauc

SEQ ID NO: 958869 - RNA, 21 nt, Mycobacterium avium subsp. paratuberculosis
ccaggucgggacguccgcgcg

SEQ ID NO: 958870 - RNA, 14 nt, Mycobacterium avium subsp. paratuberculosis
ccaggucggggugg

SEQ ID NO: 958871 - RNA, 18 nt, Mycobacterium avium subsp. paratuberculosis
ccaggucggggugggcga

SEQ ID NO: 958872 - RNA, 15 nt, Mycobacterium avium subsp. paratuberculosis
ccaggucgcggcgcu

SEQ ID NO: 958873 - RNA, 16 nt, Mycobacterium avium subsp. paratuberculosis
ccaggucgcggcgcug

SEQ ID NO: 958874 - RNA, 22 nt, Mycobacterium avium subsp. paratuberculosis
ccaggucgcggcgcugcgccgu

SEQ ID NO: 958875 - RNA, 17 nt, Mycobacterium avium subsp. paratuberculosis
ccaggucgcugacgaug

SEQ ID NO: 958876 - RNA, 20 nt, Mycobacterium avium subsp. paratuberculosis
ccaggucgcugacgaugauc

SEQ ID NO: 958877 - RNA, 21 nt, Mycobacterium avium subsp. paratuberculosis
ccaggucgccgcgcagcaccg

SEQ ID NO: 958878 - RNA, 12 nt, Mycobacterium avium subsp. paratuberculosis
ccaggucgccgg

SEQ ID NO: 958879 - RNA, 13 nt, Mycobacterium avium subsp. paratuberculosis
ccaggucgccggc

SEQ ID NO: 958880 - RNA, 15 nt, Mycobacterium avium subsp. paratuberculosis
ccaggucgccggcgg

SEQ ID NO: 958881 - RNA, 20 nt, Mycobacterium avium subsp. paratuberculosis
ccaggcaugggaucagcagc

SEQ ID NO: 958882 - RNA, 16 nt, Mycobacterium avium subsp. paratuberculosis
ccaggccgccagcucg

SEQ ID NO: 958883 - RNA, 16 nt, Mycobacterium avium subsp. paratuberculosis
ccaggccgccgccacc

SEQ ID NO: 958884 - RNA, 12 nt, Mycobacterium avium subsp. paratuberculosis
ccaggccgccgg

SEQ ID NO: 958885 - RNA, 20 nt, Mycobacterium avium subsp. paratuberculosis
ccaggccgccgggccgccga

SEQ ID NO: 958886 - RNA, 14 nt, Mycobacterium avium subsp. paratuberculosis
ccaggccgccgugg

SEQ ID NO: 958887 - RNA, 15 nt, Mycobacterium avium subsp. paratuberculosis
ccaggccgcgagcac

SEQ ID NO: 958888 - RNA, 12 nt, Mycobacterium avium subsp. paratuberculosis
ccaggcacagca

SEQ ID NO: 958889 - RNA, 22 nt, Mycobacterium avium subsp. paratuberculosis
ccaggcacagcagggcaccgac

SEQ ID NO: 958890 - RNA, 21 nt, Mycobacterium avium subsp. paratuberculosis
ccaggcagacccccagcagcg

SEQ ID NO: 958891 - RNA, 22 nt, Mycobacterium avium subsp. paratuberculosis
ccaggcagacccccagcagcgg

SEQ ID NO: 958892 - RNA, 13 nt, Mycobacterium avium subsp. paratuberculosis
ccaggauggccgc

SEQ ID NO: 958893 - RNA, 21 nt, Mycobacterium avium subsp. paratuberculosis
ccaggcagaagcuccacgccg

SEQ ID NO: 958894 - RNA, 16 nt, Mycobacterium avium subsp. paratuberculosis
ccaggcaggcggccag

SEQ ID NO: 958895 - RNA, 19 nt, Mycobacterium avium subsp. paratuberculosis
ccaggcaggcggccagggc

SEQ ID NO: 958896 - RNA, 20 nt, Mycobacterium avium subsp. paratuberculosis
ccaggcaggcggccagggcg

SEQ ID NO: 958897 - RNA, 17 nt, Mycobacterium avium subsp. paratuberculosis
ccaggccucccacagcg

SEQ ID NO: 958898 - RNA, 19 nt, Mycobacterium avium subsp. paratuberculosis
ccaggccucccacagcgga

SEQ ID NO: 958899 - RNA, 15 nt, Mycobacterium avium subsp. paratuberculosis
ccaggccgugaucgg

SEQ ID NO: 958900 - RNA, 17 nt, Mycobacterium avium subsp. paratuberculosis
ccaggccgugguuggcg

SEQ ID NO: 958901 - RNA, 14 nt, Mycobacterium avium subsp. paratuberculosis
ccaggccgucggcg

SEQ ID NO: 958902 - RNA, 16 nt, Mycobacterium avium subsp. paratuberculosis
ccaggccgucggcgcg

SEQ ID NO: 958903 - RNA, 18 nt, Mycobacterium avium subsp. paratuberculosis
ccaggccgucggcgcggc

SEQ ID NO: 958904 - RNA, 20 nt, Mycobacterium avium subsp. paratuberculosis
ccaggccgucggcgcggccg

SEQ ID NO: 958905 - RNA, 19 nt, Mycobacterium avium subsp. paratuberculosis
ccaggccgucgaggcgcug

SEQ ID NO: 958906 - RNA, 22 nt, Mycobacterium avium subsp. paratuberculosis
ccaggccgucgaggcgcugcag

SEQ ID NO: 958907 - RNA, 15 nt, Mycobacterium avium subsp. paratuberculosis
ccaggccggcgccgc

SEQ ID NO: 958908 - RNA, 13 nt, Mycobacterium avium subsp. paratuberculosis
ccaggccggcggu

SEQ ID NO: 958909 - RNA, 13 nt, Mycobacterium avium subsp. paratuberculosis
ccaggccggcgcc

SEQ ID NO: 958910 - RNA, 12 nt, Mycobacterium avium subsp. paratuberculosis
ccaggccggcga

SEQ ID NO: 958911 - RNA, 17 nt, Mycobacterium avium subsp. paratuberculosis
ccaggccggcgacgccg

SEQ ID NO: 958912 - RNA, 18 nt, Mycobacterium avium subsp. paratuberculosis
ccaggccggcgacgccgg

SEQ ID NO: 958913 - RNA, 19 nt, Mycobacterium avium subsp. paratuberculosis
ccaggccggcgacgccggc

SEQ ID NO: 958914 - RNA, 22 nt, Mycobacterium avium subsp. paratuberculosis
ccaggccggcgacgccggcgag

SEQ ID NO: 958915 - RNA, 19 nt, Mycobacterium avium subsp. paratuberculosis
ccaggccggcgagcucgcg

SEQ ID NO: 958916 - RNA, 14 nt, Mycobacterium avium subsp. paratuberculosis
ccaggccgcgcugg

SEQ ID NO: 958917 - RNA, 22 nt, Mycobacterium avium subsp. paratuberculosis
ccaggccgcggccaagugcggu

SEQ ID NO: 958918 - RNA, 15 nt, Mycobacterium avium subsp. paratuberculosis
ccaggccgcggucgc

SEQ ID NO: 958919 - RNA, 19 nt, Mycobacterium avium subsp. paratuberculosis
ccaggcguucgaccccaac

SEQ ID NO: 958920 - RNA, 18 nt, Mycobacterium avium subsp. paratuberculosis
ccaggcguugcaccgcgg

SEQ ID NO: 958921 - RNA, 21 nt, Mycobacterium avium subsp. paratuberculosis
ccaggcguugcaccgcgggca

SEQ ID NO: 958922 - RNA, 23 nt, Mycobacterium avium subsp. paratuberculosis
ccaggcguugcaccgcgggcacg

SEQ ID NO: 958923 - RNA, 23 nt, Mycobacterium avium subsp. paratuberculosis
ccaggcguuggucaccaucagcg

SEQ ID NO: 958924 - RNA, 17 nt, Mycobacterium avium subsp. paratuberculosis
ccaggcugaccagcgcc

SEQ ID NO: 958925 - RNA, 20 nt, Mycobacterium avium subsp. paratuberculosis
ccaggcucaggaucagcagc

SEQ ID NO: 958926 - RNA, 14 nt, Mycobacterium avium subsp. paratuberculosis
ccaggcugaccagc

SEQ ID NO: 958927 - RNA, 17 nt, Mycobacterium avium subsp. paratuberculosis
ccaggcugaacaccacc

SEQ ID NO: 958928 - RNA, 14 nt, Mycobacterium avium subsp. paratuberculosis
ccaggcugaacguc

SEQ ID NO: 958929 - RNA, 22 nt, Mycobacterium avium subsp. paratuberculosis
ccaggcucacguagucgaccgg

SEQ ID NO: 958930 - RNA, 20 nt, Mycobacterium avium subsp. paratuberculosis
ccaggcucgcucccgcgcgg

SEQ ID NO: 958931 - RNA, 21 nt, Mycobacterium avium subsp. paratuberculosis
ccaggcucgcucccgcgcggg

SEQ ID NO: 958932 - RNA, 18 nt, Mycobacterium avium subsp. paratuberculosis
ccagggcagccagcccgc

SEQ ID NO: 958933 - RNA, 14 nt, Mycobacterium avium subsp. paratuberculosis
ccagggcagcgcga

SEQ ID NO: 958934 - RNA, 17 nt, Mycobacterium avium subsp. paratuberculosis
ccagggcagcgcgacca

SEQ ID NO: 958935 - RNA, 19 nt, Mycobacterium avium subsp. paratuberculosis
ccagggcagcgcgaccagc

SEQ ID NO: 958936 - RNA, 14 nt, Mycobacterium avium subsp. paratuberculosis
ccaggcgcucgucg

SEQ ID NO: 958937 - RNA, 17 nt, Mycobacterium avium subsp. paratuberculosis
ccaggcggaaugcagga

SEQ ID NO: 958938 - RNA, 14 nt, Mycobacterium avium subsp. paratuberculosis
ccaggcgcgcgcug

SEQ ID NO: 958939 - RNA, 19 nt, Mycobacterium avium subsp. paratuberculosis
ccaggcgcgcguagcgcag

SEQ ID NO: 958940 - RNA, 13 nt, Mycobacterium avium subsp. paratuberculosis
ccaggcgccgggu

SEQ ID NO: 958941 - RNA, 22 nt, Mycobacterium avium subsp. paratuberculosis
ccaggcgaccggccccaacggc

SEQ ID NO: 958942 - RNA, 15 nt, Mycobacterium avium subsp. paratuberculosis
ccaggcgccggccag

SEQ ID NO: 958943 - RNA, 16 nt, Mycobacterium avium subsp. paratuberculosis
ccaggcgccggccagc

SEQ ID NO: 958944 - RNA, 19 nt, Mycobacterium avium subsp. paratuberculosis
ccaggcgccggccagcacg

SEQ ID NO: 958945 - RNA, 15 nt, Mycobacterium avium subsp. paratuberculosis
ccaggccuugucguc

SEQ ID NO: 958946 - RNA, 14 nt, Mycobacterium avium subsp. paratuberculosis
ccaggcgacguucg

SEQ ID NO: 958947 - RNA, 20 nt, Mycobacterium avium subsp. paratuberculosis
ccaggcgacuguccaggccg

SEQ ID NO: 958948 - RNA, 18 nt, Mycobacterium avium subsp. paratuberculosis
ccacgaugaucgucggca

SEQ ID NO: 958949 - RNA, 19 nt, Mycobacterium avium subsp. paratuberculosis
ccacgaucugcuuggucac

SEQ ID NO: 958950 - RNA, 19 nt, Mycobacterium avium subsp. paratuberculosis
ccacgauggggacgucgac

SEQ ID NO: 958951 - RNA, 21 nt, Mycobacterium avium subsp. paratuberculosis
ccacgauggggacgucgacgu

SEQ ID NO: 958952 - RNA, 23 nt, Mycobacterium avium subsp. paratuberculosis
ccacgauggggacgucgacgugg

SEQ ID NO: 958953 - RNA, 14 nt, Mycobacterium avium subsp. paratuberculosis
ccacgaugccgggc

SEQ ID NO: 958954 - RNA, 16 nt, Mycobacterium avium subsp. paratuberculosis
ccacgaugccgggcac

SEQ ID NO: 958955 - RNA, 24 nt, Mycobacterium avium subsp. paratuberculosis
ccacgaugccgggcacgaauucgg

SEQ ID NO: 958956 - RNA, 17 nt, Mycobacterium avium subsp. paratuberculosis
ccacgaugaugcccccg

SEQ ID NO: 958957 - RNA, 14 nt, Mycobacterium avium subsp. paratuberculosis
ccacgaugcccguc

SEQ ID NO: 958958 - RNA, 16 nt, Mycobacterium avium subsp. paratuberculosis
ccacgaugcggugccg

SEQ ID NO: 958959 - RNA, 19 nt, Mycobacterium avium subsp. paratuberculosis
ccacgaugcggugccgggu

SEQ ID NO: 958960 - RNA, 12 nt, Mycobacterium avium subsp. paratuberculosis
ccacgcacacca

SEQ ID NO: 958961 - RNA, 18 nt, Mycobacterium avium subsp. paratuberculosis
ccacgcacaccaccgacg

SEQ ID NO: 958962 - RNA, 23 nt, Mycobacterium avium subsp. paratuberculosis
ccacgcacaccaccgacgcgucg

SEQ ID NO: 958963 - RNA, 12 nt, Mycobacterium avium subsp. paratuberculosis
ccacgcacaccg

SEQ ID NO: 958964 - RNA, 17 nt, Mycobacterium avium subsp. paratuberculosis
ccacgcagccgucgauc

SEQ ID NO: 958965 - RNA, 19 nt, Mycobacterium avium subsp. paratuberculosis
ccacgcagcggugcagccc

SEQ ID NO: 958966 - RNA, 13 nt, Mycobacterium avium subsp. paratuberculosis
ccacgcccagcgc

SEQ ID NO: 958967 - RNA, 14 nt, Mycobacterium avium subsp. paratuberculosis
ccacgcccagcgcc

SEQ ID NO: 958968 - RNA, 18 nt, Mycobacterium avium subsp. paratuberculosis
ccacgccaugugccggcg

SEQ ID NO: 958969 - RNA, 19 nt, Mycobacterium avium subsp. paratuberculosis
ccacgccaugugccggcgc

SEQ ID NO: 958970 - RNA, 13 nt, Mycobacterium avium subsp. paratuberculosis
ccacgcccacgcc

SEQ ID NO: 958971 - RNA, 14 nt, Mycobacterium avium subsp. paratuberculosis
ccacgcccacgccg

SEQ ID NO: 958972 - RNA, 16 nt, Mycobacterium avium subsp. paratuberculosis
ccacgccagccaggcg

SEQ ID NO: 958973 - RNA, 12 nt, Mycobacterium avium subsp. paratuberculosis
ccacgccagccg

SEQ ID NO: 958974 - RNA, 15 nt, Mycobacterium avium subsp. paratuberculosis
ccacgcucucgccgg

SEQ ID NO: 958975 - RNA, 16 nt, Mycobacterium avium subsp. paratuberculosis
ccacgcucucgccggu

SEQ ID NO: 958976 - RNA, 19 nt, Mycobacterium avium subsp. paratuberculosis
ccacgcucucgccggucag

SEQ ID NO: 958977 - RNA, 21 nt, Mycobacterium avium subsp. paratuberculosis
ccacgcugagcaaccgccgaa

SEQ ID NO: 958978 - RNA, 17 nt, Mycobacterium avium subsp. paratuberculosis
ccacgcuggcgugacgc

SEQ ID NO: 958979 - RNA, 20 nt, Mycobacterium avium subsp. paratuberculosis
ccacgcuggugugacgcucg

SEQ ID NO: 958980 - RNA, 14 nt, Mycobacterium avium subsp. paratuberculosis
ccacgcuguagggc

SEQ ID NO: 958981 - RNA, 19 nt, Mycobacterium avium subsp. paratuberculosis
ccacgcuguagggccacca

SEQ ID NO: 958982 - RNA, 14 nt, Mycobacterium avium subsp. paratuberculosis
ccacgcuggccccg

SEQ ID NO: 958983 - RNA, 18 nt, Mycobacterium avium subsp. paratuberculosis
ccacgcugugcucgacga

SEQ ID NO: 958984 - RNA, 16 nt, Mycobacterium avium subsp. paratuberculosis
ccacggccacaacguc

SEQ ID NO: 958985 - RNA, 13 nt, Mycobacterium avium subsp. paratuberculosis
ccacggcaccgcc

SEQ ID NO: 958986 - RNA, 18 nt, Mycobacterium avium subsp. paratuberculosis
ccacggcaccgccgcgcg

SEQ ID NO: 958987 - RNA, 20 nt, Mycobacterium avium subsp. paratuberculosis
ccacggcaccgccgcgcggc

SEQ ID NO: 958988 - RNA, 14 nt, Mycobacterium avium subsp. paratuberculosis
ccacggcacgucga

SEQ ID NO: 958989 - RNA, 16 nt, Mycobacterium avium subsp. paratuberculosis
ccacggagcgcccggc

SEQ ID NO: 958990 - RNA, 17 nt, Mycobacterium avium subsp. paratuberculosis
ccacggagcgcccggcc

SEQ ID NO: 958991 - RNA, 21 nt, Mycobacterium avium subsp. paratuberculosis
ccacggagucgguuucgaccu

SEQ ID NO: 958992 - RNA, 13 nt, Mycobacterium avium subsp. paratuberculosis
ccacgcggcggcg

SEQ ID NO: 958993 - RNA, 17 nt, Mycobacterium avium subsp. paratuberculosis
ccacgcggcggcggugc

SEQ ID NO: 958994 - RNA, 20 nt, Mycobacterium avium subsp. paratuberculosis
ccacgcgcucagcgcggcca

SEQ ID NO: 958995 - RNA, 21 nt, Mycobacterium avium subsp. paratuberculosis
ccacgcgcucagcgcggccac

SEQ ID NO: 958996 - RNA, 20 nt, Mycobacterium avium subsp. paratuberculosis
ccacgccccauugccgcgcc

SEQ ID NO: 958997 - RNA, 17 nt, Mycobacterium avium subsp. paratuberculosis
ccacgcccgacgacgac

SEQ ID NO: 958998 - RNA, 19 nt, Mycobacterium avium subsp. paratuberculosis
aaaguuggcaucccgcgcc

SEQ ID NO: 958999 - RNA, 18 nt, Mycobacterium avium subsp. paratuberculosis
ccacgcucaugcccgcca

SEQ ID NO: 959000 - RNA, 17 nt, Mycobacterium avium subsp. paratuberculosis
ccacgcucgacgcgucg

SEQ ID NO: 959001 - RNA, 13 nt, Mycobacterium avium subsp. paratuberculosis
ccacgcucggcga

SEQ ID NO: 959002 - RNA, 21 nt, Mycobacterium avium subsp. paratuberculosis
ccacgcucggcgcaacgggau

SEQ ID NO: 959003 - RNA, 14 nt, Mycobacterium avium subsp. paratuberculosis
ccacgcucgggccg

SEQ ID NO: 959004 - RNA, 15 nt, Mycobacterium avium subsp. paratuberculosis
ccacgcucgggccgg

SEQ ID NO: 959005 - RNA, 16 nt, Mycobacterium avium subsp. paratuberculosis
ccacgcucgggccggc

SEQ ID NO: 959006 - RNA, 18 nt, Mycobacterium avium subsp. paratuberculosis
ccacgcucgggccggcgc

SEQ ID NO: 959007 - RNA, 19 nt, Mycobacterium avium subsp. paratuberculosis
ccacgcucgggccggcgcc

SEQ ID NO: 959008 - RNA, 21 nt, Mycobacterium avium subsp. paratuberculosis
ccacgcucgggccggcgccga

SEQ ID NO: 959009 - RNA, 22 nt, Mycobacterium avium subsp. paratuberculosis
ccacgcucgggccggcgccgac

SEQ ID NO: 959010 - RNA, 11 nt, Mycobacterium avium subsp. paratuberculosis
aaaggccgccg

SEQ ID NO: 959011 - RNA, 12 nt, Mycobacterium avium subsp. paratuberculosis
ccaccggcgaug

SEQ ID NO: 959012 - RNA, 18 nt, Mycobacterium avium subsp. paratuberculosis
ccaccggcgcagcgcguc

SEQ ID NO: 959013 - RNA, 14 nt, Mycobacterium avium subsp. paratuberculosis
ccaccggccgcgcg

SEQ ID NO: 959014 - RNA, 20 nt, Mycobacterium avium subsp. paratuberculosis
ccaccggccgguccgcccag

SEQ ID NO: 959015 - RNA, 13 nt, Mycobacterium avium subsp. paratuberculosis
ccaccggcaucgg

SEQ ID NO: 959016 - RNA, 14 nt, Mycobacterium avium subsp. paratuberculosis
ccaccggccgaccg

SEQ ID NO: 959017 - RNA, 13 nt, Mycobacterium avium subsp. paratuberculosis
ccaccggccgaug

SEQ ID NO: 959018 - RNA, 16 nt, Mycobacterium avium subsp. paratuberculosis
ccaccggcccggccgg

SEQ ID NO: 959019 - RNA, 18 nt, Mycobacterium avium subsp. paratuberculosis
ccaccggcccggccggcg

SEQ ID NO: 959020 - RNA, 19 nt, Mycobacterium avium subsp. paratuberculosis
ccaccggcccggccggcgc

SEQ ID NO: 959021 - RNA, 14 nt, Mycobacterium avium subsp. paratuberculosis
ccaccggcccggcg

SEQ ID NO: 959022 - RNA, 15 nt, Mycobacterium avium subsp. paratuberculosis
ccaccggcccggcgg

SEQ ID NO: 959023 - RNA, 17 nt, Mycobacterium avium subsp. paratuberculosis
ccaccggcccggcgggc

SEQ ID NO: 959024 - RNA, 16 nt, Mycobacterium avium subsp. paratuberculosis
ccaccggagcggcggu

SEQ ID NO: 959025 - RNA, 10 nt, Mycobacterium avium subsp. paratuberculosis
ccaccggcac

SEQ ID NO: 959026 - RNA, 18 nt, Mycobacterium avium subsp. paratuberculosis
ccaccggcaccacgauca

SEQ ID NO: 959027 - RNA, 17 nt, Mycobacterium avium subsp. paratuberculosis
ccaccggcccagccggc

SEQ ID NO: 959028 - RNA, 19 nt, Mycobacterium avium subsp. paratuberculosis
ccaccggcccagccggcgg

SEQ ID NO: 959029 - RNA, 20 nt, Mycobacterium avium subsp. paratuberculosis
ccaccggcccagccggcggu

SEQ ID NO: 959030 - RNA, 18 nt, Mycobacterium avium subsp. paratuberculosis
ccaccggauggcgcccgg

SEQ ID NO: 959031 - RNA, 23 nt, Mycobacterium avium subsp. paratuberculosis
ccaccggauggcgcccggcagcc

SEQ ID NO: 959032 - RNA, 15 nt, Mycobacterium avium subsp. paratuberculosis
ccaccggcgcgacgg

SEQ ID NO: 959033 - RNA, 16 nt, Mycobacterium avium subsp. paratuberculosis
ccaccggcgcgacggc

SEQ ID NO: 959034 - RNA, 19 nt, Mycobacterium avium subsp. paratuberculosis
ccaccggcgcgacggcggc

SEQ ID NO: 959035 - RNA, 11 nt, Mycobacterium avium subsp. paratuberculosis
ccaccggcgga

SEQ ID NO: 959036 - RNA, 18 nt, Mycobacterium avium subsp. paratuberculosis
ccaccgucgccacgauca

SEQ ID NO: 959037 - RNA, 20 nt, Mycobacterium avium subsp. paratuberculosis
ccaccgucgccacgaucacc

SEQ ID NO: 959038 - RNA, 21 nt, Mycobacterium avium subsp. paratuberculosis
ccacgacugcgcggccggcgu

SEQ ID NO: 959039 - RNA, 23 nt, Mycobacterium avium subsp. paratuberculosis
ccacgacugcgcggccggcgugu

SEQ ID NO: 959040 - RNA, 21 nt, Mycobacterium avium subsp. paratuberculosis
ccacgacuucacaggccgccu

SEQ ID NO: 959041 - RNA, 22 nt, Mycobacterium avium subsp. paratuberculosis
ccacgacuucacaggccgccuc

SEQ ID NO: 959042 - RNA, 22 nt, Mycobacterium avium subsp. paratuberculosis
ccacgacaccagcgucgcgauc

SEQ ID NO: 959043 - RNA, 20 nt, Mycobacterium avium subsp. paratuberculosis
ccacgaagucaaaccccuug

SEQ ID NO: 959044 - RNA, 18 nt, Mycobacterium avium subsp. paratuberculosis
ccacgaagcgggcggcga

SEQ ID NO: 959045 - RNA, 13 nt, Mycobacterium avium subsp. paratuberculosis
ccacgaagcuggc

SEQ ID NO: 959046 - RNA, 21 nt, Mycobacterium avium subsp. paratuberculosis
ccacgaagcuggcgaacagca

SEQ ID NO: 959047 - RNA, 20 nt, Mycobacterium avium subsp. paratuberculosis
ccacgaagaugaucagcgcg

SEQ ID NO: 959048 - RNA, 21 nt, Mycobacterium avium subsp. paratuberculosis
ccacgaagaugaucagcgcgc

SEQ ID NO: 959049 - RNA, 22 nt, Mycobacterium avium subsp. paratuberculosis
ccacgaagaugaucagcgcgcc

SEQ ID NO: 959050 - RNA, 18 nt, Mycobacterium avium subsp. paratuberculosis
ccacgaaccaggcgccgg

SEQ ID NO: 959051 - RNA, 23 nt, Mycobacterium avium subsp. paratuberculosis
ccacgaaccaggcgccggccagc

SEQ ID NO: 959052 - RNA, 22 nt, Mycobacterium avium subsp. paratuberculosis
ccacgaaccgguugcgggccga

SEQ ID NO: 959053 - RNA, 13 nt, Mycobacterium avium subsp. paratuberculosis
ccacgaacgcugc

SEQ ID NO: 959054 - RNA, 14 nt, Mycobacterium avium subsp. paratuberculosis
ccacgaacgcgccg

SEQ ID NO: 959055 - RNA, 19 nt, Mycobacterium avium subsp. paratuberculosis
ccacgaacgcgccgccgag

SEQ ID NO: 959056 - RNA, 21 nt, Mycobacterium avium subsp. paratuberculosis
ccaccugcgguucgucgcggc

SEQ ID NO: 959057 - RNA, 22 nt, Mycobacterium avium subsp. paratuberculosis
ccaccugcgguucgucgcggcg

SEQ ID NO: 959058 - RNA, 15 nt, Mycobacterium avium subsp. paratuberculosis
ccacgaaacugaccu

SEQ ID NO: 959059 - RNA, 20 nt, Mycobacterium avium subsp. paratuberculosis
ccacgaaacugaccuucucc

SEQ ID NO: 959060 - RNA, 12 nt, Mycobacterium avium subsp. paratuberculosis
ccacgaacaccg

SEQ ID NO: 959061 - RNA, 16 nt, Mycobacterium avium subsp. paratuberculosis
ccacgaacaccggcgc

SEQ ID NO: 959062 - RNA, 18 nt, Mycobacterium avium subsp. paratuberculosis
ccacgaacaccggcgcga

SEQ ID NO: 959063 - RNA, 21 nt, Mycobacterium avium subsp. paratuberculosis
ccacgaacaccggcgcgacca

SEQ ID NO: 959064 - RNA, 22 nt, Mycobacterium avium subsp. paratuberculosis
ccaccugcacggggacgucguc

SEQ ID NO: 959065 - RNA, 21 nt, Mycobacterium avium subsp. paratuberculosis
ccaccugcggcaccucggccu

SEQ ID NO: 959066 - RNA, 21 nt, Mycobacterium avium subsp. paratuberculosis
ccaccuuggccggugcgccga

SEQ ID NO: 959067 - RNA, 17 nt, Mycobacterium avium subsp. paratuberculosis
ccaccuuggcgucgauc

SEQ ID NO: 959068 - RNA, 20 nt, Mycobacterium avium subsp. paratuberculosis
ccaccuugguggccgcggcc

SEQ ID NO: 959069 - RNA, 23 nt, Mycobacterium avium subsp. paratuberculosis
ccaccuugguggccgcggccgcc

SEQ ID NO: 959070 - RNA, 15 nt, Mycobacterium avium subsp. paratuberculosis
ccaccuugucaccga

SEQ ID NO: 959071 - RNA, 18 nt, Mycobacterium avium subsp. paratuberculosis
ccaccuugucggcgccca

SEQ ID NO: 959072 - RNA, 19 nt, Mycobacterium avium subsp. paratuberculosis
ccaccucuucgcgguccau

SEQ ID NO: 959073 - RNA, 16 nt, Mycobacterium avium subsp. paratuberculosis
ccaccucgggcauugg

SEQ ID NO: 959074 - RNA, 13 nt, Mycobacterium avium subsp. paratuberculosis
ccaccucgggccg

SEQ ID NO: 959075 - RNA, 15 nt, Mycobacterium avium subsp. paratuberculosis
ccaccucgggccggg

SEQ ID NO: 959076 - RNA, 18 nt, Mycobacterium avium subsp. paratuberculosis
ccaccucgguggacgccg

SEQ ID NO: 959077 - RNA, 21 nt, Mycobacterium avium subsp. paratuberculosis
ccaccucgguggacgccgcgc

SEQ ID NO: 959078 - RNA, 23 nt, Mycobacterium avium subsp. paratuberculosis
ccaccucgguggacgccgcgcac

SEQ ID NO: 959079 - RNA, 14 nt, Mycobacterium avium subsp. paratuberculosis
ccaccucggcgauc

SEQ ID NO: 959080 - RNA, 15 nt, Mycobacterium avium subsp. paratuberculosis
ccaccucggcggcac

SEQ ID NO: 959081 - RNA, 16 nt, Mycobacterium avium subsp. paratuberculosis
ccaccgugccgucgcg

SEQ ID NO: 959082 - RNA, 15 nt, Mycobacterium avium subsp. paratuberculosis
ccaccgugcuggcca

SEQ ID NO: 959083 - RNA, 18 nt, Mycobacterium avium subsp. paratuberculosis
ccaccucgucccagcgca

SEQ ID NO: 959084 - RNA, 17 nt, Mycobacterium avium subsp. paratuberculosis
ccaccucgcgcggggcg

SEQ ID NO: 959085 - RNA, 14 nt, Mycobacterium avium subsp. paratuberculosis
ccaccugaccgcgg

SEQ ID NO: 959086 - RNA, 18 nt, Mycobacterium avium subsp. paratuberculosis
ccaccugaccgcgggccc

SEQ ID NO: 959087 - RNA, 14 nt, Mycobacterium avium subsp. paratuberculosis
ccaccugaucgcgg

SEQ ID NO: 959088 - RNA, 15 nt, Mycobacterium avium subsp. paratuberculosis
ccaccugaucgcggc

SEQ ID NO: 959089 - RNA, 24 nt, Mycobacterium avium subsp. paratuberculosis
ccaccugaucgcggcgagcagcgc

SEQ ID NO: 959090 - RNA, 21 nt, Mycobacterium avium subsp. paratuberculosis
ccaccugcaccugggugaucu

SEQ ID NO: 959091 - RNA, 17 nt, Mycobacterium avium subsp. paratuberculosis
ccaccucgaugaccuuc

SEQ ID NO: 959092 - RNA, 17 nt, Mycobacterium avium subsp. paratuberculosis
ccaccgucuugccguug

SEQ ID NO: 959093 - RNA, 22 nt, Mycobacterium avium subsp. paratuberculosis
ccaccgucuuggucucgccgau

SEQ ID NO: 959094 - RNA, 23 nt, Mycobacterium avium subsp. paratuberculosis
ccaccgucuuggucucgccgauc

SEQ ID NO: 959095 - RNA, 17 nt, Mycobacterium avium subsp. paratuberculosis
ccaccgugacguuguag

SEQ ID NO: 959096 - RNA, 17 nt, Mycobacterium avium subsp. paratuberculosis
ccaccgucuucggggcc

SEQ ID NO: 959097 - RNA, 18 nt, Mycobacterium avium subsp. paratuberculosis
ccaccgucuucggggccg

SEQ ID NO: 959098 - RNA, 19 nt, Mycobacterium avium subsp. paratuberculosis
ccaccgucuucggggccgc

SEQ ID NO: 959099 - RNA, 21 nt, Mycobacterium avium subsp. paratuberculosis
ccaccgucuucggggccgccg

SEQ ID NO: 959100 - RNA, 23 nt, Mycobacterium avium subsp. paratuberculosis
ccaccgucuucggggccgccguc

SEQ ID NO: 959101 - RNA, 13 nt, Mycobacterium avium subsp. paratuberculosis
ccaccgucgucga

SEQ ID NO: 959102 - RNA, 21 nt, Mycobacterium avium subsp. paratuberculosis
ccaccgucgucgagcgcucgc

SEQ ID NO: 959103 - RNA, 20 nt, Mycobacterium avium subsp. paratuberculosis
ccaccgucccggugucgccg

SEQ ID NO: 959104 - RNA, 22 nt, Mycobacterium avium subsp. paratuberculosis
ccaccgucccggugucgccguc

SEQ ID NO: 959105 - RNA, 23 nt, Mycobacterium avium subsp. paratuberculosis
ccaccgucccggugucgccgucg

SEQ ID NO: 959106 - RNA, 23 nt, Mycobacterium avium subsp. paratuberculosis
ccaccgucaggguggugcccccg

SEQ ID NO: 959107 - RNA, 16 nt, Mycobacterium avium subsp. paratuberculosis
ccagcaaaaccccgcc

SEQ ID NO: 959108 - RNA, 16 nt, Mycobacterium avium subsp. paratuberculosis
ccagauugcggcacca

SEQ ID NO: 959109 - RNA, 22 nt, Mycobacterium avium subsp. paratuberculosis
ccagauugcggcaccagucgcg

SEQ ID NO: 959110 - RNA, 15 nt, Mycobacterium avium subsp. paratuberculosis
ccagauucaccagcg

SEQ ID NO: 959111 - RNA, 16 nt, Mycobacterium avium subsp. paratuberculosis
ccagcaaacccagcac

SEQ ID NO: 959112 - RNA, 18 nt, Mycobacterium avium subsp. paratuberculosis
ccagcaaacccagcacca

SEQ ID NO: 959113 - RNA, 13 nt, Mycobacterium avium subsp. paratuberculosis
ccagaugucgcgu

SEQ ID NO: 959114 - RNA, 22 nt, Mycobacterium avium subsp. paratuberculosis
ccagauguugaggguccgcgcg

SEQ ID NO: 959115 - RNA, 20 nt, Mycobacterium avium subsp. paratuberculosis
ccagaugcgucaacccguuc

SEQ ID NO: 959116 - RNA, 15 nt, Mycobacterium avium subsp. paratuberculosis
ccagaugcccgcccc

SEQ ID NO: 959117 - RNA, 22 nt, Mycobacterium avium subsp. paratuberculosis
ccagaugcccgccccgcccggc

SEQ ID NO: 959118 - RNA, 17 nt, Mycobacterium avium subsp. paratuberculosis
ccagaugccgccgccag

SEQ ID NO: 959119 - RNA, 13 nt, Mycobacterium avium subsp. paratuberculosis
ccagaugccgcuc

SEQ ID NO: 959120 - RNA, 14 nt, Mycobacterium avium subsp. paratuberculosis
ccagaugccgcucg

SEQ ID NO: 959121 - RNA, 15 nt, Mycobacterium avium subsp. paratuberculosis
ccagaugccgggugg

SEQ ID NO: 959122 - RNA, 14 nt, Mycobacterium avium subsp. paratuberculosis
ccagcaccagcgcg

SEQ ID NO: 959123 - RNA, 16 nt, Mycobacterium avium subsp. paratuberculosis
ccagcaaccgccgugg

SEQ ID NO: 959124 - RNA, 23 nt, Mycobacterium avium subsp. paratuberculosis
ccagcaaccgccguggcagggcc

SEQ ID NO: 959125 - RNA, 18 nt, Mycobacterium avium subsp. paratuberculosis
ccagcaccagcacggcga

SEQ ID NO: 959126 - RNA, 19 nt, Mycobacterium avium subsp. paratuberculosis
ccagcaccagcagccgguc

SEQ ID NO: 959127 - RNA, 14 nt, Mycobacterium avium subsp. paratuberculosis
ccagcaacaccagc

SEQ ID NO: 959128 - RNA, 16 nt, Mycobacterium avium subsp. paratuberculosis
ccagcaacaccagcug

SEQ ID NO: 959129 - RNA, 18 nt, Mycobacterium avium subsp. paratuberculosis
ccagcaacaccagggugc

SEQ ID NO: 959130 - RNA, 21 nt, Mycobacterium avium subsp. paratuberculosis
ccagcaacacccagccgcuga

SEQ ID NO: 959131 - RNA, 21 nt, Mycobacterium avium subsp. paratuberculosis
ccagcaacaccuuucggccgc

SEQ ID NO: 959132 - RNA, 22 nt, Mycobacterium avium subsp. paratuberculosis
ccagcaacaccuuucggccgcg

SEQ ID NO: 959133 - RNA, 15 nt, Mycobacterium avium subsp. paratuberculosis
ccagcaacagcagcg

SEQ ID NO: 959134 - RNA, 13 nt, Mycobacterium avium subsp. paratuberculosis
ccagcaaccccgc

SEQ ID NO: 959135 - RNA, 18 nt, Mycobacterium avium subsp. paratuberculosis
ccagcaaccccgcggugc

SEQ ID NO: 959136 - RNA, 15 nt, Mycobacterium avium subsp. paratuberculosis
ccagcacccagcaca

SEQ ID NO: 959137 - RNA, 19 nt, Mycobacterium avium subsp. paratuberculosis
ccagcacccagcacagcga

SEQ ID NO: 959138 - RNA, 20 nt, Mycobacterium avium subsp. paratuberculosis
ccagcaccaggaaggcgacc

SEQ ID NO: 959139 - RNA, 12 nt, Mycobacterium avium subsp. paratuberculosis
ccagcaccaggc

SEQ ID NO: 959140 - RNA, 13 nt, Mycobacterium avium subsp. paratuberculosis
ccagcaccccgcc

SEQ ID NO: 959141 - RNA, 15 nt, Mycobacterium avium subsp. paratuberculosis
ccagcaccccgccgc

SEQ ID NO: 959142 - RNA, 17 nt, Mycobacterium avium subsp. paratuberculosis
ccagcaccccgccgcag

SEQ ID NO: 959143 - RNA, 20 nt, Mycobacterium avium subsp. paratuberculosis
ccagcaccccgguccaggcg

SEQ ID NO: 959144 - RNA, 19 nt, Mycobacterium avium subsp. paratuberculosis
ccagcacccgcucgccgau

SEQ ID NO: 959145 - RNA, 20 nt, Mycobacterium avium subsp. paratuberculosis
ccagcacccgcucgccgaug

SEQ ID NO: 959146 - RNA, 21 nt, Mycobacterium avium subsp. paratuberculosis
ccagcacccgcucgcgggccc

SEQ ID NO: 959147 - RNA, 20 nt, Mycobacterium avium subsp. paratuberculosis
ccagcacccgcugauccagc

SEQ ID NO: 959148 - RNA, 22 nt, Mycobacterium avium subsp. paratuberculosis
ccagcacccgcugauccagcag

SEQ ID NO: 959149 - RNA, 17 nt, Mycobacterium avium subsp. paratuberculosis
ccagcacccggucggug

SEQ ID NO: 959150 - RNA, 22 nt, Mycobacterium avium subsp. paratuberculosis
ccagcacccgguuccaccgggc

SEQ ID NO: 959151 - RNA, 23 nt, Mycobacterium avium subsp. paratuberculosis
ccagcacccgguuccaccgggcc

SEQ ID NO: 959152 - RNA, 17 nt, Mycobacterium avium subsp. paratuberculosis
ccagcaccgucggcgug

SEQ ID NO: 959153 - RNA, 20 nt, Mycobacterium avium subsp. paratuberculosis
ccagacgguggggcuggccg

SEQ ID NO: 959154 - RNA, 24 nt, Mycobacterium avium subsp. paratuberculosis
ccagacgguggggcuggccgcacg

SEQ ID NO: 959155 - RNA, 22 nt, Mycobacterium avium subsp. paratuberculosis
ccagacgguuccaccggucgga

SEQ ID NO: 959156 - RNA, 17 nt, Mycobacterium avium subsp. paratuberculosis
ccagacguccagcgccg

SEQ ID NO: 959157 - RNA, 20 nt, Mycobacterium avium subsp. paratuberculosis
ccagacguccagcgccgcca

SEQ ID NO: 959158 - RNA, 19 nt, Mycobacterium avium subsp. paratuberculosis
ccagacgcgggcgcccagc

SEQ ID NO: 959159 - RNA, 21 nt, Mycobacterium avium subsp. paratuberculosis
ccagacgcgggcgcccagcaa

SEQ ID NO: 959160 - RNA, 16 nt, Mycobacterium avium subsp. paratuberculosis
ccagacgcgcaccgcc

SEQ ID NO: 959161 - RNA, 21 nt, Mycobacterium avium subsp. paratuberculosis
ccagacgcgcaccgccaccgc

SEQ ID NO: 959162 - RNA, 15 nt, Mycobacterium avium subsp. paratuberculosis
ccagacgaacgcggc

SEQ ID NO: 959163 - RNA, 21 nt, Mycobacterium avium subsp. paratuberculosis
ccagacgaacgcggccgccag

SEQ ID NO: 959164 - RNA, 15 nt, Mycobacterium avium subsp. paratuberculosis
ccagaccucgccgac

SEQ ID NO: 959165 - RNA, 13 nt, Mycobacterium avium subsp. paratuberculosis
ccagaacggcggc

SEQ ID NO: 959166 - RNA, 14 nt, Mycobacterium avium subsp. paratuberculosis
ccagaacggcggca

SEQ ID NO: 959167 - RNA, 23 nt, Mycobacterium avium subsp. paratuberculosis
ccagaacggcggcagcgaggcgc

SEQ ID NO: 959168 - RNA, 14 nt, Mycobacterium avium subsp. paratuberculosis
ccagaacgacgcgc

SEQ ID NO: 959169 - RNA, 22 nt, Mycobacterium avium subsp. paratuberculosis
ccagaacgacgcgcucagcccc

SEQ ID NO: 959170 - RNA, 19 nt, Mycobacterium avium subsp. paratuberculosis
ccagaacucggcggcgguu

SEQ ID NO: 959171 - RNA, 15 nt, Mycobacterium avium subsp. paratuberculosis
ccagaacugggccgc

SEQ ID NO: 959172 - RNA, 21 nt, Mycobacterium avium subsp. paratuberculosis
ccagaacugggccgccgucgc

SEQ ID NO: 959173 - RNA, 18 nt, Mycobacterium avium subsp. paratuberculosis
ccagaagaucugccggug

SEQ ID NO: 959174 - RNA, 21 nt, Mycobacterium avium subsp. paratuberculosis
ccagaucguagggcucggcgu

SEQ ID NO: 959175 - RNA, 23 nt, Mycobacterium avium subsp. paratuberculosis
ccagaucguagggcucggcgucg

SEQ ID NO: 959176 - RNA, 21 nt, Mycobacterium avium subsp. paratuberculosis
ccagaucuccgccuucgacga

SEQ ID NO: 959177 - RNA, 17 nt, Mycobacterium avium subsp. paratuberculosis
ccagaucggccagccac

SEQ ID NO: 959178 - RNA, 23 nt, Mycobacterium avium subsp. paratuberculosis
ccagaucggccagccacgccgac

SEQ ID NO: 959179 - RNA, 21 nt, Mycobacterium avium subsp. paratuberculosis
ccagaucggccagcgcggccg

SEQ ID NO: 959180 - RNA, 21 nt, Mycobacterium avium subsp. paratuberculosis
ccagaucguguccgcgccggc

SEQ ID NO: 959181 - RNA, 23 nt, Mycobacterium avium subsp. paratuberculosis
ccagaucguguccgcgccggcgc

SEQ ID NO: 959182 - RNA, 15 nt, Mycobacterium avium subsp. paratuberculosis
ccagacucacggcgg

SEQ ID NO: 959183 - RNA, 14 nt, Mycobacterium avium subsp. paratuberculosis
ccagaucagcgugg

SEQ ID NO: 959184 - RNA, 14 nt, Mycobacterium avium subsp. paratuberculosis
ccagaucgccuggc

SEQ ID NO: 959185 - RNA, 15 nt, Mycobacterium avium subsp. paratuberculosis
ccagaucgcggucca

SEQ ID NO: 959186 - RNA, 17 nt, Mycobacterium avium subsp. paratuberculosis
ccagaucgcugaugcgc

SEQ ID NO: 959187 - RNA, 13 nt, Mycobacterium avium subsp. paratuberculosis
ccagaucggcggg

SEQ ID NO: 959188 - RNA, 21 nt, Mycobacterium avium subsp. paratuberculosis
ccagaucggcgggugcgggcg

SEQ ID NO: 959189 - RNA, 22 nt, Mycobacterium avium subsp. paratuberculosis
ccagaucggcgggugcgggcgc

SEQ ID NO: 959190 - RNA, 14 nt, Mycobacterium avium subsp. paratuberculosis
ccagacgucggcgu

SEQ ID NO: 959191 - RNA, 15 nt, Mycobacterium avium subsp. paratuberculosis
ccagacguguggcac

SEQ ID NO: 959192 - RNA, 19 nt, Mycobacterium avium subsp. paratuberculosis
ccagacguguggcacccgg

SEQ ID NO: 959193 - RNA, 12 nt, Mycobacterium avium subsp. paratuberculosis
ccagaucgaccc

SEQ ID NO: 959194 - RNA, 16 nt, Mycobacterium avium subsp. paratuberculosis
ccagaucgacgccgac

SEQ ID NO: 959195 - RNA, 21 nt, Mycobacterium avium subsp. paratuberculosis
ccagaucgacgccgaccgcgg

SEQ ID NO: 959196 - RNA, 22 nt, Mycobacterium avium subsp. paratuberculosis
ccagaucgacgccgaccgcggu

SEQ ID NO: 959197 - RNA, 18 nt, Mycobacterium avium subsp. paratuberculosis
ccagaucgagcugggccc

SEQ ID NO: 959198 - RNA, 18 nt, Mycobacterium avium subsp. paratuberculosis
ccagaucgaggccagcgc

SEQ ID NO: 959199 - RNA, 15 nt, Mycobacterium avium subsp. paratuberculosis
ccagaucgcccgggc

SEQ ID NO: 959200 - RNA, 17 nt, Mycobacterium avium subsp. paratuberculosis
ccagaucgcccgggcgg

SEQ ID NO: 959201 - RNA, 20 nt, Mycobacterium avium subsp. paratuberculosis
ccagaucgcccgggcggcgg

SEQ ID NO: 959202 - RNA, 13 nt, Mycobacterium avium subsp. paratuberculosis
ccagaucgccgcc

SEQ ID NO: 959203 - RNA, 22 nt, Mycobacterium avium subsp. paratuberculosis
ccacggccaggaagccggcgac

SEQ ID NO: 959204 - RNA, 23 nt, Mycobacterium avium subsp. paratuberculosis
ccacggccaggaagccggcgacg

SEQ ID NO: 959205 - RNA, 13 nt, Mycobacterium avium subsp. paratuberculosis
ccacggccggcaa

SEQ ID NO: 959206 - RNA, 21 nt, Mycobacterium avium subsp. paratuberculosis
ccacggccugguacagcaccg

SEQ ID NO: 959207 - RNA, 14 nt, Mycobacterium avium subsp. paratuberculosis
ccacggcgaacacc

SEQ ID NO: 959208 - RNA, 16 nt, Mycobacterium avium subsp. paratuberculosis
ccacggccaugcagac

SEQ ID NO: 959209 - RNA, 23 nt, Mycobacterium avium subsp. paratuberculosis
ccacggccaugcagaccagcccg

SEQ ID NO: 959210 - RNA, 16 nt, Mycobacterium avium subsp. paratuberculosis
ccacggccccagccgc

SEQ ID NO: 959211 - RNA, 18 nt, Mycobacterium avium subsp. paratuberculosis
ccacggccccagccgccg

SEQ ID NO: 959212 - RNA, 20 nt, Mycobacterium avium subsp. paratuberculosis
ccacggccccagccgccgcg

SEQ ID NO: 959213 - RNA, 21 nt, Mycobacterium avium subsp. paratuberculosis
ccacggccccagccgccgcga

SEQ ID NO: 959214 - RNA, 18 nt, Mycobacterium avium subsp. paratuberculosis
ccacggcccgcgccccgg

SEQ ID NO: 959215 - RNA, 22 nt, Mycobacterium avium subsp. paratuberculosis
ccacggcccgcgccccggcggc

SEQ ID NO: 959216 - RNA, 15 nt, Mycobacterium avium subsp. paratuberculosis
ccacggccgaugcag

SEQ ID NO: 959217 - RNA, 20 nt, Mycobacterium avium subsp. paratuberculosis
ccacggccgcaacggcgguc

SEQ ID NO: 959218 - RNA, 18 nt, Mycobacterium avium subsp. paratuberculosis
ccacggccgcagcggcag

SEQ ID NO: 959219 - RNA, 13 nt, Mycobacterium avium subsp. paratuberculosis
ccacggccgcggc

SEQ ID NO: 959220 - RNA, 14 nt, Mycobacterium avium subsp. paratuberculosis
ccacggccgcggcc

SEQ ID NO: 959221 - RNA, 16 nt, Mycobacterium avium subsp. paratuberculosis
ccacggccgcggcccg

SEQ ID NO: 959222 - RNA, 15 nt, Mycobacterium avium subsp. paratuberculosis
ccacgggcggucgga

SEQ ID NO: 959223 - RNA, 20 nt, Mycobacterium avium subsp. paratuberculosis
ccacgggcggucggacgcgg

SEQ ID NO: 959224 - RNA, 16 nt, Mycobacterium avium subsp. paratuberculosis
ccacggggcccgcgac

SEQ ID NO: 959225 - RNA, 14 nt, Mycobacterium avium subsp. paratuberculosis
ccacggggcgccgc

SEQ ID NO: 959226 - RNA, 16 nt, Mycobacterium avium subsp. paratuberculosis
ccacggggcgggucgu

SEQ ID NO: 959227 - RNA, 15 nt, Mycobacterium avium subsp. paratuberculosis
ccacggcgcgugcug

SEQ ID NO: 959228 - RNA, 20 nt, Mycobacterium avium subsp. paratuberculosis
ccacggcgaccccguucgcc

SEQ ID NO: 959229 - RNA, 13 nt, Mycobacterium avium subsp. paratuberculosis
ccacggcgacgac

SEQ ID NO: 959230 - RNA, 12 nt, Mycobacterium avium subsp. paratuberculosis
ccacggcgccau

SEQ ID NO: 959231 - RNA, 18 nt, Mycobacterium avium subsp. paratuberculosis
ccacggcgcgaggacgau

SEQ ID NO: 959232 - RNA, 17 nt, Mycobacterium avium subsp. paratuberculosis
ccacggggucgagaagc

SEQ ID NO: 959233 - RNA, 16 nt, Mycobacterium avium subsp. paratuberculosis
ccacgggucgccgauc

SEQ ID NO: 959234 - RNA, 18 nt, Mycobacterium avium subsp. paratuberculosis
ccacgggucgcugugcag

SEQ ID NO: 959235 - RNA, 15 nt, Mycobacterium avium subsp. paratuberculosis
ccacgggucggucgg

SEQ ID NO: 959236 - RNA, 23 nt, Mycobacterium avium subsp. paratuberculosis
ccacggucacagccgcgauagcc

SEQ ID NO: 959237 - RNA, 18 nt, Mycobacterium avium subsp. paratuberculosis
ccacggucagcgcgucgg

SEQ ID NO: 959238 - RNA, 21 nt, Mycobacterium avium subsp. paratuberculosis
ccacggucagcgcgucggcga

SEQ ID NO: 959239 - RNA, 22 nt, Mycobacterium avium subsp. paratuberculosis
ccacggucagcgcgucggcgac

SEQ ID NO: 959240 - RNA, 23 nt, Mycobacterium avium subsp. paratuberculosis
ccacggucagcgcgucggcgacc

SEQ ID NO: 959241 - RNA, 15 nt, Mycobacterium avium subsp. paratuberculosis
ccacggucagggcca

SEQ ID NO: 959242 - RNA, 17 nt, Mycobacterium avium subsp. paratuberculosis
ccacggucgccgcgccg

SEQ ID NO: 959243 - RNA, 21 nt, Mycobacterium avium subsp. paratuberculosis
ccacggucgccgcgccgccgg

SEQ ID NO: 959244 - RNA, 17 nt, Mycobacterium avium subsp. paratuberculosis
ccacggugaacgggccg

SEQ ID NO: 959245 - RNA, 19 nt, Mycobacterium avium subsp. paratuberculosis
ccacggugaacgggccgca

SEQ ID NO: 959246 - RNA, 19 nt, Mycobacterium avium subsp. paratuberculosis
ccacggugauuccggcacc

SEQ ID NO: 959247 - RNA, 18 nt, Mycobacterium avium subsp. paratuberculosis
ccacgguccccgcgcccg

SEQ ID NO: 959248 - RNA, 13 nt, Mycobacterium avium subsp. paratuberculosis
ccacgucgucggc

SEQ ID NO: 959249 - RNA, 15 nt, Mycobacterium avium subsp. paratuberculosis
ccacgucgucggccu

SEQ ID NO: 959250 - RNA, 14 nt, Mycobacterium avium subsp. paratuberculosis
ccacggucggcggg

SEQ ID NO: 959251 - RNA, 12 nt, Mycobacterium avium subsp. paratuberculosis
ccacgucgccgu

SEQ ID NO: 959252 - RNA, 21 nt, Mycobacterium avium subsp. paratuberculosis
ccacgucgcgauagggccggc

SEQ ID NO: 959253 - RNA, 22 nt, Mycobacterium avium subsp. paratuberculosis
ccacgucgcgauagggccggcc

SEQ ID NO: 959254 - RNA, 12 nt, Mycobacterium avium subsp. paratuberculosis
ccacgucgcgcc

SEQ ID NO: 959255 - RNA, 14 nt, Mycobacterium avium subsp. paratuberculosis
ccacgucgcgccga

SEQ ID NO: 959256 - RNA, 15 nt, Mycobacterium avium subsp. paratuberculosis
ccacgucgcgccgau

SEQ ID NO: 959257 - RNA, 22 nt, Mycobacterium avium subsp. paratuberculosis
ccacgucggugccgcguucgga

SEQ ID NO: 959258 - RNA, 14 nt, Mycobacterium avium subsp. paratuberculosis
ccacgucguccagc

SEQ ID NO: 959259 - RNA, 18 nt, Mycobacterium avium subsp. paratuberculosis
ccacgugcacggcgccgu

SEQ ID NO: 959260 - RNA, 13 nt, Mycobacterium avium subsp. paratuberculosis
ccacgugcggcgc

SEQ ID NO: 959261 - RNA, 12 nt, Mycobacterium avium subsp. paratuberculosis
ccacgugcggcu

SEQ ID NO: 959262 - RNA, 14 nt, Mycobacterium avium subsp. paratuberculosis
ccacuggcgccacc

SEQ ID NO: 959263 - RNA, 18 nt, Mycobacterium avium subsp. paratuberculosis
ccacugccugacccggcc

SEQ ID NO: 959264 - RNA, 18 nt, Mycobacterium avium subsp. paratuberculosis
ccacugggcgucggcgcc

SEQ ID NO: 959265 - RNA, 14 nt, Mycobacterium avium subsp. paratuberculosis
ccacuggcggccgg

SEQ ID NO: 959266 - RNA, 15 nt, Mycobacterium avium subsp. paratuberculosis
ccacuggcggccggc

SEQ ID NO: 959267 - RNA, 17 nt, Mycobacterium avium subsp. paratuberculosis
ccacuggcggccggccg

SEQ ID NO: 959268 - RNA, 21 nt, Mycobacterium avium subsp. paratuberculosis
ccacuggcggccggccgcgcc

SEQ ID NO: 959269 - RNA, 14 nt, Mycobacterium avium subsp. paratuberculosis
ccagaaaucgccgg

SEQ ID NO: 959270 - RNA, 15 nt, Mycobacterium avium subsp. paratuberculosis
ccagaaaucgccggg

SEQ ID NO: 959271 - RNA, 16 nt, Mycobacterium avium subsp. paratuberculosis
ccagaaaucgccggga

SEQ ID NO: 959272 - RNA, 20 nt, Mycobacterium avium subsp. paratuberculosis
ccagaacacgccccggcggg

SEQ ID NO: 959273 - RNA, 17 nt, Mycobacterium avium subsp. paratuberculosis
ccagaacacguuucggc

SEQ ID NO: 959274 - RNA, 19 nt, Mycobacterium avium subsp. paratuberculosis
ccagaacacguuucggccc

SEQ ID NO: 959275 - RNA, 19 nt, Mycobacterium avium subsp. paratuberculosis
ccagaaccgcucggcggcg

SEQ ID NO: 959276 - RNA, 23 nt, Mycobacterium avium subsp. paratuberculosis
ccagaaccggcaggacgggggcc

SEQ ID NO: 959277 - RNA, 13 nt, Mycobacterium avium subsp. paratuberculosis
ccacucggccacc

SEQ ID NO: 959278 - RNA, 19 nt, Mycobacterium avium subsp. paratuberculosis
ccacucggacagguggccg

SEQ ID NO: 959279 - RNA, 22 nt, Mycobacterium avium subsp. paratuberculosis
ccacucggacagguggccgauc

SEQ ID NO: 959280 - RNA, 22 nt, Mycobacterium avium subsp. paratuberculosis
ccacucgggaaaugcgucggca

SEQ ID NO: 959281 - RNA, 17 nt, Mycobacterium avium subsp. paratuberculosis
ccacucgggccagccca

SEQ ID NO: 959282 - RNA, 15 nt, Mycobacterium avium subsp. paratuberculosis
ccacucgggcggccg

SEQ ID NO: 959283 - RNA, 14 nt, Mycobacterium avium subsp. paratuberculosis
ccacugcgcgcccg

SEQ ID NO: 959284 - RNA, 19 nt, Mycobacterium avium subsp. paratuberculosis
ccacgugccacuggcgcca

SEQ ID NO: 959285 - RNA, 14 nt, Mycobacterium avium subsp. paratuberculosis
ccacgugucggcgu

SEQ ID NO: 959286 - RNA, 16 nt, Mycobacterium avium subsp. paratuberculosis
ccacgugucggcgucg

SEQ ID NO: 959287 - RNA, 17 nt, Mycobacterium avium subsp. paratuberculosis
ccacgugucggcgucga

SEQ ID NO: 959288 - RNA, 18 nt, Mycobacterium avium subsp. paratuberculosis
ccacgugucggcgucgau

SEQ ID NO: 959289 - RNA, 14 nt, Mycobacterium avium subsp. paratuberculosis
ccacuccagcaccg

SEQ ID NO: 959290 - RNA, 13 nt, Mycobacterium avium subsp. paratuberculosis
ccacucccagccg

SEQ ID NO: 959291 - RNA, 14 nt, Mycobacterium avium subsp. paratuberculosis
ccacucccgcgcgc

SEQ ID NO: 959292 - RNA, 16 nt, Mycobacterium avium subsp. paratuberculosis
ccacuccgaggucagc

SEQ ID NO: 959293 - RNA, 22 nt, Mycobacterium avium subsp. paratuberculosis
ccacuccgaggucagcgcguac

SEQ ID NO: 959294 - RNA, 14 nt, Mycobacterium avium subsp. paratuberculosis
ccaccgcccacagc

SEQ ID NO: 959295 - RNA, 15 nt, Mycobacterium avium subsp. paratuberculosis
ccaccgcccacagca

SEQ ID NO: 959296 - RNA, 14 nt, Mycobacterium avium subsp. paratuberculosis
ccaccgccaccgcg

SEQ ID NO: 959297 - RNA, 12 nt, Mycobacterium avium subsp. paratuberculosis
ccaccgccaccg

SEQ ID NO: 959298 - RNA, 20 nt, Mycobacterium avium subsp. paratuberculosis
ccaccgaugcccgacaccgc

SEQ ID NO: 959299 - RNA, 16 nt, Mycobacterium avium subsp. paratuberculosis
ccaccgaugcgggcca

SEQ ID NO: 959300 - RNA, 21 nt, Mycobacterium avium subsp. paratuberculosis
ccaccgaucaggaucggcggg

SEQ ID NO: 959301 - RNA, 22 nt, Mycobacterium avium subsp. paratuberculosis
ccaccgaucaggaucggcgggc

SEQ ID NO: 959302 - RNA, 13 nt, Mycobacterium avium subsp. paratuberculosis
ccaccgaucgcga

SEQ ID NO: 959303 - RNA, 19 nt, Mycobacterium avium subsp. paratuberculosis
ccaccgaucgcgagggccg

SEQ ID NO: 959304 - RNA, 15 nt, Mycobacterium avium subsp. paratuberculosis
ccaccgaggugacga

SEQ ID NO: 959305 - RNA, 18 nt, Mycobacterium avium subsp. paratuberculosis
ccaccgaggugacgaggc

SEQ ID NO: 959306 - RNA, 17 nt, Mycobacterium avium subsp. paratuberculosis
ccaccgaggugacgucg

SEQ ID NO: 959307 - RNA, 22 nt, Mycobacterium avium subsp. paratuberculosis
ccaccgaggugacgucgcgccg

SEQ ID NO: 959308 - RNA, 20 nt, Mycobacterium avium subsp. paratuberculosis
ccaccgagguggcccagccg

SEQ ID NO: 959309 - RNA, 23 nt, Mycobacterium avium subsp. paratuberculosis
ccaccgagguggcccagccgcug

SEQ ID NO: 959310 - RNA, 21 nt, Mycobacterium avium subsp. paratuberculosis
ccacccguuggcaggcccggu

SEQ ID NO: 959311 - RNA, 20 nt, Mycobacterium avium subsp. paratuberculosis
ccaccgacgcgucgcggcgg

SEQ ID NO: 959312 - RNA, 12 nt, Mycobacterium avium subsp. paratuberculosis
ccaccgagucgc

SEQ ID NO: 959313 - RNA, 16 nt, Mycobacterium avium subsp. paratuberculosis
ccaccgagugcggcgc

SEQ ID NO: 959314 - RNA, 19 nt, Mycobacterium avium subsp. paratuberculosis
ccaccgagugcggcgcggu

SEQ ID NO: 959315 - RNA, 21 nt, Mycobacterium avium subsp. paratuberculosis
ccaccgagugcggcgcggugc

SEQ ID NO: 959316 - RNA, 16 nt, Mycobacterium avium subsp. paratuberculosis
ccacccggucgaugug

SEQ ID NO: 959317 - RNA, 21 nt, Mycobacterium avium subsp. paratuberculosis
ccacccggucgaugugcgcgc

SEQ ID NO: 959318 - RNA, 12 nt, Mycobacterium avium subsp. paratuberculosis
ccacccgucggu

SEQ ID NO: 959319 - RNA, 16 nt, Mycobacterium avium subsp. paratuberculosis
ccacccgucggugaag

SEQ ID NO: 959320 - RNA, 15 nt, Mycobacterium avium subsp. paratuberculosis
ccaccgagcagcugc

SEQ ID NO: 959321 - RNA, 12 nt, Mycobacterium avium subsp. paratuberculosis
ccaccgagccgg

SEQ ID NO: 959322 - RNA, 14 nt, Mycobacterium avium subsp. paratuberculosis
ccaccgagccggcg

SEQ ID NO: 959323 - RNA, 17 nt, Mycobacterium avium subsp. paratuberculosis
ccaccgagccggcgucg

SEQ ID NO: 959324 - RNA, 14 nt, Mycobacterium avium subsp. paratuberculosis
ccaccgagccgggc

SEQ ID NO: 959325 - RNA, 16 nt, Mycobacterium avium subsp. paratuberculosis
ccaccgagccgggcag

SEQ ID NO: 959326 - RNA, 20 nt, Mycobacterium avium subsp. paratuberculosis
ccaccgagccgggcagcgcg

SEQ ID NO: 959327 - RNA, 15 nt, Mycobacterium avium subsp. paratuberculosis
ccaccgagccggugc

SEQ ID NO: 959328 - RNA, 17 nt, Mycobacterium avium subsp. paratuberculosis
ccaccgagccggugccg

SEQ ID NO: 959329 - RNA, 17 nt, Mycobacterium avium subsp. paratuberculosis
ccaccgaggccagcaga

SEQ ID NO: 959330 - RNA, 18 nt, Mycobacterium avium subsp. paratuberculosis
ccaccgcgaaagcgucgg

SEQ ID NO: 959331 - RNA, 12 nt, Mycobacterium avium subsp. paratuberculosis
ccaccgcgagcg

SEQ ID NO: 959332 - RNA, 14 nt, Mycobacterium avium subsp. paratuberculosis
ccaccgcgacgcug

SEQ ID NO: 959333 - RNA, 15 nt, Mycobacterium avium subsp. paratuberculosis
ccaccgcgacgcugc

SEQ ID NO: 959334 - RNA, 16 nt, Mycobacterium avium subsp. paratuberculosis
ccaccgccucgacggu

SEQ ID NO: 959335 - RNA, 18 nt, Mycobacterium avium subsp. paratuberculosis
ccaccgccgccagcagca

SEQ ID NO: 959336 - RNA, 13 nt, Mycobacterium avium subsp. paratuberculosis
ccaccgccgcgcc

SEQ ID NO: 959337 - RNA, 16 nt, Mycobacterium avium subsp. paratuberculosis
ccaccgccgcgccgag

SEQ ID NO: 959338 - RNA, 15 nt, Mycobacterium avium subsp. paratuberculosis
ccaccgccggcccag

SEQ ID NO: 959339 - RNA, 14 nt, Mycobacterium avium subsp. paratuberculosis
ccaccgccggcccg

SEQ ID NO: 959340 - RNA, 13 nt, Mycobacterium avium subsp. paratuberculosis
ccaccgccgucac

SEQ ID NO: 959341 - RNA, 15 nt, Mycobacterium avium subsp. paratuberculosis
ccaccgccgccagca

SEQ ID NO: 959342 - RNA, 13 nt, Mycobacterium avium subsp. paratuberculosis
ccaccgccgcugc

SEQ ID NO: 959343 - RNA, 13 nt, Mycobacterium avium subsp. paratuberculosis
ccaccgccgccga

SEQ ID NO: 959344 - RNA, 13 nt, Mycobacterium avium subsp. paratuberculosis
ccaccgccccagc

SEQ ID NO: 959345 - RNA, 15 nt, Mycobacterium avium subsp. paratuberculosis
ccaccgccccagccg

SEQ ID NO: 959346 - RNA, 12 nt, Mycobacterium avium subsp. paratuberculosis
ccaccgcccgga

SEQ ID NO: 959347 - RNA, 16 nt, Mycobacterium avium subsp. paratuberculosis
ccaccgcccggaccgg

SEQ ID NO: 959348 - RNA, 17 nt, Mycobacterium avium subsp. paratuberculosis
ccaccgcccggaccggc

SEQ ID NO: 959349 - RNA, 20 nt, Mycobacterium avium subsp. paratuberculosis
ccaccgcccggaccggcucg

SEQ ID NO: 959350 - RNA, 21 nt, Mycobacterium avium subsp. paratuberculosis
ccaccgcccggaccggcucgu

SEQ ID NO: 959351 - RNA, 13 nt, Mycobacterium avium subsp. paratuberculosis
ccaccgcccggau

SEQ ID NO: 959352 - RNA, 20 nt, Mycobacterium avium subsp. paratuberculosis
ccaccgcccggaugccggcg

SEQ ID NO: 959353 - RNA, 22 nt, Mycobacterium avium subsp. paratuberculosis
ccaccgcccggaugccggcgcc

SEQ ID NO: 959354 - RNA, 14 nt, Mycobacterium avium subsp. paratuberculosis
ccaccgcgucgcag

SEQ ID NO: 959355 - RNA, 20 nt, Mycobacterium avium subsp. paratuberculosis
ccaccgcgucgcagugccgg

SEQ ID NO: 959356 - RNA, 21 nt, Mycobacterium avium subsp. paratuberculosis
ccaccgcgucgcagugccggu

SEQ ID NO: 959357 - RNA, 19 nt, Mycobacterium avium subsp. paratuberculosis
ccaccgcggcguugcccgg

SEQ ID NO: 959358 - RNA, 20 nt, Mycobacterium avium subsp. paratuberculosis
ccaccgcggcguugcccggg

SEQ ID NO: 959359 - RNA, 15 nt, Mycobacterium avium subsp. paratuberculosis
ccaccgcggggcugg

SEQ ID NO: 959360 - RNA, 20 nt, Mycobacterium avium subsp. paratuberculosis
ccaccgcggucgacgggaag

SEQ ID NO: 959361 - RNA, 12 nt, Mycobacterium avium subsp. paratuberculosis
ccaccgcgguga

SEQ ID NO: 959362 - RNA, 15 nt, Mycobacterium avium subsp. paratuberculosis
ccaccgcggugaccg

SEQ ID NO: 959363 - RNA, 13 nt, Mycobacterium avium subsp. paratuberculosis
ccaccgcggugag

SEQ ID NO: 959364 - RNA, 17 nt, Mycobacterium avium subsp. paratuberculosis
ccaccgcggugagcggc

SEQ ID NO: 959365 - RNA, 17 nt, Mycobacterium avium subsp. paratuberculosis
ccaccgcgugcgagccg

SEQ ID NO: 959366 - RNA, 21 nt, Mycobacterium avium subsp. paratuberculosis
ccaccgcguugaucagcgcca

SEQ ID NO: 959367 - RNA, 22 nt, Mycobacterium avium subsp. paratuberculosis
ccaccgcugggcggcgcggcgg

SEQ ID NO: 959368 - RNA, 23 nt, Mycobacterium avium subsp. paratuberculosis
ccaccgcugggcggcgcggcggu

SEQ ID NO: 959369 - RNA, 14 nt, Mycobacterium avium subsp. paratuberculosis
ccaccgcgccggcg

SEQ ID NO: 959370 - RNA, 15 nt, Mycobacterium avium subsp. paratuberculosis
ccaccgcgccggcgg

SEQ ID NO: 959371 - RNA, 16 nt, Mycobacterium avium subsp. paratuberculosis
ccaccgcgccggcggc

SEQ ID NO: 959372 - RNA, 12 nt, Mycobacterium avium subsp. paratuberculosis
ccaccgcgccgu

SEQ ID NO: 959373 - RNA, 13 nt, Mycobacterium avium subsp. paratuberculosis
ccaccgcgccgug

SEQ ID NO: 959374 - RNA, 22 nt, Mycobacterium avium subsp. paratuberculosis
ccaccgcgccuuugacguucgc

SEQ ID NO: 959375 - RNA, 15 nt, Mycobacterium avium subsp. paratuberculosis
ccaccgcgcgcgggu

SEQ ID NO: 959376 - RNA, 15 nt, Mycobacterium avium subsp. paratuberculosis
ccaccgcgcgcugca

SEQ ID NO: 959377 - RNA, 18 nt, Mycobacterium avium subsp. paratuberculosis
ccaccgcgcgcugccgcg

SEQ ID NO: 959378 - RNA, 13 nt, Mycobacterium avium subsp. paratuberculosis
ccaccgcgcggcc

SEQ ID NO: 959379 - RNA, 14 nt, Mycobacterium avium subsp. paratuberculosis
ccaccgcgcggcca

SEQ ID NO: 959380 - RNA, 15 nt, Mycobacterium avium subsp. paratuberculosis
ccaccgcgcggccag

SEQ ID NO: 959381 - RNA, 16 nt, Mycobacterium avium subsp. paratuberculosis
ccaccgcgcggcgcag

SEQ ID NO: 959382 - RNA, 15 nt, Mycobacterium avium subsp. paratuberculosis
ccaccgcgcggcggu

SEQ ID NO: 959383 - RNA, 16 nt, Mycobacterium avium subsp. paratuberculosis
ccaccgcgcggcgguc

SEQ ID NO: 959384 - RNA, 14 nt, Mycobacterium avium subsp. paratuberculosis
ccaccgcgcggugc

SEQ ID NO: 959385 - RNA, 12 nt, Mycobacterium avium subsp. paratuberculosis
ccaccgcggcca

SEQ ID NO: 959386 - RNA, 13 nt, Mycobacterium avium subsp. paratuberculosis
ccaccgcggcgcc

SEQ ID NO: 959387 - RNA, 18 nt, Mycobacterium avium subsp. paratuberculosis
ccaccgcggcgccgucga

SEQ ID NO: 959388 - RNA, 14 nt, Mycobacterium avium subsp. paratuberculosis
ccaccgcggcgcgc

SEQ ID NO: 959389 - RNA, 18 nt, Mycobacterium avium subsp. paratuberculosis
ccaccgcggcgcgcggcc

SEQ ID NO: 959390 - RNA, 12 nt, Mycobacterium avium subsp. paratuberculosis
ccaccgcggcgg

SEQ ID NO: 959391 - RNA, 13 nt, Mycobacterium avium subsp. paratuberculosis
ccaccgcggcggc

SEQ ID NO: 959392 - RNA, 15 nt, Mycobacterium avium subsp. paratuberculosis
ccaccgcggcggcca

SEQ ID NO: 959393 - RNA, 16 nt, Mycobacterium avium subsp. paratuberculosis
ccaccgcggcggccag

SEQ ID NO: 959394 - RNA, 14 nt, Mycobacterium avium subsp. paratuberculosis
ccaccaacaggucg

SEQ ID NO: 959395 - RNA, 16 nt, Mycobacterium avium subsp. paratuberculosis
ccaccaacggcagcag

SEQ ID NO: 959396 - RNA, 16 nt, Mycobacterium avium subsp. paratuberculosis
ccaccaacggcucgcc

SEQ ID NO: 959397 - RNA, 21 nt, Mycobacterium avium subsp. paratuberculosis
ccaccaacggcucgccgcgca

SEQ ID NO: 959398 - RNA, 24 nt, Mycobacterium avium subsp. paratuberculosis
ccaccaacggcucgccgcgcauca

SEQ ID NO: 959399 - RNA, 21 nt, Mycobacterium avium subsp. paratuberculosis
ccacauuggcgaccgcggccg

SEQ ID NO: 959400 - RNA, 20 nt, Mycobacterium avium subsp. paratuberculosis
ccacaccggcgcugcccgcg

SEQ ID NO: 959401 - RNA, 16 nt, Mycobacterium avium subsp. paratuberculosis
ccacacgaugcgcggu

SEQ ID NO: 959402 - RNA, 17 nt, Mycobacterium avium subsp. paratuberculosis
ccacacgaugcgcggua

SEQ ID NO: 959403 - RNA, 17 nt, Mycobacterium avium subsp. paratuberculosis
ccacacgcucggcgagc

SEQ ID NO: 959404 - RNA, 17 nt, Mycobacterium avium subsp. paratuberculosis
ccacacgcucggcgcgc

SEQ ID NO: 959405 - RNA, 19 nt, Mycobacterium avium subsp. paratuberculosis
ccacacgcucggcgcgcgg

SEQ ID NO: 959406 - RNA, 16 nt, Mycobacterium avium subsp. paratuberculosis
ccacacggcaggcggc

SEQ ID NO: 959407 - RNA, 17 nt, Mycobacterium avium subsp. paratuberculosis
ccacacggcaggcggcc

SEQ ID NO: 959408 - RNA, 23 nt, Mycobacterium avium subsp. paratuberculosis
ccacacguccuggacgucgucgc

SEQ ID NO: 959409 - RNA, 21 nt, Mycobacterium avium subsp. paratuberculosis
ccacacgugcggauggccccg

SEQ ID NO: 959410 - RNA, 18 nt, Mycobacterium avium subsp. paratuberculosis
ccacacguugagcccgga

SEQ ID NO: 959411 - RNA, 19 nt, Mycobacterium avium subsp. paratuberculosis
ccaccacaguggccgccag

SEQ ID NO: 959412 - RNA, 16 nt, Mycobacterium avium subsp. paratuberculosis
ccaccacacccagcgc

SEQ ID NO: 959413 - RNA, 18 nt, Mycobacterium avium subsp. paratuberculosis
ccaccacacccgcggccg

SEQ ID NO: 959414 - RNA, 18 nt, Mycobacterium avium subsp. paratuberculosis
ccaccaaggucuccgggc

SEQ ID NO: 959415 - RNA, 19 nt, Mycobacterium avium subsp. paratuberculosis
ccaccaaggucuccgggcu

SEQ ID NO: 959416 - RNA, 20 nt, Mycobacterium avium subsp. paratuberculosis
ccaccaaggucuccgggcug

SEQ ID NO: 959417 - RNA, 17 nt, Mycobacterium avium subsp. paratuberculosis
ccaccacauucccgccg

SEQ ID NO: 959418 - RNA, 15 nt, Mycobacterium avium subsp. paratuberculosis
ccaccacauuggcga

SEQ ID NO: 959419 - RNA, 20 nt, Mycobacterium avium subsp. paratuberculosis
ccaccaccuucaucgccguc

SEQ ID NO: 959420 - RNA, 17 nt, Mycobacterium avium subsp. paratuberculosis
ccaccacgaaccaggcg

SEQ ID NO: 959421 - RNA, 22 nt, Mycobacterium avium subsp. paratuberculosis
ccaccacgaaccaggcgccggc

SEQ ID NO: 959422 - RNA, 23 nt, Mycobacterium avium subsp. paratuberculosis
ccaccacgaaccaggcgccggcc

SEQ ID NO: 959423 - RNA, 15 nt, Mycobacterium avium subsp. paratuberculosis
ccaccacgaacgcgc

SEQ ID NO: 959424 - RNA, 20 nt, Mycobacterium avium subsp. paratuberculosis
ccaccacgacgacguggugg

SEQ ID NO: 959425 - RNA, 15 nt, Mycobacterium avium subsp. paratuberculosis
ccaccacgacgccgg

SEQ ID NO: 959426 - RNA, 17 nt, Mycobacterium avium subsp. paratuberculosis
ccaccacgacgccgggc

SEQ ID NO: 959427 - RNA, 18 nt, Mycobacterium avium subsp. paratuberculosis
ccaccacgacgccgggcg

SEQ ID NO: 959428 - RNA, 19 nt, Mycobacterium avium subsp. paratuberculosis
ccaccacgacgccgggcgc

SEQ ID NO: 959429 - RNA, 12 nt, Mycobacterium avium subsp. paratuberculosis
ccaccacgcugg

SEQ ID NO: 959430 - RNA, 24 nt, Mycobacterium avium subsp. paratuberculosis
ccaccacggagcgcccggccagcc

SEQ ID NO: 959431 - RNA, 13 nt, Mycobacterium avium subsp. paratuberculosis
ccaccacggccag

SEQ ID NO: 959432 - RNA, 18 nt, Mycobacterium avium subsp. paratuberculosis
ccaccacggggcgggucg

SEQ ID NO: 959433 - RNA, 19 nt, Mycobacterium avium subsp. paratuberculosis
ccaccacggggcgggucgu

SEQ ID NO: 959434 - RNA, 20 nt, Mycobacterium avium subsp. paratuberculosis
ccaccacgggucggucggcc

SEQ ID NO: 959435 - RNA, 23 nt, Mycobacterium avium subsp. paratuberculosis
ccaccacggccaggaagccggcg

SEQ ID NO: 959436 - RNA, 15 nt, Mycobacterium avium subsp. paratuberculosis
ccaccacggccgaug

SEQ ID NO: 959437 - RNA, 15 nt, Mycobacterium avium subsp. paratuberculosis
ccaccacggccgccg

SEQ ID NO: 959438 - RNA, 17 nt, Mycobacterium avium subsp. paratuberculosis
ccaccacgguggcgccg

SEQ ID NO: 959439 - RNA, 19 nt, Mycobacterium avium subsp. paratuberculosis
ccaccacgguggcgccggc

SEQ ID NO: 959440 - RNA, 20 nt, Mycobacterium avium subsp. paratuberculosis
ccaccacgguggcgccggca

SEQ ID NO: 959441 - RNA, 23 nt, Mycobacterium avium subsp. paratuberculosis
ccaccacgguggcgccggcaucg

SEQ ID NO: 959442 - RNA, 22 nt, Mycobacterium avium subsp. paratuberculosis
ccaccacguaggcgaucagcgc

SEQ ID NO: 959443 - RNA, 12 nt, Mycobacterium avium subsp. paratuberculosis
ccaccacgugcg

SEQ ID NO: 959444 - RNA, 19 nt, Mycobacterium avium subsp. paratuberculosis
ccaccacguugcgcggccg

SEQ ID NO: 959445 - RNA, 21 nt, Mycobacterium avium subsp. paratuberculosis
ccaccacguugcgcggccgca

SEQ ID NO: 959446 - RNA, 17 nt, Mycobacterium avium subsp. paratuberculosis
ccaccacugcgccguca

SEQ ID NO: 959447 - RNA, 19 nt, Mycobacterium avium subsp. paratuberculosis
ccaccacugcgccgucauc

SEQ ID NO: 959448 - RNA, 12 nt, Mycobacterium avium subsp. paratuberculosis
ccaccagcgccc

SEQ ID NO: 959449 - RNA, 15 nt, Mycobacterium avium subsp. paratuberculosis
ccaccagcgcccgcc

SEQ ID NO: 959450 - RNA, 14 nt, Mycobacterium avium subsp. paratuberculosis
ccaccagccggccg

SEQ ID NO: 959451 - RNA, 15 nt, Mycobacterium avium subsp. paratuberculosis
ccaccagccggccgg

SEQ ID NO: 959452 - RNA, 18 nt, Mycobacterium avium subsp. paratuberculosis
ccaccagccggccggccg

SEQ ID NO: 959453 - RNA, 18 nt, Mycobacterium avium subsp. paratuberculosis
ccaccagccggccggcga

SEQ ID NO: 959454 - RNA, 14 nt, Mycobacterium avium subsp. paratuberculosis
ccaccagcggcgcg

SEQ ID NO: 959455 - RNA, 22 nt, Mycobacterium avium subsp. paratuberculosis
ccaccaggucgcacaccagcac

SEQ ID NO: 959456 - RNA, 23 nt, Mycobacterium avium subsp. paratuberculosis
ccaccaggucgcacaccagcacg

SEQ ID NO: 959457 - RNA, 15 nt, Mycobacterium avium subsp. paratuberculosis
ccaccagcgggcugu

SEQ ID NO: 959458 - RNA, 15 nt, Mycobacterium avium subsp. paratuberculosis
ccaccagcgcgguga

SEQ ID NO: 959459 - RNA, 15 nt, Mycobacterium avium subsp. paratuberculosis
ccaccagcggccguc

SEQ ID NO: 959460 - RNA, 20 nt, Mycobacterium avium subsp. paratuberculosis
ccaccagcggccgucgccgg

SEQ ID NO: 959461 - RNA, 19 nt, Mycobacterium avium subsp. paratuberculosis
ccaccaggucuccgucggc

SEQ ID NO: 959462 - RNA, 20 nt, Mycobacterium avium subsp. paratuberculosis
ccaccaggucuccgucggcg

SEQ ID NO: 959463 - RNA, 17 nt, Mycobacterium avium subsp. paratuberculosis
ccaccaggugcggggac

SEQ ID NO: 959464 - RNA, 19 nt, Mycobacterium avium subsp. paratuberculosis
ccaccaggugcggggacag

SEQ ID NO: 959465 - RNA, 17 nt, Mycobacterium avium subsp. paratuberculosis
ccaccagguucgcgcag

SEQ ID NO: 959466 - RNA, 15 nt, Mycobacterium avium subsp. paratuberculosis
ccaccagguuggaca

SEQ ID NO: 959467 - RNA, 15 nt, Mycobacterium avium subsp. paratuberculosis
ccaccagucggcgcg

SEQ ID NO: 959468 - RNA, 20 nt, Mycobacterium avium subsp. paratuberculosis
ccaccagucggcgcguuggc

SEQ ID NO: 959469 - RNA, 22 nt, Mycobacterium avium subsp. paratuberculosis
ccaccagucggcgcguuggccg

SEQ ID NO: 959470 - RNA, 17 nt, Mycobacterium avium subsp. paratuberculosis
ccaccaguguccgggcg

SEQ ID NO: 959471 - RNA, 19 nt, Mycobacterium avium subsp. paratuberculosis
ccaccaguguccgggcgcc

SEQ ID NO: 959472 - RNA, 12 nt, Mycobacterium avium subsp. paratuberculosis
ccaccagcgccu

SEQ ID NO: 959473 - RNA, 14 nt, Mycobacterium avium subsp. paratuberculosis
ccaccaucaggccg

SEQ ID NO: 959474 - RNA, 16 nt, Mycobacterium avium subsp. paratuberculosis
ccaccaucaggccggc

SEQ ID NO: 959475 - RNA, 21 nt, Mycobacterium avium subsp. paratuberculosis
ccaccaucaggccggccugcc

SEQ ID NO: 959476 - RNA, 18 nt, Mycobacterium avium subsp. paratuberculosis
ccacccgcagcgcggcgg

SEQ ID NO: 959477 - RNA, 15 nt, Mycobacterium avium subsp. paratuberculosis
ccacccgcagcucgc

SEQ ID NO: 959478 - RNA, 17 nt, Mycobacterium avium subsp. paratuberculosis
ccacccgcagggcgccg

SEQ ID NO: 959479 - RNA, 21 nt, Mycobacterium avium subsp. paratuberculosis
ccacccgcagggcgccgguga

SEQ ID NO: 959480 - RNA, 13 nt, Mycobacterium avium subsp. paratuberculosis
ccacccggcaucc

SEQ ID NO: 959481 - RNA, 15 nt, Mycobacterium avium subsp. paratuberculosis
ccacccggcccacca

SEQ ID NO: 959482 - RNA, 13 nt, Mycobacterium avium subsp. paratuberculosis
ccacccggggccg

SEQ ID NO: 959483 - RNA, 22 nt, Mycobacterium avium subsp. paratuberculosis
ccacccggguugcgugcagccg

SEQ ID NO: 959484 - RNA, 15 nt, Mycobacterium avium subsp. paratuberculosis
ccacccgccagcccg

SEQ ID NO: 959485 - RNA, 17 nt, Mycobacterium avium subsp. paratuberculosis
ccacccgccccgccgcg

SEQ ID NO: 959486 - RNA, 20 nt, Mycobacterium avium subsp. paratuberculosis
ccacccgccccgccgcggcc

SEQ ID NO: 959487 - RNA, 15 nt, Mycobacterium avium subsp. paratuberculosis
ccacccgcucggcga

SEQ ID NO: 959488 - RNA, 12 nt, Mycobacterium avium subsp. paratuberculosis
ccacccgcgauc

SEQ ID NO: 959489 - RNA, 11 nt, Mycobacterium avium subsp. paratuberculosis
ccacccgcgcc

SEQ ID NO: 959490 - RNA, 17 nt, Mycobacterium avium subsp. paratuberculosis
ccacccgcgccggcaga

SEQ ID NO: 959491 - RNA, 13 nt, Mycobacterium avium subsp. paratuberculosis
ccacccgcggccg

SEQ ID NO: 959492 - RNA, 19 nt, Mycobacterium avium subsp. paratuberculosis
ccacccgcggccggcccag

SEQ ID NO: 959493 - RNA, 23 nt, Mycobacterium avium subsp. paratuberculosis
ccacccgcggccggcccagcgcg

SEQ ID NO: 959494 - RNA, 20 nt, Mycobacterium avium subsp. paratuberculosis
ccaaccguuggugcgguguc

SEQ ID NO: 959495 - RNA, 15 nt, Mycobacterium avium subsp. paratuberculosis
ccaacgcagcgcauc

SEQ ID NO: 959496 - RNA, 21 nt, Mycobacterium avium subsp. paratuberculosis
ccaacgcagcgcauccgacac

SEQ ID NO: 959497 - RNA, 15 nt, Mycobacterium avium subsp. paratuberculosis
ccaacgagcgcgccg

SEQ ID NO: 959498 - RNA, 13 nt, Mycobacterium avium subsp. paratuberculosis
ccaacgacgucgg

SEQ ID NO: 959499 - RNA, 15 nt, Mycobacterium avium subsp. paratuberculosis
ccaacgacgucggcg

SEQ ID NO: 959500 - RNA, 20 nt, Mycobacterium avium subsp. paratuberculosis
ccaacgacgucggcgucauc

SEQ ID NO: 959501 - RNA, 23 nt, Mycobacterium avium subsp. paratuberculosis
ccaacgacgucggcgucaucgac

SEQ ID NO: 959502 - RNA, 14 nt, Mycobacterium avium subsp. paratuberculosis
ccaacgcggcgccg

SEQ ID NO: 959503 - RNA, 16 nt, Mycobacterium avium subsp. paratuberculosis
ccaacgcggcgccggu

SEQ ID NO: 959504 - RNA, 19 nt, Mycobacterium avium subsp. paratuberculosis
ccaacgcguucuccucgaa

SEQ ID NO: 959505 - RNA, 21 nt, Mycobacterium avium subsp. paratuberculosis
ccaacgcguucuccucgaaca

SEQ ID NO: 959506 - RNA, 17 nt, Mycobacterium avium subsp. paratuberculosis
ccaacgccgccuccgac

SEQ ID NO: 959507 - RNA, 20 nt, Mycobacterium avium subsp. paratuberculosis
ccaacgccgccuccgacagc

SEQ ID NO: 959508 - RNA, 16 nt, Mycobacterium avium subsp. paratuberculosis
ccaacgccucgucgac

SEQ ID NO: 959509 - RNA, 21 nt, Mycobacterium avium subsp. paratuberculosis
ccaagacccgcgucaucgggc

SEQ ID NO: 959510 - RNA, 21 nt, Mycobacterium avium subsp. paratuberculosis
ccaagaccgcggucaccgguc

SEQ ID NO: 959511 - RNA, 20 nt, Mycobacterium avium subsp. paratuberculosis
ccaagacggugggcccgccg

SEQ ID NO: 959512 - RNA, 15 nt, Mycobacterium avium subsp. paratuberculosis
ccaagacguccgcgu

SEQ ID NO: 959513 - RNA, 16 nt, Mycobacterium avium subsp. paratuberculosis
ccaagacguccgcguc

SEQ ID NO: 959514 - RNA, 14 nt, Mycobacterium avium subsp. paratuberculosis
ccaacggaagcggu

SEQ ID NO: 959515 - RNA, 19 nt, Mycobacterium avium subsp. paratuberculosis
ccaacggauucagcgucgc

SEQ ID NO: 959516 - RNA, 20 nt, Mycobacterium avium subsp. paratuberculosis
ccaacggauucagcgucgcc

SEQ ID NO: 959517 - RNA, 15 nt, Mycobacterium avium subsp. paratuberculosis
ccaacggcaccacca

SEQ ID NO: 959518 - RNA, 17 nt, Mycobacterium avium subsp. paratuberculosis
ccaacggcgugcagccg

SEQ ID NO: 959519 - RNA, 16 nt, Mycobacterium avium subsp. paratuberculosis
ccaacggcucgccgcg

SEQ ID NO: 959520 - RNA, 17 nt, Mycobacterium avium subsp. paratuberculosis
ccaacggcucgccgcgc

SEQ ID NO: 959521 - RNA, 20 nt, Mycobacterium avium subsp. paratuberculosis
ccaacgggaagagcggcgug

SEQ ID NO: 959522 - RNA, 21 nt, Mycobacterium avium subsp. paratuberculosis
ccaacgggaagagcggcguga

SEQ ID NO: 959523 - RNA, 18 nt, Mycobacterium avium subsp. paratuberculosis
ccaacgguucggccgcuc

SEQ ID NO: 959524 - RNA, 19 nt, Mycobacterium avium subsp. paratuberculosis
ccaacgguucggccgcucg

SEQ ID NO: 959525 - RNA, 23 nt, Mycobacterium avium subsp. paratuberculosis
ccaacgguuuccaccaccacccg

SEQ ID NO: 959526 - RNA, 16 nt, Mycobacterium avium subsp. paratuberculosis
ccaacgugaugagcgc

SEQ ID NO: 959527 - RNA, 22 nt, Mycobacterium avium subsp. paratuberculosis
ccaacagcagcgccgcggccgg

SEQ ID NO: 959528 - RNA, 22 nt, Mycobacterium avium subsp. paratuberculosis
ccaacagcggcccgaucaccgc

SEQ ID NO: 959529 - RNA, 12 nt, Mycobacterium avium subsp. paratuberculosis
ccaacagcucgc

SEQ ID NO: 959530 - RNA, 16 nt, Mycobacterium avium subsp. paratuberculosis
ccaacagcucgcgggc

SEQ ID NO: 959531 - RNA, 17 nt, Mycobacterium avium subsp. paratuberculosis
ccaacaggucggcgugc

SEQ ID NO: 959532 - RNA, 19 nt, Mycobacterium avium subsp. paratuberculosis
ccaacaggucggcgugcag

SEQ ID NO: 959533 - RNA, 20 nt, Mycobacterium avium subsp. paratuberculosis
ccaacaggugcuuggucagc

SEQ ID NO: 959534 - RNA, 15 nt, Mycobacterium avium subsp. paratuberculosis
ccaacaugaucggcg

SEQ ID NO: 959535 - RNA, 18 nt, Mycobacterium avium subsp. paratuberculosis
ccaaccaccguggcccca

SEQ ID NO: 959536 - RNA, 15 nt, Mycobacterium avium subsp. paratuberculosis
ccaaauagccgucgg

SEQ ID NO: 959537 - RNA, 17 nt, Mycobacterium avium subsp. paratuberculosis
ccaaagacguugaccgc

SEQ ID NO: 959538 - RNA, 23 nt, Mycobacterium avium subsp. paratuberculosis
caugccguucagcgcggccaccu

SEQ ID NO: 959539 - RNA, 21 nt, Mycobacterium avium subsp. paratuberculosis
caugccguagcggucgcccca

SEQ ID NO: 959540 - RNA, 15 nt, Mycobacterium avium subsp. paratuberculosis
caugccgucggcgcc

SEQ ID NO: 959541 - RNA, 14 nt, Mycobacterium avium subsp. paratuberculosis
caugccgucgacga

SEQ ID NO: 959542 - RNA, 19 nt, Mycobacterium avium subsp. paratuberculosis
caugccgucgcgcaccgca

SEQ ID NO: 959543 - RNA, 23 nt, Mycobacterium avium subsp. paratuberculosis
caugccguaaguggcgccgcggu

SEQ ID NO: 959544 - RNA, 23 nt, Mycobacterium avium subsp. paratuberculosis
caugccggugucggugcgacccg

SEQ ID NO: 959545 - RNA, 12 nt, Mycobacterium avium subsp. paratuberculosis
caugccgggcag

SEQ ID NO: 959546 - RNA, 20 nt, Mycobacterium avium subsp. paratuberculosis
caugccgggccagccggccc

SEQ ID NO: 959547 - RNA, 18 nt, Mycobacterium avium subsp. paratuberculosis
caugccggguuucggccc

SEQ ID NO: 959548 - RNA, 21 nt, Mycobacterium avium subsp. paratuberculosis
caugccggguuucggcccggc

SEQ ID NO: 959549 - RNA, 23 nt, Mycobacterium avium subsp. paratuberculosis
caugccggguuucggcccggcuc

SEQ ID NO: 959550 - RNA, 17 nt, Mycobacterium avium subsp. paratuberculosis
aaagccgguggcagccc

SEQ ID NO: 959551 - RNA, 18 nt, Mycobacterium avium subsp. paratuberculosis
aaagccgguggcagcccg

SEQ ID NO: 959552 - RNA, 15 nt, Mycobacterium avium subsp. paratuberculosis
aaagcgaccagcgcg

SEQ ID NO: 959553 - RNA, 20 nt, Mycobacterium avium subsp. paratuberculosis
aaagcggcuaagccggcguc

SEQ ID NO: 959554 - RNA, 20 nt, Mycobacterium avium subsp. paratuberculosis
ccaaugcgcccugguugauc

SEQ ID NO: 959555 - RNA, 13 nt, Mycobacterium avium subsp. paratuberculosis
ccaaugcgccggc

SEQ ID NO: 959556 - RNA, 15 nt, Mycobacterium avium subsp. paratuberculosis
ccaaugcgccggcgg

SEQ ID NO: 959557 - RNA, 14 nt, Mycobacterium avium subsp. paratuberculosis
ccaaugccggaucg

SEQ ID NO: 959558 - RNA, 14 nt, Mycobacterium avium subsp. paratuberculosis
ccacaccucggcga

SEQ ID NO: 959559 - RNA, 15 nt, Mycobacterium avium subsp. paratuberculosis
ccacaccucggcgac

SEQ ID NO: 959560 - RNA, 21 nt, Mycobacterium avium subsp. paratuberculosis
ccacaagggccaccgggccga

SEQ ID NO: 959561 - RNA, 21 nt, Mycobacterium avium subsp. paratuberculosis
ccacaacgucucugucgucga

SEQ ID NO: 959562 - RNA, 17 nt, Mycobacterium avium subsp. paratuberculosis
ccaagccauuucagcag

SEQ ID NO: 959563 - RNA, 18 nt, Mycobacterium avium subsp. paratuberculosis
ccaagccauuucagcagc

SEQ ID NO: 959564 - RNA, 19 nt, Mycobacterium avium subsp. paratuberculosis
ccaagccauuucagcagcg

SEQ ID NO: 959565 - RNA, 21 nt, Mycobacterium avium subsp. paratuberculosis
ccaagccauuucagcagcgcg

SEQ ID NO: 959566 - RNA, 22 nt, Mycobacterium avium subsp. paratuberculosis
ccaagccauuucagcagcgcgg

SEQ ID NO: 959567 - RNA, 16 nt, Mycobacterium avium subsp. paratuberculosis
ccaaggccagcaaccg

SEQ ID NO: 959568 - RNA, 15 nt, Mycobacterium avium subsp. paratuberculosis
ccaaggucgccggug

SEQ ID NO: 959569 - RNA, 22 nt, Mycobacterium avium subsp. paratuberculosis
ccaaggggaggggacgggacgu

SEQ ID NO: 959570 - RNA, 16 nt, Mycobacterium avium subsp. paratuberculosis
ccaaggcggacaacgg

SEQ ID NO: 959571 - RNA, 12 nt, Mycobacterium avium subsp. paratuberculosis
ccaagugcgguc

SEQ ID NO: 959572 - RNA, 17 nt, Mycobacterium avium subsp. paratuberculosis
ccaagugcggucgguuc

SEQ ID NO: 959573 - RNA, 20 nt, Mycobacterium avium subsp. paratuberculosis
ccaagucgagaucgucgugg

SEQ ID NO: 959574 - RNA, 14 nt, Mycobacterium avium subsp. paratuberculosis
ccaaggugcgguga

SEQ ID NO: 959575 - RNA, 11 nt, Mycobacterium avium subsp. paratuberculosis
ccaauccucgc

SEQ ID NO: 959576 - RNA, 14 nt, Mycobacterium avium subsp. paratuberculosis
ccaauccucgccga

SEQ ID NO: 959577 - RNA, 15 nt, Mycobacterium avium subsp. paratuberculosis
ccaauccucgccgag

SEQ ID NO: 959578 - RNA, 13 nt, Mycobacterium avium subsp. paratuberculosis
ccaauccggcggg

SEQ ID NO: 959579 - RNA, 22 nt, Mycobacterium avium subsp. paratuberculosis
ccaauccggcgggccucgccgc

SEQ ID NO: 959580 - RNA, 23 nt, Mycobacterium avium subsp. paratuberculosis
ccaaucggugcggaaggcccccg

SEQ ID NO: 959581 - RNA, 13 nt, Mycobacterium avium subsp. paratuberculosis
caugaaggcgacg

SEQ ID NO: 959582 - RNA, 18 nt, Mycobacterium avium subsp. paratuberculosis
caugaaggcgacgucggu

SEQ ID NO: 959583 - RNA, 16 nt, Mycobacterium avium subsp. paratuberculosis
caugaacggcagcucg

SEQ ID NO: 959584 - RNA, 17 nt, Mycobacterium avium subsp. paratuberculosis
caugaacggcagcucgu

SEQ ID NO: 959585 - RNA, 20 nt, Mycobacterium avium subsp. paratuberculosis
caugaagccguugccgccgc

SEQ ID NO: 959586 - RNA, 21 nt, Mycobacterium avium subsp. paratuberculosis
caugaagccguugccgccgcg

SEQ ID NO: 959587 - RNA, 14 nt, Mycobacterium avium subsp. paratuberculosis
caugaccaccgcgu

SEQ ID NO: 959588 - RNA, 16 nt, Mycobacterium avium subsp. paratuberculosis
caugaccaccgcgucg

SEQ ID NO: 959589 - RNA, 20 nt, Mycobacterium avium subsp. paratuberculosis
caugaccgauccgccggcga

SEQ ID NO: 959590 - RNA, 20 nt, Mycobacterium avium subsp. paratuberculosis
caugaccaugucgacgcuga

SEQ ID NO: 959591 - RNA, 17 nt, Mycobacterium avium subsp. paratuberculosis
caugacggccugcacca

SEQ ID NO: 959592 - RNA, 17 nt, Mycobacterium avium subsp. paratuberculosis
caugagcuaggucaccg

SEQ ID NO: 959593 - RNA, 18 nt, Mycobacterium avium subsp. paratuberculosis
caugagcuaggucaccgg

SEQ ID NO: 959594 - RNA, 19 nt, Mycobacterium avium subsp. paratuberculosis
caugagcuaggucaccgga

SEQ ID NO: 959595 - RNA, 17 nt, Mycobacterium avium subsp. paratuberculosis
caugagcagaccgaacc

SEQ ID NO: 959596 - RNA, 18 nt, Mycobacterium avium subsp. paratuberculosis
caugaacaucggccgggu

SEQ ID NO: 959597 - RNA, 14 nt, Mycobacterium avium subsp. paratuberculosis
caugaacgccgggu

SEQ ID NO: 959598 - RNA, 15 nt, Mycobacterium avium subsp. paratuberculosis
caugaacgccggguc

SEQ ID NO: 959599 - RNA, 16 nt, Mycobacterium avium subsp. paratuberculosis
caugaacgccgggucc

SEQ ID NO: 959600 - RNA, 14 nt, Mycobacterium avium subsp. paratuberculosis
caugaacgcgucgc

SEQ ID NO: 959601 - RNA, 15 nt, Mycobacterium avium subsp. paratuberculosis
caugaaccaggccgc

SEQ ID NO: 959602 - RNA, 22 nt, Mycobacterium avium subsp. paratuberculosis
caucugcuugaugaugucggcg

SEQ ID NO: 959603 - RNA, 17 nt, Mycobacterium avium subsp. paratuberculosis
caucuggccgcgggugc

SEQ ID NO: 959604 - RNA, 19 nt, Mycobacterium avium subsp. paratuberculosis
caucuucaguucggccggc

SEQ ID NO: 959605 - RNA, 17 nt, Mycobacterium avium subsp. paratuberculosis
caugccgaugcccauca

SEQ ID NO: 959606 - RNA, 19 nt, Mycobacterium avium subsp. paratuberculosis
caugccgaugcccaucacg

SEQ ID NO: 959607 - RNA, 23 nt, Mycobacterium avium subsp. paratuberculosis
caugccgaugcccaucacgcccc

SEQ ID NO: 959608 - RNA, 16 nt, Mycobacterium avium subsp. paratuberculosis
caugccgcccaucacc

SEQ ID NO: 959609 - RNA, 16 nt, Mycobacterium avium subsp. paratuberculosis
caugccgccgaccgcc

SEQ ID NO: 959610 - RNA, 17 nt, Mycobacterium avium subsp. paratuberculosis
caugccgccgaccgccg

SEQ ID NO: 959611 - RNA, 20 nt, Mycobacterium avium subsp. paratuberculosis
caugccgccgaccgccgagc

SEQ ID NO: 959612 - RNA, 21 nt, Mycobacterium avium subsp. paratuberculosis
caugccgccgaccgccgagcg

SEQ ID NO: 959613 - RNA, 12 nt, Mycobacterium avium subsp. paratuberculosis
caugccggccgg

SEQ ID NO: 959614 - RNA, 13 nt, Mycobacterium avium subsp. paratuberculosis
caugccggccggc

SEQ ID NO: 959615 - RNA, 15 nt, Mycobacterium avium subsp. paratuberculosis
caugccggccggcac

SEQ ID NO: 959616 - RNA, 11 nt, Mycobacterium avium subsp. paratuberculosis
caugccggccu

SEQ ID NO: 959617 - RNA, 13 nt, Mycobacterium avium subsp. paratuberculosis
caugccgcccggg

SEQ ID NO: 959618 - RNA, 12 nt, Mycobacterium avium subsp. paratuberculosis
caugccggcgcc

SEQ ID NO: 959619 - RNA, 20 nt, Mycobacterium avium subsp. paratuberculosis
caugccgcgcucgucgauca

SEQ ID NO: 959620 - RNA, 22 nt, Mycobacterium avium subsp. paratuberculosis
caugccgcgcuugguggcgacg

SEQ ID NO: 959621 - RNA, 13 nt, Mycobacterium avium subsp. paratuberculosis
caugcccggcgac

SEQ ID NO: 959622 - RNA, 14 nt, Mycobacterium avium subsp. paratuberculosis
caugcccggcgacg

SEQ ID NO: 959623 - RNA, 13 nt, Mycobacterium avium subsp. paratuberculosis
caugcccgggcga

SEQ ID NO: 959624 - RNA, 16 nt, Mycobacterium avium subsp. paratuberculosis
caugccgagcagcacc

SEQ ID NO: 959625 - RNA, 19 nt, Mycobacterium avium subsp. paratuberculosis
caugccgagcagcaccgcg

SEQ ID NO: 959626 - RNA, 20 nt, Mycobacterium avium subsp. paratuberculosis
caugccgagcagcaccgcga

SEQ ID NO: 959627 - RNA, 21 nt, Mycobacterium avium subsp. paratuberculosis
caugccgagcagcaccgcgac

SEQ ID NO: 959628 - RNA, 20 nt, Mycobacterium avium subsp. paratuberculosis
caugcccaccaucccgccgc

SEQ ID NO: 959629 - RNA, 17 nt, Mycobacterium avium subsp. paratuberculosis
caugcccacgccgucga

SEQ ID NO: 959630 - RNA, 19 nt, Mycobacterium avium subsp. paratuberculosis
caugcccacgccgucgacc

SEQ ID NO: 959631 - RNA, 18 nt, Mycobacterium avium subsp. paratuberculosis
caugcccaugucgaucgg

SEQ ID NO: 959632 - RNA, 22 nt, Mycobacterium avium subsp. paratuberculosis
caugccccaggugacgccgcac

SEQ ID NO: 959633 - RNA, 14 nt, Mycobacterium avium subsp. paratuberculosis
caugcaccggugca

SEQ ID NO: 959634 - RNA, 16 nt, Mycobacterium avium subsp. paratuberculosis
caugcaccggugcacc

SEQ ID NO: 959635 - RNA, 19 nt, Mycobacterium avium subsp. paratuberculosis
caugcaccggugcaccgcg

SEQ ID NO: 959636 - RNA, 12 nt, Mycobacterium avium subsp. paratuberculosis
caugccacuugc

SEQ ID NO: 959637 - RNA, 20 nt, Mycobacterium avium subsp. paratuberculosis
caugccacuugcgcacguac

SEQ ID NO: 959638 - RNA, 15 nt, Mycobacterium avium subsp. paratuberculosis
caugcagccgccgcg

SEQ ID NO: 959639 - RNA, 12 nt, Mycobacterium avium subsp. paratuberculosis
caugcacggcgc

SEQ ID NO: 959640 - RNA, 20 nt, Mycobacterium avium subsp. paratuberculosis
caugcacggcgcuggcgacc

SEQ ID NO: 959641 - RNA, 15 nt, Mycobacterium avium subsp. paratuberculosis
caugcagaccagccc

SEQ ID NO: 959642 - RNA, 19 nt, Mycobacterium avium subsp. paratuberculosis
caugaucgccaguccggcg

SEQ ID NO: 959643 - RNA, 15 nt, Mycobacterium avium subsp. paratuberculosis
caugaucgcccgcuc

SEQ ID NO: 959644 - RNA, 23 nt, Mycobacterium avium subsp. paratuberculosis
caugaucgcccgcuccgcggugc

SEQ ID NO: 959645 - RNA, 21 nt, Mycobacterium avium subsp. paratuberculosis
caugaucggcaggauccgguc

SEQ ID NO: 959646 - RNA, 23 nt, Mycobacterium avium subsp. paratuberculosis
caugaucggcaggauccggucga

SEQ ID NO: 959647 - RNA, 23 nt, Mycobacterium avium subsp. paratuberculosis
caucgcugccacguacaccggga

SEQ ID NO: 959648 - RNA, 22 nt, Mycobacterium avium subsp. paratuberculosis
caucgcugccguccacccggcc

SEQ ID NO: 959649 - RNA, 22 nt, Mycobacterium avium subsp. paratuberculosis
caucgcuggggugcccaccagc

SEQ ID NO: 959650 - RNA, 17 nt, Mycobacterium avium subsp. paratuberculosis
caucgcugguggccgac

SEQ ID NO: 959651 - RNA, 18 nt, Mycobacterium avium subsp. paratuberculosis
caucggaugccggggcag

SEQ ID NO: 959652 - RNA, 14 nt, Mycobacterium avium subsp. paratuberculosis
caucggcacgccgg

SEQ ID NO: 959653 - RNA, 15 nt, Mycobacterium avium subsp. paratuberculosis
caucggcacgccggg

SEQ ID NO: 959654 - RNA, 17 nt, Mycobacterium avium subsp. paratuberculosis
caucggcacgccggggc

SEQ ID NO: 959655 - RNA, 13 nt, Mycobacterium avium subsp. paratuberculosis
caucggcagaucg

SEQ ID NO: 959656 - RNA, 14 nt, Mycobacterium avium subsp. paratuberculosis
caucggcagcccgg

SEQ ID NO: 959657 - RNA, 18 nt, Mycobacterium avium subsp. paratuberculosis
caucggcaguccgcgccg

SEQ ID NO: 959658 - RNA, 21 nt, Mycobacterium avium subsp. paratuberculosis
caucggcaguccgcgccgguc

SEQ ID NO: 959659 - RNA, 16 nt, Mycobacterium avium subsp. paratuberculosis
caucggcacacgcgga

SEQ ID NO: 959660 - RNA, 21 nt, Mycobacterium avium subsp. paratuberculosis
caucggagagcuugccgcgga

SEQ ID NO: 959661 - RNA, 13 nt, Mycobacterium avium subsp. paratuberculosis
caucggcaucgcg

SEQ ID NO: 959662 - RNA, 19 nt, Mycobacterium avium subsp. paratuberculosis
caucggcaucgcgcgcggc

SEQ ID NO: 959663 - RNA, 20 nt, Mycobacterium avium subsp. paratuberculosis
caucggcaucgcgcgcggcg

SEQ ID NO: 959664 - RNA, 12 nt, Mycobacterium avium subsp. paratuberculosis
caucggcgccug

SEQ ID NO: 959665 - RNA, 14 nt, Mycobacterium avium subsp. paratuberculosis
caucggcgcccucg

SEQ ID NO: 959666 - RNA, 17 nt, Mycobacterium avium subsp. paratuberculosis
caucggcgccgacgggg

SEQ ID NO: 959667 - RNA, 15 nt, Mycobacterium avium subsp. paratuberculosis
caucggcgacggcga

SEQ ID NO: 959668 - RNA, 24 nt, Mycobacterium avium subsp. paratuberculosis
caucggcgacggcgacggcguccg

SEQ ID NO: 959669 - RNA, 16 nt, Mycobacterium avium subsp. paratuberculosis
caucgguggcaccccg

SEQ ID NO: 959670 - RNA, 20 nt, Mycobacterium avium subsp. paratuberculosis
caucgguggcaccccgcgcc

SEQ ID NO: 959671 - RNA, 21 nt, Mycobacterium avium subsp. paratuberculosis
caucgguggcaccccgcgccg

SEQ ID NO: 959672 - RNA, 16 nt, Mycobacterium avium subsp. paratuberculosis
caucgguugcuccggc

SEQ ID NO: 959673 - RNA, 21 nt, Mycobacterium avium subsp. paratuberculosis
caucgguuugaccacggcgcg

SEQ ID NO: 959674 - RNA, 16 nt, Mycobacterium avium subsp. paratuberculosis
caucggguugccggcg

SEQ ID NO: 959675 - RNA, 14 nt, Mycobacterium avium subsp. paratuberculosis
caucgggucgucgg

SEQ ID NO: 959676 - RNA, 16 nt, Mycobacterium avium subsp. paratuberculosis
caucgggucgucggcg

SEQ ID NO: 959677 - RNA, 19 nt, Mycobacterium avium subsp. paratuberculosis
caucgggucgucggcgucg

SEQ ID NO: 959678 - RNA, 14 nt, Mycobacterium avium subsp. paratuberculosis
caucggugaccguc

SEQ ID NO: 959679 - RNA, 15 nt, Mycobacterium avium subsp. paratuberculosis
caucggugaccgucg

SEQ ID NO: 959680 - RNA, 21 nt, Mycobacterium avium subsp. paratuberculosis
caucggugaccgucgccgacc

SEQ ID NO: 959681 - RNA, 18 nt, Mycobacterium avium subsp. paratuberculosis
caucgggauuggcggcca

SEQ ID NO: 959682 - RNA, 23 nt, Mycobacterium avium subsp. paratuberculosis
caucgggguuuugaucagcccgg

SEQ ID NO: 959683 - RNA, 15 nt, Mycobacterium avium subsp. paratuberculosis
caucgggcccgacga

SEQ ID NO: 959684 - RNA, 17 nt, Mycobacterium avium subsp. paratuberculosis
caucgggcccgacgacg

SEQ ID NO: 959685 - RNA, 17 nt, Mycobacterium avium subsp. paratuberculosis
caucgggcgcaggucca

SEQ ID NO: 959686 - RNA, 19 nt, Mycobacterium avium subsp. paratuberculosis
caucgggacgccugccgcc

SEQ ID NO: 959687 - RNA, 17 nt, Mycobacterium avium subsp. paratuberculosis
caucggcuggucggcgg

SEQ ID NO: 959688 - RNA, 18 nt, Mycobacterium avium subsp. paratuberculosis
caucggcuggucggcggc

SEQ ID NO: 959689 - RNA, 12 nt, Mycobacterium avium subsp. paratuberculosis
caucuccagccg

SEQ ID NO: 959690 - RNA, 13 nt, Mycobacterium avium subsp. paratuberculosis
caucuccagcgcg

SEQ ID NO: 959691 - RNA, 22 nt, Mycobacterium avium subsp. paratuberculosis
caucuccagcgcggucucgauc

SEQ ID NO: 959692 - RNA, 22 nt, Mycobacterium avium subsp. paratuberculosis
caucucagcguucacgucgauc

SEQ ID NO: 959693 - RNA, 13 nt, Mycobacterium avium subsp. paratuberculosis
caucuccgagucg

SEQ ID NO: 959694 - RNA, 17 nt, Mycobacterium avium subsp. paratuberculosis
caucuccugcacgcgcg

SEQ ID NO: 959695 - RNA, 18 nt, Mycobacterium avium subsp. paratuberculosis
caucuccugcacgcgcgg

SEQ ID NO: 959696 - RNA, 22 nt, Mycobacterium avium subsp. paratuberculosis
caucuccugcacgcgcgggucg

SEQ ID NO: 959697 - RNA, 14 nt, Mycobacterium avium subsp. paratuberculosis
caucuccguggacg

SEQ ID NO: 959698 - RNA, 20 nt, Mycobacterium avium subsp. paratuberculosis
caucuccguggacggcgagc

SEQ ID NO: 959699 - RNA, 17 nt, Mycobacterium avium subsp. paratuberculosis
caucucgaaugcggcug

SEQ ID NO: 959700 - RNA, 15 nt, Mycobacterium avium subsp. paratuberculosis
caucucgacccgggc

SEQ ID NO: 959701 - RNA, 14 nt, Mycobacterium avium subsp. paratuberculosis
caucucgacgguga

SEQ ID NO: 959702 - RNA, 23 nt, Mycobacterium avium subsp. paratuberculosis
caucucgacggugaccggcucga

SEQ ID NO: 959703 - RNA, 13 nt, Mycobacterium avium subsp. paratuberculosis
caucucggccgga

SEQ ID NO: 959704 - RNA, 12 nt, Mycobacterium avium subsp. paratuberculosis
caucucggcggc

SEQ ID NO: 959705 - RNA, 13 nt, Mycobacterium avium subsp. paratuberculosis
caucucgugcccg

SEQ ID NO: 959706 - RNA, 16 nt, Mycobacterium avium subsp. paratuberculosis
caucucgugcccgggc

SEQ ID NO: 959707 - RNA, 20 nt, Mycobacterium avium subsp. paratuberculosis
caucucgugcccgggcccgu

SEQ ID NO: 959708 - RNA, 13 nt, Mycobacterium avium subsp. paratuberculosis
caucugcucggcg

SEQ ID NO: 959709 - RNA, 17 nt, Mycobacterium avium subsp. paratuberculosis
caucugcucggcgucca

SEQ ID NO: 959710 - RNA, 20 nt, Mycobacterium avium subsp. paratuberculosis
caucugccgggcggcgacgu

SEQ ID NO: 959711 - RNA, 13 nt, Mycobacterium avium subsp. paratuberculosis
caucuacgucguc

SEQ ID NO: 959712 - RNA, 17 nt, Mycobacterium avium subsp. paratuberculosis
caucgugugggcgcccg

SEQ ID NO: 959713 - RNA, 16 nt, Mycobacterium avium subsp. paratuberculosis
caucguugccggcggc

SEQ ID NO: 959714 - RNA, 17 nt, Mycobacterium avium subsp. paratuberculosis
caucguugccggcggcg

SEQ ID NO: 959715 - RNA, 19 nt, Mycobacterium avium subsp. paratuberculosis
caucguucccugcgcggcg

SEQ ID NO: 959716 - RNA, 20 nt, Mycobacterium avium subsp. paratuberculosis
caucguucccugcgcggcga

SEQ ID NO: 959717 - RNA, 22 nt, Mycobacterium avium subsp. paratuberculosis
caucgucuuccccguugucguu

SEQ ID NO: 959718 - RNA, 13 nt, Mycobacterium avium subsp. paratuberculosis
caucgugacgcga

SEQ ID NO: 959719 - RNA, 21 nt, Mycobacterium avium subsp. paratuberculosis
caucgugaucgcccaccuggu

SEQ ID NO: 959720 - RNA, 21 nt, Mycobacterium avium subsp. paratuberculosis
caucgucuccgcugucgucgu

SEQ ID NO: 959721 - RNA, 16 nt, Mycobacterium avium subsp. paratuberculosis
caucgucucggaccgg

SEQ ID NO: 959722 - RNA, 14 nt, Mycobacterium avium subsp. paratuberculosis
caucguggcgacga

SEQ ID NO: 959723 - RNA, 18 nt, Mycobacterium avium subsp. paratuberculosis
caucguggcgacgacgcc

SEQ ID NO: 959724 - RNA, 15 nt, Mycobacterium avium subsp. paratuberculosis
caucguggcgcgacg

SEQ ID NO: 959725 - RNA, 17 nt, Mycobacterium avium subsp. paratuberculosis
caucguggcgcgacgcg

SEQ ID NO: 959726 - RNA, 23 nt, Mycobacterium avium subsp. paratuberculosis
caucgugggcgccgucgccgccg

SEQ ID NO: 959727 - RNA, 20 nt, Mycobacterium avium subsp. paratuberculosis
caucgucaaagccguucgcg

SEQ ID NO: 959728 - RNA, 18 nt, Mycobacterium avium subsp. paratuberculosis
caucgucacuucgccggg

SEQ ID NO: 959729 - RNA, 19 nt, Mycobacterium avium subsp. paratuberculosis
caucgucacuucgccgggc

SEQ ID NO: 959730 - RNA, 12 nt, Mycobacterium avium subsp. paratuberculosis
caucgucggcgc

SEQ ID NO: 959731 - RNA, 14 nt, Mycobacterium avium subsp. paratuberculosis
caucgucggcgccg

SEQ ID NO: 959732 - RNA, 16 nt, Mycobacterium avium subsp. paratuberculosis
caucgucggcgccggc

SEQ ID NO: 959733 - RNA, 18 nt, Mycobacterium avium subsp. paratuberculosis
caucgucggcgccggcgc

SEQ ID NO: 959734 - RNA, 19 nt, Mycobacterium avium subsp. paratuberculosis
caucgucggcgccggcgcg

SEQ ID NO: 959735 - RNA, 20 nt, Mycobacterium avium subsp. paratuberculosis
caucgucggcgccggcgcgc

SEQ ID NO: 959736 - RNA, 14 nt, Mycobacterium avium subsp. paratuberculosis
caucgucggggacg

SEQ ID NO: 959737 - RNA, 16 nt, Mycobacterium avium subsp. paratuberculosis
caucgucgucaccucg

SEQ ID NO: 959738 - RNA, 14 nt, Mycobacterium avium subsp. paratuberculosis
caucgucguuggcg

SEQ ID NO: 959739 - RNA, 17 nt, Mycobacterium avium subsp. paratuberculosis
cauaacgcucccgguag

SEQ ID NO: 959740 - RNA, 14 nt, Mycobacterium avium subsp. paratuberculosis
cagugucguggcga

SEQ ID NO: 959741 - RNA, 22 nt, Mycobacterium avium subsp. paratuberculosis
cagugucguggcgacaucgccg

SEQ ID NO: 959742 - RNA, 20 nt, Mycobacterium avium subsp. paratuberculosis
caguguccagucggccguga

SEQ ID NO: 959743 - RNA, 14 nt, Mycobacterium avium subsp. paratuberculosis
cagugucacugcgg

SEQ ID NO: 959744 - RNA, 15 nt, Mycobacterium avium subsp. paratuberculosis
caguguccgaucgcc

SEQ ID NO: 959745 - RNA, 16 nt, Mycobacterium avium subsp. paratuberculosis
caguguccgaucgccu

SEQ ID NO: 959746 - RNA, 17 nt, Mycobacterium avium subsp. paratuberculosis
caguguccgaucgccuc

SEQ ID NO: 959747 - RNA, 19 nt, Mycobacterium avium subsp. paratuberculosis
caguguccgaucgccuccu

SEQ ID NO: 959748 - RNA, 15 nt, Mycobacterium avium subsp. paratuberculosis
caguguggccgcggc

SEQ ID NO: 959749 - RNA, 11 nt, Mycobacterium avium subsp. paratuberculosis
cauacggcggc

SEQ ID NO: 959750 - RNA, 15 nt, Mycobacterium avium subsp. paratuberculosis
cauacggcggcucgg

SEQ ID NO: 959751 - RNA, 19 nt, Mycobacterium avium subsp. paratuberculosis
cauacgccucaccccagcg

SEQ ID NO: 959752 - RNA, 20 nt, Mycobacterium avium subsp. paratuberculosis
cauacgccucaccccagcgc

SEQ ID NO: 959753 - RNA, 11 nt, Mycobacterium avium subsp. paratuberculosis
cauacgcggcg

SEQ ID NO: 959754 - RNA, 12 nt, Mycobacterium avium subsp. paratuberculosis
cauacgcggcgg

SEQ ID NO: 959755 - RNA, 14 nt, Mycobacterium avium subsp. paratuberculosis
cauacgcggcggcc

SEQ ID NO: 959756 - RNA, 19 nt, Mycobacterium avium subsp. paratuberculosis
cauacaccgggaucggcgg

SEQ ID NO: 959757 - RNA, 20 nt, Mycobacterium avium subsp. paratuberculosis
cauacaccgggaucggcggc

SEQ ID NO: 959758 - RNA, 22 nt, Mycobacterium avium subsp. paratuberculosis
cauacaccgggaucggcggcgg

SEQ ID NO: 959759 - RNA, 17 nt, Mycobacterium avium subsp. paratuberculosis
cauacaccuugucggcg

SEQ ID NO: 959760 - RNA, 18 nt, Mycobacterium avium subsp. paratuberculosis
cauaccgggacaucgucg

SEQ ID NO: 959761 - RNA, 19 nt, Mycobacterium avium subsp. paratuberculosis
cauaccgggacaucgucgc

SEQ ID NO: 959762 - RNA, 20 nt, Mycobacterium avium subsp. paratuberculosis
cauaccgggacaucgucgcg

SEQ ID NO: 959763 - RNA, 20 nt, Mycobacterium avium subsp. paratuberculosis
cauagauaccggccagcacg

SEQ ID NO: 959764 - RNA, 15 nt, Mycobacterium avium subsp. paratuberculosis
cauagccggccgcgu

SEQ ID NO: 959765 - RNA, 16 nt, Mycobacterium avium subsp. paratuberculosis
cauagccggccgcguc

SEQ ID NO: 959766 - RNA, 17 nt, Mycobacterium avium subsp. paratuberculosis
cauagccggccgcgucg

SEQ ID NO: 959767 - RNA, 18 nt, Mycobacterium avium subsp. paratuberculosis
cauagccggccgcgucgc

SEQ ID NO: 959768 - RNA, 14 nt, Mycobacterium avium subsp. paratuberculosis
caucacggugccga

SEQ ID NO: 959769 - RNA, 15 nt, Mycobacterium avium subsp. paratuberculosis
caucacggugccgag

SEQ ID NO: 959770 - RNA, 14 nt, Mycobacterium avium subsp. paratuberculosis
caucacgguggccg

SEQ ID NO: 959771 - RNA, 21 nt, Mycobacterium avium subsp. paratuberculosis
caucagcaccgccucggccac

SEQ ID NO: 959772 - RNA, 17 nt, Mycobacterium avium subsp. paratuberculosis
caucagcccggugacga

SEQ ID NO: 959773 - RNA, 16 nt, Mycobacterium avium subsp. paratuberculosis
caucacgauggugccc

SEQ ID NO: 959774 - RNA, 17 nt, Mycobacterium avium subsp. paratuberculosis
caucacgauggugcccg

SEQ ID NO: 959775 - RNA, 22 nt, Mycobacterium avium subsp. paratuberculosis
caucacgaacgcguucgucggc

SEQ ID NO: 959776 - RNA, 24 nt, Mycobacterium avium subsp. paratuberculosis
caucacgaacgcguucgucggcgc

SEQ ID NO: 959777 - RNA, 22 nt, Mycobacterium avium subsp. paratuberculosis
caucaccuucugcgcgccgucg

SEQ ID NO: 959778 - RNA, 18 nt, Mycobacterium avium subsp. paratuberculosis
caucaccuucugcgucgg

SEQ ID NO: 959779 - RNA, 13 nt, Mycobacterium avium subsp. paratuberculosis
caucaccuugucg

SEQ ID NO: 959780 - RNA, 19 nt, Mycobacterium avium subsp. paratuberculosis
caucaccuugucgcugacc

SEQ ID NO: 959781 - RNA, 21 nt, Mycobacterium avium subsp. paratuberculosis
caucaccaaccgcucggcgau

SEQ ID NO: 959782 - RNA, 14 nt, Mycobacterium avium subsp. paratuberculosis
caucaccacgcugu

SEQ ID NO: 959783 - RNA, 16 nt, Mycobacterium avium subsp. paratuberculosis
caucaccggcgcgccg

SEQ ID NO: 959784 - RNA, 20 nt, Mycobacterium avium subsp. paratuberculosis
caucaccggggaucaccucg

SEQ ID NO: 959785 - RNA, 14 nt, Mycobacterium avium subsp. paratuberculosis
caucagcgacguca

SEQ ID NO: 959786 - RNA, 14 nt, Mycobacterium avium subsp. paratuberculosis
caucagcgccacca

SEQ ID NO: 959787 - RNA, 16 nt, Mycobacterium avium subsp. paratuberculosis
caucagcgccaccagc

SEQ ID NO: 959788 - RNA, 16 nt, Mycobacterium avium subsp. paratuberculosis
caucagcgcccgcgcg

SEQ ID NO: 959789 - RNA, 22 nt, Mycobacterium avium subsp. paratuberculosis
caucagcgcccgcgcgggcugc

SEQ ID NO: 959790 - RNA, 18 nt, Mycobacterium avium subsp. paratuberculosis
caucagccgccgucgcgc

SEQ ID NO: 959791 - RNA, 17 nt, Mycobacterium avium subsp. paratuberculosis
caucagccugcggugau

SEQ ID NO: 959792 - RNA, 17 nt, Mycobacterium avium subsp. paratuberculosis
caucaggaugcccgggc

SEQ ID NO: 959793 - RNA, 13 nt, Mycobacterium avium subsp. paratuberculosis
caucagcucggca

SEQ ID NO: 959794 - RNA, 19 nt, Mycobacterium avium subsp. paratuberculosis
caucagcucggcagccccg

SEQ ID NO: 959795 - RNA, 20 nt, Mycobacterium avium subsp. paratuberculosis
caucagcucggcagccccgu

SEQ ID NO: 959796 - RNA, 21 nt, Mycobacterium avium subsp. paratuberculosis
caucagcucggcagccccguc

SEQ ID NO: 959797 - RNA, 13 nt, Mycobacterium avium subsp. paratuberculosis
caucagcucggcg

SEQ ID NO: 959798 - RNA, 16 nt, Mycobacterium avium subsp. paratuberculosis
caucagcucggcggcc

SEQ ID NO: 959799 - RNA, 14 nt, Mycobacterium avium subsp. paratuberculosis
caucagcucgucag

SEQ ID NO: 959800 - RNA, 20 nt, Mycobacterium avium subsp. paratuberculosis
caucagggccagccgaugcg

SEQ ID NO: 959801 - RNA, 13 nt, Mycobacterium avium subsp. paratuberculosis
caucaggcggccg

SEQ ID NO: 959802 - RNA, 20 nt, Mycobacterium avium subsp. paratuberculosis
caucagggcguugaucacga

SEQ ID NO: 959803 - RNA, 20 nt, Mycobacterium avium subsp. paratuberculosis
cauccaggugaacagcagcc

SEQ ID NO: 959804 - RNA, 13 nt, Mycobacterium avium subsp. paratuberculosis
cauccagucggcg

SEQ ID NO: 959805 - RNA, 16 nt, Mycobacterium avium subsp. paratuberculosis
cauccagugcaguucg

SEQ ID NO: 959806 - RNA, 20 nt, Mycobacterium avium subsp. paratuberculosis
caucaggucggugccgcggc

SEQ ID NO: 959807 - RNA, 13 nt, Mycobacterium avium subsp. paratuberculosis
caucagcggcucg

SEQ ID NO: 959808 - RNA, 17 nt, Mycobacterium avium subsp. paratuberculosis
cauccaggaccgcgcgc

SEQ ID NO: 959809 - RNA, 21 nt, Mycobacterium avium subsp. paratuberculosis
cauccaggaccgcgcgccggc

SEQ ID NO: 959810 - RNA, 19 nt, Mycobacterium avium subsp. paratuberculosis
cauccaggccagcaccugg

SEQ ID NO: 959811 - RNA, 22 nt, Mycobacterium avium subsp. paratuberculosis
cauccaggccagcaccuggcgc

SEQ ID NO: 959812 - RNA, 22 nt, Mycobacterium avium subsp. paratuberculosis
cauccgccacccgcugcucgac

SEQ ID NO: 959813 - RNA, 14 nt, Mycobacterium avium subsp. paratuberculosis
cauccgcaccgaga

SEQ ID NO: 959814 - RNA, 13 nt, Mycobacterium avium subsp. paratuberculosis
cauccgcagcccg

SEQ ID NO: 959815 - RNA, 16 nt, Mycobacterium avium subsp. paratuberculosis
cauccgcagcccgucg

SEQ ID NO: 959816 - RNA, 17 nt, Mycobacterium avium subsp. paratuberculosis
caucccuagcgugccgu

SEQ ID NO: 959817 - RNA, 19 nt, Mycobacterium avium subsp. paratuberculosis
caucccgugcggagaucgu

SEQ ID NO: 959818 - RNA, 22 nt, Mycobacterium avium subsp. paratuberculosis
caucccguugcgcaugacggcc

SEQ ID NO: 959819 - RNA, 14 nt, Mycobacterium avium subsp. paratuberculosis
caucccggugccgc

SEQ ID NO: 959820 - RNA, 22 nt, Mycobacterium avium subsp. paratuberculosis
caucccgguggacgcgauggcg

SEQ ID NO: 959821 - RNA, 16 nt, Mycobacterium avium subsp. paratuberculosis
caucccggggacaccg

SEQ ID NO: 959822 - RNA, 15 nt, Mycobacterium avium subsp. paratuberculosis
cauccgacaccgccu

SEQ ID NO: 959823 - RNA, 23 nt, Mycobacterium avium subsp. paratuberculosis
caucccuuccugggacagccggu

SEQ ID NO: 959824 - RNA, 16 nt, Mycobacterium avium subsp. paratuberculosis
cauccgggagacgucc

SEQ ID NO: 959825 - RNA, 23 nt, Mycobacterium avium subsp. paratuberculosis
cauccgggccaccaccacggccg

SEQ ID NO: 959826 - RNA, 22 nt, Mycobacterium avium subsp. paratuberculosis
cauccggcgggggaucgggaag

SEQ ID NO: 959827 - RNA, 21 nt, Mycobacterium avium subsp. paratuberculosis
cauccggcucagaaggcguca

SEQ ID NO: 959828 - RNA, 13 nt, Mycobacterium avium subsp. paratuberculosis
cauccggccggcg

SEQ ID NO: 959829 - RNA, 17 nt, Mycobacterium avium subsp. paratuberculosis
cauccggccggcgagga

SEQ ID NO: 959830 - RNA, 18 nt, Mycobacterium avium subsp. paratuberculosis
cauccgggccgccgcgga

SEQ ID NO: 959831 - RNA, 20 nt, Mycobacterium avium subsp. paratuberculosis
cauccgggcggccagccgcg

SEQ ID NO: 959832 - RNA, 15 nt, Mycobacterium avium subsp. paratuberculosis
cauccgguccagauc

SEQ ID NO: 959833 - RNA, 20 nt, Mycobacterium avium subsp. paratuberculosis
cauccgguccagaucggcgc

SEQ ID NO: 959834 - RNA, 16 nt, Mycobacterium avium subsp. paratuberculosis
cauccguucggcucug

SEQ ID NO: 959835 - RNA, 23 nt, Mycobacterium avium subsp. paratuberculosis
cauccguucggcucugcagagcg

SEQ ID NO: 959836 - RNA, 15 nt, Mycobacterium avium subsp. paratuberculosis
cauccgucgcccgcg

SEQ ID NO: 959837 - RNA, 16 nt, Mycobacterium avium subsp. paratuberculosis
cauccgguugcaccgc

SEQ ID NO: 959838 - RNA, 17 nt, Mycobacterium avium subsp. paratuberculosis
cauccgguugcaccgcg

SEQ ID NO: 959839 - RNA, 18 nt, Mycobacterium avium subsp. paratuberculosis
cauccgguugcaccgcga

SEQ ID NO: 959840 - RNA, 18 nt, Mycobacterium avium subsp. paratuberculosis
cauccggugccgagcgcg

SEQ ID NO: 959841 - RNA, 22 nt, Mycobacterium avium subsp. paratuberculosis
cauccggugccgagcgcgcuug

SEQ ID NO: 959842 - RNA, 17 nt, Mycobacterium avium subsp. paratuberculosis
caucgcgauggaagcgc

SEQ ID NO: 959843 - RNA, 14 nt, Mycobacterium avium subsp. paratuberculosis
caucgcgcgcggcg

SEQ ID NO: 959844 - RNA, 17 nt, Mycobacterium avium subsp. paratuberculosis
caucgcgcgcggcgacg

SEQ ID NO: 959845 - RNA, 16 nt, Mycobacterium avium subsp. paratuberculosis
caucgcgcgcggcggc

SEQ ID NO: 959846 - RNA, 22 nt, Mycobacterium avium subsp. paratuberculosis
caucgcgcgcggcggccaccgc

SEQ ID NO: 959847 - RNA, 21 nt, Mycobacterium avium subsp. paratuberculosis
caucgcgcaccagggccugca

SEQ ID NO: 959848 - RNA, 17 nt, Mycobacterium avium subsp. paratuberculosis
caucgccucggucgcgu

SEQ ID NO: 959849 - RNA, 20 nt, Mycobacterium avium subsp. paratuberculosis
caucgccugagcaaccgguu

SEQ ID NO: 959850 - RNA, 21 nt, Mycobacterium avium subsp. paratuberculosis
caucgccggcgcgcugaagcg

SEQ ID NO: 959851 - RNA, 16 nt, Mycobacterium avium subsp. paratuberculosis
caucgccucgaccagc

SEQ ID NO: 959852 - RNA, 17 nt, Mycobacterium avium subsp. paratuberculosis
caucgccucggccacca

SEQ ID NO: 959853 - RNA, 19 nt, Mycobacterium avium subsp. paratuberculosis
caucgccucggccaccaga

SEQ ID NO: 959854 - RNA, 14 nt, Mycobacterium avium subsp. paratuberculosis
caucgccucggccg

SEQ ID NO: 959855 - RNA, 17 nt, Mycobacterium avium subsp. paratuberculosis
caucgccucggccgcgg

SEQ ID NO: 959856 - RNA, 16 nt, Mycobacterium avium subsp. paratuberculosis
caucgccucggcggcc

SEQ ID NO: 959857 - RNA, 17 nt, Mycobacterium avium subsp. paratuberculosis
caucgccucggcggccg

SEQ ID NO: 959858 - RNA, 12 nt, Mycobacterium avium subsp. paratuberculosis
caucgcgucguc

SEQ ID NO: 959859 - RNA, 20 nt, Mycobacterium avium subsp. paratuberculosis
caucgcuacaccccaccgga

SEQ ID NO: 959860 - RNA, 20 nt, Mycobacterium avium subsp. paratuberculosis
caucgcggccgcccgguccg

SEQ ID NO: 959861 - RNA, 21 nt, Mycobacterium avium subsp. paratuberculosis
caucgcggccgcccgguccgg

SEQ ID NO: 959862 - RNA, 13 nt, Mycobacterium avium subsp. paratuberculosis
caucgcggcgacc

SEQ ID NO: 959863 - RNA, 17 nt, Mycobacterium avium subsp. paratuberculosis
caucgcggucagcgucu

SEQ ID NO: 959864 - RNA, 22 nt, Mycobacterium avium subsp. paratuberculosis
caucgcggcguuguggccaccg

SEQ ID NO: 959865 - RNA, 13 nt, Mycobacterium avium subsp. paratuberculosis
caucgcggcgauc

SEQ ID NO: 959866 - RNA, 14 nt, Mycobacterium avium subsp. paratuberculosis
caucgcggcgaugg

SEQ ID NO: 959867 - RNA, 17 nt, Mycobacterium avium subsp. paratuberculosis
caucgcgggccaccggc

SEQ ID NO: 959868 - RNA, 19 nt, Mycobacterium avium subsp. paratuberculosis
caucgcgggccaccggcgc

SEQ ID NO: 959869 - RNA, 17 nt, Mycobacterium avium subsp. paratuberculosis
caucgccaucagcagcg

SEQ ID NO: 959870 - RNA, 22 nt, Mycobacterium avium subsp. paratuberculosis
caucgccaggaaccacaccccg

SEQ ID NO: 959871 - RNA, 13 nt, Mycobacterium avium subsp. paratuberculosis
caucgccagcaca

SEQ ID NO: 959872 - RNA, 14 nt, Mycobacterium avium subsp. paratuberculosis
caucgccgcggugc

SEQ ID NO: 959873 - RNA, 22 nt, Mycobacterium avium subsp. paratuberculosis
caucgccgcgguggcgccgcgg

SEQ ID NO: 959874 - RNA, 13 nt, Mycobacterium avium subsp. paratuberculosis
caucgccggcgac

SEQ ID NO: 959875 - RNA, 15 nt, Mycobacterium avium subsp. paratuberculosis
caucgccggcgaccg

SEQ ID NO: 959876 - RNA, 22 nt, Mycobacterium avium subsp. paratuberculosis
caucgccggcgaccgugcccac

SEQ ID NO: 959877 - RNA, 19 nt, Mycobacterium avium subsp. paratuberculosis
caucgccggcgaugcgcgc

SEQ ID NO: 959878 - RNA, 20 nt, Mycobacterium avium subsp. paratuberculosis
caucgccggcgaugcgcgcc

SEQ ID NO: 959879 - RNA, 18 nt, Mycobacterium avium subsp. paratuberculosis
caucgccguccacggguc

SEQ ID NO: 959880 - RNA, 14 nt, Mycobacterium avium subsp. paratuberculosis
caucgccgucgcca

SEQ ID NO: 959881 - RNA, 16 nt, Mycobacterium avium subsp. paratuberculosis
caucgccgucgccacc

SEQ ID NO: 959882 - RNA, 20 nt, Mycobacterium avium subsp. paratuberculosis
caucgacuccagcaccggcg

SEQ ID NO: 959883 - RNA, 23 nt, Mycobacterium avium subsp. paratuberculosis
caucgacuccagcaccggcgcca

SEQ ID NO: 959884 - RNA, 20 nt, Mycobacterium avium subsp. paratuberculosis
caucgacucgaagaaccgca

SEQ ID NO: 959885 - RNA, 17 nt, Mycobacterium avium subsp. paratuberculosis
caucgacuugccgccgc

SEQ ID NO: 959886 - RNA, 18 nt, Mycobacterium avium subsp. paratuberculosis
caucgacuugccgccgca

SEQ ID NO: 959887 - RNA, 19 nt, Mycobacterium avium subsp. paratuberculosis
caucgacuugccgccgcac

SEQ ID NO: 959888 - RNA, 19 nt, Mycobacterium avium subsp. paratuberculosis
caucgagcaguagacgccg

SEQ ID NO: 959889 - RNA, 22 nt, Mycobacterium avium subsp. paratuberculosis
caucgagcaguagacgccgccg

SEQ ID NO: 959890 - RNA, 13 nt, Mycobacterium avium subsp. paratuberculosis
caucgagccgagc

SEQ ID NO: 959891 - RNA, 14 nt, Mycobacterium avium subsp. paratuberculosis
caucgagccgguac

SEQ ID NO: 959892 - RNA, 15 nt, Mycobacterium avium subsp. paratuberculosis
caucgagccgguacg

SEQ ID NO: 959893 - RNA, 17 nt, Mycobacterium avium subsp. paratuberculosis
caucgagccgguacggc

SEQ ID NO: 959894 - RNA, 20 nt, Mycobacterium avium subsp. paratuberculosis
caucgagccgguacggcucg

SEQ ID NO: 959895 - RNA, 14 nt, Mycobacterium avium subsp. paratuberculosis
caucgccacccgca

SEQ ID NO: 959896 - RNA, 19 nt, Mycobacterium avium subsp. paratuberculosis
caucgccacccgcaccucg

SEQ ID NO: 959897 - RNA, 16 nt, Mycobacterium avium subsp. paratuberculosis
caucgccaccgucguc

SEQ ID NO: 959898 - RNA, 20 nt, Mycobacterium avium subsp. paratuberculosis
caucgccaccgucgucgagc

SEQ ID NO: 959899 - RNA, 15 nt, Mycobacterium avium subsp. paratuberculosis
caucgccacgccgug

SEQ ID NO: 959900 - RNA, 20 nt, Mycobacterium avium subsp. paratuberculosis
caucgacggaucgcccuggc

SEQ ID NO: 959901 - RNA, 19 nt, Mycobacterium avium subsp. paratuberculosis
caucgacgcgaccggcccg

SEQ ID NO: 959902 - RNA, 14 nt, Mycobacterium avium subsp. paratuberculosis
caggacggcgcggu

SEQ ID NO: 959903 - RNA, 16 nt, Mycobacterium avium subsp. paratuberculosis
caggacggcgcggugg

SEQ ID NO: 959904 - RNA, 15 nt, Mycobacterium avium subsp. paratuberculosis
caggacgcgcccggc

SEQ ID NO: 959905 - RNA, 19 nt, Mycobacterium avium subsp. paratuberculosis
caggacgcgcccggcgacg

SEQ ID NO: 959906 - RNA, 13 nt, Mycobacterium avium subsp. paratuberculosis
caggacgcgguga

SEQ ID NO: 959907 - RNA, 19 nt, Mycobacterium avium subsp. paratuberculosis
caggacgcggugacgguga

SEQ ID NO: 959908 - RNA, 17 nt, Mycobacterium avium subsp. paratuberculosis
cagcguuauccaccagg

SEQ ID NO: 959909 - RNA, 13 nt, Mycobacterium avium subsp. paratuberculosis
caggaccuugucg

SEQ ID NO: 959910 - RNA, 13 nt, Mycobacterium avium subsp. paratuberculosis
cagcgugccgcgc

SEQ ID NO: 959911 - RNA, 18 nt, Mycobacterium avium subsp. paratuberculosis
cagcguggcgucggcgcg

SEQ ID NO: 959912 - RNA, 16 nt, Mycobacterium avium subsp. paratuberculosis
cagcgugggcaccggc

SEQ ID NO: 959913 - RNA, 22 nt, Mycobacterium avium subsp. paratuberculosis
cagcgugggcaccggcaccgcc

SEQ ID NO: 959914 - RNA, 15 nt, Mycobacterium avium subsp. paratuberculosis
cagcguggccagcac

SEQ ID NO: 959915 - RNA, 20 nt, Mycobacterium avium subsp. paratuberculosis
cagcguggccagcaccguca

SEQ ID NO: 959916 - RNA, 16 nt, Mycobacterium avium subsp. paratuberculosis
cagcguggucacccgc

SEQ ID NO: 959917 - RNA, 13 nt, Mycobacterium avium subsp. paratuberculosis
cagcguggucagc

SEQ ID NO: 959918 - RNA, 17 nt, Mycobacterium avium subsp. paratuberculosis
cagcguggucagcgucu

SEQ ID NO: 959919 - RNA, 23 nt, Mycobacterium avium subsp. paratuberculosis
cagcguggucagcgucucgccgg

SEQ ID NO: 959920 - RNA, 21 nt, Mycobacterium avium subsp. paratuberculosis
cagcguggugcgcccgucggu

SEQ ID NO: 959921 - RNA, 20 nt, Mycobacterium avium subsp. paratuberculosis
cagcgugucccgguacaggu

SEQ ID NO: 959922 - RNA, 19 nt, Mycobacterium avium subsp. paratuberculosis
cagcguggcgcgccccggc

SEQ ID NO: 959923 - RNA, 21 nt, Mycobacterium avium subsp. paratuberculosis
cagcguguagacggugcuggc

SEQ ID NO: 959924 - RNA, 17 nt, Mycobacterium avium subsp. paratuberculosis
cagcguucacgucgauc

SEQ ID NO: 959925 - RNA, 18 nt, Mycobacterium avium subsp. paratuberculosis
cagcguucacgucgauca

SEQ ID NO: 959926 - RNA, 15 nt, Mycobacterium avium subsp. paratuberculosis
caggaccgcgcgccg

SEQ ID NO: 959927 - RNA, 16 nt, Mycobacterium avium subsp. paratuberculosis
caggaccgcgcgccgg

SEQ ID NO: 959928 - RNA, 18 nt, Mycobacterium avium subsp. paratuberculosis
caggaccgcgcgccggcc

SEQ ID NO: 959929 - RNA, 19 nt, Mycobacterium avium subsp. paratuberculosis
caggaccgcgcgccggcca

SEQ ID NO: 959930 - RNA, 18 nt, Mycobacterium avium subsp. paratuberculosis
cagcguguuggacgcccg

SEQ ID NO: 959931 - RNA, 15 nt, Mycobacterium avium subsp. paratuberculosis
cagcgugucgccggg

SEQ ID NO: 959932 - RNA, 16 nt, Mycobacterium avium subsp. paratuberculosis
cagcgugucgccgggg

SEQ ID NO: 959933 - RNA, 17 nt, Mycobacterium avium subsp. paratuberculosis
cagcgugucgccggggc

SEQ ID NO: 959934 - RNA, 20 nt, Mycobacterium avium subsp. paratuberculosis
cagcgugucggggucggcgc

SEQ ID NO: 959935 - RNA, 23 nt, Mycobacterium avium subsp. paratuberculosis
cagcgugucggggucggcgccgc

SEQ ID NO: 959936 - RNA, 13 nt, Mycobacterium avium subsp. paratuberculosis
caggaucaccggg

SEQ ID NO: 959937 - RNA, 16 nt, Mycobacterium avium subsp. paratuberculosis
caggaucaccgggacg

SEQ ID NO: 959938 - RNA, 16 nt, Mycobacterium avium subsp. paratuberculosis
caggaucagcagccgu

SEQ ID NO: 959939 - RNA, 17 nt, Mycobacterium avium subsp. paratuberculosis
caggauuccgucggcgg

SEQ ID NO: 959940 - RNA, 21 nt, Mycobacterium avium subsp. paratuberculosis
caggauuccgucggcggccga

SEQ ID NO: 959941 - RNA, 23 nt, Mycobacterium avium subsp. paratuberculosis
caggauucucagcagcgggccga

SEQ ID NO: 959942 - RNA, 18 nt, Mycobacterium avium subsp. paratuberculosis
caggauguucaccccggc

SEQ ID NO: 959943 - RNA, 20 nt, Mycobacterium avium subsp. paratuberculosis
caggauguucaccccggcgc

SEQ ID NO: 959944 - RNA, 21 nt, Mycobacterium avium subsp. paratuberculosis
caggauguucaccccggcgcg

SEQ ID NO: 959945 - RNA, 23 nt, Mycobacterium avium subsp. paratuberculosis
caggauguucaccccggcgcgga

SEQ ID NO: 959946 - RNA, 13 nt, Mycobacterium avium subsp. paratuberculosis
caggaucgacguc

SEQ ID NO: 959947 - RNA, 22 nt, Mycobacterium avium subsp. paratuberculosis
caggauggagcugaccuggcug

SEQ ID NO: 959948 - RNA, 19 nt, Mycobacterium avium subsp. paratuberculosis
caggaugcgggugaugccg

SEQ ID NO: 959949 - RNA, 20 nt, Mycobacterium avium subsp. paratuberculosis
caggaugcguuggccgagca

SEQ ID NO: 959950 - RNA, 19 nt, Mycobacterium avium subsp. paratuberculosis
caggcacucgaucagcacc

SEQ ID NO: 959951 - RNA, 20 nt, Mycobacterium avium subsp. paratuberculosis
caggcacucgcgcaggguca

SEQ ID NO: 959952 - RNA, 20 nt, Mycobacterium avium subsp. paratuberculosis
caggcagaagcuccacgccg

SEQ ID NO: 959953 - RNA, 22 nt, Mycobacterium avium subsp. paratuberculosis
caggcagaagcuccacgccgcc

SEQ ID NO: 959954 - RNA, 20 nt, Mycobacterium avium subsp. paratuberculosis
caggcagacccccagcagcg

SEQ ID NO: 959955 - RNA, 16 nt, Mycobacterium avium subsp. paratuberculosis
caggcagccguugucc

SEQ ID NO: 959956 - RNA, 15 nt, Mycobacterium avium subsp. paratuberculosis
caggcacggugucga

SEQ ID NO: 959957 - RNA, 13 nt, Mycobacterium avium subsp. paratuberculosis
caggcccagcggc

SEQ ID NO: 959958 - RNA, 17 nt, Mycobacterium avium subsp. paratuberculosis
caggcccaggccgacgc

SEQ ID NO: 959959 - RNA, 16 nt, Mycobacterium avium subsp. paratuberculosis
caggcccaggccgaug

SEQ ID NO: 959960 - RNA, 21 nt, Mycobacterium avium subsp. paratuberculosis
caggcccaacgugaugagcgc

SEQ ID NO: 959961 - RNA, 14 nt, Mycobacterium avium subsp. paratuberculosis
caggcccaccacca

SEQ ID NO: 959962 - RNA, 22 nt, Mycobacterium avium subsp. paratuberculosis
caggcccaccaccacgaggacc

SEQ ID NO: 959963 - RNA, 14 nt, Mycobacterium avium subsp. paratuberculosis
caggcccagcagca

SEQ ID NO: 959964 - RNA, 19 nt, Mycobacterium avium subsp. paratuberculosis
caggcccagcagcaccgcg

SEQ ID NO: 959965 - RNA, 16 nt, Mycobacterium avium subsp. paratuberculosis
caggcaucgcgugccg

SEQ ID NO: 959966 - RNA, 17 nt, Mycobacterium avium subsp. paratuberculosis
caggcaguagccgaucu

SEQ ID NO: 959967 - RNA, 14 nt, Mycobacterium avium subsp. paratuberculosis
caggcaggcggcca

SEQ ID NO: 959968 - RNA, 16 nt, Mycobacterium avium subsp. paratuberculosis
caggcagcgcacgaug

SEQ ID NO: 959969 - RNA, 16 nt, Mycobacterium avium subsp. paratuberculosis
caggcagcccggcugc

SEQ ID NO: 959970 - RNA, 12 nt, Mycobacterium avium subsp. paratuberculosis
caggccgccgca

SEQ ID NO: 959971 - RNA, 15 nt, Mycobacterium avium subsp. paratuberculosis
caggccgccgccacc

SEQ ID NO: 959972 - RNA, 17 nt, Mycobacterium avium subsp. paratuberculosis
caggccgcccggcccaa

SEQ ID NO: 959973 - RNA, 11 nt, Mycobacterium avium subsp. paratuberculosis
caggccgccag

SEQ ID NO: 959974 - RNA, 13 nt, Mycobacterium avium subsp. paratuberculosis
caggccgcgcugg

SEQ ID NO: 959975 - RNA, 16 nt, Mycobacterium avium subsp. paratuberculosis
caggccgcgcuggcgc

SEQ ID NO: 959976 - RNA, 14 nt, Mycobacterium avium subsp. paratuberculosis
caggccgcgccggg

SEQ ID NO: 959977 - RNA, 16 nt, Mycobacterium avium subsp. paratuberculosis
caggccgccgggccgc

SEQ ID NO: 959978 - RNA, 18 nt, Mycobacterium avium subsp. paratuberculosis
caggccgccgggccgccg

SEQ ID NO: 959979 - RNA, 22 nt, Mycobacterium avium subsp. paratuberculosis
caggccgcgacgggcugucccg

SEQ ID NO: 959980 - RNA, 22 nt, Mycobacterium avium subsp. paratuberculosis
caggccgcgagcacgacgucga

SEQ ID NO: 959981 - RNA, 13 nt, Mycobacterium avium subsp. paratuberculosis
caggccgcgagcc

SEQ ID NO: 959982 - RNA, 20 nt, Mycobacterium avium subsp. paratuberculosis
caggccgaagaacucagccg

SEQ ID NO: 959983 - RNA, 17 nt, Mycobacterium avium subsp. paratuberculosis
caggccgacgccggcca

SEQ ID NO: 959984 - RNA, 20 nt, Mycobacterium avium subsp. paratuberculosis
caggccgacgccggccacca

SEQ ID NO: 959985 - RNA, 13 nt, Mycobacterium avium subsp. paratuberculosis
caggccgacgcug

SEQ ID NO: 959986 - RNA, 15 nt, Mycobacterium avium subsp. paratuberculosis
caggccgacgcuggc

SEQ ID NO: 959987 - RNA, 14 nt, Mycobacterium avium subsp. paratuberculosis
caggccgaacaccg

SEQ ID NO: 959988 - RNA, 17 nt, Mycobacterium avium subsp. paratuberculosis
caggccgaacagcagcg

SEQ ID NO: 959989 - RNA, 16 nt, Mycobacterium avium subsp. paratuberculosis
caggcccgcgccgacg

SEQ ID NO: 959990 - RNA, 23 nt, Mycobacterium avium subsp. paratuberculosis
caggccccguucgguggccaccg

SEQ ID NO: 959991 - RNA, 17 nt, Mycobacterium avium subsp. paratuberculosis
caggccccuccagcugg

SEQ ID NO: 959992 - RNA, 16 nt, Mycobacterium avium subsp. paratuberculosis
caggccccggccgagc

SEQ ID NO: 959993 - RNA, 19 nt, Mycobacterium avium subsp. paratuberculosis
caggccccacgcgcucagc

SEQ ID NO: 959994 - RNA, 16 nt, Mycobacterium avium subsp. paratuberculosis
cagggcaacgaacgcg

SEQ ID NO: 959995 - RNA, 15 nt, Mycobacterium avium subsp. paratuberculosis
cagggcaccgacggc

SEQ ID NO: 959996 - RNA, 21 nt, Mycobacterium avium subsp. paratuberculosis
cagggcaccgacggccgcacc

SEQ ID NO: 959997 - RNA, 16 nt, Mycobacterium avium subsp. paratuberculosis
cagggcagccagcccg

SEQ ID NO: 959998 - RNA, 18 nt, Mycobacterium avium subsp. paratuberculosis
cagggcagccagcccgcg

SEQ ID NO: 959999 - RNA, 12 nt, Mycobacterium avium subsp. paratuberculosis
cagggccgcggc

SEQ ID NO: 960000 - RNA, 14 nt, Mycobacterium avium subsp. paratuberculosis
cagggcccgcagcc

SEQ ID NO: 960001 - RNA, 19 nt, Mycobacterium avium subsp. paratuberculosis
cagggcccgcagccgcugg

SEQ ID NO: 960002 - RNA, 21 nt, Mycobacterium avium subsp. paratuberculosis
cagggccgaaaaaccugcggu

SEQ ID NO: 960003 - RNA, 23 nt, Mycobacterium avium subsp. paratuberculosis
cagggccgaaaaaccugcggugc

SEQ ID NO: 960004 - RNA, 15 nt, Mycobacterium avium subsp. paratuberculosis
cagggcauccgggag

SEQ ID NO: 960005 - RNA, 19 nt, Mycobacterium avium subsp. paratuberculosis
caggcgggccagcucgaac

SEQ ID NO: 960006 - RNA, 17 nt, Mycobacterium avium subsp. paratuberculosis
caggcgguccgacaccg

SEQ ID NO: 960007 - RNA, 18 nt, Mycobacterium avium subsp. paratuberculosis
caggcgguccgacaccgc

SEQ ID NO: 960008 - RNA, 14 nt, Mycobacterium avium subsp. paratuberculosis
caggcggucgaacg

SEQ ID NO: 960009 - RNA, 19 nt, Mycobacterium avium subsp. paratuberculosis
caggcggucgaacgcggcg

SEQ ID NO: 960010 - RNA, 15 nt, Mycobacterium avium subsp. paratuberculosis
caggcguccagggcc

SEQ ID NO: 960011 - RNA, 16 nt, Mycobacterium avium subsp. paratuberculosis
caggcguccagcaccu

SEQ ID NO: 960012 - RNA, 15 nt, Mycobacterium avium subsp. paratuberculosis
caggcguccagccag

SEQ ID NO: 960013 - RNA, 13 nt, Mycobacterium avium subsp. paratuberculosis
caggcgucgucgu

SEQ ID NO: 960014 - RNA, 16 nt, Mycobacterium avium subsp. paratuberculosis
caggcgucgucgucga

SEQ ID NO: 960015 - RNA, 20 nt, Mycobacterium avium subsp. paratuberculosis
caggcugaacaccaccaggc

SEQ ID NO: 960016 - RNA, 19 nt, Mycobacterium avium subsp. paratuberculosis
caggcugaacgucgucagc

SEQ ID NO: 960017 - RNA, 20 nt, Mycobacterium avium subsp. paratuberculosis
caggcugaacgucgucagca

SEQ ID NO: 960018 - RNA, 23 nt, Mycobacterium avium subsp. paratuberculosis
caggcugaacgucgucagcaccg

SEQ ID NO: 960019 - RNA, 21 nt, Mycobacterium avium subsp. paratuberculosis
caggcugaccagcgccucgcg

SEQ ID NO: 960020 - RNA, 18 nt, Mycobacterium avium subsp. paratuberculosis
caggcugacgccacgcgu

SEQ ID NO: 960021 - RNA, 16 nt, Mycobacterium avium subsp. paratuberculosis
caggcgucggucagca

SEQ ID NO: 960022 - RNA, 17 nt, Mycobacterium avium subsp. paratuberculosis
caggcugaucucggcgg

SEQ ID NO: 960023 - RNA, 20 nt, Mycobacterium avium subsp. paratuberculosis
caggcugaucuggaugcggc

SEQ ID NO: 960024 - RNA, 18 nt, Mycobacterium avium subsp. paratuberculosis
caggcugccgcugcgccg

SEQ ID NO: 960025 - RNA, 21 nt, Mycobacterium avium subsp. paratuberculosis
caggcguccuugauccgggcg

SEQ ID NO: 960026 - RNA, 18 nt, Mycobacterium avium subsp. paratuberculosis
caggccggcagccggcgc

SEQ ID NO: 960027 - RNA, 14 nt, Mycobacterium avium subsp. paratuberculosis
caggccggccacca

SEQ ID NO: 960028 - RNA, 13 nt, Mycobacterium avium subsp. paratuberculosis
caggccgcggcca

SEQ ID NO: 960029 - RNA, 19 nt, Mycobacterium avium subsp. paratuberculosis
caggccgcggguggcgcca

SEQ ID NO: 960030 - RNA, 13 nt, Mycobacterium avium subsp. paratuberculosis
caggccgcggucg

SEQ ID NO: 960031 - RNA, 20 nt, Mycobacterium avium subsp. paratuberculosis
caggccgcggucgccccggc

SEQ ID NO: 960032 - RNA, 20 nt, Mycobacterium avium subsp. paratuberculosis
caggccgcggccgucgucgu

SEQ ID NO: 960033 - RNA, 17 nt, Mycobacterium avium subsp. paratuberculosis
caggccgugguuggcga

SEQ ID NO: 960034 - RNA, 18 nt, Mycobacterium avium subsp. paratuberculosis
caggccguuguccgucga

SEQ ID NO: 960035 - RNA, 17 nt, Mycobacterium avium subsp. paratuberculosis
caggccgugcacgaaca

SEQ ID NO: 960036 - RNA, 16 nt, Mycobacterium avium subsp. paratuberculosis
caggccggccaccagg

SEQ ID NO: 960037 - RNA, 20 nt, Mycobacterium avium subsp. paratuberculosis
caggccgucggggaugccga

SEQ ID NO: 960038 - RNA, 17 nt, Mycobacterium avium subsp. paratuberculosis
caggccgucucgagccg

SEQ ID NO: 960039 - RNA, 21 nt, Mycobacterium avium subsp. paratuberculosis
caggccgucucgagccggcgc

SEQ ID NO: 960040 - RNA, 23 nt, Mycobacterium avium subsp. paratuberculosis
caggccgucucgagccggcgcac

SEQ ID NO: 960041 - RNA, 18 nt, Mycobacterium avium subsp. paratuberculosis
caggccucgaggaucgcg

SEQ ID NO: 960042 - RNA, 24 nt, Mycobacterium avium subsp. paratuberculosis
caggcgauggcgucggccagcggc

SEQ ID NO: 960043 - RNA, 16 nt, Mycobacterium avium subsp. paratuberculosis
caggcgauggugccgg

SEQ ID NO: 960044 - RNA, 17 nt, Mycobacterium avium subsp. paratuberculosis
caggcgauggugccggc

SEQ ID NO: 960045 - RNA, 15 nt, Mycobacterium avium subsp. paratuberculosis
caggcgcaacagcac

SEQ ID NO: 960046 - RNA, 22 nt, Mycobacterium avium subsp. paratuberculosis
caggcgcaacagcaccucgucg

SEQ ID NO: 960047 - RNA, 20 nt, Mycobacterium avium subsp. paratuberculosis
caggcgcaccaccagcucgu

SEQ ID NO: 960048 - RNA, 22 nt, Mycobacterium avium subsp. paratuberculosis
caggcgcaccaccagcucgucg

SEQ ID NO: 960049 - RNA, 15 nt, Mycobacterium avium subsp. paratuberculosis
caggcgcagccagcg

SEQ ID NO: 960050 - RNA, 22 nt, Mycobacterium avium subsp. paratuberculosis
caggcgcagccagcggucacgg

SEQ ID NO: 960051 - RNA, 15 nt, Mycobacterium avium subsp. paratuberculosis
caggcgcagcccgag

SEQ ID NO: 960052 - RNA, 19 nt, Mycobacterium avium subsp. paratuberculosis
caggcgcagcccgagcggc

SEQ ID NO: 960053 - RNA, 22 nt, Mycobacterium avium subsp. paratuberculosis
caggcgcagcccgagcggcauc

SEQ ID NO: 960054 - RNA, 17 nt, Mycobacterium avium subsp. paratuberculosis
caggcgcaccgccaccg

SEQ ID NO: 960055 - RNA, 15 nt, Mycobacterium avium subsp. paratuberculosis
caggcgcaccagcug

SEQ ID NO: 960056 - RNA, 16 nt, Mycobacterium avium subsp. paratuberculosis
caggcgcaccagcuga

SEQ ID NO: 960057 - RNA, 14 nt, Mycobacterium avium subsp. paratuberculosis
caggcggacggcga

SEQ ID NO: 960058 - RNA, 21 nt, Mycobacterium avium subsp. paratuberculosis
caggcgccauugucggaucgc

SEQ ID NO: 960059 - RNA, 15 nt, Mycobacterium avium subsp. paratuberculosis
caggcggaucggccc

SEQ ID NO: 960060 - RNA, 22 nt, Mycobacterium avium subsp. paratuberculosis
caggcggcgacgaacgccggca

SEQ ID NO: 960061 - RNA, 13 nt, Mycobacterium avium subsp. paratuberculosis
caggcggccggcc

SEQ ID NO: 960062 - RNA, 16 nt, Mycobacterium avium subsp. paratuberculosis
caggcggccggcccgg

SEQ ID NO: 960063 - RNA, 17 nt, Mycobacterium avium subsp. paratuberculosis
caggcggccggcccggc

SEQ ID NO: 960064 - RNA, 17 nt, Mycobacterium avium subsp. paratuberculosis
caggcggccagcaccag

SEQ ID NO: 960065 - RNA, 19 nt, Mycobacterium avium subsp. paratuberculosis
caggcggccagcaccaguu

SEQ ID NO: 960066 - RNA, 19 nt, Mycobacterium avium subsp. paratuberculosis
caggcggcgcgcagccggc

SEQ ID NO: 960067 - RNA, 21 nt, Mycobacterium avium subsp. paratuberculosis
caggcggcgcgcagccggccg

SEQ ID NO: 960068 - RNA, 14 nt, Mycobacterium avium subsp. paratuberculosis
caggcggcgcgcca

SEQ ID NO: 960069 - RNA, 20 nt, Mycobacterium avium subsp. paratuberculosis
caggcggaaugcaggaucgc

SEQ ID NO: 960070 - RNA, 21 nt, Mycobacterium avium subsp. paratuberculosis
caggcggaaugcaggaucgcg

SEQ ID NO: 960071 - RNA, 19 nt, Mycobacterium avium subsp. paratuberculosis
caggcggaccugggugcgc

SEQ ID NO: 960072 - RNA, 13 nt, Mycobacterium avium subsp. paratuberculosis
caggcgccggcca

SEQ ID NO: 960073 - RNA, 18 nt, Mycobacterium avium subsp. paratuberculosis
caggcgccggccagcacg

SEQ ID NO: 960074 - RNA, 17 nt, Mycobacterium avium subsp. paratuberculosis
caggcgcccagcacccg

SEQ ID NO: 960075 - RNA, 12 nt, Mycobacterium avium subsp. paratuberculosis
caggcgccccag

SEQ ID NO: 960076 - RNA, 15 nt, Mycobacterium avium subsp. paratuberculosis
caggcgccacagcag

SEQ ID NO: 960077 - RNA, 18 nt, Mycobacterium avium subsp. paratuberculosis
cagucuuguugaccuucu

SEQ ID NO: 960078 - RNA, 13 nt, Mycobacterium avium subsp. paratuberculosis
cagugcaccucga

SEQ ID NO: 960079 - RNA, 15 nt, Mycobacterium avium subsp. paratuberculosis
cagugcacgacgacc

SEQ ID NO: 960080 - RNA, 13 nt, Mycobacterium avium subsp. paratuberculosis
cagugcacgcucg

SEQ ID NO: 960081 - RNA, 14 nt, Mycobacterium avium subsp. paratuberculosis
cagugcacgcucgg

SEQ ID NO: 960082 - RNA, 15 nt, Mycobacterium avium subsp. paratuberculosis
cagugcacgcucggc

SEQ ID NO: 960083 - RNA, 17 nt, Mycobacterium avium subsp. paratuberculosis
cagugcacgcucggcgc

SEQ ID NO: 960084 - RNA, 18 nt, Mycobacterium avium subsp. paratuberculosis
cagugcacgcucggcgcg

SEQ ID NO: 960085 - RNA, 23 nt, Mycobacterium avium subsp. paratuberculosis
cagucguacucccaggccgcggc

SEQ ID NO: 960086 - RNA, 13 nt, Mycobacterium avium subsp. paratuberculosis
cagucgugacgcg

SEQ ID NO: 960087 - RNA, 15 nt, Mycobacterium avium subsp. paratuberculosis
cagucgugacgcggc

SEQ ID NO: 960088 - RNA, 22 nt, Mycobacterium avium subsp. paratuberculosis
cagucguuggugcgcaccagca

SEQ ID NO: 960089 - RNA, 23 nt, Mycobacterium avium subsp. paratuberculosis
cagucguuggugcgcaccagcag

SEQ ID NO: 960090 - RNA, 13 nt, Mycobacterium avium subsp. paratuberculosis
cagugcaugccgg

SEQ ID NO: 960091 - RNA, 14 nt, Mycobacterium avium subsp. paratuberculosis
cagugccaccacca

SEQ ID NO: 960092 - RNA, 17 nt, Mycobacterium avium subsp. paratuberculosis
cagugccaccaccacgg

SEQ ID NO: 960093 - RNA, 20 nt, Mycobacterium avium subsp. paratuberculosis
cagugccaccaccacggcca

SEQ ID NO: 960094 - RNA, 22 nt, Mycobacterium avium subsp. paratuberculosis
cagugccaccaccacggccagg

SEQ ID NO: 960095 - RNA, 21 nt, Mycobacterium avium subsp. paratuberculosis
cagugccaguaccagcggccg

SEQ ID NO: 960096 - RNA, 22 nt, Mycobacterium avium subsp. paratuberculosis
cagugcgucagaaccggggcca

SEQ ID NO: 960097 - RNA, 19 nt, Mycobacterium avium subsp. paratuberculosis
cagugcgucgcccaucacc

SEQ ID NO: 960098 - RNA, 16 nt, Mycobacterium avium subsp. paratuberculosis
cagugcggcccgccgg

SEQ ID NO: 960099 - RNA, 13 nt, Mycobacterium avium subsp. paratuberculosis
cagugcgggcauc

SEQ ID NO: 960100 - RNA, 19 nt, Mycobacterium avium subsp. paratuberculosis
cagugcggguacgcguacg

SEQ ID NO: 960101 - RNA, 18 nt, Mycobacterium avium subsp. paratuberculosis
cagugcgcaggcggcgcg

SEQ ID NO: 960102 - RNA, 19 nt, Mycobacterium avium subsp. paratuberculosis
cagugcgcauucggcgacg

SEQ ID NO: 960103 - RNA, 22 nt, Mycobacterium avium subsp. paratuberculosis
cagugcgcauucggcgacgcuc

SEQ ID NO: 960104 - RNA, 20 nt, Mycobacterium avium subsp. paratuberculosis
cagugcgccgucccggacgc

SEQ ID NO: 960105 - RNA, 23 nt, Mycobacterium avium subsp. paratuberculosis
cagugcgccgucccggacgcugc

SEQ ID NO: 960106 - RNA, 19 nt, Mycobacterium avium subsp. paratuberculosis
cagugcgccuugucgaugg

SEQ ID NO: 960107 - RNA, 19 nt, Mycobacterium avium subsp. paratuberculosis
cagugcgcggcguccucga

SEQ ID NO: 960108 - RNA, 16 nt, Mycobacterium avium subsp. paratuberculosis
cagugcggacgccaca

SEQ ID NO: 960109 - RNA, 15 nt, Mycobacterium avium subsp. paratuberculosis
caguccaggccgccg

SEQ ID NO: 960110 - RNA, 16 nt, Mycobacterium avium subsp. paratuberculosis
caguccaggccgccgu

SEQ ID NO: 960111 - RNA, 17 nt, Mycobacterium avium subsp. paratuberculosis
caguccaggccgccgug

SEQ ID NO: 960112 - RNA, 15 nt, Mycobacterium avium subsp. paratuberculosis
cagucauggcaguug

SEQ ID NO: 960113 - RNA, 14 nt, Mycobacterium avium subsp. paratuberculosis
cagucgaucagcga

SEQ ID NO: 960114 - RNA, 15 nt, Mycobacterium avium subsp. paratuberculosis
cagucgaucagcgac

SEQ ID NO: 960115 - RNA, 17 nt, Mycobacterium avium subsp. paratuberculosis
cagucgaccucgcgcgu

SEQ ID NO: 960116 - RNA, 15 nt, Mycobacterium avium subsp. paratuberculosis
caguccccgccuucg

SEQ ID NO: 960117 - RNA, 17 nt, Mycobacterium avium subsp. paratuberculosis
cagucgaagaccacgaa

SEQ ID NO: 960118 - RNA, 19 nt, Mycobacterium avium subsp. paratuberculosis
cagucgaagaugucgcggc

SEQ ID NO: 960119 - RNA, 20 nt, Mycobacterium avium subsp. paratuberculosis
cagucgaagaugucgcggcg

SEQ ID NO: 960120 - RNA, 23 nt, Mycobacterium avium subsp. paratuberculosis
cagucgaagaugucgcggcgcac

SEQ ID NO: 960121 - RNA, 19 nt, Mycobacterium avium subsp. paratuberculosis
cagucgcauaugcgugggc

SEQ ID NO: 960122 - RNA, 21 nt, Mycobacterium avium subsp. paratuberculosis
cagucgccgccgcgcaccgcg

SEQ ID NO: 960123 - RNA, 14 nt, Mycobacterium avium subsp. paratuberculosis
cagucgccgcgcag

SEQ ID NO: 960124 - RNA, 14 nt, Mycobacterium avium subsp. paratuberculosis
caguaccggcgaug

SEQ ID NO: 960125 - RNA, 17 nt, Mycobacterium avium subsp. paratuberculosis
cagguuguggugcacga

SEQ ID NO: 960126 - RNA, 17 nt, Mycobacterium avium subsp. paratuberculosis
cagguugucgucgggca

SEQ ID NO: 960127 - RNA, 13 nt, Mycobacterium avium subsp. paratuberculosis
caguacgcgccgg

SEQ ID NO: 960128 - RNA, 13 nt, Mycobacterium avium subsp. paratuberculosis
cagguugucggcc

SEQ ID NO: 960129 - RNA, 14 nt, Mycobacterium avium subsp. paratuberculosis
cagguugucggcca

SEQ ID NO: 960130 - RNA, 15 nt, Mycobacterium avium subsp. paratuberculosis
cagguugucggccaa

SEQ ID NO: 960131 - RNA, 16 nt, Mycobacterium avium subsp. paratuberculosis
cagguugucgccgcgc

SEQ ID NO: 960132 - RNA, 22 nt, Mycobacterium avium subsp. paratuberculosis
cagguugucgccgcgccagccg

SEQ ID NO: 960133 - RNA, 17 nt, Mycobacterium avium subsp. paratuberculosis
cagguuggcggcggccc

SEQ ID NO: 960134 - RNA, 22 nt, Mycobacterium avium subsp. paratuberculosis
cagguuggcggcggcccgcgcg

SEQ ID NO: 960135 - RNA, 19 nt, Mycobacterium avium subsp. paratuberculosis
cagguuguagucggcgccg

SEQ ID NO: 960136 - RNA, 20 nt, Mycobacterium avium subsp. paratuberculosis
cagguuguagucggcgccga

SEQ ID NO: 960137 - RNA, 18 nt, Mycobacterium avium subsp. paratuberculosis
cagguuguccagccggug

SEQ ID NO: 960138 - RNA, 19 nt, Mycobacterium avium subsp. paratuberculosis
cagguuguccagccggugc

SEQ ID NO: 960139 - RNA, 23 nt, Mycobacterium avium subsp. paratuberculosis
cagguuguccagccggugcacca

SEQ ID NO: 960140 - RNA, 15 nt, Mycobacterium avium subsp. paratuberculosis
cagguuggcgccgaa

SEQ ID NO: 960141 - RNA, 20 nt, Mycobacterium avium subsp. paratuberculosis
cagguuggggacggcgagga

SEQ ID NO: 960142 - RNA, 16 nt, Mycobacterium avium subsp. paratuberculosis
cagguuggggccgaug

SEQ ID NO: 960143 - RNA, 16 nt, Mycobacterium avium subsp. paratuberculosis
cagguuggacaguucg

SEQ ID NO: 960144 - RNA, 14 nt, Mycobacterium avium subsp. paratuberculosis
caguagaacggccc

SEQ ID NO: 960145 - RNA, 15 nt, Mycobacterium avium subsp. paratuberculosis
caguagacgccgccg

SEQ ID NO: 960146 - RNA, 16 nt, Mycobacterium avium subsp. paratuberculosis
caguagacguugccga

SEQ ID NO: 960147 - RNA, 21 nt, Mycobacterium avium subsp. paratuberculosis
caguagacguugccgaucccg

SEQ ID NO: 960148 - RNA, 22 nt, Mycobacterium avium subsp. paratuberculosis
caguagacguugccgaucccgg

SEQ ID NO: 960149 - RNA, 13 nt, Mycobacterium avium subsp. paratuberculosis
caguagcgacgcg

SEQ ID NO: 960150 - RNA, 15 nt, Mycobacterium avium subsp. paratuberculosis
caguagccgccgggc

SEQ ID NO: 960151 - RNA, 17 nt, Mycobacterium avium subsp. paratuberculosis
caguagccgccgggcgu

SEQ ID NO: 960152 - RNA, 23 nt, Mycobacterium avium subsp. paratuberculosis
caguagccgccgggcguagucga

SEQ ID NO: 960153 - RNA, 20 nt, Mycobacterium avium subsp. paratuberculosis
caguaucuuguucgccgaca

SEQ ID NO: 960154 - RNA, 20 nt, Mycobacterium avium subsp. paratuberculosis
caguagcgcauaggccgcga

SEQ ID NO: 960155 - RNA, 17 nt, Mycobacterium avium subsp. paratuberculosis
cagguggggcacgggcg

SEQ ID NO: 960156 - RNA, 20 nt, Mycobacterium avium subsp. paratuberculosis
cagguggggcagcaccucgc

SEQ ID NO: 960157 - RNA, 14 nt, Mycobacterium avium subsp. paratuberculosis
cagguuccaccggg

SEQ ID NO: 960158 - RNA, 14 nt, Mycobacterium avium subsp. paratuberculosis
caggugggcggcca

SEQ ID NO: 960159 - RNA, 17 nt, Mycobacterium avium subsp. paratuberculosis
caggugggcggccacca

SEQ ID NO: 960160 - RNA, 14 nt, Mycobacterium avium subsp. paratuberculosis
caggugggcggugc

SEQ ID NO: 960161 - RNA, 15 nt, Mycobacterium avium subsp. paratuberculosis
cagguggcgcccgga

SEQ ID NO: 960162 - RNA, 15 nt, Mycobacterium avium subsp. paratuberculosis
caggugggcgcgcag

SEQ ID NO: 960163 - RNA, 16 nt, Mycobacterium avium subsp. paratuberculosis
caggugggcgcgcagc

SEQ ID NO: 960164 - RNA, 17 nt, Mycobacterium avium subsp. paratuberculosis
caggugggcgcgcagca

SEQ ID NO: 960165 - RNA, 14 nt, Mycobacterium avium subsp. paratuberculosis
cagguugcgcagca

SEQ ID NO: 960166 - RNA, 18 nt, Mycobacterium avium subsp. paratuberculosis
cagguugcgcagcagcca

SEQ ID NO: 960167 - RNA, 19 nt, Mycobacterium avium subsp. paratuberculosis
cagguucugcacgugguga

SEQ ID NO: 960168 - RNA, 22 nt, Mycobacterium avium subsp. paratuberculosis
cagguugcgguguugcgcagcg

SEQ ID NO: 960169 - RNA, 15 nt, Mycobacterium avium subsp. paratuberculosis
cagguugauccgcgc

SEQ ID NO: 960170 - RNA, 17 nt, Mycobacterium avium subsp. paratuberculosis
cagguucuuggcggccu

SEQ ID NO: 960171 - RNA, 15 nt, Mycobacterium avium subsp. paratuberculosis
cagguugaccaccag

SEQ ID NO: 960172 - RNA, 18 nt, Mycobacterium avium subsp. paratuberculosis
cagguugaccaccagcgu

SEQ ID NO: 960173 - RNA, 19 nt, Mycobacterium avium subsp. paratuberculosis
cagguugaccaggugggcg

SEQ ID NO: 960174 - RNA, 22 nt, Mycobacterium avium subsp. paratuberculosis
cagguggaugcgagccagcugc

SEQ ID NO: 960175 - RNA, 18 nt, Mycobacterium avium subsp. paratuberculosis
cagguggauugucggccg

SEQ ID NO: 960176 - RNA, 20 nt, Mycobacterium avium subsp. paratuberculosis
cagguggcguagucggugca

SEQ ID NO: 960177 - RNA, 21 nt, Mycobacterium avium subsp. paratuberculosis
cagguggcguagucggugcag

SEQ ID NO: 960178 - RNA, 17 nt, Mycobacterium avium subsp. paratuberculosis
cagguggcgucggcguc

SEQ ID NO: 960179 - RNA, 24 nt, Mycobacterium avium subsp. paratuberculosis
cagguggcccacacgcgauagacc

SEQ ID NO: 960180 - RNA, 22 nt, Mycobacterium avium subsp. paratuberculosis
cagguggccgcuuuccaccccg

SEQ ID NO: 960181 - RNA, 24 nt, Mycobacterium avium subsp. paratuberculosis
cagguggccgcuuuccaccccggc

SEQ ID NO: 960182 - RNA, 14 nt, Mycobacterium avium subsp. paratuberculosis
caggucggcggucg

SEQ ID NO: 960183 - RNA, 20 nt, Mycobacterium avium subsp. paratuberculosis
caggugcuuggucagcgcgg

SEQ ID NO: 960184 - RNA, 12 nt, Mycobacterium avium subsp. paratuberculosis
caggucggcggg

SEQ ID NO: 960185 - RNA, 15 nt, Mycobacterium avium subsp. paratuberculosis
caggucggcgggagc

SEQ ID NO: 960186 - RNA, 19 nt, Mycobacterium avium subsp. paratuberculosis
caggucggcgggagccggc

SEQ ID NO: 960187 - RNA, 20 nt, Mycobacterium avium subsp. paratuberculosis
caggucggcgggagccggcg

SEQ ID NO: 960188 - RNA, 21 nt, Mycobacterium avium subsp. paratuberculosis
caggucggcgggagccggcgg

SEQ ID NO: 960189 - RNA, 14 nt, Mycobacterium avium subsp. paratuberculosis
caggucggcgugca

SEQ ID NO: 960190 - RNA, 19 nt, Mycobacterium avium subsp. paratuberculosis
caggucggcgugcagcacg

SEQ ID NO: 960191 - RNA, 20 nt, Mycobacterium avium subsp. paratuberculosis
caggucggcgugcucgucgc

SEQ ID NO: 960192 - RNA, 21 nt, Mycobacterium avium subsp. paratuberculosis
caggucggcgugcucgucgcg

SEQ ID NO: 960193 - RNA, 17 nt, Mycobacterium avium subsp. paratuberculosis
caggucgggacguccgc

SEQ ID NO: 960194 - RNA, 20 nt, Mycobacterium avium subsp. paratuberculosis
caggucgggacguccgcgcg

SEQ ID NO: 960195 - RNA, 13 nt, Mycobacterium avium subsp. paratuberculosis
caggucggcgaug

SEQ ID NO: 960196 - RNA, 14 nt, Mycobacterium avium subsp. paratuberculosis
caggucggccgcgg

SEQ ID NO: 960197 - RNA, 15 nt, Mycobacterium avium subsp. paratuberculosis
caggucggccgcggc

SEQ ID NO: 960198 - RNA, 17 nt, Mycobacterium avium subsp. paratuberculosis
caggucggccgcggccg

SEQ ID NO: 960199 - RNA, 19 nt, Mycobacterium avium subsp. paratuberculosis
caggucggccgcggccggc

SEQ ID NO: 960200 - RNA, 22 nt, Mycobacterium avium subsp. paratuberculosis
caggucggccuucagcguccac

SEQ ID NO: 960201 - RNA, 15 nt, Mycobacterium avium subsp. paratuberculosis
cagggucagcagcac

SEQ ID NO: 960202 - RNA, 17 nt, Mycobacterium avium subsp. paratuberculosis
cagggucagcagcaccc

SEQ ID NO: 960203 - RNA, 22 nt, Mycobacterium avium subsp. paratuberculosis
cagggucagcuuggagccgagc

SEQ ID NO: 960204 - RNA, 15 nt, Mycobacterium avium subsp. paratuberculosis
cagggucccggucag

SEQ ID NO: 960205 - RNA, 14 nt, Mycobacterium avium subsp. paratuberculosis
caggguccgccguc

SEQ ID NO: 960206 - RNA, 16 nt, Mycobacterium avium subsp. paratuberculosis
caggguccgccgucga

SEQ ID NO: 960207 - RNA, 15 nt, Mycobacterium avium subsp. paratuberculosis
cagggucgcggagcg

SEQ ID NO: 960208 - RNA, 14 nt, Mycobacterium avium subsp. paratuberculosis
caggguggccgcca

SEQ ID NO: 960209 - RNA, 16 nt, Mycobacterium avium subsp. paratuberculosis
caggguggccgccacc

SEQ ID NO: 960210 - RNA, 17 nt, Mycobacterium avium subsp. paratuberculosis
caggguggccgccacca

SEQ ID NO: 960211 - RNA, 22 nt, Mycobacterium avium subsp. paratuberculosis
caggguggccgccaccaggcug

SEQ ID NO: 960212 - RNA, 22 nt, Mycobacterium avium subsp. paratuberculosis
caggguggccucgucggcgccg

SEQ ID NO: 960213 - RNA, 20 nt, Mycobacterium avium subsp. paratuberculosis
cagggucucgggcagcagca

SEQ ID NO: 960214 - RNA, 17 nt, Mycobacterium avium subsp. paratuberculosis
cagggucuggcccggug

SEQ ID NO: 960215 - RNA, 18 nt, Mycobacterium avium subsp. paratuberculosis
cagggucuggcccggugc

SEQ ID NO: 960216 - RNA, 14 nt, Mycobacterium avium subsp. paratuberculosis
cagggucguucagc

SEQ ID NO: 960217 - RNA, 17 nt, Mycobacterium avium subsp. paratuberculosis
cagggucguucagcuga

SEQ ID NO: 960218 - RNA, 12 nt, Mycobacterium avium subsp. paratuberculosis
cagggugucgau

SEQ ID NO: 960219 - RNA, 23 nt, Mycobacterium avium subsp. paratuberculosis
cagguacugggcguggucgccgu

SEQ ID NO: 960220 - RNA, 13 nt, Mycobacterium avium subsp. paratuberculosis
cagguacgcgacg

SEQ ID NO: 960221 - RNA, 14 nt, Mycobacterium avium subsp. paratuberculosis
cagguacgcgacgg

SEQ ID NO: 960222 - RNA, 20 nt, Mycobacterium avium subsp. paratuberculosis
cagguacugcuugccgccgg

SEQ ID NO: 960223 - RNA, 21 nt, Mycobacterium avium subsp. paratuberculosis
cagguacugcuugccgccggg

SEQ ID NO: 960224 - RNA, 18 nt, Mycobacterium avium subsp. paratuberculosis
cagguaccggcgggcgaa

SEQ ID NO: 960225 - RNA, 22 nt, Mycobacterium avium subsp. paratuberculosis
cagguaccgguuccgggcgacc

SEQ ID NO: 960226 - RNA, 20 nt, Mycobacterium avium subsp. paratuberculosis
cagguacgcggcguugccgc

SEQ ID NO: 960227 - RNA, 22 nt, Mycobacterium avium subsp. paratuberculosis
cagguacgcggcguugccgccg

SEQ ID NO: 960228 - RNA, 23 nt, Mycobacterium avium subsp. paratuberculosis
cagguacgcggcguugccgccgg

SEQ ID NO: 960229 - RNA, 20 nt, Mycobacterium avium subsp. paratuberculosis
caggguggugcccccgcccg

SEQ ID NO: 960230 - RNA, 22 nt, Mycobacterium avium subsp. paratuberculosis
caggguggugcccccgcccggc

SEQ ID NO: 960231 - RNA, 19 nt, Mycobacterium avium subsp. paratuberculosis
cagggugucgaacagcagg

SEQ ID NO: 960232 - RNA, 16 nt, Mycobacterium avium subsp. paratuberculosis
cagggugucgucgcgc

SEQ ID NO: 960233 - RNA, 17 nt, Mycobacterium avium subsp. paratuberculosis
cagggugucgucgcgca

SEQ ID NO: 960234 - RNA, 21 nt, Mycobacterium avium subsp. paratuberculosis
cagggugucgucgcgcaccca

SEQ ID NO: 960235 - RNA, 14 nt, Mycobacterium avium subsp. paratuberculosis
cagggugucgucgu

SEQ ID NO: 960236 - RNA, 15 nt, Mycobacterium avium subsp. paratuberculosis
cagggugucgucguc

SEQ ID NO: 960237 - RNA, 18 nt, Mycobacterium avium subsp. paratuberculosis
cagggugugacggauccg

SEQ ID NO: 960238 - RNA, 16 nt, Mycobacterium avium subsp. paratuberculosis
caggguggccagcacg

SEQ ID NO: 960239 - RNA, 20 nt, Mycobacterium avium subsp. paratuberculosis
caggguggggaucacgucgg

SEQ ID NO: 960240 - RNA, 15 nt, Mycobacterium avium subsp. paratuberculosis
caggguggucagcgu

SEQ ID NO: 960241 - RNA, 22 nt, Mycobacterium avium subsp. paratuberculosis
cagguagcaggcgcgcagcagg

SEQ ID NO: 960242 - RNA, 14 nt, Mycobacterium avium subsp. paratuberculosis
cagguccacccgcc

SEQ ID NO: 960243 - RNA, 22 nt, Mycobacterium avium subsp. paratuberculosis
cagguccacccgccccgccgcg

SEQ ID NO: 960244 - RNA, 21 nt, Mycobacterium avium subsp. paratuberculosis
cagguccaggaucacgcggcg

SEQ ID NO: 960245 - RNA, 14 nt, Mycobacterium avium subsp. paratuberculosis
cagguccaccccgc

SEQ ID NO: 960246 - RNA, 23 nt, Mycobacterium avium subsp. paratuberculosis
cagguccaccguugucucggcgc

SEQ ID NO: 960247 - RNA, 18 nt, Mycobacterium avium subsp. paratuberculosis
cagguagaagccgcgacg

SEQ ID NO: 960248 - RNA, 23 nt, Mycobacterium avium subsp. paratuberculosis
cagguagauggugaucgaccgga

SEQ ID NO: 960249 - RNA, 19 nt, Mycobacterium avium subsp. paratuberculosis
cagguagcccaugucgccg

SEQ ID NO: 960250 - RNA, 15 nt, Mycobacterium avium subsp. paratuberculosis
cagguagccgagguc

SEQ ID NO: 960251 - RNA, 13 nt, Mycobacterium avium subsp. paratuberculosis
cagguagccgccg

SEQ ID NO: 960252 - RNA, 14 nt, Mycobacterium avium subsp. paratuberculosis
cagguagccgccgu

SEQ ID NO: 960253 - RNA, 21 nt, Mycobacterium avium subsp. paratuberculosis
cagguccguggugaucgccgc

SEQ ID NO: 960254 - RNA, 20 nt, Mycobacterium avium subsp. paratuberculosis
cagguccgguucgaccggcg

SEQ ID NO: 960255 - RNA, 20 nt, Mycobacterium avium subsp. paratuberculosis
cagguccgggaacagcgacu

SEQ ID NO: 960256 - RNA, 21 nt, Mycobacterium avium subsp. paratuberculosis
cagguccgggaacagcgacuc

SEQ ID NO: 960257 - RNA, 13 nt, Mycobacterium avium subsp. paratuberculosis
cagguccgggcac

SEQ ID NO: 960258 - RNA, 19 nt, Mycobacterium avium subsp. paratuberculosis
cagguccucggacucgucg

SEQ ID NO: 960259 - RNA, 18 nt, Mycobacterium avium subsp. paratuberculosis
cagguccuugcccagcag

SEQ ID NO: 960260 - RNA, 22 nt, Mycobacterium avium subsp. paratuberculosis
cagguccuugcgcgccgcgacg

SEQ ID NO: 960261 - RNA, 19 nt, Mycobacterium avium subsp. paratuberculosis
caggucgaaacccguugcc

SEQ ID NO: 960262 - RNA, 18 nt, Mycobacterium avium subsp. paratuberculosis
caggucccaggcgugguc

SEQ ID NO: 960263 - RNA, 22 nt, Mycobacterium avium subsp. paratuberculosis
caggucccaggcguggucggcg

SEQ ID NO: 960264 - RNA, 15 nt, Mycobacterium avium subsp. paratuberculosis
cagguccgccggugc

SEQ ID NO: 960265 - RNA, 22 nt, Mycobacterium avium subsp. paratuberculosis
caggucgaccaucugccggcgc

SEQ ID NO: 960266 - RNA, 20 nt, Mycobacterium avium subsp. paratuberculosis
caggucgaagcccgccguca

SEQ ID NO: 960267 - RNA, 16 nt, Mycobacterium avium subsp. paratuberculosis
caggucgaagcgcagc

SEQ ID NO: 960268 - RNA, 17 nt, Mycobacterium avium subsp. paratuberculosis
caggucgaagcgcagca

SEQ ID NO: 960269 - RNA, 20 nt, Mycobacterium avium subsp. paratuberculosis
caggucgaaggcggccgcga

SEQ ID NO: 960270 - RNA, 21 nt, Mycobacterium avium subsp. paratuberculosis
caggucgaaggcggccgcgag

SEQ ID NO: 960271 - RNA, 16 nt, Mycobacterium avium subsp. paratuberculosis
caggucgaagggcauc

SEQ ID NO: 960272 - RNA, 12 nt, Mycobacterium avium subsp. paratuberculosis
caggucgaggcc

SEQ ID NO: 960273 - RNA, 15 nt, Mycobacterium avium subsp. paratuberculosis
caggucgaggccggc

SEQ ID NO: 960274 - RNA, 17 nt, Mycobacterium avium subsp. paratuberculosis
caggucgaggccggcca

SEQ ID NO: 960275 - RNA, 16 nt, Mycobacterium avium subsp. paratuberculosis
caggucggccagcgcc

SEQ ID NO: 960276 - RNA, 13 nt, Mycobacterium avium subsp. paratuberculosis
caggucggccagc

SEQ ID NO: 960277 - RNA, 19 nt, Mycobacterium avium subsp. paratuberculosis
caggucgcacaccagcacg

SEQ ID NO: 960278 - RNA, 17 nt, Mycobacterium avium subsp. paratuberculosis
caggucgaucucggcca

SEQ ID NO: 960279 - RNA, 23 nt, Mycobacterium avium subsp. paratuberculosis
caggucgaucugcggcacggugc

SEQ ID NO: 960280 - RNA, 22 nt, Mycobacterium avium subsp. paratuberculosis
caggucgauggucugcccgccg

SEQ ID NO: 960281 - RNA, 13 nt, Mycobacterium avium subsp. paratuberculosis
caggucgaguuca

SEQ ID NO: 960282 - RNA, 23 nt, Mycobacterium avium subsp. paratuberculosis
caggucgagggucgagacaccgu

SEQ ID NO: 960283 - RNA, 23 nt, Mycobacterium avium subsp. paratuberculosis
caggucgagguccucggcgaugu

SEQ ID NO: 960284 - RNA, 21 nt, Mycobacterium avium subsp. paratuberculosis
cagggcguggaacgcgucgcg

SEQ ID NO: 960285 - RNA, 23 nt, Mycobacterium avium subsp. paratuberculosis
cagggcgucggacaugccggcgc

SEQ ID NO: 960286 - RNA, 17 nt, Mycobacterium avium subsp. paratuberculosis
cagggcguucgacgucc

SEQ ID NO: 960287 - RNA, 19 nt, Mycobacterium avium subsp. paratuberculosis
cagggcucgcaaccgucuu

SEQ ID NO: 960288 - RNA, 18 nt, Mycobacterium avium subsp. paratuberculosis
cagggcucgugcagccgg

SEQ ID NO: 960289 - RNA, 15 nt, Mycobacterium avium subsp. paratuberculosis
cagggcgugcgcggc

SEQ ID NO: 960290 - RNA, 18 nt, Mycobacterium avium subsp. paratuberculosis
cagggcgugcgcggccgc

SEQ ID NO: 960291 - RNA, 19 nt, Mycobacterium avium subsp. paratuberculosis
cagggcgugcgcggccgcc

SEQ ID NO: 960292 - RNA, 15 nt, Mycobacterium avium subsp. paratuberculosis
cagggcgguggcggc

SEQ ID NO: 960293 - RNA, 14 nt, Mycobacterium avium subsp. paratuberculosis
cagggcgucgagcg

SEQ ID NO: 960294 - RNA, 19 nt, Mycobacterium avium subsp. paratuberculosis
cagggcgucgagcgcgucg

SEQ ID NO: 960295 - RNA, 14 nt, Mycobacterium avium subsp. paratuberculosis
caggggcagcagca

SEQ ID NO: 960296 - RNA, 17 nt, Mycobacterium avium subsp. paratuberculosis
cagggggaguagucggc

SEQ ID NO: 960297 - RNA, 20 nt, Mycobacterium avium subsp. paratuberculosis
cagggggaguagucggcgau

SEQ ID NO: 960298 - RNA, 14 nt, Mycobacterium avium subsp. paratuberculosis
cagggggcgcagcc

SEQ ID NO: 960299 - RNA, 16 nt, Mycobacterium avium subsp. paratuberculosis
cagggggcgcagccga

SEQ ID NO: 960300 - RNA, 14 nt, Mycobacterium avium subsp. paratuberculosis
cagggggacgaacc

SEQ ID NO: 960301 - RNA, 16 nt, Mycobacterium avium subsp. paratuberculosis
caggguagaggcggcg

SEQ ID NO: 960302 - RNA, 15 nt, Mycobacterium avium subsp. paratuberculosis
caggggugggcgacg

SEQ ID NO: 960303 - RNA, 15 nt, Mycobacterium avium subsp. paratuberculosis
cagggcggccggcca

SEQ ID NO: 960304 - RNA, 18 nt, Mycobacterium avium subsp. paratuberculosis
cagggcggcaccgaucgg

SEQ ID NO: 960305 - RNA, 22 nt, Mycobacterium avium subsp. paratuberculosis
cagggcggcaccgaucggcacg

SEQ ID NO: 960306 - RNA, 13 nt, Mycobacterium avium subsp. paratuberculosis
cagggcgccgacg

SEQ ID NO: 960307 - RNA, 22 nt, Mycobacterium avium subsp. paratuberculosis
cagggcgccgacgaucccggcg

SEQ ID NO: 960308 - RNA, 22 nt, Mycobacterium avium subsp. paratuberculosis
cagggcgcgcaucugcucggcg

SEQ ID NO: 960309 - RNA, 13 nt, Mycobacterium avium subsp. paratuberculosis
cagggcgcgcugu

SEQ ID NO: 960310 - RNA, 18 nt, Mycobacterium avium subsp. paratuberculosis
cagggcgcgcugucgacg

SEQ ID NO: 960311 - RNA, 20 nt, Mycobacterium avium subsp. paratuberculosis
cagggcgcgcugucgacgcg

SEQ ID NO: 960312 - RNA, 16 nt, Mycobacterium avium subsp. paratuberculosis
cagggcgccggugaag

SEQ ID NO: 960313 - RNA, 14 nt, Mycobacterium avium subsp. paratuberculosis
cagggcggugcggu

SEQ ID NO: 960314 - RNA, 22 nt, Mycobacterium avium subsp. paratuberculosis
cagggcggugcggugcgccgca

SEQ ID NO: 960315 - RNA, 17 nt, Mycobacterium avium subsp. paratuberculosis
cagggcggcgccgcggc

SEQ ID NO: 960316 - RNA, 15 nt, Mycobacterium avium subsp. paratuberculosis
cagggcggcgccggc

SEQ ID NO: 960317 - RNA, 17 nt, Mycobacterium avium subsp. paratuberculosis
cagggcggaaucgcggu

SEQ ID NO: 960318 - RNA, 11 nt, Mycobacterium avium subsp. paratuberculosis
cagggcggugc

SEQ ID NO: 960319 - RNA, 16 nt, Mycobacterium avium subsp. paratuberculosis
cagggcgggucgucga

SEQ ID NO: 960320 - RNA, 13 nt, Mycobacterium avium subsp. paratuberculosis
cagggcggcgcgc

SEQ ID NO: 960321 - RNA, 16 nt, Mycobacterium avium subsp. paratuberculosis
cagggcggcgggcccg

SEQ ID NO: 960322 - RNA, 22 nt, Mycobacterium avium subsp. paratuberculosis
cagggcggcgggcccggcgaug

SEQ ID NO: 960323 - RNA, 12 nt, Mycobacterium avium subsp. paratuberculosis
cagggcgggcag

SEQ ID NO: 960324 - RNA, 16 nt, Mycobacterium avium subsp. paratuberculosis
cagggcgaucaccgcg

SEQ ID NO: 960325 - RNA, 19 nt, Mycobacterium avium subsp. paratuberculosis
cagggcgaucaccgcggcc

SEQ ID NO: 960326 - RNA, 21 nt, Mycobacterium avium subsp. paratuberculosis
cagggcgaucaccgcggccac

SEQ ID NO: 960327 - RNA, 15 nt, Mycobacterium avium subsp. paratuberculosis
cagggcgacaucggc

SEQ ID NO: 960328 - RNA, 16 nt, Mycobacterium avium subsp. paratuberculosis
cagggcgacaucggca

SEQ ID NO: 960329 - RNA, 14 nt, Mycobacterium avium subsp. paratuberculosis
cagggcgacggcgg

SEQ ID NO: 960330 - RNA, 17 nt, Mycobacterium avium subsp. paratuberculosis
cagggcgacggcggcga

SEQ ID NO: 960331 - RNA, 16 nt, Mycobacterium avium subsp. paratuberculosis
cagggcgacuccggcg

SEQ ID NO: 960332 - RNA, 17 nt, Mycobacterium avium subsp. paratuberculosis
cagggcgacgccgcgga

SEQ ID NO: 960333 - RNA, 18 nt, Mycobacterium avium subsp. paratuberculosis
cagggcgaggaacccgac

SEQ ID NO: 960334 - RNA, 21 nt, Mycobacterium avium subsp. paratuberculosis
cagggcgaggaacccgaccgc

SEQ ID NO: 960335 - RNA, 17 nt, Mycobacterium avium subsp. paratuberculosis
cagggccucgccguugc

SEQ ID NO: 960336 - RNA, 14 nt, Mycobacterium avium subsp. paratuberculosis
cagggccucggcga

SEQ ID NO: 960337 - RNA, 16 nt, Mycobacterium avium subsp. paratuberculosis
cagggccucggcgacc

SEQ ID NO: 960338 - RNA, 20 nt, Mycobacterium avium subsp. paratuberculosis
cagggcgaacggcggaucca

SEQ ID NO: 960339 - RNA, 12 nt, Mycobacterium avium subsp. paratuberculosis
cagggccgggcg

SEQ ID NO: 960340 - RNA, 14 nt, Mycobacterium avium subsp. paratuberculosis
cagggccucgucgu

SEQ ID NO: 960341 - RNA, 17 nt, Mycobacterium avium subsp. paratuberculosis
cagggccucgucgucgu

SEQ ID NO: 960342 - RNA, 22 nt, Mycobacterium avium subsp. paratuberculosis
cagggccucgucgucgucgagc

SEQ ID NO: 960343 - RNA, 16 nt, Mycobacterium avium subsp. paratuberculosis
cagcauuuccgagcga

SEQ ID NO: 960344 - RNA, 19 nt, Mycobacterium avium subsp. paratuberculosis
cagccaaacagguuggcgc

SEQ ID NO: 960345 - RNA, 21 nt, Mycobacterium avium subsp. paratuberculosis
cagccaaagccuacggcgccg

SEQ ID NO: 960346 - RNA, 13 nt, Mycobacterium avium subsp. paratuberculosis
cagcauguguggc

SEQ ID NO: 960347 - RNA, 14 nt, Mycobacterium avium subsp. paratuberculosis
cagcaugucgcccg

SEQ ID NO: 960348 - RNA, 17 nt, Mycobacterium avium subsp. paratuberculosis
cagcaugucgcccgcgu

SEQ ID NO: 960349 - RNA, 22 nt, Mycobacterium avium subsp. paratuberculosis
cagcaugucgcccgcgucgugg

SEQ ID NO: 960350 - RNA, 12 nt, Mycobacterium avium subsp. paratuberculosis
cagcaucgccgc

SEQ ID NO: 960351 - RNA, 17 nt, Mycobacterium avium subsp. paratuberculosis
cagcauccgcaacgugc

SEQ ID NO: 960352 - RNA, 13 nt, Mycobacterium avium subsp. paratuberculosis
cagcaucgccguc

SEQ ID NO: 960353 - RNA, 14 nt, Mycobacterium avium subsp. paratuberculosis
cagcaucgccgucg

SEQ ID NO: 960354 - RNA, 24 nt, Mycobacterium avium subsp. paratuberculosis
cagcaucgccgucgucagccgggc

SEQ ID NO: 960355 - RNA, 17 nt, Mycobacterium avium subsp. paratuberculosis
cagcaugcgccagagcg

SEQ ID NO: 960356 - RNA, 20 nt, Mycobacterium avium subsp. paratuberculosis
cagcaugcgccagagcgcga

SEQ ID NO: 960357 - RNA, 23 nt, Mycobacterium avium subsp. paratuberculosis
cagcauggcgaucaccccggcga

SEQ ID NO: 960358 - RNA, 19 nt, Mycobacterium avium subsp. paratuberculosis
cagcagggcaccgacggcc

SEQ ID NO: 960359 - RNA, 20 nt, Mycobacterium avium subsp. paratuberculosis
cagcagggcaucucccgcgc

SEQ ID NO: 960360 - RNA, 21 nt, Mycobacterium avium subsp. paratuberculosis
cagcagggcaucucccgcgcg

SEQ ID NO: 960361 - RNA, 16 nt, Mycobacterium avium subsp. paratuberculosis
cagcagggcgcgcauc

SEQ ID NO: 960362 - RNA, 16 nt, Mycobacterium avium subsp. paratuberculosis
cagcagggcggcaccg

SEQ ID NO: 960363 - RNA, 15 nt, Mycobacterium avium subsp. paratuberculosis
cagcagggcgccgac

SEQ ID NO: 960364 - RNA, 20 nt, Mycobacterium avium subsp. paratuberculosis
cagcagggcgccgacgaucc

SEQ ID NO: 960365 - RNA, 13 nt, Mycobacterium avium subsp. paratuberculosis
cagcagggcgccg

SEQ ID NO: 960366 - RNA, 19 nt, Mycobacterium avium subsp. paratuberculosis
cagcaggcccaggccgaug

SEQ ID NO: 960367 - RNA, 16 nt, Mycobacterium avium subsp. paratuberculosis
cagcagggccucgccg

SEQ ID NO: 960368 - RNA, 22 nt, Mycobacterium avium subsp. paratuberculosis
cagcagggugacgucguugacc

SEQ ID NO: 960369 - RNA, 14 nt, Mycobacterium avium subsp. paratuberculosis
cagcagggugccgc

SEQ ID NO: 960370 - RNA, 19 nt, Mycobacterium avium subsp. paratuberculosis
cagcagugccccguccggc

SEQ ID NO: 960371 - RNA, 22 nt, Mycobacterium avium subsp. paratuberculosis
cagcagugccccguccggcgcc

SEQ ID NO: 960372 - RNA, 20 nt, Mycobacterium avium subsp. paratuberculosis
cagcaguguccagucggccg

SEQ ID NO: 960373 - RNA, 20 nt, Mycobacterium avium subsp. paratuberculosis
cagcaguucguccacgcugg

SEQ ID NO: 960374 - RNA, 22 nt, Mycobacterium avium subsp. paratuberculosis
cagcaguuuguccugcucggcg

SEQ ID NO: 960375 - RNA, 13 nt, Mycobacterium avium subsp. paratuberculosis
cagcauccaggug

SEQ ID NO: 960376 - RNA, 23 nt, Mycobacterium avium subsp. paratuberculosis
cagcauccccuuggugcggucga

SEQ ID NO: 960377 - RNA, 16 nt, Mycobacterium avium subsp. paratuberculosis
cagcagcggggugugc

SEQ ID NO: 960378 - RNA, 19 nt, Mycobacterium avium subsp. paratuberculosis
cagcagcguuccgucggcg

SEQ ID NO: 960379 - RNA, 21 nt, Mycobacterium avium subsp. paratuberculosis
cagcagcguuccgucggcgag

SEQ ID NO: 960380 - RNA, 17 nt, Mycobacterium avium subsp. paratuberculosis
cagcagcgggcccgggc

SEQ ID NO: 960381 - RNA, 20 nt, Mycobacterium avium subsp. paratuberculosis
cagcagcgggcccgggcugc

SEQ ID NO: 960382 - RNA, 14 nt, Mycobacterium avium subsp. paratuberculosis
cagcagcgggccga

SEQ ID NO: 960383 - RNA, 17 nt, Mycobacterium avium subsp. paratuberculosis
cagcagcgucacgucga

SEQ ID NO: 960384 - RNA, 20 nt, Mycobacterium avium subsp. paratuberculosis
cagcagcgucacgucgacgg

SEQ ID NO: 960385 - RNA, 20 nt, Mycobacterium avium subsp. paratuberculosis
cagcagcuucaugcccgcga

SEQ ID NO: 960386 - RNA, 15 nt, Mycobacterium avium subsp. paratuberculosis
cagcagcugcuggcg

SEQ ID NO: 960387 - RNA, 16 nt, Mycobacterium avium subsp. paratuberculosis
cagcagcugcuggcgu

SEQ ID NO: 960388 - RNA, 18 nt, Mycobacterium avium subsp. paratuberculosis
cagcagcugcuggcguga

SEQ ID NO: 960389 - RNA, 22 nt, Mycobacterium avium subsp. paratuberculosis
cagcagcuggaaauaggccggg

SEQ ID NO: 960390 - RNA, 14 nt, Mycobacterium avium subsp. paratuberculosis
cagcagcucggcga

SEQ ID NO: 960391 - RNA, 22 nt, Mycobacterium avium subsp. paratuberculosis
cagcagcucgguggcgucggcg

SEQ ID NO: 960392 - RNA, 18 nt, Mycobacterium avium subsp. paratuberculosis
cagcagcugcccgagcgg

SEQ ID NO: 960393 - RNA, 16 nt, Mycobacterium avium subsp. paratuberculosis
cagcagcucggcgauc

SEQ ID NO: 960394 - RNA, 17 nt, Mycobacterium avium subsp. paratuberculosis
cagcagcucggcgauca

SEQ ID NO: 960395 - RNA, 13 nt, Mycobacterium avium subsp. paratuberculosis
cagcagcucggcg

SEQ ID NO: 960396 - RNA, 17 nt, Mycobacterium avium subsp. paratuberculosis
cagcaggacgcgcccgg

SEQ ID NO: 960397 - RNA, 21 nt, Mycobacterium avium subsp. paratuberculosis
cagcaggacgcgcccggcgac

SEQ ID NO: 960398 - RNA, 17 nt, Mycobacterium avium subsp. paratuberculosis
cagcagcuugggggccg

SEQ ID NO: 960399 - RNA, 18 nt, Mycobacterium avium subsp. paratuberculosis
cagcagcuugggggccga

SEQ ID NO: 960400 - RNA, 17 nt, Mycobacterium avium subsp. paratuberculosis
cagcagcuugacgucgg

SEQ ID NO: 960401 - RNA, 22 nt, Mycobacterium avium subsp. paratuberculosis
cagcagcuugacgucggucagc

SEQ ID NO: 960402 - RNA, 18 nt, Mycobacterium avium subsp. paratuberculosis
cagcagcuugaucgccgg

SEQ ID NO: 960403 - RNA, 19 nt, Mycobacterium avium subsp. paratuberculosis
cagcagcuugaucgccggg

SEQ ID NO: 960404 - RNA, 22 nt, Mycobacterium avium subsp. paratuberculosis
cagcagcuugaucgccggggcg

SEQ ID NO: 960405 - RNA, 14 nt, Mycobacterium avium subsp. paratuberculosis
cagcaggcccucgg

SEQ ID NO: 960406 - RNA, 21 nt, Mycobacterium avium subsp. paratuberculosis
cagcaggcccucggccagcca

SEQ ID NO: 960407 - RNA, 22 nt, Mycobacterium avium subsp. paratuberculosis
cagcaggccccguucgguggcc

SEQ ID NO: 960408 - RNA, 16 nt, Mycobacterium avium subsp. paratuberculosis
cagcaggaccgggauc

SEQ ID NO: 960409 - RNA, 22 nt, Mycobacterium avium subsp. paratuberculosis
cagcaggaucuccggccgguga

SEQ ID NO: 960410 - RNA, 23 nt, Mycobacterium avium subsp. paratuberculosis
cagcaggaucuccggccggugau

SEQ ID NO: 960411 - RNA, 15 nt, Mycobacterium avium subsp. paratuberculosis
cagcagcagcaccag

SEQ ID NO: 960412 - RNA, 17 nt, Mycobacterium avium subsp. paratuberculosis
cagcagcgccucggcga

SEQ ID NO: 960413 - RNA, 13 nt, Mycobacterium avium subsp. paratuberculosis
cagcagcagcccg

SEQ ID NO: 960414 - RNA, 16 nt, Mycobacterium avium subsp. paratuberculosis
cagcagcagcccgccg

SEQ ID NO: 960415 - RNA, 13 nt, Mycobacterium avium subsp. paratuberculosis
cagcagcagccgc

SEQ ID NO: 960416 - RNA, 13 nt, Mycobacterium avium subsp. paratuberculosis
cagcagcagcgcc

SEQ ID NO: 960417 - RNA, 13 nt, Mycobacterium avium subsp. paratuberculosis
cagcagcgcgacg

SEQ ID NO: 960418 - RNA, 22 nt, Mycobacterium avium subsp. paratuberculosis
cagcagcgcgacgccgacgccc

SEQ ID NO: 960419 - RNA, 14 nt, Mycobacterium avium subsp. paratuberculosis
cagcagcgcggugc

SEQ ID NO: 960420 - RNA, 16 nt, Mycobacterium avium subsp. paratuberculosis
cagcagcgcggugccg

SEQ ID NO: 960421 - RNA, 13 nt, Mycobacterium avium subsp. paratuberculosis
cagcagcgcgccg

SEQ ID NO: 960422 - RNA, 13 nt, Mycobacterium avium subsp. paratuberculosis
cagcagcgcggca

SEQ ID NO: 960423 - RNA, 15 nt, Mycobacterium avium subsp. paratuberculosis
cagcagcgcggcaug

SEQ ID NO: 960424 - RNA, 14 nt, Mycobacterium avium subsp. paratuberculosis
cagcagcgcggcga

SEQ ID NO: 960425 - RNA, 17 nt, Mycobacterium avium subsp. paratuberculosis
cagcagcggcaguagcg

SEQ ID NO: 960426 - RNA, 16 nt, Mycobacterium avium subsp. paratuberculosis
cagcagcggccggcgc

SEQ ID NO: 960427 - RNA, 11 nt, Mycobacterium avium subsp. paratuberculosis
cagcagcgcgu

SEQ ID NO: 960428 - RNA, 20 nt, Mycobacterium avium subsp. paratuberculosis
cagcagcgcguaggugcggu

SEQ ID NO: 960429 - RNA, 21 nt, Mycobacterium avium subsp. paratuberculosis
cagcagcgcguaggugcgguc

SEQ ID NO: 960430 - RNA, 13 nt, Mycobacterium avium subsp. paratuberculosis
cagcagcggcacc

SEQ ID NO: 960431 - RNA, 17 nt, Mycobacterium avium subsp. paratuberculosis
cagcagcacccggguga

SEQ ID NO: 960432 - RNA, 19 nt, Mycobacterium avium subsp. paratuberculosis
cagcagcacccggucgccg

SEQ ID NO: 960433 - RNA, 11 nt, Mycobacterium avium subsp. paratuberculosis
cagcagcaccg

SEQ ID NO: 960434 - RNA, 16 nt, Mycobacterium avium subsp. paratuberculosis
cagcagcaccgcgacc

SEQ ID NO: 960435 - RNA, 20 nt, Mycobacterium avium subsp. paratuberculosis
cagcagcaccgcgaccgguc

SEQ ID NO: 960436 - RNA, 15 nt, Mycobacterium avium subsp. paratuberculosis
cagcagcaccggcgc

SEQ ID NO: 960437 - RNA, 16 nt, Mycobacterium avium subsp. paratuberculosis
cagcagcaccuggauc

SEQ ID NO: 960438 - RNA, 14 nt, Mycobacterium avium subsp. paratuberculosis
cagcagcacgccca

SEQ ID NO: 960439 - RNA, 16 nt, Mycobacterium avium subsp. paratuberculosis
cagcagcacgcccagc

SEQ ID NO: 960440 - RNA, 22 nt, Mycobacterium avium subsp. paratuberculosis
cagcagcacgcccagcccgcgg

SEQ ID NO: 960441 - RNA, 13 nt, Mycobacterium avium subsp. paratuberculosis
cagcagcagcagc

SEQ ID NO: 960442 - RNA, 16 nt, Mycobacterium avium subsp. paratuberculosis
cagcagcagcaggucg

SEQ ID NO: 960443 - RNA, 21 nt, Mycobacterium avium subsp. paratuberculosis
cagcagcacguugucgcccgg

SEQ ID NO: 960444 - RNA, 16 nt, Mycobacterium avium subsp. paratuberculosis
cagcagcagaaccagc

SEQ ID NO: 960445 - RNA, 17 nt, Mycobacterium avium subsp. paratuberculosis
cagcagcagaaccagca

SEQ ID NO: 960446 - RNA, 19 nt, Mycobacterium avium subsp. paratuberculosis
cagcagcagaaccagcacc

SEQ ID NO: 960447 - RNA, 14 nt, Mycobacterium avium subsp. paratuberculosis
cagcagcaccccga

SEQ ID NO: 960448 - RNA, 23 nt, Mycobacterium avium subsp. paratuberculosis
cagcagcaccccgaucgcgauca

SEQ ID NO: 960449 - RNA, 14 nt, Mycobacterium avium subsp. paratuberculosis
cagcagacccgacg

SEQ ID NO: 960450 - RNA, 13 nt, Mycobacterium avium subsp. paratuberculosis
cagcagaccgccg

SEQ ID NO: 960451 - RNA, 14 nt, Mycobacterium avium subsp. paratuberculosis
cagcagaccgccgg

SEQ ID NO: 960452 - RNA, 15 nt, Mycobacterium avium subsp. paratuberculosis
cagcagaccgcgauc

SEQ ID NO: 960453 - RNA, 18 nt, Mycobacterium avium subsp. paratuberculosis
cagcagaccgcgaucagc

SEQ ID NO: 960454 - RNA, 18 nt, Mycobacterium avium subsp. paratuberculosis
cagcagaaccagcaccgc

SEQ ID NO: 960455 - RNA, 16 nt, Mycobacterium avium subsp. paratuberculosis
cagcaacacccagccg

SEQ ID NO: 960456 - RNA, 19 nt, Mycobacterium avium subsp. paratuberculosis
cagcaacaccuuucggccg

SEQ ID NO: 960457 - RNA, 16 nt, Mycobacterium avium subsp. paratuberculosis
cagcaacagcagcggc

SEQ ID NO: 960458 - RNA, 17 nt, Mycobacterium avium subsp. paratuberculosis
cagcaacagcagcggca

SEQ ID NO: 960459 - RNA, 22 nt, Mycobacterium avium subsp. paratuberculosis
cagcaacagcagcggcaugccc

SEQ ID NO: 960460 - RNA, 15 nt, Mycobacterium avium subsp. paratuberculosis
cagcaauccgcugaa

SEQ ID NO: 960461 - RNA, 22 nt, Mycobacterium avium subsp. paratuberculosis
cagcaacugcucgaccagcccc

SEQ ID NO: 960462 - RNA, 15 nt, Mycobacterium avium subsp. paratuberculosis
cagauggucgccgac

SEQ ID NO: 960463 - RNA, 15 nt, Mycobacterium avium subsp. paratuberculosis
cagauggggaucgaa

SEQ ID NO: 960464 - RNA, 23 nt, Mycobacterium avium subsp. paratuberculosis
cagauugcggcccuugcggccga

SEQ ID NO: 960465 - RNA, 23 nt, Mycobacterium avium subsp. paratuberculosis
cagaugccguuccagggugucga

SEQ ID NO: 960466 - RNA, 17 nt, Mycobacterium avium subsp. paratuberculosis
cagaugccugcccagcg

SEQ ID NO: 960467 - RNA, 23 nt, Mycobacterium avium subsp. paratuberculosis
cagaugccugcccagcggcacgg

SEQ ID NO: 960468 - RNA, 23 nt, Mycobacterium avium subsp. paratuberculosis
cagaugaugccgucacugucggc

SEQ ID NO: 960469 - RNA, 16 nt, Mycobacterium avium subsp. paratuberculosis
cagaugcaccucgccc

SEQ ID NO: 960470 - RNA, 23 nt, Mycobacterium avium subsp. paratuberculosis
cagaugcaccucgcccugcagcc

SEQ ID NO: 960471 - RNA, 16 nt, Mycobacterium avium subsp. paratuberculosis
cagaugcgcgacggcc

SEQ ID NO: 960472 - RNA, 17 nt, Mycobacterium avium subsp. paratuberculosis
cagaugcgcgucgcggc

SEQ ID NO: 960473 - RNA, 21 nt, Mycobacterium avium subsp. paratuberculosis
cagaugcgcgucgcggcgcgg

SEQ ID NO: 960474 - RNA, 22 nt, Mycobacterium avium subsp. paratuberculosis
cagaugcgcgucgcggcgcgga

SEQ ID NO: 960475 - RNA, 22 nt, Mycobacterium avium subsp. paratuberculosis
cagaugcggcaccagcccgccg

SEQ ID NO: 960476 - RNA, 21 nt, Mycobacterium avium subsp. paratuberculosis
cagcacgcugaagcccaccgc

SEQ ID NO: 960477 - RNA, 21 nt, Mycobacterium avium subsp. paratuberculosis
cagcacggaacccaaggcgga

SEQ ID NO: 960478 - RNA, 20 nt, Mycobacterium avium subsp. paratuberculosis
cagcacggcaaugguugcgg

SEQ ID NO: 960479 - RNA, 22 nt, Mycobacterium avium subsp. paratuberculosis
cagcacggcauagauaccggcc

SEQ ID NO: 960480 - RNA, 17 nt, Mycobacterium avium subsp. paratuberculosis
cagcacggcaucgaugg

SEQ ID NO: 960481 - RNA, 19 nt, Mycobacterium avium subsp. paratuberculosis
cagcacggcaucgauggcg

SEQ ID NO: 960482 - RNA, 22 nt, Mycobacterium avium subsp. paratuberculosis
cagcacggcaucgauggcgggc

SEQ ID NO: 960483 - RNA, 13 nt, Mycobacterium avium subsp. paratuberculosis
cagcacggccacc

SEQ ID NO: 960484 - RNA, 14 nt, Mycobacterium avium subsp. paratuberculosis
cagcacggccacca

SEQ ID NO: 960485 - RNA, 17 nt, Mycobacterium avium subsp. paratuberculosis
cagcacggccaccagca

SEQ ID NO: 960486 - RNA, 19 nt, Mycobacterium avium subsp. paratuberculosis
cagcacggccaccagcagc

SEQ ID NO: 960487 - RNA, 17 nt, Mycobacterium avium subsp. paratuberculosis
cagcaccuucgggccga

SEQ ID NO: 960488 - RNA, 20 nt, Mycobacterium avium subsp. paratuberculosis
cagcacgcugaucaccacgg

SEQ ID NO: 960489 - RNA, 23 nt, Mycobacterium avium subsp. paratuberculosis
cagcacgcugaucaccacgguca

SEQ ID NO: 960490 - RNA, 15 nt, Mycobacterium avium subsp. paratuberculosis
cagcacugagcggca

SEQ ID NO: 960491 - RNA, 22 nt, Mycobacterium avium subsp. paratuberculosis
cagcacgcggaucgcgcugacc

SEQ ID NO: 960492 - RNA, 16 nt, Mycobacterium avium subsp. paratuberculosis
cagcacgccggucagc

SEQ ID NO: 960493 - RNA, 14 nt, Mycobacterium avium subsp. paratuberculosis
cagcacgccguuga

SEQ ID NO: 960494 - RNA, 12 nt, Mycobacterium avium subsp. paratuberculosis
cagcacgccuuc

SEQ ID NO: 960495 - RNA, 13 nt, Mycobacterium avium subsp. paratuberculosis
cagcacgccuucc

SEQ ID NO: 960496 - RNA, 14 nt, Mycobacterium avium subsp. paratuberculosis
cagcacgccggccg

SEQ ID NO: 960497 - RNA, 19 nt, Mycobacterium avium subsp. paratuberculosis
cagcacgccggccggcgug

SEQ ID NO: 960498 - RNA, 12 nt, Mycobacterium avium subsp. paratuberculosis
cagcacgccggc

SEQ ID NO: 960499 - RNA, 15 nt, Mycobacterium avium subsp. paratuberculosis
cagcacgacgccgcu

SEQ ID NO: 960500 - RNA, 23 nt, Mycobacterium avium subsp. paratuberculosis
cagcacgacaccgacgaccauca

SEQ ID NO: 960501 - RNA, 17 nt, Mycobacterium avium subsp. paratuberculosis
cagcaccuucagcgggc

SEQ ID NO: 960502 - RNA, 17 nt, Mycobacterium avium subsp. paratuberculosis
cagcacgaaggccgccg

SEQ ID NO: 960503 - RNA, 18 nt, Mycobacterium avium subsp. paratuberculosis
cagcacgaaggccgccgg

SEQ ID NO: 960504 - RNA, 22 nt, Mycobacterium avium subsp. paratuberculosis
cagcaccuugcccaggugcaga

SEQ ID NO: 960505 - RNA, 17 nt, Mycobacterium avium subsp. paratuberculosis
cagcacgaacaccacgu

SEQ ID NO: 960506 - RNA, 17 nt, Mycobacterium avium subsp. paratuberculosis
cagcacgaacagcagcg

SEQ ID NO: 960507 - RNA, 20 nt, Mycobacterium avium subsp. paratuberculosis
cagcacgaacagcagcggga

SEQ ID NO: 960508 - RNA, 16 nt, Mycobacterium avium subsp. paratuberculosis
cagcaccucgucgccc

SEQ ID NO: 960509 - RNA, 22 nt, Mycobacterium avium subsp. paratuberculosis
cagcaccucgucgcccggcguc

SEQ ID NO: 960510 - RNA, 23 nt, Mycobacterium avium subsp. paratuberculosis
cagcaccucgucgcccggcgucc

SEQ ID NO: 960511 - RNA, 18 nt, Mycobacterium avium subsp. paratuberculosis
cagcaccuggcgcaccgc

SEQ ID NO: 960512 - RNA, 19 nt, Mycobacterium avium subsp. paratuberculosis
cagcaccuggcgcaccgcc

SEQ ID NO: 960513 - RNA, 20 nt, Mycobacterium avium subsp. paratuberculosis
cagcaccuggcgcaccgccg

SEQ ID NO: 960514 - RNA, 17 nt, Mycobacterium avium subsp. paratuberculosis
cagcaccugaccgucgg

SEQ ID NO: 960515 - RNA, 21 nt, Mycobacterium avium subsp. paratuberculosis
cagcaccugaccgucggccag

SEQ ID NO: 960516 - RNA, 11 nt, Mycobacterium avium subsp. paratuberculosis
cagcaccggcu

SEQ ID NO: 960517 - RNA, 13 nt, Mycobacterium avium subsp. paratuberculosis
cagcaccggcgcc

SEQ ID NO: 960518 - RNA, 14 nt, Mycobacterium avium subsp. paratuberculosis
cagcaccggcgcgc

SEQ ID NO: 960519 - RNA, 19 nt, Mycobacterium avium subsp. paratuberculosis
cagcaccggcgcgccgcgu

SEQ ID NO: 960520 - RNA, 12 nt, Mycobacterium avium subsp. paratuberculosis
cagcaccggcgu

SEQ ID NO: 960521 - RNA, 14 nt, Mycobacterium avium subsp. paratuberculosis
cagcaccggcgucg

SEQ ID NO: 960522 - RNA, 17 nt, Mycobacterium avium subsp. paratuberculosis
cagcaccggcgucgaca

SEQ ID NO: 960523 - RNA, 18 nt, Mycobacterium avium subsp. paratuberculosis
cagcaccggcgucgacag

SEQ ID NO: 960524 - RNA, 17 nt, Mycobacterium avium subsp. paratuberculosis
cagcaccggcaccgcca

SEQ ID NO: 960525 - RNA, 16 nt, Mycobacterium avium subsp. paratuberculosis
cagcaccggcaccgcg

SEQ ID NO: 960526 - RNA, 13 nt, Mycobacterium avium subsp. paratuberculosis
cagcaccggccgg

SEQ ID NO: 960527 - RNA, 12 nt, Mycobacterium avium subsp. paratuberculosis
cagcaccggcgc

SEQ ID NO: 960528 - RNA, 14 nt, Mycobacterium avium subsp. paratuberculosis
cagcaccgacagcu

SEQ ID NO: 960529 - RNA, 19 nt, Mycobacterium avium subsp. paratuberculosis
cagcaccgacgcggcgacc

SEQ ID NO: 960530 - RNA, 23 nt, Mycobacterium avium subsp. paratuberculosis
cagcaccgacgcggcgaccacca

SEQ ID NO: 960531 - RNA, 15 nt, Mycobacterium avium subsp. paratuberculosis
cagcaccgaugccag

SEQ ID NO: 960532 - RNA, 19 nt, Mycobacterium avium subsp. paratuberculosis
cagcacccggucgccggug

SEQ ID NO: 960533 - RNA, 14 nt, Mycobacterium avium subsp. paratuberculosis
cagcacccgguucc

SEQ ID NO: 960534 - RNA, 22 nt, Mycobacterium avium subsp. paratuberculosis
cagcacccgguuccaccgggcc

SEQ ID NO: 960535 - RNA, 14 nt, Mycobacterium avium subsp. paratuberculosis
cagcacccggguga

SEQ ID NO: 960536 - RNA, 16 nt, Mycobacterium avium subsp. paratuberculosis
cagcaccgccacggcg

SEQ ID NO: 960537 - RNA, 17 nt, Mycobacterium avium subsp. paratuberculosis
cagcaccgccacggcga

SEQ ID NO: 960538 - RNA, 18 nt, Mycobacterium avium subsp. paratuberculosis
cagcaccgccacggcgac

SEQ ID NO: 960539 - RNA, 17 nt, Mycobacterium avium subsp. paratuberculosis
cagcaccgccagcaucc

SEQ ID NO: 960540 - RNA, 19 nt, Mycobacterium avium subsp. paratuberculosis
cagcaccgccacgccguug

SEQ ID NO: 960541 - RNA, 21 nt, Mycobacterium avium subsp. paratuberculosis
cagcaccgccagcgccggcag

SEQ ID NO: 960542 - RNA, 23 nt, Mycobacterium avium subsp. paratuberculosis
cagcaccgccagcgccggcagca

SEQ ID NO: 960543 - RNA, 13 nt, Mycobacterium avium subsp. paratuberculosis
cagcaccgccauc

SEQ ID NO: 960544 - RNA, 15 nt, Mycobacterium avium subsp. paratuberculosis
cagcaccgccaucgc

SEQ ID NO: 960545 - RNA, 19 nt, Mycobacterium avium subsp. paratuberculosis
cagcaccgccaucgcggcg

SEQ ID NO: 960546 - RNA, 14 nt, Mycobacterium avium subsp. paratuberculosis
cagcaccgcggcgu

SEQ ID NO: 960547 - RNA, 12 nt, Mycobacterium avium subsp. paratuberculosis
cagcaccgcguc

SEQ ID NO: 960548 - RNA, 16 nt, Mycobacterium avium subsp. paratuberculosis
cagcaccgcgaccggu

SEQ ID NO: 960549 - RNA, 14 nt, Mycobacterium avium subsp. paratuberculosis
cagcaccgcgcggc

SEQ ID NO: 960550 - RNA, 15 nt, Mycobacterium avium subsp. paratuberculosis
cagcaccgcgcggcg

SEQ ID NO: 960551 - RNA, 16 nt, Mycobacterium avium subsp. paratuberculosis
cagcaccgcgcggcgg

SEQ ID NO: 960552 - RNA, 23 nt, Mycobacterium avium subsp. paratuberculosis
cagcaccgcgcggcggugcucgc

SEQ ID NO: 960553 - RNA, 14 nt, Mycobacterium avium subsp. paratuberculosis
cagcaccgcggccg

SEQ ID NO: 960554 - RNA, 19 nt, Mycobacterium avium subsp. paratuberculosis
cagcaccgcggccgucgcg

SEQ ID NO: 960555 - RNA, 16 nt, Mycobacterium avium subsp. paratuberculosis
cagcaccgcggcgauc

SEQ ID NO: 960556 - RNA, 20 nt, Mycobacterium avium subsp. paratuberculosis
cagcaccgccgcggccgcga

SEQ ID NO: 960557 - RNA, 22 nt, Mycobacterium avium subsp. paratuberculosis
cagcaccgccgcggccgcgaug

SEQ ID NO: 960558 - RNA, 15 nt, Mycobacterium avium subsp. paratuberculosis
cagcaccgccgcggg

SEQ ID NO: 960559 - RNA, 19 nt, Mycobacterium avium subsp. paratuberculosis
cagcaccgccaccggcccg

SEQ ID NO: 960560 - RNA, 12 nt, Mycobacterium avium subsp. paratuberculosis
cagcaccgccga

SEQ ID NO: 960561 - RNA, 15 nt, Mycobacterium avium subsp. paratuberculosis
cagcaccgccggcgc

SEQ ID NO: 960562 - RNA, 19 nt, Mycobacterium avium subsp. paratuberculosis
cagcaccgccucggccacc

SEQ ID NO: 960563 - RNA, 10 nt, Mycobacterium avium subsp. paratuberculosis
cagcaccgcg

SEQ ID NO: 960564 - RNA, 13 nt, Mycobacterium avium subsp. paratuberculosis
cagcaccgcgacc

SEQ ID NO: 960565 - RNA, 18 nt, Mycobacterium avium subsp. paratuberculosis
cagcacccccucggcgcc

SEQ ID NO: 960566 - RNA, 14 nt, Mycobacterium avium subsp. paratuberculosis
cagcacccagcaca

SEQ ID NO: 960567 - RNA, 20 nt, Mycobacterium avium subsp. paratuberculosis
cagcaauugacgccgacagc

SEQ ID NO: 960568 - RNA, 14 nt, Mycobacterium avium subsp. paratuberculosis
cagcaccccgccgc

SEQ ID NO: 960569 - RNA, 15 nt, Mycobacterium avium subsp. paratuberculosis
cagcaccccgccgca

SEQ ID NO: 960570 - RNA, 18 nt, Mycobacterium avium subsp. paratuberculosis
cagcaccccgccgcagcc

SEQ ID NO: 960571 - RNA, 14 nt, Mycobacterium avium subsp. paratuberculosis
cagcaccccgucga

SEQ ID NO: 960572 - RNA, 15 nt, Mycobacterium avium subsp. paratuberculosis
cagcaccccgucgag

SEQ ID NO: 960573 - RNA, 19 nt, Mycobacterium avium subsp. paratuberculosis
cagcaccccgucgagguuc

SEQ ID NO: 960574 - RNA, 21 nt, Mycobacterium avium subsp. paratuberculosis
cagcacccgcaacgcgcgcga

SEQ ID NO: 960575 - RNA, 23 nt, Mycobacterium avium subsp. paratuberculosis
cagcacccgcaacgcgcgcgacg

SEQ ID NO: 960576 - RNA, 16 nt, Mycobacterium avium subsp. paratuberculosis
cagcacccgcaccgug

SEQ ID NO: 960577 - RNA, 13 nt, Mycobacterium avium subsp. paratuberculosis
cagcacccgcagc

SEQ ID NO: 960578 - RNA, 18 nt, Mycobacterium avium subsp. paratuberculosis
cagcacccgcagccgcga

SEQ ID NO: 960579 - RNA, 20 nt, Mycobacterium avium subsp. paratuberculosis
cagcacccgcugcagccggu

SEQ ID NO: 960580 - RNA, 22 nt, Mycobacterium avium subsp. paratuberculosis
cagcacccggcccacgccgucg

SEQ ID NO: 960581 - RNA, 23 nt, Mycobacterium avium subsp. paratuberculosis
cagcacccggcccacgccgucgu

SEQ ID NO: 960582 - RNA, 14 nt, Mycobacterium avium subsp. paratuberculosis
cagcacccggcccc

SEQ ID NO: 960583 - RNA, 23 nt, Mycobacterium avium subsp. paratuberculosis
cagcacccgcaucaacugcacca

SEQ ID NO: 960584 - RNA, 19 nt, Mycobacterium avium subsp. paratuberculosis
cagcacccgcucgccgaug

SEQ ID NO: 960585 - RNA, 23 nt, Mycobacterium avium subsp. paratuberculosis
cagcacccgggccugcggcggcc

SEQ ID NO: 960586 - RNA, 16 nt, Mycobacterium avium subsp. paratuberculosis
cagacgauuugggcgg

SEQ ID NO: 960587 - RNA, 20 nt, Mycobacterium avium subsp. paratuberculosis
cagacgauuugggcgguccg

SEQ ID NO: 960588 - RNA, 19 nt, Mycobacterium avium subsp. paratuberculosis
cagacgcaaaagccccgcg

SEQ ID NO: 960589 - RNA, 20 nt, Mycobacterium avium subsp. paratuberculosis
cagacgcaaaagccccgcga

SEQ ID NO: 960590 - RNA, 16 nt, Mycobacterium avium subsp. paratuberculosis
cagacgaugggccgcc

SEQ ID NO: 960591 - RNA, 17 nt, Mycobacterium avium subsp. paratuberculosis
cagacgaugggccgccc

SEQ ID NO: 960592 - RNA, 18 nt, Mycobacterium avium subsp. paratuberculosis
cagacgaugggccgcccg

SEQ ID NO: 960593 - RNA, 16 nt, Mycobacterium avium subsp. paratuberculosis
cagacgaugucgucgc

SEQ ID NO: 960594 - RNA, 16 nt, Mycobacterium avium subsp. paratuberculosis
cagacaggccggccgc

SEQ ID NO: 960595 - RNA, 18 nt, Mycobacterium avium subsp. paratuberculosis
cagacaggccggccgcua

SEQ ID NO: 960596 - RNA, 18 nt, Mycobacterium avium subsp. paratuberculosis
cagacacaaaagcaccca

SEQ ID NO: 960597 - RNA, 15 nt, Mycobacterium avium subsp. paratuberculosis
cagaaucuucgccuc

SEQ ID NO: 960598 - RNA, 15 nt, Mycobacterium avium subsp. paratuberculosis
cagacucagcccggc

SEQ ID NO: 960599 - RNA, 22 nt, Mycobacterium avium subsp. paratuberculosis
cagacucacggcggcagcgcgg

SEQ ID NO: 960600 - RNA, 23 nt, Mycobacterium avium subsp. paratuberculosis
cagacucacggcggcagcgcggc

SEQ ID NO: 960601 - RNA, 21 nt, Mycobacterium avium subsp. paratuberculosis
cagacguuuccguccggcgac

SEQ ID NO: 960602 - RNA, 19 nt, Mycobacterium avium subsp. paratuberculosis
cagacguccagcgccgcca

SEQ ID NO: 960603 - RNA, 17 nt, Mycobacterium avium subsp. paratuberculosis
cagacguguggcacccg

SEQ ID NO: 960604 - RNA, 19 nt, Mycobacterium avium subsp. paratuberculosis
cagacguguggcacccggg

SEQ ID NO: 960605 - RNA, 15 nt, Mycobacterium avium subsp. paratuberculosis
cagacguagcaccag

SEQ ID NO: 960606 - RNA, 13 nt, Mycobacterium avium subsp. paratuberculosis
cagacgguggggc

SEQ ID NO: 960607 - RNA, 21 nt, Mycobacterium avium subsp. paratuberculosis
cagacgguggggcuggccgca

SEQ ID NO: 960608 - RNA, 16 nt, Mycobacterium avium subsp. paratuberculosis
cagacgguuccaccgg

SEQ ID NO: 960609 - RNA, 18 nt, Mycobacterium avium subsp. paratuberculosis
cagacgguuccaccgguc

SEQ ID NO: 960610 - RNA, 21 nt, Mycobacterium avium subsp. paratuberculosis
cagaucaccacgguggccgcg

SEQ ID NO: 960611 - RNA, 13 nt, Mycobacterium avium subsp. paratuberculosis
cagaucagcgugg

SEQ ID NO: 960612 - RNA, 19 nt, Mycobacterium avium subsp. paratuberculosis
cagaucagcguggucagcg

SEQ ID NO: 960613 - RNA, 16 nt, Mycobacterium avium subsp. paratuberculosis
cagauaggacccggcg

SEQ ID NO: 960614 - RNA, 17 nt, Mycobacterium avium subsp. paratuberculosis
cagauaggacccggcga

SEQ ID NO: 960615 - RNA, 15 nt, Mycobacterium avium subsp. paratuberculosis
cagauaggccagcgc

SEQ ID NO: 960616 - RNA, 16 nt, Mycobacterium avium subsp. paratuberculosis
cagauaggccagcgcg

SEQ ID NO: 960617 - RNA, 17 nt, Mycobacterium avium subsp. paratuberculosis
cagauaggccagcgcgu

SEQ ID NO: 960618 - RNA, 13 nt, Mycobacterium avium subsp. paratuberculosis
cagauaggcggcg

SEQ ID NO: 960619 - RNA, 22 nt, Mycobacterium avium subsp. paratuberculosis
cagauaggcggcgacggcgucg

SEQ ID NO: 960620 - RNA, 20 nt, Mycobacterium avium subsp. paratuberculosis
cagagcgggaucccgcagcc

SEQ ID NO: 960621 - RNA, 22 nt, Mycobacterium avium subsp. paratuberculosis
cagaucgccuggcagcugccga

SEQ ID NO: 960622 - RNA, 18 nt, Mycobacterium avium subsp. paratuberculosis
cagaucgccagcaccggc

SEQ ID NO: 960623 - RNA, 19 nt, Mycobacterium avium subsp. paratuberculosis
cagaucgccagcaccggcg

SEQ ID NO: 960624 - RNA, 22 nt, Mycobacterium avium subsp. paratuberculosis
cagaucgccagcaccggcgcgc

SEQ ID NO: 960625 - RNA, 21 nt, Mycobacterium avium subsp. paratuberculosis
cagaucgcccaucaccgcacc

SEQ ID NO: 960626 - RNA, 22 nt, Mycobacterium avium subsp. paratuberculosis
cagaucgcccaucaccgcaccg

SEQ ID NO: 960627 - RNA, 16 nt, Mycobacterium avium subsp. paratuberculosis
cagaucgcccgggcgg

SEQ ID NO: 960628 - RNA, 21 nt, Mycobacterium avium subsp. paratuberculosis
cagaucgcccgggcggcgggg

SEQ ID NO: 960629 - RNA, 20 nt, Mycobacterium avium subsp. paratuberculosis
cagaucgccgcccaucggca

SEQ ID NO: 960630 - RNA, 19 nt, Mycobacterium avium subsp. paratuberculosis
cagaucgacgccgaccgcg

SEQ ID NO: 960631 - RNA, 22 nt, Mycobacterium avium subsp. paratuberculosis
cagaucgacgccgaccgcgguc

SEQ ID NO: 960632 - RNA, 19 nt, Mycobacterium avium subsp. paratuberculosis
cagaucgacgccgcggugg

SEQ ID NO: 960633 - RNA, 19 nt, Mycobacterium avium subsp. paratuberculosis
cagaucgagcugggcccgc

SEQ ID NO: 960634 - RNA, 15 nt, Mycobacterium avium subsp. paratuberculosis
cagaucgaggccagc

SEQ ID NO: 960635 - RNA, 18 nt, Mycobacterium avium subsp. paratuberculosis
cagaucgaggccagcgcg

SEQ ID NO: 960636 - RNA, 22 nt, Mycobacterium avium subsp. paratuberculosis
cagaucgauggggauggugcgc

SEQ ID NO: 960637 - RNA, 14 nt, Mycobacterium avium subsp. paratuberculosis
cagaucccgcagcu

SEQ ID NO: 960638 - RNA, 17 nt, Mycobacterium avium subsp. paratuberculosis
cagaucccgccggcggc

SEQ ID NO: 960639 - RNA, 18 nt, Mycobacterium avium subsp. paratuberculosis
cagauccgcucgccgucg

SEQ ID NO: 960640 - RNA, 15 nt, Mycobacterium avium subsp. paratuberculosis
cagaucguguccgcg

SEQ ID NO: 960641 - RNA, 18 nt, Mycobacterium avium subsp. paratuberculosis
cagaucguguccgcgccg

SEQ ID NO: 960642 - RNA, 19 nt, Mycobacterium avium subsp. paratuberculosis
cagaucguguccgcgccgg

SEQ ID NO: 960643 - RNA, 22 nt, Mycobacterium avium subsp. paratuberculosis
cagaucguguccgcgccggcgc

SEQ ID NO: 960644 - RNA, 23 nt, Mycobacterium avium subsp. paratuberculosis
cagaucguugaugucgguggugu

SEQ ID NO: 960645 - RNA, 23 nt, Mycobacterium avium subsp. paratuberculosis
cagaucguugggcaugucgccga

SEQ ID NO: 960646 - RNA, 16 nt, Mycobacterium avium subsp. paratuberculosis
cagaucuccgccuucg

SEQ ID NO: 960647 - RNA, 15 nt, Mycobacterium avium subsp. paratuberculosis
cagaucgucgggcac

SEQ ID NO: 960648 - RNA, 19 nt, Mycobacterium avium subsp. paratuberculosis
cagaucugucuucgcgguc

SEQ ID NO: 960649 - RNA, 20 nt, Mycobacterium avium subsp. paratuberculosis
cagaucggagacguccucgg

SEQ ID NO: 960650 - RNA, 13 nt, Mycobacterium avium subsp. paratuberculosis
cagaucgcggccc

SEQ ID NO: 960651 - RNA, 12 nt, Mycobacterium avium subsp. paratuberculosis
cagaucggccag

SEQ ID NO: 960652 - RNA, 13 nt, Mycobacterium avium subsp. paratuberculosis
cagaucggccagc

SEQ ID NO: 960653 - RNA, 17 nt, Mycobacterium avium subsp. paratuberculosis
cagaucggccagcgcgg

SEQ ID NO: 960654 - RNA, 15 nt, Mycobacterium avium subsp. paratuberculosis
cagaucggcgggugc

SEQ ID NO: 960655 - RNA, 21 nt, Mycobacterium avium subsp. paratuberculosis
cagaucggcgucacugcccag

SEQ ID NO: 960656 - RNA, 13 nt, Mycobacterium avium subsp. paratuberculosis
cagaucggguccc

SEQ ID NO: 960657 - RNA, 16 nt, Mycobacterium avium subsp. paratuberculosis
cagaucgggucgcccg

SEQ ID NO: 960658 - RNA, 20 nt, Mycobacterium avium subsp. paratuberculosis
cagaucguagggcucggcgu

SEQ ID NO: 960659 - RNA, 22 nt, Mycobacterium avium subsp. paratuberculosis
cagaucguagggcucggcgucg

SEQ ID NO: 960660 - RNA, 15 nt, Mycobacterium avium subsp. paratuberculosis
cagaucggcgcgcgg

SEQ ID NO: 960661 - RNA, 21 nt, Mycobacterium avium subsp. paratuberculosis
cagaucgucgaacucgggccc

SEQ ID NO: 960662 - RNA, 15 nt, Mycobacterium avium subsp. paratuberculosis
cagaaaucgccggga

SEQ ID NO: 960663 - RNA, 16 nt, Mycobacterium avium subsp. paratuberculosis
cagaacaccacggugu

SEQ ID NO: 960664 - RNA, 14 nt, Mycobacterium avium subsp. paratuberculosis
cagaacaccagcgc

SEQ ID NO: 960665 - RNA, 14 nt, Mycobacterium avium subsp. paratuberculosis
cagaacacgccccg

SEQ ID NO: 960666 - RNA, 21 nt, Mycobacterium avium subsp. paratuberculosis
cagaacacguuucggcccucc

SEQ ID NO: 960667 - RNA, 21 nt, Mycobacterium avium subsp. paratuberculosis
cagaacagccgguccgaccgc

SEQ ID NO: 960668 - RNA, 20 nt, Mycobacterium avium subsp. paratuberculosis
cagaaccgcaccccgucgcg

SEQ ID NO: 960669 - RNA, 22 nt, Mycobacterium avium subsp. paratuberculosis
cagaaccgcaccccgucgcgga

SEQ ID NO: 960670 - RNA, 22 nt, Mycobacterium avium subsp. paratuberculosis
cagaaccaccugggcgucgucg

SEQ ID NO: 960671 - RNA, 14 nt, Mycobacterium avium subsp. paratuberculosis
cagaaccagcaccg

SEQ ID NO: 960672 - RNA, 23 nt, Mycobacterium avium subsp. paratuberculosis
cagaaccauuugcccagcagggc

SEQ ID NO: 960673 - RNA, 22 nt, Mycobacterium avium subsp. paratuberculosis
cagaaccgcucggcggcgccgu

SEQ ID NO: 960674 - RNA, 19 nt, Mycobacterium avium subsp. paratuberculosis
cagaaccggggccagcacg

SEQ ID NO: 960675 - RNA, 20 nt, Mycobacterium avium subsp. paratuberculosis
cagaaccggggccagcacgc

SEQ ID NO: 960676 - RNA, 23 nt, Mycobacterium avium subsp. paratuberculosis
cagaacgaguuucccgucgucga

SEQ ID NO: 960677 - RNA, 16 nt, Mycobacterium avium subsp. paratuberculosis
cagaacggcggcagcg

SEQ ID NO: 960678 - RNA, 20 nt, Mycobacterium avium subsp. paratuberculosis
cagaacggcggcagcgaggc

SEQ ID NO: 960679 - RNA, 17 nt, Mycobacterium avium subsp. paratuberculosis
cagaacugggccgccgu

SEQ ID NO: 960680 - RNA, 16 nt, Mycobacterium avium subsp. paratuberculosis
cagaacucggcggcgg

SEQ ID NO: 960681 - RNA, 16 nt, Mycobacterium avium subsp. paratuberculosis
cagaacugguccucca

SEQ ID NO: 960682 - RNA, 19 nt, Mycobacterium avium subsp. paratuberculosis
cagaacuucuccgccggca

SEQ ID NO: 960683 - RNA, 22 nt, Mycobacterium avium subsp. paratuberculosis
cacuggagugcugcagaccgaa

SEQ ID NO: 960684 - RNA, 20 nt, Mycobacterium avium subsp. paratuberculosis
cacuuggccucgggcgacga

SEQ ID NO: 960685 - RNA, 16 nt, Mycobacterium avium subsp. paratuberculosis
cacuugaagccgguga

SEQ ID NO: 960686 - RNA, 19 nt, Mycobacterium avium subsp. paratuberculosis
cacuucuggcgcugcucgg

SEQ ID NO: 960687 - RNA, 17 nt, Mycobacterium avium subsp. paratuberculosis
cacuucuccacgccgac

SEQ ID NO: 960688 - RNA, 18 nt, Mycobacterium avium subsp. paratuberculosis
cacuucuccacgccgacg

SEQ ID NO: 960689 - RNA, 20 nt, Mycobacterium avium subsp. paratuberculosis
cacuucggguguggugccgg

SEQ ID NO: 960690 - RNA, 24 nt, Mycobacterium avium subsp. paratuberculosis
cacuucgaucaucuccacccggca

SEQ ID NO: 960691 - RNA, 12 nt, Mycobacterium avium subsp. paratuberculosis
cacuucgccggg

SEQ ID NO: 960692 - RNA, 14 nt, Mycobacterium avium subsp. paratuberculosis
cacuuccgcgcagg

SEQ ID NO: 960693 - RNA, 19 nt, Mycobacterium avium subsp. paratuberculosis
cacuucgacggcagcggca

SEQ ID NO: 960694 - RNA, 14 nt, Mycobacterium avium subsp. paratuberculosis
cacuucgacgguga

SEQ ID NO: 960695 - RNA, 16 nt, Mycobacterium avium subsp. paratuberculosis
cacuucgacggugaug

SEQ ID NO: 960696 - RNA, 17 nt, Mycobacterium avium subsp. paratuberculosis
cacuagguccggcgcga

SEQ ID NO: 960697 - RNA, 17 nt, Mycobacterium avium subsp. paratuberculosis
cacguugugcucgucga

SEQ ID NO: 960698 - RNA, 16 nt, Mycobacterium avium subsp. paratuberculosis
cacguugugggcgggc

SEQ ID NO: 960699 - RNA, 19 nt, Mycobacterium avium subsp. paratuberculosis
cacguuggcggccagcgcg

SEQ ID NO: 960700 - RNA, 17 nt, Mycobacterium avium subsp. paratuberculosis
cacguugcgcaucagcg

SEQ ID NO: 960701 - RNA, 17 nt, Mycobacterium avium subsp. paratuberculosis
cacguugcgcggccgca

SEQ ID NO: 960702 - RNA, 14 nt, Mycobacterium avium subsp. paratuberculosis
cacguuggcggcca

SEQ ID NO: 960703 - RNA, 17 nt, Mycobacterium avium subsp. paratuberculosis
cacguuggcggccagcg

SEQ ID NO: 960704 - RNA, 15 nt, Mycobacterium avium subsp. paratuberculosis
cacguugucgcggcc

SEQ ID NO: 960705 - RNA, 23 nt, Mycobacterium avium subsp. paratuberculosis
cacgccuugcgguuggccggaau

SEQ ID NO: 960706 - RNA, 12 nt, Mycobacterium avium subsp. paratuberculosis
cacgcgaacacc

SEQ ID NO: 960707 - RNA, 14 nt, Mycobacterium avium subsp. paratuberculosis
cacgcgagacgagc

SEQ ID NO: 960708 - RNA, 15 nt, Mycobacterium avium subsp. paratuberculosis
cacgcgaucaggucc

SEQ ID NO: 960709 - RNA, 15 nt, Mycobacterium avium subsp. paratuberculosis
cacguugagcacgcc

SEQ ID NO: 960710 - RNA, 21 nt, Mycobacterium avium subsp. paratuberculosis
cacguugagcccggaccggcc

SEQ ID NO: 960711 - RNA, 18 nt, Mycobacterium avium subsp. paratuberculosis
cacgcgcagggcgaacgg

SEQ ID NO: 960712 - RNA, 22 nt, Mycobacterium avium subsp. paratuberculosis
cacgcgcagggcgaacggcgga

SEQ ID NO: 960713 - RNA, 21 nt, Mycobacterium avium subsp. paratuberculosis
cacguugagucccucggcgag

SEQ ID NO: 960714 - RNA, 18 nt, Mycobacterium avium subsp. paratuberculosis
cacguugaugaucgccga

SEQ ID NO: 960715 - RNA, 19 nt, Mycobacterium avium subsp. paratuberculosis
cacguugaugaucgccgau

SEQ ID NO: 960716 - RNA, 20 nt, Mycobacterium avium subsp. paratuberculosis
cacguugaugaucgccgauc

SEQ ID NO: 960717 - RNA, 13 nt, Mycobacterium avium subsp. paratuberculosis
cacguugaugccg

SEQ ID NO: 960718 - RNA, 19 nt, Mycobacterium avium subsp. paratuberculosis
cacguugaugccgcccagc

SEQ ID NO: 960719 - RNA, 23 nt, Mycobacterium avium subsp. paratuberculosis
cacguugaugccgcccagcagcg

SEQ ID NO: 960720 - RNA, 16 nt, Mycobacterium avium subsp. paratuberculosis
cacguugcacggcagc

SEQ ID NO: 960721 - RNA, 16 nt, Mycobacterium avium subsp. paratuberculosis
cacugaucccuccguc

SEQ ID NO: 960722 - RNA, 15 nt, Mycobacterium avium subsp. paratuberculosis
cacugauccgucauc

SEQ ID NO: 960723 - RNA, 16 nt, Mycobacterium avium subsp. paratuberculosis
cacucgaacggcccgg

SEQ ID NO: 960724 - RNA, 23 nt, Mycobacterium avium subsp. paratuberculosis
cacucgaacggcccggacggagc

SEQ ID NO: 960725 - RNA, 16 nt, Mycobacterium avium subsp. paratuberculosis
cacuccgucgcgauca

SEQ ID NO: 960726 - RNA, 14 nt, Mycobacterium avium subsp. paratuberculosis
cacucccuuguugc

SEQ ID NO: 960727 - RNA, 13 nt, Mycobacterium avium subsp. paratuberculosis
cacucccgcgcgc

SEQ ID NO: 960728 - RNA, 13 nt, Mycobacterium avium subsp. paratuberculosis
cacucccagccgc

SEQ ID NO: 960729 - RNA, 15 nt, Mycobacterium avium subsp. paratuberculosis
cacucccagccgccg

SEQ ID NO: 960730 - RNA, 16 nt, Mycobacterium avium subsp. paratuberculosis
cacucccagccgccgg

SEQ ID NO: 960731 - RNA, 16 nt, Mycobacterium avium subsp. paratuberculosis
cacuccagcggcggcc

SEQ ID NO: 960732 - RNA, 23 nt, Mycobacterium avium subsp. paratuberculosis
cacuccaggguucucgcggcggc

SEQ ID NO: 960733 - RNA, 14 nt, Mycobacterium avium subsp. paratuberculosis
cacucauguucagg

SEQ ID NO: 960734 - RNA, 21 nt, Mycobacterium avium subsp. paratuberculosis
cacucauguucagggugcguu

SEQ ID NO: 960735 - RNA, 19 nt, Mycobacterium avium subsp. paratuberculosis
cacuccaauacggcccggc

SEQ ID NO: 960736 - RNA, 21 nt, Mycobacterium avium subsp. paratuberculosis
cacugcgguagaggcgggcgu

SEQ ID NO: 960737 - RNA, 17 nt, Mycobacterium avium subsp. paratuberculosis
cacugcugcccgcgacg

SEQ ID NO: 960738 - RNA, 21 nt, Mycobacterium avium subsp. paratuberculosis
cacugcugcccgcgacggcga

SEQ ID NO: 960739 - RNA, 16 nt, Mycobacterium avium subsp. paratuberculosis
cacugcuucgggucgc

SEQ ID NO: 960740 - RNA, 13 nt, Mycobacterium avium subsp. paratuberculosis
cacugcacgcacg

SEQ ID NO: 960741 - RNA, 15 nt, Mycobacterium avium subsp. paratuberculosis
cacugcacgcacggc

SEQ ID NO: 960742 - RNA, 17 nt, Mycobacterium avium subsp. paratuberculosis
cacugccaagacguccg

SEQ ID NO: 960743 - RNA, 19 nt, Mycobacterium avium subsp. paratuberculosis
cacugccaagacguccgcg

SEQ ID NO: 960744 - RNA, 20 nt, Mycobacterium avium subsp. paratuberculosis
cacugcaacuacgcacccga

SEQ ID NO: 960745 - RNA, 15 nt, Mycobacterium avium subsp. paratuberculosis
cagcggccacaccgg

SEQ ID NO: 960746 - RNA, 17 nt, Mycobacterium avium subsp. paratuberculosis
cagcggcauggcgauga

SEQ ID NO: 960747 - RNA, 22 nt, Mycobacterium avium subsp. paratuberculosis
cagcggcauggcgaugaccagc

SEQ ID NO: 960748 - RNA, 15 nt, Mycobacterium avium subsp. paratuberculosis
cagcggccagcccau

SEQ ID NO: 960749 - RNA, 21 nt, Mycobacterium avium subsp. paratuberculosis
cagcggccagcccgcggcagc

SEQ ID NO: 960750 - RNA, 13 nt, Mycobacterium avium subsp. paratuberculosis
cagcggcccaccg

SEQ ID NO: 960751 - RNA, 14 nt, Mycobacterium avium subsp. paratuberculosis
cagcggcccaccgc

SEQ ID NO: 960752 - RNA, 16 nt, Mycobacterium avium subsp. paratuberculosis
cagcggcccaccgcga

SEQ ID NO: 960753 - RNA, 20 nt, Mycobacterium avium subsp. paratuberculosis
cagcggcccaccgcgacccg

SEQ ID NO: 960754 - RNA, 19 nt, Mycobacterium avium subsp. paratuberculosis
cagcggccggaacagcugg

SEQ ID NO: 960755 - RNA, 14 nt, Mycobacterium avium subsp. paratuberculosis
cagcggccggcgca

SEQ ID NO: 960756 - RNA, 15 nt, Mycobacterium avium subsp. paratuberculosis
cagcggccggcgcag

SEQ ID NO: 960757 - RNA, 18 nt, Mycobacterium avium subsp. paratuberculosis
cagcggccggcgcagccg

SEQ ID NO: 960758 - RNA, 17 nt, Mycobacterium avium subsp. paratuberculosis
cagcggccgggcgaucu

SEQ ID NO: 960759 - RNA, 15 nt, Mycobacterium avium subsp. paratuberculosis
cagcggccaucgccg

SEQ ID NO: 960760 - RNA, 18 nt, Mycobacterium avium subsp. paratuberculosis
cagcggccaucgccgcca

SEQ ID NO: 960761 - RNA, 12 nt, Mycobacterium avium subsp. paratuberculosis
cagcggccccgg

SEQ ID NO: 960762 - RNA, 13 nt, Mycobacterium avium subsp. paratuberculosis
cagcggccccggc

SEQ ID NO: 960763 - RNA, 14 nt, Mycobacterium avium subsp. paratuberculosis
cagcggccccggcu

SEQ ID NO: 960764 - RNA, 18 nt, Mycobacterium avium subsp. paratuberculosis
cagcggccccggcucggg

SEQ ID NO: 960765 - RNA, 19 nt, Mycobacterium avium subsp. paratuberculosis
cagcggccccggcucgggc

SEQ ID NO: 960766 - RNA, 16 nt, Mycobacterium avium subsp. paratuberculosis
cagcggcccgaucacc

SEQ ID NO: 960767 - RNA, 19 nt, Mycobacterium avium subsp. paratuberculosis
cagcggcccgaucaccagg

SEQ ID NO: 960768 - RNA, 20 nt, Mycobacterium avium subsp. paratuberculosis
cagcggcccgaucaccaggc

SEQ ID NO: 960769 - RNA, 17 nt, Mycobacterium avium subsp. paratuberculosis
cagcggcccgaucaccg

SEQ ID NO: 960770 - RNA, 20 nt, Mycobacterium avium subsp. paratuberculosis
cagcggcccgaucaccgccg

SEQ ID NO: 960771 - RNA, 12 nt, Mycobacterium avium subsp. paratuberculosis
cagcggcgccca

SEQ ID NO: 960772 - RNA, 13 nt, Mycobacterium avium subsp. paratuberculosis
cagcggcgcccac

SEQ ID NO: 960773 - RNA, 21 nt, Mycobacterium avium subsp. paratuberculosis
cagcggcgcccacggccacca

SEQ ID NO: 960774 - RNA, 13 nt, Mycobacterium avium subsp. paratuberculosis
cagcggcgccagg

SEQ ID NO: 960775 - RNA, 17 nt, Mycobacterium avium subsp. paratuberculosis
cagcggcgccaccggga

SEQ ID NO: 960776 - RNA, 17 nt, Mycobacterium avium subsp. paratuberculosis
cagcggcgcgcgccgca

SEQ ID NO: 960777 - RNA, 20 nt, Mycobacterium avium subsp. paratuberculosis
cagcggcgcgcgccgcagcg

SEQ ID NO: 960778 - RNA, 16 nt, Mycobacterium avium subsp. paratuberculosis
cagcggcgcgccgggc

SEQ ID NO: 960779 - RNA, 17 nt, Mycobacterium avium subsp. paratuberculosis
cagcggcgcgccgggca

SEQ ID NO: 960780 - RNA, 19 nt, Mycobacterium avium subsp. paratuberculosis
cagcggcgcgccgggcagc

SEQ ID NO: 960781 - RNA, 13 nt, Mycobacterium avium subsp. paratuberculosis
cagcggcgcgcgc

SEQ ID NO: 960782 - RNA, 15 nt, Mycobacterium avium subsp. paratuberculosis
cagcggcgccgcagc

SEQ ID NO: 960783 - RNA, 14 nt, Mycobacterium avium subsp. paratuberculosis
cagcggcgccggga

SEQ ID NO: 960784 - RNA, 14 nt, Mycobacterium avium subsp. paratuberculosis
cagcggcgccgggu

SEQ ID NO: 960785 - RNA, 15 nt, Mycobacterium avium subsp. paratuberculosis
cagcggcgacagcgg

SEQ ID NO: 960786 - RNA, 14 nt, Mycobacterium avium subsp. paratuberculosis
cagcggcgaugccc

SEQ ID NO: 960787 - RNA, 14 nt, Mycobacterium avium subsp. paratuberculosis
cagcggcgcaccgu

SEQ ID NO: 960788 - RNA, 17 nt, Mycobacterium avium subsp. paratuberculosis
cagcggcgcaccguguc

SEQ ID NO: 960789 - RNA, 19 nt, Mycobacterium avium subsp. paratuberculosis
cagcggccgucgcgcagcc

SEQ ID NO: 960790 - RNA, 19 nt, Mycobacterium avium subsp. paratuberculosis
cagcggccuaugcgcccgg

SEQ ID NO: 960791 - RNA, 20 nt, Mycobacterium avium subsp. paratuberculosis
cagcggccuaugcgcccggg

SEQ ID NO: 960792 - RNA, 18 nt, Mycobacterium avium subsp. paratuberculosis
cagcggccgucgccgggc

SEQ ID NO: 960793 - RNA, 23 nt, Mycobacterium avium subsp. paratuberculosis
cagcggccgucgccgggcggggu

SEQ ID NO: 960794 - RNA, 16 nt, Mycobacterium avium subsp. paratuberculosis
cagcggcaacacgccg

SEQ ID NO: 960795 - RNA, 19 nt, Mycobacterium avium subsp. paratuberculosis
cagcggcaacacgccggcg

SEQ ID NO: 960796 - RNA, 19 nt, Mycobacterium avium subsp. paratuberculosis
cagcggaugccggaggcgc

SEQ ID NO: 960797 - RNA, 21 nt, Mycobacterium avium subsp. paratuberculosis
cagcggaugccggaggcgccg

SEQ ID NO: 960798 - RNA, 22 nt, Mycobacterium avium subsp. paratuberculosis
cagcggaugccggaggcgccgu

SEQ ID NO: 960799 - RNA, 13 nt, Mycobacterium avium subsp. paratuberculosis
cagcggaucggcc

SEQ ID NO: 960800 - RNA, 22 nt, Mycobacterium avium subsp. paratuberculosis
cagcggagcguucuccacccgc

SEQ ID NO: 960801 - RNA, 22 nt, Mycobacterium avium subsp. paratuberculosis
cagcggaaccgggggccgucac

SEQ ID NO: 960802 - RNA, 17 nt, Mycobacterium avium subsp. paratuberculosis
cagcggaaucgcccggg

SEQ ID NO: 960803 - RNA, 16 nt, Mycobacterium avium subsp. paratuberculosis
cagcggaaugaacgcg

SEQ ID NO: 960804 - RNA, 20 nt, Mycobacterium avium subsp. paratuberculosis
cagcggaaugaacgcggcca

SEQ ID NO: 960805 - RNA, 24 nt, Mycobacterium avium subsp. paratuberculosis
cagcggacccggucggccgcgugc

SEQ ID NO: 960806 - RNA, 16 nt, Mycobacterium avium subsp. paratuberculosis
cagcggcagcagcacc

SEQ ID NO: 960807 - RNA, 22 nt, Mycobacterium avium subsp. paratuberculosis
cagcggcagcagcaccagcgug

SEQ ID NO: 960808 - RNA, 15 nt, Mycobacterium avium subsp. paratuberculosis
cagcggcagccacgg

SEQ ID NO: 960809 - RNA, 23 nt, Mycobacterium avium subsp. paratuberculosis
cagcggcagcgacagcgcgucgg

SEQ ID NO: 960810 - RNA, 20 nt, Mycobacterium avium subsp. paratuberculosis
cagcggcacgaucucgacca

SEQ ID NO: 960811 - RNA, 14 nt, Mycobacterium avium subsp. paratuberculosis
cagcggcacgucgc

SEQ ID NO: 960812 - RNA, 17 nt, Mycobacterium avium subsp. paratuberculosis
cagcggcacgucgccgu

SEQ ID NO: 960813 - RNA, 14 nt, Mycobacterium avium subsp. paratuberculosis
cagcggcacccggu

SEQ ID NO: 960814 - RNA, 23 nt, Mycobacterium avium subsp. paratuberculosis
cagcggcaccgccaucggcaucg

SEQ ID NO: 960815 - RNA, 17 nt, Mycobacterium avium subsp. paratuberculosis
cagcggcaccgucaccg

SEQ ID NO: 960816 - RNA, 19 nt, Mycobacterium avium subsp. paratuberculosis
cagcggcaucgaggaccgg

SEQ ID NO: 960817 - RNA, 16 nt, Mycobacterium avium subsp. paratuberculosis
cagcggcaucgccgcc

SEQ ID NO: 960818 - RNA, 20 nt, Mycobacterium avium subsp. paratuberculosis
cagcggcaucgccgccaagg

SEQ ID NO: 960819 - RNA, 13 nt, Mycobacterium avium subsp. paratuberculosis
cagcggcaggucc

SEQ ID NO: 960820 - RNA, 19 nt, Mycobacterium avium subsp. paratuberculosis
cagcggcaggucccaggcc

SEQ ID NO: 960821 - RNA, 17 nt, Mycobacterium avium subsp. paratuberculosis
cagcggcaggucgucgu

SEQ ID NO: 960822 - RNA, 18 nt, Mycobacterium avium subsp. paratuberculosis
cagcggcaggucgucguc

SEQ ID NO: 960823 - RNA, 13 nt, Mycobacterium avium subsp. paratuberculosis
cagcggcaggugg

SEQ ID NO: 960824 - RNA, 19 nt, Mycobacterium avium subsp. paratuberculosis
cagcggcaguagcgcaccg

SEQ ID NO: 960825 - RNA, 20 nt, Mycobacterium avium subsp. paratuberculosis
cagcggcaguagcgcaccgg

SEQ ID NO: 960826 - RNA, 21 nt, Mycobacterium avium subsp. paratuberculosis
cagcggcaguagcgcaccggu

SEQ ID NO: 960827 - RNA, 17 nt, Mycobacterium avium subsp. paratuberculosis
cagcggcagcgucgggc

SEQ ID NO: 960828 - RNA, 17 nt, Mycobacterium avium subsp. paratuberculosis
cagcggcagcggcgucg

SEQ ID NO: 960829 - RNA, 17 nt, Mycobacterium avium subsp. paratuberculosis
cagcggcagcgccagcg

SEQ ID NO: 960830 - RNA, 19 nt, Mycobacterium avium subsp. paratuberculosis
cagcgggaacaccacgucg

SEQ ID NO: 960831 - RNA, 20 nt, Mycobacterium avium subsp. paratuberculosis
cagcgggaacaccacgucgu

SEQ ID NO: 960832 - RNA, 15 nt, Mycobacterium avium subsp. paratuberculosis
cagcgggaagccgag

SEQ ID NO: 960833 - RNA, 18 nt, Mycobacterium avium subsp. paratuberculosis
cagcgggaagccgagguc

SEQ ID NO: 960834 - RNA, 18 nt, Mycobacterium avium subsp. paratuberculosis
cagcggcuugagccggau

SEQ ID NO: 960835 - RNA, 20 nt, Mycobacterium avium subsp. paratuberculosis
cagcggcuugagcgccagcg

SEQ ID NO: 960836 - RNA, 17 nt, Mycobacterium avium subsp. paratuberculosis
cagcggcuuggccgugc

SEQ ID NO: 960837 - RNA, 21 nt, Mycobacterium avium subsp. paratuberculosis
cagcggcuuggccgugcaggg

SEQ ID NO: 960838 - RNA, 19 nt, Mycobacterium avium subsp. paratuberculosis
cagcggcuuggucaccagc

SEQ ID NO: 960839 - RNA, 21 nt, Mycobacterium avium subsp. paratuberculosis
cagcggcuuggucaccagcuc

SEQ ID NO: 960840 - RNA, 23 nt, Mycobacterium avium subsp. paratuberculosis
cagcgggauacccaugaucgcca

SEQ ID NO: 960841 - RNA, 21 nt, Mycobacterium avium subsp. paratuberculosis
cagcgggaucagcuccucgcg

SEQ ID NO: 960842 - RNA, 21 nt, Mycobacterium avium subsp. paratuberculosis
cagcgggauguacuugaugac

SEQ ID NO: 960843 - RNA, 14 nt, Mycobacterium avium subsp. paratuberculosis
cagcgggauguagc

SEQ ID NO: 960844 - RNA, 19 nt, Mycobacterium avium subsp. paratuberculosis
cagcgggauguagccgguc

SEQ ID NO: 960845 - RNA, 20 nt, Mycobacterium avium subsp. paratuberculosis
cagcgggauuggcgccacug

SEQ ID NO: 960846 - RNA, 18 nt, Mycobacterium avium subsp. paratuberculosis
cagcggcuguagcacccg

SEQ ID NO: 960847 - RNA, 22 nt, Mycobacterium avium subsp. paratuberculosis
cagcggcugcugcagcgcccgg

SEQ ID NO: 960848 - RNA, 14 nt, Mycobacterium avium subsp. paratuberculosis
cagcggcggcacgg

SEQ ID NO: 960849 - RNA, 21 nt, Mycobacterium avium subsp. paratuberculosis
cagcggcggccauucaucgcg

SEQ ID NO: 960850 - RNA, 12 nt, Mycobacterium avium subsp. paratuberculosis
cagcggcggccc

SEQ ID NO: 960851 - RNA, 20 nt, Mycobacterium avium subsp. paratuberculosis
cagcggcggaugggugcggu

SEQ ID NO: 960852 - RNA, 15 nt, Mycobacterium avium subsp. paratuberculosis
cagcggcgcgguuuc

SEQ ID NO: 960853 - RNA, 20 nt, Mycobacterium avium subsp. paratuberculosis
cagcggcgcgguuucggcgu

SEQ ID NO: 960854 - RNA, 22 nt, Mycobacterium avium subsp. paratuberculosis
cagcggcgcgguuucggcgucg

SEQ ID NO: 960855 - RNA, 13 nt, Mycobacterium avium subsp. paratuberculosis
cagcggcgccgca

SEQ ID NO: 960856 - RNA, 16 nt, Mycobacterium avium subsp. paratuberculosis
cagcgguaaccacccg

SEQ ID NO: 960857 - RNA, 23 nt, Mycobacterium avium subsp. paratuberculosis
cagcggguucuucagggcggugc

SEQ ID NO: 960858 - RNA, 13 nt, Mycobacterium avium subsp. paratuberculosis
cagcggguugcgg

SEQ ID NO: 960859 - RNA, 17 nt, Mycobacterium avium subsp. paratuberculosis
cagcgguaucccguugg

SEQ ID NO: 960860 - RNA, 13 nt, Mycobacterium avium subsp. paratuberculosis
cagcgggcggcca

SEQ ID NO: 960861 - RNA, 13 nt, Mycobacterium avium subsp. paratuberculosis
cagcgggcgcagc

SEQ ID NO: 960862 - RNA, 19 nt, Mycobacterium avium subsp. paratuberculosis
cagcgggcgcagcucgucg

SEQ ID NO: 960863 - RNA, 14 nt, Mycobacterium avium subsp. paratuberculosis
cagcgggcccgggc

SEQ ID NO: 960864 - RNA, 19 nt, Mycobacterium avium subsp. paratuberculosis
cagcggguugucgucgucg

SEQ ID NO: 960865 - RNA, 22 nt, Mycobacterium avium subsp. paratuberculosis
cagcggguugucgucgucggcg

SEQ ID NO: 960866 - RNA, 23 nt, Mycobacterium avium subsp. paratuberculosis
cagcggguugucgucgucggcga

SEQ ID NO: 960867 - RNA, 21 nt, Mycobacterium avium subsp. paratuberculosis
cagcggguuguucuccagcgg

SEQ ID NO: 960868 - RNA, 17 nt, Mycobacterium avium subsp. paratuberculosis
cagcggguuuggccgcg

SEQ ID NO: 960869 - RNA, 12 nt, Mycobacterium avium subsp. paratuberculosis
cagcgggccggc

SEQ ID NO: 960870 - RNA, 14 nt, Mycobacterium avium subsp. paratuberculosis
cagcgggccgaaga

SEQ ID NO: 960871 - RNA, 20 nt, Mycobacterium avium subsp. paratuberculosis
cagcgggccgaagaccgggc

SEQ ID NO: 960872 - RNA, 21 nt, Mycobacterium avium subsp. paratuberculosis
cagcgggccgaagaccgggcc

SEQ ID NO: 960873 - RNA, 23 nt, Mycobacterium avium subsp. paratuberculosis
cagcgggccgaagaccgggccga

SEQ ID NO: 960874 - RNA, 16 nt, Mycobacterium avium subsp. paratuberculosis
cagcgggccgacagca

SEQ ID NO: 960875 - RNA, 15 nt, Mycobacterium avium subsp. paratuberculosis
cagcgggccgacccg

SEQ ID NO: 960876 - RNA, 20 nt, Mycobacterium avium subsp. paratuberculosis
cagcgggccgacccggccga

SEQ ID NO: 960877 - RNA, 13 nt, Mycobacterium avium subsp. paratuberculosis
cagcgggccgagc

SEQ ID NO: 960878 - RNA, 14 nt, Mycobacterium avium subsp. paratuberculosis
cagcgggccggcgu

SEQ ID NO: 960879 - RNA, 15 nt, Mycobacterium avium subsp. paratuberculosis
cagcgggccggcguc

SEQ ID NO: 960880 - RNA, 18 nt, Mycobacterium avium subsp. paratuberculosis
cagcgggccggcgucguc

SEQ ID NO: 960881 - RNA, 15 nt, Mycobacterium avium subsp. paratuberculosis
cagcgggccgugccg

SEQ ID NO: 960882 - RNA, 18 nt, Mycobacterium avium subsp. paratuberculosis
cagcgggccguugccggu

SEQ ID NO: 960883 - RNA, 14 nt, Mycobacterium avium subsp. paratuberculosis
cagcgucgcggccg

SEQ ID NO: 960884 - RNA, 17 nt, Mycobacterium avium subsp. paratuberculosis
cagcgucgcggccggga

SEQ ID NO: 960885 - RNA, 17 nt, Mycobacterium avium subsp. paratuberculosis
cagcgucgucaggccgu

SEQ ID NO: 960886 - RNA, 13 nt, Mycobacterium avium subsp. paratuberculosis
cagcgucggcgug

SEQ ID NO: 960887 - RNA, 14 nt, Mycobacterium avium subsp. paratuberculosis
cagcgucgggcucg

SEQ ID NO: 960888 - RNA, 18 nt, Mycobacterium avium subsp. paratuberculosis
cagcgucgggcucgccuc

SEQ ID NO: 960889 - RNA, 19 nt, Mycobacterium avium subsp. paratuberculosis
cagcgucgccagccgccgg

SEQ ID NO: 960890 - RNA, 13 nt, Mycobacterium avium subsp. paratuberculosis
cagcgucgccgac

SEQ ID NO: 960891 - RNA, 14 nt, Mycobacterium avium subsp. paratuberculosis
cagcgucgccgacg

SEQ ID NO: 960892 - RNA, 15 nt, Mycobacterium avium subsp. paratuberculosis
cagcgucgccgacgg

SEQ ID NO: 960893 - RNA, 12 nt, Mycobacterium avium subsp. paratuberculosis
cagcgucgccgc

SEQ ID NO: 960894 - RNA, 17 nt, Mycobacterium avium subsp. paratuberculosis
cagcgucgccgccccga

SEQ ID NO: 960895 - RNA, 14 nt, Mycobacterium avium subsp. paratuberculosis
cagcgucgcgauca

SEQ ID NO: 960896 - RNA, 23 nt, Mycobacterium avium subsp. paratuberculosis
cagcgucucccgggugcgcgucg

SEQ ID NO: 960897 - RNA, 15 nt, Mycobacterium avium subsp. paratuberculosis
cagcgucuccggcgg

SEQ ID NO: 960898 - RNA, 23 nt, Mycobacterium avium subsp. paratuberculosis
cagcgucuccggcgggcuggugc

SEQ ID NO: 960899 - RNA, 16 nt, Mycobacterium avium subsp. paratuberculosis
cagcgucucgaccgcg

SEQ ID NO: 960900 - RNA, 18 nt, Mycobacterium avium subsp. paratuberculosis
cagcgucucgaccgcggu

SEQ ID NO: 960901 - RNA, 15 nt, Mycobacterium avium subsp. paratuberculosis
cagcgucucgacggc

SEQ ID NO: 960902 - RNA, 17 nt, Mycobacterium avium subsp. paratuberculosis
cagcgucucgacggcgc

SEQ ID NO: 960903 - RNA, 20 nt, Mycobacterium avium subsp. paratuberculosis
cagcgucucgacggcgccga

SEQ ID NO: 960904 - RNA, 18 nt, Mycobacterium avium subsp. paratuberculosis
cagcgucucgaucgacga

SEQ ID NO: 960905 - RNA, 15 nt, Mycobacterium avium subsp. paratuberculosis
cagcgugaccucgac

SEQ ID NO: 960906 - RNA, 23 nt, Mycobacterium avium subsp. paratuberculosis
cagcgugaccucgacggugcugc

SEQ ID NO: 960907 - RNA, 15 nt, Mycobacterium avium subsp. paratuberculosis
cagcgugacgcccgg

SEQ ID NO: 960908 - RNA, 16 nt, Mycobacterium avium subsp. paratuberculosis
cagcgugacgcccggc

SEQ ID NO: 960909 - RNA, 22 nt, Mycobacterium avium subsp. paratuberculosis
cagcgugacgcccggcgccggc

SEQ ID NO: 960910 - RNA, 18 nt, Mycobacterium avium subsp. paratuberculosis
cagcgugacgccgggccg

SEQ ID NO: 960911 - RNA, 16 nt, Mycobacterium avium subsp. paratuberculosis
cagcgugacgcugaag

SEQ ID NO: 960912 - RNA, 20 nt, Mycobacterium avium subsp. paratuberculosis
cagcgugcacacccgcagcg

SEQ ID NO: 960913 - RNA, 21 nt, Mycobacterium avium subsp. paratuberculosis
cagcgugcacacccgcagcga

SEQ ID NO: 960914 - RNA, 12 nt, Mycobacterium avium subsp. paratuberculosis
cagcggucggcg

SEQ ID NO: 960915 - RNA, 16 nt, Mycobacterium avium subsp. paratuberculosis
cagcggucggcgguuc

SEQ ID NO: 960916 - RNA, 14 nt, Mycobacterium avium subsp. paratuberculosis
cagcggucgggugc

SEQ ID NO: 960917 - RNA, 16 nt, Mycobacterium avium subsp. paratuberculosis
cagcgguccagcguga

SEQ ID NO: 960918 - RNA, 20 nt, Mycobacterium avium subsp. paratuberculosis
cagcgguccagcgugaacgu

SEQ ID NO: 960919 - RNA, 14 nt, Mycobacterium avium subsp. paratuberculosis
cagcggugaucgcg

SEQ ID NO: 960920 - RNA, 16 nt, Mycobacterium avium subsp. paratuberculosis
cagcggugaucgcguc

SEQ ID NO: 960921 - RNA, 17 nt, Mycobacterium avium subsp. paratuberculosis
cagcggugaucgcguca

SEQ ID NO: 960922 - RNA, 13 nt, Mycobacterium avium subsp. paratuberculosis
cagcggucggcgg

SEQ ID NO: 960923 - RNA, 14 nt, Mycobacterium avium subsp. paratuberculosis
cagcggugccgccc

SEQ ID NO: 960924 - RNA, 16 nt, Mycobacterium avium subsp. paratuberculosis
cagcggugccgcccgg

SEQ ID NO: 960925 - RNA, 17 nt, Mycobacterium avium subsp. paratuberculosis
cagcggugccgcccgga

SEQ ID NO: 960926 - RNA, 13 nt, Mycobacterium avium subsp. paratuberculosis
cagcggugucacc

SEQ ID NO: 960927 - RNA, 16 nt, Mycobacterium avium subsp. paratuberculosis
cagcgguucggcgacg

SEQ ID NO: 960928 - RNA, 18 nt, Mycobacterium avium subsp. paratuberculosis
cagcgguucggcgacgcu

SEQ ID NO: 960929 - RNA, 16 nt, Mycobacterium avium subsp. paratuberculosis
cagcgguugcacgguc

SEQ ID NO: 960930 - RNA, 20 nt, Mycobacterium avium subsp. paratuberculosis
cagcgcguuggccagguugc

SEQ ID NO: 960931 - RNA, 18 nt, Mycobacterium avium subsp. paratuberculosis
cagcgcuaaccgcgggca

SEQ ID NO: 960932 - RNA, 22 nt, Mycobacterium avium subsp. paratuberculosis
cagcgcuaaccgcgggcaucgc

SEQ ID NO: 960933 - RNA, 22 nt, Mycobacterium avium subsp. paratuberculosis
cagcgcgugaccccggcgacca

SEQ ID NO: 960934 - RNA, 14 nt, Mycobacterium avium subsp. paratuberculosis
cagcgcgugaucgg

SEQ ID NO: 960935 - RNA, 17 nt, Mycobacterium avium subsp. paratuberculosis
cagcgcgucggugaugu

SEQ ID NO: 960936 - RNA, 13 nt, Mycobacterium avium subsp. paratuberculosis
cagcgcgucggcg

SEQ ID NO: 960937 - RNA, 14 nt, Mycobacterium avium subsp. paratuberculosis
cagcgcgucggcga

SEQ ID NO: 960938 - RNA, 21 nt, Mycobacterium avium subsp. paratuberculosis
cagcgcgucggcgaccgcgcg

SEQ ID NO: 960939 - RNA, 19 nt, Mycobacterium avium subsp. paratuberculosis
cagcgcgucggccagcgcg

SEQ ID NO: 960940 - RNA, 14 nt, Mycobacterium avium subsp. paratuberculosis
cagcgcgucgcugc

SEQ ID NO: 960941 - RNA, 19 nt, Mycobacterium avium subsp. paratuberculosis
cagcgcuccugcagcgcgg

SEQ ID NO: 960942 - RNA, 20 nt, Mycobacterium avium subsp. paratuberculosis
cagcgcuccugcagcgcggc

SEQ ID NO: 960943 - RNA, 21 nt, Mycobacterium avium subsp. paratuberculosis
cagcgcuccugcagcgcggcg

SEQ ID NO: 960944 - RNA, 22 nt, Mycobacterium avium subsp. paratuberculosis
cagcgcuccugcagcgcggcga

SEQ ID NO: 960945 - RNA, 16 nt, Mycobacterium avium subsp. paratuberculosis
cagcgcuccuggccgg

SEQ ID NO: 960946 - RNA, 18 nt, Mycobacterium avium subsp. paratuberculosis
cagcgcuccuggccggac

SEQ ID NO: 960947 - RNA, 18 nt, Mycobacterium avium subsp. paratuberculosis
cagcgcucgacgaggcgg

SEQ ID NO: 960948 - RNA, 14 nt, Mycobacterium avium subsp. paratuberculosis
cagcgcucgucguc

SEQ ID NO: 960949 - RNA, 15 nt, Mycobacterium avium subsp. paratuberculosis
cagcgcucgucgucg

SEQ ID NO: 960950 - RNA, 16 nt, Mycobacterium avium subsp. paratuberculosis
cagcgcuucgcgcugu

SEQ ID NO: 960951 - RNA, 16 nt, Mycobacterium avium subsp. paratuberculosis
cagcgcuuucgcgcac

SEQ ID NO: 960952 - RNA, 20 nt, Mycobacterium avium subsp. paratuberculosis
cagcgcuuucgcgcacgcca

SEQ ID NO: 960953 - RNA, 23 nt, Mycobacterium avium subsp. paratuberculosis
cagcggaaacgacgucgccacca

SEQ ID NO: 960954 - RNA, 14 nt, Mycobacterium avium subsp. paratuberculosis
cagcggaaccgaca

SEQ ID NO: 960955 - RNA, 19 nt, Mycobacterium avium subsp. paratuberculosis
cagcgcugucgcgggcccg

SEQ ID NO: 960956 - RNA, 22 nt, Mycobacterium avium subsp. paratuberculosis
cagcgcugucgcgggcccgcgu

SEQ ID NO: 960957 - RNA, 14 nt, Mycobacterium avium subsp. paratuberculosis
cagcgcuggccggc

SEQ ID NO: 960958 - RNA, 16 nt, Mycobacterium avium subsp. paratuberculosis
cagcgcuggccggcca

SEQ ID NO: 960959 - RNA, 18 nt, Mycobacterium avium subsp. paratuberculosis
cagcgcuggccggccacc

SEQ ID NO: 960960 - RNA, 17 nt, Mycobacterium avium subsp. paratuberculosis
cagcgcggccagcacgg

SEQ ID NO: 960961 - RNA, 16 nt, Mycobacterium avium subsp. paratuberculosis
cagcgcggcccgcggc

SEQ ID NO: 960962 - RNA, 18 nt, Mycobacterium avium subsp. paratuberculosis
cagcgcggcccgcggcgu

SEQ ID NO: 960963 - RNA, 19 nt, Mycobacterium avium subsp. paratuberculosis
cagcgcggcccgcggcguc

SEQ ID NO: 960964 - RNA, 12 nt, Mycobacterium avium subsp. paratuberculosis
cagcgcggccgg

SEQ ID NO: 960965 - RNA, 14 nt, Mycobacterium avium subsp. paratuberculosis
cagcgcggccgggc

SEQ ID NO: 960966 - RNA, 15 nt, Mycobacterium avium subsp. paratuberculosis
cagcgcggccgggcg

SEQ ID NO: 960967 - RNA, 16 nt, Mycobacterium avium subsp. paratuberculosis
cagcgcggccgggcgc

SEQ ID NO: 960968 - RNA, 13 nt, Mycobacterium avium subsp. paratuberculosis
cagcgcggcgaca

SEQ ID NO: 960969 - RNA, 23 nt, Mycobacterium avium subsp. paratuberculosis
cagcgcggcgacauuggccgcgc

SEQ ID NO: 960970 - RNA, 13 nt, Mycobacterium avium subsp. paratuberculosis
cagcgcggcgaug

SEQ ID NO: 960971 - RNA, 14 nt, Mycobacterium avium subsp. paratuberculosis
cagcgcggcgauga

SEQ ID NO: 960972 - RNA, 16 nt, Mycobacterium avium subsp. paratuberculosis
cagcgcggcgaugacc

SEQ ID NO: 960973 - RNA, 19 nt, Mycobacterium avium subsp. paratuberculosis
cagcgcggcguucagcagc

SEQ ID NO: 960974 - RNA, 13 nt, Mycobacterium avium subsp. paratuberculosis
cagcgcggcuugg

SEQ ID NO: 960975 - RNA, 19 nt, Mycobacterium avium subsp. paratuberculosis
cagcgcggcuuggccacca

SEQ ID NO: 960976 - RNA, 14 nt, Mycobacterium avium subsp. paratuberculosis
cagcgcggcgguga

SEQ ID NO: 960977 - RNA, 16 nt, Mycobacterium avium subsp. paratuberculosis
cagcgcggcggugagc

SEQ ID NO: 960978 - RNA, 21 nt, Mycobacterium avium subsp. paratuberculosis
cagcgcggcggugagccgcca

SEQ ID NO: 960979 - RNA, 20 nt, Mycobacterium avium subsp. paratuberculosis
cagcgcggcgucacccugga

SEQ ID NO: 960980 - RNA, 17 nt, Mycobacterium avium subsp. paratuberculosis
cagcgcggcggcgccgu

SEQ ID NO: 960981 - RNA, 19 nt, Mycobacterium avium subsp. paratuberculosis
cagcgcggcggcgccgucg

SEQ ID NO: 960982 - RNA, 17 nt, Mycobacterium avium subsp. paratuberculosis
cagcgcggcggccaccu

SEQ ID NO: 960983 - RNA, 22 nt, Mycobacterium avium subsp. paratuberculosis
cagcgcguagagcaucaggucg

SEQ ID NO: 960984 - RNA, 17 nt, Mycobacterium avium subsp. paratuberculosis
cagcgcguacuccgaca

SEQ ID NO: 960985 - RNA, 15 nt, Mycobacterium avium subsp. paratuberculosis
cagcgcguagucggc

SEQ ID NO: 960986 - RNA, 17 nt, Mycobacterium avium subsp. paratuberculosis
cagcgcguagucggcgu

SEQ ID NO: 960987 - RNA, 18 nt, Mycobacterium avium subsp. paratuberculosis
cagcgcguagucggcguc

SEQ ID NO: 960988 - RNA, 19 nt, Mycobacterium avium subsp. paratuberculosis
cagcgcguagucggcgucg

SEQ ID NO: 960989 - RNA, 23 nt, Mycobacterium avium subsp. paratuberculosis
cagcgcguagucggcgucggcca

SEQ ID NO: 960990 - RNA, 13 nt, Mycobacterium avium subsp. paratuberculosis
cagcgcgucgagg

SEQ ID NO: 960991 - RNA, 23 nt, Mycobacterium avium subsp. paratuberculosis
cagcgcgucgaggucgcgcagca

SEQ ID NO: 960992 - RNA, 12 nt, Mycobacterium avium subsp. paratuberculosis
cagcgcgucgcg

SEQ ID NO: 960993 - RNA, 16 nt, Mycobacterium avium subsp. paratuberculosis
cagcgcgucgcgcccg

SEQ ID NO: 960994 - RNA, 18 nt, Mycobacterium avium subsp. paratuberculosis
cagcgcgucgcgcccggc

SEQ ID NO: 960995 - RNA, 22 nt, Mycobacterium avium subsp. paratuberculosis
cagcgcgucgcgcccggcgucg

SEQ ID NO: 960996 - RNA, 14 nt, Mycobacterium avium subsp. paratuberculosis
cagcgcguccaggu

SEQ ID NO: 960997 - RNA, 16 nt, Mycobacterium avium subsp. paratuberculosis
cagcgcguccaggugc

SEQ ID NO: 960998 - RNA, 17 nt, Mycobacterium avium subsp. paratuberculosis
cagcgcggucgccacca

SEQ ID NO: 960999 - RNA, 23 nt, Mycobacterium avium subsp. paratuberculosis
cagcgcggucucgaucugcacca

SEQ ID NO: 961000 - RNA, 17 nt, Mycobacterium avium subsp. paratuberculosis
cagcgcggggucggcca

SEQ ID NO: 961001 - RNA, 17 nt, Mycobacterium avium subsp. paratuberculosis
cagcgcggucaacaccg

SEQ ID NO: 961002 - RNA, 18 nt, Mycobacterium avium subsp. paratuberculosis
cagcgcggucaacaccgg

SEQ ID NO: 961003 - RNA, 15 nt, Mycobacterium avium subsp. paratuberculosis
cagcgcggucagccc

SEQ ID NO: 961004 - RNA, 16 nt, Mycobacterium avium subsp. paratuberculosis
cagcgcggucagcccg

SEQ ID NO: 961005 - RNA, 17 nt, Mycobacterium avium subsp. paratuberculosis
cagcgcggucagcccgc

SEQ ID NO: 961006 - RNA, 20 nt, Mycobacterium avium subsp. paratuberculosis
cagcgcggugaagucggugc

SEQ ID NO: 961007 - RNA, 21 nt, Mycobacterium avium subsp. paratuberculosis
cagcgcggugaagucggugcc

SEQ ID NO: 961008 - RNA, 23 nt, Mycobacterium avium subsp. paratuberculosis
cagcgcggugaagucggugccca

SEQ ID NO: 961009 - RNA, 23 nt, Mycobacterium avium subsp. paratuberculosis
cagcgcggugauguugucgaaca

SEQ ID NO: 961010 - RNA, 13 nt, Mycobacterium avium subsp. paratuberculosis
cagcgcggugccc

SEQ ID NO: 961011 - RNA, 14 nt, Mycobacterium avium subsp. paratuberculosis
cagcgcggugccca

SEQ ID NO: 961012 - RNA, 16 nt, Mycobacterium avium subsp. paratuberculosis
cagcgcggugcccagc

SEQ ID NO: 961013 - RNA, 13 nt, Mycobacterium avium subsp. paratuberculosis
cagcgcggugccg

SEQ ID NO: 961014 - RNA, 14 nt, Mycobacterium avium subsp. paratuberculosis
cagcgcggugccgg

SEQ ID NO: 961015 - RNA, 15 nt, Mycobacterium avium subsp. paratuberculosis
cagcgcggugccggu

SEQ ID NO: 961016 - RNA, 17 nt, Mycobacterium avium subsp. paratuberculosis
cagcgcgguggccagca

SEQ ID NO: 961017 - RNA, 18 nt, Mycobacterium avium subsp. paratuberculosis
cagcgcgguggccagcag

SEQ ID NO: 961018 - RNA, 19 nt, Mycobacterium avium subsp. paratuberculosis
cagcgcgguggccagcagg

SEQ ID NO: 961019 - RNA, 15 nt, Mycobacterium avium subsp. paratuberculosis
cagcgcgguggucag

SEQ ID NO: 961020 - RNA, 19 nt, Mycobacterium avium subsp. paratuberculosis
cagcgcgguggucagcacc

SEQ ID NO: 961021 - RNA, 20 nt, Mycobacterium avium subsp. paratuberculosis
cagcgcgguggucagcaccg

SEQ ID NO: 961022 - RNA, 20 nt, Mycobacterium avium subsp. paratuberculosis
cagcgcgguggucagcggcg

SEQ ID NO: 961023 - RNA, 22 nt, Mycobacterium avium subsp. paratuberculosis
cagcgcgguggucagcggcgcc

SEQ ID NO: 961024 - RNA, 23 nt, Mycobacterium avium subsp. paratuberculosis
cagcgcgguggucagcggcgcca

SEQ ID NO: 961025 - RNA, 22 nt, Mycobacterium avium subsp. paratuberculosis
cagcgcgguggucagcaccggc

SEQ ID NO: 961026 - RNA, 18 nt, Mycobacterium avium subsp. paratuberculosis
cagcgcggugucgacguc

SEQ ID NO: 961027 - RNA, 19 nt, Mycobacterium avium subsp. paratuberculosis
cagcgcggugugcggcggc

SEQ ID NO: 961028 - RNA, 20 nt, Mycobacterium avium subsp. paratuberculosis
cagcgcggugugcggcggcu

SEQ ID NO: 961029 - RNA, 12 nt, Mycobacterium avium subsp. paratuberculosis
cagcgcgagguc

SEQ ID NO: 961030 - RNA, 17 nt, Mycobacterium avium subsp. paratuberculosis
cagcgcgaggucgacgg

SEQ ID NO: 961031 - RNA, 13 nt, Mycobacterium avium subsp. paratuberculosis
cagcgcgaggcgc

SEQ ID NO: 961032 - RNA, 23 nt, Mycobacterium avium subsp. paratuberculosis
cagcgcgaggcgcaguagccgac

SEQ ID NO: 961033 - RNA, 17 nt, Mycobacterium avium subsp. paratuberculosis
cagcgcgaucaacgggu

SEQ ID NO: 961034 - RNA, 19 nt, Mycobacterium avium subsp. paratuberculosis
cagcgcgaucaacgggucg

SEQ ID NO: 961035 - RNA, 20 nt, Mycobacterium avium subsp. paratuberculosis
cagcgcgaucaacgggucga

SEQ ID NO: 961036 - RNA, 22 nt, Mycobacterium avium subsp. paratuberculosis
cagcgcgaucaacgggucgagc

SEQ ID NO: 961037 - RNA, 16 nt, Mycobacterium avium subsp. paratuberculosis
cagcgcgcaacgacga

SEQ ID NO: 961038 - RNA, 15 nt, Mycobacterium avium subsp. paratuberculosis
cagcgcgaugccggc

SEQ ID NO: 961039 - RNA, 18 nt, Mycobacterium avium subsp. paratuberculosis
cagcgcgaugccggccag

SEQ ID NO: 961040 - RNA, 13 nt, Mycobacterium avium subsp. paratuberculosis
cagcgcgaugucc

SEQ ID NO: 961041 - RNA, 12 nt, Mycobacterium avium subsp. paratuberculosis
cagcgcgauccg

SEQ ID NO: 961042 - RNA, 16 nt, Mycobacterium avium subsp. paratuberculosis
cagcgcgauccgcgcg

SEQ ID NO: 961043 - RNA, 19 nt, Mycobacterium avium subsp. paratuberculosis
cagcgcgauccgcgcgucg

SEQ ID NO: 961044 - RNA, 18 nt, Mycobacterium avium subsp. paratuberculosis
cagcgcgauccggggggc

SEQ ID NO: 961045 - RNA, 23 nt, Mycobacterium avium subsp. paratuberculosis
cagcgcgauccggggggcggggu

SEQ ID NO: 961046 - RNA, 14 nt, Mycobacterium avium subsp. paratuberculosis
cagcgcgaucgccg

SEQ ID NO: 961047 - RNA, 15 nt, Mycobacterium avium subsp. paratuberculosis
cagcgcgaucgccgg

SEQ ID NO: 961048 - RNA, 16 nt, Mycobacterium avium subsp. paratuberculosis
cagcgcgaucgccggg

SEQ ID NO: 961049 - RNA, 19 nt, Mycobacterium avium subsp. paratuberculosis
cagcgcgaucgccgggaug

SEQ ID NO: 961050 - RNA, 15 nt, Mycobacterium avium subsp. paratuberculosis
cagcgcgcccaggcc

SEQ ID NO: 961051 - RNA, 18 nt, Mycobacterium avium subsp. paratuberculosis
cagcgcgcccaggcccga

SEQ ID NO: 961052 - RNA, 17 nt, Mycobacterium avium subsp. paratuberculosis
cagcgcgcccaggcuga

SEQ ID NO: 961053 - RNA, 20 nt, Mycobacterium avium subsp. paratuberculosis
cagcgcgcccaggcugaaca

SEQ ID NO: 961054 - RNA, 18 nt, Mycobacterium avium subsp. paratuberculosis
cagcgcgccccagugcag

SEQ ID NO: 961055 - RNA, 17 nt, Mycobacterium avium subsp. paratuberculosis
cagcgcgcacgcggaca

SEQ ID NO: 961056 - RNA, 21 nt, Mycobacterium avium subsp. paratuberculosis
cagcgcgcacaauucggucag

SEQ ID NO: 961057 - RNA, 16 nt, Mycobacterium avium subsp. paratuberculosis
cagcgcgcacagcgcc

SEQ ID NO: 961058 - RNA, 17 nt, Mycobacterium avium subsp. paratuberculosis
cagcgcgcacagcgcca

SEQ ID NO: 961059 - RNA, 19 nt, Mycobacterium avium subsp. paratuberculosis
cagcgcgcacagcgccaca

SEQ ID NO: 961060 - RNA, 18 nt, Mycobacterium avium subsp. paratuberculosis
cagcgcgacgggcacccg

SEQ ID NO: 961061 - RNA, 19 nt, Mycobacterium avium subsp. paratuberculosis
cagcgcgacgggcacccgc

SEQ ID NO: 961062 - RNA, 14 nt, Mycobacterium avium subsp. paratuberculosis
cagcgcgacggccu

SEQ ID NO: 961063 - RNA, 15 nt, Mycobacterium avium subsp. paratuberculosis
cagcgcgacggccuc

SEQ ID NO: 961064 - RNA, 18 nt, Mycobacterium avium subsp. paratuberculosis
cagcgcgaccgcccgggc

SEQ ID NO: 961065 - RNA, 19 nt, Mycobacterium avium subsp. paratuberculosis
cagcgcgaccgcccgggcc

SEQ ID NO: 961066 - RNA, 16 nt, Mycobacterium avium subsp. paratuberculosis
cagcgcgacgucgacc

SEQ ID NO: 961067 - RNA, 20 nt, Mycobacterium avium subsp. paratuberculosis
cagcgcgacgucgaccgcga

SEQ ID NO: 961068 - RNA, 21 nt, Mycobacterium avium subsp. paratuberculosis
cagcgcgacgucgaccgcgac

SEQ ID NO: 961069 - RNA, 14 nt, Mycobacterium avium subsp. paratuberculosis
cagcgcgacgugcc

SEQ ID NO: 961070 - RNA, 18 nt, Mycobacterium avium subsp. paratuberculosis
cagcgcgacgcacgccgg

SEQ ID NO: 961071 - RNA, 19 nt, Mycobacterium avium subsp. paratuberculosis
cagcgcgacgcacgccggc

SEQ ID NO: 961072 - RNA, 14 nt, Mycobacterium avium subsp. paratuberculosis
cagcgcgacgccga

SEQ ID NO: 961073 - RNA, 15 nt, Mycobacterium avium subsp. paratuberculosis
cagcgcgacgccgac

SEQ ID NO: 961074 - RNA, 16 nt, Mycobacterium avium subsp. paratuberculosis
cagcgcgacgccgacg

SEQ ID NO: 961075 - RNA, 17 nt, Mycobacterium avium subsp. paratuberculosis
cagcgcgacgccgacgc

SEQ ID NO: 961076 - RNA, 13 nt, Mycobacterium avium subsp. paratuberculosis
cagcgcgaccucg

SEQ ID NO: 961077 - RNA, 20 nt, Mycobacterium avium subsp. paratuberculosis
cagcgcgacgaacagcaccg

SEQ ID NO: 961078 - RNA, 23 nt, Mycobacterium avium subsp. paratuberculosis
cagcgcgacgaacagcaccgcca

SEQ ID NO: 961079 - RNA, 18 nt, Mycobacterium avium subsp. paratuberculosis
cagcgcgacccgcucgac

SEQ ID NO: 961080 - RNA, 21 nt, Mycobacterium avium subsp. paratuberculosis
cagcgcgacccgcucgacgcg

SEQ ID NO: 961081 - RNA, 17 nt, Mycobacterium avium subsp. paratuberculosis
cagcgcgaauccgguca

SEQ ID NO: 961082 - RNA, 14 nt, Mycobacterium avium subsp. paratuberculosis
cagcgcgacaccgg

SEQ ID NO: 961083 - RNA, 14 nt, Mycobacterium avium subsp. paratuberculosis
cagcgcgacaucgc

SEQ ID NO: 961084 - RNA, 21 nt, Mycobacterium avium subsp. paratuberculosis
cagcgcgacaucgccggcgac

SEQ ID NO: 961085 - RNA, 15 nt, Mycobacterium avium subsp. paratuberculosis
cagcgcgaccagccc

SEQ ID NO: 961086 - RNA, 16 nt, Mycobacterium avium subsp. paratuberculosis
cagcgcgaccagcccg

SEQ ID NO: 961087 - RNA, 21 nt, Mycobacterium avium subsp. paratuberculosis
cagcgcgaccagcccggccgc

SEQ ID NO: 961088 - RNA, 23 nt, Mycobacterium avium subsp. paratuberculosis
cagcgcgaacaaucgcugcgagc

SEQ ID NO: 961089 - RNA, 20 nt, Mycobacterium avium subsp. paratuberculosis
cagcgcgaacagcgcggcca

SEQ ID NO: 961090 - RNA, 13 nt, Mycobacterium avium subsp. paratuberculosis
cagcgcgaaagca

SEQ ID NO: 961091 - RNA, 15 nt, Mycobacterium avium subsp. paratuberculosis
cagcgccuugccgac

SEQ ID NO: 961092 - RNA, 16 nt, Mycobacterium avium subsp. paratuberculosis
cagcgccuugccgacg

SEQ ID NO: 961093 - RNA, 17 nt, Mycobacterium avium subsp. paratuberculosis
cagcgccuugccgacga

SEQ ID NO: 961094 - RNA, 19 nt, Mycobacterium avium subsp. paratuberculosis
cagcgccuugccgacgacg

SEQ ID NO: 961095 - RNA, 22 nt, Mycobacterium avium subsp. paratuberculosis
cagcgccuugccgacgacgucg

SEQ ID NO: 961096 - RNA, 23 nt, Mycobacterium avium subsp. paratuberculosis
cagcgccuugccgacgacgucgu

SEQ ID NO: 961097 - RNA, 14 nt, Mycobacterium avium subsp. paratuberculosis
cagcgcggacacca

SEQ ID NO: 961098 - RNA, 16 nt, Mycobacterium avium subsp. paratuberculosis
cagcgcggacaccagg

SEQ ID NO: 961099 - RNA, 20 nt, Mycobacterium avium subsp. paratuberculosis
cagcgcggauuccagcgcga

SEQ ID NO: 961100 - RNA, 14 nt, Mycobacterium avium subsp. paratuberculosis
cagcgcggccagca

SEQ ID NO: 961101 - RNA, 13 nt, Mycobacterium avium subsp. paratuberculosis
cagcgcggcaugg

SEQ ID NO: 961102 - RNA, 18 nt, Mycobacterium avium subsp. paratuberculosis
cagcgcggcauggcuggc

SEQ ID NO: 961103 - RNA, 14 nt, Mycobacterium avium subsp. paratuberculosis
cagcgcggccacac

SEQ ID NO: 961104 - RNA, 13 nt, Mycobacterium avium subsp. paratuberculosis
cagcgcggccacc

SEQ ID NO: 961105 - RNA, 15 nt, Mycobacterium avium subsp. paratuberculosis
cagcgcggccaccac

SEQ ID NO: 961106 - RNA, 17 nt, Mycobacterium avium subsp. paratuberculosis
cagcgcggccaccacga

SEQ ID NO: 961107 - RNA, 23 nt, Mycobacterium avium subsp. paratuberculosis
cagcgcggccaccacgacgggga

SEQ ID NO: 961108 - RNA, 14 nt, Mycobacterium avium subsp. paratuberculosis
cagcgcgcggguga

SEQ ID NO: 961109 - RNA, 14 nt, Mycobacterium avium subsp. paratuberculosis
cagcgcgcgggcgc

SEQ ID NO: 961110 - RNA, 14 nt, Mycobacterium avium subsp. paratuberculosis
cagcgcgcgcucgg

SEQ ID NO: 961111 - RNA, 15 nt, Mycobacterium avium subsp. paratuberculosis
cagcgcgcggcgcag

SEQ ID NO: 961112 - RNA, 16 nt, Mycobacterium avium subsp. paratuberculosis
cagcgcgcggcgcaga

SEQ ID NO: 961113 - RNA, 14 nt, Mycobacterium avium subsp. paratuberculosis
cagcgcgcggcgga

SEQ ID NO: 961114 - RNA, 19 nt, Mycobacterium avium subsp. paratuberculosis
cagcgcgcgagacaccucg

SEQ ID NO: 961115 - RNA, 24 nt, Mycobacterium avium subsp. paratuberculosis
cagcgcgcgcuugcgcucggucgc

SEQ ID NO: 961116 - RNA, 12 nt, Mycobacterium avium subsp. paratuberculosis
cagcgcgccgca

SEQ ID NO: 961117 - RNA, 13 nt, Mycobacterium avium subsp. paratuberculosis
cagcgcgccgccc

SEQ ID NO: 961118 - RNA, 14 nt, Mycobacterium avium subsp. paratuberculosis
cagcgcgccgccca

SEQ ID NO: 961119 - RNA, 15 nt, Mycobacterium avium subsp. paratuberculosis
cagcgcgccgcccag

SEQ ID NO: 961120 - RNA, 18 nt, Mycobacterium avium subsp. paratuberculosis
cagcgcgccgcccagcgg

SEQ ID NO: 961121 - RNA, 21 nt, Mycobacterium avium subsp. paratuberculosis
cagcgcgccgcccagcgguga

SEQ ID NO: 961122 - RNA, 14 nt, Mycobacterium avium subsp. paratuberculosis
cagcgcgccggccg

SEQ ID NO: 961123 - RNA, 15 nt, Mycobacterium avium subsp. paratuberculosis
cagcgcgccggccgg

SEQ ID NO: 961124 - RNA, 16 nt, Mycobacterium avium subsp. paratuberculosis
cagcgcgccggccggc

SEQ ID NO: 961125 - RNA, 18 nt, Mycobacterium avium subsp. paratuberculosis
cagcgcgccggccggcac

SEQ ID NO: 961126 - RNA, 20 nt, Mycobacterium avium subsp. paratuberculosis
cagcgcgccggccggcacga

SEQ ID NO: 961127 - RNA, 14 nt, Mycobacterium avium subsp. paratuberculosis
cagcgcgccgacca

SEQ ID NO: 961128 - RNA, 17 nt, Mycobacterium avium subsp. paratuberculosis
cagcgcgccgaccacgg

SEQ ID NO: 961129 - RNA, 19 nt, Mycobacterium avium subsp. paratuberculosis
cagcgcgccgaccacggcc

SEQ ID NO: 961130 - RNA, 11 nt, Mycobacterium avium subsp. paratuberculosis
cagcgcgccga

SEQ ID NO: 961131 - RNA, 14 nt, Mycobacterium avium subsp. paratuberculosis
cagcgcgccgaaca

SEQ ID NO: 961132 - RNA, 22 nt, Mycobacterium avium subsp. paratuberculosis
cagcgcgcccgacggucgccac

SEQ ID NO: 961133 - RNA, 16 nt, Mycobacterium avium subsp. paratuberculosis
cagcgcgcccgccauc

SEQ ID NO: 961134 - RNA, 15 nt, Mycobacterium avium subsp. paratuberculosis
cagcgcgcgaucgcc

SEQ ID NO: 961135 - RNA, 16 nt, Mycobacterium avium subsp. paratuberculosis
cagcgcgcgaucagcg

SEQ ID NO: 961136 - RNA, 18 nt, Mycobacterium avium subsp. paratuberculosis
cagcgcgcgaucagcgcc

SEQ ID NO: 961137 - RNA, 15 nt, Mycobacterium avium subsp. paratuberculosis
cagcgcgccggccag

SEQ ID NO: 961138 - RNA, 20 nt, Mycobacterium avium subsp. paratuberculosis
cagcgcgccggccagcagca

SEQ ID NO: 961139 - RNA, 17 nt, Mycobacterium avium subsp. paratuberculosis
cagcgcgccgucggacu

SEQ ID NO: 961140 - RNA, 14 nt, Mycobacterium avium subsp. paratuberculosis
cagcgcgccgcgga

SEQ ID NO: 961141 - RNA, 20 nt, Mycobacterium avium subsp. paratuberculosis
cagcgcgcccugaggcccgg

SEQ ID NO: 961142 - RNA, 22 nt, Mycobacterium avium subsp. paratuberculosis
cagcgcgcccugaggcccggug

SEQ ID NO: 961143 - RNA, 17 nt, Mycobacterium avium subsp. paratuberculosis
cagcgccagcagcggca

SEQ ID NO: 961144 - RNA, 18 nt, Mycobacterium avium subsp. paratuberculosis
cagcgccagcaccgggcc

SEQ ID NO: 961145 - RNA, 16 nt, Mycobacterium avium subsp. paratuberculosis
cagcgccagcaccgcc

SEQ ID NO: 961146 - RNA, 15 nt, Mycobacterium avium subsp. paratuberculosis
cagcgccagcaccgg

SEQ ID NO: 961147 - RNA, 13 nt, Mycobacterium avium subsp. paratuberculosis
cagcgccacgggu

SEQ ID NO: 961148 - RNA, 14 nt, Mycobacterium avium subsp. paratuberculosis
cagcgccacggugg

SEQ ID NO: 961149 - RNA, 19 nt, Mycobacterium avium subsp. paratuberculosis
cagcgccagcaacacccag

SEQ ID NO: 961150 - RNA, 16 nt, Mycobacterium avium subsp. paratuberculosis
cagcgcagguccucgg

SEQ ID NO: 961151 - RNA, 16 nt, Mycobacterium avium subsp. paratuberculosis
cagcgcagcgccucgg

SEQ ID NO: 961152 - RNA, 17 nt, Mycobacterium avium subsp. paratuberculosis
cagcgcagcgccucggc

SEQ ID NO: 961153 - RNA, 19 nt, Mycobacterium avium subsp. paratuberculosis
cagcgcagcgucggcgugc

SEQ ID NO: 961154 - RNA, 17 nt, Mycobacterium avium subsp. paratuberculosis
cagcgcagcaccauccg

SEQ ID NO: 961155 - RNA, 22 nt, Mycobacterium avium subsp. paratuberculosis
cagcgcagcaccauccgcgcga

SEQ ID NO: 961156 - RNA, 13 nt, Mycobacterium avium subsp. paratuberculosis
cagcgcagcaucg

SEQ ID NO: 961157 - RNA, 15 nt, Mycobacterium avium subsp. paratuberculosis
cagcgcagcgaccug

SEQ ID NO: 961158 - RNA, 12 nt, Mycobacterium avium subsp. paratuberculosis
cagcgcagcgcc

SEQ ID NO: 961159 - RNA, 13 nt, Mycobacterium avium subsp. paratuberculosis
cagcgccagcggc

SEQ ID NO: 961160 - RNA, 13 nt, Mycobacterium avium subsp. paratuberculosis
cagcgccagcgag

SEQ ID NO: 961161 - RNA, 15 nt, Mycobacterium avium subsp. paratuberculosis
cagcgccagcgccag

SEQ ID NO: 961162 - RNA, 14 nt, Mycobacterium avium subsp. paratuberculosis
cagcgccagcggga

SEQ ID NO: 961163 - RNA, 14 nt, Mycobacterium avium subsp. paratuberculosis
cagcgcccaggcgu

SEQ ID NO: 961164 - RNA, 20 nt, Mycobacterium avium subsp. paratuberculosis
cagcgcccaggcgugcgcgu

SEQ ID NO: 961165 - RNA, 13 nt, Mycobacterium avium subsp. paratuberculosis
cagcgcccagccg

SEQ ID NO: 961166 - RNA, 20 nt, Mycobacterium avium subsp. paratuberculosis
cagcgcccaggaugacgccg

SEQ ID NO: 961167 - RNA, 16 nt, Mycobacterium avium subsp. paratuberculosis
cagcgcccgcgcgauc

SEQ ID NO: 961168 - RNA, 18 nt, Mycobacterium avium subsp. paratuberculosis
cagcgcccgcgcgaucgg

SEQ ID NO: 961169 - RNA, 23 nt, Mycobacterium avium subsp. paratuberculosis
cagcgcccgcgcgaucggcgagc

SEQ ID NO: 961170 - RNA, 16 nt, Mycobacterium avium subsp. paratuberculosis
cagcgcccgcgcgggc

SEQ ID NO: 961171 - RNA, 19 nt, Mycobacterium avium subsp. paratuberculosis
cagcgcccgcgcgggcugc

SEQ ID NO: 961172 - RNA, 16 nt, Mycobacterium avium subsp. paratuberculosis
cagcgcccgcgcgugg

SEQ ID NO: 961173 - RNA, 18 nt, Mycobacterium avium subsp. paratuberculosis
cagcgcccgcgcgugggc

SEQ ID NO: 961174 - RNA, 13 nt, Mycobacterium avium subsp. paratuberculosis
cagcgcccgcccg

SEQ ID NO: 961175 - RNA, 15 nt, Mycobacterium avium subsp. paratuberculosis
cagcgcccgcccggc

SEQ ID NO: 961176 - RNA, 20 nt, Mycobacterium avium subsp. paratuberculosis
cagcgcccgcccggcccggc

SEQ ID NO: 961177 - RNA, 22 nt, Mycobacterium avium subsp. paratuberculosis
cagcgcccgcccggcccggcgc

SEQ ID NO: 961178 - RNA, 23 nt, Mycobacterium avium subsp. paratuberculosis
cagcgcccgcccggcccggcgcg

SEQ ID NO: 961179 - RNA, 15 nt, Mycobacterium avium subsp. paratuberculosis
cagcgcccgccgcaa

SEQ ID NO: 961180 - RNA, 14 nt, Mycobacterium avium subsp. paratuberculosis
cagcgccccgccgg

SEQ ID NO: 961181 - RNA, 18 nt, Mycobacterium avium subsp. paratuberculosis
cagcgccccgccggggga

SEQ ID NO: 961182 - RNA, 12 nt, Mycobacterium avium subsp. paratuberculosis
cagcgccccggu

SEQ ID NO: 961183 - RNA, 16 nt, Mycobacterium avium subsp. paratuberculosis
cagcgcccccagcggg

SEQ ID NO: 961184 - RNA, 17 nt, Mycobacterium avium subsp. paratuberculosis
cagcgcccccagcgggg

SEQ ID NO: 961185 - RNA, 20 nt, Mycobacterium avium subsp. paratuberculosis
cagcgcccccagcggggcaa

SEQ ID NO: 961186 - RNA, 12 nt, Mycobacterium avium subsp. paratuberculosis
cagcgcccccga

SEQ ID NO: 961187 - RNA, 14 nt, Mycobacterium avium subsp. paratuberculosis
cagcgcccccgaca

SEQ ID NO: 961188 - RNA, 23 nt, Mycobacterium avium subsp. paratuberculosis
cagcgcccccgaggagacgucgg

SEQ ID NO: 961189 - RNA, 19 nt, Mycobacterium avium subsp. paratuberculosis
cagcgcccguagccgcggu

SEQ ID NO: 961190 - RNA, 17 nt, Mycobacterium avium subsp. paratuberculosis
cagcgcccgcugcgcgg

SEQ ID NO: 961191 - RNA, 19 nt, Mycobacterium avium subsp. paratuberculosis
cagcgcccggaugucgggc

SEQ ID NO: 961192 - RNA, 15 nt, Mycobacterium avium subsp. paratuberculosis
cagcgcccggcagcg

SEQ ID NO: 961193 - RNA, 20 nt, Mycobacterium avium subsp. paratuberculosis
cagcgccccgaaguucgaca

SEQ ID NO: 961194 - RNA, 13 nt, Mycobacterium avium subsp. paratuberculosis
cagcgcccggccg

SEQ ID NO: 961195 - RNA, 14 nt, Mycobacterium avium subsp. paratuberculosis
cagcgcccggccgu

SEQ ID NO: 961196 - RNA, 16 nt, Mycobacterium avium subsp. paratuberculosis
cagcgcccggccguga

SEQ ID NO: 961197 - RNA, 13 nt, Mycobacterium avium subsp. paratuberculosis
cagcgcccggcga

SEQ ID NO: 961198 - RNA, 14 nt, Mycobacterium avium subsp. paratuberculosis
cagcgcccggcgac

SEQ ID NO: 961199 - RNA, 21 nt, Mycobacterium avium subsp. paratuberculosis
cagcgcccggcgaccaccagc

SEQ ID NO: 961200 - RNA, 15 nt, Mycobacterium avium subsp. paratuberculosis
cagcgcccggcgauc

SEQ ID NO: 961201 - RNA, 14 nt, Mycobacterium avium subsp. paratuberculosis
cagcgcccgggcca

SEQ ID NO: 961202 - RNA, 20 nt, Mycobacterium avium subsp. paratuberculosis
cagcgcccgggccaggaccg

SEQ ID NO: 961203 - RNA, 21 nt, Mycobacterium avium subsp. paratuberculosis
cagcgcccgggccaggaccgg

SEQ ID NO: 961204 - RNA, 14 nt, Mycobacterium avium subsp. paratuberculosis
cagcgcccgggcgc

SEQ ID NO: 961205 - RNA, 18 nt, Mycobacterium avium subsp. paratuberculosis
cagcgcccgggcgcgugc

SEQ ID NO: 961206 - RNA, 15 nt, Mycobacterium avium subsp. paratuberculosis
cagcgccucgcgggu

SEQ ID NO: 961207 - RNA, 15 nt, Mycobacterium avium subsp. paratuberculosis
cagcgccucgcgguc

SEQ ID NO: 961208 - RNA, 17 nt, Mycobacterium avium subsp. paratuberculosis
cagcgccucgcggucga

SEQ ID NO: 961209 - RNA, 16 nt, Mycobacterium avium subsp. paratuberculosis
cagcgccucgccgggc

SEQ ID NO: 961210 - RNA, 13 nt, Mycobacterium avium subsp. paratuberculosis
cagcgccucggcc

SEQ ID NO: 961211 - RNA, 14 nt, Mycobacterium avium subsp. paratuberculosis
cagcgccucggccu

SEQ ID NO: 961212 - RNA, 15 nt, Mycobacterium avium subsp. paratuberculosis
cagcgccucggcgau

SEQ ID NO: 961213 - RNA, 16 nt, Mycobacterium avium subsp. paratuberculosis
cagcgccucggcgauc

SEQ ID NO: 961214 - RNA, 22 nt, Mycobacterium avium subsp. paratuberculosis
cagcgccucggcgaucggccgc

SEQ ID NO: 961215 - RNA, 15 nt, Mycobacterium avium subsp. paratuberculosis
cagcgccucggcggc

SEQ ID NO: 961216 - RNA, 16 nt, Mycobacterium avium subsp. paratuberculosis
cagcgccucggcgggc

SEQ ID NO: 961217 - RNA, 16 nt, Mycobacterium avium subsp. paratuberculosis
cagcgccucggcgugg

SEQ ID NO: 961218 - RNA, 17 nt, Mycobacterium avium subsp. paratuberculosis
cagcgccucggcguggc

SEQ ID NO: 961219 - RNA, 21 nt, Mycobacterium avium subsp. paratuberculosis
cagcgccucgagcaccacggc

SEQ ID NO: 961220 - RNA, 13 nt, Mycobacterium avium subsp. paratuberculosis
cagcgccucgccg

SEQ ID NO: 961221 - RNA, 13 nt, Mycobacterium avium subsp. paratuberculosis
cagcgccgaggcc

SEQ ID NO: 961222 - RNA, 19 nt, Mycobacterium avium subsp. paratuberculosis
cagcgccgaggccagcacg

SEQ ID NO: 961223 - RNA, 14 nt, Mycobacterium avium subsp. paratuberculosis
cagcgccgaggugc

SEQ ID NO: 961224 - RNA, 14 nt, Mycobacterium avium subsp. paratuberculosis
cagcgccgcaacgg

SEQ ID NO: 961225 - RNA, 15 nt, Mycobacterium avium subsp. paratuberculosis
cagcgccugcugcca

SEQ ID NO: 961226 - RNA, 14 nt, Mycobacterium avium subsp. paratuberculosis
cagcgccugcccgg

SEQ ID NO: 961227 - RNA, 23 nt, Mycobacterium avium subsp. paratuberculosis
cagcgccucggugaagccgcgga

SEQ ID NO: 961228 - RNA, 15 nt, Mycobacterium avium subsp. paratuberculosis
cagcgccucgucgag

SEQ ID NO: 961229 - RNA, 20 nt, Mycobacterium avium subsp. paratuberculosis
cagcgccucgucgagccggg

SEQ ID NO: 961230 - RNA, 19 nt, Mycobacterium avium subsp. paratuberculosis
cagcgccugguccucccgg

SEQ ID NO: 961231 - RNA, 20 nt, Mycobacterium avium subsp. paratuberculosis
cagcgccugcugccaggaca

SEQ ID NO: 961232 - RNA, 16 nt, Mycobacterium avium subsp. paratuberculosis
cagcgccuucggcgcc

SEQ ID NO: 961233 - RNA, 17 nt, Mycobacterium avium subsp. paratuberculosis
cagcgccuucggcgcca

SEQ ID NO: 961234 - RNA, 22 nt, Mycobacterium avium subsp. paratuberculosis
cagcgccuucggcgccagcccg

SEQ ID NO: 961235 - RNA, 13 nt, Mycobacterium avium subsp. paratuberculosis
cagcgccuugacc

SEQ ID NO: 961236 - RNA, 22 nt, Mycobacterium avium subsp. paratuberculosis
cagcgauacccguugcgcccca

SEQ ID NO: 961237 - RNA, 23 nt, Mycobacterium avium subsp. paratuberculosis
cagcgauacccguugcgccccac

SEQ ID NO: 961238 - RNA, 16 nt, Mycobacterium avium subsp. paratuberculosis
cagcgauccggcgcgu

SEQ ID NO: 961239 - RNA, 19 nt, Mycobacterium avium subsp. paratuberculosis
cagcgcaacggcgucgaca

SEQ ID NO: 961240 - RNA, 12 nt, Mycobacterium avium subsp. paratuberculosis
cagcgcaccgcc

SEQ ID NO: 961241 - RNA, 16 nt, Mycobacterium avium subsp. paratuberculosis
cagcgcaccgccgucg

SEQ ID NO: 961242 - RNA, 13 nt, Mycobacterium avium subsp. paratuberculosis
cagcgcaccggcg

SEQ ID NO: 961243 - RNA, 13 nt, Mycobacterium avium subsp. paratuberculosis
cagcgcacgucgc

SEQ ID NO: 961244 - RNA, 20 nt, Mycobacterium avium subsp. paratuberculosis
cagcgcacgucgccgccgca

SEQ ID NO: 961245 - RNA, 14 nt, Mycobacterium avium subsp. paratuberculosis
cagcgcaccggcga

SEQ ID NO: 961246 - RNA, 19 nt, Mycobacterium avium subsp. paratuberculosis
cagcgcaccgggcccgccc

SEQ ID NO: 961247 - RNA, 20 nt, Mycobacterium avium subsp. paratuberculosis
cagcgcaccgggcccgcccg

SEQ ID NO: 961248 - RNA, 19 nt, Mycobacterium avium subsp. paratuberculosis
cagcgaggggguggguccg

SEQ ID NO: 961249 - RNA, 21 nt, Mycobacterium avium subsp. paratuberculosis
cagcgagucgagaaacgcgcg

SEQ ID NO: 961250 - RNA, 15 nt, Mycobacterium avium subsp. paratuberculosis
cagcgagucggucga

SEQ ID NO: 961251 - RNA, 16 nt, Mycobacterium avium subsp. paratuberculosis
cagcgaguccagccag

SEQ ID NO: 961252 - RNA, 20 nt, Mycobacterium avium subsp. paratuberculosis
cagcgaggcguccagcgcgu

SEQ ID NO: 961253 - RNA, 20 nt, Mycobacterium avium subsp. paratuberculosis
cagcgaggcggccagcggca

SEQ ID NO: 961254 - RNA, 23 nt, Mycobacterium avium subsp. paratuberculosis
cagcgaggcggccagcggcagcg

SEQ ID NO: 961255 - RNA, 12 nt, Mycobacterium avium subsp. paratuberculosis
cagcgaggcgcg

SEQ ID NO: 961256 - RNA, 16 nt, Mycobacterium avium subsp. paratuberculosis
cagcgaggcgcgcagg

SEQ ID NO: 961257 - RNA, 22 nt, Mycobacterium avium subsp. paratuberculosis
cagcgaggcgacgucgaacgcg

SEQ ID NO: 961258 - RNA, 19 nt, Mycobacterium avium subsp. paratuberculosis
cagcgacuccagcgcgauc

SEQ ID NO: 961259 - RNA, 15 nt, Mycobacterium avium subsp. paratuberculosis
cagcgacucgggcag

SEQ ID NO: 961260 - RNA, 18 nt, Mycobacterium avium subsp. paratuberculosis
cagcgacuugaccagcag

SEQ ID NO: 961261 - RNA, 17 nt, Mycobacterium avium subsp. paratuberculosis
cagcgacucguuggccg

SEQ ID NO: 961262 - RNA, 19 nt, Mycobacterium avium subsp. paratuberculosis
cagcgacucguuggccggc

SEQ ID NO: 961263 - RNA, 17 nt, Mycobacterium avium subsp. paratuberculosis
cagcgacugcacccggg

SEQ ID NO: 961264 - RNA, 21 nt, Mycobacterium avium subsp. paratuberculosis
cagcgacuccugguccucgau

SEQ ID NO: 961265 - RNA, 22 nt, Mycobacterium avium subsp. paratuberculosis
cagcgacuccugguccucgauc

SEQ ID NO: 961266 - RNA, 12 nt, Mycobacterium avium subsp. paratuberculosis
cagccgucgaug

SEQ ID NO: 961267 - RNA, 14 nt, Mycobacterium avium subsp. paratuberculosis
cagccgucgcaccg

SEQ ID NO: 961268 - RNA, 21 nt, Mycobacterium avium subsp. paratuberculosis
cagccgucgcaucagcucggc

SEQ ID NO: 961269 - RNA, 24 nt, Mycobacterium avium subsp. paratuberculosis
cagccgucgcaucagcucggcagc

SEQ ID NO: 961270 - RNA, 15 nt, Mycobacterium avium subsp. paratuberculosis
cagccgugcggcacg

SEQ ID NO: 961271 - RNA, 20 nt, Mycobacterium avium subsp. paratuberculosis
cagccgugcggcacgccgca

SEQ ID NO: 961272 - RNA, 20 nt, Mycobacterium avium subsp. paratuberculosis
cagccgucgucguccgcaac

SEQ ID NO: 961273 - RNA, 13 nt, Mycobacterium avium subsp. paratuberculosis
cagccgugcuggg

SEQ ID NO: 961274 - RNA, 19 nt, Mycobacterium avium subsp. paratuberculosis
cagcgaacgcggcugauca

SEQ ID NO: 961275 - RNA, 22 nt, Mycobacterium avium subsp. paratuberculosis
cagccgucguugcgggcggcgc

SEQ ID NO: 961276 - RNA, 20 nt, Mycobacterium avium subsp. paratuberculosis
cagccguuccaucgggccca

SEQ ID NO: 961277 - RNA, 23 nt, Mycobacterium avium subsp. paratuberculosis
cagccguuccaucgggcccagca

SEQ ID NO: 961278 - RNA, 14 nt, Mycobacterium avium subsp. paratuberculosis
cagccguucccggc

SEQ ID NO: 961279 - RNA, 21 nt, Mycobacterium avium subsp. paratuberculosis
cagccguucgcgcacggcgcg

SEQ ID NO: 961280 - RNA, 15 nt, Mycobacterium avium subsp. paratuberculosis
cagccguucgcugcc

SEQ ID NO: 961281 - RNA, 20 nt, Mycobacterium avium subsp. paratuberculosis
cagccguucgcugcccucgg

SEQ ID NO: 961282 - RNA, 19 nt, Mycobacterium avium subsp. paratuberculosis
cagccgugggugucggcga

SEQ ID NO: 961283 - RNA, 14 nt, Mycobacterium avium subsp. paratuberculosis
cagcgacgcgguga

SEQ ID NO: 961284 - RNA, 16 nt, Mycobacterium avium subsp. paratuberculosis
cagcgacggcaggucg

SEQ ID NO: 961285 - RNA, 16 nt, Mycobacterium avium subsp. paratuberculosis
cagcgacggcccgccg

SEQ ID NO: 961286 - RNA, 15 nt, Mycobacterium avium subsp. paratuberculosis
cagcgacggccgggu

SEQ ID NO: 961287 - RNA, 16 nt, Mycobacterium avium subsp. paratuberculosis
cagcgacggccggguc

SEQ ID NO: 961288 - RNA, 13 nt, Mycobacterium avium subsp. paratuberculosis
cagcgacgggccg

SEQ ID NO: 961289 - RNA, 14 nt, Mycobacterium avium subsp. paratuberculosis
cagcgacgggccgg

SEQ ID NO: 961290 - RNA, 16 nt, Mycobacterium avium subsp. paratuberculosis
cagcgacgggccgggc

SEQ ID NO: 961291 - RNA, 18 nt, Mycobacterium avium subsp. paratuberculosis
cagcgacgggccgggcac

SEQ ID NO: 961292 - RNA, 22 nt, Mycobacterium avium subsp. paratuberculosis
cagcgacgucaggucgaccggc

SEQ ID NO: 961293 - RNA, 23 nt, Mycobacterium avium subsp. paratuberculosis
cagcgacgucugcggcucggcgc

SEQ ID NO: 961294 - RNA, 20 nt, Mycobacterium avium subsp. paratuberculosis
cagcgacggaucggccgcgu

SEQ ID NO: 961295 - RNA, 14 nt, Mycobacterium avium subsp. paratuberculosis
cagcgacaccacgg

SEQ ID NO: 961296 - RNA, 17 nt, Mycobacterium avium subsp. paratuberculosis
cagcgacaccacgguga

SEQ ID NO: 961297 - RNA, 16 nt, Mycobacterium avium subsp. paratuberculosis
cagcgacagcacccgc

SEQ ID NO: 961298 - RNA, 18 nt, Mycobacterium avium subsp. paratuberculosis
cagcgacagcacccgcug

SEQ ID NO: 961299 - RNA, 18 nt, Mycobacterium avium subsp. paratuberculosis
cagcgacaacggccccca

SEQ ID NO: 961300 - RNA, 16 nt, Mycobacterium avium subsp. paratuberculosis
cagcgacaacgggccg

SEQ ID NO: 961301 - RNA, 19 nt, Mycobacterium avium subsp. paratuberculosis
cagcgacaacgggccgccu

SEQ ID NO: 961302 - RNA, 16 nt, Mycobacterium avium subsp. paratuberculosis
cagcgaaucgaccggg

SEQ ID NO: 961303 - RNA, 22 nt, Mycobacterium avium subsp. paratuberculosis
cagcgaaucgaccggguuggcg

SEQ ID NO: 961304 - RNA, 19 nt, Mycobacterium avium subsp. paratuberculosis
cagcgaaucggggucgauc

SEQ ID NO: 961305 - RNA, 20 nt, Mycobacterium avium subsp. paratuberculosis
cagcgaaucggggucgauca

SEQ ID NO: 961306 - RNA, 18 nt, Mycobacterium avium subsp. paratuberculosis
cagcgaagcgaggcgcca

SEQ ID NO: 961307 - RNA, 17 nt, Mycobacterium avium subsp. paratuberculosis
cagcgaauacaccgucc

SEQ ID NO: 961308 - RNA, 13 nt, Mycobacterium avium subsp. paratuberculosis
cagccaccgcccg

SEQ ID NO: 961309 - RNA, 14 nt, Mycobacterium avium subsp. paratuberculosis
cagccaccgcccga

SEQ ID NO: 961310 - RNA, 13 nt, Mycobacterium avium subsp. paratuberculosis
cagccaccgugcc

SEQ ID NO: 961311 - RNA, 17 nt, Mycobacterium avium subsp. paratuberculosis
cagccaccguggcccca

SEQ ID NO: 961312 - RNA, 18 nt, Mycobacterium avium subsp. paratuberculosis
cagccacgagcccagccg

SEQ ID NO: 961313 - RNA, 14 nt, Mycobacterium avium subsp. paratuberculosis
cagccccucggggc

SEQ ID NO: 961314 - RNA, 18 nt, Mycobacterium avium subsp. paratuberculosis
cagccccucggggcugcg

SEQ ID NO: 961315 - RNA, 21 nt, Mycobacterium avium subsp. paratuberculosis
cagccccucggggcugcgcgg

SEQ ID NO: 961316 - RNA, 14 nt, Mycobacterium avium subsp. paratuberculosis
cagccccugcacca

SEQ ID NO: 961317 - RNA, 19 nt, Mycobacterium avium subsp. paratuberculosis
cagccacgguccuuggcgu

SEQ ID NO: 961318 - RNA, 18 nt, Mycobacterium avium subsp. paratuberculosis
cagccccucgccgggcgu

SEQ ID NO: 961319 - RNA, 15 nt, Mycobacterium avium subsp. paratuberculosis
cagccacggcagcug

SEQ ID NO: 961320 - RNA, 16 nt, Mycobacterium avium subsp. paratuberculosis
cagccacgggcggucg

SEQ ID NO: 961321 - RNA, 14 nt, Mycobacterium avium subsp. paratuberculosis
cagccacgccgaca

SEQ ID NO: 961322 - RNA, 20 nt, Mycobacterium avium subsp. paratuberculosis
cagccacgccgacaccgucg

SEQ ID NO: 961323 - RNA, 13 nt, Mycobacterium avium subsp. paratuberculosis
cagccacgccggc

SEQ ID NO: 961324 - RNA, 13 nt, Mycobacterium avium subsp. paratuberculosis
cagcccggcgugc

SEQ ID NO: 961325 - RNA, 13 nt, Mycobacterium avium subsp. paratuberculosis
cagcccggcgucc

SEQ ID NO: 961326 - RNA, 20 nt, Mycobacterium avium subsp. paratuberculosis
cagcccggcgcucaccgcga

SEQ ID NO: 961327 - RNA, 23 nt, Mycobacterium avium subsp. paratuberculosis
cagcccggcgcucaccgcgauga

SEQ ID NO: 961328 - RNA, 17 nt, Mycobacterium avium subsp. paratuberculosis
cagcccggcgcugcgcc

SEQ ID NO: 961329 - RNA, 19 nt, Mycobacterium avium subsp. paratuberculosis
cagcccgaucucgcggucg

SEQ ID NO: 961330 - RNA, 13 nt, Mycobacterium avium subsp. paratuberculosis
cagcccggcgacg

SEQ ID NO: 961331 - RNA, 17 nt, Mycobacterium avium subsp. paratuberculosis
cagcccggcgacgaagc

SEQ ID NO: 961332 - RNA, 18 nt, Mycobacterium avium subsp. paratuberculosis
cagcccgauucagccggc

SEQ ID NO: 961333 - RNA, 13 nt, Mycobacterium avium subsp. paratuberculosis
cagcccggcgaac

SEQ ID NO: 961334 - RNA, 17 nt, Mycobacterium avium subsp. paratuberculosis
cagcccgagcggcauca

SEQ ID NO: 961335 - RNA, 15 nt, Mycobacterium avium subsp. paratuberculosis
cagcccgagcaccag

SEQ ID NO: 961336 - RNA, 20 nt, Mycobacterium avium subsp. paratuberculosis
cagcccgagcaccagcggac

SEQ ID NO: 961337 - RNA, 17 nt, Mycobacterium avium subsp. paratuberculosis
cagcccgagcacguugu

SEQ ID NO: 961338 - RNA, 13 nt, Mycobacterium avium subsp. paratuberculosis
cagcccgaaaguc

SEQ ID NO: 961339 - RNA, 22 nt, Mycobacterium avium subsp. paratuberculosis
cagcccgaaaguccccgggugg

SEQ ID NO: 961340 - RNA, 15 nt, Mycobacterium avium subsp. paratuberculosis
cagcccgaacagccg

SEQ ID NO: 961341 - RNA, 17 nt, Mycobacterium avium subsp. paratuberculosis
cagcccgaacagccggg

SEQ ID NO: 961342 - RNA, 14 nt, Mycobacterium avium subsp. paratuberculosis
cagcccgaccaccu

SEQ ID NO: 961343 - RNA, 20 nt, Mycobacterium avium subsp. paratuberculosis
cagcccgacccggcucucca

SEQ ID NO: 961344 - RNA, 13 nt, Mycobacterium avium subsp. paratuberculosis
cagcccgaccguc

SEQ ID NO: 961345 - RNA, 21 nt, Mycobacterium avium subsp. paratuberculosis
cagcccgaccgucgucccggu

SEQ ID NO: 961346 - RNA, 22 nt, Mycobacterium avium subsp. paratuberculosis
cagcccgaccgucgucccggug

SEQ ID NO: 961347 - RNA, 19 nt, Mycobacterium avium subsp. paratuberculosis
cagcccgaccuucugcugc

SEQ ID NO: 961348 - RNA, 21 nt, Mycobacterium avium subsp. paratuberculosis
cagccgaagaacuggcugagc

SEQ ID NO: 961349 - RNA, 17 nt, Mycobacterium avium subsp. paratuberculosis
cagccgaagccggcgca

SEQ ID NO: 961350 - RNA, 18 nt, Mycobacterium avium subsp. paratuberculosis
cagccgaagccggcgcag

SEQ ID NO: 961351 - RNA, 19 nt, Mycobacterium avium subsp. paratuberculosis
cagccgaaguauccgguca

SEQ ID NO: 961352 - RNA, 17 nt, Mycobacterium avium subsp. paratuberculosis
cagccgcaacacggccu

SEQ ID NO: 961353 - RNA, 20 nt, Mycobacterium avium subsp. paratuberculosis
cagccgcaacacggccucga

SEQ ID NO: 961354 - RNA, 22 nt, Mycobacterium avium subsp. paratuberculosis
cagccgcaacacggccucgauc

SEQ ID NO: 961355 - RNA, 20 nt, Mycobacterium avium subsp. paratuberculosis
cagccgaugcgcccgcgcca

SEQ ID NO: 961356 - RNA, 19 nt, Mycobacterium avium subsp. paratuberculosis
cagccgaucuggcgggcgg

SEQ ID NO: 961357 - RNA, 23 nt, Mycobacterium avium subsp. paratuberculosis
cagccgaucuggcgggcggucca

SEQ ID NO: 961358 - RNA, 19 nt, Mycobacterium avium subsp. paratuberculosis
cagccgaugucgucgaacg

SEQ ID NO: 961359 - RNA, 13 nt, Mycobacterium avium subsp. paratuberculosis
cagcccucgucga

SEQ ID NO: 961360 - RNA, 17 nt, Mycobacterium avium subsp. paratuberculosis
cagcccucgucgaugac

SEQ ID NO: 961361 - RNA, 23 nt, Mycobacterium avium subsp. paratuberculosis
cagcccucgucgaugacguccac

SEQ ID NO: 961362 - RNA, 17 nt, Mycobacterium avium subsp. paratuberculosis
cagcccucgugcguagc

SEQ ID NO: 961363 - RNA, 19 nt, Mycobacterium avium subsp. paratuberculosis
cagcccugcuugaccgcga

SEQ ID NO: 961364 - RNA, 21 nt, Mycobacterium avium subsp. paratuberculosis
cagcccugcuugaccgcgacg

SEQ ID NO: 961365 - RNA, 23 nt, Mycobacterium avium subsp. paratuberculosis
cagcccugcuugaccgcgacggg

SEQ ID NO: 961366 - RNA, 13 nt, Mycobacterium avium subsp. paratuberculosis
cagcccucgagcc

SEQ ID NO: 961367 - RNA, 20 nt, Mycobacterium avium subsp. paratuberculosis
cagcccguugucgagcaccg

SEQ ID NO: 961368 - RNA, 23 nt, Mycobacterium avium subsp. paratuberculosis
cagcccguugucgagcaccgcga

SEQ ID NO: 961369 - RNA, 14 nt, Mycobacterium avium subsp. paratuberculosis
cagcccguuguggc

SEQ ID NO: 961370 - RNA, 19 nt, Mycobacterium avium subsp. paratuberculosis
cagcccguuguggcggcca

SEQ ID NO: 961371 - RNA, 22 nt, Mycobacterium avium subsp. paratuberculosis
cagcccguuguggcggccagcg

SEQ ID NO: 961372 - RNA, 19 nt, Mycobacterium avium subsp. paratuberculosis
cagcccuacccguccagcg

SEQ ID NO: 961373 - RNA, 22 nt, Mycobacterium avium subsp. paratuberculosis
cagcccuacccguccagcgcga

SEQ ID NO: 961374 - RNA, 16 nt, Mycobacterium avium subsp. paratuberculosis
cagcccgucgaucccg

SEQ ID NO: 961375 - RNA, 14 nt, Mycobacterium avium subsp. paratuberculosis
cagcccgucggccu

SEQ ID NO: 961376 - RNA, 17 nt, Mycobacterium avium subsp. paratuberculosis
cagcccgucggccucca

SEQ ID NO: 961377 - RNA, 12 nt, Mycobacterium avium subsp. paratuberculosis
cagcccggcggu

SEQ ID NO: 961378 - RNA, 16 nt, Mycobacterium avium subsp. paratuberculosis
cagcccgucgggugug

SEQ ID NO: 961379 - RNA, 16 nt, Mycobacterium avium subsp. paratuberculosis
cagcccguggccagcg

SEQ ID NO: 961380 - RNA, 23 nt, Mycobacterium avium subsp. paratuberculosis
cagcccgggcugcagcagcgacu

SEQ ID NO: 961381 - RNA, 17 nt, Mycobacterium avium subsp. paratuberculosis
cagcccggggguggcgg

SEQ ID NO: 961382 - RNA, 14 nt, Mycobacterium avium subsp. paratuberculosis
cagcccgggugcga

SEQ ID NO: 961383 - RNA, 12 nt, Mycobacterium avium subsp. paratuberculosis
cagcccggcuaa

SEQ ID NO: 961384 - RNA, 16 nt, Mycobacterium avium subsp. paratuberculosis
cagcccggcugcgcag

SEQ ID NO: 961385 - RNA, 20 nt, Mycobacterium avium subsp. paratuberculosis
cagcccggcugcgcagcgca

SEQ ID NO: 961386 - RNA, 17 nt, Mycobacterium avium subsp. paratuberculosis
cagcccggucaguucgu

SEQ ID NO: 961387 - RNA, 13 nt, Mycobacterium avium subsp. paratuberculosis
cagcccggugacg

SEQ ID NO: 961388 - RNA, 17 nt, Mycobacterium avium subsp. paratuberculosis
cagcccggugacgaaca

SEQ ID NO: 961389 - RNA, 23 nt, Mycobacterium avium subsp. paratuberculosis
cagcccggugacgaacaucgacg

SEQ ID NO: 961390 - RNA, 13 nt, Mycobacterium avium subsp. paratuberculosis
cagcccggugauc

SEQ ID NO: 961391 - RNA, 20 nt, Mycobacterium avium subsp. paratuberculosis
cagcccggugaucgccgccc

SEQ ID NO: 961392 - RNA, 23 nt, Mycobacterium avium subsp. paratuberculosis
cagcccgguuuccaguccggcgc

SEQ ID NO: 961393 - RNA, 20 nt, Mycobacterium avium subsp. paratuberculosis
cagcccguacuugcuggcgc

SEQ ID NO: 961394 - RNA, 23 nt, Mycobacterium avium subsp. paratuberculosis
cagccgcauguugugcccgacgg

SEQ ID NO: 961395 - RNA, 19 nt, Mycobacterium avium subsp. paratuberculosis
cagccgcaggguuucguga

SEQ ID NO: 961396 - RNA, 18 nt, Mycobacterium avium subsp. paratuberculosis
cagccgcaggugcagcuc

SEQ ID NO: 961397 - RNA, 17 nt, Mycobacterium avium subsp. paratuberculosis
cagccgcaggugcucgc

SEQ ID NO: 961398 - RNA, 19 nt, Mycobacterium avium subsp. paratuberculosis
cagccgcaggugcucgccg

SEQ ID NO: 961399 - RNA, 14 nt, Mycobacterium avium subsp. paratuberculosis
cagccgcagcggcg

SEQ ID NO: 961400 - RNA, 16 nt, Mycobacterium avium subsp. paratuberculosis
cagccgcagcggcggc

SEQ ID NO: 961401 - RNA, 17 nt, Mycobacterium avium subsp. paratuberculosis
cagccgcagcuguucgg

SEQ ID NO: 961402 - RNA, 21 nt, Mycobacterium avium subsp. paratuberculosis
cagccgcagcuguucgggcag

SEQ ID NO: 961403 - RNA, 15 nt, Mycobacterium avium subsp. paratuberculosis
cagccgcagcgcgcg

SEQ ID NO: 961404 - RNA, 14 nt, Mycobacterium avium subsp. paratuberculosis
cagccgcagcaggc

SEQ ID NO: 961405 - RNA, 15 nt, Mycobacterium avium subsp. paratuberculosis
cagccgcagcaggca

SEQ ID NO: 961406 - RNA, 22 nt, Mycobacterium avium subsp. paratuberculosis
cagccgcacuuggccucgggcg

SEQ ID NO: 961407 - RNA, 14 nt, Mycobacterium avium subsp. paratuberculosis
cagccgcagcagcc

SEQ ID NO: 961408 - RNA, 16 nt, Mycobacterium avium subsp. paratuberculosis
cagccgcagcagccgc

SEQ ID NO: 961409 - RNA, 18 nt, Mycobacterium avium subsp. paratuberculosis
cagccgcagcagccgcgc

SEQ ID NO: 961410 - RNA, 23 nt, Mycobacterium avium subsp. paratuberculosis
cagccgcaaggugauucgcgcgg

SEQ ID NO: 961411 - RNA, 13 nt, Mycobacterium avium subsp. paratuberculosis
cagccgcaccaga

SEQ ID NO: 961412 - RNA, 20 nt, Mycobacterium avium subsp. paratuberculosis
cagccgcaccagaucgucgg

SEQ ID NO: 961413 - RNA, 22 nt, Mycobacterium avium subsp. paratuberculosis
cagccgcaccgcgaccgucauc

SEQ ID NO: 961414 - RNA, 14 nt, Mycobacterium avium subsp. paratuberculosis
cagccgcaccggcg

SEQ ID NO: 961415 - RNA, 15 nt, Mycobacterium avium subsp. paratuberculosis
cagccgcaccggcgc

SEQ ID NO: 961416 - RNA, 16 nt, Mycobacterium avium subsp. paratuberculosis
cagccgcaccggcgcc

SEQ ID NO: 961417 - RNA, 20 nt, Mycobacterium avium subsp. paratuberculosis
cagccgcaccggcgccgcca

SEQ ID NO: 961418 - RNA, 17 nt, Mycobacterium avium subsp. paratuberculosis
cagccgcaccucggggc

SEQ ID NO: 961419 - RNA, 18 nt, Mycobacterium avium subsp. paratuberculosis
cagccgcacgaaccgcuc

SEQ ID NO: 961420 - RNA, 16 nt, Mycobacterium avium subsp. paratuberculosis
cagccgcugacgaugg

SEQ ID NO: 961421 - RNA, 21 nt, Mycobacterium avium subsp. paratuberculosis
cagccgcugcagcgccgcccg

SEQ ID NO: 961422 - RNA, 16 nt, Mycobacterium avium subsp. paratuberculosis
cagccgcugccgcacc

SEQ ID NO: 961423 - RNA, 23 nt, Mycobacterium avium subsp. paratuberculosis
cagccgcugccguucgccgguac

SEQ ID NO: 961424 - RNA, 12 nt, Mycobacterium avium subsp. paratuberculosis
cagccgccccga

SEQ ID NO: 961425 - RNA, 13 nt, Mycobacterium avium subsp. paratuberculosis
cagccgccagccg

SEQ ID NO: 961426 - RNA, 17 nt, Mycobacterium avium subsp. paratuberculosis
cagccgccagccgguca

SEQ ID NO: 961427 - RNA, 21 nt, Mycobacterium avium subsp. paratuberculosis
cagccgcccagcaucgccgcg

SEQ ID NO: 961428 - RNA, 22 nt, Mycobacterium avium subsp. paratuberculosis
cagccgcccagcaucgccgcga

SEQ ID NO: 961429 - RNA, 23 nt, Mycobacterium avium subsp. paratuberculosis
cagccgcccagcaucgccgcgac

SEQ ID NO: 961430 - RNA, 20 nt, Mycobacterium avium subsp. paratuberculosis
cagccggacgggaucggcgc

SEQ ID NO: 961431 - RNA, 21 nt, Mycobacterium avium subsp. paratuberculosis
cagccggacgggaucggcgcg

SEQ ID NO: 961432 - RNA, 22 nt, Mycobacterium avium subsp. paratuberculosis
cagccggacgggaucggcgcgu

SEQ ID NO: 961433 - RNA, 22 nt, Mycobacterium avium subsp. paratuberculosis
cagccggagccggccucgccgg

SEQ ID NO: 961434 - RNA, 17 nt, Mycobacterium avium subsp. paratuberculosis
cagccggaucaccuggu

SEQ ID NO: 961435 - RNA, 23 nt, Mycobacterium avium subsp. paratuberculosis
cagccggaucagcguuccggcgg

SEQ ID NO: 961436 - RNA, 17 nt, Mycobacterium avium subsp. paratuberculosis
cagccggaucucgucgg

SEQ ID NO: 961437 - RNA, 23 nt, Mycobacterium avium subsp. paratuberculosis
cagccggaucucgucgggcaccg

SEQ ID NO: 961438 - RNA, 19 nt, Mycobacterium avium subsp. paratuberculosis
cagccggaaggccaaggcc

SEQ ID NO: 961439 - RNA, 23 nt, Mycobacterium avium subsp. paratuberculosis
cagccggaaggccaaggccagca

SEQ ID NO: 961440 - RNA, 14 nt, Mycobacterium avium subsp. paratuberculosis
cagccgcuuggccg

SEQ ID NO: 961441 - RNA, 18 nt, Mycobacterium avium subsp. paratuberculosis
cagccgcuuggccgggcg

SEQ ID NO: 961442 - RNA, 16 nt, Mycobacterium avium subsp. paratuberculosis
cagccgcuggccgcgc

SEQ ID NO: 961443 - RNA, 15 nt, Mycobacterium avium subsp. paratuberculosis
cagccggugcgagcc

SEQ ID NO: 961444 - RNA, 16 nt, Mycobacterium avium subsp. paratuberculosis
cagccggugcgagccg

SEQ ID NO: 961445 - RNA, 17 nt, Mycobacterium avium subsp. paratuberculosis
cagccggugcgagccgc

SEQ ID NO: 961446 - RNA, 19 nt, Mycobacterium avium subsp. paratuberculosis
cagccggugcgagccgcug

SEQ ID NO: 961447 - RNA, 20 nt, Mycobacterium avium subsp. paratuberculosis
cagccgguugcgguggccga

SEQ ID NO: 961448 - RNA, 22 nt, Mycobacterium avium subsp. paratuberculosis
cagccgucccuguucgcgccgg

SEQ ID NO: 961449 - RNA, 16 nt, Mycobacterium avium subsp. paratuberculosis
cagccggugcggucgg

SEQ ID NO: 961450 - RNA, 14 nt, Mycobacterium avium subsp. paratuberculosis
cagccggugcugac

SEQ ID NO: 961451 - RNA, 16 nt, Mycobacterium avium subsp. paratuberculosis
cagccggugcugaccc

SEQ ID NO: 961452 - RNA, 22 nt, Mycobacterium avium subsp. paratuberculosis
cagccggugcugacccggucgc

SEQ ID NO: 961453 - RNA, 23 nt, Mycobacterium avium subsp. paratuberculosis
cagccggugcugacccggucgcg

SEQ ID NO: 961454 - RNA, 21 nt, Mycobacterium avium subsp. paratuberculosis
cagccgguggaauucuggccg

SEQ ID NO: 961455 - RNA, 22 nt, Mycobacterium avium subsp. paratuberculosis
cagccgguggaauucuggccga

SEQ ID NO: 961456 - RNA, 23 nt, Mycobacterium avium subsp. paratuberculosis
cagccgguggcggccacgaucgc

SEQ ID NO: 961457 - RNA, 22 nt, Mycobacterium avium subsp. paratuberculosis
cagccggucuuggacagcagca

SEQ ID NO: 961458 - RNA, 12 nt, Mycobacterium avium subsp. paratuberculosis
cagccggugcac

SEQ ID NO: 961459 - RNA, 14 nt, Mycobacterium avium subsp. paratuberculosis
cagccggugcacca

SEQ ID NO: 961460 - RNA, 22 nt, Mycobacterium avium subsp. paratuberculosis
cagccggcggauauagccgacg

SEQ ID NO: 961461 - RNA, 23 nt, Mycobacterium avium subsp. paratuberculosis
cagccgguacagcgucugcugga

SEQ ID NO: 961462 - RNA, 19 nt, Mycobacterium avium subsp. paratuberculosis
cagccgguacggaucgccg

SEQ ID NO: 961463 - RNA, 22 nt, Mycobacterium avium subsp. paratuberculosis
cagccgguacggaucgccggac

SEQ ID NO: 961464 - RNA, 19 nt, Mycobacterium avium subsp. paratuberculosis
cagccgguaggccugcguc

SEQ ID NO: 961465 - RNA, 18 nt, Mycobacterium avium subsp. paratuberculosis
cagccgguaugcgaucgc

SEQ ID NO: 961466 - RNA, 19 nt, Mycobacterium avium subsp. paratuberculosis
cagccggucauaggccgcg

SEQ ID NO: 961467 - RNA, 22 nt, Mycobacterium avium subsp. paratuberculosis
cagccggucauaggccgcgcag

SEQ ID NO: 961468 - RNA, 19 nt, Mycobacterium avium subsp. paratuberculosis
cagccggucaucgcguagu

SEQ ID NO: 961469 - RNA, 18 nt, Mycobacterium avium subsp. paratuberculosis
cagccgguccgaccgcca

SEQ ID NO: 961470 - RNA, 20 nt, Mycobacterium avium subsp. paratuberculosis
cagccgguccgaccgccacc

SEQ ID NO: 961471 - RNA, 16 nt, Mycobacterium avium subsp. paratuberculosis
cagccgguccggcggc

SEQ ID NO: 961472 - RNA, 20 nt, Mycobacterium avium subsp. paratuberculosis
cagccgguccugggccuccg

SEQ ID NO: 961473 - RNA, 23 nt, Mycobacterium avium subsp. paratuberculosis
cagccgguccuuggccugcuugg

SEQ ID NO: 961474 - RNA, 13 nt, Mycobacterium avium subsp. paratuberculosis
cagccggucgacg

SEQ ID NO: 961475 - RNA, 16 nt, Mycobacterium avium subsp. paratuberculosis
cagccggucgaggucg

SEQ ID NO: 961476 - RNA, 20 nt, Mycobacterium avium subsp. paratuberculosis
cagccggucgaggucgccga

SEQ ID NO: 961477 - RNA, 21 nt, Mycobacterium avium subsp. paratuberculosis
cagccggucgaggucgccgac

SEQ ID NO: 961478 - RNA, 15 nt, Mycobacterium avium subsp. paratuberculosis
cagccggucgccggg

SEQ ID NO: 961479 - RNA, 19 nt, Mycobacterium avium subsp. paratuberculosis
cagccggucgccgggccgg

SEQ ID NO: 961480 - RNA, 23 nt, Mycobacterium avium subsp. paratuberculosis
cagccggucgcgcaucgccucgg

SEQ ID NO: 961481 - RNA, 16 nt, Mycobacterium avium subsp. paratuberculosis
cagccggucggaggcc

SEQ ID NO: 961482 - RNA, 14 nt, Mycobacterium avium subsp. paratuberculosis
cagccggucgucgg

SEQ ID NO: 961483 - RNA, 19 nt, Mycobacterium avium subsp. paratuberculosis
cagccggucgucggggcau

SEQ ID NO: 961484 - RNA, 22 nt, Mycobacterium avium subsp. paratuberculosis
cagccggucgucggggcaucgc

SEQ ID NO: 961485 - RNA, 16 nt, Mycobacterium avium subsp. paratuberculosis
cagccggguagcgccg

SEQ ID NO: 961486 - RNA, 22 nt, Mycobacterium avium subsp. paratuberculosis
cagccgggucaguucgcggcgc

SEQ ID NO: 961487 - RNA, 16 nt, Mycobacterium avium subsp. paratuberculosis
cagccggguccgcacc

SEQ ID NO: 961488 - RNA, 21 nt, Mycobacterium avium subsp. paratuberculosis
cagccggguccgcacccgggc

SEQ ID NO: 961489 - RNA, 23 nt, Mycobacterium avium subsp. paratuberculosis
cagccgggugaacccgacguugc

SEQ ID NO: 961490 - RNA, 14 nt, Mycobacterium avium subsp. paratuberculosis
cagccgggugcggg

SEQ ID NO: 961491 - RNA, 15 nt, Mycobacterium avium subsp. paratuberculosis
cagccgggugcgggc

SEQ ID NO: 961492 - RNA, 14 nt, Mycobacterium avium subsp. paratuberculosis
cagccgggugcggu

SEQ ID NO: 961493 - RNA, 19 nt, Mycobacterium avium subsp. paratuberculosis
cagccggguggcccgcccg

SEQ ID NO: 961494 - RNA, 20 nt, Mycobacterium avium subsp. paratuberculosis
cagccggguggcccgcccgg

SEQ ID NO: 961495 - RNA, 15 nt, Mycobacterium avium subsp. paratuberculosis
cagccgggugggcgg

SEQ ID NO: 961496 - RNA, 19 nt, Mycobacterium avium subsp. paratuberculosis
cagccgggugggcggcaca

SEQ ID NO: 961497 - RNA, 22 nt, Mycobacterium avium subsp. paratuberculosis
cagccgggugggcggcacaccg

SEQ ID NO: 961498 - RNA, 15 nt, Mycobacterium avium subsp. paratuberculosis
cagccggggaucgcg

SEQ ID NO: 961499 - RNA, 14 nt, Mycobacterium avium subsp. paratuberculosis
cagccggggcagcu

SEQ ID NO: 961500 - RNA, 22 nt, Mycobacterium avium subsp. paratuberculosis
cagccgggaaucgagggcgcgc

SEQ ID NO: 961501 - RNA, 18 nt, Mycobacterium avium subsp. paratuberculosis
cagccgggggaucaccuc

SEQ ID NO: 961502 - RNA, 22 nt, Mycobacterium avium subsp. paratuberculosis
cagccgggggaucaccucaucg

SEQ ID NO: 961503 - RNA, 18 nt, Mycobacterium avium subsp. paratuberculosis
cagccgggggcggugcag

SEQ ID NO: 961504 - RNA, 21 nt, Mycobacterium avium subsp. paratuberculosis
cagccgggggcggugcagccg

SEQ ID NO: 961505 - RNA, 23 nt, Mycobacterium avium subsp. paratuberculosis
cagccgggggcggugcagccggg

SEQ ID NO: 961506 - RNA, 22 nt, Mycobacterium avium subsp. paratuberculosis
cagccgggguagggcggcgggg

SEQ ID NO: 961507 - RNA, 18 nt, Mycobacterium avium subsp. paratuberculosis
cagccggggugcccgggc

SEQ ID NO: 961508 - RNA, 15 nt, Mycobacterium avium subsp. paratuberculosis
cagccgggcggccgg

SEQ ID NO: 961509 - RNA, 15 nt, Mycobacterium avium subsp. paratuberculosis
cagccgggcggcgcc

SEQ ID NO: 961510 - RNA, 18 nt, Mycobacterium avium subsp. paratuberculosis
cagccgggcggcgccgaa

SEQ ID NO: 961511 - RNA, 14 nt, Mycobacterium avium subsp. paratuberculosis
cagccgggcggcgg

SEQ ID NO: 961512 - RNA, 15 nt, Mycobacterium avium subsp. paratuberculosis
cagccgggcggcggc

SEQ ID NO: 961513 - RNA, 22 nt, Mycobacterium avium subsp. paratuberculosis
cagccgggcggugauggucacc

SEQ ID NO: 961514 - RNA, 15 nt, Mycobacterium avium subsp. paratuberculosis
cagccgggccagcaa

SEQ ID NO: 961515 - RNA, 17 nt, Mycobacterium avium subsp. paratuberculosis
cagccgggccagcaaca

SEQ ID NO: 961516 - RNA, 21 nt, Mycobacterium avium subsp. paratuberculosis
cagccgggccagcaacagcag

SEQ ID NO: 961517 - RNA, 15 nt, Mycobacterium avium subsp. paratuberculosis
cagccgggccagcag

SEQ ID NO: 961518 - RNA, 16 nt, Mycobacterium avium subsp. paratuberculosis
cagccgggccagcccg

SEQ ID NO: 961519 - RNA, 16 nt, Mycobacterium avium subsp. paratuberculosis
cagccgggccgagcgc

SEQ ID NO: 961520 - RNA, 20 nt, Mycobacterium avium subsp. paratuberculosis
cagccgggccgagcgcgccg

SEQ ID NO: 961521 - RNA, 14 nt, Mycobacterium avium subsp. paratuberculosis
cagccgggccgccc

SEQ ID NO: 961522 - RNA, 18 nt, Mycobacterium avium subsp. paratuberculosis
cagccgggccgcccgcgc

SEQ ID NO: 961523 - RNA, 20 nt, Mycobacterium avium subsp. paratuberculosis
cagccgggccugcggcgcgg

SEQ ID NO: 961524 - RNA, 22 nt, Mycobacterium avium subsp. paratuberculosis
cagccgggccugcggcgcggcc

SEQ ID NO: 961525 - RNA, 13 nt, Mycobacterium avium subsp. paratuberculosis
cagccgggcgacc

SEQ ID NO: 961526 - RNA, 14 nt, Mycobacterium avium subsp. paratuberculosis
cagccggcggcgcc

SEQ ID NO: 961527 - RNA, 15 nt, Mycobacterium avium subsp. paratuberculosis
cagccggcggcggcg

SEQ ID NO: 961528 - RNA, 18 nt, Mycobacterium avium subsp. paratuberculosis
cagccggcgggcgcucga

SEQ ID NO: 961529 - RNA, 14 nt, Mycobacterium avium subsp. paratuberculosis
cagccggcggugca

SEQ ID NO: 961530 - RNA, 17 nt, Mycobacterium avium subsp. paratuberculosis
cagccggcucagggugc

SEQ ID NO: 961531 - RNA, 19 nt, Mycobacterium avium subsp. paratuberculosis
cagccggcucagggugcgc

SEQ ID NO: 961532 - RNA, 17 nt, Mycobacterium avium subsp. paratuberculosis
cagccggcucuuggcga

SEQ ID NO: 961533 - RNA, 20 nt, Mycobacterium avium subsp. paratuberculosis
cagccggcucuuggcgaccu

SEQ ID NO: 961534 - RNA, 22 nt, Mycobacterium avium subsp. paratuberculosis
cagccggcugagcagccagucg

SEQ ID NO: 961535 - RNA, 14 nt, Mycobacterium avium subsp. paratuberculosis
cagccggcgcggca

SEQ ID NO: 961536 - RNA, 15 nt, Mycobacterium avium subsp. paratuberculosis
cagccggcgcggcag

SEQ ID NO: 961537 - RNA, 16 nt, Mycobacterium avium subsp. paratuberculosis
cagccggcgcggugau

SEQ ID NO: 961538 - RNA, 17 nt, Mycobacterium avium subsp. paratuberculosis
auuuugaaauagccgcg

SEQ ID NO: 961539 - RNA, 21 nt, Mycobacterium avium subsp. paratuberculosis
auuuucgguuucauucaccgc

SEQ ID NO: 961540 - RNA, 15 nt, Mycobacterium avium subsp. paratuberculosis
auuuggcuagcgggc

SEQ ID NO: 961541 - RNA, 13 nt, Mycobacterium avium subsp. paratuberculosis
caaaacgcugggc

SEQ ID NO: 961542 - RNA, 17 nt, Mycobacterium avium subsp. paratuberculosis
caaaacgcugggcgccg

SEQ ID NO: 961543 - RNA, 18 nt, Mycobacterium avium subsp. paratuberculosis
caaaacgcugggcgccgg

SEQ ID NO: 961544 - RNA, 15 nt, Mycobacterium avium subsp. paratuberculosis
caaaagcccgagauc

SEQ ID NO: 961545 - RNA, 19 nt, Mycobacterium avium subsp. paratuberculosis
caaaagcauccggccgucg

SEQ ID NO: 961546 - RNA, 21 nt, Mycobacterium avium subsp. paratuberculosis
caacacagccaaucgccgaug

SEQ ID NO: 961547 - RNA, 18 nt, Mycobacterium avium subsp. paratuberculosis
caacaccagggugcgcag

SEQ ID NO: 961548 - RNA, 19 nt, Mycobacterium avium subsp. paratuberculosis
caacaccagggugcgcagc

SEQ ID NO: 961549 - RNA, 23 nt, Mycobacterium avium subsp. paratuberculosis
caacaccagggugcgcagcgcgu

SEQ ID NO: 961550 - RNA, 20 nt, Mycobacterium avium subsp. paratuberculosis
caacacccccgcgcugccca

SEQ ID NO: 961551 - RNA, 21 nt, Mycobacterium avium subsp. paratuberculosis
caacacccccgcgcugcccag

SEQ ID NO: 961552 - RNA, 19 nt, Mycobacterium avium subsp. paratuberculosis
caacacgucguccggcgcg

SEQ ID NO: 961553 - RNA, 16 nt, Mycobacterium avium subsp. paratuberculosis
caacacgucgucgugc

SEQ ID NO: 961554 - RNA, 22 nt, Mycobacterium avium subsp. paratuberculosis
caacacguugagucccucggcg

SEQ ID NO: 961555 - RNA, 18 nt, Mycobacterium avium subsp. paratuberculosis
caacacguccuggcgcca

SEQ ID NO: 961556 - RNA, 14 nt, Mycobacterium avium subsp. paratuberculosis
caacaccgccagca

SEQ ID NO: 961557 - RNA, 13 nt, Mycobacterium avium subsp. paratuberculosis
caacacggcggcg

SEQ ID NO: 961558 - RNA, 19 nt, Mycobacterium avium subsp. paratuberculosis
caacacggcggcgcgcacg

SEQ ID NO: 961559 - RNA, 18 nt, Mycobacterium avium subsp. paratuberculosis
caacaccgccagcaccgc

SEQ ID NO: 961560 - RNA, 16 nt, Mycobacterium avium subsp. paratuberculosis
caaauccggcagcgcu

SEQ ID NO: 961561 - RNA, 12 nt, Mycobacterium avium subsp. paratuberculosis
caaaccgaccgc

SEQ ID NO: 961562 - RNA, 14 nt, Mycobacterium avium subsp. paratuberculosis
caaaccgaccgccg

SEQ ID NO: 961563 - RNA, 16 nt, Mycobacterium avium subsp. paratuberculosis
caaaccgaccgccgcg

SEQ ID NO: 961564 - RNA, 18 nt, Mycobacterium avium subsp. paratuberculosis
caaaccgaccgccgcggc

SEQ ID NO: 961565 - RNA, 19 nt, Mycobacterium avium subsp. paratuberculosis
caaacccauugucgccgug

SEQ ID NO: 961566 - RNA, 15 nt, Mycobacterium avium subsp. paratuberculosis
caaacgaaucgagcc

SEQ ID NO: 961567 - RNA, 15 nt, Mycobacterium avium subsp. paratuberculosis
caaaccggaccgccg

SEQ ID NO: 961568 - RNA, 19 nt, Mycobacterium avium subsp. paratuberculosis
caaaccggaccgccgcggc

SEQ ID NO: 961569 - RNA, 21 nt, Mycobacterium avium subsp. paratuberculosis
caaacacgagcagacccgccg

SEQ ID NO: 961570 - RNA, 23 nt, Mycobacterium avium subsp. paratuberculosis
caaacacgagcagacccgccgcg

SEQ ID NO: 961571 - RNA, 18 nt, Mycobacterium avium subsp. paratuberculosis
caaacagguuggcgccga

SEQ ID NO: 961572 - RNA, 18 nt, Mycobacterium avium subsp. paratuberculosis
caaaaugcguuccgcgac

SEQ ID NO: 961573 - RNA, 15 nt, Mycobacterium avium subsp. paratuberculosis
auuucccgacuccuc

SEQ ID NO: 961574 - RNA, 20 nt, Mycobacterium avium subsp. paratuberculosis
auuucggcguggcgguggcg

SEQ ID NO: 961575 - RNA, 18 nt, Mycobacterium avium subsp. paratuberculosis
auuucgccugcagccgcc

SEQ ID NO: 961576 - RNA, 15 nt, Mycobacterium avium subsp. paratuberculosis
auucgcggcggcgcc

SEQ ID NO: 961577 - RNA, 22 nt, Mycobacterium avium subsp. paratuberculosis
auucgccgucgugguggccgcg

SEQ ID NO: 961578 - RNA, 17 nt, Mycobacterium avium subsp. paratuberculosis
auugcgauacgacggga

SEQ ID NO: 961579 - RNA, 20 nt, Mycobacterium avium subsp. paratuberculosis
auugccgagcaccccgucga

SEQ ID NO: 961580 - RNA, 17 nt, Mycobacterium avium subsp. paratuberculosis
auugcccaucgccacgc

SEQ ID NO: 961581 - RNA, 17 nt, Mycobacterium avium subsp. paratuberculosis
auugccagaaaucgccg

SEQ ID NO: 961582 - RNA, 17 nt, Mycobacterium avium subsp. paratuberculosis
auugccagcuucgggcg

SEQ ID NO: 961583 - RNA, 20 nt, Mycobacterium avium subsp. paratuberculosis
auuggcgccacugccgccgc

SEQ ID NO: 961584 - RNA, 19 nt, Mycobacterium avium subsp. paratuberculosis
auugcgcuugucagcggcc

SEQ ID NO: 961585 - RNA, 16 nt, Mycobacterium avium subsp. paratuberculosis
auuggcaccggaccgc

SEQ ID NO: 961586 - RNA, 18 nt, Mycobacterium avium subsp. paratuberculosis
auuggccuuuugcaccaa

SEQ ID NO: 961587 - RNA, 17 nt, Mycobacterium avium subsp. paratuberculosis
auugcgcccgccgaaca

SEQ ID NO: 961588 - RNA, 23 nt, Mycobacterium avium subsp. paratuberculosis
auugcggcccuugcggccgauca

SEQ ID NO: 961589 - RNA, 14 nt, Mycobacterium avium subsp. paratuberculosis
auugcgugcccggc

SEQ ID NO: 961590 - RNA, 17 nt, Mycobacterium avium subsp. paratuberculosis
auugcgugcccggccag

SEQ ID NO: 961591 - RNA, 14 nt, Mycobacterium avium subsp. paratuberculosis
auugcgccggucgu

SEQ ID NO: 961592 - RNA, 14 nt, Mycobacterium avium subsp. paratuberculosis
auugcggaucuugg

SEQ ID NO: 961593 - RNA, 14 nt, Mycobacterium avium subsp. paratuberculosis
augucgcccggcgc

SEQ ID NO: 961594 - RNA, 17 nt, Mycobacterium avium subsp. paratuberculosis
augucgcccggcgcggc

SEQ ID NO: 961595 - RNA, 15 nt, Mycobacterium avium subsp. paratuberculosis
augucgcccggcggc

SEQ ID NO: 961596 - RNA, 15 nt, Mycobacterium avium subsp. paratuberculosis
augucgcgcagcauc

SEQ ID NO: 961597 - RNA, 23 nt, Mycobacterium avium subsp. paratuberculosis
augucgcugccgccgccggcggu

SEQ ID NO: 961598 - RNA, 17 nt, Mycobacterium avium subsp. paratuberculosis
augucgccggcgaccgc

SEQ ID NO: 961599 - RNA, 14 nt, Mycobacterium avium subsp. paratuberculosis
augucgccggcggc

SEQ ID NO: 961600 - RNA, 16 nt, Mycobacterium avium subsp. paratuberculosis
augucgacccgcggcg

SEQ ID NO: 961601 - RNA, 21 nt, Mycobacterium avium subsp. paratuberculosis
augucgacgccgugcugccgg

SEQ ID NO: 961602 - RNA, 20 nt, Mycobacterium avium subsp. paratuberculosis
augucgaugacggcggcgcc

SEQ ID NO: 961603 - RNA, 16 nt, Mycobacterium avium subsp. paratuberculosis
augucgaugccgagcc

SEQ ID NO: 961604 - RNA, 16 nt, Mycobacterium avium subsp. paratuberculosis
auucacgaggccgggc

SEQ ID NO: 961605 - RNA, 22 nt, Mycobacterium avium subsp. paratuberculosis
auuacgguacuguuacgcccga

SEQ ID NO: 961606 - RNA, 14 nt, Mycobacterium avium subsp. paratuberculosis
auuacgaccaguuc

SEQ ID NO: 961607 - RNA, 16 nt, Mycobacterium avium subsp. paratuberculosis
auuccgacgugccgug

SEQ ID NO: 961608 - RNA, 15 nt, Mycobacterium avium subsp. paratuberculosis
auuccggugugccga

SEQ ID NO: 961609 - RNA, 16 nt, Mycobacterium avium subsp. paratuberculosis
auuccgccgcgcccgu

SEQ ID NO: 961610 - RNA, 15 nt, Mycobacterium avium subsp. paratuberculosis
auuccggccggccgc

SEQ ID NO: 961611 - RNA, 16 nt, Mycobacterium avium subsp. paratuberculosis
auuccggcgcgaucgg

SEQ ID NO: 961612 - RNA, 15 nt, Mycobacterium avium subsp. paratuberculosis
auucgcccagcggca

SEQ ID NO: 961613 - RNA, 22 nt, Mycobacterium avium subsp. paratuberculosis
auucgaucaaaucccgcagcuc

SEQ ID NO: 961614 - RNA, 17 nt, Mycobacterium avium subsp. paratuberculosis
auucgaggucaucgagc

SEQ ID NO: 961615 - RNA, 16 nt, Mycobacterium avium subsp. paratuberculosis
auuccaccguggucgg

SEQ ID NO: 961616 - RNA, 13 nt, Mycobacterium avium subsp. paratuberculosis
auuccagcgcgac

SEQ ID NO: 961617 - RNA, 21 nt, Mycobacterium avium subsp. paratuberculosis
auuccagcaacugcucgacca

SEQ ID NO: 961618 - RNA, 18 nt, Mycobacterium avium subsp. paratuberculosis
auucagccggcgguucgg

SEQ ID NO: 961619 - RNA, 17 nt, Mycobacterium avium subsp. paratuberculosis
auucccgaccccgccag

SEQ ID NO: 961620 - RNA, 23 nt, Mycobacterium avium subsp. paratuberculosis
aaacuaguuucacguucggcggg

SEQ ID NO: 961621 - RNA, 21 nt, Mycobacterium avium subsp. paratuberculosis
auuccccggcgugucgcgugc

SEQ ID NO: 961622 - RNA, 21 nt, Mycobacterium avium subsp. paratuberculosis
auuccagcgacaacagcacga

SEQ ID NO: 961623 - RNA, 23 nt, Mycobacterium avium subsp. paratuberculosis
auuccagcgcguagucggcgucg

SEQ ID NO: 961624 - RNA, 14 nt, Mycobacterium avium subsp. paratuberculosis
auuccaugucgucg

SEQ ID NO: 961625 - RNA, 17 nt, Mycobacterium avium subsp. paratuberculosis
aucuugcccagccacgc

SEQ ID NO: 961626 - RNA, 15 nt, Mycobacterium avium subsp. paratuberculosis
aucuugccgucggcc

SEQ ID NO: 961627 - RNA, 21 nt, Mycobacterium avium subsp. paratuberculosis
aucuugccgucggccgccgac

SEQ ID NO: 961628 - RNA, 23 nt, Mycobacterium avium subsp. paratuberculosis
aucuugcuggucuucggugucgc

SEQ ID NO: 961629 - RNA, 13 nt, Mycobacterium avium subsp. paratuberculosis
aucuuggccucca

SEQ ID NO: 961630 - RNA, 19 nt, Mycobacterium avium subsp. paratuberculosis
aucuuggccuccaccggca

SEQ ID NO: 961631 - RNA, 13 nt, Mycobacterium avium subsp. paratuberculosis
aucugggccgcca

SEQ ID NO: 961632 - RNA, 15 nt, Mycobacterium avium subsp. paratuberculosis
aucugggccgccaac

SEQ ID NO: 961633 - RNA, 15 nt, Mycobacterium avium subsp. paratuberculosis
aucugggcggcggga

SEQ ID NO: 961634 - RNA, 15 nt, Mycobacterium avium subsp. paratuberculosis
aucugggugccgcgg

SEQ ID NO: 961635 - RNA, 19 nt, Mycobacterium avium subsp. paratuberculosis
aucuggcggauggcgcccu

SEQ ID NO: 961636 - RNA, 14 nt, Mycobacterium avium subsp. paratuberculosis
aucuggccgcgggu

SEQ ID NO: 961637 - RNA, 19 nt, Mycobacterium avium subsp. paratuberculosis
augaaauccgggaccggcg

SEQ ID NO: 961638 - RNA, 17 nt, Mycobacterium avium subsp. paratuberculosis
augaacacggucgccgg

SEQ ID NO: 961639 - RNA, 13 nt, Mycobacterium avium subsp. paratuberculosis
augacgcacgucg

SEQ ID NO: 961640 - RNA, 16 nt, Mycobacterium avium subsp. paratuberculosis
augaccaggucgccgg

SEQ ID NO: 961641 - RNA, 22 nt, Mycobacterium avium subsp. paratuberculosis
augaagucggugagcaccguug

SEQ ID NO: 961642 - RNA, 14 nt, Mycobacterium avium subsp. paratuberculosis
augacaaccaucga

SEQ ID NO: 961643 - RNA, 16 nt, Mycobacterium avium subsp. paratuberculosis
augaacugccgcggca

SEQ ID NO: 961644 - RNA, 12 nt, Mycobacterium avium subsp. paratuberculosis
augaacgaccug

SEQ ID NO: 961645 - RNA, 19 nt, Mycobacterium avium subsp. paratuberculosis
augaagaugaucucgccga

SEQ ID NO: 961646 - RNA, 21 nt, Mycobacterium avium subsp. paratuberculosis
augaagccgccgacgguggcc

SEQ ID NO: 961647 - RNA, 16 nt, Mycobacterium avium subsp. paratuberculosis
augauguucaccccgu

SEQ ID NO: 961648 - RNA, 16 nt, Mycobacterium avium subsp. paratuberculosis
augagcugggcggcgc

SEQ ID NO: 961649 - RNA, 16 nt, Mycobacterium avium subsp. paratuberculosis
augagccucagcgcgc

SEQ ID NO: 961650 - RNA, 13 nt, Mycobacterium avium subsp. paratuberculosis
augacggcggcgc

SEQ ID NO: 961651 - RNA, 14 nt, Mycobacterium avium subsp. paratuberculosis
augacggcggcgcc

SEQ ID NO: 961652 - RNA, 14 nt, Mycobacterium avium subsp. paratuberculosis
augacggcggcggu

SEQ ID NO: 961653 - RNA, 22 nt, Mycobacterium avium subsp. paratuberculosis
augacggcggcggugccgcagg

SEQ ID NO: 961654 - RNA, 20 nt, Mycobacterium avium subsp. paratuberculosis
augcaccggugcaccgcgcg

SEQ ID NO: 961655 - RNA, 17 nt, Mycobacterium avium subsp. paratuberculosis
augcacaaccgcugcug

SEQ ID NO: 961656 - RNA, 16 nt, Mycobacterium avium subsp. paratuberculosis
augcagaacagccggu

SEQ ID NO: 961657 - RNA, 16 nt, Mycobacterium avium subsp. paratuberculosis
augcacggcgcuggcg

SEQ ID NO: 961658 - RNA, 13 nt, Mycobacterium avium subsp. paratuberculosis
augcagcggcucc

SEQ ID NO: 961659 - RNA, 16 nt, Mycobacterium avium subsp. paratuberculosis
aucgggcuggguccga

SEQ ID NO: 961660 - RNA, 17 nt, Mycobacterium avium subsp. paratuberculosis
aucggugaagccgacgc

SEQ ID NO: 961661 - RNA, 14 nt, Mycobacterium avium subsp. paratuberculosis
aucgggcgcucggc

SEQ ID NO: 961662 - RNA, 18 nt, Mycobacterium avium subsp. paratuberculosis
aucgggcgguccaccgac

SEQ ID NO: 961663 - RNA, 20 nt, Mycobacterium avium subsp. paratuberculosis
aucgggcgguccaccgacgc

SEQ ID NO: 961664 - RNA, 15 nt, Mycobacterium avium subsp. paratuberculosis
aucgggcccgacgac

SEQ ID NO: 961665 - RNA, 20 nt, Mycobacterium avium subsp. paratuberculosis
aucgggcgcagguccacccg

SEQ ID NO: 961666 - RNA, 13 nt, Mycobacterium avium subsp. paratuberculosis
aucgggcccagca

SEQ ID NO: 961667 - RNA, 15 nt, Mycobacterium avium subsp. paratuberculosis
aucgaauccggcggc

SEQ ID NO: 961668 - RNA, 17 nt, Mycobacterium avium subsp. paratuberculosis
aucgacaacgcgugaug

SEQ ID NO: 961669 - RNA, 13 nt, Mycobacterium avium subsp. paratuberculosis
aucgacaccgcac

SEQ ID NO: 961670 - RNA, 13 nt, Mycobacterium avium subsp. paratuberculosis
aucgaaccgccgc

SEQ ID NO: 961671 - RNA, 19 nt, Mycobacterium avium subsp. paratuberculosis
aucgaacagggcggcgggc

SEQ ID NO: 961672 - RNA, 20 nt, Mycobacterium avium subsp. paratuberculosis
aucgaacagggcggcgggcc

SEQ ID NO: 961673 - RNA, 17 nt, Mycobacterium avium subsp. paratuberculosis
aucgaaggccaggugca

SEQ ID NO: 961674 - RNA, 16 nt, Mycobacterium avium subsp. paratuberculosis
aucgaacggcaccucg

SEQ ID NO: 961675 - RNA, 13 nt, Mycobacterium avium subsp. paratuberculosis
aucgaacggcgga

SEQ ID NO: 961676 - RNA, 20 nt, Mycobacterium avium subsp. paratuberculosis
aucgaacggcggaaccgggc

SEQ ID NO: 961677 - RNA, 14 nt, Mycobacterium avium subsp. paratuberculosis
aucgguucggccag

SEQ ID NO: 961678 - RNA, 19 nt, Mycobacterium avium subsp. paratuberculosis
aucgguggacgcggucgcc

SEQ ID NO: 961679 - RNA, 15 nt, Mycobacterium avium subsp. paratuberculosis
aucgguggcaccccg

SEQ ID NO: 961680 - RNA, 17 nt, Mycobacterium avium subsp. paratuberculosis
aucgguguccagccgca

SEQ ID NO: 961681 - RNA, 18 nt, Mycobacterium avium subsp. paratuberculosis
aucgguguccagccgcac

SEQ ID NO: 961682 - RNA, 17 nt, Mycobacterium avium subsp. paratuberculosis
aucgucgccgccaacgc

SEQ ID NO: 961683 - RNA, 19 nt, Mycobacterium avium subsp. paratuberculosis
aucgucgcggcggucacgc

SEQ ID NO: 961684 - RNA, 14 nt, Mycobacterium avium subsp. paratuberculosis
aucgucggccacgc

SEQ ID NO: 961685 - RNA, 16 nt, Mycobacterium avium subsp. paratuberculosis
aucgucggcgauggag

SEQ ID NO: 961686 - RNA, 24 nt, Mycobacterium avium subsp. paratuberculosis
aucgucgcgcccaggaacgcgccg

SEQ ID NO: 961687 - RNA, 18 nt, Mycobacterium avium subsp. paratuberculosis
aucgucggcacugcccgc

SEQ ID NO: 961688 - RNA, 21 nt, Mycobacterium avium subsp. paratuberculosis
aucgucggcacugcccgcauc

SEQ ID NO: 961689 - RNA, 15 nt, Mycobacterium avium subsp. paratuberculosis
aucuccaccgagugc

SEQ ID NO: 961690 - RNA, 13 nt, Mycobacterium avium subsp. paratuberculosis
aucuccagcggcc

SEQ ID NO: 961691 - RNA, 17 nt, Mycobacterium avium subsp. paratuberculosis
aucuccagcggccgggc

SEQ ID NO: 961692 - RNA, 19 nt, Mycobacterium avium subsp. paratuberculosis
aucuccagcggccgggcga

SEQ ID NO: 961693 - RNA, 13 nt, Mycobacterium avium subsp. paratuberculosis
aucuccagcuccg

SEQ ID NO: 961694 - RNA, 17 nt, Mycobacterium avium subsp. paratuberculosis
aucuccagcuccgcggc

SEQ ID NO: 961695 - RNA, 18 nt, Mycobacterium avium subsp. paratuberculosis
aucgugugggcgcccgcg

SEQ ID NO: 961696 - RNA, 23 nt, Mycobacterium avium subsp. paratuberculosis
aucgugugggcgcccgcggcgcg

SEQ ID NO: 961697 - RNA, 16 nt, Mycobacterium avium subsp. paratuberculosis
aucguguuaccgaucu

SEQ ID NO: 961698 - RNA, 17 nt, Mycobacterium avium subsp. paratuberculosis
aucguguccgcgccggc

SEQ ID NO: 961699 - RNA, 17 nt, Mycobacterium avium subsp. paratuberculosis
aucgugggcgccgucgc

SEQ ID NO: 961700 - RNA, 20 nt, Mycobacterium avium subsp. paratuberculosis
aucgugggcgccgucgccgc

SEQ ID NO: 961701 - RNA, 16 nt, Mycobacterium avium subsp. paratuberculosis
aucguggcgacgacgc

SEQ ID NO: 961702 - RNA, 19 nt, Mycobacterium avium subsp. paratuberculosis
aucguggcgacgacgccga

SEQ ID NO: 961703 - RNA, 22 nt, Mycobacterium avium subsp. paratuberculosis
aucucggugagcagaaccaccu

SEQ ID NO: 961704 - RNA, 16 nt, Mycobacterium avium subsp. paratuberculosis
aucucggugccgucga

SEQ ID NO: 961705 - RNA, 24 nt, Mycobacterium avium subsp. paratuberculosis
aucucggugguggccaucgcggcc

SEQ ID NO: 961706 - RNA, 16 nt, Mycobacterium avium subsp. paratuberculosis
aucucguagccgugca

SEQ ID NO: 961707 - RNA, 17 nt, Mycobacterium avium subsp. paratuberculosis
aucucguagguggccag

SEQ ID NO: 961708 - RNA, 11 nt, Mycobacterium avium subsp. paratuberculosis
aucucggcggc

SEQ ID NO: 961709 - RNA, 13 nt, Mycobacterium avium subsp. paratuberculosis
aucucggcggcga

SEQ ID NO: 961710 - RNA, 21 nt, Mycobacterium avium subsp. paratuberculosis
aucucggcggucugucgcgcg

SEQ ID NO: 961711 - RNA, 18 nt, Mycobacterium avium subsp. paratuberculosis
aucucggcguacagcccg

SEQ ID NO: 961712 - RNA, 15 nt, Mycobacterium avium subsp. paratuberculosis
aucucggcgcaggug

SEQ ID NO: 961713 - RNA, 19 nt, Mycobacterium avium subsp. paratuberculosis
aucucgggagugcggccca

SEQ ID NO: 961714 - RNA, 18 nt, Mycobacterium avium subsp. paratuberculosis
aucucgcgggcccgcgcg

SEQ ID NO: 961715 - RNA, 14 nt, Mycobacterium avium subsp. paratuberculosis
aucuccgcggcgau

SEQ ID NO: 961716 - RNA, 15 nt, Mycobacterium avium subsp. paratuberculosis
aucuccgcggcgaug

SEQ ID NO: 961717 - RNA, 20 nt, Mycobacterium avium subsp. paratuberculosis
aucuccgcggcgaugaccgg

SEQ ID NO: 961718 - RNA, 11 nt, Mycobacterium avium subsp. paratuberculosis
aucuccagcag

SEQ ID NO: 961719 - RNA, 20 nt, Mycobacterium avium subsp. paratuberculosis
aucugcacagcuucggcgcc

SEQ ID NO: 961720 - RNA, 18 nt, Mycobacterium avium subsp. paratuberculosis
aucugcacacgggcccgu

SEQ ID NO: 961721 - RNA, 15 nt, Mycobacterium avium subsp. paratuberculosis
aucugccggcagauc

SEQ ID NO: 961722 - RNA, 14 nt, Mycobacterium avium subsp. paratuberculosis
aucugccgggcggc

SEQ ID NO: 961723 - RNA, 22 nt, Mycobacterium avium subsp. paratuberculosis
aucugccggucgaugucggcga

SEQ ID NO: 961724 - RNA, 15 nt, Mycobacterium avium subsp. paratuberculosis
aucugccggugccgc

SEQ ID NO: 961725 - RNA, 15 nt, Mycobacterium avium subsp. paratuberculosis
aucucguugcggcgc

SEQ ID NO: 961726 - RNA, 19 nt, Mycobacterium avium subsp. paratuberculosis
aucucgugguaccggcgcc

SEQ ID NO: 961727 - RNA, 13 nt, Mycobacterium avium subsp. paratuberculosis
aucucgucgcgca

SEQ ID NO: 961728 - RNA, 14 nt, Mycobacterium avium subsp. paratuberculosis
aucucgucggcggc

SEQ ID NO: 961729 - RNA, 18 nt, Mycobacterium avium subsp. paratuberculosis
aucucgucgggcaccgcc

SEQ ID NO: 961730 - RNA, 14 nt, Mycobacterium avium subsp. paratuberculosis
aucucgugccgcac

SEQ ID NO: 961731 - RNA, 22 nt, Mycobacterium avium subsp. paratuberculosis
aucucugauuugaaauucaccu

SEQ ID NO: 961732 - RNA, 14 nt, Mycobacterium avium subsp. paratuberculosis
augucacggcgggu

SEQ ID NO: 961733 - RNA, 16 nt, Mycobacterium avium subsp. paratuberculosis
auguccaggccgucga

SEQ ID NO: 961734 - RNA, 14 nt, Mycobacterium avium subsp. paratuberculosis
auggucaccguguc

SEQ ID NO: 961735 - RNA, 14 nt, Mycobacterium avium subsp. paratuberculosis
augguccagcaccg

SEQ ID NO: 961736 - RNA, 18 nt, Mycobacterium avium subsp. paratuberculosis
augguccccgggcccagc

SEQ ID NO: 961737 - RNA, 17 nt, Mycobacterium avium subsp. paratuberculosis
auggggauggugcgccg

SEQ ID NO: 961738 - RNA, 19 nt, Mycobacterium avium subsp. paratuberculosis
auggggauggugcgccggg

SEQ ID NO: 961739 - RNA, 19 nt, Mycobacterium avium subsp. paratuberculosis
augggcgugccggcccggc

SEQ ID NO: 961740 - RNA, 21 nt, Mycobacterium avium subsp. paratuberculosis
augggcgcacgaucgggcgca

SEQ ID NO: 961741 - RNA, 19 nt, Mycobacterium avium subsp. paratuberculosis
augguauccgaucgcggcc

SEQ ID NO: 961742 - RNA, 21 nt, Mycobacterium avium subsp. paratuberculosis
auggguggcgaucaccgcggc

SEQ ID NO: 961743 - RNA, 22 nt, Mycobacterium avium subsp. paratuberculosis
auggguucuucgaccacgcgcc

SEQ ID NO: 961744 - RNA, 13 nt, Mycobacterium avium subsp. paratuberculosis
augggugggcagc

SEQ ID NO: 961745 - RNA, 20 nt, Mycobacterium avium subsp. paratuberculosis
auggguguaacgcgucgacg

SEQ ID NO: 961746 - RNA, 19 nt, Mycobacterium avium subsp. paratuberculosis
auggggugaugcgucccgu

SEQ ID NO: 961747 - RNA, 12 nt, Mycobacterium avium subsp. paratuberculosis
auggcgcggccc

SEQ ID NO: 961748 - RNA, 13 nt, Mycobacterium avium subsp. paratuberculosis
auggcggcggccc

SEQ ID NO: 961749 - RNA, 15 nt, Mycobacterium avium subsp. paratuberculosis
auggcggcggcccgc

SEQ ID NO: 961750 - RNA, 17 nt, Mycobacterium avium subsp. paratuberculosis
auggcggcggcccgccg

SEQ ID NO: 961751 - RNA, 18 nt, Mycobacterium avium subsp. paratuberculosis
auggcggcggcccgccgc

SEQ ID NO: 961752 - RNA, 22 nt, Mycobacterium avium subsp. paratuberculosis
auggcggcggcccgccgcgccc

SEQ ID NO: 961753 - RNA, 22 nt, Mycobacterium avium subsp. paratuberculosis
auggcgcggcgcaccgcccgcg

SEQ ID NO: 961754 - RNA, 15 nt, Mycobacterium avium subsp. paratuberculosis
auggcgggccgcuuc

SEQ ID NO: 961755 - RNA, 14 nt, Mycobacterium avium subsp. paratuberculosis
auggcgggcgcgcc

SEQ ID NO: 961756 - RNA, 17 nt, Mycobacterium avium subsp. paratuberculosis
auggcgggcgcgccggc

SEQ ID NO: 961757 - RNA, 20 nt, Mycobacterium avium subsp. paratuberculosis
auggcgggcgcgccggcgcg

SEQ ID NO: 961758 - RNA, 17 nt, Mycobacterium avium subsp. paratuberculosis
auggcgguccaccacca

SEQ ID NO: 961759 - RNA, 21 nt, Mycobacterium avium subsp. paratuberculosis
auggcgguccaccaccacacc

SEQ ID NO: 961760 - RNA, 17 nt, Mycobacterium avium subsp. paratuberculosis
auggcguagcgggucag

SEQ ID NO: 961761 - RNA, 23 nt, Mycobacterium avium subsp. paratuberculosis
auggcguagcgggucagcuccac

SEQ ID NO: 961762 - RNA, 19 nt, Mycobacterium avium subsp. paratuberculosis
augcugauacccgcgcggc

SEQ ID NO: 961763 - RNA, 22 nt, Mycobacterium avium subsp. paratuberculosis
augcugauccgcaggaugccga

SEQ ID NO: 961764 - RNA, 20 nt, Mycobacterium avium subsp. paratuberculosis
augcugcaacggcuggcgca

SEQ ID NO: 961765 - RNA, 20 nt, Mycobacterium avium subsp. paratuberculosis
augcugcgcaacaccucggc

SEQ ID NO: 961766 - RNA, 14 nt, Mycobacterium avium subsp. paratuberculosis
augcugccgccggc

SEQ ID NO: 961767 - RNA, 19 nt, Mycobacterium avium subsp. paratuberculosis
augcugcacccaccggcgc

SEQ ID NO: 961768 - RNA, 20 nt, Mycobacterium avium subsp. paratuberculosis
augcugcacccaccggcgca

SEQ ID NO: 961769 - RNA, 14 nt, Mycobacterium avium subsp. paratuberculosis
augcugcccggcgc

SEQ ID NO: 961770 - RNA, 21 nt, Mycobacterium avium subsp. paratuberculosis
augcugagcgggucggccggc

SEQ ID NO: 961771 - RNA, 23 nt, Mycobacterium avium subsp. paratuberculosis
auggaggugccgcgcagcaccgu

SEQ ID NO: 961772 - RNA, 18 nt, Mycobacterium avium subsp. paratuberculosis
auggacguccagcggccc

SEQ ID NO: 961773 - RNA, 23 nt, Mycobacterium avium subsp. paratuberculosis
auggacgcccaacuacccgccga

SEQ ID NO: 961774 - RNA, 17 nt, Mycobacterium avium subsp. paratuberculosis
auggacgcgguggugcu

SEQ ID NO: 961775 - RNA, 21 nt, Mycobacterium avium subsp. paratuberculosis
auggaucagacccagcgucag

SEQ ID NO: 961776 - RNA, 20 nt, Mycobacterium avium subsp. paratuberculosis
auggccgacaacauccgcga

SEQ ID NO: 961777 - RNA, 19 nt, Mycobacterium avium subsp. paratuberculosis
auggcccggaccgccgcgg

SEQ ID NO: 961778 - RNA, 23 nt, Mycobacterium avium subsp. paratuberculosis
auggcccggaccgccgcggcggc

SEQ ID NO: 961779 - RNA, 18 nt, Mycobacterium avium subsp. paratuberculosis
auggcacacagcgugacc

SEQ ID NO: 961780 - RNA, 11 nt, Mycobacterium avium subsp. paratuberculosis
auggccggccg

SEQ ID NO: 961781 - RNA, 21 nt, Mycobacterium avium subsp. paratuberculosis
auggccggcgaaccgccgcac

SEQ ID NO: 961782 - RNA, 17 nt, Mycobacterium avium subsp. paratuberculosis
auggccggcuaccgcgc

SEQ ID NO: 961783 - RNA, 15 nt, Mycobacterium avium subsp. paratuberculosis
auggccgcuucgggg

SEQ ID NO: 961784 - RNA, 14 nt, Mycobacterium avium subsp. paratuberculosis
auggcgaugaccag

SEQ ID NO: 961785 - RNA, 18 nt, Mycobacterium avium subsp. paratuberculosis
auggcgaugaccagcgcg

SEQ ID NO: 961786 - RNA, 16 nt, Mycobacterium avium subsp. paratuberculosis
auggcgaugacgucgu

SEQ ID NO: 961787 - RNA, 18 nt, Mycobacterium avium subsp. paratuberculosis
auggcgcccagcccgagc

SEQ ID NO: 961788 - RNA, 23 nt, Mycobacterium avium subsp. paratuberculosis
auggcgcccagcccgagcaccag

SEQ ID NO: 961789 - RNA, 22 nt, Mycobacterium avium subsp. paratuberculosis
auggcgcccagcgucucggcgg

SEQ ID NO: 961790 - RNA, 19 nt, Mycobacterium avium subsp. paratuberculosis
auggcgcccggcagccgcu

SEQ ID NO: 961791 - RNA, 21 nt, Mycobacterium avium subsp. paratuberculosis
augcccacgccgucgacccgu

SEQ ID NO: 961792 - RNA, 20 nt, Mycobacterium avium subsp. paratuberculosis
augcccaagccggccaggcc

SEQ ID NO: 961793 - RNA, 16 nt, Mycobacterium avium subsp. paratuberculosis
augccaguuuuuggcg

SEQ ID NO: 961794 - RNA, 16 nt, Mycobacterium avium subsp. paratuberculosis
augcccaugucgaucg

SEQ ID NO: 961795 - RNA, 14 nt, Mycobacterium avium subsp. paratuberculosis
augcccaucacgcc

SEQ ID NO: 961796 - RNA, 12 nt, Mycobacterium avium subsp. paratuberculosis
augcccagcgcg

SEQ ID NO: 961797 - RNA, 17 nt, Mycobacterium avium subsp. paratuberculosis
augcccaggccggcgag

SEQ ID NO: 961798 - RNA, 13 nt, Mycobacterium avium subsp. paratuberculosis
augcccagcagga

SEQ ID NO: 961799 - RNA, 21 nt, Mycobacterium avium subsp. paratuberculosis
augccagacgaacgcggccgc

SEQ ID NO: 961800 - RNA, 22 nt, Mycobacterium avium subsp. paratuberculosis
augccagacgaacgcggccgcc

SEQ ID NO: 961801 - RNA, 23 nt, Mycobacterium avium subsp. paratuberculosis
augccagacgcgcaccgccaccg

SEQ ID NO: 961802 - RNA, 18 nt, Mycobacterium avium subsp. paratuberculosis
augccagcgcaccgggcc

SEQ ID NO: 961803 - RNA, 22 nt, Mycobacterium avium subsp. paratuberculosis
augccaagccauuucagcagcg

SEQ ID NO: 961804 - RNA, 23 nt, Mycobacterium avium subsp. paratuberculosis
augccaagccauuucagcagcgc

SEQ ID NO: 961805 - RNA, 20 nt, Mycobacterium avium subsp. paratuberculosis
augcccggcgacggcgccug

SEQ ID NO: 961806 - RNA, 22 nt, Mycobacterium avium subsp. paratuberculosis
augcccggcgacggcgccugau

SEQ ID NO: 961807 - RNA, 13 nt, Mycobacterium avium subsp. paratuberculosis
augcccgggccgu

SEQ ID NO: 961808 - RNA, 17 nt, Mycobacterium avium subsp. paratuberculosis
augcccgggccgucauc

SEQ ID NO: 961809 - RNA, 17 nt, Mycobacterium avium subsp. paratuberculosis
augcccggggugcuggc

SEQ ID NO: 961810 - RNA, 16 nt, Mycobacterium avium subsp. paratuberculosis
augcccgcgccgacca

SEQ ID NO: 961811 - RNA, 16 nt, Mycobacterium avium subsp. paratuberculosis
augcccgccggcgucu

SEQ ID NO: 961812 - RNA, 20 nt, Mycobacterium avium subsp. paratuberculosis
augcccgcgaacgccucguu

SEQ ID NO: 961813 - RNA, 22 nt, Mycobacterium avium subsp. paratuberculosis
augcccgcgaacgccucguugg

SEQ ID NO: 961814 - RNA, 19 nt, Mycobacterium avium subsp. paratuberculosis
augcccgccacggccagca

SEQ ID NO: 961815 - RNA, 22 nt, Mycobacterium avium subsp. paratuberculosis
augccgaacaacagggccgcgc

SEQ ID NO: 961816 - RNA, 19 nt, Mycobacterium avium subsp. paratuberculosis
augccgaaccgcugcggau

SEQ ID NO: 961817 - RNA, 18 nt, Mycobacterium avium subsp. paratuberculosis
augccgaacuccgccgaa

SEQ ID NO: 961818 - RNA, 16 nt, Mycobacterium avium subsp. paratuberculosis
augcccuuggccagca

SEQ ID NO: 961819 - RNA, 22 nt, Mycobacterium avium subsp. paratuberculosis
augcccugcacgaucucggcgg

SEQ ID NO: 961820 - RNA, 17 nt, Mycobacterium avium subsp. paratuberculosis
augcccucgccggucag

SEQ ID NO: 961821 - RNA, 21 nt, Mycobacterium avium subsp. paratuberculosis
augcccucguagcggccgcac

SEQ ID NO: 961822 - RNA, 16 nt, Mycobacterium avium subsp. paratuberculosis
augccgaagccguuga

SEQ ID NO: 961823 - RNA, 20 nt, Mycobacterium avium subsp. paratuberculosis
augccgaccgacagccgcac

SEQ ID NO: 961824 - RNA, 21 nt, Mycobacterium avium subsp. paratuberculosis
augccgaccgacagccgcacc

SEQ ID NO: 961825 - RNA, 12 nt, Mycobacterium avium subsp. paratuberculosis
augccgcccauc

SEQ ID NO: 961826 - RNA, 13 nt, Mycobacterium avium subsp. paratuberculosis
augccgcccagca

SEQ ID NO: 961827 - RNA, 17 nt, Mycobacterium avium subsp. paratuberculosis
augccgcccagcagcgg

SEQ ID NO: 961828 - RNA, 14 nt, Mycobacterium avium subsp. paratuberculosis
augccgacgucggu

SEQ ID NO: 961829 - RNA, 13 nt, Mycobacterium avium subsp. paratuberculosis
augccgagcaccu

SEQ ID NO: 961830 - RNA, 20 nt, Mycobacterium avium subsp. paratuberculosis
augccgagcagcaccgcgac

SEQ ID NO: 961831 - RNA, 17 nt, Mycobacterium avium subsp. paratuberculosis
augccgagcagcucggc

SEQ ID NO: 961832 - RNA, 18 nt, Mycobacterium avium subsp. paratuberculosis
augccgagcagcucggcg

SEQ ID NO: 961833 - RNA, 20 nt, Mycobacterium avium subsp. paratuberculosis
augccgagcagcucggcggc

SEQ ID NO: 961834 - RNA, 16 nt, Mycobacterium avium subsp. paratuberculosis
augccgcccgggccgu

SEQ ID NO: 961835 - RNA, 19 nt, Mycobacterium avium subsp. paratuberculosis
augccgcccgggccguauc

SEQ ID NO: 961836 - RNA, 14 nt, Mycobacterium avium subsp. paratuberculosis
augccgccgaccgc

SEQ ID NO: 961837 - RNA, 16 nt, Mycobacterium avium subsp. paratuberculosis
augccgccgaccgccg

SEQ ID NO: 961838 - RNA, 20 nt, Mycobacterium avium subsp. paratuberculosis
augccgccgaccgccgagcg

SEQ ID NO: 961839 - RNA, 19 nt, Mycobacterium avium subsp. paratuberculosis
augccgccgagggccagca

SEQ ID NO: 961840 - RNA, 21 nt, Mycobacterium avium subsp. paratuberculosis
augccgccgagggccagcagc

SEQ ID NO: 961841 - RNA, 23 nt, Mycobacterium avium subsp. paratuberculosis
augccgccgagggccagcagcca

SEQ ID NO: 961842 - RNA, 16 nt, Mycobacterium avium subsp. paratuberculosis
augccgccgcgacgau

SEQ ID NO: 961843 - RNA, 21 nt, Mycobacterium avium subsp. paratuberculosis
augccgccgcgacgaugccgg

SEQ ID NO: 961844 - RNA, 22 nt, Mycobacterium avium subsp. paratuberculosis
augccgccgcgacgaugccggc

SEQ ID NO: 961845 - RNA, 19 nt, Mycobacterium avium subsp. paratuberculosis
augccgccgaagcggcgca

SEQ ID NO: 961846 - RNA, 17 nt, Mycobacterium avium subsp. paratuberculosis
augccggcauccucggc

SEQ ID NO: 961847 - RNA, 19 nt, Mycobacterium avium subsp. paratuberculosis
augccggcauccucggcgc

SEQ ID NO: 961848 - RNA, 20 nt, Mycobacterium avium subsp. paratuberculosis
augccggcauccucggcgcg

SEQ ID NO: 961849 - RNA, 13 nt, Mycobacterium avium subsp. paratuberculosis
augccggccgcgu

SEQ ID NO: 961850 - RNA, 15 nt, Mycobacterium avium subsp. paratuberculosis
augccggccgcguac

SEQ ID NO: 961851 - RNA, 19 nt, Mycobacterium avium subsp. paratuberculosis
augccggcgcccagcggcg

SEQ ID NO: 961852 - RNA, 20 nt, Mycobacterium avium subsp. paratuberculosis
augccggcgcccagcggcga

SEQ ID NO: 961853 - RNA, 21 nt, Mycobacterium avium subsp. paratuberculosis
augccggcgcccagcggcgau

SEQ ID NO: 961854 - RNA, 13 nt, Mycobacterium avium subsp. paratuberculosis
augccggcgccga

SEQ ID NO: 961855 - RNA, 14 nt, Mycobacterium avium subsp. paratuberculosis
augccggcgccgau

SEQ ID NO: 961856 - RNA, 20 nt, Mycobacterium avium subsp. paratuberculosis
augccggccuggcccagccg

SEQ ID NO: 961857 - RNA, 23 nt, Mycobacterium avium subsp. paratuberculosis
augccggccuggcccagccgcgu

SEQ ID NO: 961858 - RNA, 17 nt, Mycobacterium avium subsp. paratuberculosis
augccggccagccgcgc

SEQ ID NO: 961859 - RNA, 19 nt, Mycobacterium avium subsp. paratuberculosis
augccggccagccgcgcga

SEQ ID NO: 961860 - RNA, 19 nt, Mycobacterium avium subsp. paratuberculosis
augccgcccaucagcagga

SEQ ID NO: 961861 - RNA, 13 nt, Mycobacterium avium subsp. paratuberculosis
augccggcaaccg

SEQ ID NO: 961862 - RNA, 16 nt, Mycobacterium avium subsp. paratuberculosis
augccuuggcccgcgc

SEQ ID NO: 961863 - RNA, 15 nt, Mycobacterium avium subsp. paratuberculosis
augccuuggcggcgu

SEQ ID NO: 961864 - RNA, 21 nt, Mycobacterium avium subsp. paratuberculosis
augccggcgauccgcgcggcg

SEQ ID NO: 961865 - RNA, 16 nt, Mycobacterium avium subsp. paratuberculosis
augccgggcaaccaca

SEQ ID NO: 961866 - RNA, 12 nt, Mycobacterium avium subsp. paratuberculosis
augccggcggua

SEQ ID NO: 961867 - RNA, 20 nt, Mycobacterium avium subsp. paratuberculosis
augccggcgguaccgccgau

SEQ ID NO: 961868 - RNA, 21 nt, Mycobacterium avium subsp. paratuberculosis
augccggcgguaccgccgauc

SEQ ID NO: 961869 - RNA, 23 nt, Mycobacterium avium subsp. paratuberculosis
augccggcguccaguucggccag

SEQ ID NO: 961870 - RNA, 14 nt, Mycobacterium avium subsp. paratuberculosis
augccggcgucguc

SEQ ID NO: 961871 - RNA, 22 nt, Mycobacterium avium subsp. paratuberculosis
augccggcggacagccccgagc

SEQ ID NO: 961872 - RNA, 16 nt, Mycobacterium avium subsp. paratuberculosis
augccggccagcggcc

SEQ ID NO: 961873 - RNA, 15 nt, Mycobacterium avium subsp. paratuberculosis
augcgacaccgcguc

SEQ ID NO: 961874 - RNA, 13 nt, Mycobacterium avium subsp. paratuberculosis
augcgaccacgac

SEQ ID NO: 961875 - RNA, 21 nt, Mycobacterium avium subsp. paratuberculosis
augccuuucagcucgauggug

SEQ ID NO: 961876 - RNA, 15 nt, Mycobacterium avium subsp. paratuberculosis
augcgacgcaccucg

SEQ ID NO: 961877 - RNA, 17 nt, Mycobacterium avium subsp. paratuberculosis
augcgacgcaccucggc

SEQ ID NO: 961878 - RNA, 16 nt, Mycobacterium avium subsp. paratuberculosis
augcgagccagcugcg

SEQ ID NO: 961879 - RNA, 17 nt, Mycobacterium avium subsp. paratuberculosis
augcgagccagcugcgc

SEQ ID NO: 961880 - RNA, 14 nt, Mycobacterium avium subsp. paratuberculosis
augcgccaccgaca

SEQ ID NO: 961881 - RNA, 16 nt, Mycobacterium avium subsp. paratuberculosis
augcgccaccgacacc

SEQ ID NO: 961882 - RNA, 16 nt, Mycobacterium avium subsp. paratuberculosis
augcgccagagcgcga

SEQ ID NO: 961883 - RNA, 14 nt, Mycobacterium avium subsp. paratuberculosis
augcgccggcggcc

SEQ ID NO: 961884 - RNA, 23 nt, Mycobacterium avium subsp. paratuberculosis
augcgcccgcugcggcgcagguu

SEQ ID NO: 961885 - RNA, 14 nt, Mycobacterium avium subsp. paratuberculosis
augcgccugcacgg

SEQ ID NO: 961886 - RNA, 23 nt, Mycobacterium avium subsp. paratuberculosis
augcgccugcacggugccgccgu

SEQ ID NO: 961887 - RNA, 13 nt, Mycobacterium avium subsp. paratuberculosis
augcgcgccgacg

SEQ ID NO: 961888 - RNA, 14 nt, Mycobacterium avium subsp. paratuberculosis
augcgcgccgacga

SEQ ID NO: 961889 - RNA, 16 nt, Mycobacterium avium subsp. paratuberculosis
augcgcgagucgagca

SEQ ID NO: 961890 - RNA, 19 nt, Mycobacterium avium subsp. paratuberculosis
augcgcgagucgagcaccg

SEQ ID NO: 961891 - RNA, 13 nt, Mycobacterium avium subsp. paratuberculosis
augcgcgccagca

SEQ ID NO: 961892 - RNA, 17 nt, Mycobacterium avium subsp. paratuberculosis
augcgcgccagcagcgc

SEQ ID NO: 961893 - RNA, 20 nt, Mycobacterium avium subsp. paratuberculosis
augcgcgguaacagagcggg

SEQ ID NO: 961894 - RNA, 22 nt, Mycobacterium avium subsp. paratuberculosis
augcggcccugguugagcaccg

SEQ ID NO: 961895 - RNA, 16 nt, Mycobacterium avium subsp. paratuberculosis
augcggcccagcccgg

SEQ ID NO: 961896 - RNA, 19 nt, Mycobacterium avium subsp. paratuberculosis
augcggcccagcccggcca

SEQ ID NO: 961897 - RNA, 14 nt, Mycobacterium avium subsp. paratuberculosis
augcggcccgaccc

SEQ ID NO: 961898 - RNA, 20 nt, Mycobacterium avium subsp. paratuberculosis
augcgcgucauggccgucgg

SEQ ID NO: 961899 - RNA, 16 nt, Mycobacterium avium subsp. paratuberculosis
augcgcgucgcggcgc

SEQ ID NO: 961900 - RNA, 17 nt, Mycobacterium avium subsp. paratuberculosis
augcgcgucgcggcgcg

SEQ ID NO: 961901 - RNA, 13 nt, Mycobacterium avium subsp. paratuberculosis
augcgcggcgacg

SEQ ID NO: 961902 - RNA, 16 nt, Mycobacterium avium subsp. paratuberculosis
augcggcucccaccgu

SEQ ID NO: 961903 - RNA, 16 nt, Mycobacterium avium subsp. paratuberculosis
augcgggauucgcgca

SEQ ID NO: 961904 - RNA, 21 nt, Mycobacterium avium subsp. paratuberculosis
augcgggcccgcaacuguucg

SEQ ID NO: 961905 - RNA, 14 nt, Mycobacterium avium subsp. paratuberculosis
augcgggcgccgaa

SEQ ID NO: 961906 - RNA, 16 nt, Mycobacterium avium subsp. paratuberculosis
caagucgucggugggc

SEQ ID NO: 961907 - RNA, 22 nt, Mycobacterium avium subsp. paratuberculosis
caagucgucggugggccgccgc

SEQ ID NO: 961908 - RNA, 23 nt, Mycobacterium avium subsp. paratuberculosis
caagucgucggugggccgccgcg

SEQ ID NO: 961909 - RNA, 14 nt, Mycobacterium avium subsp. paratuberculosis
caaggggcuguccu

SEQ ID NO: 961910 - RNA, 15 nt, Mycobacterium avium subsp. paratuberculosis
caagggcuugggcgc

SEQ ID NO: 961911 - RNA, 19 nt, Mycobacterium avium subsp. paratuberculosis
caaggguuuugcggaucgg

SEQ ID NO: 961912 - RNA, 16 nt, Mycobacterium avium subsp. paratuberculosis
caagucggcggugaug

SEQ ID NO: 961913 - RNA, 19 nt, Mycobacterium avium subsp. paratuberculosis
caaggugauucgcgcggcg

SEQ ID NO: 961914 - RNA, 17 nt, Mycobacterium avium subsp. paratuberculosis
caaggucgucgcggcca

SEQ ID NO: 961915 - RNA, 15 nt, Mycobacterium avium subsp. paratuberculosis
caagguggacgagca

SEQ ID NO: 961916 - RNA, 17 nt, Mycobacterium avium subsp. paratuberculosis
caagcguauccggccag

SEQ ID NO: 961917 - RNA, 21 nt, Mycobacterium avium subsp. paratuberculosis
caagcguauccggccagccgg

SEQ ID NO: 961918 - RNA, 21 nt, Mycobacterium avium subsp. paratuberculosis
caagcgguuccagaccggcgg

SEQ ID NO: 961919 - RNA, 18 nt, Mycobacterium avium subsp. paratuberculosis
caagcgauuaggugggcu

SEQ ID NO: 961920 - RNA, 21 nt, Mycobacterium avium subsp. paratuberculosis
caagccgaguuugcggugauc

SEQ ID NO: 961921 - RNA, 21 nt, Mycobacterium avium subsp. paratuberculosis
caagaugauugcgugcccggc

SEQ ID NO: 961922 - RNA, 21 nt, Mycobacterium avium subsp. paratuberculosis
caagccauuucagcagcgcgg

SEQ ID NO: 961923 - RNA, 15 nt, Mycobacterium avium subsp. paratuberculosis
caagcaguccccgcc

SEQ ID NO: 961924 - RNA, 12 nt, Mycobacterium avium subsp. paratuberculosis
caagcaccggcu

SEQ ID NO: 961925 - RNA, 14 nt, Mycobacterium avium subsp. paratuberculosis
caagcaccggcugg

SEQ ID NO: 961926 - RNA, 17 nt, Mycobacterium avium subsp. paratuberculosis
caagcaccggcuggccg

SEQ ID NO: 961927 - RNA, 21 nt, Mycobacterium avium subsp. paratuberculosis
caacuugaucagcucgcggau

SEQ ID NO: 961928 - RNA, 11 nt, Mycobacterium avium subsp. paratuberculosis
caacuggccgc

SEQ ID NO: 961929 - RNA, 13 nt, Mycobacterium avium subsp. paratuberculosis
caacuggccgccc

SEQ ID NO: 961930 - RNA, 16 nt, Mycobacterium avium subsp. paratuberculosis
caacuggucgugcucg

SEQ ID NO: 961931 - RNA, 19 nt, Mycobacterium avium subsp. paratuberculosis
caacuggucgugcucgucg

SEQ ID NO: 961932 - RNA, 23 nt, Mycobacterium avium subsp. paratuberculosis
caacuggucgugcucgucggcgg

SEQ ID NO: 961933 - RNA, 13 nt, Mycobacterium avium subsp. paratuberculosis
caacuggccggga

SEQ ID NO: 961934 - RNA, 13 nt, Mycobacterium avium subsp. paratuberculosis
caacuggcgaccg

SEQ ID NO: 961935 - RNA, 19 nt, Mycobacterium avium subsp. paratuberculosis
caacucguccaccagcucg

SEQ ID NO: 961936 - RNA, 22 nt, Mycobacterium avium subsp. paratuberculosis
caacagcaccagcaccaccgug

SEQ ID NO: 961937 - RNA, 17 nt, Mycobacterium avium subsp. paratuberculosis
caacagcaccucgucgc

SEQ ID NO: 961938 - RNA, 23 nt, Mycobacterium avium subsp. paratuberculosis
caacagcagcagaaccagcaccg

SEQ ID NO: 961939 - RNA, 12 nt, Mycobacterium avium subsp. paratuberculosis
caacagcagcgg

SEQ ID NO: 961940 - RNA, 19 nt, Mycobacterium avium subsp. paratuberculosis
caacagcauuucgcgcggc

SEQ ID NO: 961941 - RNA, 20 nt, Mycobacterium avium subsp. paratuberculosis
caacucaguccucgccgaga

SEQ ID NO: 961942 - RNA, 14 nt, Mycobacterium avium subsp. paratuberculosis
caacucgcgaggcc

SEQ ID NO: 961943 - RNA, 18 nt, Mycobacterium avium subsp. paratuberculosis
caacucgcgaggccgcca

SEQ ID NO: 961944 - RNA, 19 nt, Mycobacterium avium subsp. paratuberculosis
caacucgcgcucccggcgc

SEQ ID NO: 961945 - RNA, 14 nt, Mycobacterium avium subsp. paratuberculosis
caacuccggcggca

SEQ ID NO: 961946 - RNA, 17 nt, Mycobacterium avium subsp. paratuberculosis
caacucgaagcugcgcc

SEQ ID NO: 961947 - RNA, 20 nt, Mycobacterium avium subsp. paratuberculosis
caacucgacgcucggcgaug

SEQ ID NO: 961948 - RNA, 14 nt, Mycobacterium avium subsp. paratuberculosis
caacucgggcucgu

SEQ ID NO: 961949 - RNA, 17 nt, Mycobacterium avium subsp. paratuberculosis
caacucgggcucgucgu

SEQ ID NO: 961950 - RNA, 21 nt, Mycobacterium avium subsp. paratuberculosis
caacucggguguggacggcga

SEQ ID NO: 961951 - RNA, 14 nt, Mycobacterium avium subsp. paratuberculosis
caacucgucggcga

SEQ ID NO: 961952 - RNA, 18 nt, Mycobacterium avium subsp. paratuberculosis
caacucgucggcgaacuc

SEQ ID NO: 961953 - RNA, 21 nt, Mycobacterium avium subsp. paratuberculosis
cacaacaugucccgggcacgc

SEQ ID NO: 961954 - RNA, 16 nt, Mycobacterium avium subsp. paratuberculosis
cacaacccggacagcg

SEQ ID NO: 961955 - RNA, 17 nt, Mycobacterium avium subsp. paratuberculosis
cacaacccggacagcgc

SEQ ID NO: 961956 - RNA, 19 nt, Mycobacterium avium subsp. paratuberculosis
cacaacccggacagcgcga

SEQ ID NO: 961957 - RNA, 23 nt, Mycobacterium avium subsp. paratuberculosis
cacaaccgauguggacgaugcgg

SEQ ID NO: 961958 - RNA, 19 nt, Mycobacterium avium subsp. paratuberculosis
caauugccgggccagauag

SEQ ID NO: 961959 - RNA, 17 nt, Mycobacterium avium subsp. paratuberculosis
caauugcgccagcagca

SEQ ID NO: 961960 - RNA, 18 nt, Mycobacterium avium subsp. paratuberculosis
caauugccaacugcagca

SEQ ID NO: 961961 - RNA, 16 nt, Mycobacterium avium subsp. paratuberculosis
caaugucacggcgggu

SEQ ID NO: 961962 - RNA, 22 nt, Mycobacterium avium subsp. paratuberculosis
cacacacugcugcgcagacccg

SEQ ID NO: 961963 - RNA, 13 nt, Mycobacterium avium subsp. paratuberculosis
cacacacaggucg

SEQ ID NO: 961964 - RNA, 19 nt, Mycobacterium avium subsp. paratuberculosis
cacaccagcacggcggcgc

SEQ ID NO: 961965 - RNA, 13 nt, Mycobacterium avium subsp. paratuberculosis
cacaccaccacgu

SEQ ID NO: 961966 - RNA, 15 nt, Mycobacterium avium subsp. paratuberculosis
cacaccaccagcgag

SEQ ID NO: 961967 - RNA, 18 nt, Mycobacterium avium subsp. paratuberculosis
cacaccaccgacgcgucg

SEQ ID NO: 961968 - RNA, 16 nt, Mycobacterium avium subsp. paratuberculosis
cacaacgccuccgaau

SEQ ID NO: 961969 - RNA, 22 nt, Mycobacterium avium subsp. paratuberculosis
cacaacgucucugucgucgacc

SEQ ID NO: 961970 - RNA, 17 nt, Mycobacterium avium subsp. paratuberculosis
caauacccgaccagcac

SEQ ID NO: 961971 - RNA, 14 nt, Mycobacterium avium subsp. paratuberculosis
caauacggcccggc

SEQ ID NO: 961972 - RNA, 15 nt, Mycobacterium avium subsp. paratuberculosis
caaucaggcggucga

SEQ ID NO: 961973 - RNA, 20 nt, Mycobacterium avium subsp. paratuberculosis
caaugccuuugccguggcgg

SEQ ID NO: 961974 - RNA, 23 nt, Mycobacterium avium subsp. paratuberculosis
caaugccuuugccguggcggcgg

SEQ ID NO: 961975 - RNA, 21 nt, Mycobacterium avium subsp. paratuberculosis
caaugcgaucauuccgccgaa

SEQ ID NO: 961976 - RNA, 16 nt, Mycobacterium avium subsp. paratuberculosis
caaugcgccggcggcc

SEQ ID NO: 961977 - RNA, 18 nt, Mycobacterium avium subsp. paratuberculosis
caaugcgccggcggccgc

SEQ ID NO: 961978 - RNA, 14 nt, Mycobacterium avium subsp. paratuberculosis
caaugccggaucgg

SEQ ID NO: 961979 - RNA, 19 nt, Mycobacterium avium subsp. paratuberculosis
caaugccgccgcgacgaug

SEQ ID NO: 961980 - RNA, 14 nt, Mycobacterium avium subsp. paratuberculosis
caaugccgcagccg

SEQ ID NO: 961981 - RNA, 15 nt, Mycobacterium avium subsp. paratuberculosis
caaugccgcagccga

SEQ ID NO: 961982 - RNA, 17 nt, Mycobacterium avium subsp. paratuberculosis
caaugaccggcaccagc

SEQ ID NO: 961983 - RNA, 23 nt, Mycobacterium avium subsp. paratuberculosis
caaucgggacgccacggcgaaca

SEQ ID NO: 961984 - RNA, 16 nt, Mycobacterium avium subsp. paratuberculosis
cacagcaccggcgucg

SEQ ID NO: 961985 - RNA, 17 nt, Mycobacterium avium subsp. paratuberculosis
cacagcaccggcgucga

SEQ ID NO: 961986 - RNA, 19 nt, Mycobacterium avium subsp. paratuberculosis
cacagcaccggcgucgaca

SEQ ID NO: 961987 - RNA, 16 nt, Mycobacterium avium subsp. paratuberculosis
cacagcaacgacaucc

SEQ ID NO: 961988 - RNA, 15 nt, Mycobacterium avium subsp. paratuberculosis
cacagauacgcgacg

SEQ ID NO: 961989 - RNA, 19 nt, Mycobacterium avium subsp. paratuberculosis
cacagauacgcgacgaacc

SEQ ID NO: 961990 - RNA, 15 nt, Mycobacterium avium subsp. paratuberculosis
cacagcgccagcacg

SEQ ID NO: 961991 - RNA, 19 nt, Mycobacterium avium subsp. paratuberculosis
cacagcgccagcacggcca

SEQ ID NO: 961992 - RNA, 18 nt, Mycobacterium avium subsp. paratuberculosis
cacagcgaggcgacgucg

SEQ ID NO: 961993 - RNA, 22 nt, Mycobacterium avium subsp. paratuberculosis
cacagcgacaacgggccgccuc

SEQ ID NO: 961994 - RNA, 12 nt, Mycobacterium avium subsp. paratuberculosis
cacagcacggca

SEQ ID NO: 961995 - RNA, 15 nt, Mycobacterium avium subsp. paratuberculosis
cacagcacggcaucg

SEQ ID NO: 961996 - RNA, 16 nt, Mycobacterium avium subsp. paratuberculosis
cacagcacggcaucga

SEQ ID NO: 961997 - RNA, 16 nt, Mycobacterium avium subsp. paratuberculosis
cacagcagcaccagcg

SEQ ID NO: 961998 - RNA, 15 nt, Mycobacterium avium subsp. paratuberculosis
cacagcagcagcacc

SEQ ID NO: 961999 - RNA, 13 nt, Mycobacterium avium subsp. paratuberculosis
cacagcagccgca

SEQ ID NO: 962000 - RNA, 15 nt, Mycobacterium avium subsp. paratuberculosis
cacagcagccgcacc

SEQ ID NO: 962001 - RNA, 17 nt, Mycobacterium avium subsp. paratuberculosis
cacagcagccgcaccuc

SEQ ID NO: 962002 - RNA, 15 nt, Mycobacterium avium subsp. paratuberculosis
cacagcgccacaccg

SEQ ID NO: 962003 - RNA, 13 nt, Mycobacterium avium subsp. paratuberculosis
cacagcgcggcgg

SEQ ID NO: 962004 - RNA, 16 nt, Mycobacterium avium subsp. paratuberculosis
cacagcgcggcgguga

SEQ ID NO: 962005 - RNA, 23 nt, Mycobacterium avium subsp. paratuberculosis
cacagcgcccuugagcacgguga

SEQ ID NO: 962006 - RNA, 21 nt, Mycobacterium avium subsp. paratuberculosis
cacagcgccgcguugucggcg

SEQ ID NO: 962007 - RNA, 22 nt, Mycobacterium avium subsp. paratuberculosis
cacagcgccgcguugucggcgu

SEQ ID NO: 962008 - RNA, 21 nt, Mycobacterium avium subsp. paratuberculosis
cacagcgccucgcggucgacg

SEQ ID NO: 962009 - RNA, 23 nt, Mycobacterium avium subsp. paratuberculosis
cacagcgccucgcggucgacgga

SEQ ID NO: 962010 - RNA, 21 nt, Mycobacterium avium subsp. paratuberculosis
cacacgugcggauggccccgg

SEQ ID NO: 962011 - RNA, 23 nt, Mycobacterium avium subsp. paratuberculosis
cacacgugcggauggccccggcg

SEQ ID NO: 962012 - RNA, 15 nt, Mycobacterium avium subsp. paratuberculosis
cacacuggcgugacg

SEQ ID NO: 962013 - RNA, 16 nt, Mycobacterium avium subsp. paratuberculosis
cacacuggcgugacgc

SEQ ID NO: 962014 - RNA, 22 nt, Mycobacterium avium subsp. paratuberculosis
cacacuggcgugacgcucggcc

SEQ ID NO: 962015 - RNA, 13 nt, Mycobacterium avium subsp. paratuberculosis
cacacccagcgag

SEQ ID NO: 962016 - RNA, 17 nt, Mycobacterium avium subsp. paratuberculosis
cacacccagcgagccga

SEQ ID NO: 962017 - RNA, 19 nt, Mycobacterium avium subsp. paratuberculosis
cacacccagcgagccgaug

SEQ ID NO: 962018 - RNA, 14 nt, Mycobacterium avium subsp. paratuberculosis
cacacccagcgcca

SEQ ID NO: 962019 - RNA, 16 nt, Mycobacterium avium subsp. paratuberculosis
cacaccccggccacca

SEQ ID NO: 962020 - RNA, 20 nt, Mycobacterium avium subsp. paratuberculosis
cacaccccggccaccagggc

SEQ ID NO: 962021 - RNA, 18 nt, Mycobacterium avium subsp. paratuberculosis
cacacccgcacgcugucg

SEQ ID NO: 962022 - RNA, 14 nt, Mycobacterium avium subsp. paratuberculosis
cacacccgcagcga

SEQ ID NO: 962023 - RNA, 15 nt, Mycobacterium avium subsp. paratuberculosis
cacacccgcggccgc

SEQ ID NO: 962024 - RNA, 16 nt, Mycobacterium avium subsp. paratuberculosis
cacacccgcggccgcu

SEQ ID NO: 962025 - RNA, 13 nt, Mycobacterium avium subsp. paratuberculosis
cacaccgcggcca

SEQ ID NO: 962026 - RNA, 19 nt, Mycobacterium avium subsp. paratuberculosis
cacaccgcggccagcgcgc

SEQ ID NO: 962027 - RNA, 18 nt, Mycobacterium avium subsp. paratuberculosis
cacaccgcggcggcgucg

SEQ ID NO: 962028 - RNA, 21 nt, Mycobacterium avium subsp. paratuberculosis
cacaccgcugucggugugagc

SEQ ID NO: 962029 - RNA, 15 nt, Mycobacterium avium subsp. paratuberculosis
cacaccggaucggcu

SEQ ID NO: 962030 - RNA, 21 nt, Mycobacterium avium subsp. paratuberculosis
cacaccggaucggcugcgggc

SEQ ID NO: 962031 - RNA, 18 nt, Mycobacterium avium subsp. paratuberculosis
cacaccgaucagcaugcc

SEQ ID NO: 962032 - RNA, 14 nt, Mycobacterium avium subsp. paratuberculosis
cacaccgccgcggc

SEQ ID NO: 962033 - RNA, 15 nt, Mycobacterium avium subsp. paratuberculosis
cacaccgccgcggcg

SEQ ID NO: 962034 - RNA, 18 nt, Mycobacterium avium subsp. paratuberculosis
cacaccgccgcggcggug

SEQ ID NO: 962035 - RNA, 21 nt, Mycobacterium avium subsp. paratuberculosis
cacaccgccgcggcgguggcc

SEQ ID NO: 962036 - RNA, 17 nt, Mycobacterium avium subsp. paratuberculosis
cacaccgccggcgcgga

SEQ ID NO: 962037 - RNA, 13 nt, Mycobacterium avium subsp. paratuberculosis
cacacccggugcg

SEQ ID NO: 962038 - RNA, 22 nt, Mycobacterium avium subsp. paratuberculosis
cacaccgaagaaccccgagauc

SEQ ID NO: 962039 - RNA, 13 nt, Mycobacterium avium subsp. paratuberculosis
cacaccgacaccg

SEQ ID NO: 962040 - RNA, 14 nt, Mycobacterium avium subsp. paratuberculosis
cacaccgacauguc

SEQ ID NO: 962041 - RNA, 16 nt, Mycobacterium avium subsp. paratuberculosis
cacaccgagcgagcgc

SEQ ID NO: 962042 - RNA, 14 nt, Mycobacterium avium subsp. paratuberculosis
cacaccggcgcugc

SEQ ID NO: 962043 - RNA, 16 nt, Mycobacterium avium subsp. paratuberculosis
cacaccguaccgagga

SEQ ID NO: 962044 - RNA, 13 nt, Mycobacterium avium subsp. paratuberculosis
cacaccucggcga

SEQ ID NO: 962045 - RNA, 18 nt, Mycobacterium avium subsp. paratuberculosis
cacaccucggcgaccucg

SEQ ID NO: 962046 - RNA, 16 nt, Mycobacterium avium subsp. paratuberculosis
cacaccgucggcgauc

SEQ ID NO: 962047 - RNA, 21 nt, Mycobacterium avium subsp. paratuberculosis
cacaccgucggcgaucgccgg

SEQ ID NO: 962048 - RNA, 16 nt, Mycobacterium avium subsp. paratuberculosis
cacacgcucggcgagc

SEQ ID NO: 962049 - RNA, 16 nt, Mycobacterium avium subsp. paratuberculosis
cacacgcucggcgcgc

SEQ ID NO: 962050 - RNA, 19 nt, Mycobacterium avium subsp. paratuberculosis
cacacgcucggcgcgcggg

SEQ ID NO: 962051 - RNA, 13 nt, Mycobacterium avium subsp. paratuberculosis
cacacgggcccgu

SEQ ID NO: 962052 - RNA, 20 nt, Mycobacterium avium subsp. paratuberculosis
cacacgaauacccuccgggc

SEQ ID NO: 962053 - RNA, 22 nt, Mycobacterium avium subsp. paratuberculosis
cacaccuuccaccaccgcggcg

SEQ ID NO: 962054 - RNA, 17 nt, Mycobacterium avium subsp. paratuberculosis
cacaccuucgcggucgg

SEQ ID NO: 962055 - RNA, 22 nt, Mycobacterium avium subsp. paratuberculosis
cacaccuucgcggucggcaacc

SEQ ID NO: 962056 - RNA, 12 nt, Mycobacterium avium subsp. paratuberculosis
cacacgaacacc

SEQ ID NO: 962057 - RNA, 13 nt, Mycobacterium avium subsp. paratuberculosis
cacacgaacaccg

SEQ ID NO: 962058 - RNA, 15 nt, Mycobacterium avium subsp. paratuberculosis
cacacgaugcgcggu

SEQ ID NO: 962059 - RNA, 14 nt, Mycobacterium avium subsp. paratuberculosis
cacacgccgaggcg

SEQ ID NO: 962060 - RNA, 21 nt, Mycobacterium avium subsp. paratuberculosis
cacaucggucucgacaccggc

SEQ ID NO: 962061 - RNA, 14 nt, Mycobacterium avium subsp. paratuberculosis
cacaucggagagcu

SEQ ID NO: 962062 - RNA, 16 nt, Mycobacterium avium subsp. paratuberculosis
caccaacggcucgccg

SEQ ID NO: 962063 - RNA, 19 nt, Mycobacterium avium subsp. paratuberculosis
caccaacggcucgccgcgc

SEQ ID NO: 962064 - RNA, 15 nt, Mycobacterium avium subsp. paratuberculosis
cacaucugccggcag

SEQ ID NO: 962065 - RNA, 16 nt, Mycobacterium avium subsp. paratuberculosis
caccaacgacagcgac

SEQ ID NO: 962066 - RNA, 19 nt, Mycobacterium avium subsp. paratuberculosis
cacaucgguugcuccggcg

SEQ ID NO: 962067 - RNA, 16 nt, Mycobacterium avium subsp. paratuberculosis
cacaucguggcgacga

SEQ ID NO: 962068 - RNA, 18 nt, Mycobacterium avium subsp. paratuberculosis
cacaucguggcgacgacg

SEQ ID NO: 962069 - RNA, 14 nt, Mycobacterium avium subsp. paratuberculosis
cacaguaggcggcu

SEQ ID NO: 962070 - RNA, 15 nt, Mycobacterium avium subsp. paratuberculosis
cacaguaggcggcug

SEQ ID NO: 962071 - RNA, 12 nt, Mycobacterium avium subsp. paratuberculosis
cacagggcggcg

SEQ ID NO: 962072 - RNA, 15 nt, Mycobacterium avium subsp. paratuberculosis
cacagggcggcgaca

SEQ ID NO: 962073 - RNA, 13 nt, Mycobacterium avium subsp. paratuberculosis
cacaggucgaugg

SEQ ID NO: 962074 - RNA, 15 nt, Mycobacterium avium subsp. paratuberculosis
cacaggucgcccggc

SEQ ID NO: 962075 - RNA, 17 nt, Mycobacterium avium subsp. paratuberculosis
cacaggucgcccggcuc

SEQ ID NO: 962076 - RNA, 18 nt, Mycobacterium avium subsp. paratuberculosis
cacaggucgcccggcucg

SEQ ID NO: 962077 - RNA, 21 nt, Mycobacterium avium subsp. paratuberculosis
cacaggucgcccggcucgccg

SEQ ID NO: 962078 - RNA, 13 nt, Mycobacterium avium subsp. paratuberculosis
cacagcggcgaca

SEQ ID NO: 962079 - RNA, 19 nt, Mycobacterium avium subsp. paratuberculosis
cacagcggcgacagcggcc

SEQ ID NO: 962080 - RNA, 15 nt, Mycobacterium avium subsp. paratuberculosis
cacagcggaucggcc

SEQ ID NO: 962081 - RNA, 13 nt, Mycobacterium avium subsp. paratuberculosis
cacagcggcgcau

SEQ ID NO: 962082 - RNA, 22 nt, Mycobacterium avium subsp. paratuberculosis
cacagcggcgcaugaccgaucc

SEQ ID NO: 962083 - RNA, 22 nt, Mycobacterium avium subsp. paratuberculosis
cacagcggcggaugggugcggu

SEQ ID NO: 962084 - RNA, 12 nt, Mycobacterium avium subsp. paratuberculosis
cacagcgguucg

SEQ ID NO: 962085 - RNA, 13 nt, Mycobacterium avium subsp. paratuberculosis
cacagcgguucgg

SEQ ID NO: 962086 - RNA, 14 nt, Mycobacterium avium subsp. paratuberculosis
cacagcgguucggc

SEQ ID NO: 962087 - RNA, 15 nt, Mycobacterium avium subsp. paratuberculosis
cacagcgguucggcg

SEQ ID NO: 962088 - RNA, 22 nt, Mycobacterium avium subsp. paratuberculosis
cacagcuaggucguggcgccga

SEQ ID NO: 962089 - RNA, 20 nt, Mycobacterium avium subsp. paratuberculosis
caccacaucggucucgacac

SEQ ID NO: 962090 - RNA, 21 nt, Mycobacterium avium subsp. paratuberculosis
caccacaucgguugcuccggc

SEQ ID NO: 962091 - RNA, 23 nt, Mycobacterium avium subsp. paratuberculosis
caccacaucgguugcuccggcgu

SEQ ID NO: 962092 - RNA, 18 nt, Mycobacterium avium subsp. paratuberculosis
caccacauucccgccgcc

SEQ ID NO: 962093 - RNA, 18 nt, Mycobacterium avium subsp. paratuberculosis
caccaccaacagcagcga

SEQ ID NO: 962094 - RNA, 13 nt, Mycobacterium avium subsp. paratuberculosis
caccaccaacgcc

SEQ ID NO: 962095 - RNA, 21 nt, Mycobacterium avium subsp. paratuberculosis
caccacccaggccacccgggc

SEQ ID NO: 962096 - RNA, 22 nt, Mycobacterium avium subsp. paratuberculosis
caccacccaggccacccgggcg

SEQ ID NO: 962097 - RNA, 11 nt, Mycobacterium avium subsp. paratuberculosis
caccaccgaga

SEQ ID NO: 962098 - RNA, 22 nt, Mycobacterium avium subsp. paratuberculosis
caccaccgagccggcgucgccg

SEQ ID NO: 962099 - RNA, 16 nt, Mycobacterium avium subsp. paratuberculosis
caccaccgagccggug

SEQ ID NO: 962100 - RNA, 17 nt, Mycobacterium avium subsp. paratuberculosis
caccaccgacaccccga

SEQ ID NO: 962101 - RNA, 14 nt, Mycobacterium avium subsp. paratuberculosis
caccaccgacgcgu

SEQ ID NO: 962102 - RNA, 14 nt, Mycobacterium avium subsp. paratuberculosis
caccacccccgacc

SEQ ID NO: 962103 - RNA, 14 nt, Mycobacterium avium subsp. paratuberculosis
caccaccccggugc

SEQ ID NO: 962104 - RNA, 13 nt, Mycobacterium avium subsp. paratuberculosis
caccacccgcggc

SEQ ID NO: 962105 - RNA, 17 nt, Mycobacterium avium subsp. paratuberculosis
caccacccgcggccggc

SEQ ID NO: 962106 - RNA, 11 nt, Mycobacterium avium subsp. paratuberculosis
caccacccgga

SEQ ID NO: 962107 - RNA, 23 nt, Mycobacterium avium subsp. paratuberculosis
caccaaggcaaucaggcggucga

SEQ ID NO: 962108 - RNA, 20 nt, Mycobacterium avium subsp. paratuberculosis
caccaaggcgauuucgggau

SEQ ID NO: 962109 - RNA, 23 nt, Mycobacterium avium subsp. paratuberculosis
caccaagaaguuuccccaccagg

SEQ ID NO: 962110 - RNA, 14 nt, Mycobacterium avium subsp. paratuberculosis
caccaauucgcgcu

SEQ ID NO: 962111 - RNA, 16 nt, Mycobacterium avium subsp. paratuberculosis
caccaauucgcgcugc

SEQ ID NO: 962112 - RNA, 13 nt, Mycobacterium avium subsp. paratuberculosis
caccaaugcgccg

SEQ ID NO: 962113 - RNA, 16 nt, Mycobacterium avium subsp. paratuberculosis
caccaaugcgccggcg

SEQ ID NO: 962114 - RNA, 17 nt, Mycobacterium avium subsp. paratuberculosis
caccaaugcgccggcgg

SEQ ID NO: 962115 - RNA, 18 nt, Mycobacterium avium subsp. paratuberculosis
caccaaugcgccggcggc

SEQ ID NO: 962116 - RNA, 20 nt, Mycobacterium avium subsp. paratuberculosis
caccaaugcgccggcggccg

SEQ ID NO: 962117 - RNA, 15 nt, Mycobacterium avium subsp. paratuberculosis
caccaauggcggcca

SEQ ID NO: 962118 - RNA, 16 nt, Mycobacterium avium subsp. paratuberculosis
caccaauggcggccac

SEQ ID NO: 962119 - RNA, 15 nt, Mycobacterium avium subsp. paratuberculosis
caccacacccagcgc

SEQ ID NO: 962120 - RNA, 13 nt, Mycobacterium avium subsp. paratuberculosis
caccacacccgcg

SEQ ID NO: 962121 - RNA, 15 nt, Mycobacterium avium subsp. paratuberculosis
caccagaugccgcuc

SEQ ID NO: 962122 - RNA, 17 nt, Mycobacterium avium subsp. paratuberculosis
caccagaugccgcucgg

SEQ ID NO: 962123 - RNA, 18 nt, Mycobacterium avium subsp. paratuberculosis
caccagaugccgcucggc

SEQ ID NO: 962124 - RNA, 19 nt, Mycobacterium avium subsp. paratuberculosis
caccagaugccgcucggcg

SEQ ID NO: 962125 - RNA, 16 nt, Mycobacterium avium subsp. paratuberculosis
caccagcaacaccagg

SEQ ID NO: 962126 - RNA, 18 nt, Mycobacterium avium subsp. paratuberculosis
caccagcaacaccagggu

SEQ ID NO: 962127 - RNA, 18 nt, Mycobacterium avium subsp. paratuberculosis
caccagcacaccggaucg

SEQ ID NO: 962128 - RNA, 13 nt, Mycobacterium avium subsp. paratuberculosis
caccagcaccacc

SEQ ID NO: 962129 - RNA, 23 nt, Mycobacterium avium subsp. paratuberculosis
caccacuugcccagauugcggcc

SEQ ID NO: 962130 - RNA, 14 nt, Mycobacterium avium subsp. paratuberculosis
caccagaccggcga

SEQ ID NO: 962131 - RNA, 15 nt, Mycobacterium avium subsp. paratuberculosis
caccagaccggcgaa

SEQ ID NO: 962132 - RNA, 13 nt, Mycobacterium avium subsp. paratuberculosis
caccacgaccucc

SEQ ID NO: 962133 - RNA, 17 nt, Mycobacterium avium subsp. paratuberculosis
caccacgaacugggugc

SEQ ID NO: 962134 - RNA, 20 nt, Mycobacterium avium subsp. paratuberculosis
caccacuuccagcaccggcu

SEQ ID NO: 962135 - RNA, 21 nt, Mycobacterium avium subsp. paratuberculosis
caccacuuccagcaccggcug

SEQ ID NO: 962136 - RNA, 19 nt, Mycobacterium avium subsp. paratuberculosis
caccacgaagcgggcggcg

SEQ ID NO: 962137 - RNA, 12 nt, Mycobacterium avium subsp. paratuberculosis
caccacgaccag

SEQ ID NO: 962138 - RNA, 22 nt, Mycobacterium avium subsp. paratuberculosis
caccacgaaccaggcgccggcc

SEQ ID NO: 962139 - RNA, 23 nt, Mycobacterium avium subsp. paratuberculosis
caccacgaaccaggcgccggcca

SEQ ID NO: 962140 - RNA, 14 nt, Mycobacterium avium subsp. paratuberculosis
caccacgaacgcgc

SEQ ID NO: 962141 - RNA, 19 nt, Mycobacterium avium subsp. paratuberculosis
caccacgaacgcgccgccg

SEQ ID NO: 962142 - RNA, 13 nt, Mycobacterium avium subsp. paratuberculosis
caccacgaacgcu

SEQ ID NO: 962143 - RNA, 18 nt, Mycobacterium avium subsp. paratuberculosis
caccacgaacgcugccag

SEQ ID NO: 962144 - RNA, 19 nt, Mycobacterium avium subsp. paratuberculosis
caccaccgugccgucgcgg

SEQ ID NO: 962145 - RNA, 19 nt, Mycobacterium avium subsp. paratuberculosis
caccaccgggucgucgcgg

SEQ ID NO: 962146 - RNA, 14 nt, Mycobacterium avium subsp. paratuberculosis
caccaccggugaac

SEQ ID NO: 962147 - RNA, 13 nt, Mycobacterium avium subsp. paratuberculosis
caccaccgccacc

SEQ ID NO: 962148 - RNA, 19 nt, Mycobacterium avium subsp. paratuberculosis
caccaccgccaccagcgca

SEQ ID NO: 962149 - RNA, 20 nt, Mycobacterium avium subsp. paratuberculosis
caccaccgcccggaccggcu

SEQ ID NO: 962150 - RNA, 22 nt, Mycobacterium avium subsp. paratuberculosis
caccaccgcccggaccggcucg

SEQ ID NO: 962151 - RNA, 23 nt, Mycobacterium avium subsp. paratuberculosis
caccaccucgugcacaugcccgu

SEQ ID NO: 962152 - RNA, 16 nt, Mycobacterium avium subsp. paratuberculosis
caccaccuggccggcc

SEQ ID NO: 962153 - RNA, 19 nt, Mycobacterium avium subsp. paratuberculosis
caccaccuucaucgccguc

SEQ ID NO: 962154 - RNA, 17 nt, Mycobacterium avium subsp. paratuberculosis
caccaccuugguggccg

SEQ ID NO: 962155 - RNA, 22 nt, Mycobacterium avium subsp. paratuberculosis
caccaccuugguggccgcggcc

SEQ ID NO: 962156 - RNA, 17 nt, Mycobacterium avium subsp. paratuberculosis
caccaccguggcgaugg

SEQ ID NO: 962157 - RNA, 21 nt, Mycobacterium avium subsp. paratuberculosis
caccaccuccucgcgggcgau

SEQ ID NO: 962158 - RNA, 14 nt, Mycobacterium avium subsp. paratuberculosis
caccaccucggcga

SEQ ID NO: 962159 - RNA, 15 nt, Mycobacterium avium subsp. paratuberculosis
caccaccucggcgau

SEQ ID NO: 962160 - RNA, 16 nt, Mycobacterium avium subsp. paratuberculosis
caccaccucggcgauc

SEQ ID NO: 962161 - RNA, 13 nt, Mycobacterium avium subsp. paratuberculosis
caccagcagcagg

SEQ ID NO: 962162 - RNA, 17 nt, Mycobacterium avium subsp. paratuberculosis
caccagcagccgcagcg

SEQ ID NO: 962163 - RNA, 21 nt, Mycobacterium avium subsp. paratuberculosis
caccagcagccgcagcgcgcg

SEQ ID NO: 962164 - RNA, 11 nt, Mycobacterium avium subsp. paratuberculosis
caccagcagcg

SEQ ID NO: 962165 - RNA, 17 nt, Mycobacterium avium subsp. paratuberculosis
caccagcagcgagaccg

SEQ ID NO: 962166 - RNA, 19 nt, Mycobacterium avium subsp. paratuberculosis
caccagcacggcgaccagc

SEQ ID NO: 962167 - RNA, 14 nt, Mycobacterium avium subsp. paratuberculosis
caccagcacggcgg

SEQ ID NO: 962168 - RNA, 17 nt, Mycobacterium avium subsp. paratuberculosis
caccagcacggcggcgc

SEQ ID NO: 962169 - RNA, 20 nt, Mycobacterium avium subsp. paratuberculosis
caccagcacggcggcgcuga

SEQ ID NO: 962170 - RNA, 16 nt, Mycobacterium avium subsp. paratuberculosis
caccagcacgccguug

SEQ ID NO: 962171 - RNA, 17 nt, Mycobacterium avium subsp. paratuberculosis
caccagcacccagcaca

SEQ ID NO: 962172 - RNA, 16 nt, Mycobacterium avium subsp. paratuberculosis
caccagcacgacaccg

SEQ ID NO: 962173 - RNA, 13 nt, Mycobacterium avium subsp. paratuberculosis
caccagcaggucg

SEQ ID NO: 962174 - RNA, 13 nt, Mycobacterium avium subsp. paratuberculosis
caccagcagcgcg

SEQ ID NO: 962175 - RNA, 16 nt, Mycobacterium avium subsp. paratuberculosis
caccagcagcgcgacg

SEQ ID NO: 962176 - RNA, 18 nt, Mycobacterium avium subsp. paratuberculosis
caccagcagcgcgacgcc

SEQ ID NO: 962177 - RNA, 20 nt, Mycobacterium avium subsp. paratuberculosis
caccagcagcgcgacgccga

SEQ ID NO: 962178 - RNA, 22 nt, Mycobacterium avium subsp. paratuberculosis
caccagcagcgcgacgccgacg

SEQ ID NO: 962179 - RNA, 17 nt, Mycobacterium avium subsp. paratuberculosis
caccagcauggcgauca

SEQ ID NO: 962180 - RNA, 23 nt, Mycobacterium avium subsp. paratuberculosis
caccagcauggcgaucaccccgg

SEQ ID NO: 962181 - RNA, 20 nt, Mycobacterium avium subsp. paratuberculosis
caccagcaccaggcggguca

SEQ ID NO: 962182 - RNA, 14 nt, Mycobacterium avium subsp. paratuberculosis
caccagccacaccg

SEQ ID NO: 962183 - RNA, 20 nt, Mycobacterium avium subsp. paratuberculosis
caccagccacaccgccgcgg

SEQ ID NO: 962184 - RNA, 14 nt, Mycobacterium avium subsp. paratuberculosis
caccagcgccgcga

SEQ ID NO: 962185 - RNA, 17 nt, Mycobacterium avium subsp. paratuberculosis
caccagcgccgcgauga

SEQ ID NO: 962186 - RNA, 13 nt, Mycobacterium avium subsp. paratuberculosis
caccagcgcggug

SEQ ID NO: 962187 - RNA, 16 nt, Mycobacterium avium subsp. paratuberculosis
caccagcgcggccacc

SEQ ID NO: 962188 - RNA, 17 nt, Mycobacterium avium subsp. paratuberculosis
caccagcgcggccacca

SEQ ID NO: 962189 - RNA, 17 nt, Mycobacterium avium subsp. paratuberculosis
caccagcccgaugccgc

SEQ ID NO: 962190 - RNA, 18 nt, Mycobacterium avium subsp. paratuberculosis
caccagcgcgcacgcgga

SEQ ID NO: 962191 - RNA, 16 nt, Mycobacterium avium subsp. paratuberculosis
caccagcgcgcgggug

SEQ ID NO: 962192 - RNA, 21 nt, Mycobacterium avium subsp. paratuberculosis
caccagcgcggacaccagguu

SEQ ID NO: 962193 - RNA, 22 nt, Mycobacterium avium subsp. paratuberculosis
caccagcgcggacaccagguug

SEQ ID NO: 962194 - RNA, 23 nt, Mycobacterium avium subsp. paratuberculosis
caccagcgcuuucgcgcacgcca

SEQ ID NO: 962195 - RNA, 20 nt, Mycobacterium avium subsp. paratuberculosis
caccagcugggaggcgcaca

SEQ ID NO: 962196 - RNA, 14 nt, Mycobacterium avium subsp. paratuberculosis
caccaggacgcgac

SEQ ID NO: 962197 - RNA, 15 nt, Mycobacterium avium subsp. paratuberculosis
caccaggacgcgacc

SEQ ID NO: 962198 - RNA, 16 nt, Mycobacterium avium subsp. paratuberculosis
caccaggacgcgaccg

SEQ ID NO: 962199 - RNA, 20 nt, Mycobacterium avium subsp. paratuberculosis
caccaggacgcgaccggcca

SEQ ID NO: 962200 - RNA, 17 nt, Mycobacterium avium subsp. paratuberculosis
caccagcggaucggcgg

SEQ ID NO: 962201 - RNA, 13 nt, Mycobacterium avium subsp. paratuberculosis
caccagcggcauc

SEQ ID NO: 962202 - RNA, 15 nt, Mycobacterium avium subsp. paratuberculosis
caccagcggcaucgc

SEQ ID NO: 962203 - RNA, 13 nt, Mycobacterium avium subsp. paratuberculosis
caccagcggccgu

SEQ ID NO: 962204 - RNA, 19 nt, Mycobacterium avium subsp. paratuberculosis
caccagcggccgucgccgg

SEQ ID NO: 962205 - RNA, 20 nt, Mycobacterium avium subsp. paratuberculosis
caccagcggccgucgccggg

SEQ ID NO: 962206 - RNA, 22 nt, Mycobacterium avium subsp. paratuberculosis
caccagcggccgucgccgggcg

SEQ ID NO: 962207 - RNA, 13 nt, Mycobacterium avium subsp. paratuberculosis
caccagcggcgcc

SEQ ID NO: 962208 - RNA, 15 nt, Mycobacterium avium subsp. paratuberculosis
caccagcggcgccca

SEQ ID NO: 962209 - RNA, 17 nt, Mycobacterium avium subsp. paratuberculosis
caccagcggcgcccacg

SEQ ID NO: 962210 - RNA, 14 nt, Mycobacterium avium subsp. paratuberculosis
caccagcggcgcgu

SEQ ID NO: 962211 - RNA, 18 nt, Mycobacterium avium subsp. paratuberculosis
caccaggcccaggccgac

SEQ ID NO: 962212 - RNA, 19 nt, Mycobacterium avium subsp. paratuberculosis
caccaggcccaggccgacg

SEQ ID NO: 962213 - RNA, 19 nt, Mycobacterium avium subsp. paratuberculosis
caccaggcccucgccgcgg

SEQ ID NO: 962214 - RNA, 22 nt, Mycobacterium avium subsp. paratuberculosis
caccaggcccucgccgcgguca

SEQ ID NO: 962215 - RNA, 19 nt, Mycobacterium avium subsp. paratuberculosis
caccagguucacgucgggg

SEQ ID NO: 962216 - RNA, 13 nt, Mycobacterium avium subsp. paratuberculosis
caccagguucgcg

SEQ ID NO: 962217 - RNA, 18 nt, Mycobacterium avium subsp. paratuberculosis
caccagguucgcgcagcu

SEQ ID NO: 962218 - RNA, 17 nt, Mycobacterium avium subsp. paratuberculosis
caccagguggcccgacc

SEQ ID NO: 962219 - RNA, 17 nt, Mycobacterium avium subsp. paratuberculosis
caccagguuggucucga

SEQ ID NO: 962220 - RNA, 16 nt, Mycobacterium avium subsp. paratuberculosis
caccagguugucgccg

SEQ ID NO: 962221 - RNA, 17 nt, Mycobacterium avium subsp. paratuberculosis
caccagguugucgccgc

SEQ ID NO: 962222 - RNA, 18 nt, Mycobacterium avium subsp. paratuberculosis
caccagguugucgccgcg

SEQ ID NO: 962223 - RNA, 13 nt, Mycobacterium avium subsp. paratuberculosis
caccaggcgcacc

SEQ ID NO: 962224 - RNA, 14 nt, Mycobacterium avium subsp. paratuberculosis
caccaggcgcacca

SEQ ID NO: 962225 - RNA, 17 nt, Mycobacterium avium subsp. paratuberculosis
caccaggucgcacacca

SEQ ID NO: 962226 - RNA, 20 nt, Mycobacterium avium subsp. paratuberculosis
caccaggucguugccggugc

SEQ ID NO: 962227 - RNA, 23 nt, Mycobacterium avium subsp. paratuberculosis
caccaggucguugccggugccga

SEQ ID NO: 962228 - RNA, 20 nt, Mycobacterium avium subsp. paratuberculosis
caccaggucuccgucggcgc

SEQ ID NO: 962229 - RNA, 15 nt, Mycobacterium avium subsp. paratuberculosis
caccagucggcgcgu

SEQ ID NO: 962230 - RNA, 19 nt, Mycobacterium avium subsp. paratuberculosis
caccauccagugcaguucg

SEQ ID NO: 962231 - RNA, 16 nt, Mycobacterium avium subsp. paratuberculosis
caccagucgcgcagcg

SEQ ID NO: 962232 - RNA, 14 nt, Mycobacterium avium subsp. paratuberculosis
caccaucaggccgg

SEQ ID NO: 962233 - RNA, 15 nt, Mycobacterium avium subsp. paratuberculosis
caccaucaggccggc

SEQ ID NO: 962234 - RNA, 13 nt, Mycobacterium avium subsp. paratuberculosis
caccauccgcgcg

SEQ ID NO: 962235 - RNA, 14 nt, Mycobacterium avium subsp. paratuberculosis
caccauccgcgcga

SEQ ID NO: 962236 - RNA, 20 nt, Mycobacterium avium subsp. paratuberculosis
caccaucgcgauggaagcgc

SEQ ID NO: 962237 - RNA, 18 nt, Mycobacterium avium subsp. paratuberculosis
caccaucggggugaccgu

SEQ ID NO: 962238 - RNA, 15 nt, Mycobacterium avium subsp. paratuberculosis
caccaucuccgcggc

SEQ ID NO: 962239 - RNA, 12 nt, Mycobacterium avium subsp. paratuberculosis
cacccaccggca

SEQ ID NO: 962240 - RNA, 12 nt, Mycobacterium avium subsp. paratuberculosis
cacccaccggcc

SEQ ID NO: 962241 - RNA, 22 nt, Mycobacterium avium subsp. paratuberculosis
cacccaccggcccagccggcgg

SEQ ID NO: 962242 - RNA, 13 nt, Mycobacterium avium subsp. paratuberculosis
cacccaccggcgc

SEQ ID NO: 962243 - RNA, 17 nt, Mycobacterium avium subsp. paratuberculosis
cacccaccggcgcagcg

SEQ ID NO: 962244 - RNA, 21 nt, Mycobacterium avium subsp. paratuberculosis
cacccaccggcgcagcgcguc

SEQ ID NO: 962245 - RNA, 19 nt, Mycobacterium avium subsp. paratuberculosis
cacccacgaacgucugcgg

SEQ ID NO: 962246 - RNA, 12 nt, Mycobacterium avium subsp. paratuberculosis
cacccacgccag

SEQ ID NO: 962247 - RNA, 15 nt, Mycobacterium avium subsp. paratuberculosis
cacccacgccagccg

SEQ ID NO: 962248 - RNA, 18 nt, Mycobacterium avium subsp. paratuberculosis
cacccacgccagccgggu

SEQ ID NO: 962249 - RNA, 22 nt, Mycobacterium avium subsp. paratuberculosis
cacccacucggacagguggccg

SEQ ID NO: 962250 - RNA, 20 nt, Mycobacterium avium subsp. paratuberculosis
cacccacuggcggccggccg

SEQ ID NO: 962251 - RNA, 18 nt, Mycobacterium avium subsp. paratuberculosis
caccaugaucagcgccgu

SEQ ID NO: 962252 - RNA, 22 nt, Mycobacterium avium subsp. paratuberculosis
caccaugaucagcgccguggcc

SEQ ID NO: 962253 - RNA, 23 nt, Mycobacterium avium subsp. paratuberculosis
caccaucuucacgaagugcccgg

SEQ ID NO: 962254 - RNA, 17 nt, Mycobacterium avium subsp. paratuberculosis
cacccaugauggugggc

SEQ ID NO: 962255 - RNA, 21 nt, Mycobacterium avium subsp. paratuberculosis
cacccaugauggugggcaccg

SEQ ID NO: 962256 - RNA, 22 nt, Mycobacterium avium subsp. paratuberculosis
cacccauucacgcagcuggcca

SEQ ID NO: 962257 - RNA, 18 nt, Mycobacterium avium subsp. paratuberculosis
cacccaggucaugguggc

SEQ ID NO: 962258 - RNA, 22 nt, Mycobacterium avium subsp. paratuberculosis
cacccaggucuuccggaugccg

SEQ ID NO: 962259 - RNA, 17 nt, Mycobacterium avium subsp. paratuberculosis
cacccagaugcccagcg

SEQ ID NO: 962260 - RNA, 23 nt, Mycobacterium avium subsp. paratuberculosis
cacccagacguguggcacccggg

SEQ ID NO: 962261 - RNA, 24 nt, Mycobacterium avium subsp. paratuberculosis
cacccagccgcugaacgcgaucca

SEQ ID NO: 962262 - RNA, 14 nt, Mycobacterium avium subsp. paratuberculosis
cacccagcgagccg

SEQ ID NO: 962263 - RNA, 18 nt, Mycobacterium avium subsp. paratuberculosis
cacccagcgagccgauga

SEQ ID NO: 962264 - RNA, 14 nt, Mycobacterium avium subsp. paratuberculosis
cacccagcggcgcg

SEQ ID NO: 962265 - RNA, 16 nt, Mycobacterium avium subsp. paratuberculosis
cacccagcggcgcggc

SEQ ID NO: 962266 - RNA, 15 nt, Mycobacterium avium subsp. paratuberculosis
cacccaggccacccg

SEQ ID NO: 962267 - RNA, 16 nt, Mycobacterium avium subsp. paratuberculosis
cacccaggccacccgg

SEQ ID NO: 962268 - RNA, 13 nt, Mycobacterium avium subsp. paratuberculosis
cacccagcgggcg

SEQ ID NO: 962269 - RNA, 16 nt, Mycobacterium avium subsp. paratuberculosis
cacccagcgggcgacg

SEQ ID NO: 962270 - RNA, 21 nt, Mycobacterium avium subsp. paratuberculosis
cacccagcgggcgacgucggg

SEQ ID NO: 962271 - RNA, 18 nt, Mycobacterium avium subsp. paratuberculosis
cacccaggaaaaccagcg

SEQ ID NO: 962272 - RNA, 21 nt, Mycobacterium avium subsp. paratuberculosis
cacccaggaaaaccagcgacg

SEQ ID NO: 962273 - RNA, 14 nt, Mycobacterium avium subsp. paratuberculosis
caccuucugcgcgc

SEQ ID NO: 962274 - RNA, 22 nt, Mycobacterium avium subsp. paratuberculosis
caccuucugcgcgccgucggcg

SEQ ID NO: 962275 - RNA, 23 nt, Mycobacterium avium subsp. paratuberculosis
caccuucugcgcgccgucggcgu

SEQ ID NO: 962276 - RNA, 16 nt, Mycobacterium avium subsp. paratuberculosis
caccuucaucgccguc

SEQ ID NO: 962277 - RNA, 16 nt, Mycobacterium avium subsp. paratuberculosis
caccuuggccggaucg

SEQ ID NO: 962278 - RNA, 20 nt, Mycobacterium avium subsp. paratuberculosis
caccuuggacaggcccagcg

SEQ ID NO: 962279 - RNA, 22 nt, Mycobacterium avium subsp. paratuberculosis
caccuuggacaggcccagcggc

SEQ ID NO: 962280 - RNA, 23 nt, Mycobacterium avium subsp. paratuberculosis
caccuuggacaggcccagcggcu

SEQ ID NO: 962281 - RNA, 23 nt, Mycobacterium avium subsp. paratuberculosis
caccuugcccugcgugcagacaa

SEQ ID NO: 962282 - RNA, 17 nt, Mycobacterium avium subsp. paratuberculosis
caccuugcgcagcagca

SEQ ID NO: 962283 - RNA, 17 nt, Mycobacterium avium subsp. paratuberculosis
caccuugcgcgggucgc

SEQ ID NO: 962284 - RNA, 16 nt, Mycobacterium avium subsp. paratuberculosis
caccuugcggccggcg

SEQ ID NO: 962285 - RNA, 16 nt, Mycobacterium avium subsp. paratuberculosis
caccuuucggccgcgg

SEQ ID NO: 962286 - RNA, 14 nt, Mycobacterium avium subsp. paratuberculosis
caccuugucgcuga

SEQ ID NO: 962287 - RNA, 14 nt, Mycobacterium avium subsp. paratuberculosis
caccuugucggcgc

SEQ ID NO: 962288 - RNA, 14 nt, Mycobacterium avium subsp. paratuberculosis
caccuuggugagca

SEQ ID NO: 962289 - RNA, 23 nt, Mycobacterium avium subsp. paratuberculosis
caccuugaucucgucgcggcugc

SEQ ID NO: 962290 - RNA, 15 nt, Mycobacterium avium subsp. paratuberculosis
caccuuggccggugc

SEQ ID NO: 962291 - RNA, 18 nt, Mycobacterium avium subsp. paratuberculosis
caccuuggcucggccgau

SEQ ID NO: 962292 - RNA, 12 nt, Mycobacterium avium subsp. paratuberculosis
cacgaagccgaa

SEQ ID NO: 962293 - RNA, 22 nt, Mycobacterium avium subsp. paratuberculosis
cacgaagccgaacgacagcagg

SEQ ID NO: 962294 - RNA, 14 nt, Mycobacterium avium subsp. paratuberculosis
cacgaacgcgccgc

SEQ ID NO: 962295 - RNA, 21 nt, Mycobacterium avium subsp. paratuberculosis
cacgaagaugaucagcgcgcc

SEQ ID NO: 962296 - RNA, 15 nt, Mycobacterium avium subsp. paratuberculosis
cacgaaggccgccgg

SEQ ID NO: 962297 - RNA, 17 nt, Mycobacterium avium subsp. paratuberculosis
cacgaagcgggcggcga

SEQ ID NO: 962298 - RNA, 18 nt, Mycobacterium avium subsp. paratuberculosis
cacgaagcgggcggcgaa

SEQ ID NO: 962299 - RNA, 23 nt, Mycobacterium avium subsp. paratuberculosis
cacgaacggguccuugccggcgg

SEQ ID NO: 962300 - RNA, 16 nt, Mycobacterium avium subsp. paratuberculosis
cacgaacgucaggccg

SEQ ID NO: 962301 - RNA, 19 nt, Mycobacterium avium subsp. paratuberculosis
cacgaacuccuugacccgg

SEQ ID NO: 962302 - RNA, 20 nt, Mycobacterium avium subsp. paratuberculosis
cacgaacuccuugacccggc

SEQ ID NO: 962303 - RNA, 21 nt, Mycobacterium avium subsp. paratuberculosis
cacgaagaacuugucgucguc

SEQ ID NO: 962304 - RNA, 19 nt, Mycobacterium avium subsp. paratuberculosis
cacgaagaaggcuccgccg

SEQ ID NO: 962305 - RNA, 17 nt, Mycobacterium avium subsp. paratuberculosis
cacgaaccaggcgccgg

SEQ ID NO: 962306 - RNA, 23 nt, Mycobacterium avium subsp. paratuberculosis
cacgaaccaggcgccggccagca

SEQ ID NO: 962307 - RNA, 14 nt, Mycobacterium avium subsp. paratuberculosis
cacgaacgacgcgg

SEQ ID NO: 962308 - RNA, 16 nt, Mycobacterium avium subsp. paratuberculosis
cacgaacgacgcggca

SEQ ID NO: 962309 - RNA, 14 nt, Mycobacterium avium subsp. paratuberculosis
cacgaacgcggccg

SEQ ID NO: 962310 - RNA, 15 nt, Mycobacterium avium subsp. paratuberculosis
cacgaacgcggccgc

SEQ ID NO: 962311 - RNA, 17 nt, Mycobacterium avium subsp. paratuberculosis
cacgaacgcggccgcca

SEQ ID NO: 962312 - RNA, 19 nt, Mycobacterium avium subsp. paratuberculosis
cacgaacgcugccaggcgg

SEQ ID NO: 962313 - RNA, 13 nt, Mycobacterium avium subsp. paratuberculosis
cacgaacggcgcc

SEQ ID NO: 962314 - RNA, 14 nt, Mycobacterium avium subsp. paratuberculosis
cacgaacaccggcg

SEQ ID NO: 962315 - RNA, 17 nt, Mycobacterium avium subsp. paratuberculosis
cacgaacaccggcgcga

SEQ ID NO: 962316 - RNA, 20 nt, Mycobacterium avium subsp. paratuberculosis
cacgaacaccggcgcgacca

SEQ ID NO: 962317 - RNA, 22 nt, Mycobacterium avium subsp. paratuberculosis
cacgaacaccggcgcgaccaca

SEQ ID NO: 962318 - RNA, 15 nt, Mycobacterium avium subsp. paratuberculosis
cacgaacccggcggc

SEQ ID NO: 962319 - RNA, 17 nt, Mycobacterium avium subsp. paratuberculosis
cacgaaauaaccgcgcg

SEQ ID NO: 962320 - RNA, 22 nt, Mycobacterium avium subsp. paratuberculosis
cacgaaauaaccgcgcggcgcc

SEQ ID NO: 962321 - RNA, 16 nt, Mycobacterium avium subsp. paratuberculosis
caccugugaggcaccg

SEQ ID NO: 962322 - RNA, 18 nt, Mycobacterium avium subsp. paratuberculosis
caccuuccaccaccgcgg

SEQ ID NO: 962323 - RNA, 21 nt, Mycobacterium avium subsp. paratuberculosis
caccuuccaccaccgcggcgc

SEQ ID NO: 962324 - RNA, 16 nt, Mycobacterium avium subsp. paratuberculosis
caccuucagcgggcgc

SEQ ID NO: 962325 - RNA, 20 nt, Mycobacterium avium subsp. paratuberculosis
caccuucagcgggcgcagcu

SEQ ID NO: 962326 - RNA, 22 nt, Mycobacterium avium subsp. paratuberculosis
caccugguugaacggcaccccg

SEQ ID NO: 962327 - RNA, 16 nt, Mycobacterium avium subsp. paratuberculosis
caccuggcugugcacg

SEQ ID NO: 962328 - RNA, 17 nt, Mycobacterium avium subsp. paratuberculosis
caccuggcugugcacga

SEQ ID NO: 962329 - RNA, 19 nt, Mycobacterium avium subsp. paratuberculosis
caccugggagaacucgauc

SEQ ID NO: 962330 - RNA, 19 nt, Mycobacterium avium subsp. paratuberculosis
caccugguccugccccggg

SEQ ID NO: 962331 - RNA, 16 nt, Mycobacterium avium subsp. paratuberculosis
caccuggucggguucg

SEQ ID NO: 962332 - RNA, 14 nt, Mycobacterium avium subsp. paratuberculosis
caccuggugcucgc

SEQ ID NO: 962333 - RNA, 15 nt, Mycobacterium avium subsp. paratuberculosis
caccuggugcucgcg

SEQ ID NO: 962334 - RNA, 16 nt, Mycobacterium avium subsp. paratuberculosis
caccuggugcucgcgc

SEQ ID NO: 962335 - RNA, 19 nt, Mycobacterium avium subsp. paratuberculosis
caccuggugcucgcgcucg

SEQ ID NO: 962336 - RNA, 14 nt, Mycobacterium avium subsp. paratuberculosis
caccugccgucgac

SEQ ID NO: 962337 - RNA, 15 nt, Mycobacterium avium subsp. paratuberculosis
caccugccgucgacg

SEQ ID NO: 962338 - RNA, 16 nt, Mycobacterium avium subsp. paratuberculosis
caccugccgucgacga

SEQ ID NO: 962339 - RNA, 14 nt, Mycobacterium avium subsp. paratuberculosis
caccugcggcccgu

SEQ ID NO: 962340 - RNA, 19 nt, Mycobacterium avium subsp. paratuberculosis
caccugcggcccgucgccg

SEQ ID NO: 962341 - RNA, 23 nt, Mycobacterium avium subsp. paratuberculosis
caccugcggcccgucgccgugcg

SEQ ID NO: 962342 - RNA, 13 nt, Mycobacterium avium subsp. paratuberculosis
caccugcgcgccg

SEQ ID NO: 962343 - RNA, 13 nt, Mycobacterium avium subsp. paratuberculosis
caccugcgguucg

SEQ ID NO: 962344 - RNA, 19 nt, Mycobacterium avium subsp. paratuberculosis
caccugcucaccgagcugg

SEQ ID NO: 962345 - RNA, 19 nt, Mycobacterium avium subsp. paratuberculosis
caccuggccguucaggucg

SEQ ID NO: 962346 - RNA, 22 nt, Mycobacterium avium subsp. paratuberculosis
caccuggccguucaggucgauc

SEQ ID NO: 962347 - RNA, 14 nt, Mycobacterium avium subsp. paratuberculosis
caccuggcgcaccg

SEQ ID NO: 962348 - RNA, 22 nt, Mycobacterium avium subsp. paratuberculosis
caccuggcgcaccgccgcggga

SEQ ID NO: 962349 - RNA, 14 nt, Mycobacterium avium subsp. paratuberculosis
caccuggcgcagca

SEQ ID NO: 962350 - RNA, 17 nt, Mycobacterium avium subsp. paratuberculosis
caccuggcgcagcaccg

SEQ ID NO: 962351 - RNA, 22 nt, Mycobacterium avium subsp. paratuberculosis
caccuggcagcauccgccgacg

SEQ ID NO: 962352 - RNA, 14 nt, Mycobacterium avium subsp. paratuberculosis
caccuggccggcca

SEQ ID NO: 962353 - RNA, 17 nt, Mycobacterium avium subsp. paratuberculosis
caccuggaagcgcaucg

SEQ ID NO: 962354 - RNA, 20 nt, Mycobacterium avium subsp. paratuberculosis
caccuggaagcgcaucgccg

SEQ ID NO: 962355 - RNA, 17 nt, Mycobacterium avium subsp. paratuberculosis
cacgaucagcgcgucga

SEQ ID NO: 962356 - RNA, 17 nt, Mycobacterium avium subsp. paratuberculosis
cacgauccaaccgaguc

SEQ ID NO: 962357 - RNA, 13 nt, Mycobacterium avium subsp. paratuberculosis
cacgauccgcgcg

SEQ ID NO: 962358 - RNA, 17 nt, Mycobacterium avium subsp. paratuberculosis
cacgauccgcgcggcca

SEQ ID NO: 962359 - RNA, 24 nt, Mycobacterium avium subsp. paratuberculosis
cacgauccgcgcggccaccagcgc

SEQ ID NO: 962360 - RNA, 12 nt, Mycobacterium avium subsp. paratuberculosis
cacgaucgagcc

SEQ ID NO: 962361 - RNA, 18 nt, Mycobacterium avium subsp. paratuberculosis
cacgaucaccaccaccgc

SEQ ID NO: 962362 - RNA, 20 nt, Mycobacterium avium subsp. paratuberculosis
cacgaucgcgaucgccgauc

SEQ ID NO: 962363 - RNA, 21 nt, Mycobacterium avium subsp. paratuberculosis
cacgaucgcgaucgccgaucc

SEQ ID NO: 962364 - RNA, 22 nt, Mycobacterium avium subsp. paratuberculosis
cacgaucgcggugacgcgccgg

SEQ ID NO: 962365 - RNA, 15 nt, Mycobacterium avium subsp. paratuberculosis
cacgaucggcagcgc

SEQ ID NO: 962366 - RNA, 16 nt, Mycobacterium avium subsp. paratuberculosis
cacgaucggcagcgcc

SEQ ID NO: 962367 - RNA, 17 nt, Mycobacterium avium subsp. paratuberculosis
cacgaucggcagcgcca

SEQ ID NO: 962368 - RNA, 20 nt, Mycobacterium avium subsp. paratuberculosis
cacgaucggcagcgccaaca

SEQ ID NO: 962369 - RNA, 14 nt, Mycobacterium avium subsp. paratuberculosis
cacgaucggcauga

SEQ ID NO: 962370 - RNA, 22 nt, Mycobacterium avium subsp. paratuberculosis
cacgaucggcaugacgcccagc

SEQ ID NO: 962371 - RNA, 16 nt, Mycobacterium avium subsp. paratuberculosis
cacgaucgucgccgcc

SEQ ID NO: 962372 - RNA, 22 nt, Mycobacterium avium subsp. paratuberculosis
cacgaucgucgccgccaacgcg

SEQ ID NO: 962373 - RNA, 16 nt, Mycobacterium avium subsp. paratuberculosis
cacgaucucggcgguc

SEQ ID NO: 962374 - RNA, 16 nt, Mycobacterium avium subsp. paratuberculosis
cacgaucucggucgcc

SEQ ID NO: 962375 - RNA, 19 nt, Mycobacterium avium subsp. paratuberculosis
cacgaucucggucgccagc

SEQ ID NO: 962376 - RNA, 20 nt, Mycobacterium avium subsp. paratuberculosis
cacgaucucggucgccagca

SEQ ID NO: 962377 - RNA, 20 nt, Mycobacterium avium subsp. paratuberculosis
cacgagcagccgaucuggcg

SEQ ID NO: 962378 - RNA, 21 nt, Mycobacterium avium subsp. paratuberculosis
cacgagcgaacacgugcagcu

SEQ ID NO: 962379 - RNA, 14 nt, Mycobacterium avium subsp. paratuberculosis
cacgagcgucgugc

SEQ ID NO: 962380 - RNA, 21 nt, Mycobacterium avium subsp. paratuberculosis
cacgagcgucgugcgggcucc

SEQ ID NO: 962381 - RNA, 15 nt, Mycobacterium avium subsp. paratuberculosis
cacgagcuccagcua

SEQ ID NO: 962382 - RNA, 16 nt, Mycobacterium avium subsp. paratuberculosis
cacgagcuccagcuag

SEQ ID NO: 962383 - RNA, 18 nt, Mycobacterium avium subsp. paratuberculosis
cacgaggccgggcuggcg

SEQ ID NO: 962384 - RNA, 23 nt, Mycobacterium avium subsp. paratuberculosis
cacgaggccgggcuggcgcugga

SEQ ID NO: 962385 - RNA, 16 nt, Mycobacterium avium subsp. paratuberculosis
cacgacuccuggccga

SEQ ID NO: 962386 - RNA, 16 nt, Mycobacterium avium subsp. paratuberculosis
cacgacugcgcggccg

SEQ ID NO: 962387 - RNA, 18 nt, Mycobacterium avium subsp. paratuberculosis
cacgacugcgcggccggc

SEQ ID NO: 962388 - RNA, 19 nt, Mycobacterium avium subsp. paratuberculosis
cacgacugcgcggccggcg

SEQ ID NO: 962389 - RNA, 20 nt, Mycobacterium avium subsp. paratuberculosis
cacgacugcgcggccggcgu

SEQ ID NO: 962390 - RNA, 18 nt, Mycobacterium avium subsp. paratuberculosis
cacgacuucacaggccgc

SEQ ID NO: 962391 - RNA, 18 nt, Mycobacterium avium subsp. paratuberculosis
cacgagcagacccgccgc

SEQ ID NO: 962392 - RNA, 19 nt, Mycobacterium avium subsp. paratuberculosis
cacgagcagacccgccgcg

SEQ ID NO: 962393 - RNA, 13 nt, Mycobacterium avium subsp. paratuberculosis
cacgacgccgccg

SEQ ID NO: 962394 - RNA, 14 nt, Mycobacterium avium subsp. paratuberculosis
cacgacgccgccga

SEQ ID NO: 962395 - RNA, 18 nt, Mycobacterium avium subsp. paratuberculosis
cacgacgccgccgagggg

SEQ ID NO: 962396 - RNA, 18 nt, Mycobacterium avium subsp. paratuberculosis
cacgacgccgcugggcgu

SEQ ID NO: 962397 - RNA, 21 nt, Mycobacterium avium subsp. paratuberculosis
cacgacgaccgcgacggcgcc

SEQ ID NO: 962398 - RNA, 14 nt, Mycobacterium avium subsp. paratuberculosis
cacgacgaccgcgu

SEQ ID NO: 962399 - RNA, 22 nt, Mycobacterium avium subsp. paratuberculosis
cacgacgacugggugcgcgggc

SEQ ID NO: 962400 - RNA, 15 nt, Mycobacterium avium subsp. paratuberculosis
cacgaccuggcgggc

SEQ ID NO: 962401 - RNA, 17 nt, Mycobacterium avium subsp. paratuberculosis
cacgacgaacaccaccg

SEQ ID NO: 962402 - RNA, 19 nt, Mycobacterium avium subsp. paratuberculosis
cacgacgaacaccaccggc

SEQ ID NO: 962403 - RNA, 20 nt, Mycobacterium avium subsp. paratuberculosis
cacgacgaacaccaccggca

SEQ ID NO: 962404 - RNA, 21 nt, Mycobacterium avium subsp. paratuberculosis
cacgacggcgcuggccgcggc

SEQ ID NO: 962405 - RNA, 14 nt, Mycobacterium avium subsp. paratuberculosis
cacgacgcgaccga

SEQ ID NO: 962406 - RNA, 18 nt, Mycobacterium avium subsp. paratuberculosis
cacgacgcgaccgagguc

SEQ ID NO: 962407 - RNA, 17 nt, Mycobacterium avium subsp. paratuberculosis
cacgacgcggcgcgcga

SEQ ID NO: 962408 - RNA, 20 nt, Mycobacterium avium subsp. paratuberculosis
cacgacgcggucugcggugc

SEQ ID NO: 962409 - RNA, 21 nt, Mycobacterium avium subsp. paratuberculosis
cacgacgcggucugcggugcg

SEQ ID NO: 962410 - RNA, 18 nt, Mycobacterium avium subsp. paratuberculosis
cacgacguccucgacgau

SEQ ID NO: 962411 - RNA, 14 nt, Mycobacterium avium subsp. paratuberculosis
cacgacgucgagcc

SEQ ID NO: 962412 - RNA, 17 nt, Mycobacterium avium subsp. paratuberculosis
cacgacgucugggccgc

SEQ ID NO: 962413 - RNA, 18 nt, Mycobacterium avium subsp. paratuberculosis
cacgacgucugggccgcc

SEQ ID NO: 962414 - RNA, 20 nt, Mycobacterium avium subsp. paratuberculosis
cacgacgucugggccgccga

SEQ ID NO: 962415 - RNA, 19 nt, Mycobacterium avium subsp. paratuberculosis
cacgaccucggggucggcc

SEQ ID NO: 962416 - RNA, 22 nt, Mycobacterium avium subsp. paratuberculosis
cacgaagggcgccagcaccucg

SEQ ID NO: 962417 - RNA, 23 nt, Mycobacterium avium subsp. paratuberculosis
cacgaagucaaaccccuuggcgu

SEQ ID NO: 962418 - RNA, 23 nt, Mycobacterium avium subsp. paratuberculosis
cacgaagucguuggggaugucga

SEQ ID NO: 962419 - RNA, 14 nt, Mycobacterium avium subsp. paratuberculosis
cacgaagugcccgg

SEQ ID NO: 962420 - RNA, 18 nt, Mycobacterium avium subsp. paratuberculosis
cacgaauugccgguggug

SEQ ID NO: 962421 - RNA, 23 nt, Mycobacterium avium subsp. paratuberculosis
cacgaaguugaucgcggcggaca

SEQ ID NO: 962422 - RNA, 16 nt, Mycobacterium avium subsp. paratuberculosis
cacgacaccagcgucg

SEQ ID NO: 962423 - RNA, 16 nt, Mycobacterium avium subsp. paratuberculosis
cacgaccacacccgca

SEQ ID NO: 962424 - RNA, 18 nt, Mycobacterium avium subsp. paratuberculosis
cacgaccacacccgcacg

SEQ ID NO: 962425 - RNA, 23 nt, Mycobacterium avium subsp. paratuberculosis
cacgacauccccgcaaacacgag

SEQ ID NO: 962426 - RNA, 18 nt, Mycobacterium avium subsp. paratuberculosis
cacgaccagugcccggcc

SEQ ID NO: 962427 - RNA, 14 nt, Mycobacterium avium subsp. paratuberculosis
cacgaccaugucgg

SEQ ID NO: 962428 - RNA, 19 nt, Mycobacterium avium subsp. paratuberculosis
cacgaccaugucggcgacc

SEQ ID NO: 962429 - RNA, 14 nt, Mycobacterium avium subsp. paratuberculosis
cacgaccccggcgg

SEQ ID NO: 962430 - RNA, 13 nt, Mycobacterium avium subsp. paratuberculosis
cacgaccagcggc

SEQ ID NO: 962431 - RNA, 15 nt, Mycobacterium avium subsp. paratuberculosis
cacgaccccggcggc

SEQ ID NO: 962432 - RNA, 17 nt, Mycobacterium avium subsp. paratuberculosis
cacgaccgccagcagca

SEQ ID NO: 962433 - RNA, 13 nt, Mycobacterium avium subsp. paratuberculosis
cacgaccggcagc

SEQ ID NO: 962434 - RNA, 17 nt, Mycobacterium avium subsp. paratuberculosis
cacgaccggcagcaccg

SEQ ID NO: 962435 - RNA, 15 nt, Mycobacterium avium subsp. paratuberculosis
cacgaugggucaggu

SEQ ID NO: 962436 - RNA, 13 nt, Mycobacterium avium subsp. paratuberculosis
cacgaugcgcugu

SEQ ID NO: 962437 - RNA, 23 nt, Mycobacterium avium subsp. paratuberculosis
cacgaugugaugggucugcgccu

SEQ ID NO: 962438 - RNA, 20 nt, Mycobacterium avium subsp. paratuberculosis
cacgauguugaugucgcgcg

SEQ ID NO: 962439 - RNA, 20 nt, Mycobacterium avium subsp. paratuberculosis
cacgauggcggcccagaucg

SEQ ID NO: 962440 - RNA, 19 nt, Mycobacterium avium subsp. paratuberculosis
cacgauggggacgucgacg

SEQ ID NO: 962441 - RNA, 15 nt, Mycobacterium avium subsp. paratuberculosis
cacgauggcgcggcg

SEQ ID NO: 962442 - RNA, 19 nt, Mycobacterium avium subsp. paratuberculosis
cacgauggcgcggcgcacc

SEQ ID NO: 962443 - RNA, 20 nt, Mycobacterium avium subsp. paratuberculosis
cacgauggcgcggcgcaccg

SEQ ID NO: 962444 - RNA, 16 nt, Mycobacterium avium subsp. paratuberculosis
cacgaugccgcgcucg

SEQ ID NO: 962445 - RNA, 13 nt, Mycobacterium avium subsp. paratuberculosis
cacgaugcggugc

SEQ ID NO: 962446 - RNA, 16 nt, Mycobacterium avium subsp. paratuberculosis
cacgaugcggugccgg

SEQ ID NO: 962447 - RNA, 14 nt, Mycobacterium avium subsp. paratuberculosis
cacgaugcguuggu

SEQ ID NO: 962448 - RNA, 22 nt, Mycobacterium avium subsp. paratuberculosis
cacgaugcguugguguagccga

SEQ ID NO: 962449 - RNA, 15 nt, Mycobacterium avium subsp. paratuberculosis
cacgaugaucgucgg

SEQ ID NO: 962450 - RNA, 14 nt, Mycobacterium avium subsp. paratuberculosis
cacgaugaucccga

SEQ ID NO: 962451 - RNA, 16 nt, Mycobacterium avium subsp. paratuberculosis
cacgaugacgaccggg

SEQ ID NO: 962452 - RNA, 13 nt, Mycobacterium avium subsp. paratuberculosis
cacgaugacggug

SEQ ID NO: 962453 - RNA, 14 nt, Mycobacterium avium subsp. paratuberculosis
cacgaugacggugg

SEQ ID NO: 962454 - RNA, 22 nt, Mycobacterium avium subsp. paratuberculosis
cacgaugaacuccucgaucguc

SEQ ID NO: 962455 - RNA, 23 nt, Mycobacterium avium subsp. paratuberculosis
cacgaugaacuccucgaucgucc

SEQ ID NO: 962456 - RNA, 15 nt, Mycobacterium avium subsp. paratuberculosis
cacgaugaagccgug

SEQ ID NO: 962457 - RNA, 17 nt, Mycobacterium avium subsp. paratuberculosis
cacgaugaagccgugcc

SEQ ID NO: 962458 - RNA, 20 nt, Mycobacterium avium subsp. paratuberculosis
cacgcacggcgaacggccgc

SEQ ID NO: 962459 - RNA, 21 nt, Mycobacterium avium subsp. paratuberculosis
cacgcacggcgaacggccgcg

SEQ ID NO: 962460 - RNA, 20 nt, Mycobacterium avium subsp. paratuberculosis
cacgcagaacucgucgccac

SEQ ID NO: 962461 - RNA, 22 nt, Mycobacterium avium subsp. paratuberculosis
cacgcaggcguccagggccacc

SEQ ID NO: 962462 - RNA, 14 nt, Mycobacterium avium subsp. paratuberculosis
cacgccacucgucg

SEQ ID NO: 962463 - RNA, 15 nt, Mycobacterium avium subsp. paratuberculosis
cacgccacucgucga

SEQ ID NO: 962464 - RNA, 19 nt, Mycobacterium avium subsp. paratuberculosis
cacgccagccaggcgauga

SEQ ID NO: 962465 - RNA, 16 nt, Mycobacterium avium subsp. paratuberculosis
cacgccagcgugacgc

SEQ ID NO: 962466 - RNA, 17 nt, Mycobacterium avium subsp. paratuberculosis
cacgccagcgugacgcc

SEQ ID NO: 962467 - RNA, 19 nt, Mycobacterium avium subsp. paratuberculosis
cacgccagcgugacgcccg

SEQ ID NO: 962468 - RNA, 20 nt, Mycobacterium avium subsp. paratuberculosis
cacgccagcgugacgcccgg

SEQ ID NO: 962469 - RNA, 18 nt, Mycobacterium avium subsp. paratuberculosis
cacgccagcgugacgccg

SEQ ID NO: 962470 - RNA, 19 nt, Mycobacterium avium subsp. paratuberculosis
cacgccagcgugacgccgg

SEQ ID NO: 962471 - RNA, 19 nt, Mycobacterium avium subsp. paratuberculosis
cacgccagcgugacgcucg

SEQ ID NO: 962472 - RNA, 20 nt, Mycobacterium avium subsp. paratuberculosis
cacgccagcgugacgcucgg

SEQ ID NO: 962473 - RNA, 14 nt, Mycobacterium avium subsp. paratuberculosis
cacgcagucgucga

SEQ ID NO: 962474 - RNA, 19 nt, Mycobacterium avium subsp. paratuberculosis
cacgcagugccgcaccagc

SEQ ID NO: 962475 - RNA, 23 nt, Mycobacterium avium subsp. paratuberculosis
cacgcagugccgcaccagcaccc

SEQ ID NO: 962476 - RNA, 16 nt, Mycobacterium avium subsp. paratuberculosis
cacgcaguguccgauc

SEQ ID NO: 962477 - RNA, 17 nt, Mycobacterium avium subsp. paratuberculosis
cacgcagguccaggauc

SEQ ID NO: 962478 - RNA, 22 nt, Mycobacterium avium subsp. paratuberculosis
cacgccaguguggccgcggcgg

SEQ ID NO: 962479 - RNA, 13 nt, Mycobacterium avium subsp. paratuberculosis
cacgcccagcgcc

SEQ ID NO: 962480 - RNA, 14 nt, Mycobacterium avium subsp. paratuberculosis
cacgcccagcgccc

SEQ ID NO: 962481 - RNA, 13 nt, Mycobacterium avium subsp. paratuberculosis
cacgcccagaucg

SEQ ID NO: 962482 - RNA, 19 nt, Mycobacterium avium subsp. paratuberculosis
cacgcccagaucgacgccg

SEQ ID NO: 962483 - RNA, 20 nt, Mycobacterium avium subsp. paratuberculosis
cacgcccagaucgacgccga

SEQ ID NO: 962484 - RNA, 22 nt, Mycobacterium avium subsp. paratuberculosis
cacgcccagaucgacgccgacc

SEQ ID NO: 962485 - RNA, 20 nt, Mycobacterium avium subsp. paratuberculosis
cacgcccagaucgccgaccc

SEQ ID NO: 962486 - RNA, 13 nt, Mycobacterium avium subsp. paratuberculosis
cacgcccgcagcg

SEQ ID NO: 962487 - RNA, 15 nt, Mycobacterium avium subsp. paratuberculosis
cacgcccgacgacga

SEQ ID NO: 962488 - RNA, 19 nt, Mycobacterium avium subsp. paratuberculosis
cacgccccauugccgcgcc

SEQ ID NO: 962489 - RNA, 15 nt, Mycobacterium avium subsp. paratuberculosis
cacgcccccgcuggc

SEQ ID NO: 962490 - RNA, 22 nt, Mycobacterium avium subsp. paratuberculosis
cacgcccccgcuggcccggcgu

SEQ ID NO: 962491 - RNA, 15 nt, Mycobacterium avium subsp. paratuberculosis
cacgccccgacagga

SEQ ID NO: 962492 - RNA, 14 nt, Mycobacterium avium subsp. paratuberculosis
cacgccccggcgcc

SEQ ID NO: 962493 - RNA, 13 nt, Mycobacterium avium subsp. paratuberculosis
cacgccccggcgg

SEQ ID NO: 962494 - RNA, 15 nt, Mycobacterium avium subsp. paratuberculosis
cacgccccggcgggu

SEQ ID NO: 962495 - RNA, 19 nt, Mycobacterium avium subsp. paratuberculosis
cacgcccaugaucacaccg

SEQ ID NO: 962496 - RNA, 15 nt, Mycobacterium avium subsp. paratuberculosis
cacgccccagguucc

SEQ ID NO: 962497 - RNA, 13 nt, Mycobacterium avium subsp. paratuberculosis
cacgcccagcccg

SEQ ID NO: 962498 - RNA, 15 nt, Mycobacterium avium subsp. paratuberculosis
cacgccggcacaccg

SEQ ID NO: 962499 - RNA, 20 nt, Mycobacterium avium subsp. paratuberculosis
cacgccggcacaccgagcga

SEQ ID NO: 962500 - RNA, 14 nt, Mycobacterium avium subsp. paratuberculosis
cacgccgcgcauca

SEQ ID NO: 962501 - RNA, 20 nt, Mycobacterium avium subsp. paratuberculosis
cacgccgcgggaggcccagu

SEQ ID NO: 962502 - RNA, 20 nt, Mycobacterium avium subsp. paratuberculosis
cacgccgcggucgcugaccc

SEQ ID NO: 962503 - RNA, 21 nt, Mycobacterium avium subsp. paratuberculosis
cacgccggccguucgccggcc

SEQ ID NO: 962504 - RNA, 15 nt, Mycobacterium avium subsp. paratuberculosis
cacgccggccggcgu

SEQ ID NO: 962505 - RNA, 15 nt, Mycobacterium avium subsp. paratuberculosis
cacgccgggcauccg

SEQ ID NO: 962506 - RNA, 17 nt, Mycobacterium avium subsp. paratuberculosis
cacgccgggcauccgcc

SEQ ID NO: 962507 - RNA, 17 nt, Mycobacterium avium subsp. paratuberculosis
cacgccggguugggcgg

SEQ ID NO: 962508 - RNA, 21 nt, Mycobacterium avium subsp. paratuberculosis
cacgccggguugggcggcggc

SEQ ID NO: 962509 - RNA, 22 nt, Mycobacterium avium subsp. paratuberculosis
cacgccggguuuguccggccag

SEQ ID NO: 962510 - RNA, 18 nt, Mycobacterium avium subsp. paratuberculosis
cacgccggucagcaccau

SEQ ID NO: 962511 - RNA, 13 nt, Mycobacterium avium subsp. paratuberculosis
cacgccggugacc

SEQ ID NO: 962512 - RNA, 12 nt, Mycobacterium avium subsp. paratuberculosis
cacgccggcggg

SEQ ID NO: 962513 - RNA, 20 nt, Mycobacterium avium subsp. paratuberculosis
cacgccgggcaugccguuca

SEQ ID NO: 962514 - RNA, 20 nt, Mycobacterium avium subsp. paratuberculosis
cacgccggugagcacgaccg

SEQ ID NO: 962515 - RNA, 23 nt, Mycobacterium avium subsp. paratuberculosis
cacgccggugagcacgaccgcca

SEQ ID NO: 962516 - RNA, 13 nt, Mycobacterium avium subsp. paratuberculosis
cacgccggcgggg

SEQ ID NO: 962517 - RNA, 19 nt, Mycobacterium avium subsp. paratuberculosis
cacgccggcggggguucga

SEQ ID NO: 962518 - RNA, 13 nt, Mycobacterium avium subsp. paratuberculosis
cacgccggcgauc

SEQ ID NO: 962519 - RNA, 13 nt, Mycobacterium avium subsp. paratuberculosis
cacgccucgucga

SEQ ID NO: 962520 - RNA, 16 nt, Mycobacterium avium subsp. paratuberculosis
cacgccucgucgagca

SEQ ID NO: 962521 - RNA, 16 nt, Mycobacterium avium subsp. paratuberculosis
cacgccguggcggcgg

SEQ ID NO: 962522 - RNA, 18 nt, Mycobacterium avium subsp. paratuberculosis
cacgccguggcggcgggc

SEQ ID NO: 962523 - RNA, 20 nt, Mycobacterium avium subsp. paratuberculosis
cacgccguggcggcgggcca

SEQ ID NO: 962524 - RNA, 16 nt, Mycobacterium avium subsp. paratuberculosis
cacgccguugaccccg

SEQ ID NO: 962525 - RNA, 13 nt, Mycobacterium avium subsp. paratuberculosis
cacgccguugggc

SEQ ID NO: 962526 - RNA, 22 nt, Mycobacterium avium subsp. paratuberculosis
cacgccguauucgccgacgguc

SEQ ID NO: 962527 - RNA, 13 nt, Mycobacterium avium subsp. paratuberculosis
cacgccgucgacg

SEQ ID NO: 962528 - RNA, 22 nt, Mycobacterium avium subsp. paratuberculosis
cacgccgucgacgaucugcaca

SEQ ID NO: 962529 - RNA, 21 nt, Mycobacterium avium subsp. paratuberculosis
cacgccguggcccgcccagcg

SEQ ID NO: 962530 - RNA, 22 nt, Mycobacterium avium subsp. paratuberculosis
cacgccguggcccgcccagcgc

SEQ ID NO: 962531 - RNA, 12 nt, Mycobacterium avium subsp. paratuberculosis
cacgccguggcg

SEQ ID NO: 962532 - RNA, 21 nt, Mycobacterium avium subsp. paratuberculosis
cacgccguacaccgugcccga

SEQ ID NO: 962533 - RNA, 23 nt, Mycobacterium avium subsp. paratuberculosis
cacgccgucgucguuguuggcgg

SEQ ID NO: 962534 - RNA, 19 nt, Mycobacterium avium subsp. paratuberculosis
cacgccgucgugcucggcg

SEQ ID NO: 962535 - RNA, 21 nt, Mycobacterium avium subsp. paratuberculosis
cacgccgucgugcucggcgag

SEQ ID NO: 962536 - RNA, 23 nt, Mycobacterium avium subsp. paratuberculosis
cacgccgucgugcucggcgagca

SEQ ID NO: 962537 - RNA, 18 nt, Mycobacterium avium subsp. paratuberculosis
cacgccgugcagaacagc

SEQ ID NO: 962538 - RNA, 15 nt, Mycobacterium avium subsp. paratuberculosis
cacgccgcccaggcc

SEQ ID NO: 962539 - RNA, 20 nt, Mycobacterium avium subsp. paratuberculosis
cacgccgcccaggccccggc

SEQ ID NO: 962540 - RNA, 19 nt, Mycobacterium avium subsp. paratuberculosis
cacgccgcccccgccgcga

SEQ ID NO: 962541 - RNA, 22 nt, Mycobacterium avium subsp. paratuberculosis
cacgccgcccccgccgcgagca

SEQ ID NO: 962542 - RNA, 14 nt, Mycobacterium avium subsp. paratuberculosis
cacgccgcgcccgu

SEQ ID NO: 962543 - RNA, 20 nt, Mycobacterium avium subsp. paratuberculosis
cacgccgcgcccgucgagcg

SEQ ID NO: 962544 - RNA, 22 nt, Mycobacterium avium subsp. paratuberculosis
cacgccgccgggaacagcgacg

SEQ ID NO: 962545 - RNA, 13 nt, Mycobacterium avium subsp. paratuberculosis
cacgccgccgggg

SEQ ID NO: 962546 - RNA, 21 nt, Mycobacterium avium subsp. paratuberculosis
cacgccgacuagcgcggcggc

SEQ ID NO: 962547 - RNA, 22 nt, Mycobacterium avium subsp. paratuberculosis
cacgccgacuagcgcggcggcc

SEQ ID NO: 962548 - RNA, 14 nt, Mycobacterium avium subsp. paratuberculosis
cacgccgagcagca

SEQ ID NO: 962549 - RNA, 20 nt, Mycobacterium avium subsp. paratuberculosis
cacgccgagcagcaccggca

SEQ ID NO: 962550 - RNA, 13 nt, Mycobacterium avium subsp. paratuberculosis
cacgccgaggcgu

SEQ ID NO: 962551 - RNA, 17 nt, Mycobacterium avium subsp. paratuberculosis
cacgccgaggcgugccg

SEQ ID NO: 962552 - RNA, 19 nt, Mycobacterium avium subsp. paratuberculosis
cacgccgaggcgugccgcu

SEQ ID NO: 962553 - RNA, 19 nt, Mycobacterium avium subsp. paratuberculosis
cacgccgagggcggcggcu

SEQ ID NO: 962554 - RNA, 14 nt, Mycobacterium avium subsp. paratuberculosis
cacgccgagggugc

SEQ ID NO: 962555 - RNA, 17 nt, Mycobacterium avium subsp. paratuberculosis
cacgccgagggugccgg

SEQ ID NO: 962556 - RNA, 23 nt, Mycobacterium avium subsp. paratuberculosis
cacgccgagggugccggccaccg

SEQ ID NO: 962557 - RNA, 14 nt, Mycobacterium avium subsp. paratuberculosis
cacgccgacgaaca

SEQ ID NO: 962558 - RNA, 14 nt, Mycobacterium avium subsp. paratuberculosis
cacgccgacgaucc

SEQ ID NO: 962559 - RNA, 13 nt, Mycobacterium avium subsp. paratuberculosis
cacgccgacaccg

SEQ ID NO: 962560 - RNA, 16 nt, Mycobacterium avium subsp. paratuberculosis
cacgccgacaccgucg

SEQ ID NO: 962561 - RNA, 13 nt, Mycobacterium avium subsp. paratuberculosis
cacgccgaccacc

SEQ ID NO: 962562 - RNA, 15 nt, Mycobacterium avium subsp. paratuberculosis
cacgccgaccagguc

SEQ ID NO: 962563 - RNA, 19 nt, Mycobacterium avium subsp. paratuberculosis
cacgcccuggccgccggcc

SEQ ID NO: 962564 - RNA, 20 nt, Mycobacterium avium subsp. paratuberculosis
cacgcccuggaaggcgauca

SEQ ID NO: 962565 - RNA, 23 nt, Mycobacterium avium subsp. paratuberculosis
cacgcccugcagguucugcacgu

SEQ ID NO: 962566 - RNA, 21 nt, Mycobacterium avium subsp. paratuberculosis
cacgcccucuucuucgagguc

SEQ ID NO: 962567 - RNA, 17 nt, Mycobacterium avium subsp. paratuberculosis
cacgcccguugacgccc

SEQ ID NO: 962568 - RNA, 19 nt, Mycobacterium avium subsp. paratuberculosis
cacgcccggggugaugccg

SEQ ID NO: 962569 - RNA, 13 nt, Mycobacterium avium subsp. paratuberculosis
cacgcccggguac

SEQ ID NO: 962570 - RNA, 20 nt, Mycobacterium avium subsp. paratuberculosis
cacgcccgcgaucggcgcca

SEQ ID NO: 962571 - RNA, 23 nt, Mycobacterium avium subsp. paratuberculosis
cacgcccgcgaucggcgccacga

SEQ ID NO: 962572 - RNA, 15 nt, Mycobacterium avium subsp. paratuberculosis
cacgcccacgccgag

SEQ ID NO: 962573 - RNA, 14 nt, Mycobacterium avium subsp. paratuberculosis
caccccacccgcgc

SEQ ID NO: 962574 - RNA, 15 nt, Mycobacterium avium subsp. paratuberculosis
caccccacccgcgcg

SEQ ID NO: 962575 - RNA, 15 nt, Mycobacterium avium subsp. paratuberculosis
caccccaggcgaugc

SEQ ID NO: 962576 - RNA, 17 nt, Mycobacterium avium subsp. paratuberculosis
caccccaggcgaugccg

SEQ ID NO: 962577 - RNA, 19 nt, Mycobacterium avium subsp. paratuberculosis
cacccccagcccgccgggc

SEQ ID NO: 962578 - RNA, 13 nt, Mycobacterium avium subsp. paratuberculosis
caccccgcggucg

SEQ ID NO: 962579 - RNA, 14 nt, Mycobacterium avium subsp. paratuberculosis
caccccgcucggcc

SEQ ID NO: 962580 - RNA, 18 nt, Mycobacterium avium subsp. paratuberculosis
caccccgcucggccagcg

SEQ ID NO: 962581 - RNA, 22 nt, Mycobacterium avium subsp. paratuberculosis
caccccgcucggccagcgcgcc

SEQ ID NO: 962582 - RNA, 23 nt, Mycobacterium avium subsp. paratuberculosis
caccccgcucggccagcgcgccg

SEQ ID NO: 962583 - RNA, 13 nt, Mycobacterium avium subsp. paratuberculosis
caccccggccacc

SEQ ID NO: 962584 - RNA, 23 nt, Mycobacterium avium subsp. paratuberculosis
caccccggccagggugccgacga

SEQ ID NO: 962585 - RNA, 16 nt, Mycobacterium avium subsp. paratuberculosis
caccccggccaguccg

SEQ ID NO: 962586 - RNA, 14 nt, Mycobacterium avium subsp. paratuberculosis
caccccggccauca

SEQ ID NO: 962587 - RNA, 12 nt, Mycobacterium avium subsp. paratuberculosis
caccccggcgac

SEQ ID NO: 962588 - RNA, 13 nt, Mycobacterium avium subsp. paratuberculosis
caccccggcgaug

SEQ ID NO: 962589 - RNA, 12 nt, Mycobacterium avium subsp. paratuberculosis
caccccggcgcg

SEQ ID NO: 962590 - RNA, 18 nt, Mycobacterium avium subsp. paratuberculosis
caccccggcgcggaacgc

SEQ ID NO: 962591 - RNA, 12 nt, Mycobacterium avium subsp. paratuberculosis
caccccggcggc

SEQ ID NO: 962592 - RNA, 13 nt, Mycobacterium avium subsp. paratuberculosis
caccccgucgcgg

SEQ ID NO: 962593 - RNA, 16 nt, Mycobacterium avium subsp. paratuberculosis
caccccggugccgcag

SEQ ID NO: 962594 - RNA, 22 nt, Mycobacterium avium subsp. paratuberculosis
caccccguaggugcacagcccg

SEQ ID NO: 962595 - RNA, 19 nt, Mycobacterium avium subsp. paratuberculosis
caccccgugguagacgccg

SEQ ID NO: 962596 - RNA, 20 nt, Mycobacterium avium subsp. paratuberculosis
caccccgugguagacgccgg

SEQ ID NO: 962597 - RNA, 17 nt, Mycobacterium avium subsp. paratuberculosis
caccccguugagcagcg

SEQ ID NO: 962598 - RNA, 19 nt, Mycobacterium avium subsp. paratuberculosis
caccccguugccgccggcg

SEQ ID NO: 962599 - RNA, 17 nt, Mycobacterium avium subsp. paratuberculosis
caccgacaccaccggcc

SEQ ID NO: 962600 - RNA, 19 nt, Mycobacterium avium subsp. paratuberculosis
caccgacaccaccggccgc

SEQ ID NO: 962601 - RNA, 20 nt, Mycobacterium avium subsp. paratuberculosis
caccgacaccaccggccgcc

SEQ ID NO: 962602 - RNA, 18 nt, Mycobacterium avium subsp. paratuberculosis
caccgacaccccgaugcg

SEQ ID NO: 962603 - RNA, 20 nt, Mycobacterium avium subsp. paratuberculosis
caccccgguccaggcgaccg

SEQ ID NO: 962604 - RNA, 20 nt, Mycobacterium avium subsp. paratuberculosis
caccccgggaacgacggugc

SEQ ID NO: 962605 - RNA, 18 nt, Mycobacterium avium subsp. paratuberculosis
caccccggugaccucccg

SEQ ID NO: 962606 - RNA, 23 nt, Mycobacterium avium subsp. paratuberculosis
caccccggcggucggaucgagcu

SEQ ID NO: 962607 - RNA, 19 nt, Mycobacterium avium subsp. paratuberculosis
caccccggcguccacgccg

SEQ ID NO: 962608 - RNA, 21 nt, Mycobacterium avium subsp. paratuberculosis
caccccggcguccacgccgug

SEQ ID NO: 962609 - RNA, 15 nt, Mycobacterium avium subsp. paratuberculosis
caccccggacggccg

SEQ ID NO: 962610 - RNA, 19 nt, Mycobacterium avium subsp. paratuberculosis
caccccggagauccggccg

SEQ ID NO: 962611 - RNA, 21 nt, Mycobacterium avium subsp. paratuberculosis
caccgacuguuugaugccguc

SEQ ID NO: 962612 - RNA, 19 nt, Mycobacterium avium subsp. paratuberculosis
caccgagaucaugccggcg

SEQ ID NO: 962613 - RNA, 16 nt, Mycobacterium avium subsp. paratuberculosis
caccgagaccaugccg

SEQ ID NO: 962614 - RNA, 20 nt, Mycobacterium avium subsp. paratuberculosis
caccgagaccaugccgccga

SEQ ID NO: 962615 - RNA, 13 nt, Mycobacterium avium subsp. paratuberculosis
caccgaccagcug

SEQ ID NO: 962616 - RNA, 14 nt, Mycobacterium avium subsp. paratuberculosis
caccgaccagcugu

SEQ ID NO: 962617 - RNA, 20 nt, Mycobacterium avium subsp. paratuberculosis
caccgaccccucggcggccg

SEQ ID NO: 962618 - RNA, 15 nt, Mycobacterium avium subsp. paratuberculosis
caccgacuccuccgg

SEQ ID NO: 962619 - RNA, 19 nt, Mycobacterium avium subsp. paratuberculosis
caccgacuccuccggcccg

SEQ ID NO: 962620 - RNA, 20 nt, Mycobacterium avium subsp. paratuberculosis
caccgacuccuccggcccga

SEQ ID NO: 962621 - RNA, 21 nt, Mycobacterium avium subsp. paratuberculosis
caccgacuccuccggcccgau

SEQ ID NO: 962622 - RNA, 14 nt, Mycobacterium avium subsp. paratuberculosis
caccgacugcggcg

SEQ ID NO: 962623 - RNA, 15 nt, Mycobacterium avium subsp. paratuberculosis
caccgacugcggcgc

SEQ ID NO: 962624 - RNA, 20 nt, Mycobacterium avium subsp. paratuberculosis
caccgacaugucgccgggcg

SEQ ID NO: 962625 - RNA, 20 nt, Mycobacterium avium subsp. paratuberculosis
caccgacaucagaucgccga

SEQ ID NO: 962626 - RNA, 21 nt, Mycobacterium avium subsp. paratuberculosis
caccgacaucagaucgccgac

SEQ ID NO: 962627 - RNA, 22 nt, Mycobacterium avium subsp. paratuberculosis
caccgacaucagaucgccgacg

SEQ ID NO: 962628 - RNA, 24 nt, Mycobacterium avium subsp. paratuberculosis
caccgacaucagaucgccgacgac

SEQ ID NO: 962629 - RNA, 21 nt, Mycobacterium avium subsp. paratuberculosis
caccgacagggccagcgccau

SEQ ID NO: 962630 - RNA, 13 nt, Mycobacterium avium subsp. paratuberculosis
caccgacaggucg

SEQ ID NO: 962631 - RNA, 15 nt, Mycobacterium avium subsp. paratuberculosis
caccgacagcacccg

SEQ ID NO: 962632 - RNA, 12 nt, Mycobacterium avium subsp. paratuberculosis
caccgacagccg

SEQ ID NO: 962633 - RNA, 14 nt, Mycobacterium avium subsp. paratuberculosis
caccgacagcgcgu

SEQ ID NO: 962634 - RNA, 14 nt, Mycobacterium avium subsp. paratuberculosis
caccgacagcaccc

SEQ ID NO: 962635 - RNA, 11 nt, Mycobacterium avium subsp. paratuberculosis
caccgacagca

SEQ ID NO: 962636 - RNA, 14 nt, Mycobacterium avium subsp. paratuberculosis
caccgacaccggcc

SEQ ID NO: 962637 - RNA, 16 nt, Mycobacterium avium subsp. paratuberculosis
caccgacaccggccgg

SEQ ID NO: 962638 - RNA, 18 nt, Mycobacterium avium subsp. paratuberculosis
caccgacaccggccggga

SEQ ID NO: 962639 - RNA, 17 nt, Mycobacterium avium subsp. paratuberculosis
caccgcaaagcaccgcg

SEQ ID NO: 962640 - RNA, 18 nt, Mycobacterium avium subsp. paratuberculosis
caccgcaaagcaccgcga

SEQ ID NO: 962641 - RNA, 21 nt, Mycobacterium avium subsp. paratuberculosis
caccgcaaagcaccgcgaaca

SEQ ID NO: 962642 - RNA, 20 nt, Mycobacterium avium subsp. paratuberculosis
caccgaguugaacgcgucga

SEQ ID NO: 962643 - RNA, 16 nt, Mycobacterium avium subsp. paratuberculosis
caccgaguugaucccc

SEQ ID NO: 962644 - RNA, 16 nt, Mycobacterium avium subsp. paratuberculosis
caccgagucgcgcgac

SEQ ID NO: 962645 - RNA, 17 nt, Mycobacterium avium subsp. paratuberculosis
caccgagucgcgcgacc

SEQ ID NO: 962646 - RNA, 18 nt, Mycobacterium avium subsp. paratuberculosis
caccgagucgcgcgacca

SEQ ID NO: 962647 - RNA, 16 nt, Mycobacterium avium subsp. paratuberculosis
caccgagugcggcgcg

SEQ ID NO: 962648 - RNA, 18 nt, Mycobacterium avium subsp. paratuberculosis
caccgagugcggcgcggu

SEQ ID NO: 962649 - RNA, 20 nt, Mycobacterium avium subsp. paratuberculosis
caccgagugcggcgcggugc

SEQ ID NO: 962650 - RNA, 24 nt, Mycobacterium avium subsp. paratuberculosis
caccgagguggcccagccgcugac

SEQ ID NO: 962651 - RNA, 23 nt, Mycobacterium avium subsp. paratuberculosis
caccgagcccguucagugaccag

SEQ ID NO: 962652 - RNA, 13 nt, Mycobacterium avium subsp. paratuberculosis
caccgaggugacg

SEQ ID NO: 962653 - RNA, 20 nt, Mycobacterium avium subsp. paratuberculosis
caccgaggugacgaggccca

SEQ ID NO: 962654 - RNA, 17 nt, Mycobacterium avium subsp. paratuberculosis
caccgaggugacgucgc

SEQ ID NO: 962655 - RNA, 23 nt, Mycobacterium avium subsp. paratuberculosis
caccgaggugacgucgcgccgcu

SEQ ID NO: 962656 - RNA, 14 nt, Mycobacterium avium subsp. paratuberculosis
caccgagcugggcc

SEQ ID NO: 962657 - RNA, 18 nt, Mycobacterium avium subsp. paratuberculosis
caccgagcugggccggcg

SEQ ID NO: 962658 - RNA, 21 nt, Mycobacterium avium subsp. paratuberculosis
caccgagcugggccggcgccg

SEQ ID NO: 962659 - RNA, 23 nt, Mycobacterium avium subsp. paratuberculosis
caccgagcugggccggcgccgaa

SEQ ID NO: 962660 - RNA, 20 nt, Mycobacterium avium subsp. paratuberculosis
caccgagcgucacgcuggcg

SEQ ID NO: 962661 - RNA, 23 nt, Mycobacterium avium subsp. paratuberculosis
caccgagccugggauugccgggc

SEQ ID NO: 962662 - RNA, 14 nt, Mycobacterium avium subsp. paratuberculosis
caccgagcggggug

SEQ ID NO: 962663 - RNA, 13 nt, Mycobacterium avium subsp. paratuberculosis
caccgagccggcg

SEQ ID NO: 962664 - RNA, 14 nt, Mycobacterium avium subsp. paratuberculosis
caccgagccggcgg

SEQ ID NO: 962665 - RNA, 15 nt, Mycobacterium avium subsp. paratuberculosis
caccgagccggcggc

SEQ ID NO: 962666 - RNA, 16 nt, Mycobacterium avium subsp. paratuberculosis
caccgagccggcgucg

SEQ ID NO: 962667 - RNA, 20 nt, Mycobacterium avium subsp. paratuberculosis
caccgagccggcgucgccgc

SEQ ID NO: 962668 - RNA, 16 nt, Mycobacterium avium subsp. paratuberculosis
caccgagccgggcagc

SEQ ID NO: 962669 - RNA, 20 nt, Mycobacterium avium subsp. paratuberculosis
caccgagccggugccgccca

SEQ ID NO: 962670 - RNA, 17 nt, Mycobacterium avium subsp. paratuberculosis
caccgagauggccacca

SEQ ID NO: 962671 - RNA, 22 nt, Mycobacterium avium subsp. paratuberculosis
caccgagauguaucugcggacc

SEQ ID NO: 962672 - RNA, 13 nt, Mycobacterium avium subsp. paratuberculosis
caccgccagcagc

SEQ ID NO: 962673 - RNA, 22 nt, Mycobacterium avium subsp. paratuberculosis
caccgccagcaccgccaccggc

SEQ ID NO: 962674 - RNA, 12 nt, Mycobacterium avium subsp. paratuberculosis
caccgccagcag

SEQ ID NO: 962675 - RNA, 19 nt, Mycobacterium avium subsp. paratuberculosis
caccgcauaggaccggaug

SEQ ID NO: 962676 - RNA, 18 nt, Mycobacterium avium subsp. paratuberculosis
caccgcaucccccucggc

SEQ ID NO: 962677 - RNA, 18 nt, Mycobacterium avium subsp. paratuberculosis
caccgcaucgaaccgccg

SEQ ID NO: 962678 - RNA, 20 nt, Mycobacterium avium subsp. paratuberculosis
caccgcaucgaaccgccgcg

SEQ ID NO: 962679 - RNA, 21 nt, Mycobacterium avium subsp. paratuberculosis
caccgcaucgaaccgccgcgc

SEQ ID NO: 962680 - RNA, 19 nt, Mycobacterium avium subsp. paratuberculosis
caccgccagcgccggcagc

SEQ ID NO: 962681 - RNA, 14 nt, Mycobacterium avium subsp. paratuberculosis
caccgccagcgcgg

SEQ ID NO: 962682 - RNA, 17 nt, Mycobacterium avium subsp. paratuberculosis
caccgccagcgcggcgg

SEQ ID NO: 962683 - RNA, 18 nt, Mycobacterium avium subsp. paratuberculosis
caccgccagcgcggcggc

SEQ ID NO: 962684 - RNA, 19 nt, Mycobacterium avium subsp. paratuberculosis
caccgccagcgcggcggcg

SEQ ID NO: 962685 - RNA, 22 nt, Mycobacterium avium subsp. paratuberculosis
caccgccagcgcggcggcgccg

SEQ ID NO: 962686 - RNA, 15 nt, Mycobacterium avium subsp. paratuberculosis
caccgccagcauccg

SEQ ID NO: 962687 - RNA, 17 nt, Mycobacterium avium subsp. paratuberculosis
caccgccagccaccaca

SEQ ID NO: 962688 - RNA, 14 nt, Mycobacterium avium subsp. paratuberculosis
caccgcacggccca

SEQ ID NO: 962689 - RNA, 14 nt, Mycobacterium avium subsp. paratuberculosis
caccgcaccgacga

SEQ ID NO: 962690 - RNA, 14 nt, Mycobacterium avium subsp. paratuberculosis
caccgccaucggca

SEQ ID NO: 962691 - RNA, 20 nt, Mycobacterium avium subsp. paratuberculosis
caccgccagucugagcccgg

SEQ ID NO: 962692 - RNA, 22 nt, Mycobacterium avium subsp. paratuberculosis
caccgccagucugagcccgggc

SEQ ID NO: 962693 - RNA, 16 nt, Mycobacterium avium subsp. paratuberculosis
caccgccccagccgac

SEQ ID NO: 962694 - RNA, 18 nt, Mycobacterium avium subsp. paratuberculosis
caccgccccagccgacca

SEQ ID NO: 962695 - RNA, 12 nt, Mycobacterium avium subsp. paratuberculosis
caccgccccggu

SEQ ID NO: 962696 - RNA, 14 nt, Mycobacterium avium subsp. paratuberculosis
caccgccccgguca

SEQ ID NO: 962697 - RNA, 15 nt, Mycobacterium avium subsp. paratuberculosis
caccgccgcgccgag

SEQ ID NO: 962698 - RNA, 19 nt, Mycobacterium avium subsp. paratuberculosis
caccgccgcgcggccgggc

SEQ ID NO: 962699 - RNA, 11 nt, Mycobacterium avium subsp. paratuberculosis
caccgccgcgg

SEQ ID NO: 962700 - RNA, 20 nt, Mycobacterium avium subsp. paratuberculosis
caccgccgcugcgcgcgcga

SEQ ID NO: 962701 - RNA, 14 nt, Mycobacterium avium subsp. paratuberculosis
caccgccgcggcgg

SEQ ID NO: 962702 - RNA, 13 nt, Mycobacterium avium subsp. paratuberculosis
caccgccgcggga

SEQ ID NO: 962703 - RNA, 14 nt, Mycobacterium avium subsp. paratuberculosis
caccgccgcgggau

SEQ ID NO: 962704 - RNA, 12 nt, Mycobacterium avium subsp. paratuberculosis
caccgccgcggu

SEQ ID NO: 962705 - RNA, 16 nt, Mycobacterium avium subsp. paratuberculosis
caccgccgccgacucc

SEQ ID NO: 962706 - RNA, 21 nt, Mycobacterium avium subsp. paratuberculosis
caccgcgcccagccccagcac

SEQ ID NO: 962707 - RNA, 14 nt, Mycobacterium avium subsp. paratuberculosis
caccgcgccggcgg

SEQ ID NO: 962708 - RNA, 15 nt, Mycobacterium avium subsp. paratuberculosis
caccgcgccggcggc

SEQ ID NO: 962709 - RNA, 17 nt, Mycobacterium avium subsp. paratuberculosis
caccgcgccccggcgca

SEQ ID NO: 962710 - RNA, 23 nt, Mycobacterium avium subsp. paratuberculosis
caccgcgacgaucgcgacggccg

SEQ ID NO: 962711 - RNA, 12 nt, Mycobacterium avium subsp. paratuberculosis
caccgcgacgcc

SEQ ID NO: 962712 - RNA, 17 nt, Mycobacterium avium subsp. paratuberculosis
caccgccggcccggcgu

SEQ ID NO: 962713 - RNA, 14 nt, Mycobacterium avium subsp. paratuberculosis
caccgcgacgcugc

SEQ ID NO: 962714 - RNA, 15 nt, Mycobacterium avium subsp. paratuberculosis
caccgcgacgcugcc

SEQ ID NO: 962715 - RNA, 16 nt, Mycobacterium avium subsp. paratuberculosis
caccgcgacgcugccg

SEQ ID NO: 962716 - RNA, 17 nt, Mycobacterium avium subsp. paratuberculosis
caccgcgacgcugccgg

SEQ ID NO: 962717 - RNA, 15 nt, Mycobacterium avium subsp. paratuberculosis
caccgcgacggugag

SEQ ID NO: 962718 - RNA, 17 nt, Mycobacterium avium subsp. paratuberculosis
caccgcgacggugagca

SEQ ID NO: 962719 - RNA, 16 nt, Mycobacterium avium subsp. paratuberculosis
caccgcgagcaccgcg

SEQ ID NO: 962720 - RNA, 14 nt, Mycobacterium avium subsp. paratuberculosis
caccgcgaguucgc

SEQ ID NO: 962721 - RNA, 19 nt, Mycobacterium avium subsp. paratuberculosis
caccgcgaucaccaccccg

SEQ ID NO: 962722 - RNA, 23 nt, Mycobacterium avium subsp. paratuberculosis
caccgcgaucaccaccccggugc

SEQ ID NO: 962723 - RNA, 17 nt, Mycobacterium avium subsp. paratuberculosis
caccgcgaucaccgaga

SEQ ID NO: 962724 - RNA, 13 nt, Mycobacterium avium subsp. paratuberculosis
caccgcgaucgcc

SEQ ID NO: 962725 - RNA, 17 nt, Mycobacterium avium subsp. paratuberculosis
caccgcgaucgccgacg

SEQ ID NO: 962726 - RNA, 21 nt, Mycobacterium avium subsp. paratuberculosis
caccgcgaucgccgacgucgg

SEQ ID NO: 962727 - RNA, 17 nt, Mycobacterium avium subsp. paratuberculosis
caccgcgaucugcucgg

SEQ ID NO: 962728 - RNA, 19 nt, Mycobacterium avium subsp. paratuberculosis
caccgcgaucugcucggug

SEQ ID NO: 962729 - RNA, 23 nt, Mycobacterium avium subsp. paratuberculosis
caccgcgaucugcucggugucga

SEQ ID NO: 962730 - RNA, 20 nt, Mycobacterium avium subsp. paratuberculosis
caccgcgaugauggcgucga

SEQ ID NO: 962731 - RNA, 22 nt, Mycobacterium avium subsp. paratuberculosis
caccgcgaugauggcgucgacg

SEQ ID NO: 962732 - RNA, 20 nt, Mycobacterium avium subsp. paratuberculosis
caccgcgauggcccgcgcga

SEQ ID NO: 962733 - RNA, 21 nt, Mycobacterium avium subsp. paratuberculosis
caccgcgauggcccgcgcgau

SEQ ID NO: 962734 - RNA, 19 nt, Mycobacterium avium subsp. paratuberculosis
caccgcgcaaccgggccgc

SEQ ID NO: 962735 - RNA, 23 nt, Mycobacterium avium subsp. paratuberculosis
caccgcgcaaccgggccgcaccc

SEQ ID NO: 962736 - RNA, 14 nt, Mycobacterium avium subsp. paratuberculosis
caccgccggcgccg

SEQ ID NO: 962737 - RNA, 23 nt, Mycobacterium avium subsp. paratuberculosis
caccgcgcagaaccgcaccccgu

SEQ ID NO: 962738 - RNA, 21 nt, Mycobacterium avium subsp. paratuberculosis
caccgcuuugugaggcgcgcc

SEQ ID NO: 962739 - RNA, 22 nt, Mycobacterium avium subsp. paratuberculosis
caccgcuuugugaggcgcgccg

SEQ ID NO: 962740 - RNA, 14 nt, Mycobacterium avium subsp. paratuberculosis
caccgcggucgacg

SEQ ID NO: 962741 - RNA, 15 nt, Mycobacterium avium subsp. paratuberculosis
caccgcggucgacgg

SEQ ID NO: 962742 - RNA, 17 nt, Mycobacterium avium subsp. paratuberculosis
caccgcggucgacggga

SEQ ID NO: 962743 - RNA, 13 nt, Mycobacterium avium subsp. paratuberculosis
caccgcggugacc

SEQ ID NO: 962744 - RNA, 23 nt, Mycobacterium avium subsp. paratuberculosis
caccgcggugaccgcccgcucga

SEQ ID NO: 962745 - RNA, 17 nt, Mycobacterium avium subsp. paratuberculosis
caccgcggugagcggcc

SEQ ID NO: 962746 - RNA, 18 nt, Mycobacterium avium subsp. paratuberculosis
caccgcggugagcggccg

SEQ ID NO: 962747 - RNA, 20 nt, Mycobacterium avium subsp. paratuberculosis
caccgcggugagcggccgca

SEQ ID NO: 962748 - RNA, 23 nt, Mycobacterium avium subsp. paratuberculosis
caccgcggugagcggccgcagcg

SEQ ID NO: 962749 - RNA, 15 nt, Mycobacterium avium subsp. paratuberculosis
caccgcggcgggguc

SEQ ID NO: 962750 - RNA, 14 nt, Mycobacterium avium subsp. paratuberculosis
caccgcggcggugu

SEQ ID NO: 962751 - RNA, 14 nt, Mycobacterium avium subsp. paratuberculosis
caccgcggcgaucg

SEQ ID NO: 962752 - RNA, 16 nt, Mycobacterium avium subsp. paratuberculosis
caccgcggcggcgucg

SEQ ID NO: 962753 - RNA, 13 nt, Mycobacterium avium subsp. paratuberculosis
caccgcggcgccg

SEQ ID NO: 962754 - RNA, 14 nt, Mycobacterium avium subsp. paratuberculosis
caccgcggcgccgu

SEQ ID NO: 962755 - RNA, 22 nt, Mycobacterium avium subsp. paratuberculosis
caccgcggcgcgcaucgccguc

SEQ ID NO: 962756 - RNA, 23 nt, Mycobacterium avium subsp. paratuberculosis
caccgcggcgcgcaucgccgucc

SEQ ID NO: 962757 - RNA, 17 nt, Mycobacterium avium subsp. paratuberculosis
caccgcggcgcgcggcc

SEQ ID NO: 962758 - RNA, 13 nt, Mycobacterium avium subsp. paratuberculosis
caccgcggcgugg

SEQ ID NO: 962759 - RNA, 17 nt, Mycobacterium avium subsp. paratuberculosis
caccgcggcucggucgc

SEQ ID NO: 962760 - RNA, 18 nt, Mycobacterium avium subsp. paratuberculosis
caccgcggcucggucgcg

SEQ ID NO: 962761 - RNA, 19 nt, Mycobacterium avium subsp. paratuberculosis
caccgcggcucggucgcga

SEQ ID NO: 962762 - RNA, 19 nt, Mycobacterium avium subsp. paratuberculosis
caccgcgggcacggcgaug

SEQ ID NO: 962763 - RNA, 17 nt, Mycobacterium avium subsp. paratuberculosis
caccgcgggccaggccc

SEQ ID NO: 962764 - RNA, 19 nt, Mycobacterium avium subsp. paratuberculosis
caccgcgggcgcgccgucc

SEQ ID NO: 962765 - RNA, 22 nt, Mycobacterium avium subsp. paratuberculosis
caccgcgggcgcgccgucccag

SEQ ID NO: 962766 - RNA, 20 nt, Mycobacterium avium subsp. paratuberculosis
caccgcggggcugggcgcca

SEQ ID NO: 962767 - RNA, 16 nt, Mycobacterium avium subsp. paratuberculosis
caccgcgggggcggcc

SEQ ID NO: 962768 - RNA, 13 nt, Mycobacterium avium subsp. paratuberculosis
caccgcggggugc

SEQ ID NO: 962769 - RNA, 20 nt, Mycobacterium avium subsp. paratuberculosis
caccgcggggugcccggcga

SEQ ID NO: 962770 - RNA, 13 nt, Mycobacterium avium subsp. paratuberculosis
caccgcgggugau

SEQ ID NO: 962771 - RNA, 13 nt, Mycobacterium avium subsp. paratuberculosis
caccgcggcgacg

SEQ ID NO: 962772 - RNA, 23 nt, Mycobacterium avium subsp. paratuberculosis
caccgcggcgacgucgugcacgc

SEQ ID NO: 962773 - RNA, 16 nt, Mycobacterium avium subsp. paratuberculosis
caccgcggccgucgcg

SEQ ID NO: 962774 - RNA, 15 nt, Mycobacterium avium subsp. paratuberculosis
caccgcggccucggc

SEQ ID NO: 962775 - RNA, 16 nt, Mycobacterium avium subsp. paratuberculosis
caccgcggccucggcg

SEQ ID NO: 962776 - RNA, 19 nt, Mycobacterium avium subsp. paratuberculosis
caccgcggccucggcgucg

SEQ ID NO: 962777 - RNA, 19 nt, Mycobacterium avium subsp. paratuberculosis
caccgcggccaacccgggc

SEQ ID NO: 962778 - RNA, 21 nt, Mycobacterium avium subsp. paratuberculosis
caccgcggccaacccgggcgc

SEQ ID NO: 962779 - RNA, 14 nt, Mycobacterium avium subsp. paratuberculosis
caccgcggccacca

SEQ ID NO: 962780 - RNA, 15 nt, Mycobacterium avium subsp. paratuberculosis
caccgcggccaccac

SEQ ID NO: 962781 - RNA, 20 nt, Mycobacterium avium subsp. paratuberculosis
caccgcggccaccaccgcca

SEQ ID NO: 962782 - RNA, 16 nt, Mycobacterium avium subsp. paratuberculosis
caccgcggccagcgcg

SEQ ID NO: 962783 - RNA, 18 nt, Mycobacterium avium subsp. paratuberculosis
caccgcggccagcugcga

SEQ ID NO: 962784 - RNA, 13 nt, Mycobacterium avium subsp. paratuberculosis
caccgcgcggcgc

SEQ ID NO: 962785 - RNA, 16 nt, Mycobacterium avium subsp. paratuberculosis
caccgcgcuugccgcg

SEQ ID NO: 962786 - RNA, 17 nt, Mycobacterium avium subsp. paratuberculosis
caccgcgcuugccgcga

SEQ ID NO: 962787 - RNA, 14 nt, Mycobacterium avium subsp. paratuberculosis
caccgcggaccacc

SEQ ID NO: 962788 - RNA, 15 nt, Mycobacterium avium subsp. paratuberculosis
caccgcggaccaccg

SEQ ID NO: 962789 - RNA, 14 nt, Mycobacterium avium subsp. paratuberculosis
caccgcggagcgca

SEQ ID NO: 962790 - RNA, 18 nt, Mycobacterium avium subsp. paratuberculosis
caccgcggagcgcaacgu

SEQ ID NO: 962791 - RNA, 20 nt, Mycobacterium avium subsp. paratuberculosis
caccgcggauuccagcgcgu

SEQ ID NO: 962792 - RNA, 20 nt, Mycobacterium avium subsp. paratuberculosis
caccgcgcgcaggccccggc

SEQ ID NO: 962793 - RNA, 21 nt, Mycobacterium avium subsp. paratuberculosis
caccgcgcgcaggccccggcg

SEQ ID NO: 962794 - RNA, 13 nt, Mycobacterium avium subsp. paratuberculosis
caccgcgcgccag

SEQ ID NO: 962795 - RNA, 23 nt, Mycobacterium avium subsp. paratuberculosis
caccgcgccgucgucgagcacca

SEQ ID NO: 962796 - RNA, 13 nt, Mycobacterium avium subsp. paratuberculosis
caccgcgccgguc

SEQ ID NO: 962797 - RNA, 14 nt, Mycobacterium avium subsp. paratuberculosis
caccgcgccgucgu

SEQ ID NO: 962798 - RNA, 24 nt, Mycobacterium avium subsp. paratuberculosis
caccgcgccggcggcggcgguccg

SEQ ID NO: 962799 - RNA, 12 nt, Mycobacterium avium subsp. paratuberculosis
caccgcgccggg

SEQ ID NO: 962800 - RNA, 15 nt, Mycobacterium avium subsp. paratuberculosis
caccgcgccgggcac

SEQ ID NO: 962801 - RNA, 20 nt, Mycobacterium avium subsp. paratuberculosis
caccgcgccgggcaccacca

SEQ ID NO: 962802 - RNA, 13 nt, Mycobacterium avium subsp. paratuberculosis
caccgcgcgcggg

SEQ ID NO: 962803 - RNA, 16 nt, Mycobacterium avium subsp. paratuberculosis
caccgcgcgcugcagc

SEQ ID NO: 962804 - RNA, 15 nt, Mycobacterium avium subsp. paratuberculosis
caccgcgcgcugccg

SEQ ID NO: 962805 - RNA, 14 nt, Mycobacterium avium subsp. paratuberculosis
caccgcgcgcacca

SEQ ID NO: 962806 - RNA, 15 nt, Mycobacterium avium subsp. paratuberculosis
caccgcgcgcaccac

SEQ ID NO: 962807 - RNA, 13 nt, Mycobacterium avium subsp. paratuberculosis
caccgcgcggcca

SEQ ID NO: 962808 - RNA, 22 nt, Mycobacterium avium subsp. paratuberculosis
caccgcgcggccagcggcgccg

SEQ ID NO: 962809 - RNA, 15 nt, Mycobacterium avium subsp. paratuberculosis
caccgcgcggcgguc

SEQ ID NO: 962810 - RNA, 21 nt, Mycobacterium avium subsp. paratuberculosis
caccgcgcggcggugcucgcg

SEQ ID NO: 962811 - RNA, 14 nt, Mycobacterium avium subsp. paratuberculosis
caccgcgcuccugc

SEQ ID NO: 962812 - RNA, 19 nt, Mycobacterium avium subsp. paratuberculosis
caccgcgcuccugccagcg

SEQ ID NO: 962813 - RNA, 20 nt, Mycobacterium avium subsp. paratuberculosis
caccgcgcuccugccagcgg

SEQ ID NO: 962814 - RNA, 14 nt, Mycobacterium avium subsp. paratuberculosis
caccgcgcucggcg

SEQ ID NO: 962815 - RNA, 16 nt, Mycobacterium avium subsp. paratuberculosis
caccgcgcucggcgac

SEQ ID NO: 962816 - RNA, 17 nt, Mycobacterium avium subsp. paratuberculosis
caccgcgcucggcgacg

SEQ ID NO: 962817 - RNA, 18 nt, Mycobacterium avium subsp. paratuberculosis
caccgcgcucggcgacga

SEQ ID NO: 962818 - RNA, 16 nt, Mycobacterium avium subsp. paratuberculosis
caccucgucccagcgc

SEQ ID NO: 962819 - RNA, 13 nt, Mycobacterium avium subsp. paratuberculosis
caccucgucgauc

SEQ ID NO: 962820 - RNA, 18 nt, Mycobacterium avium subsp. paratuberculosis
caccucgucgcccggcgu

SEQ ID NO: 962821 - RNA, 21 nt, Mycobacterium avium subsp. paratuberculosis
caccucgucgcccggcgucca

SEQ ID NO: 962822 - RNA, 13 nt, Mycobacterium avium subsp. paratuberculosis
caccucgucgccg

SEQ ID NO: 962823 - RNA, 15 nt, Mycobacterium avium subsp. paratuberculosis
caccucgucgccguc

SEQ ID NO: 962824 - RNA, 19 nt, Mycobacterium avium subsp. paratuberculosis
caccucgucgccgucgggg

SEQ ID NO: 962825 - RNA, 23 nt, Mycobacterium avium subsp. paratuberculosis
caccucgucggcggucaacacga

SEQ ID NO: 962826 - RNA, 21 nt, Mycobacterium avium subsp. paratuberculosis
caccucucgggaaacgcgucg

SEQ ID NO: 962827 - RNA, 18 nt, Mycobacterium avium subsp. paratuberculosis
caccucggggcguggcgg

SEQ ID NO: 962828 - RNA, 14 nt, Mycobacterium avium subsp. paratuberculosis
caccucggucgggg

SEQ ID NO: 962829 - RNA, 16 nt, Mycobacterium avium subsp. paratuberculosis
caccucggucggggau

SEQ ID NO: 962830 - RNA, 21 nt, Mycobacterium avium subsp. paratuberculosis
caccucggugaucucaccggc

SEQ ID NO: 962831 - RNA, 21 nt, Mycobacterium avium subsp. paratuberculosis
caccucggugaugucgacguc

SEQ ID NO: 962832 - RNA, 18 nt, Mycobacterium avium subsp. paratuberculosis
caccucgguggacgccgc

SEQ ID NO: 962833 - RNA, 20 nt, Mycobacterium avium subsp. paratuberculosis
caccucgguggacgccgcgc

SEQ ID NO: 962834 - RNA, 21 nt, Mycobacterium avium subsp. paratuberculosis
caccucgguggacgccgcgca

SEQ ID NO: 962835 - RNA, 16 nt, Mycobacterium avium subsp. paratuberculosis
caccucggcgucggcg

SEQ ID NO: 962836 - RNA, 20 nt, Mycobacterium avium subsp. paratuberculosis
caccucgggauagccgagcg

SEQ ID NO: 962837 - RNA, 12 nt, Mycobacterium avium subsp. paratuberculosis
caccucgggauc

SEQ ID NO: 962838 - RNA, 22 nt, Mycobacterium avium subsp. paratuberculosis
caccucgggcacguccagcccg

SEQ ID NO: 962839 - RNA, 16 nt, Mycobacterium avium subsp. paratuberculosis
caccucgggccgggcg

SEQ ID NO: 962840 - RNA, 19 nt, Mycobacterium avium subsp. paratuberculosis
caccucgggccgggcgggc

SEQ ID NO: 962841 - RNA, 22 nt, Mycobacterium avium subsp. paratuberculosis
caccucgccgaucucgaccagc

SEQ ID NO: 962842 - RNA, 14 nt, Mycobacterium avium subsp. paratuberculosis
caccucgccggccg

SEQ ID NO: 962843 - RNA, 18 nt, Mycobacterium avium subsp. paratuberculosis
caccucggcggcaccgcc

SEQ ID NO: 962844 - RNA, 20 nt, Mycobacterium avium subsp. paratuberculosis
caccucggcggcaccgcccg

SEQ ID NO: 962845 - RNA, 14 nt, Mycobacterium avium subsp. paratuberculosis
caccucggccgggu

SEQ ID NO: 962846 - RNA, 13 nt, Mycobacterium avium subsp. paratuberculosis
caccucggcgacc

SEQ ID NO: 962847 - RNA, 19 nt, Mycobacterium avium subsp. paratuberculosis
caccucggcgaccacgucc

SEQ ID NO: 962848 - RNA, 15 nt, Mycobacterium avium subsp. paratuberculosis
caccucggcgacguc

SEQ ID NO: 962849 - RNA, 16 nt, Mycobacterium avium subsp. paratuberculosis
caccucggccagcgcc

SEQ ID NO: 962850 - RNA, 17 nt, Mycobacterium avium subsp. paratuberculosis
caccucggccagcgccg

SEQ ID NO: 962851 - RNA, 19 nt, Mycobacterium avium subsp. paratuberculosis
caccucggccagcgccgcg

SEQ ID NO: 962852 - RNA, 17 nt, Mycobacterium avium subsp. paratuberculosis
caccucgcuacgcgagc

SEQ ID NO: 962853 - RNA, 20 nt, Mycobacterium avium subsp. paratuberculosis
caccucgcuacgcgagcugc

SEQ ID NO: 962854 - RNA, 21 nt, Mycobacterium avium subsp. paratuberculosis
caccucgcuacgcgagcugcu

SEQ ID NO: 962855 - RNA, 22 nt, Mycobacterium avium subsp. paratuberculosis
caccucgcuacgcgagcugcuu

SEQ ID NO: 962856 - RNA, 23 nt, Mycobacterium avium subsp. paratuberculosis
caccucgcuacgcgagcugcuuc

SEQ ID NO: 962857 - RNA, 19 nt, Mycobacterium avium subsp. paratuberculosis
caccucgcugacgucgaug

SEQ ID NO: 962858 - RNA, 19 nt, Mycobacterium avium subsp. paratuberculosis
caccugacagacccgaucg

SEQ ID NO: 962859 - RNA, 22 nt, Mycobacterium avium subsp. paratuberculosis
caccugacagacccgaucgauc

SEQ ID NO: 962860 - RNA, 15 nt, Mycobacterium avium subsp. paratuberculosis
caccugaccgcgggc

SEQ ID NO: 962861 - RNA, 21 nt, Mycobacterium avium subsp. paratuberculosis
caccugaccgcgggcccgccg

SEQ ID NO: 962862 - RNA, 16 nt, Mycobacterium avium subsp. paratuberculosis
caccugaccgucggcc

SEQ ID NO: 962863 - RNA, 17 nt, Mycobacterium avium subsp. paratuberculosis
caccugaccgucggcca

SEQ ID NO: 962864 - RNA, 16 nt, Mycobacterium avium subsp. paratuberculosis
caccucuucgggcagc

SEQ ID NO: 962865 - RNA, 20 nt, Mycobacterium avium subsp. paratuberculosis
caccucuucgggcagcgcgu

SEQ ID NO: 962866 - RNA, 23 nt, Mycobacterium avium subsp. paratuberculosis
caccugaacggccgcgcagaucg

SEQ ID NO: 962867 - RNA, 16 nt, Mycobacterium avium subsp. paratuberculosis
caccugaucgaugccg

SEQ ID NO: 962868 - RNA, 17 nt, Mycobacterium avium subsp. paratuberculosis
caccugaucgcggcgag

SEQ ID NO: 962869 - RNA, 19 nt, Mycobacterium avium subsp. paratuberculosis
caccugaucgcggcgagca

SEQ ID NO: 962870 - RNA, 20 nt, Mycobacterium avium subsp. paratuberculosis
caccugaucgcggcgagcag

SEQ ID NO: 962871 - RNA, 22 nt, Mycobacterium avium subsp. paratuberculosis
caccugaucgcggcgagcagcg

SEQ ID NO: 962872 - RNA, 21 nt, Mycobacterium avium subsp. paratuberculosis
caccugauaggggucggcgaa

SEQ ID NO: 962873 - RNA, 19 nt, Mycobacterium avium subsp. paratuberculosis
caccugcacggggacgucg

SEQ ID NO: 962874 - RNA, 21 nt, Mycobacterium avium subsp. paratuberculosis
caccugcacggggacgucguc

SEQ ID NO: 962875 - RNA, 18 nt, Mycobacterium avium subsp. paratuberculosis
caccugagucugggucac

SEQ ID NO: 962876 - RNA, 13 nt, Mycobacterium avium subsp. paratuberculosis
caccugcagccgg

SEQ ID NO: 962877 - RNA, 20 nt, Mycobacterium avium subsp. paratuberculosis
caccugcagccggucggagg

SEQ ID NO: 962878 - RNA, 20 nt, Mycobacterium avium subsp. paratuberculosis
caccugcaucacgauggugc

SEQ ID NO: 962879 - RNA, 15 nt, Mycobacterium avium subsp. paratuberculosis
caccgugcugaucca

SEQ ID NO: 962880 - RNA, 22 nt, Mycobacterium avium subsp. paratuberculosis
caccgugcugauccacgcccgg

SEQ ID NO: 962881 - RNA, 17 nt, Mycobacterium avium subsp. paratuberculosis
caccgugcuggccacca

SEQ ID NO: 962882 - RNA, 18 nt, Mycobacterium avium subsp. paratuberculosis
caccgugcuggccaccac

SEQ ID NO: 962883 - RNA, 16 nt, Mycobacterium avium subsp. paratuberculosis
caccgugcugugcugc

SEQ ID NO: 962884 - RNA, 23 nt, Mycobacterium avium subsp. paratuberculosis
caccgugcugugcugccugccgu

SEQ ID NO: 962885 - RNA, 14 nt, Mycobacterium avium subsp. paratuberculosis
caccguggccccac

SEQ ID NO: 962886 - RNA, 17 nt, Mycobacterium avium subsp. paratuberculosis
caccguggccccacggg

SEQ ID NO: 962887 - RNA, 19 nt, Mycobacterium avium subsp. paratuberculosis
caccguggccccacgggcc

SEQ ID NO: 962888 - RNA, 16 nt, Mycobacterium avium subsp. paratuberculosis
caccguggcgaugggc

SEQ ID NO: 962889 - RNA, 17 nt, Mycobacterium avium subsp. paratuberculosis
caccgugcgggucgcgc

SEQ ID NO: 962890 - RNA, 16 nt, Mycobacterium avium subsp. paratuberculosis
caccguggagacgucc

SEQ ID NO: 962891 - RNA, 17 nt, Mycobacterium avium subsp. paratuberculosis
caccguggagacguccg

SEQ ID NO: 962892 - RNA, 20 nt, Mycobacterium avium subsp. paratuberculosis
caccguggagacguccgagg

SEQ ID NO: 962893 - RNA, 14 nt, Mycobacterium avium subsp. paratuberculosis
caccgucggcgauc

SEQ ID NO: 962894 - RNA, 15 nt, Mycobacterium avium subsp. paratuberculosis
caccgucggcgaucg

SEQ ID NO: 962895 - RNA, 20 nt, Mycobacterium avium subsp. paratuberculosis
caccgucggcgaucgccggg

SEQ ID NO: 962896 - RNA, 21 nt, Mycobacterium avium subsp. paratuberculosis
caccgucggcgaucgccgggg

SEQ ID NO: 962897 - RNA, 17 nt, Mycobacterium avium subsp. paratuberculosis
caccgucguacucgacc

SEQ ID NO: 962898 - RNA, 21 nt, Mycobacterium avium subsp. paratuberculosis
caccgucguacucgaccgcga

SEQ ID NO: 962899 - RNA, 15 nt, Mycobacterium avium subsp. paratuberculosis
caccgucgucgagcg

SEQ ID NO: 962900 - RNA, 12 nt, Mycobacterium avium subsp. paratuberculosis
caccgucgucgc

SEQ ID NO: 962901 - RNA, 17 nt, Mycobacterium avium subsp. paratuberculosis
caccgucgucgcaccgg

SEQ ID NO: 962902 - RNA, 19 nt, Mycobacterium avium subsp. paratuberculosis
caccgucgucgcaccggca

SEQ ID NO: 962903 - RNA, 16 nt, Mycobacterium avium subsp. paratuberculosis
caccgucgugccagcg

SEQ ID NO: 962904 - RNA, 16 nt, Mycobacterium avium subsp. paratuberculosis
caccucgaucagcggc

SEQ ID NO: 962905 - RNA, 17 nt, Mycobacterium avium subsp. paratuberculosis
caccucgaucagcggca

SEQ ID NO: 962906 - RNA, 12 nt, Mycobacterium avium subsp. paratuberculosis
caccucgacgaa

SEQ ID NO: 962907 - RNA, 18 nt, Mycobacterium avium subsp. paratuberculosis
caccucgagcucaccgac

SEQ ID NO: 962908 - RNA, 16 nt, Mycobacterium avium subsp. paratuberculosis
caccucgaagccgacg

SEQ ID NO: 962909 - RNA, 18 nt, Mycobacterium avium subsp. paratuberculosis
caccucgaagccgacguc

SEQ ID NO: 962910 - RNA, 16 nt, Mycobacterium avium subsp. paratuberculosis
caccucgaagccgauc

SEQ ID NO: 962911 - RNA, 14 nt, Mycobacterium avium subsp. paratuberculosis
caccucgacggcgu

SEQ ID NO: 962912 - RNA, 15 nt, Mycobacterium avium subsp. paratuberculosis
caccucgagcaaccg

SEQ ID NO: 962913 - RNA, 15 nt, Mycobacterium avium subsp. paratuberculosis
caccucgagcacgcc

SEQ ID NO: 962914 - RNA, 20 nt, Mycobacterium avium subsp. paratuberculosis
caccucgagcacucgcggga

SEQ ID NO: 962915 - RNA, 23 nt, Mycobacterium avium subsp. paratuberculosis
caccuccuuggguucggcggcgc

SEQ ID NO: 962916 - RNA, 15 nt, Mycobacterium avium subsp. paratuberculosis
caccucgcccggcuc

SEQ ID NO: 962917 - RNA, 16 nt, Mycobacterium avium subsp. paratuberculosis
caccucgcccggcucg

SEQ ID NO: 962918 - RNA, 15 nt, Mycobacterium avium subsp. paratuberculosis
caccucgccggccgc

SEQ ID NO: 962919 - RNA, 18 nt, Mycobacterium avium subsp. paratuberculosis
caccucgccggccgggcg

SEQ ID NO: 962920 - RNA, 14 nt, Mycobacterium avium subsp. paratuberculosis
caccucgccguccu

SEQ ID NO: 962921 - RNA, 17 nt, Mycobacterium avium subsp. paratuberculosis
caccucgcgcagcaccg

SEQ ID NO: 962922 - RNA, 20 nt, Mycobacterium avium subsp. paratuberculosis
caccucgcgcggggcggccg

SEQ ID NO: 962923 - RNA, 22 nt, Mycobacterium avium subsp. paratuberculosis
caccucgcgcucuugggcggcc

SEQ ID NO: 962924 - RNA, 14 nt, Mycobacterium avium subsp. paratuberculosis
caccucgcggcagc

SEQ ID NO: 962925 - RNA, 15 nt, Mycobacterium avium subsp. paratuberculosis
caccucgcggcagcc

SEQ ID NO: 962926 - RNA, 21 nt, Mycobacterium avium subsp. paratuberculosis
caccguggcgggggagccgug

SEQ ID NO: 962927 - RNA, 15 nt, Mycobacterium avium subsp. paratuberculosis
caccgugggcggcgc

SEQ ID NO: 962928 - RNA, 16 nt, Mycobacterium avium subsp. paratuberculosis
caccgugggcggcgcg

SEQ ID NO: 962929 - RNA, 13 nt, Mycobacterium avium subsp. paratuberculosis
caccguggucggc

SEQ ID NO: 962930 - RNA, 15 nt, Mycobacterium avium subsp. paratuberculosis
caccguggucggcag

SEQ ID NO: 962931 - RNA, 23 nt, Mycobacterium avium subsp. paratuberculosis
caccuccccgcggugccgcagcu

SEQ ID NO: 962932 - RNA, 21 nt, Mycobacterium avium subsp. paratuberculosis
caccucccuguuagggcgacc

SEQ ID NO: 962933 - RNA, 12 nt, Mycobacterium avium subsp. paratuberculosis
caccuccucgcg

SEQ ID NO: 962934 - RNA, 19 nt, Mycobacterium avium subsp. paratuberculosis
caccuccucgcgggcgauc

SEQ ID NO: 962935 - RNA, 22 nt, Mycobacterium avium subsp. paratuberculosis
caccuccucgguguacagcgcc

SEQ ID NO: 962936 - RNA, 23 nt, Mycobacterium avium subsp. paratuberculosis
caccuccucgguguacagcgcca

SEQ ID NO: 962937 - RNA, 22 nt, Mycobacterium avium subsp. paratuberculosis
caccuccugggugagcggcgcg

SEQ ID NO: 962938 - RNA, 18 nt, Mycobacterium avium subsp. paratuberculosis
caccuccuuggccaggcg

SEQ ID NO: 962939 - RNA, 19 nt, Mycobacterium avium subsp. paratuberculosis
caccggaagcgcgcaucgc

SEQ ID NO: 962940 - RNA, 20 nt, Mycobacterium avium subsp. paratuberculosis
caccggaagcgcgcaucgcg

SEQ ID NO: 962941 - RNA, 13 nt, Mycobacterium avium subsp. paratuberculosis
caccggaccgccg

SEQ ID NO: 962942 - RNA, 15 nt, Mycobacterium avium subsp. paratuberculosis
caccggaccgccgag

SEQ ID NO: 962943 - RNA, 13 nt, Mycobacterium avium subsp. paratuberculosis
caccggaccggcc

SEQ ID NO: 962944 - RNA, 16 nt, Mycobacterium avium subsp. paratuberculosis
caccggaccggccagc

SEQ ID NO: 962945 - RNA, 17 nt, Mycobacterium avium subsp. paratuberculosis
caccggaccggccagca

SEQ ID NO: 962946 - RNA, 20 nt, Mycobacterium avium subsp. paratuberculosis
caccggaccggccagcagcc

SEQ ID NO: 962947 - RNA, 13 nt, Mycobacterium avium subsp. paratuberculosis
caccggacgcagc

SEQ ID NO: 962948 - RNA, 22 nt, Mycobacterium avium subsp. paratuberculosis
caccggagccuuggucgcggcc

SEQ ID NO: 962949 - RNA, 22 nt, Mycobacterium avium subsp. paratuberculosis
caccggcgucauggugcgcggg

SEQ ID NO: 962950 - RNA, 14 nt, Mycobacterium avium subsp. paratuberculosis
caccggcgcgccgu

SEQ ID NO: 962951 - RNA, 16 nt, Mycobacterium avium subsp. paratuberculosis
caccggcgcgccgucc

SEQ ID NO: 962952 - RNA, 17 nt, Mycobacterium avium subsp. paratuberculosis
caccggcgcgccguccu

SEQ ID NO: 962953 - RNA, 14 nt, Mycobacterium avium subsp. paratuberculosis
caccggcgucgaca

SEQ ID NO: 962954 - RNA, 18 nt, Mycobacterium avium subsp. paratuberculosis
caccggcgucgacagccg

SEQ ID NO: 962955 - RNA, 21 nt, Mycobacterium avium subsp. paratuberculosis
caccggcgucgacagccgguc

SEQ ID NO: 962956 - RNA, 23 nt, Mycobacterium avium subsp. paratuberculosis
caccggcgucgacagccggucgc

SEQ ID NO: 962957 - RNA, 19 nt, Mycobacterium avium subsp. paratuberculosis
caccggcgcguuggcccgu

SEQ ID NO: 962958 - RNA, 16 nt, Mycobacterium avium subsp. paratuberculosis
caccggcgcugcccgc

SEQ ID NO: 962959 - RNA, 22 nt, Mycobacterium avium subsp. paratuberculosis
caccggcggauucucgcucugc

SEQ ID NO: 962960 - RNA, 17 nt, Mycobacterium avium subsp. paratuberculosis
caccggcggcagcgacu

SEQ ID NO: 962961 - RNA, 13 nt, Mycobacterium avium subsp. paratuberculosis
caccggcgcgacg

SEQ ID NO: 962962 - RNA, 15 nt, Mycobacterium avium subsp. paratuberculosis
caccggcgcgacggc

SEQ ID NO: 962963 - RNA, 17 nt, Mycobacterium avium subsp. paratuberculosis
caccggcgcgacggcgg

SEQ ID NO: 962964 - RNA, 20 nt, Mycobacterium avium subsp. paratuberculosis
caccggcgcgccgcguucgg

SEQ ID NO: 962965 - RNA, 22 nt, Mycobacterium avium subsp. paratuberculosis
caccggcgcgccgcguucggcg

SEQ ID NO: 962966 - RNA, 23 nt, Mycobacterium avium subsp. paratuberculosis
caccggcgcgccgcguucggcgg

SEQ ID NO: 962967 - RNA, 23 nt, Mycobacterium avium subsp. paratuberculosis
caccgggaccagcgcggugccgg

SEQ ID NO: 962968 - RNA, 13 nt, Mycobacterium avium subsp. paratuberculosis
caccgggaccugc

SEQ ID NO: 962969 - RNA, 22 nt, Mycobacterium avium subsp. paratuberculosis
caccgggaccugcugcucgucg

SEQ ID NO: 962970 - RNA, 23 nt, Mycobacterium avium subsp. paratuberculosis
caccgggaccugcugcucgucgc

SEQ ID NO: 962971 - RNA, 13 nt, Mycobacterium avium subsp. paratuberculosis
caccggcuggccg

SEQ ID NO: 962972 - RNA, 17 nt, Mycobacterium avium subsp. paratuberculosis
caccggcuucuccucgg

SEQ ID NO: 962973 - RNA, 18 nt, Mycobacterium avium subsp. paratuberculosis
caccggcuucuccucggu

SEQ ID NO: 962974 - RNA, 16 nt, Mycobacterium avium subsp. paratuberculosis
caccggcuugccgauc

SEQ ID NO: 962975 - RNA, 16 nt, Mycobacterium avium subsp. paratuberculosis
caccggcuuggccacg

SEQ ID NO: 962976 - RNA, 16 nt, Mycobacterium avium subsp. paratuberculosis
caccggcuuggcggug

SEQ ID NO: 962977 - RNA, 17 nt, Mycobacterium avium subsp. paratuberculosis
caccggcuuggcgguga

SEQ ID NO: 962978 - RNA, 16 nt, Mycobacterium avium subsp. paratuberculosis
caccggcuggucggcg

SEQ ID NO: 962979 - RNA, 19 nt, Mycobacterium avium subsp. paratuberculosis
caccggcuggucggcgggu

SEQ ID NO: 962980 - RNA, 20 nt, Mycobacterium avium subsp. paratuberculosis
caccggcuggucggcgggua

SEQ ID NO: 962981 - RNA, 15 nt, Mycobacterium avium subsp. paratuberculosis
caccggcuggugcag

SEQ ID NO: 962982 - RNA, 17 nt, Mycobacterium avium subsp. paratuberculosis
caccggcuggugcagca

SEQ ID NO: 962983 - RNA, 23 nt, Mycobacterium avium subsp. paratuberculosis
caccggcuggugcagcagcugga

SEQ ID NO: 962984 - RNA, 14 nt, Mycobacterium avium subsp. paratuberculosis
caccggcuggccgg

SEQ ID NO: 962985 - RNA, 15 nt, Mycobacterium avium subsp. paratuberculosis
caccggcuggccgga

SEQ ID NO: 962986 - RNA, 18 nt, Mycobacterium avium subsp. paratuberculosis
caccggcuggccggaaag

SEQ ID NO: 962987 - RNA, 16 nt, Mycobacterium avium subsp. paratuberculosis
caccggcguggggacc

SEQ ID NO: 962988 - RNA, 22 nt, Mycobacterium avium subsp. paratuberculosis
caccggcgugaugacggcggcg

SEQ ID NO: 962989 - RNA, 20 nt, Mycobacterium avium subsp. paratuberculosis
caccggcuccuugcgccgca

SEQ ID NO: 962990 - RNA, 21 nt, Mycobacterium avium subsp. paratuberculosis
caccggcucgcggggugucgu

SEQ ID NO: 962991 - RNA, 16 nt, Mycobacterium avium subsp. paratuberculosis
caccggcugaccggcg

SEQ ID NO: 962992 - RNA, 20 nt, Mycobacterium avium subsp. paratuberculosis
caccggcugaccggcggugc

SEQ ID NO: 962993 - RNA, 22 nt, Mycobacterium avium subsp. paratuberculosis
caccggcugaccggcggugccg

SEQ ID NO: 962994 - RNA, 20 nt, Mycobacterium avium subsp. paratuberculosis
caccggcucgcugaucugcg

SEQ ID NO: 962995 - RNA, 15 nt, Mycobacterium avium subsp. paratuberculosis
caccggcugcccgac

SEQ ID NO: 962996 - RNA, 18 nt, Mycobacterium avium subsp. paratuberculosis
caccggcugcccgacccg

SEQ ID NO: 962997 - RNA, 19 nt, Mycobacterium avium subsp. paratuberculosis
caccggcugcccgacccgc

SEQ ID NO: 962998 - RNA, 20 nt, Mycobacterium avium subsp. paratuberculosis
caccggcuggccgagcggcu

SEQ ID NO: 962999 - RNA, 22 nt, Mycobacterium avium subsp. paratuberculosis
caccggcuggccgagcggcugc

SEQ ID NO: 963000 - RNA, 21 nt, Mycobacterium avium subsp. paratuberculosis
caccggucagcgcuacugccg

SEQ ID NO: 963001 - RNA, 17 nt, Mycobacterium avium subsp. paratuberculosis
caccggucagcuggugc

SEQ ID NO: 963002 - RNA, 14 nt, Mycobacterium avium subsp. paratuberculosis
caccggugacgacc

SEQ ID NO: 963003 - RNA, 17 nt, Mycobacterium avium subsp. paratuberculosis
caccggugacgaccggc

SEQ ID NO: 963004 - RNA, 23 nt, Mycobacterium avium subsp. paratuberculosis
caccggucgcguugaaagccgcg

SEQ ID NO: 963005 - RNA, 16 nt, Mycobacterium avium subsp. paratuberculosis
caccggucggugccca

SEQ ID NO: 963006 - RNA, 14 nt, Mycobacterium avium subsp. paratuberculosis
caccggucuccggc

SEQ ID NO: 963007 - RNA, 17 nt, Mycobacterium avium subsp. paratuberculosis
caccgggauccggcgcg

SEQ ID NO: 963008 - RNA, 18 nt, Mycobacterium avium subsp. paratuberculosis
caccgggauccggcgcgc

SEQ ID NO: 963009 - RNA, 20 nt, Mycobacterium avium subsp. paratuberculosis
caccgggauccggcgcgccg

SEQ ID NO: 963010 - RNA, 20 nt, Mycobacterium avium subsp. paratuberculosis
caccgggauggugaccagcg

SEQ ID NO: 963011 - RNA, 21 nt, Mycobacterium avium subsp. paratuberculosis
caccgggauggugaccagcgc

SEQ ID NO: 963012 - RNA, 22 nt, Mycobacterium avium subsp. paratuberculosis
caccgggauggugaccagcgcc

SEQ ID NO: 963013 - RNA, 13 nt, Mycobacterium avium subsp. paratuberculosis
caccgggacgggg

SEQ ID NO: 963014 - RNA, 15 nt, Mycobacterium avium subsp. paratuberculosis
caccgggacgggggu

SEQ ID NO: 963015 - RNA, 16 nt, Mycobacterium avium subsp. paratuberculosis
caccgggacgggggug

SEQ ID NO: 963016 - RNA, 23 nt, Mycobacterium avium subsp. paratuberculosis
caccgggacgggggugccgaccg

SEQ ID NO: 963017 - RNA, 21 nt, Mycobacterium avium subsp. paratuberculosis
caccgggacgggucggugguu

SEQ ID NO: 963018 - RNA, 18 nt, Mycobacterium avium subsp. paratuberculosis
caccgggacaccgcuggc

SEQ ID NO: 963019 - RNA, 21 nt, Mycobacterium avium subsp. paratuberculosis
caccgggaucacccucggcgu

SEQ ID NO: 963020 - RNA, 14 nt, Mycobacterium avium subsp. paratuberculosis
caccgggaucggcg

SEQ ID NO: 963021 - RNA, 16 nt, Mycobacterium avium subsp. paratuberculosis
caccgggaucggcggc

SEQ ID NO: 963022 - RNA, 17 nt, Mycobacterium avium subsp. paratuberculosis
caccgggaucggcggcg

SEQ ID NO: 963023 - RNA, 18 nt, Mycobacterium avium subsp. paratuberculosis
caccgggaucggcggcgg

SEQ ID NO: 963024 - RNA, 15 nt, Mycobacterium avium subsp. paratuberculosis
caccgucaccgacgg

SEQ ID NO: 963025 - RNA, 14 nt, Mycobacterium avium subsp. paratuberculosis
caccgucaccgccg

SEQ ID NO: 963026 - RNA, 19 nt, Mycobacterium avium subsp. paratuberculosis
caccgucgcccgcccaggc

SEQ ID NO: 963027 - RNA, 14 nt, Mycobacterium avium subsp. paratuberculosis
caccgucgccggcg

SEQ ID NO: 963028 - RNA, 22 nt, Mycobacterium avium subsp. paratuberculosis
caccgucgccggcggggcgucg

SEQ ID NO: 963029 - RNA, 15 nt, Mycobacterium avium subsp. paratuberculosis
caccgucgccggcug

SEQ ID NO: 963030 - RNA, 17 nt, Mycobacterium avium subsp. paratuberculosis
caccgucgccggcugac

SEQ ID NO: 963031 - RNA, 20 nt, Mycobacterium avium subsp. paratuberculosis
caccgucgccggcugacugc

SEQ ID NO: 963032 - RNA, 22 nt, Mycobacterium avium subsp. paratuberculosis
caccgucgccggcugacugccg

SEQ ID NO: 963033 - RNA, 15 nt, Mycobacterium avium subsp. paratuberculosis
caccgucaccgccgc

SEQ ID NO: 963034 - RNA, 14 nt, Mycobacterium avium subsp. paratuberculosis
caccgucaccgccu

SEQ ID NO: 963035 - RNA, 15 nt, Mycobacterium avium subsp. paratuberculosis
caccgucaccgccuc

SEQ ID NO: 963036 - RNA, 17 nt, Mycobacterium avium subsp. paratuberculosis
caccgguugcgccgagg

SEQ ID NO: 963037 - RNA, 19 nt, Mycobacterium avium subsp. paratuberculosis
caccggugcggcggugacg

SEQ ID NO: 963038 - RNA, 21 nt, Mycobacterium avium subsp. paratuberculosis
caccggugcucuccugcuuga

SEQ ID NO: 963039 - RNA, 16 nt, Mycobacterium avium subsp. paratuberculosis
caccgguggccgcguc

SEQ ID NO: 963040 - RNA, 21 nt, Mycobacterium avium subsp. paratuberculosis
caccgguggcguugcgggcga

SEQ ID NO: 963041 - RNA, 23 nt, Mycobacterium avium subsp. paratuberculosis
caccgguggcguugcgggcgaac

SEQ ID NO: 963042 - RNA, 17 nt, Mycobacterium avium subsp. paratuberculosis
caccggugucacgcugg

SEQ ID NO: 963043 - RNA, 19 nt, Mycobacterium avium subsp. paratuberculosis
caccggugucacgcuggcg

SEQ ID NO: 963044 - RNA, 13 nt, Mycobacterium avium subsp. paratuberculosis
aucccaccaugag

SEQ ID NO: 963045 - RNA, 18 nt, Mycobacterium avium subsp. paratuberculosis
auccauugggccgcggcg

SEQ ID NO: 963046 - RNA, 20 nt, Mycobacterium avium subsp. paratuberculosis
auccauugggccgcggcguc

SEQ ID NO: 963047 - RNA, 17 nt, Mycobacterium avium subsp. paratuberculosis
auccagguggggcacgg

SEQ ID NO: 963048 - RNA, 16 nt, Mycobacterium avium subsp. paratuberculosis
auccagucggcgccga

SEQ ID NO: 963049 - RNA, 16 nt, Mycobacterium avium subsp. paratuberculosis
auccccaccgugacgu

SEQ ID NO: 963050 - RNA, 16 nt, Mycobacterium avium subsp. paratuberculosis
auccccacgucgccgu

SEQ ID NO: 963051 - RNA, 18 nt, Mycobacterium avium subsp. paratuberculosis
aucccaucagugcggccc

SEQ ID NO: 963052 - RNA, 16 nt, Mycobacterium avium subsp. paratuberculosis
aucccagcgggacagc

SEQ ID NO: 963053 - RNA, 16 nt, Mycobacterium avium subsp. paratuberculosis
aucccaggaacgcgcc

SEQ ID NO: 963054 - RNA, 13 nt, Mycobacterium avium subsp. paratuberculosis
auccccgcgcugg

SEQ ID NO: 963055 - RNA, 21 nt, Mycobacterium avium subsp. paratuberculosis
auccccgcgcugggcuggccg

SEQ ID NO: 963056 - RNA, 13 nt, Mycobacterium avium subsp. paratuberculosis
auccccagcggca

SEQ ID NO: 963057 - RNA, 13 nt, Mycobacterium avium subsp. paratuberculosis
auccccccgcgcc

SEQ ID NO: 963058 - RNA, 23 nt, Mycobacterium avium subsp. paratuberculosis
aucccccgaaaccauugcaccgc

SEQ ID NO: 963059 - RNA, 19 nt, Mycobacterium avium subsp. paratuberculosis
aucccgguucccggcacca

SEQ ID NO: 963060 - RNA, 19 nt, Mycobacterium avium subsp. paratuberculosis
aucccguacucgaugccgu

SEQ ID NO: 963061 - RNA, 16 nt, Mycobacterium avium subsp. paratuberculosis
aucccguagccguaga

SEQ ID NO: 963062 - RNA, 19 nt, Mycobacterium avium subsp. paratuberculosis
aucccguaggucgccucca

SEQ ID NO: 963063 - RNA, 12 nt, Mycobacterium avium subsp. paratuberculosis
aucccgggccgu

SEQ ID NO: 963064 - RNA, 16 nt, Mycobacterium avium subsp. paratuberculosis
aucccggccaccccgc

SEQ ID NO: 963065 - RNA, 12 nt, Mycobacterium avium subsp. paratuberculosis
aucccggccacg

SEQ ID NO: 963066 - RNA, 13 nt, Mycobacterium avium subsp. paratuberculosis
aucccggccagca

SEQ ID NO: 963067 - RNA, 13 nt, Mycobacterium avium subsp. paratuberculosis
aucccggcgagca

SEQ ID NO: 963068 - RNA, 16 nt, Mycobacterium avium subsp. paratuberculosis
aucccuugccgccgaa

SEQ ID NO: 963069 - RNA, 21 nt, Mycobacterium avium subsp. paratuberculosis
aucccuggugaccgacgacgu

SEQ ID NO: 963070 - RNA, 16 nt, Mycobacterium avium subsp. paratuberculosis
aucccgugcggagauc

SEQ ID NO: 963071 - RNA, 21 nt, Mycobacterium avium subsp. paratuberculosis
aucccuccggcaggccgcggc

SEQ ID NO: 963072 - RNA, 21 nt, Mycobacterium avium subsp. paratuberculosis
aucccgucggccaucagccgc

SEQ ID NO: 963073 - RNA, 19 nt, Mycobacterium avium subsp. paratuberculosis
aucccgucgucggcgccgc

SEQ ID NO: 963074 - RNA, 23 nt, Mycobacterium avium subsp. paratuberculosis
aucccgucgucggcgccgcgccg

SEQ ID NO: 963075 - RNA, 19 nt, Mycobacterium avium subsp. paratuberculosis
aucccgcaauugcgccagc

SEQ ID NO: 963076 - RNA, 14 nt, Mycobacterium avium subsp. paratuberculosis
aucccgcagccgcg

SEQ ID NO: 963077 - RNA, 15 nt, Mycobacterium avium subsp. paratuberculosis
aucccgcagccgcga

SEQ ID NO: 963078 - RNA, 12 nt, Mycobacterium avium subsp. paratuberculosis
aucccgcagcuc

SEQ ID NO: 963079 - RNA, 15 nt, Mycobacterium avium subsp. paratuberculosis
aucccgcagcuucug

SEQ ID NO: 963080 - RNA, 15 nt, Mycobacterium avium subsp. paratuberculosis
aucccgaggaugccg

SEQ ID NO: 963081 - RNA, 19 nt, Mycobacterium avium subsp. paratuberculosis
aucccgaggaugccgccca

SEQ ID NO: 963082 - RNA, 21 nt, Mycobacterium avium subsp. paratuberculosis
aucccgaggaugccgcccacc

SEQ ID NO: 963083 - RNA, 15 nt, Mycobacterium avium subsp. paratuberculosis
aucccgauccgcgcc

SEQ ID NO: 963084 - RNA, 16 nt, Mycobacterium avium subsp. paratuberculosis
aucccgauccgcgccg

SEQ ID NO: 963085 - RNA, 17 nt, Mycobacterium avium subsp. paratuberculosis
aucccgauccgcgccgc

SEQ ID NO: 963086 - RNA, 14 nt, Mycobacterium avium subsp. paratuberculosis
aucccgaucgacgu

SEQ ID NO: 963087 - RNA, 15 nt, Mycobacterium avium subsp. paratuberculosis
aucccgaugccgcgc

SEQ ID NO: 963088 - RNA, 17 nt, Mycobacterium avium subsp. paratuberculosis
aucccgaugccgcgcag

SEQ ID NO: 963089 - RNA, 13 nt, Mycobacterium avium subsp. paratuberculosis
auccccuggccga

SEQ ID NO: 963090 - RNA, 17 nt, Mycobacterium avium subsp. paratuberculosis
aucccgaacugccgcgc

SEQ ID NO: 963091 - RNA, 14 nt, Mycobacterium avium subsp. paratuberculosis
aucccgcgggucgc

SEQ ID NO: 963092 - RNA, 23 nt, Mycobacterium avium subsp. paratuberculosis
aucccgccggcgaucgacgucac

SEQ ID NO: 963093 - RNA, 18 nt, Mycobacterium avium subsp. paratuberculosis
aucccgccggcggccacg

SEQ ID NO: 963094 - RNA, 16 nt, Mycobacterium avium subsp. paratuberculosis
aucccgccucggcgga

SEQ ID NO: 963095 - RNA, 14 nt, Mycobacterium avium subsp. paratuberculosis
aucccgccgccgaa

SEQ ID NO: 963096 - RNA, 15 nt, Mycobacterium avium subsp. paratuberculosis
aucauggucggcgac

SEQ ID NO: 963097 - RNA, 22 nt, Mycobacterium avium subsp. paratuberculosis
aucauggucggcgacgccgucg

SEQ ID NO: 963098 - RNA, 18 nt, Mycobacterium avium subsp. paratuberculosis
aucauggcgcugcgcgac

SEQ ID NO: 963099 - RNA, 13 nt, Mycobacterium avium subsp. paratuberculosis
aucauugagccgc

SEQ ID NO: 963100 - RNA, 14 nt, Mycobacterium avium subsp. paratuberculosis
auccacagcgcgaa

SEQ ID NO: 963101 - RNA, 11 nt, Mycobacterium avium subsp. paratuberculosis
auccacagcgg

SEQ ID NO: 963102 - RNA, 15 nt, Mycobacterium avium subsp. paratuberculosis
auccacagcgguucg

SEQ ID NO: 963103 - RNA, 15 nt, Mycobacterium avium subsp. paratuberculosis
auccacgaugccggg

SEQ ID NO: 963104 - RNA, 14 nt, Mycobacterium avium subsp. paratuberculosis
auccacucggccac

SEQ ID NO: 963105 - RNA, 19 nt, Mycobacterium avium subsp. paratuberculosis
auccacucgggccagccca

SEQ ID NO: 963106 - RNA, 20 nt, Mycobacterium avium subsp. paratuberculosis
auccacgcggugauccagag

SEQ ID NO: 963107 - RNA, 17 nt, Mycobacterium avium subsp. paratuberculosis
auccacgccuccggcag

SEQ ID NO: 963108 - RNA, 14 nt, Mycobacterium avium subsp. paratuberculosis
auccagcagcgccu

SEQ ID NO: 963109 - RNA, 24 nt, Mycobacterium avium subsp. paratuberculosis
auccagcagcgccucggcgaucgg

SEQ ID NO: 963110 - RNA, 13 nt, Mycobacterium avium subsp. paratuberculosis
auccagcagcgcg

SEQ ID NO: 963111 - RNA, 14 nt, Mycobacterium avium subsp. paratuberculosis
auccagcagcgcgg

SEQ ID NO: 963112 - RNA, 16 nt, Mycobacterium avium subsp. paratuberculosis
auccagcagcgcgguu

SEQ ID NO: 963113 - RNA, 13 nt, Mycobacterium avium subsp. paratuberculosis
auccagaugccca

SEQ ID NO: 963114 - RNA, 18 nt, Mycobacterium avium subsp. paratuberculosis
auccagagcaucagggcg

SEQ ID NO: 963115 - RNA, 18 nt, Mycobacterium avium subsp. paratuberculosis
auccagacggucuuggcg

SEQ ID NO: 963116 - RNA, 23 nt, Mycobacterium avium subsp. paratuberculosis
auccagcccugcuugaccgcgac

SEQ ID NO: 963117 - RNA, 19 nt, Mycobacterium avium subsp. paratuberculosis
auccagccuugcagccgcu

SEQ ID NO: 963118 - RNA, 23 nt, Mycobacterium avium subsp. paratuberculosis
auccagccgucguugcgggcggc

SEQ ID NO: 963119 - RNA, 22 nt, Mycobacterium avium subsp. paratuberculosis
auccagccgugcggcuugcccg

SEQ ID NO: 963120 - RNA, 13 nt, Mycobacterium avium subsp. paratuberculosis
auccagcggcggc

SEQ ID NO: 963121 - RNA, 15 nt, Mycobacterium avium subsp. paratuberculosis
auccagcggcggccu

SEQ ID NO: 963122 - RNA, 17 nt, Mycobacterium avium subsp. paratuberculosis
auccagcgcuggccggc

SEQ ID NO: 963123 - RNA, 19 nt, Mycobacterium avium subsp. paratuberculosis
auccagcgcuggccggcca

SEQ ID NO: 963124 - RNA, 20 nt, Mycobacterium avium subsp. paratuberculosis
auccaggaccgcgcgccggc

SEQ ID NO: 963125 - RNA, 12 nt, Mycobacterium avium subsp. paratuberculosis
auccagcgcgcc

SEQ ID NO: 963126 - RNA, 11 nt, Mycobacterium avium subsp. paratuberculosis
auccagcggcg

SEQ ID NO: 963127 - RNA, 22 nt, Mycobacterium avium subsp. paratuberculosis
auccuggccuggucggccggca

SEQ ID NO: 963128 - RNA, 15 nt, Mycobacterium avium subsp. paratuberculosis
auccugggcgucgag

SEQ ID NO: 963129 - RNA, 18 nt, Mycobacterium avium subsp. paratuberculosis
auccugguuucagguggc

SEQ ID NO: 963130 - RNA, 14 nt, Mycobacterium avium subsp. paratuberculosis
auccucgccgagca

SEQ ID NO: 963131 - RNA, 13 nt, Mycobacterium avium subsp. paratuberculosis
auccucgccgcgc

SEQ ID NO: 963132 - RNA, 20 nt, Mycobacterium avium subsp. paratuberculosis
auccucagcacggccgcggc

SEQ ID NO: 963133 - RNA, 22 nt, Mycobacterium avium subsp. paratuberculosis
auccucagcacggccgcggcca

SEQ ID NO: 963134 - RNA, 18 nt, Mycobacterium avium subsp. paratuberculosis
auccucauagccggccgc

SEQ ID NO: 963135 - RNA, 15 nt, Mycobacterium avium subsp. paratuberculosis
auccgguugcaccgc

SEQ ID NO: 963136 - RNA, 16 nt, Mycobacterium avium subsp. paratuberculosis
auccgucacgcccguc

SEQ ID NO: 963137 - RNA, 16 nt, Mycobacterium avium subsp. paratuberculosis
auccgggaggccagca

SEQ ID NO: 963138 - RNA, 22 nt, Mycobacterium avium subsp. paratuberculosis
auccggcgucucagucggccac

SEQ ID NO: 963139 - RNA, 16 nt, Mycobacterium avium subsp. paratuberculosis
auccgggccgccgcgg

SEQ ID NO: 963140 - RNA, 17 nt, Mycobacterium avium subsp. paratuberculosis
auccgggccgccgcgga

SEQ ID NO: 963141 - RNA, 13 nt, Mycobacterium avium subsp. paratuberculosis
auccgggcgccau

SEQ ID NO: 963142 - RNA, 13 nt, Mycobacterium avium subsp. paratuberculosis
auccgggcgccgg

SEQ ID NO: 963143 - RNA, 14 nt, Mycobacterium avium subsp. paratuberculosis
auccgggcgccggc

SEQ ID NO: 963144 - RNA, 18 nt, Mycobacterium avium subsp. paratuberculosis
auccgggcgccggccggc

SEQ ID NO: 963145 - RNA, 15 nt, Mycobacterium avium subsp. paratuberculosis
auccgggcgcggaug

SEQ ID NO: 963146 - RNA, 16 nt, Mycobacterium avium subsp. paratuberculosis
auccgggcggccagcc

SEQ ID NO: 963147 - RNA, 20 nt, Mycobacterium avium subsp. paratuberculosis
auccgggccaccaccacggc

SEQ ID NO: 963148 - RNA, 16 nt, Mycobacterium avium subsp. paratuberculosis
auccggggcagcagca

SEQ ID NO: 963149 - RNA, 23 nt, Mycobacterium avium subsp. paratuberculosis
auccggucagcguggcgucggcg

SEQ ID NO: 963150 - RNA, 17 nt, Mycobacterium avium subsp. paratuberculosis
auccggggucagggcgc

SEQ ID NO: 963151 - RNA, 13 nt, Mycobacterium avium subsp. paratuberculosis
auccgggugucga

SEQ ID NO: 963152 - RNA, 16 nt, Mycobacterium avium subsp. paratuberculosis
auccgggugucgacgc

SEQ ID NO: 963153 - RNA, 16 nt, Mycobacterium avium subsp. paratuberculosis
auccgguccacucguc

SEQ ID NO: 963154 - RNA, 18 nt, Mycobacterium avium subsp. paratuberculosis
auccgguccagaucggcg

SEQ ID NO: 963155 - RNA, 19 nt, Mycobacterium avium subsp. paratuberculosis
auccggugccgagcgcgcu

SEQ ID NO: 963156 - RNA, 16 nt, Mycobacterium avium subsp. paratuberculosis
auccgaugacgcugcc

SEQ ID NO: 963157 - RNA, 15 nt, Mycobacterium avium subsp. paratuberculosis
auccgaugcagggcc

SEQ ID NO: 963158 - RNA, 14 nt, Mycobacterium avium subsp. paratuberculosis
auccgauugcggcg

SEQ ID NO: 963159 - RNA, 19 nt, Mycobacterium avium subsp. paratuberculosis
auccgcaacgugcgccggc

SEQ ID NO: 963160 - RNA, 19 nt, Mycobacterium avium subsp. paratuberculosis
auccgcaggccgucgccgg

SEQ ID NO: 963161 - RNA, 18 nt, Mycobacterium avium subsp. paratuberculosis
auccgccacccgcugcuc

SEQ ID NO: 963162 - RNA, 22 nt, Mycobacterium avium subsp. paratuberculosis
auccgcaccgagaccaugccgc

SEQ ID NO: 963163 - RNA, 15 nt, Mycobacterium avium subsp. paratuberculosis
auccgaucagcagca

SEQ ID NO: 963164 - RNA, 20 nt, Mycobacterium avium subsp. paratuberculosis
aucccugacacgaccgccug

SEQ ID NO: 963165 - RNA, 13 nt, Mycobacterium avium subsp. paratuberculosis
auccgcccgccgg

SEQ ID NO: 963166 - RNA, 21 nt, Mycobacterium avium subsp. paratuberculosis
auccgcccggcccgcaugcac

SEQ ID NO: 963167 - RNA, 22 nt, Mycobacterium avium subsp. paratuberculosis
auccgccgacgauacgugcucc

SEQ ID NO: 963168 - RNA, 19 nt, Mycobacterium avium subsp. paratuberculosis
auccgccugcgcgggcgcg

SEQ ID NO: 963169 - RNA, 23 nt, Mycobacterium avium subsp. paratuberculosis
auccgcgccgaacgcaccaccgc

SEQ ID NO: 963170 - RNA, 15 nt, Mycobacterium avium subsp. paratuberculosis
auccgcgcagcagcg

SEQ ID NO: 963171 - RNA, 17 nt, Mycobacterium avium subsp. paratuberculosis
auccgcgccgccgccag

SEQ ID NO: 963172 - RNA, 18 nt, Mycobacterium avium subsp. paratuberculosis
auccgcgcgagcgcgcug

SEQ ID NO: 963173 - RNA, 17 nt, Mycobacterium avium subsp. paratuberculosis
auccgccguugcggccc

SEQ ID NO: 963174 - RNA, 16 nt, Mycobacterium avium subsp. paratuberculosis
auccgcgacgccagca

SEQ ID NO: 963175 - RNA, 18 nt, Mycobacterium avium subsp. paratuberculosis
auccgcgacgccagcacc

SEQ ID NO: 963176 - RNA, 19 nt, Mycobacterium avium subsp. paratuberculosis
auccgcgacgccagcaccu

SEQ ID NO: 963177 - RNA, 17 nt, Mycobacterium avium subsp. paratuberculosis
auccgccgggcggcguc

SEQ ID NO: 963178 - RNA, 14 nt, Mycobacterium avium subsp. paratuberculosis
auccgccgucgacc

SEQ ID NO: 963179 - RNA, 18 nt, Mycobacterium avium subsp. paratuberculosis
auccgcucgccgcgggug

SEQ ID NO: 963180 - RNA, 14 nt, Mycobacterium avium subsp. paratuberculosis
auccgcucgccguc

SEQ ID NO: 963181 - RNA, 18 nt, Mycobacterium avium subsp. paratuberculosis
auccggacgaccugggcg

SEQ ID NO: 963182 - RNA, 20 nt, Mycobacterium avium subsp. paratuberculosis
auccggacgaccugggcgcc

SEQ ID NO: 963183 - RNA, 15 nt, Mycobacterium avium subsp. paratuberculosis
auccggaacacguga

SEQ ID NO: 963184 - RNA, 22 nt, Mycobacterium avium subsp. paratuberculosis
auccggaacacgugauccaggu

SEQ ID NO: 963185 - RNA, 15 nt, Mycobacterium avium subsp. paratuberculosis
auccggaagccgucg

SEQ ID NO: 963186 - RNA, 16 nt, Mycobacterium avium subsp. paratuberculosis
auccggaucgggcggu

SEQ ID NO: 963187 - RNA, 15 nt, Mycobacterium avium subsp. paratuberculosis
auccgcggccaccgg

SEQ ID NO: 963188 - RNA, 16 nt, Mycobacterium avium subsp. paratuberculosis
auccgcgccgcgaugc

SEQ ID NO: 963189 - RNA, 12 nt, Mycobacterium avium subsp. paratuberculosis
auccgcgcggcg

SEQ ID NO: 963190 - RNA, 16 nt, Mycobacterium avium subsp. paratuberculosis
auccgcgcgucgggcu

SEQ ID NO: 963191 - RNA, 15 nt, Mycobacterium avium subsp. paratuberculosis
auccgcgggccggca

SEQ ID NO: 963192 - RNA, 22 nt, Mycobacterium avium subsp. paratuberculosis
auccgcggguacggucggccgu

SEQ ID NO: 963193 - RNA, 13 nt, Mycobacterium avium subsp. paratuberculosis
auccgcggucgac

SEQ ID NO: 963194 - RNA, 13 nt, Mycobacterium avium subsp. paratuberculosis
auccggccgcgga

SEQ ID NO: 963195 - RNA, 19 nt, Mycobacterium avium subsp. paratuberculosis
auccggccggcgaggaacu

SEQ ID NO: 963196 - RNA, 14 nt, Mycobacterium avium subsp. paratuberculosis
auccggcgcccgau

SEQ ID NO: 963197 - RNA, 18 nt, Mycobacterium avium subsp. paratuberculosis
auccggcgcccgaugaag

SEQ ID NO: 963198 - RNA, 19 nt, Mycobacterium avium subsp. paratuberculosis
auccggcgccgcgggcgcc

SEQ ID NO: 963199 - RNA, 18 nt, Mycobacterium avium subsp. paratuberculosis
auccggcggcgcucagcg

SEQ ID NO: 963200 - RNA, 21 nt, Mycobacterium avium subsp. paratuberculosis
auccggcggcgcucagcgcgg

SEQ ID NO: 963201 - RNA, 23 nt, Mycobacterium avium subsp. paratuberculosis
auccggcggcgcucagcgcggcg

SEQ ID NO: 963202 - RNA, 13 nt, Mycobacterium avium subsp. paratuberculosis
auccggcagcgcu

SEQ ID NO: 963203 - RNA, 16 nt, Mycobacterium avium subsp. paratuberculosis
auccggcagcgcucgu

SEQ ID NO: 963204 - RNA, 18 nt, Mycobacterium avium subsp. paratuberculosis
auccggcagcgcucgucg

SEQ ID NO: 963205 - RNA, 16 nt, Mycobacterium avium subsp. paratuberculosis
auccggccagccgggg

SEQ ID NO: 963206 - RNA, 13 nt, Mycobacterium avium subsp. paratuberculosis
aucaugccgccca

SEQ ID NO: 963207 - RNA, 17 nt, Mycobacterium avium subsp. paratuberculosis
aucaugccgcccaucac

SEQ ID NO: 963208 - RNA, 22 nt, Mycobacterium avium subsp. paratuberculosis
aucaugcccaccaucccgccgc

SEQ ID NO: 963209 - RNA, 19 nt, Mycobacterium avium subsp. paratuberculosis
aucaucggcacgccggggc

SEQ ID NO: 963210 - RNA, 14 nt, Mycobacterium avium subsp. paratuberculosis
aucaucccggccac

SEQ ID NO: 963211 - RNA, 13 nt, Mycobacterium avium subsp. paratuberculosis
aucagggcggcgc

SEQ ID NO: 963212 - RNA, 16 nt, Mycobacterium avium subsp. paratuberculosis
aucagggcggcgccgc

SEQ ID NO: 963213 - RNA, 19 nt, Mycobacterium avium subsp. paratuberculosis
aucagggcggcgccgcggc

SEQ ID NO: 963214 - RNA, 21 nt, Mycobacterium avium subsp. paratuberculosis
aucagggcggcgcgcgccagc

SEQ ID NO: 963215 - RNA, 15 nt, Mycobacterium avium subsp. paratuberculosis
aucaggcugccgcug

SEQ ID NO: 963216 - RNA, 15 nt, Mycobacterium avium subsp. paratuberculosis
aucagcugcucggcc

SEQ ID NO: 963217 - RNA, 16 nt, Mycobacterium avium subsp. paratuberculosis
aucagcugcucggcca

SEQ ID NO: 963218 - RNA, 17 nt, Mycobacterium avium subsp. paratuberculosis
aucagcggcgggcccag

SEQ ID NO: 963219 - RNA, 13 nt, Mycobacterium avium subsp. paratuberculosis
aucagcggggcgu

SEQ ID NO: 963220 - RNA, 17 nt, Mycobacterium avium subsp. paratuberculosis
aucagcggggcguccag

SEQ ID NO: 963221 - RNA, 19 nt, Mycobacterium avium subsp. paratuberculosis
aucagcguggucagcgucu

SEQ ID NO: 963222 - RNA, 20 nt, Mycobacterium avium subsp. paratuberculosis
aucagcguguuggacgcccg

SEQ ID NO: 963223 - RNA, 18 nt, Mycobacterium avium subsp. paratuberculosis
aucagcucguggcgggcc

SEQ ID NO: 963224 - RNA, 14 nt, Mycobacterium avium subsp. paratuberculosis
aucagcucggcagc

SEQ ID NO: 963225 - RNA, 18 nt, Mycobacterium avium subsp. paratuberculosis
aucagcucggcagccccg

SEQ ID NO: 963226 - RNA, 14 nt, Mycobacterium avium subsp. paratuberculosis
aucagcucggcggc

SEQ ID NO: 963227 - RNA, 17 nt, Mycobacterium avium subsp. paratuberculosis
aucagcucgucagcgcg

SEQ ID NO: 963228 - RNA, 13 nt, Mycobacterium avium subsp. paratuberculosis
aucagugcggccc

SEQ ID NO: 963229 - RNA, 14 nt, Mycobacterium avium subsp. paratuberculosis
aucagugccgcgcc

SEQ ID NO: 963230 - RNA, 22 nt, Mycobacterium avium subsp. paratuberculosis
aucaguuccuugauccggccgc

SEQ ID NO: 963231 - RNA, 15 nt, Mycobacterium avium subsp. paratuberculosis
aucaccgccgcggcg

SEQ ID NO: 963232 - RNA, 16 nt, Mycobacterium avium subsp. paratuberculosis
aucacgccccaggcgc

SEQ ID NO: 963233 - RNA, 19 nt, Mycobacterium avium subsp. paratuberculosis
aucaccggaccggccagca

SEQ ID NO: 963234 - RNA, 13 nt, Mycobacterium avium subsp. paratuberculosis
aucaccgcggugu

SEQ ID NO: 963235 - RNA, 19 nt, Mycobacterium avium subsp. paratuberculosis
aucaccgcgggcgcgccgu

SEQ ID NO: 963236 - RNA, 16 nt, Mycobacterium avium subsp. paratuberculosis
aucaccggcgcgccgu

SEQ ID NO: 963237 - RNA, 17 nt, Mycobacterium avium subsp. paratuberculosis
aucaccggcgcgccguc

SEQ ID NO: 963238 - RNA, 18 nt, Mycobacterium avium subsp. paratuberculosis
aucaccggcuugccgauc

SEQ ID NO: 963239 - RNA, 21 nt, Mycobacterium avium subsp. paratuberculosis
aucaccgggacgggggugccg

SEQ ID NO: 963240 - RNA, 22 nt, Mycobacterium avium subsp. paratuberculosis
aucaccgggacgggggugccga

SEQ ID NO: 963241 - RNA, 21 nt, Mycobacterium avium subsp. paratuberculosis
aucaccgggcggccguggucg

SEQ ID NO: 963242 - RNA, 15 nt, Mycobacterium avium subsp. paratuberculosis
aucagaacgcccgca

SEQ ID NO: 963243 - RNA, 16 nt, Mycobacterium avium subsp. paratuberculosis
aucagaacgcccgcaa

SEQ ID NO: 963244 - RNA, 20 nt, Mycobacterium avium subsp. paratuberculosis
aucacggcguugaccgggcc

SEQ ID NO: 963245 - RNA, 22 nt, Mycobacterium avium subsp. paratuberculosis
aucagccccagggugcgccgcu

SEQ ID NO: 963246 - RNA, 14 nt, Mycobacterium avium subsp. paratuberculosis
aucagcccggcguc

SEQ ID NO: 963247 - RNA, 15 nt, Mycobacterium avium subsp. paratuberculosis
aucagccacaccgcc

SEQ ID NO: 963248 - RNA, 17 nt, Mycobacterium avium subsp. paratuberculosis
aucagccacaccgccgg

SEQ ID NO: 963249 - RNA, 23 nt, Mycobacterium avium subsp. paratuberculosis
aucagccacaccgccggcgcgga

SEQ ID NO: 963250 - RNA, 14 nt, Mycobacterium avium subsp. paratuberculosis
aucagccgccgucg

SEQ ID NO: 963251 - RNA, 19 nt, Mycobacterium avium subsp. paratuberculosis
aucagccgccgucgcgcca

SEQ ID NO: 963252 - RNA, 18 nt, Mycobacterium avium subsp. paratuberculosis
aucagccgcgacagccgc

SEQ ID NO: 963253 - RNA, 24 nt, Mycobacterium avium subsp. paratuberculosis
aucagcgaaggcaugggcgugccg

SEQ ID NO: 963254 - RNA, 22 nt, Mycobacterium avium subsp. paratuberculosis
aucagccggcgagcgcgcugau

SEQ ID NO: 963255 - RNA, 20 nt, Mycobacterium avium subsp. paratuberculosis
aucagccggguagcgccgcc

SEQ ID NO: 963256 - RNA, 15 nt, Mycobacterium avium subsp. paratuberculosis
aucagcaugccgguc

SEQ ID NO: 963257 - RNA, 18 nt, Mycobacterium avium subsp. paratuberculosis
aucacgggcacaccgucg

SEQ ID NO: 963258 - RNA, 17 nt, Mycobacterium avium subsp. paratuberculosis
auauugguucgcucguc

SEQ ID NO: 963259 - RNA, 19 nt, Mycobacterium avium subsp. paratuberculosis
aucaacaggauuccgggga

SEQ ID NO: 963260 - RNA, 14 nt, Mycobacterium avium subsp. paratuberculosis
aucaacgcgccgaa

SEQ ID NO: 963261 - RNA, 13 nt, Mycobacterium avium subsp. paratuberculosis
auaugacgccggc

SEQ ID NO: 963262 - RNA, 15 nt, Mycobacterium avium subsp. paratuberculosis
auaugacgccggccu

SEQ ID NO: 963263 - RNA, 17 nt, Mycobacterium avium subsp. paratuberculosis
auagcucaggugcgacg

SEQ ID NO: 963264 - RNA, 14 nt, Mycobacterium avium subsp. paratuberculosis
auagcuggcgccga

SEQ ID NO: 963265 - RNA, 17 nt, Mycobacterium avium subsp. paratuberculosis
auagcuggcgccgaaca

SEQ ID NO: 963266 - RNA, 14 nt, Mycobacterium avium subsp. paratuberculosis
auacccgaccagca

SEQ ID NO: 963267 - RNA, 14 nt, Mycobacterium avium subsp. paratuberculosis
auaccacugcgcgc

SEQ ID NO: 963268 - RNA, 14 nt, Mycobacterium avium subsp. paratuberculosis
auaccagccgcgga

SEQ ID NO: 963269 - RNA, 13 nt, Mycobacterium avium subsp. paratuberculosis
auacacgggccgu

SEQ ID NO: 963270 - RNA, 14 nt, Mycobacterium avium subsp. paratuberculosis
auacagcggcgcgc

SEQ ID NO: 963271 - RNA, 20 nt, Mycobacterium avium subsp. paratuberculosis
auacagcggcgcgcgccgca

SEQ ID NO: 963272 - RNA, 14 nt, Mycobacterium avium subsp. paratuberculosis
auaaaccggccggc

SEQ ID NO: 963273 - RNA, 21 nt, Mycobacterium avium subsp. paratuberculosis
auaaaccugguuggcgacagg

SEQ ID NO: 963274 - RNA, 22 nt, Mycobacterium avium subsp. paratuberculosis
aguuguccccgauuucgcggcc

SEQ ID NO: 963275 - RNA, 22 nt, Mycobacterium avium subsp. paratuberculosis
aguugucgaucuccucgcgcgg

SEQ ID NO: 963276 - RNA, 16 nt, Mycobacterium avium subsp. paratuberculosis
aguuggggccggccgc

SEQ ID NO: 963277 - RNA, 17 nt, Mycobacterium avium subsp. paratuberculosis
aguuggcggcggugauc

SEQ ID NO: 963278 - RNA, 16 nt, Mycobacterium avium subsp. paratuberculosis
aguuggcgucgucggc

SEQ ID NO: 963279 - RNA, 14 nt, Mycobacterium avium subsp. paratuberculosis
aguucagcagccgg

SEQ ID NO: 963280 - RNA, 13 nt, Mycobacterium avium subsp. paratuberculosis
aguucaccaccgc

SEQ ID NO: 963281 - RNA, 23 nt, Mycobacterium avium subsp. paratuberculosis
agucguuggugaacagguaggcg

SEQ ID NO: 963282 - RNA, 14 nt, Mycobacterium avium subsp. paratuberculosis
agugcaacuaccga

SEQ ID NO: 963283 - RNA, 17 nt, Mycobacterium avium subsp. paratuberculosis
agugcaagcucgccagg

SEQ ID NO: 963284 - RNA, 14 nt, Mycobacterium avium subsp. paratuberculosis
agugcacgacgacc

SEQ ID NO: 963285 - RNA, 21 nt, Mycobacterium avium subsp. paratuberculosis
agugcacgccgaggcgugccg

SEQ ID NO: 963286 - RNA, 16 nt, Mycobacterium avium subsp. paratuberculosis
agugcacgcucggcgc

SEQ ID NO: 963287 - RNA, 13 nt, Mycobacterium avium subsp. paratuberculosis
agugcaugccggc

SEQ ID NO: 963288 - RNA, 21 nt, Mycobacterium avium subsp. paratuberculosis
agugccaacacggcggcgcgc

SEQ ID NO: 963289 - RNA, 18 nt, Mycobacterium avium subsp. paratuberculosis
agugcaguucgaugccga

SEQ ID NO: 963290 - RNA, 19 nt, Mycobacterium avium subsp. paratuberculosis
agugcaguucgaugccgau

SEQ ID NO: 963291 - RNA, 15 nt, Mycobacterium avium subsp. paratuberculosis
agugcagccgcccgu

SEQ ID NO: 963292 - RNA, 23 nt, Mycobacterium avium subsp. paratuberculosis
agugcaggcugacgcgaccgcgc

SEQ ID NO: 963293 - RNA, 16 nt, Mycobacterium avium subsp. paratuberculosis
agucggugcccagcgc

SEQ ID NO: 963294 - RNA, 17 nt, Mycobacterium avium subsp. paratuberculosis
agucggugcccagcgcg

SEQ ID NO: 963295 - RNA, 23 nt, Mycobacterium avium subsp. paratuberculosis
agucggugcccuugguguaggcg

SEQ ID NO: 963296 - RNA, 15 nt, Mycobacterium avium subsp. paratuberculosis
agucggucggucagc

SEQ ID NO: 963297 - RNA, 16 nt, Mycobacterium avium subsp. paratuberculosis
agucggugagcaccgu

SEQ ID NO: 963298 - RNA, 15 nt, Mycobacterium avium subsp. paratuberculosis
agucggagacccgcc

SEQ ID NO: 963299 - RNA, 19 nt, Mycobacterium avium subsp. paratuberculosis
agucggggugcucgaucgg

SEQ ID NO: 963300 - RNA, 22 nt, Mycobacterium avium subsp. paratuberculosis
agucgggauagggcgcgucgau

SEQ ID NO: 963301 - RNA, 17 nt, Mycobacterium avium subsp. paratuberculosis
agucgggaaaucggacc

SEQ ID NO: 963302 - RNA, 17 nt, Mycobacterium avium subsp. paratuberculosis
agucggcgucggagaug

SEQ ID NO: 963303 - RNA, 22 nt, Mycobacterium avium subsp. paratuberculosis
agucggcgucggccaccgcgcc

SEQ ID NO: 963304 - RNA, 23 nt, Mycobacterium avium subsp. paratuberculosis
agucggcggugaugcgcgccgac

SEQ ID NO: 963305 - RNA, 17 nt, Mycobacterium avium subsp. paratuberculosis
agucggugcagugaugc

SEQ ID NO: 963306 - RNA, 15 nt, Mycobacterium avium subsp. paratuberculosis
agucgucgcgcacca

SEQ ID NO: 963307 - RNA, 16 nt, Mycobacterium avium subsp. paratuberculosis
agucgucgcgcaccag

SEQ ID NO: 963308 - RNA, 14 nt, Mycobacterium avium subsp. paratuberculosis
agucgugacgcggc

SEQ ID NO: 963309 - RNA, 18 nt, Mycobacterium avium subsp. paratuberculosis
agucgugacgcggcgucg

SEQ ID NO: 963310 - RNA, 20 nt, Mycobacterium avium subsp. paratuberculosis
agucgucggugggccgccgc

SEQ ID NO: 963311 - RNA, 16 nt, Mycobacterium avium subsp. paratuberculosis
agucguucggccagca

SEQ ID NO: 963312 - RNA, 15 nt, Mycobacterium avium subsp. paratuberculosis
agugggucggcggcu

SEQ ID NO: 963313 - RNA, 12 nt, Mycobacterium avium subsp. paratuberculosis
agugggccauca

SEQ ID NO: 963314 - RNA, 14 nt, Mycobacterium avium subsp. paratuberculosis
aguggucgucgucg

SEQ ID NO: 963315 - RNA, 15 nt, Mycobacterium avium subsp. paratuberculosis
aguggucgucgucga

SEQ ID NO: 963316 - RNA, 16 nt, Mycobacterium avium subsp. paratuberculosis
agugguccaccgccgc

SEQ ID NO: 963317 - RNA, 18 nt, Mycobacterium avium subsp. paratuberculosis
agugguccaccgccgcgc

SEQ ID NO: 963318 - RNA, 22 nt, Mycobacterium avium subsp. paratuberculosis
aguggcugcacgucacgggcca

SEQ ID NO: 963319 - RNA, 23 nt, Mycobacterium avium subsp. paratuberculosis
aguggcugcacgucacgggccag

SEQ ID NO: 963320 - RNA, 21 nt, Mycobacterium avium subsp. paratuberculosis
aguggcguccaaugcgccgau

SEQ ID NO: 963321 - RNA, 19 nt, Mycobacterium avium subsp. paratuberculosis
aguggcgugcggccucggc

SEQ ID NO: 963322 - RNA, 14 nt, Mycobacterium avium subsp. paratuberculosis
aguggcgccgcggu

SEQ ID NO: 963323 - RNA, 14 nt, Mycobacterium avium subsp. paratuberculosis
aguggccggcgucc

SEQ ID NO: 963324 - RNA, 18 nt, Mycobacterium avium subsp. paratuberculosis
agugccggcgcaccgcgu

SEQ ID NO: 963325 - RNA, 15 nt, Mycobacterium avium subsp. paratuberculosis
agugccgcaccagca

SEQ ID NO: 963326 - RNA, 17 nt, Mycobacterium avium subsp. paratuberculosis
agugccgcaccagcacc

SEQ ID NO: 963327 - RNA, 20 nt, Mycobacterium avium subsp. paratuberculosis
agucgcuguuggcgacggug

SEQ ID NO: 963328 - RNA, 21 nt, Mycobacterium avium subsp. paratuberculosis
agucgcuguuggcgacggugc

SEQ ID NO: 963329 - RNA, 13 nt, Mycobacterium avium subsp. paratuberculosis
agucgcucggcgg

SEQ ID NO: 963330 - RNA, 20 nt, Mycobacterium avium subsp. paratuberculosis
agucgcugaggcugcgggug

SEQ ID NO: 963331 - RNA, 20 nt, Mycobacterium avium subsp. paratuberculosis
agucgcuggguguaaccggc

SEQ ID NO: 963332 - RNA, 17 nt, Mycobacterium avium subsp. paratuberculosis
agucggcgccgacggcc

SEQ ID NO: 963333 - RNA, 15 nt, Mycobacterium avium subsp. paratuberculosis
agucggcgaaggcgc

SEQ ID NO: 963334 - RNA, 13 nt, Mycobacterium avium subsp. paratuberculosis
agucggcgaucgg

SEQ ID NO: 963335 - RNA, 14 nt, Mycobacterium avium subsp. paratuberculosis
agucggccugcagc

SEQ ID NO: 963336 - RNA, 22 nt, Mycobacterium avium subsp. paratuberculosis
agucggccugcagcucggugcg

SEQ ID NO: 963337 - RNA, 14 nt, Mycobacterium avium subsp. paratuberculosis
agucggcccaggcc

SEQ ID NO: 963338 - RNA, 15 nt, Mycobacterium avium subsp. paratuberculosis
agucggcccaggcca

SEQ ID NO: 963339 - RNA, 21 nt, Mycobacterium avium subsp. paratuberculosis
agucggcccgaucgcgucgac

SEQ ID NO: 963340 - RNA, 14 nt, Mycobacterium avium subsp. paratuberculosis
agucggcccgccgg

SEQ ID NO: 963341 - RNA, 17 nt, Mycobacterium avium subsp. paratuberculosis
agucggcccgccgggcc

SEQ ID NO: 963342 - RNA, 14 nt, Mycobacterium avium subsp. paratuberculosis
agucggccggcguu

SEQ ID NO: 963343 - RNA, 21 nt, Mycobacterium avium subsp. paratuberculosis
agucggccuccuccucgcugc

SEQ ID NO: 963344 - RNA, 15 nt, Mycobacterium avium subsp. paratuberculosis
agucgccggccucca

SEQ ID NO: 963345 - RNA, 16 nt, Mycobacterium avium subsp. paratuberculosis
agucgcggaugcgggc

SEQ ID NO: 963346 - RNA, 12 nt, Mycobacterium avium subsp. paratuberculosis
agucgcgccgcc

SEQ ID NO: 963347 - RNA, 19 nt, Mycobacterium avium subsp. paratuberculosis
agucgcgggcggggcgccg

SEQ ID NO: 963348 - RNA, 23 nt, Mycobacterium avium subsp. paratuberculosis
agucgcgggcggggcgccgacag

SEQ ID NO: 963349 - RNA, 16 nt, Mycobacterium avium subsp. paratuberculosis
agucgcgggcagccgg

SEQ ID NO: 963350 - RNA, 20 nt, Mycobacterium avium subsp. paratuberculosis
agucgcgggcgagccgacag

SEQ ID NO: 963351 - RNA, 13 nt, Mycobacterium avium subsp. paratuberculosis
agucgacuuccca

SEQ ID NO: 963352 - RNA, 20 nt, Mycobacterium avium subsp. paratuberculosis
agucgagguugaugccgacg

SEQ ID NO: 963353 - RNA, 20 nt, Mycobacterium avium subsp. paratuberculosis
agucgaugaccucgcgcccg

SEQ ID NO: 963354 - RNA, 22 nt, Mycobacterium avium subsp. paratuberculosis
agucgcauaugcgugggcccuc

SEQ ID NO: 963355 - RNA, 19 nt, Mycobacterium avium subsp. paratuberculosis
agucgcagcagcagcccga

SEQ ID NO: 963356 - RNA, 18 nt, Mycobacterium avium subsp. paratuberculosis
agucgauucaucgccgaa

SEQ ID NO: 963357 - RNA, 17 nt, Mycobacterium avium subsp. paratuberculosis
agucgauugccgcggcc

SEQ ID NO: 963358 - RNA, 20 nt, Mycobacterium avium subsp. paratuberculosis
agucgccgacgccgaagauc

SEQ ID NO: 963359 - RNA, 17 nt, Mycobacterium avium subsp. paratuberculosis
agucgcccagcagcccg

SEQ ID NO: 963360 - RNA, 20 nt, Mycobacterium avium subsp. paratuberculosis
agucgcccagcagcccggcc

SEQ ID NO: 963361 - RNA, 23 nt, Mycobacterium avium subsp. paratuberculosis
agucgccgguguagaucggcuca

SEQ ID NO: 963362 - RNA, 18 nt, Mycobacterium avium subsp. paratuberculosis
agucgcgcaccauccgcg

SEQ ID NO: 963363 - RNA, 12 nt, Mycobacterium avium subsp. paratuberculosis
agucgcgcagcu

SEQ ID NO: 963364 - RNA, 15 nt, Mycobacterium avium subsp. paratuberculosis
agucgcgcagcugcg

SEQ ID NO: 963365 - RNA, 17 nt, Mycobacterium avium subsp. paratuberculosis
agucgcgcagcugcgcc

SEQ ID NO: 963366 - RNA, 19 nt, Mycobacterium avium subsp. paratuberculosis
agucgcgcagcugcgccgc

SEQ ID NO: 963367 - RNA, 12 nt, Mycobacterium avium subsp. paratuberculosis
agucgccgcccg

SEQ ID NO: 963368 - RNA, 20 nt, Mycobacterium avium subsp. paratuberculosis
agucgccgccgcgcaccgcg

SEQ ID NO: 963369 - RNA, 21 nt, Mycobacterium avium subsp. paratuberculosis
aguccgccagggugccgcugc

SEQ ID NO: 963370 - RNA, 13 nt, Mycobacterium avium subsp. paratuberculosis
aguccgccccgau

SEQ ID NO: 963371 - RNA, 16 nt, Mycobacterium avium subsp. paratuberculosis
aguccgccgccguccc

SEQ ID NO: 963372 - RNA, 14 nt, Mycobacterium avium subsp. paratuberculosis
aguccgacgauccg

SEQ ID NO: 963373 - RNA, 13 nt, Mycobacterium avium subsp. paratuberculosis
aguccgcgugaca

SEQ ID NO: 963374 - RNA, 22 nt, Mycobacterium avium subsp. paratuberculosis
aguccggacacggccagcgccg

SEQ ID NO: 963375 - RNA, 21 nt, Mycobacterium avium subsp. paratuberculosis
aguccguugggggcgccgcgg

SEQ ID NO: 963376 - RNA, 22 nt, Mycobacterium avium subsp. paratuberculosis
aguccggccgugaugcgccggc

SEQ ID NO: 963377 - RNA, 16 nt, Mycobacterium avium subsp. paratuberculosis
aguccgggccgccggc

SEQ ID NO: 963378 - RNA, 22 nt, Mycobacterium avium subsp. paratuberculosis
aguccggcgugccaccgcuggg

SEQ ID NO: 963379 - RNA, 17 nt, Mycobacterium avium subsp. paratuberculosis
aguccggccaggucgcc

SEQ ID NO: 963380 - RNA, 21 nt, Mycobacterium avium subsp. paratuberculosis
aguccggccaggucgccgcgc

SEQ ID NO: 963381 - RNA, 17 nt, Mycobacterium avium subsp. paratuberculosis
aguccugcgccgcggug

SEQ ID NO: 963382 - RNA, 20 nt, Mycobacterium avium subsp. paratuberculosis
aguccucgcgguugcgggug

SEQ ID NO: 963383 - RNA, 20 nt, Mycobacterium avium subsp. paratuberculosis
aguccugcagcucgccggcg

SEQ ID NO: 963384 - RNA, 20 nt, Mycobacterium avium subsp. paratuberculosis
agucgaagaugucgcggcgc

SEQ ID NO: 963385 - RNA, 12 nt, Mycobacterium avium subsp. paratuberculosis
agucgaagccgu

SEQ ID NO: 963386 - RNA, 14 nt, Mycobacterium avium subsp. paratuberculosis
agucgaagcggugc

SEQ ID NO: 963387 - RNA, 17 nt, Mycobacterium avium subsp. paratuberculosis
aguccuuguggcccagg

SEQ ID NO: 963388 - RNA, 14 nt, Mycobacterium avium subsp. paratuberculosis
agucgagcaccgcg

SEQ ID NO: 963389 - RNA, 13 nt, Mycobacterium avium subsp. paratuberculosis
agucgacgcugug

SEQ ID NO: 963390 - RNA, 18 nt, Mycobacterium avium subsp. paratuberculosis
agucgacgcugugcgccu

SEQ ID NO: 963391 - RNA, 18 nt, Mycobacterium avium subsp. paratuberculosis
agucgaauuccuugcgga

SEQ ID NO: 963392 - RNA, 20 nt, Mycobacterium avium subsp. paratuberculosis
agucgaccgcggcuccggcc

SEQ ID NO: 963393 - RNA, 21 nt, Mycobacterium avium subsp. paratuberculosis
agucauucugaauucggccac

SEQ ID NO: 963394 - RNA, 14 nt, Mycobacterium avium subsp. paratuberculosis
aguccaccggcgga

SEQ ID NO: 963395 - RNA, 14 nt, Mycobacterium avium subsp. paratuberculosis
aguccacgacgucc

SEQ ID NO: 963396 - RNA, 15 nt, Mycobacterium avium subsp. paratuberculosis
aguccagcacggcga

SEQ ID NO: 963397 - RNA, 14 nt, Mycobacterium avium subsp. paratuberculosis
aguccagccagccg

SEQ ID NO: 963398 - RNA, 16 nt, Mycobacterium avium subsp. paratuberculosis
aguccagccagccgcg

SEQ ID NO: 963399 - RNA, 23 nt, Mycobacterium avium subsp. paratuberculosis
aguccagcucccaggacgcggug

SEQ ID NO: 963400 - RNA, 13 nt, Mycobacterium avium subsp. paratuberculosis
aguccagcucgcg

SEQ ID NO: 963401 - RNA, 16 nt, Mycobacterium avium subsp. paratuberculosis
aguccaggccgccgug

SEQ ID NO: 963402 - RNA, 19 nt, Mycobacterium avium subsp. paratuberculosis
agucccagcacagccgucg

SEQ ID NO: 963403 - RNA, 16 nt, Mycobacterium avium subsp. paratuberculosis
aguccccgguucacca

SEQ ID NO: 963404 - RNA, 16 nt, Mycobacterium avium subsp. paratuberculosis
agucccgcgcggcgca

SEQ ID NO: 963405 - RNA, 17 nt, Mycobacterium avium subsp. paratuberculosis
aguccaggucgaucucg

SEQ ID NO: 963406 - RNA, 23 nt, Mycobacterium avium subsp. paratuberculosis
aguccaggucgaucucggccagc

SEQ ID NO: 963407 - RNA, 17 nt, Mycobacterium avium subsp. paratuberculosis
aguccagggugguggug

SEQ ID NO: 963408 - RNA, 23 nt, Mycobacterium avium subsp. paratuberculosis
aguaguccagcaccgccacgucg

SEQ ID NO: 963409 - RNA, 15 nt, Mycobacterium avium subsp. paratuberculosis
agucagcgcgugacc

SEQ ID NO: 963410 - RNA, 17 nt, Mycobacterium avium subsp. paratuberculosis
agucaucaccggggauc

SEQ ID NO: 963411 - RNA, 15 nt, Mycobacterium avium subsp. paratuberculosis
agucaucgccacccg

SEQ ID NO: 963412 - RNA, 18 nt, Mycobacterium avium subsp. paratuberculosis
aguaggcggcugucgaca

SEQ ID NO: 963413 - RNA, 18 nt, Mycobacterium avium subsp. paratuberculosis
aguagcuguuggccagcu

SEQ ID NO: 963414 - RNA, 21 nt, Mycobacterium avium subsp. paratuberculosis
aguagccgguucgucccgcgc

SEQ ID NO: 963415 - RNA, 23 nt, Mycobacterium avium subsp. paratuberculosis
aguagcgacgcgacgcgcucggc

SEQ ID NO: 963416 - RNA, 20 nt, Mycobacterium avium subsp. paratuberculosis
aguagcgcauaggccgcgag

SEQ ID NO: 963417 - RNA, 15 nt, Mycobacterium avium subsp. paratuberculosis
aggugucggccggga

SEQ ID NO: 963418 - RNA, 20 nt, Mycobacterium avium subsp. paratuberculosis
agguugacgugcaccggcga

SEQ ID NO: 963419 - RNA, 16 nt, Mycobacterium avium subsp. paratuberculosis
agguugaugccgacgu

SEQ ID NO: 963420 - RNA, 16 nt, Mycobacterium avium subsp. paratuberculosis
agguucagcccggcgc

SEQ ID NO: 963421 - RNA, 17 nt, Mycobacterium avium subsp. paratuberculosis
aguaccagcggccgucg

SEQ ID NO: 963422 - RNA, 14 nt, Mycobacterium avium subsp. paratuberculosis
aguacccgccgcac

SEQ ID NO: 963423 - RNA, 17 nt, Mycobacterium avium subsp. paratuberculosis
aguacgaccgcgacgug

SEQ ID NO: 963424 - RNA, 16 nt, Mycobacterium avium subsp. paratuberculosis
aguagcaggcaucgcg

SEQ ID NO: 963425 - RNA, 15 nt, Mycobacterium avium subsp. paratuberculosis
aguagccgccgggcg

SEQ ID NO: 963426 - RNA, 19 nt, Mycobacterium avium subsp. paratuberculosis
aguagccggccagcgucgc

SEQ ID NO: 963427 - RNA, 11 nt, Mycobacterium avium subsp. paratuberculosis
aguagccggcg

SEQ ID NO: 963428 - RNA, 19 nt, Mycobacterium avium subsp. paratuberculosis
aguacagcuaggccagcag

SEQ ID NO: 963429 - RNA, 22 nt, Mycobacterium avium subsp. paratuberculosis
aguacagcuaggccagcagcgc

SEQ ID NO: 963430 - RNA, 13 nt, Mycobacterium avium subsp. paratuberculosis
aguacaccaccgc

SEQ ID NO: 963431 - RNA, 14 nt, Mycobacterium avium subsp. paratuberculosis
aguacaccucgagc

SEQ ID NO: 963432 - RNA, 19 nt, Mycobacterium avium subsp. paratuberculosis
aguacaccucgagcuugcc

SEQ ID NO: 963433 - RNA, 13 nt, Mycobacterium avium subsp. paratuberculosis
agguagucgcgca

SEQ ID NO: 963434 - RNA, 15 nt, Mycobacterium avium subsp. paratuberculosis
agguagucgcgcagc

SEQ ID NO: 963435 - RNA, 14 nt, Mycobacterium avium subsp. paratuberculosis
agguaguagcgcgc

SEQ ID NO: 963436 - RNA, 17 nt, Mycobacterium avium subsp. paratuberculosis
agguaguagcgcgccgg

SEQ ID NO: 963437 - RNA, 14 nt, Mycobacterium avium subsp. paratuberculosis
agguaggccaccgg

SEQ ID NO: 963438 - RNA, 22 nt, Mycobacterium avium subsp. paratuberculosis
agguacacguagcgguccagcg

SEQ ID NO: 963439 - RNA, 22 nt, Mycobacterium avium subsp. paratuberculosis
agguagccgccguagccggcgg

SEQ ID NO: 963440 - RNA, 16 nt, Mycobacterium avium subsp. paratuberculosis
agguacucgaguggcg

SEQ ID NO: 963441 - RNA, 18 nt, Mycobacterium avium subsp. paratuberculosis
agguacugggcguggucg

SEQ ID NO: 963442 - RNA, 19 nt, Mycobacterium avium subsp. paratuberculosis
agguacugggcguggucgc

SEQ ID NO: 963443 - RNA, 19 nt, Mycobacterium avium subsp. paratuberculosis
aggucgcccggcucgccgg

SEQ ID NO: 963444 - RNA, 19 nt, Mycobacterium avium subsp. paratuberculosis
aggucgccgacgccgucga

SEQ ID NO: 963445 - RNA, 11 nt, Mycobacterium avium subsp. paratuberculosis
aggucgccgau

SEQ ID NO: 963446 - RNA, 22 nt, Mycobacterium avium subsp. paratuberculosis
aggucgccgauccagccgucgu

SEQ ID NO: 963447 - RNA, 20 nt, Mycobacterium avium subsp. paratuberculosis
aggucgccgcgcagcaccgc

SEQ ID NO: 963448 - RNA, 23 nt, Mycobacterium avium subsp. paratuberculosis
aggucgccgcgcagcaccgcguc

SEQ ID NO: 963449 - RNA, 13 nt, Mycobacterium avium subsp. paratuberculosis
aggucgccggcgg

SEQ ID NO: 963450 - RNA, 14 nt, Mycobacterium avium subsp. paratuberculosis
aggucgccggugug

SEQ ID NO: 963451 - RNA, 15 nt, Mycobacterium avium subsp. paratuberculosis
aggucgcgaccgccg

SEQ ID NO: 963452 - RNA, 21 nt, Mycobacterium avium subsp. paratuberculosis
aggucgcugcgcucgccgucg

SEQ ID NO: 963453 - RNA, 15 nt, Mycobacterium avium subsp. paratuberculosis
aggucguaguaggcg

SEQ ID NO: 963454 - RNA, 19 nt, Mycobacterium avium subsp. paratuberculosis
aggucgguggccaccaccg

SEQ ID NO: 963455 - RNA, 20 nt, Mycobacterium avium subsp. paratuberculosis
aggucgguggccaccaccga

SEQ ID NO: 963456 - RNA, 12 nt, Mycobacterium avium subsp. paratuberculosis
aggucgcggcgc

SEQ ID NO: 963457 - RNA, 20 nt, Mycobacterium avium subsp. paratuberculosis
aggucgcggcggccggcgcc

SEQ ID NO: 963458 - RNA, 20 nt, Mycobacterium avium subsp. paratuberculosis
aggucgcgccggagccggag

SEQ ID NO: 963459 - RNA, 21 nt, Mycobacterium avium subsp. paratuberculosis
aggucgcggauacgcccggcc

SEQ ID NO: 963460 - RNA, 24 nt, Mycobacterium avium subsp. paratuberculosis
aggucgcggauacgcccggccacc

SEQ ID NO: 963461 - RNA, 15 nt, Mycobacterium avium subsp. paratuberculosis
aggugcugucgucgc

SEQ ID NO: 963462 - RNA, 14 nt, Mycobacterium avium subsp. paratuberculosis
aggugcucgccggc

SEQ ID NO: 963463 - RNA, 18 nt, Mycobacterium avium subsp. paratuberculosis
agguggacgagcagccgc

SEQ ID NO: 963464 - RNA, 19 nt, Mycobacterium avium subsp. paratuberculosis
aggucuucggucccggcgg

SEQ ID NO: 963465 - RNA, 21 nt, Mycobacterium avium subsp. paratuberculosis
aggugcgggucucgaaccggg

SEQ ID NO: 963466 - RNA, 13 nt, Mycobacterium avium subsp. paratuberculosis
aggucguggcgcc

SEQ ID NO: 963467 - RNA, 21 nt, Mycobacterium avium subsp. paratuberculosis
aggucguugccggugccgacg

SEQ ID NO: 963468 - RNA, 18 nt, Mycobacterium avium subsp. paratuberculosis
aggucucccgguccacgg

SEQ ID NO: 963469 - RNA, 17 nt, Mycobacterium avium subsp. paratuberculosis
aggucugaaaugccggg

SEQ ID NO: 963470 - RNA, 15 nt, Mycobacterium avium subsp. paratuberculosis
aggucgucgcgucca

SEQ ID NO: 963471 - RNA, 19 nt, Mycobacterium avium subsp. paratuberculosis
aggucgucgcguccagcau

SEQ ID NO: 963472 - RNA, 15 nt, Mycobacterium avium subsp. paratuberculosis
aggucgucgggcgcc

SEQ ID NO: 963473 - RNA, 18 nt, Mycobacterium avium subsp. paratuberculosis
aggucgucgucgccgcgc

SEQ ID NO: 963474 - RNA, 15 nt, Mycobacterium avium subsp. paratuberculosis
aggucgucgacgucg

SEQ ID NO: 963475 - RNA, 17 nt, Mycobacterium avium subsp. paratuberculosis
aggugggcaccagcugc

SEQ ID NO: 963476 - RNA, 19 nt, Mycobacterium avium subsp. paratuberculosis
aggugggcagcgcggccag

SEQ ID NO: 963477 - RNA, 23 nt, Mycobacterium avium subsp. paratuberculosis
agguggcugggcgcuagcugcgc

SEQ ID NO: 963478 - RNA, 20 nt, Mycobacterium avium subsp. paratuberculosis
agguggcguagucgucgauc

SEQ ID NO: 963479 - RNA, 17 nt, Mycobacterium avium subsp. paratuberculosis
agguggcgucggcgucg

SEQ ID NO: 963480 - RNA, 22 nt, Mycobacterium avium subsp. paratuberculosis
aggugggguugaagcuggccac

SEQ ID NO: 963481 - RNA, 18 nt, Mycobacterium avium subsp. paratuberculosis
agguggucucccagacgu

SEQ ID NO: 963482 - RNA, 20 nt, Mycobacterium avium subsp. paratuberculosis
agguggucucccagacgucg

SEQ ID NO: 963483 - RNA, 21 nt, Mycobacterium avium subsp. paratuberculosis
agguggucucccagacgucga

SEQ ID NO: 963484 - RNA, 23 nt, Mycobacterium avium subsp. paratuberculosis
aggugguuucggggucgccgucg

SEQ ID NO: 963485 - RNA, 15 nt, Mycobacterium avium subsp. paratuberculosis
agguguagccggugg

SEQ ID NO: 963486 - RNA, 19 nt, Mycobacterium avium subsp. paratuberculosis
agguggauugucggccgcc

SEQ ID NO: 963487 - RNA, 21 nt, Mycobacterium avium subsp. paratuberculosis
agguggauugucggccgcccg

SEQ ID NO: 963488 - RNA, 16 nt, Mycobacterium avium subsp. paratuberculosis
agguggcccagccgcu

SEQ ID NO: 963489 - RNA, 17 nt, Mycobacterium avium subsp. paratuberculosis
agguggcccagccgcug

SEQ ID NO: 963490 - RNA, 14 nt, Mycobacterium avium subsp. paratuberculosis
agguggcccgccac

SEQ ID NO: 963491 - RNA, 13 nt, Mycobacterium avium subsp. paratuberculosis
agguggccgucgc

SEQ ID NO: 963492 - RNA, 14 nt, Mycobacterium avium subsp. paratuberculosis
agguggccgucgcc

SEQ ID NO: 963493 - RNA, 12 nt, Mycobacterium avium subsp. paratuberculosis
agguggcgcccg

SEQ ID NO: 963494 - RNA, 17 nt, Mycobacterium avium subsp. paratuberculosis
agguggcgaccaccgac

SEQ ID NO: 963495 - RNA, 13 nt, Mycobacterium avium subsp. paratuberculosis
agguggcgccggu

SEQ ID NO: 963496 - RNA, 15 nt, Mycobacterium avium subsp. paratuberculosis
agguggcgccuccgc

SEQ ID NO: 963497 - RNA, 21 nt, Mycobacterium avium subsp. paratuberculosis
agguggcgccuccgcccgggu

SEQ ID NO: 963498 - RNA, 13 nt, Mycobacterium avium subsp. paratuberculosis
aggcugccgcugc

SEQ ID NO: 963499 - RNA, 13 nt, Mycobacterium avium subsp. paratuberculosis
aggcugaucucgg

SEQ ID NO: 963500 - RNA, 16 nt, Mycobacterium avium subsp. paratuberculosis
aggcugaucucggcgg

SEQ ID NO: 963501 - RNA, 23 nt, Mycobacterium avium subsp. paratuberculosis
aggcgucggucagcaggcgccgc

SEQ ID NO: 963502 - RNA, 14 nt, Mycobacterium avium subsp. paratuberculosis
aggcgugcgacucg

SEQ ID NO: 963503 - RNA, 19 nt, Mycobacterium avium subsp. paratuberculosis
aggcguggucggcgcgguc

SEQ ID NO: 963504 - RNA, 19 nt, Mycobacterium avium subsp. paratuberculosis
aggccgaugaugaugccgc

SEQ ID NO: 963505 - RNA, 22 nt, Mycobacterium avium subsp. paratuberculosis
aggccgaugaugaugccgccca

SEQ ID NO: 963506 - RNA, 22 nt, Mycobacterium avium subsp. paratuberculosis
aggccgacagguagcaggcgcg

SEQ ID NO: 963507 - RNA, 14 nt, Mycobacterium avium subsp. paratuberculosis
aggcgucgacgcgc

SEQ ID NO: 963508 - RNA, 14 nt, Mycobacterium avium subsp. paratuberculosis
aggcgucgcgcagc

SEQ ID NO: 963509 - RNA, 21 nt, Mycobacterium avium subsp. paratuberculosis
aggcgucgcgcagcagcggga

SEQ ID NO: 963510 - RNA, 13 nt, Mycobacterium avium subsp. paratuberculosis
aggcgucgcgguc

SEQ ID NO: 963511 - RNA, 13 nt, Mycobacterium avium subsp. paratuberculosis
aggccgccccggc

SEQ ID NO: 963512 - RNA, 21 nt, Mycobacterium avium subsp. paratuberculosis
aggccgccccggccgcgcacc

SEQ ID NO: 963513 - RNA, 16 nt, Mycobacterium avium subsp. paratuberculosis
aggccgcccgacccgu

SEQ ID NO: 963514 - RNA, 23 nt, Mycobacterium avium subsp. paratuberculosis
aggccgcccgacccguccagcag

SEQ ID NO: 963515 - RNA, 22 nt, Mycobacterium avium subsp. paratuberculosis
aggcguccuugauccgggcgcc

SEQ ID NO: 963516 - RNA, 12 nt, Mycobacterium avium subsp. paratuberculosis
aggccgcccggc

SEQ ID NO: 963517 - RNA, 14 nt, Mycobacterium avium subsp. paratuberculosis
aggccgcccggccc

SEQ ID NO: 963518 - RNA, 14 nt, Mycobacterium avium subsp. paratuberculosis
aggcugcucggcgg

SEQ ID NO: 963519 - RNA, 20 nt, Mycobacterium avium subsp. paratuberculosis
aggcuggcaucgucggcgcc

SEQ ID NO: 963520 - RNA, 23 nt, Mycobacterium avium subsp. paratuberculosis
aggcuggcaucgucggcgccggc

SEQ ID NO: 963521 - RNA, 17 nt, Mycobacterium avium subsp. paratuberculosis
agggaaaggcagcagcc

SEQ ID NO: 963522 - RNA, 22 nt, Mycobacterium avium subsp. paratuberculosis
agggagcacucgauggcggcga

SEQ ID NO: 963523 - RNA, 18 nt, Mycobacterium avium subsp. paratuberculosis
agggacaugccgagcagc

SEQ ID NO: 963524 - RNA, 14 nt, Mycobacterium avium subsp. paratuberculosis
agggauucggccau

SEQ ID NO: 963525 - RNA, 23 nt, Mycobacterium avium subsp. paratuberculosis
agggcaccgacggccgcacccca

SEQ ID NO: 963526 - RNA, 18 nt, Mycobacterium avium subsp. paratuberculosis
agguaaaccagcagcgcc

SEQ ID NO: 963527 - RNA, 18 nt, Mycobacterium avium subsp. paratuberculosis
aggguugccgcacgacca

SEQ ID NO: 963528 - RNA, 15 nt, Mycobacterium avium subsp. paratuberculosis
agggugucggcgggg

SEQ ID NO: 963529 - RNA, 15 nt, Mycobacterium avium subsp. paratuberculosis
aggguguuggacgag

SEQ ID NO: 963530 - RNA, 17 nt, Mycobacterium avium subsp. paratuberculosis
aggguggccucgucggc

SEQ ID NO: 963531 - RNA, 19 nt, Mycobacterium avium subsp. paratuberculosis
agggugcgcagcgcgucgu

SEQ ID NO: 963532 - RNA, 16 nt, Mycobacterium avium subsp. paratuberculosis
agggugcgcuggccga

SEQ ID NO: 963533 - RNA, 13 nt, Mycobacterium avium subsp. paratuberculosis
aggguccgccguc

SEQ ID NO: 963534 - RNA, 15 nt, Mycobacterium avium subsp. paratuberculosis
aggguccgccgucga

SEQ ID NO: 963535 - RNA, 17 nt, Mycobacterium avium subsp. paratuberculosis
agggcgggcaggcccga

SEQ ID NO: 963536 - RNA, 20 nt, Mycobacterium avium subsp. paratuberculosis
agggcgggcaggcccgagcc

SEQ ID NO: 963537 - RNA, 19 nt, Mycobacterium avium subsp. paratuberculosis
agggcgggccagcucgaac

SEQ ID NO: 963538 - RNA, 18 nt, Mycobacterium avium subsp. paratuberculosis
agggcggguaggcgccga

SEQ ID NO: 963539 - RNA, 19 nt, Mycobacterium avium subsp. paratuberculosis
agggcggguaggcgccgau

SEQ ID NO: 963540 - RNA, 21 nt, Mycobacterium avium subsp. paratuberculosis
agggcggguaggcgccgaugc

SEQ ID NO: 963541 - RNA, 13 nt, Mycobacterium avium subsp. paratuberculosis
agggcggcgccgc

SEQ ID NO: 963542 - RNA, 20 nt, Mycobacterium avium subsp. paratuberculosis
agggcggcgcgcgccagcgu

SEQ ID NO: 963543 - RNA, 16 nt, Mycobacterium avium subsp. paratuberculosis
agggcggugcggugcg

SEQ ID NO: 963544 - RNA, 20 nt, Mycobacterium avium subsp. paratuberculosis
agggcggugcggugcgccgc

SEQ ID NO: 963545 - RNA, 21 nt, Mycobacterium avium subsp. paratuberculosis
aggggcuguccucccagcgcc

SEQ ID NO: 963546 - RNA, 19 nt, Mycobacterium avium subsp. paratuberculosis
aggggcuugagcgcgucgu

SEQ ID NO: 963547 - RNA, 20 nt, Mycobacterium avium subsp. paratuberculosis
aggggcuuggcgacgaaguc

SEQ ID NO: 963548 - RNA, 21 nt, Mycobacterium avium subsp. paratuberculosis
aggggcuuggcgacgaagucg

SEQ ID NO: 963549 - RNA, 19 nt, Mycobacterium avium subsp. paratuberculosis
aggggcuuuugcgucugcu

SEQ ID NO: 963550 - RNA, 14 nt, Mycobacterium avium subsp. paratuberculosis
agggucagcagcac

SEQ ID NO: 963551 - RNA, 21 nt, Mycobacterium avium subsp. paratuberculosis
agggucagcagcacccggucg

SEQ ID NO: 963552 - RNA, 15 nt, Mycobacterium avium subsp. paratuberculosis
agggucaucgcgccg

SEQ ID NO: 963553 - RNA, 19 nt, Mycobacterium avium subsp. paratuberculosis
aggggguggguccggucag

SEQ ID NO: 963554 - RNA, 20 nt, Mycobacterium avium subsp. paratuberculosis
aggggguggguccggucagc

SEQ ID NO: 963555 - RNA, 18 nt, Mycobacterium avium subsp. paratuberculosis
agggguccggggcacggu

SEQ ID NO: 963556 - RNA, 18 nt, Mycobacterium avium subsp. paratuberculosis
agggcagauaggcggcga

SEQ ID NO: 963557 - RNA, 21 nt, Mycobacterium avium subsp. paratuberculosis
agggcaucucccgcgcgcagg

SEQ ID NO: 963558 - RNA, 12 nt, Mycobacterium avium subsp. paratuberculosis
agggcagccagc

SEQ ID NO: 963559 - RNA, 14 nt, Mycobacterium avium subsp. paratuberculosis
agggcagccagccc

SEQ ID NO: 963560 - RNA, 12 nt, Mycobacterium avium subsp. paratuberculosis
agggcagcgccu

SEQ ID NO: 963561 - RNA, 16 nt, Mycobacterium avium subsp. paratuberculosis
agggcagcgccucggc

SEQ ID NO: 963562 - RNA, 19 nt, Mycobacterium avium subsp. paratuberculosis
agggcagcgccucggcggg

SEQ ID NO: 963563 - RNA, 21 nt, Mycobacterium avium subsp. paratuberculosis
agggcagcgccucggcgggcc

SEQ ID NO: 963564 - RNA, 14 nt, Mycobacterium avium subsp. paratuberculosis
agggcagcgcgacc

SEQ ID NO: 963565 - RNA, 18 nt, Mycobacterium avium subsp. paratuberculosis
agggcagcgcgaccagcc

SEQ ID NO: 963566 - RNA, 14 nt, Mycobacterium avium subsp. paratuberculosis
agggccagcaacac

SEQ ID NO: 963567 - RNA, 11 nt, Mycobacterium avium subsp. paratuberculosis
agggccaccgg

SEQ ID NO: 963568 - RNA, 13 nt, Mycobacterium avium subsp. paratuberculosis
agggccgggcgug

SEQ ID NO: 963569 - RNA, 21 nt, Mycobacterium avium subsp. paratuberculosis
agggccgggcgugcccggcgc

SEQ ID NO: 963570 - RNA, 22 nt, Mycobacterium avium subsp. paratuberculosis
agggccgggcgugcccggcgca

SEQ ID NO: 963571 - RNA, 13 nt, Mycobacterium avium subsp. paratuberculosis
agggcgaccacca

SEQ ID NO: 963572 - RNA, 19 nt, Mycobacterium avium subsp. paratuberculosis
agggccucgucgucgucga

SEQ ID NO: 963573 - RNA, 23 nt, Mycobacterium avium subsp. paratuberculosis
agggccucgccguugccggcccg

SEQ ID NO: 963574 - RNA, 16 nt, Mycobacterium avium subsp. paratuberculosis
agggcgaccgccgcgu

SEQ ID NO: 963575 - RNA, 17 nt, Mycobacterium avium subsp. paratuberculosis
agggcgacgaugccggc

SEQ ID NO: 963576 - RNA, 13 nt, Mycobacterium avium subsp. paratuberculosis
agggcgacgccgc

SEQ ID NO: 963577 - RNA, 16 nt, Mycobacterium avium subsp. paratuberculosis
agggcgacgccgcgga

SEQ ID NO: 963578 - RNA, 16 nt, Mycobacterium avium subsp. paratuberculosis
agggcgacggcggcga

SEQ ID NO: 963579 - RNA, 20 nt, Mycobacterium avium subsp. paratuberculosis
agggcgacuccggcgccggu

SEQ ID NO: 963580 - RNA, 21 nt, Mycobacterium avium subsp. paratuberculosis
agggcgcggcguagccgccgg

SEQ ID NO: 963581 - RNA, 14 nt, Mycobacterium avium subsp. paratuberculosis
agggcgcgucgauc

SEQ ID NO: 963582 - RNA, 15 nt, Mycobacterium avium subsp. paratuberculosis
agggcgcgucgaucg

SEQ ID NO: 963583 - RNA, 24 nt, Mycobacterium avium subsp. paratuberculosis
agggcgcgucguagccggcacgca

SEQ ID NO: 963584 - RNA, 15 nt, Mycobacterium avium subsp. paratuberculosis
agggcggccggccag

SEQ ID NO: 963585 - RNA, 19 nt, Mycobacterium avium subsp. paratuberculosis
agggcgcucaucaggcggc

SEQ ID NO: 963586 - RNA, 23 nt, Mycobacterium avium subsp. paratuberculosis
agggcgcucaucaggcggccggc

SEQ ID NO: 963587 - RNA, 16 nt, Mycobacterium avium subsp. paratuberculosis
agcucauacagcggcg

SEQ ID NO: 963588 - RNA, 23 nt, Mycobacterium avium subsp. paratuberculosis
agcucauacagcggcgcgcgccg

SEQ ID NO: 963589 - RNA, 14 nt, Mycobacterium avium subsp. paratuberculosis
agcucaucaccggc

SEQ ID NO: 963590 - RNA, 17 nt, Mycobacterium avium subsp. paratuberculosis
agcucaucaccggcgcg

SEQ ID NO: 963591 - RNA, 19 nt, Mycobacterium avium subsp. paratuberculosis
agcucaucaccggcgcgcc

SEQ ID NO: 963592 - RNA, 23 nt, Mycobacterium avium subsp. paratuberculosis
agcucaucaccggcgcgccgucc

SEQ ID NO: 963593 - RNA, 13 nt, Mycobacterium avium subsp. paratuberculosis
agcucagccacgc

SEQ ID NO: 963594 - RNA, 17 nt, Mycobacterium avium subsp. paratuberculosis
agcucagccgccuggcg

SEQ ID NO: 963595 - RNA, 21 nt, Mycobacterium avium subsp. paratuberculosis
agcucagcugcugcgcggcgg

SEQ ID NO: 963596 - RNA, 22 nt, Mycobacterium avium subsp. paratuberculosis
agcucagcugcugcgcggcggc

SEQ ID NO: 963597 - RNA, 18 nt, Mycobacterium avium subsp. paratuberculosis
agcucaggaacggccgga

SEQ ID NO: 963598 - RNA, 17 nt, Mycobacterium avium subsp. paratuberculosis
agcucaggccggccuug

SEQ ID NO: 963599 - RNA, 21 nt, Mycobacterium avium subsp. paratuberculosis
agcucaggugcgacgcccacu

SEQ ID NO: 963600 - RNA, 14 nt, Mycobacterium avium subsp. paratuberculosis
agcucgauggugcc

SEQ ID NO: 963601 - RNA, 14 nt, Mycobacterium avium subsp. paratuberculosis
agcucgaucgccgc

SEQ ID NO: 963602 - RNA, 17 nt, Mycobacterium avium subsp. paratuberculosis
agcucgaucgccgcgcc

SEQ ID NO: 963603 - RNA, 19 nt, Mycobacterium avium subsp. paratuberculosis
agcucgauggugccgucgg

SEQ ID NO: 963604 - RNA, 21 nt, Mycobacterium avium subsp. paratuberculosis
agcucgauguccagguaggcg

SEQ ID NO: 963605 - RNA, 19 nt, Mycobacterium avium subsp. paratuberculosis
agcucgacgaccucgccga

SEQ ID NO: 963606 - RNA, 20 nt, Mycobacterium avium subsp. paratuberculosis
agcucgacgaccucgccgac

SEQ ID NO: 963607 - RNA, 12 nt, Mycobacterium avium subsp. paratuberculosis
agcucgacgacu

SEQ ID NO: 963608 - RNA, 19 nt, Mycobacterium avium subsp. paratuberculosis
agcucgacgacuucggccu

SEQ ID NO: 963609 - RNA, 16 nt, Mycobacterium avium subsp. paratuberculosis
agcucgaccgcggcga

SEQ ID NO: 963610 - RNA, 17 nt, Mycobacterium avium subsp. paratuberculosis
agcucgaccgcggcgau

SEQ ID NO: 963611 - RNA, 18 nt, Mycobacterium avium subsp. paratuberculosis
agcucgaccgcggcgaug

SEQ ID NO: 963612 - RNA, 16 nt, Mycobacterium avium subsp. paratuberculosis
agcucaucgaggucga

SEQ ID NO: 963613 - RNA, 21 nt, Mycobacterium avium subsp. paratuberculosis
agcucaugucguacgggcgca

SEQ ID NO: 963614 - RNA, 16 nt, Mycobacterium avium subsp. paratuberculosis
agcucauguggggggu

SEQ ID NO: 963615 - RNA, 19 nt, Mycobacterium avium subsp. paratuberculosis
agcuccagcagcccgggcu

SEQ ID NO: 963616 - RNA, 17 nt, Mycobacterium avium subsp. paratuberculosis
agcuccuugagccgccg

SEQ ID NO: 963617 - RNA, 18 nt, Mycobacterium avium subsp. paratuberculosis
agcuccuugagccgccgc

SEQ ID NO: 963618 - RNA, 18 nt, Mycobacterium avium subsp. paratuberculosis
agcucgaacaccgucgag

SEQ ID NO: 963619 - RNA, 13 nt, Mycobacterium avium subsp. paratuberculosis
agcugcgccggcu

SEQ ID NO: 963620 - RNA, 12 nt, Mycobacterium avium subsp. paratuberculosis
agcugccguccg

SEQ ID NO: 963621 - RNA, 20 nt, Mycobacterium avium subsp. paratuberculosis
agcugccggcggccgccggc

SEQ ID NO: 963622 - RNA, 13 nt, Mycobacterium avium subsp. paratuberculosis
agcugccgaccag

SEQ ID NO: 963623 - RNA, 16 nt, Mycobacterium avium subsp. paratuberculosis
agcugccgaccaggaa

SEQ ID NO: 963624 - RNA, 21 nt, Mycobacterium avium subsp. paratuberculosis
agcugccggccguugcgggug

SEQ ID NO: 963625 - RNA, 14 nt, Mycobacterium avium subsp. paratuberculosis
agcugccggcgacc

SEQ ID NO: 963626 - RNA, 19 nt, Mycobacterium avium subsp. paratuberculosis
agcugcccugaagcugggc

SEQ ID NO: 963627 - RNA, 17 nt, Mycobacterium avium subsp. paratuberculosis
agcugcauggacagcga

SEQ ID NO: 963628 - RNA, 15 nt, Mycobacterium avium subsp. paratuberculosis
agcucggcggcccgc

SEQ ID NO: 963629 - RNA, 15 nt, Mycobacterium avium subsp. paratuberculosis
agcugcagcgacugc

SEQ ID NO: 963630 - RNA, 15 nt, Mycobacterium avium subsp. paratuberculosis
agcugcaggcgacga

SEQ ID NO: 963631 - RNA, 22 nt, Mycobacterium avium subsp. paratuberculosis
agcugcaggcuggucugguggg

SEQ ID NO: 963632 - RNA, 22 nt, Mycobacterium avium subsp. paratuberculosis
agcugcaccggguacaccggcu

SEQ ID NO: 963633 - RNA, 18 nt, Mycobacterium avium subsp. paratuberculosis
agcugcaacgcgucggcg

SEQ ID NO: 963634 - RNA, 20 nt, Mycobacterium avium subsp. paratuberculosis
agcugcaacgcgucggcgcc

SEQ ID NO: 963635 - RNA, 22 nt, Mycobacterium avium subsp. paratuberculosis
agcugauggcacccucggugcu

SEQ ID NO: 963636 - RNA, 18 nt, Mycobacterium avium subsp. paratuberculosis
agcugauucgcgguggcg

SEQ ID NO: 963637 - RNA, 23 nt, Mycobacterium avium subsp. paratuberculosis
agcucggucaccagcggcccgcu

SEQ ID NO: 963638 - RNA, 12 nt, Mycobacterium avium subsp. paratuberculosis
agcucggucgcg

SEQ ID NO: 963639 - RNA, 18 nt, Mycobacterium avium subsp. paratuberculosis
agcucggucgcggucggc

SEQ ID NO: 963640 - RNA, 18 nt, Mycobacterium avium subsp. paratuberculosis
agcucggggucggcgucg

SEQ ID NO: 963641 - RNA, 17 nt, Mycobacterium avium subsp. paratuberculosis
agcucgggcagcccgcc

SEQ ID NO: 963642 - RNA, 21 nt, Mycobacterium avium subsp. paratuberculosis
agcucgggcagcccgccgacc

SEQ ID NO: 963643 - RNA, 15 nt, Mycobacterium avium subsp. paratuberculosis
agcucggcggccggg

SEQ ID NO: 963644 - RNA, 17 nt, Mycobacterium avium subsp. paratuberculosis
agcucggcggccgggug

SEQ ID NO: 963645 - RNA, 22 nt, Mycobacterium avium subsp. paratuberculosis
agcucggccuuacgcugcgcga

SEQ ID NO: 963646 - RNA, 21 nt, Mycobacterium avium subsp. paratuberculosis
agcucgccgauguggcgggcg

SEQ ID NO: 963647 - RNA, 16 nt, Mycobacterium avium subsp. paratuberculosis
agcucgccgccgacga

SEQ ID NO: 963648 - RNA, 13 nt, Mycobacterium avium subsp. paratuberculosis
agcucgccgcggc

SEQ ID NO: 963649 - RNA, 14 nt, Mycobacterium avium subsp. paratuberculosis
agcucgccgcggcc

SEQ ID NO: 963650 - RNA, 19 nt, Mycobacterium avium subsp. paratuberculosis
agcucgccgcugucgucga

SEQ ID NO: 963651 - RNA, 22 nt, Mycobacterium avium subsp. paratuberculosis
agcucggccaccagcgcccgcc

SEQ ID NO: 963652 - RNA, 14 nt, Mycobacterium avium subsp. paratuberculosis
agcgucgugcgggc

SEQ ID NO: 963653 - RNA, 16 nt, Mycobacterium avium subsp. paratuberculosis
agcgucggcgugcccg

SEQ ID NO: 963654 - RNA, 20 nt, Mycobacterium avium subsp. paratuberculosis
agcgucggcgugcccgccga

SEQ ID NO: 963655 - RNA, 18 nt, Mycobacterium avium subsp. paratuberculosis
agcgucggcuagcggcug

SEQ ID NO: 963656 - RNA, 19 nt, Mycobacterium avium subsp. paratuberculosis
agcgucggucucgacguug

SEQ ID NO: 963657 - RNA, 16 nt, Mycobacterium avium subsp. paratuberculosis
agcgucgucaggccgu

SEQ ID NO: 963658 - RNA, 18 nt, Mycobacterium avium subsp. paratuberculosis
agcgucgucaggccguga

SEQ ID NO: 963659 - RNA, 15 nt, Mycobacterium avium subsp. paratuberculosis
agcgucguccaugcc

SEQ ID NO: 963660 - RNA, 19 nt, Mycobacterium avium subsp. paratuberculosis
agcgucguccaugcccgcc

SEQ ID NO: 963661 - RNA, 20 nt, Mycobacterium avium subsp. paratuberculosis
agcgucgcgccgccacccca

SEQ ID NO: 963662 - RNA, 13 nt, Mycobacterium avium subsp. paratuberculosis
agcgucgcggccg

SEQ ID NO: 963663 - RNA, 15 nt, Mycobacterium avium subsp. paratuberculosis
agcgucauuccgccg

SEQ ID NO: 963664 - RNA, 22 nt, Mycobacterium avium subsp. paratuberculosis
agcgucauuccgccgcgcccgu

SEQ ID NO: 963665 - RNA, 14 nt, Mycobacterium avium subsp. paratuberculosis
agcgucagcaucgc

SEQ ID NO: 963666 - RNA, 17 nt, Mycobacterium avium subsp. paratuberculosis
agcgucagcaucgccgu

SEQ ID NO: 963667 - RNA, 23 nt, Mycobacterium avium subsp. paratuberculosis
agcgucagggcgacuccggcgcc

SEQ ID NO: 963668 - RNA, 20 nt, Mycobacterium avium subsp. paratuberculosis
agcgucaucacgugcuggcg

SEQ ID NO: 963669 - RNA, 18 nt, Mycobacterium avium subsp. paratuberculosis
agcguccaguccggcgug

SEQ ID NO: 963670 - RNA, 19 nt, Mycobacterium avium subsp. paratuberculosis
agcgucgccagccgccggc

SEQ ID NO: 963671 - RNA, 20 nt, Mycobacterium avium subsp. paratuberculosis
agcgucgccagccgccggcu

SEQ ID NO: 963672 - RNA, 21 nt, Mycobacterium avium subsp. paratuberculosis
agcgucgccagccgccggcuc

SEQ ID NO: 963673 - RNA, 17 nt, Mycobacterium avium subsp. paratuberculosis
agcgucgccaugccguc

SEQ ID NO: 963674 - RNA, 19 nt, Mycobacterium avium subsp. paratuberculosis
agcgucgccaugccgucgc

SEQ ID NO: 963675 - RNA, 21 nt, Mycobacterium avium subsp. paratuberculosis
agcgucgccaugccgucgcgc

SEQ ID NO: 963676 - RNA, 13 nt, Mycobacterium avium subsp. paratuberculosis
agcgucgccgccc

SEQ ID NO: 963677 - RNA, 19 nt, Mycobacterium avium subsp. paratuberculosis
agcguguuggacgcccgcu

SEQ ID NO: 963678 - RNA, 21 nt, Mycobacterium avium subsp. paratuberculosis
agcguuccagguucagcccgg

SEQ ID NO: 963679 - RNA, 19 nt, Mycobacterium avium subsp. paratuberculosis
agcguuugagcaccucuuc

SEQ ID NO: 963680 - RNA, 17 nt, Mycobacterium avium subsp. paratuberculosis
agcguuuggccugcggc

SEQ ID NO: 963681 - RNA, 13 nt, Mycobacterium avium subsp. paratuberculosis
agcgucucgccgg

SEQ ID NO: 963682 - RNA, 14 nt, Mycobacterium avium subsp. paratuberculosis
agcgucucggcggc

SEQ ID NO: 963683 - RNA, 19 nt, Mycobacterium avium subsp. paratuberculosis
agcgugggggccauguacg

SEQ ID NO: 963684 - RNA, 16 nt, Mycobacterium avium subsp. paratuberculosis
agcguggugcgcccgu

SEQ ID NO: 963685 - RNA, 23 nt, Mycobacterium avium subsp. paratuberculosis
agcguggugcgcccgucgguggg

SEQ ID NO: 963686 - RNA, 14 nt, Mycobacterium avium subsp. paratuberculosis
agcguggucacccg

SEQ ID NO: 963687 - RNA, 13 nt, Mycobacterium avium subsp. paratuberculosis
agcgugucgccgg

SEQ ID NO: 963688 - RNA, 19 nt, Mycobacterium avium subsp. paratuberculosis
agcgugucggcgaucgcgc

SEQ ID NO: 963689 - RNA, 15 nt, Mycobacterium avium subsp. paratuberculosis
agcguguagacggug

SEQ ID NO: 963690 - RNA, 18 nt, Mycobacterium avium subsp. paratuberculosis
agcguauccggccagccg

SEQ ID NO: 963691 - RNA, 15 nt, Mycobacterium avium subsp. paratuberculosis
agcguaugccggugg

SEQ ID NO: 963692 - RNA, 15 nt, Mycobacterium avium subsp. paratuberculosis
agcgucacgucgacg

SEQ ID NO: 963693 - RNA, 16 nt, Mycobacterium avium subsp. paratuberculosis
agcgucacgucgacgg

SEQ ID NO: 963694 - RNA, 19 nt, Mycobacterium avium subsp. paratuberculosis
agcgucaacucgucggcga

SEQ ID NO: 963695 - RNA, 22 nt, Mycobacterium avium subsp. paratuberculosis
agcgucaccaaugcgccggcgg

SEQ ID NO: 963696 - RNA, 23 nt, Mycobacterium avium subsp. paratuberculosis
agcgucaccaaugcgccggcggc

SEQ ID NO: 963697 - RNA, 20 nt, Mycobacterium avium subsp. paratuberculosis
agcgucaccuucaccacggc

SEQ ID NO: 963698 - RNA, 20 nt, Mycobacterium avium subsp. paratuberculosis
agcgucacgccagcgugacg

SEQ ID NO: 963699 - RNA, 16 nt, Mycobacterium avium subsp. paratuberculosis
agcgucacgccgcgcc

SEQ ID NO: 963700 - RNA, 22 nt, Mycobacterium avium subsp. paratuberculosis
agcgucacgccgcgcccgucga

SEQ ID NO: 963701 - RNA, 13 nt, Mycobacterium avium subsp. paratuberculosis
agcgucacgcugg

SEQ ID NO: 963702 - RNA, 20 nt, Mycobacterium avium subsp. paratuberculosis
agcgucacgcuggcgugaca

SEQ ID NO: 963703 - RNA, 21 nt, Mycobacterium avium subsp. paratuberculosis
agcgucacgcuggcgugacag

SEQ ID NO: 963704 - RNA, 21 nt, Mycobacterium avium subsp. paratuberculosis
agcgucacgcuggcguggcac

SEQ ID NO: 963705 - RNA, 20 nt, Mycobacterium avium subsp. paratuberculosis
agcgucacgcuggcguggcg

SEQ ID NO: 963706 - RNA, 22 nt, Mycobacterium avium subsp. paratuberculosis
agcgucacgcuggcguggcucg

SEQ ID NO: 963707 - RNA, 17 nt, Mycobacterium avium subsp. paratuberculosis
agcgguuggcgacgcug

SEQ ID NO: 963708 - RNA, 21 nt, Mycobacterium avium subsp. paratuberculosis
agcgguucggcgacgcuggug

SEQ ID NO: 963709 - RNA, 22 nt, Mycobacterium avium subsp. paratuberculosis
agcgguucggcgacgcuggugg

SEQ ID NO: 963710 - RNA, 23 nt, Mycobacterium avium subsp. paratuberculosis
agcgguucggcgacgcugguggc

SEQ ID NO: 963711 - RNA, 20 nt, Mycobacterium avium subsp. paratuberculosis
agcgggcugugccggcgggu

SEQ ID NO: 963712 - RNA, 20 nt, Mycobacterium avium subsp. paratuberculosis
agcggugucaccgacgccag

SEQ ID NO: 963713 - RNA, 21 nt, Mycobacterium avium subsp. paratuberculosis
agcggugucaccgacgccagc

SEQ ID NO: 963714 - RNA, 19 nt, Mycobacterium avium subsp. paratuberculosis
agcguacccaggucggcgu

SEQ ID NO: 963715 - RNA, 22 nt, Mycobacterium avium subsp. paratuberculosis
agcgguuuggauggcccgccag

SEQ ID NO: 963716 - RNA, 20 nt, Mycobacterium avium subsp. paratuberculosis
agcggccagcccgcggcagc

SEQ ID NO: 963717 - RNA, 21 nt, Mycobacterium avium subsp. paratuberculosis
agcggccagcccgcggcagcc

SEQ ID NO: 963718 - RNA, 22 nt, Mycobacterium avium subsp. paratuberculosis
agcggccagcccgcggcagcca

SEQ ID NO: 963719 - RNA, 17 nt, Mycobacterium avium subsp. paratuberculosis
agcggcaacacgccggc

SEQ ID NO: 963720 - RNA, 16 nt, Mycobacterium avium subsp. paratuberculosis
agcggcaccaacccga

SEQ ID NO: 963721 - RNA, 19 nt, Mycobacterium avium subsp. paratuberculosis
agcggcaccagguaccggc

SEQ ID NO: 963722 - RNA, 15 nt, Mycobacterium avium subsp. paratuberculosis
agcggcacccggucc

SEQ ID NO: 963723 - RNA, 21 nt, Mycobacterium avium subsp. paratuberculosis
agcggcacccgguccggcccg

SEQ ID NO: 963724 - RNA, 13 nt, Mycobacterium avium subsp. paratuberculosis
agcggcaccgcca

SEQ ID NO: 963725 - RNA, 17 nt, Mycobacterium avium subsp. paratuberculosis
agcggcccucccccgag

SEQ ID NO: 963726 - RNA, 21 nt, Mycobacterium avium subsp. paratuberculosis
agcggcccgaucaccaggccc

SEQ ID NO: 963727 - RNA, 16 nt, Mycobacterium avium subsp. paratuberculosis
agcggcccgcaccgau

SEQ ID NO: 963728 - RNA, 21 nt, Mycobacterium avium subsp. paratuberculosis
agcggcccuguucgccgucgc

SEQ ID NO: 963729 - RNA, 20 nt, Mycobacterium avium subsp. paratuberculosis
agcggccgcaaucggcgccg

SEQ ID NO: 963730 - RNA, 15 nt, Mycobacterium avium subsp. paratuberculosis
agcggccgcacgcga

SEQ ID NO: 963731 - RNA, 13 nt, Mycobacterium avium subsp. paratuberculosis
agcggccaucgcc

SEQ ID NO: 963732 - RNA, 19 nt, Mycobacterium avium subsp. paratuberculosis
agcggccaucgccgccauc

SEQ ID NO: 963733 - RNA, 21 nt, Mycobacterium avium subsp. paratuberculosis
agcggccaucgccgccaucgc

SEQ ID NO: 963734 - RNA, 13 nt, Mycobacterium avium subsp. paratuberculosis
agcggcccaccgc

SEQ ID NO: 963735 - RNA, 14 nt, Mycobacterium avium subsp. paratuberculosis
agcggcccaccgcg

SEQ ID NO: 963736 - RNA, 19 nt, Mycobacterium avium subsp. paratuberculosis
agcggcccagcucggugau

SEQ ID NO: 963737 - RNA, 12 nt, Mycobacterium avium subsp. paratuberculosis
agcggcccaggu

SEQ ID NO: 963738 - RNA, 23 nt, Mycobacterium avium subsp. paratuberculosis
agcggccccccgcacaccggcca

SEQ ID NO: 963739 - RNA, 12 nt, Mycobacterium avium subsp. paratuberculosis
agcggcccgaga

SEQ ID NO: 963740 - RNA, 17 nt, Mycobacterium avium subsp. paratuberculosis
agcggcgacagcggccu

SEQ ID NO: 963741 - RNA, 12 nt, Mycobacterium avium subsp. paratuberculosis
agcggccgcgga

SEQ ID NO: 963742 - RNA, 23 nt, Mycobacterium avium subsp. paratuberculosis
agcggcgaccuugcggcgcgaug

SEQ ID NO: 963743 - RNA, 21 nt, Mycobacterium avium subsp. paratuberculosis
agcggcgcaccgugucgucgc

SEQ ID NO: 963744 - RNA, 23 nt, Mycobacterium avium subsp. paratuberculosis
agcggcgaugcccacagccaggu

SEQ ID NO: 963745 - RNA, 21 nt, Mycobacterium avium subsp. paratuberculosis
agcggcgacuccagcagcgcc

SEQ ID NO: 963746 - RNA, 21 nt, Mycobacterium avium subsp. paratuberculosis
agcggccuaugcgcccgggaa

SEQ ID NO: 963747 - RNA, 15 nt, Mycobacterium avium subsp. paratuberculosis
agcggccucggaagg

SEQ ID NO: 963748 - RNA, 17 nt, Mycobacterium avium subsp. paratuberculosis
agcggccgucgcgcagc

SEQ ID NO: 963749 - RNA, 12 nt, Mycobacterium avium subsp. paratuberculosis
agcggccgucca

SEQ ID NO: 963750 - RNA, 14 nt, Mycobacterium avium subsp. paratuberculosis
agcggccguccacc

SEQ ID NO: 963751 - RNA, 12 nt, Mycobacterium avium subsp. paratuberculosis
agcggccgucgc

SEQ ID NO: 963752 - RNA, 23 nt, Mycobacterium avium subsp. paratuberculosis
agcggccgucgccgggcggggug

SEQ ID NO: 963753 - RNA, 14 nt, Mycobacterium avium subsp. paratuberculosis
agcgggcacgccgc

SEQ ID NO: 963754 - RNA, 17 nt, Mycobacterium avium subsp. paratuberculosis
agcgggcacgccgccgc

SEQ ID NO: 963755 - RNA, 19 nt, Mycobacterium avium subsp. paratuberculosis
agcgggcacgccgccgcga

SEQ ID NO: 963756 - RNA, 12 nt, Mycobacterium avium subsp. paratuberculosis
agcgggccacgc

SEQ ID NO: 963757 - RNA, 22 nt, Mycobacterium avium subsp. paratuberculosis
agcgggccgacagcacgccggg

SEQ ID NO: 963758 - RNA, 23 nt, Mycobacterium avium subsp. paratuberculosis
agcgggccgacagcacgccgggc

SEQ ID NO: 963759 - RNA, 18 nt, Mycobacterium avium subsp. paratuberculosis
agcgggccgaccgucagc

SEQ ID NO: 963760 - RNA, 19 nt, Mycobacterium avium subsp. paratuberculosis
agcgggccgagcguucggc

SEQ ID NO: 963761 - RNA, 13 nt, Mycobacterium avium subsp. paratuberculosis
agcgggccgauca

SEQ ID NO: 963762 - RNA, 19 nt, Mycobacterium avium subsp. paratuberculosis
agcgggcgaacgaccgggu

SEQ ID NO: 963763 - RNA, 12 nt, Mycobacterium avium subsp. paratuberculosis
agcgggcgacgu

SEQ ID NO: 963764 - RNA, 14 nt, Mycobacterium avium subsp. paratuberculosis
agcgggccggcguc

SEQ ID NO: 963765 - RNA, 22 nt, Mycobacterium avium subsp. paratuberculosis
agcgggccggcgucgucgagca

SEQ ID NO: 963766 - RNA, 19 nt, Mycobacterium avium subsp. paratuberculosis
agcgggccgugccgccaua

SEQ ID NO: 963767 - RNA, 15 nt, Mycobacterium avium subsp. paratuberculosis
agcgggccguggcac

SEQ ID NO: 963768 - RNA, 18 nt, Mycobacterium avium subsp. paratuberculosis
agcgggccguugccgguc

SEQ ID NO: 963769 - RNA, 14 nt, Mycobacterium avium subsp. paratuberculosis
agcgggcggcggug

SEQ ID NO: 963770 - RNA, 16 nt, Mycobacterium avium subsp. paratuberculosis
agcgggcggccagccg

SEQ ID NO: 963771 - RNA, 15 nt, Mycobacterium avium subsp. paratuberculosis
agcgggcggccccgg

SEQ ID NO: 963772 - RNA, 17 nt, Mycobacterium avium subsp. paratuberculosis
agcgggcggccccgggc

SEQ ID NO: 963773 - RNA, 21 nt, Mycobacterium avium subsp. paratuberculosis
agcgggcggccccgggcgcug

SEQ ID NO: 963774 - RNA, 12 nt, Mycobacterium avium subsp. paratuberculosis
agcgggcggcgg

SEQ ID NO: 963775 - RNA, 20 nt, Mycobacterium avium subsp. paratuberculosis
agcgggcuaggcucggcagc

SEQ ID NO: 963776 - RNA, 24 nt, Mycobacterium avium subsp. paratuberculosis
agcgggcuaggcucggcagccggc

SEQ ID NO: 963777 - RNA, 14 nt, Mycobacterium avium subsp. paratuberculosis
agcgggcuggcgua

SEQ ID NO: 963778 - RNA, 14 nt, Mycobacterium avium subsp. paratuberculosis
agcgggacgcgcag

SEQ ID NO: 963779 - RNA, 15 nt, Mycobacterium avium subsp. paratuberculosis
agcgggagccggcca

SEQ ID NO: 963780 - RNA, 12 nt, Mycobacterium avium subsp. paratuberculosis
agcgggaucccc

SEQ ID NO: 963781 - RNA, 19 nt, Mycobacterium avium subsp. paratuberculosis
agcgggauccccaccguga

SEQ ID NO: 963782 - RNA, 21 nt, Mycobacterium avium subsp. paratuberculosis
agcgggauccccaccgugacg

SEQ ID NO: 963783 - RNA, 15 nt, Mycobacterium avium subsp. paratuberculosis
agcgggaucccgcag

SEQ ID NO: 963784 - RNA, 22 nt, Mycobacterium avium subsp. paratuberculosis
agcgggaucccgcagccgcgac

SEQ ID NO: 963785 - RNA, 22 nt, Mycobacterium avium subsp. paratuberculosis
agcgggaucugcgccgccuccg

SEQ ID NO: 963786 - RNA, 18 nt, Mycobacterium avium subsp. paratuberculosis
agcggcgugcugcgcagc

SEQ ID NO: 963787 - RNA, 18 nt, Mycobacterium avium subsp. paratuberculosis
agcggcgucacgcccucu

SEQ ID NO: 963788 - RNA, 15 nt, Mycobacterium avium subsp. paratuberculosis
agcggcgggcccagc

SEQ ID NO: 963789 - RNA, 18 nt, Mycobacterium avium subsp. paratuberculosis
agcggcggucggcgccga

SEQ ID NO: 963790 - RNA, 19 nt, Mycobacterium avium subsp. paratuberculosis
agcggcggucggcgccgau

SEQ ID NO: 963791 - RNA, 21 nt, Mycobacterium avium subsp. paratuberculosis
agcggcggucggcgccgauca

SEQ ID NO: 963792 - RNA, 17 nt, Mycobacterium avium subsp. paratuberculosis
agcggcguaccgcggcg

SEQ ID NO: 963793 - RNA, 19 nt, Mycobacterium avium subsp. paratuberculosis
agcggcguaccgcggcggc

SEQ ID NO: 963794 - RNA, 17 nt, Mycobacterium avium subsp. paratuberculosis
agcgccggguugcaggc

SEQ ID NO: 963795 - RNA, 18 nt, Mycobacterium avium subsp. paratuberculosis
agcgccgguaggccgcgc

SEQ ID NO: 963796 - RNA, 19 nt, Mycobacterium avium subsp. paratuberculosis
agcgccgguaggccgcgcc

SEQ ID NO: 963797 - RNA, 22 nt, Mycobacterium avium subsp. paratuberculosis
agcgccgguaggccgcgccgau

SEQ ID NO: 963798 - RNA, 16 nt, Mycobacterium avium subsp. paratuberculosis
agcgccgucaucaccg

SEQ ID NO: 963799 - RNA, 20 nt, Mycobacterium avium subsp. paratuberculosis
agcgccgucaucaccgccga

SEQ ID NO: 963800 - RNA, 21 nt, Mycobacterium avium subsp. paratuberculosis
agcgccgucaucaccgccgag

SEQ ID NO: 963801 - RNA, 18 nt, Mycobacterium avium subsp. paratuberculosis
agcgccgucuccucgacc

SEQ ID NO: 963802 - RNA, 22 nt, Mycobacterium avium subsp. paratuberculosis
agcgccgucuccucgaccagcg

SEQ ID NO: 963803 - RNA, 15 nt, Mycobacterium avium subsp. paratuberculosis
agcgccgucucgacc

SEQ ID NO: 963804 - RNA, 13 nt, Mycobacterium avium subsp. paratuberculosis
agcgcggcgauca

SEQ ID NO: 963805 - RNA, 18 nt, Mycobacterium avium subsp. paratuberculosis
agcgcggcgaucagcagc

SEQ ID NO: 963806 - RNA, 19 nt, Mycobacterium avium subsp. paratuberculosis
agcgcggcgaucagcagca

SEQ ID NO: 963807 - RNA, 16 nt, Mycobacterium avium subsp. paratuberculosis
agcgcggcgaucagcu

SEQ ID NO: 963808 - RNA, 19 nt, Mycobacterium avium subsp. paratuberculosis
agcgcggcgacauuggccg

SEQ ID NO: 963809 - RNA, 13 nt, Mycobacterium avium subsp. paratuberculosis
agcgcgucgggcu

SEQ ID NO: 963810 - RNA, 23 nt, Mycobacterium avium subsp. paratuberculosis
agcgcgucggccagcgcgcgggc

SEQ ID NO: 963811 - RNA, 19 nt, Mycobacterium avium subsp. paratuberculosis
agcgcgucggcgaccgcgc

SEQ ID NO: 963812 - RNA, 16 nt, Mycobacterium avium subsp. paratuberculosis
agcgcgucggccagca

SEQ ID NO: 963813 - RNA, 18 nt, Mycobacterium avium subsp. paratuberculosis
agcgcgucggccagcacc

SEQ ID NO: 963814 - RNA, 19 nt, Mycobacterium avium subsp. paratuberculosis
agcgcgucgaccagccgca

SEQ ID NO: 963815 - RNA, 13 nt, Mycobacterium avium subsp. paratuberculosis
agcgcgucgacgc

SEQ ID NO: 963816 - RNA, 22 nt, Mycobacterium avium subsp. paratuberculosis
agcgcgucgacgcggucgaaca

SEQ ID NO: 963817 - RNA, 19 nt, Mycobacterium avium subsp. paratuberculosis
agcgcgucgcgcccggcgu

SEQ ID NO: 963818 - RNA, 13 nt, Mycobacterium avium subsp. paratuberculosis
agcgcgucgaggu

SEQ ID NO: 963819 - RNA, 19 nt, Mycobacterium avium subsp. paratuberculosis
agcgcguccaggugcgccg

SEQ ID NO: 963820 - RNA, 16 nt, Mycobacterium avium subsp. paratuberculosis
agcgcggcuuggccac

SEQ ID NO: 963821 - RNA, 13 nt, Mycobacterium avium subsp. paratuberculosis
agcgcgucgacca

SEQ ID NO: 963822 - RNA, 22 nt, Mycobacterium avium subsp. paratuberculosis
agcgcggcgggccagucgccgc

SEQ ID NO: 963823 - RNA, 20 nt, Mycobacterium avium subsp. paratuberculosis
agcgcggcggccaccucggc

SEQ ID NO: 963824 - RNA, 19 nt, Mycobacterium avium subsp. paratuberculosis
agcgcggcggccagcucgg

SEQ ID NO: 963825 - RNA, 13 nt, Mycobacterium avium subsp. paratuberculosis
agcgcggcggcgc

SEQ ID NO: 963826 - RNA, 14 nt, Mycobacterium avium subsp. paratuberculosis
agcgcggcggcgcc

SEQ ID NO: 963827 - RNA, 19 nt, Mycobacterium avium subsp. paratuberculosis
agcgcggcggcgccgucgc

SEQ ID NO: 963828 - RNA, 17 nt, Mycobacterium avium subsp. paratuberculosis
agcgcggcggaggucag

SEQ ID NO: 963829 - RNA, 20 nt, Mycobacterium avium subsp. paratuberculosis
agcgcgugaccccggcgacc

SEQ ID NO: 963830 - RNA, 13 nt, Mycobacterium avium subsp. paratuberculosis
agcgcgugaucgg

SEQ ID NO: 963831 - RNA, 17 nt, Mycobacterium avium subsp. paratuberculosis
agcgcgugaucggugcc

SEQ ID NO: 963832 - RNA, 20 nt, Mycobacterium avium subsp. paratuberculosis
agcgcgucgucgauggccac

SEQ ID NO: 963833 - RNA, 22 nt, Mycobacterium avium subsp. paratuberculosis
agcgcgucgucgauggccacca

SEQ ID NO: 963834 - RNA, 17 nt, Mycobacterium avium subsp. paratuberculosis
agcgcgucgucgccgaa

SEQ ID NO: 963835 - RNA, 20 nt, Mycobacterium avium subsp. paratuberculosis
agcgcucgacgaggcgggcg

SEQ ID NO: 963836 - RNA, 21 nt, Mycobacterium avium subsp. paratuberculosis
agcgcucgcggauguccgacc

SEQ ID NO: 963837 - RNA, 17 nt, Mycobacterium avium subsp. paratuberculosis
agcgcugggugaacacc

SEQ ID NO: 963838 - RNA, 21 nt, Mycobacterium avium subsp. paratuberculosis
agcgcugcauagucggcccga

SEQ ID NO: 963839 - RNA, 17 nt, Mycobacterium avium subsp. paratuberculosis
agcgcugcccgugccgc

SEQ ID NO: 963840 - RNA, 24 nt, Mycobacterium avium subsp. paratuberculosis
agcgcugcccgugccgcaccuggu

SEQ ID NO: 963841 - RNA, 15 nt, Mycobacterium avium subsp. paratuberculosis
agcggaaugaacgcg

SEQ ID NO: 963842 - RNA, 20 nt, Mycobacterium avium subsp. paratuberculosis
agcggaaugaacgcggccag

SEQ ID NO: 963843 - RNA, 21 nt, Mycobacterium avium subsp. paratuberculosis
agcggaugccggaggcgccgu

SEQ ID NO: 963844 - RNA, 18 nt, Mycobacterium avium subsp. paratuberculosis
agcggauugaccagcacg

SEQ ID NO: 963845 - RNA, 20 nt, Mycobacterium avium subsp. paratuberculosis
agcggauggcgacggcgacg

SEQ ID NO: 963846 - RNA, 22 nt, Mycobacterium avium subsp. paratuberculosis
agcggauggcgacggcgacgac

SEQ ID NO: 963847 - RNA, 14 nt, Mycobacterium avium subsp. paratuberculosis
agcggaagcugccg

SEQ ID NO: 963848 - RNA, 14 nt, Mycobacterium avium subsp. paratuberculosis
agcggaaccgacac

SEQ ID NO: 963849 - RNA, 21 nt, Mycobacterium avium subsp. paratuberculosis
agcggaaccgggggccgucac

SEQ ID NO: 963850 - RNA, 22 nt, Mycobacterium avium subsp. paratuberculosis
agcggaaacgacgucgccacca

SEQ ID NO: 963851 - RNA, 18 nt, Mycobacterium avium subsp. paratuberculosis
agcgcuuucccugcucga

SEQ ID NO: 963852 - RNA, 18 nt, Mycobacterium avium subsp. paratuberculosis
agcgcuuucgcgcacgcc

SEQ ID NO: 963853 - RNA, 23 nt, Mycobacterium avium subsp. paratuberculosis
agcgcuuucgcgcacgccaucgc

SEQ ID NO: 963854 - RNA, 20 nt, Mycobacterium avium subsp. paratuberculosis
agcgcuuugaucagcucgcc

SEQ ID NO: 963855 - RNA, 22 nt, Mycobacterium avium subsp. paratuberculosis
agcgcuuugaucagcucgccga

SEQ ID NO: 963856 - RNA, 15 nt, Mycobacterium avium subsp. paratuberculosis
agcuucuugcugccg

SEQ ID NO: 963857 - RNA, 13 nt, Mycobacterium avium subsp. paratuberculosis
agcuugaccaccc

SEQ ID NO: 963858 - RNA, 14 nt, Mycobacterium avium subsp. paratuberculosis
agcuugacgucggu

SEQ ID NO: 963859 - RNA, 13 nt, Mycobacterium avium subsp. paratuberculosis
agcuucccggcgg

SEQ ID NO: 963860 - RNA, 16 nt, Mycobacterium avium subsp. paratuberculosis
agcuucucggugauca

SEQ ID NO: 963861 - RNA, 18 nt, Mycobacterium avium subsp. paratuberculosis
agcuucgugucaccgccc

SEQ ID NO: 963862 - RNA, 22 nt, Mycobacterium avium subsp. paratuberculosis
agcuucgugucaccgcccacga

SEQ ID NO: 963863 - RNA, 20 nt, Mycobacterium avium subsp. paratuberculosis
agcugguggugaucggccag

SEQ ID NO: 963864 - RNA, 17 nt, Mycobacterium avium subsp. paratuberculosis
agcuggugggccaucgc

SEQ ID NO: 963865 - RNA, 18 nt, Mycobacterium avium subsp. paratuberculosis
agcuggugggccaucgcc

SEQ ID NO: 963866 - RNA, 14 nt, Mycobacterium avium subsp. paratuberculosis
agcugucggguggc

SEQ ID NO: 963867 - RNA, 12 nt, Mycobacterium avium subsp. paratuberculosis
agcuucaccggu

SEQ ID NO: 963868 - RNA, 14 nt, Mycobacterium avium subsp. paratuberculosis
agcuucacgcucgg

SEQ ID NO: 963869 - RNA, 16 nt, Mycobacterium avium subsp. paratuberculosis
agcuucacguucggcg

SEQ ID NO: 963870 - RNA, 19 nt, Mycobacterium avium subsp. paratuberculosis
agcugugccgcggugcggc

SEQ ID NO: 963871 - RNA, 15 nt, Mycobacterium avium subsp. paratuberculosis
agcuggugcgcagcc

SEQ ID NO: 963872 - RNA, 17 nt, Mycobacterium avium subsp. paratuberculosis
agcuggugcgcagcccg

SEQ ID NO: 963873 - RNA, 22 nt, Mycobacterium avium subsp. paratuberculosis
agcuggugaagcugccgaccag

SEQ ID NO: 963874 - RNA, 21 nt, Mycobacterium avium subsp. paratuberculosis
agcuggguggucaccagcgcg

SEQ ID NO: 963875 - RNA, 23 nt, Mycobacterium avium subsp. paratuberculosis
agcuggguggucaccagcgcggu

SEQ ID NO: 963876 - RNA, 18 nt, Mycobacterium avium subsp. paratuberculosis
agcugguagaugguggcc

SEQ ID NO: 963877 - RNA, 15 nt, Mycobacterium avium subsp. paratuberculosis
agcugggccagcgcg

SEQ ID NO: 963878 - RNA, 14 nt, Mycobacterium avium subsp. paratuberculosis
agcugggcggcgcg

SEQ ID NO: 963879 - RNA, 17 nt, Mycobacterium avium subsp. paratuberculosis
agcugggcggcgcgcug

SEQ ID NO: 963880 - RNA, 20 nt, Mycobacterium avium subsp. paratuberculosis
agcugggcguacugcucggc

SEQ ID NO: 963881 - RNA, 18 nt, Mycobacterium avium subsp. paratuberculosis
agcugggacagcgucacc

SEQ ID NO: 963882 - RNA, 23 nt, Mycobacterium avium subsp. paratuberculosis
agcuggcggucgcugaccccgcu

SEQ ID NO: 963883 - RNA, 18 nt, Mycobacterium avium subsp. paratuberculosis
agcugcgggaccagcgcc

SEQ ID NO: 963884 - RNA, 16 nt, Mycobacterium avium subsp. paratuberculosis
agcugcggaucgggcg

SEQ ID NO: 963885 - RNA, 16 nt, Mycobacterium avium subsp. paratuberculosis
agcugcggguugcggg

SEQ ID NO: 963886 - RNA, 13 nt, Mycobacterium avium subsp. paratuberculosis
agcuggcgccgaa

SEQ ID NO: 963887 - RNA, 23 nt, Mycobacterium avium subsp. paratuberculosis
agcugcgcgggcgcggccagcgc

SEQ ID NO: 963888 - RNA, 14 nt, Mycobacterium avium subsp. paratuberculosis
agcugcgcgucgaa

SEQ ID NO: 963889 - RNA, 15 nt, Mycobacterium avium subsp. paratuberculosis
agcugcgcgccggcg

SEQ ID NO: 963890 - RNA, 17 nt, Mycobacterium avium subsp. paratuberculosis
agcugcgcgccggcggc

SEQ ID NO: 963891 - RNA, 19 nt, Mycobacterium avium subsp. paratuberculosis
agcugcgcgccggcggccg

SEQ ID NO: 963892 - RNA, 24 nt, Mycobacterium avium subsp. paratuberculosis
aggaauccgguccacucgucggcg

SEQ ID NO: 963893 - RNA, 13 nt, Mycobacterium avium subsp. paratuberculosis
aggaaucgcggca

SEQ ID NO: 963894 - RNA, 13 nt, Mycobacterium avium subsp. paratuberculosis
aggaaguccggcg

SEQ ID NO: 963895 - RNA, 15 nt, Mycobacterium avium subsp. paratuberculosis
aggaaguccggcgcg

SEQ ID NO: 963896 - RNA, 16 nt, Mycobacterium avium subsp. paratuberculosis
aggaaguccggcgcgc

SEQ ID NO: 963897 - RNA, 14 nt, Mycobacterium avium subsp. paratuberculosis
aggaauucgccgac

SEQ ID NO: 963898 - RNA, 21 nt, Mycobacterium avium subsp. paratuberculosis
aggaauuugcggcccggcucg

SEQ ID NO: 963899 - RNA, 17 nt, Mycobacterium avium subsp. paratuberculosis
aggacaccacgaucagc

SEQ ID NO: 963900 - RNA, 14 nt, Mycobacterium avium subsp. paratuberculosis
aggacagcaccaca

SEQ ID NO: 963901 - RNA, 13 nt, Mycobacterium avium subsp. paratuberculosis
aggacagcaccgc

SEQ ID NO: 963902 - RNA, 16 nt, Mycobacterium avium subsp. paratuberculosis
aggacagcaccgccau

SEQ ID NO: 963903 - RNA, 23 nt, Mycobacterium avium subsp. paratuberculosis
aggacagcaccgccaucgcggcg

SEQ ID NO: 963904 - RNA, 14 nt, Mycobacterium avium subsp. paratuberculosis
aggacgcccggcga

SEQ ID NO: 963905 - RNA, 14 nt, Mycobacterium avium subsp. paratuberculosis
aggacgaggcccgc

SEQ ID NO: 963906 - RNA, 13 nt, Mycobacterium avium subsp. paratuberculosis
aggacgaggcgag

SEQ ID NO: 963907 - RNA, 14 nt, Mycobacterium avium subsp. paratuberculosis
aggacgaggcgggu

SEQ ID NO: 963908 - RNA, 21 nt, Mycobacterium avium subsp. paratuberculosis
aggaccuugucgggccgcggg

SEQ ID NO: 963909 - RNA, 17 nt, Mycobacterium avium subsp. paratuberculosis
aggacgaaaaccaggaa

SEQ ID NO: 963910 - RNA, 13 nt, Mycobacterium avium subsp. paratuberculosis
aggaccggcgccg

SEQ ID NO: 963911 - RNA, 17 nt, Mycobacterium avium subsp. paratuberculosis
aggaccggcgccggccg

SEQ ID NO: 963912 - RNA, 16 nt, Mycobacterium avium subsp. paratuberculosis
aggaccagcgggucga

SEQ ID NO: 963913 - RNA, 22 nt, Mycobacterium avium subsp. paratuberculosis
aggaccggaugaaggacuggcc

SEQ ID NO: 963914 - RNA, 14 nt, Mycobacterium avium subsp. paratuberculosis
aggacagcgcggug

SEQ ID NO: 963915 - RNA, 14 nt, Mycobacterium avium subsp. paratuberculosis
aggacagcgucagc

SEQ ID NO: 963916 - RNA, 14 nt, Mycobacterium avium subsp. paratuberculosis
aggacagcugacga

SEQ ID NO: 963917 - RNA, 19 nt, Mycobacterium avium subsp. paratuberculosis
aggacaggaacgggccggc

SEQ ID NO: 963918 - RNA, 14 nt, Mycobacterium avium subsp. paratuberculosis
aggaccacccacuc

SEQ ID NO: 963919 - RNA, 13 nt, Mycobacterium avium subsp. paratuberculosis
aggacaggucgcg

SEQ ID NO: 963920 - RNA, 20 nt, Mycobacterium avium subsp. paratuberculosis
aggacaggucgcgguagcgc

SEQ ID NO: 963921 - RNA, 21 nt, Mycobacterium avium subsp. paratuberculosis
aggacccggugcccaccgucu

SEQ ID NO: 963922 - RNA, 21 nt, Mycobacterium avium subsp. paratuberculosis
aggacccguacuucucgaaga

SEQ ID NO: 963923 - RNA, 15 nt, Mycobacterium avium subsp. paratuberculosis
aggaccgagccgcgc

SEQ ID NO: 963924 - RNA, 16 nt, Mycobacterium avium subsp. paratuberculosis
aggaccgagccgcgcg

SEQ ID NO: 963925 - RNA, 21 nt, Mycobacterium avium subsp. paratuberculosis
aggaccgagccgcgcgccgag

SEQ ID NO: 963926 - RNA, 17 nt, Mycobacterium avium subsp. paratuberculosis
aggaagaacccggcgug

SEQ ID NO: 963927 - RNA, 18 nt, Mycobacterium avium subsp. paratuberculosis
aggaacuggucgaacagc

SEQ ID NO: 963928 - RNA, 20 nt, Mycobacterium avium subsp. paratuberculosis
aggaacgcggacagcucgcc

SEQ ID NO: 963929 - RNA, 22 nt, Mycobacterium avium subsp. paratuberculosis
aggaagcgaauccgggugucga

SEQ ID NO: 963930 - RNA, 14 nt, Mycobacterium avium subsp. paratuberculosis
aggaaggagguggu

SEQ ID NO: 963931 - RNA, 17 nt, Mycobacterium avium subsp. paratuberculosis
aggaaguacaccaccgc

SEQ ID NO: 963932 - RNA, 21 nt, Mycobacterium avium subsp. paratuberculosis
aggaaguacaccaccgcggcg

SEQ ID NO: 963933 - RNA, 14 nt, Mycobacterium avium subsp. paratuberculosis
aggaacacggcucg

SEQ ID NO: 963934 - RNA, 13 nt, Mycobacterium avium subsp. paratuberculosis
aggaacaaccgca

SEQ ID NO: 963935 - RNA, 18 nt, Mycobacterium avium subsp. paratuberculosis
aggaaccggcagccggcg

SEQ ID NO: 963936 - RNA, 20 nt, Mycobacterium avium subsp. paratuberculosis
aggaaccggcagccggcgua

SEQ ID NO: 963937 - RNA, 21 nt, Mycobacterium avium subsp. paratuberculosis
aggaguuuuucgggguggugg

SEQ ID NO: 963938 - RNA, 13 nt, Mycobacterium avium subsp. paratuberculosis
aggagguggucga

SEQ ID NO: 963939 - RNA, 22 nt, Mycobacterium avium subsp. paratuberculosis
aggagucgggcaaucggaccca

SEQ ID NO: 963940 - RNA, 12 nt, Mycobacterium avium subsp. paratuberculosis
aggaucaccggg

SEQ ID NO: 963941 - RNA, 14 nt, Mycobacterium avium subsp. paratuberculosis
aggaucaccgggac

SEQ ID NO: 963942 - RNA, 20 nt, Mycobacterium avium subsp. paratuberculosis
aggaucaacucgucgggggu

SEQ ID NO: 963943 - RNA, 23 nt, Mycobacterium avium subsp. paratuberculosis
aggauccgaugacgcugccgcgc

SEQ ID NO: 963944 - RNA, 16 nt, Mycobacterium avium subsp. paratuberculosis
aggaugaccgcggcga

SEQ ID NO: 963945 - RNA, 20 nt, Mycobacterium avium subsp. paratuberculosis
aggaugaccgcgucggcgcc

SEQ ID NO: 963946 - RNA, 16 nt, Mycobacterium avium subsp. paratuberculosis
aggaucugggcggcgg

SEQ ID NO: 963947 - RNA, 16 nt, Mycobacterium avium subsp. paratuberculosis
aggaucuggugcgcgc

SEQ ID NO: 963948 - RNA, 22 nt, Mycobacterium avium subsp. paratuberculosis
aggaucuucggcuuucucgcca

SEQ ID NO: 963949 - RNA, 18 nt, Mycobacterium avium subsp. paratuberculosis
aggaucucccggguggcc

SEQ ID NO: 963950 - RNA, 13 nt, Mycobacterium avium subsp. paratuberculosis
aggaucucgcggg

SEQ ID NO: 963951 - RNA, 15 nt, Mycobacterium avium subsp. paratuberculosis
aggaucucgcgggcc

SEQ ID NO: 963952 - RNA, 17 nt, Mycobacterium avium subsp. paratuberculosis
aggaucucgcgggcccg

SEQ ID NO: 963953 - RNA, 20 nt, Mycobacterium avium subsp. paratuberculosis
aggaucucgcgggcccgcgc

SEQ ID NO: 963954 - RNA, 23 nt, Mycobacterium avium subsp. paratuberculosis
aggaucucgcgggcccgcgcggc

SEQ ID NO: 963955 - RNA, 21 nt, Mycobacterium avium subsp. paratuberculosis
aggaucugcacgucggcggcc

SEQ ID NO: 963956 - RNA, 13 nt, Mycobacterium avium subsp. paratuberculosis
aggaucgacgucg

SEQ ID NO: 963957 - RNA, 22 nt, Mycobacterium avium subsp. paratuberculosis
aggaucgccugauacgacgucc

SEQ ID NO: 963958 - RNA, 19 nt, Mycobacterium avium subsp. paratuberculosis
aggaugagcugggcggcgc

SEQ ID NO: 963959 - RNA, 16 nt, Mycobacterium avium subsp. paratuberculosis
aggaugccgcccacca

SEQ ID NO: 963960 - RNA, 18 nt, Mycobacterium avium subsp. paratuberculosis
aggaugccgcccaccacc

SEQ ID NO: 963961 - RNA, 22 nt, Mycobacterium avium subsp. paratuberculosis
aggauggggucgcgggcgccga

SEQ ID NO: 963962 - RNA, 12 nt, Mycobacterium avium subsp. paratuberculosis
aaacggcggcgg

SEQ ID NO: 963963 - RNA, 22 nt, Mycobacterium avium subsp. paratuberculosis
aggaggacaagucaugccgcgc

SEQ ID NO: 963964 - RNA, 16 nt, Mycobacterium avium subsp. paratuberculosis
aggaggccgcggcgac

SEQ ID NO: 963965 - RNA, 16 nt, Mycobacterium avium subsp. paratuberculosis
aggacgggcgugacag

SEQ ID NO: 963966 - RNA, 15 nt, Mycobacterium avium subsp. paratuberculosis
aggagaaggccgcgc

SEQ ID NO: 963967 - RNA, 15 nt, Mycobacterium avium subsp. paratuberculosis
aggagacgucggccg

SEQ ID NO: 963968 - RNA, 18 nt, Mycobacterium avium subsp. paratuberculosis
aggacguugaggcggcgg

SEQ ID NO: 963969 - RNA, 20 nt, Mycobacterium avium subsp. paratuberculosis
aggacguugaggcggcggcg

SEQ ID NO: 963970 - RNA, 18 nt, Mycobacterium avium subsp. paratuberculosis
aggacucaaucggucagg

SEQ ID NO: 963971 - RNA, 19 nt, Mycobacterium avium subsp. paratuberculosis
aggacuccaguugacggcg

SEQ ID NO: 963972 - RNA, 20 nt, Mycobacterium avium subsp. paratuberculosis
aggacgucggccggcugcag

SEQ ID NO: 963973 - RNA, 16 nt, Mycobacterium avium subsp. paratuberculosis
aggacgucgucgacgu

SEQ ID NO: 963974 - RNA, 17 nt, Mycobacterium avium subsp. paratuberculosis
aggacgcgggccugggc

SEQ ID NO: 963975 - RNA, 23 nt, Mycobacterium avium subsp. paratuberculosis
aggacgguuucugccggccgccg

SEQ ID NO: 963976 - RNA, 23 nt, Mycobacterium avium subsp. paratuberculosis
aggauucccgaccccgccagcac

SEQ ID NO: 963977 - RNA, 17 nt, Mycobacterium avium subsp. paratuberculosis
aggauuccgucggcggc

SEQ ID NO: 963978 - RNA, 19 nt, Mycobacterium avium subsp. paratuberculosis
aggaugguggugcaggcga

SEQ ID NO: 963979 - RNA, 13 nt, Mycobacterium avium subsp. paratuberculosis
aggaugucgacga

SEQ ID NO: 963980 - RNA, 18 nt, Mycobacterium avium subsp. paratuberculosis
aggcaaucaggcggucga

SEQ ID NO: 963981 - RNA, 23 nt, Mycobacterium avium subsp. paratuberculosis
aggcacccaggaaaaccagcgac

SEQ ID NO: 963982 - RNA, 13 nt, Mycobacterium avium subsp. paratuberculosis
aggcacggcccgu

SEQ ID NO: 963983 - RNA, 17 nt, Mycobacterium avium subsp. paratuberculosis
aggcaccgaacgccagc

SEQ ID NO: 963984 - RNA, 21 nt, Mycobacterium avium subsp. paratuberculosis
aggcaccgaacgccagcagcu

SEQ ID NO: 963985 - RNA, 13 nt, Mycobacterium avium subsp. paratuberculosis
aggccaacgagcg

SEQ ID NO: 963986 - RNA, 19 nt, Mycobacterium avium subsp. paratuberculosis
aggccaacgagcgcgccga

SEQ ID NO: 963987 - RNA, 20 nt, Mycobacterium avium subsp. paratuberculosis
aggcauuuccagguccggga

SEQ ID NO: 963988 - RNA, 19 nt, Mycobacterium avium subsp. paratuberculosis
aggccacaugggccacggc

SEQ ID NO: 963989 - RNA, 20 nt, Mycobacterium avium subsp. paratuberculosis
aggccacaugggccacggcg

SEQ ID NO: 963990 - RNA, 15 nt, Mycobacterium avium subsp. paratuberculosis
aggcacucgcccagg

SEQ ID NO: 963991 - RNA, 20 nt, Mycobacterium avium subsp. paratuberculosis
aggccacccgggcgccggcg

SEQ ID NO: 963992 - RNA, 19 nt, Mycobacterium avium subsp. paratuberculosis
aggccaggugcacgccgag

SEQ ID NO: 963993 - RNA, 21 nt, Mycobacterium avium subsp. paratuberculosis
aggccaggugcacgccgagca

SEQ ID NO: 963994 - RNA, 21 nt, Mycobacterium avium subsp. paratuberculosis
aggccagcuccucggggauga

SEQ ID NO: 963995 - RNA, 23 nt, Mycobacterium avium subsp. paratuberculosis
aggccagcugcaccggggccggc

SEQ ID NO: 963996 - RNA, 23 nt, Mycobacterium avium subsp. paratuberculosis
aggccaggaccgggacgacggcg

SEQ ID NO: 963997 - RNA, 11 nt, Mycobacterium avium subsp. paratuberculosis
aggcccaccgu

SEQ ID NO: 963998 - RNA, 17 nt, Mycobacterium avium subsp. paratuberculosis
aggccauggcgcaccgc

SEQ ID NO: 963999 - RNA, 21 nt, Mycobacterium avium subsp. paratuberculosis
aggccauggcgcaccgcggcc

SEQ ID NO: 964000 - RNA, 13 nt, Mycobacterium avium subsp. paratuberculosis
aggcccucgccgc

SEQ ID NO: 964001 - RNA, 13 nt, Mycobacterium avium subsp. paratuberculosis
aggcccucggcca

SEQ ID NO: 964002 - RNA, 23 nt, Mycobacterium avium subsp. paratuberculosis
aggcccucggccagccaggccgu

SEQ ID NO: 964003 - RNA, 17 nt, Mycobacterium avium subsp. paratuberculosis
aggccgaacagcagcga

SEQ ID NO: 964004 - RNA, 23 nt, Mycobacterium avium subsp. paratuberculosis
aggccgaagaacgacuggcggcg

SEQ ID NO: 964005 - RNA, 19 nt, Mycobacterium avium subsp. paratuberculosis
aggcccugcugcagcgcga

SEQ ID NO: 964006 - RNA, 15 nt, Mycobacterium avium subsp. paratuberculosis
aggcccugccagcgc

SEQ ID NO: 964007 - RNA, 21 nt, Mycobacterium avium subsp. paratuberculosis
agcagcgugcugacgucgucg

SEQ ID NO: 964008 - RNA, 17 nt, Mycobacterium avium subsp. paratuberculosis
agcagcguuccgucggc

SEQ ID NO: 964009 - RNA, 20 nt, Mycobacterium avium subsp. paratuberculosis
agcagcguuccgucggcgag

SEQ ID NO: 964010 - RNA, 15 nt, Mycobacterium avium subsp. paratuberculosis
agcagcucagccgcc

SEQ ID NO: 964011 - RNA, 16 nt, Mycobacterium avium subsp. paratuberculosis
agcagcucauacagcg

SEQ ID NO: 964012 - RNA, 20 nt, Mycobacterium avium subsp. paratuberculosis
agcagcucauacagcggcgc

SEQ ID NO: 964013 - RNA, 21 nt, Mycobacterium avium subsp. paratuberculosis
agcagcucauacagcggcgcg

SEQ ID NO: 964014 - RNA, 24 nt, Mycobacterium avium subsp. paratuberculosis
agcagcucgcguagcgagguguga

SEQ ID NO: 964015 - RNA, 15 nt, Mycobacterium avium subsp. paratuberculosis
agcagcugcacccgc

SEQ ID NO: 964016 - RNA, 16 nt, Mycobacterium avium subsp. paratuberculosis
agcagcugcagcgucg

SEQ ID NO: 964017 - RNA, 18 nt, Mycobacterium avium subsp. paratuberculosis
agcagcugcccgagcggc

SEQ ID NO: 964018 - RNA, 17 nt, Mycobacterium avium subsp. paratuberculosis
agcagcuccggucggcg

SEQ ID NO: 964019 - RNA, 21 nt, Mycobacterium avium subsp. paratuberculosis
agcagcuccggucggcgcucg

SEQ ID NO: 964020 - RNA, 13 nt, Mycobacterium avium subsp. paratuberculosis
agcagcucggcgg

SEQ ID NO: 964021 - RNA, 14 nt, Mycobacterium avium subsp. paratuberculosis
agcagcucggcggc

SEQ ID NO: 964022 - RNA, 15 nt, Mycobacterium avium subsp. paratuberculosis
agcagcucggcggcc

SEQ ID NO: 964023 - RNA, 16 nt, Mycobacterium avium subsp. paratuberculosis
agcagcucggcggccu

SEQ ID NO: 964024 - RNA, 21 nt, Mycobacterium avium subsp. paratuberculosis
agcagcucggucaccagcggc

SEQ ID NO: 964025 - RNA, 22 nt, Mycobacterium avium subsp. paratuberculosis
agcagcucggucaccagcggcc

SEQ ID NO: 964026 - RNA, 20 nt, Mycobacterium avium subsp. paratuberculosis
agcagcucgguggcgucggc

SEQ ID NO: 964027 - RNA, 15 nt, Mycobacterium avium subsp. paratuberculosis
agauugguucggccg

SEQ ID NO: 964028 - RNA, 16 nt, Mycobacterium avium subsp. paratuberculosis
agcaguucguccacgc

SEQ ID NO: 964029 - RNA, 16 nt, Mycobacterium avium subsp. paratuberculosis
agcagggucagcgaca

SEQ ID NO: 964030 - RNA, 13 nt, Mycobacterium avium subsp. paratuberculosis
agcagggugccgc

SEQ ID NO: 964031 - RNA, 12 nt, Mycobacterium avium subsp. paratuberculosis
agcagggcgccg

SEQ ID NO: 964032 - RNA, 15 nt, Mycobacterium avium subsp. paratuberculosis
agcagggcgccgacg

SEQ ID NO: 964033 - RNA, 15 nt, Mycobacterium avium subsp. paratuberculosis
agcagggcaccgacg

SEQ ID NO: 964034 - RNA, 22 nt, Mycobacterium avium subsp. paratuberculosis
agcagggcaccgacggccgcac

SEQ ID NO: 964035 - RNA, 13 nt, Mycobacterium avium subsp. paratuberculosis
agcagggccucgc

SEQ ID NO: 964036 - RNA, 16 nt, Mycobacterium avium subsp. paratuberculosis
agcagggccucgccgu

SEQ ID NO: 964037 - RNA, 23 nt, Mycobacterium avium subsp. paratuberculosis
agcagcuggaaauaggccgggca

SEQ ID NO: 964038 - RNA, 14 nt, Mycobacterium avium subsp. paratuberculosis
agcaggcgcgcagc

SEQ ID NO: 964039 - RNA, 20 nt, Mycobacterium avium subsp. paratuberculosis
agcagcuguugcggcgucag

SEQ ID NO: 964040 - RNA, 13 nt, Mycobacterium avium subsp. paratuberculosis
agcaggcgccggu

SEQ ID NO: 964041 - RNA, 16 nt, Mycobacterium avium subsp. paratuberculosis
agcaggcgccgcagca

SEQ ID NO: 964042 - RNA, 15 nt, Mycobacterium avium subsp. paratuberculosis
agcaggcgcgcagca

SEQ ID NO: 964043 - RNA, 15 nt, Mycobacterium avium subsp. paratuberculosis
agcaggcgcgccgag

SEQ ID NO: 964044 - RNA, 16 nt, Mycobacterium avium subsp. paratuberculosis
agcaggcggacggcga

SEQ ID NO: 964045 - RNA, 18 nt, Mycobacterium avium subsp. paratuberculosis
agcaggcggacggcgacc

SEQ ID NO: 964046 - RNA, 19 nt, Mycobacterium avium subsp. paratuberculosis
agcaggcgguggugggguc

SEQ ID NO: 964047 - RNA, 21 nt, Mycobacterium avium subsp. paratuberculosis
agcagggcaucucccgcgcgc

SEQ ID NO: 964048 - RNA, 15 nt, Mycobacterium avium subsp. paratuberculosis
agcaggcuggcggcg

SEQ ID NO: 964049 - RNA, 16 nt, Mycobacterium avium subsp. paratuberculosis
agcaggcuggcggcga

SEQ ID NO: 964050 - RNA, 19 nt, Mycobacterium avium subsp. paratuberculosis
agcaggcuggcggcgauca

SEQ ID NO: 964051 - RNA, 19 nt, Mycobacterium avium subsp. paratuberculosis
agccaaagccuacggcgcc

SEQ ID NO: 964052 - RNA, 20 nt, Mycobacterium avium subsp. paratuberculosis
agccaaagccuacggcgccg

SEQ ID NO: 964053 - RNA, 22 nt, Mycobacterium avium subsp. paratuberculosis
agccaaagccuacggcgccggu

SEQ ID NO: 964054 - RNA, 13 nt, Mycobacterium avium subsp. paratuberculosis
agcauuucgcgcg

SEQ ID NO: 964055 - RNA, 20 nt, Mycobacterium avium subsp. paratuberculosis
agcauggcgaucaccccggc

SEQ ID NO: 964056 - RNA, 21 nt, Mycobacterium avium subsp. paratuberculosis
agcauggcgaugacgucgucg

SEQ ID NO: 964057 - RNA, 20 nt, Mycobacterium avium subsp. paratuberculosis
agcaugccgagcaccuccga

SEQ ID NO: 964058 - RNA, 12 nt, Mycobacterium avium subsp. paratuberculosis
agcaugcgggug

SEQ ID NO: 964059 - RNA, 16 nt, Mycobacterium avium subsp. paratuberculosis
agcaugaucaccgcca

SEQ ID NO: 964060 - RNA, 20 nt, Mycobacterium avium subsp. paratuberculosis
agcaugaucaccgccagcgc

SEQ ID NO: 964061 - RNA, 23 nt, Mycobacterium avium subsp. paratuberculosis
agcaugaucaccgccagcgcgcc

SEQ ID NO: 964062 - RNA, 21 nt, Mycobacterium avium subsp. paratuberculosis
agccaguugggggccagcgcc

SEQ ID NO: 964063 - RNA, 15 nt, Mycobacterium avium subsp. paratuberculosis
agccauaaaccggcc

SEQ ID NO: 964064 - RNA, 16 nt, Mycobacterium avium subsp. paratuberculosis
agccauaaaccggccg

SEQ ID NO: 964065 - RNA, 21 nt, Mycobacterium avium subsp. paratuberculosis
agccauaaaccggccggcgcg

SEQ ID NO: 964066 - RNA, 14 nt, Mycobacterium avium subsp. paratuberculosis
agccaguucgccag

SEQ ID NO: 964067 - RNA, 21 nt, Mycobacterium avium subsp. paratuberculosis
agccaguucgccagcaugcga

SEQ ID NO: 964068 - RNA, 13 nt, Mycobacterium avium subsp. paratuberculosis
agccagucgccgg

SEQ ID NO: 964069 - RNA, 17 nt, Mycobacterium avium subsp. paratuberculosis
agccagucgccggccag

SEQ ID NO: 964070 - RNA, 20 nt, Mycobacterium avium subsp. paratuberculosis
agccagucgccggccaggcc

SEQ ID NO: 964071 - RNA, 16 nt, Mycobacterium avium subsp. paratuberculosis
agccagcgcccggcga

SEQ ID NO: 964072 - RNA, 16 nt, Mycobacterium avium subsp. paratuberculosis
agccaguccgccgccg

SEQ ID NO: 964073 - RNA, 15 nt, Mycobacterium avium subsp. paratuberculosis
agccagcugcgcguc

SEQ ID NO: 964074 - RNA, 21 nt, Mycobacterium avium subsp. paratuberculosis
agccagcuggugaagcugccg

SEQ ID NO: 964075 - RNA, 19 nt, Mycobacterium avium subsp. paratuberculosis
agccacgacaccagcgucg

SEQ ID NO: 964076 - RNA, 15 nt, Mycobacterium avium subsp. paratuberculosis
agccacgccgacacc

SEQ ID NO: 964077 - RNA, 19 nt, Mycobacterium avium subsp. paratuberculosis
agccacgccgacaccgucg

SEQ ID NO: 964078 - RNA, 21 nt, Mycobacterium avium subsp. paratuberculosis
agccacggcagcugcagcgga

SEQ ID NO: 964079 - RNA, 22 nt, Mycobacterium avium subsp. paratuberculosis
agccacuccaccaccggccgcg

SEQ ID NO: 964080 - RNA, 13 nt, Mycobacterium avium subsp. paratuberculosis
agccagcccagcc

SEQ ID NO: 964081 - RNA, 15 nt, Mycobacterium avium subsp. paratuberculosis
agccagccgcgccgc

SEQ ID NO: 964082 - RNA, 15 nt, Mycobacterium avium subsp. paratuberculosis
agccagccgguggcg

SEQ ID NO: 964083 - RNA, 21 nt, Mycobacterium avium subsp. paratuberculosis
agccagccgguggcggccacg

SEQ ID NO: 964084 - RNA, 17 nt, Mycobacterium avium subsp. paratuberculosis
agccagcccguggccag

SEQ ID NO: 964085 - RNA, 20 nt, Mycobacterium avium subsp. paratuberculosis
agccagcccguggccagcgc

SEQ ID NO: 964086 - RNA, 15 nt, Mycobacterium avium subsp. paratuberculosis
agccagccgcccagc

SEQ ID NO: 964087 - RNA, 18 nt, Mycobacterium avium subsp. paratuberculosis
agccaugggucucggcga

SEQ ID NO: 964088 - RNA, 16 nt, Mycobacterium avium subsp. paratuberculosis
agccauuucagcagcg

SEQ ID NO: 964089 - RNA, 20 nt, Mycobacterium avium subsp. paratuberculosis
agccaugccgggggaggcgu

SEQ ID NO: 964090 - RNA, 14 nt, Mycobacterium avium subsp. paratuberculosis
agccauggcggccc

SEQ ID NO: 964091 - RNA, 15 nt, Mycobacterium avium subsp. paratuberculosis
agccauggcggcccg

SEQ ID NO: 964092 - RNA, 16 nt, Mycobacterium avium subsp. paratuberculosis
agccauggcggcccgc

SEQ ID NO: 964093 - RNA, 18 nt, Mycobacterium avium subsp. paratuberculosis
agccauggcggcccgcgc

SEQ ID NO: 964094 - RNA, 22 nt, Mycobacterium avium subsp. paratuberculosis
agccauggcggcccgcgccggc

SEQ ID NO: 964095 - RNA, 19 nt, Mycobacterium avium subsp. paratuberculosis
agccaucagaacgcccgca

SEQ ID NO: 964096 - RNA, 18 nt, Mycobacterium avium subsp. paratuberculosis
agcccccacgcucggcgc

SEQ ID NO: 964097 - RNA, 22 nt, Mycobacterium avium subsp. paratuberculosis
agcccccaccugaucgcggcga

SEQ ID NO: 964098 - RNA, 12 nt, Mycobacterium avium subsp. paratuberculosis
agcccccagcuc

SEQ ID NO: 964099 - RNA, 21 nt, Mycobacterium avium subsp. paratuberculosis
agccccagggugcgccgcucg

SEQ ID NO: 964100 - RNA, 12 nt, Mycobacterium avium subsp. paratuberculosis
agccccagcgga

SEQ ID NO: 964101 - RNA, 22 nt, Mycobacterium avium subsp. paratuberculosis
agcccgaccgucgucccgguga

SEQ ID NO: 964102 - RNA, 20 nt, Mycobacterium avium subsp. paratuberculosis
agcccgacggcagcaccgcc

SEQ ID NO: 964103 - RNA, 22 nt, Mycobacterium avium subsp. paratuberculosis
agcccgacggcagcaccgccga

SEQ ID NO: 964104 - RNA, 20 nt, Mycobacterium avium subsp. paratuberculosis
agcccgacgggcgugccggc

SEQ ID NO: 964105 - RNA, 14 nt, Mycobacterium avium subsp. paratuberculosis
agcccgagcgucac

SEQ ID NO: 964106 - RNA, 22 nt, Mycobacterium avium subsp. paratuberculosis
agcccgagcgucacgccagcgu

SEQ ID NO: 964107 - RNA, 21 nt, Mycobacterium avium subsp. paratuberculosis
agcccccgcgggucgucgacg

SEQ ID NO: 964108 - RNA, 12 nt, Mycobacterium avium subsp. paratuberculosis
agcccccggacc

SEQ ID NO: 964109 - RNA, 21 nt, Mycobacterium avium subsp. paratuberculosis
agccccgcgacacgccgcgca

SEQ ID NO: 964110 - RNA, 20 nt, Mycobacterium avium subsp. paratuberculosis
agcccgacaucugccgggcg

SEQ ID NO: 964111 - RNA, 16 nt, Mycobacterium avium subsp. paratuberculosis
agcccugcucggccag

SEQ ID NO: 964112 - RNA, 14 nt, Mycobacterium avium subsp. paratuberculosis
agcccugcucggug

SEQ ID NO: 964113 - RNA, 19 nt, Mycobacterium avium subsp. paratuberculosis
agcccugcucggugaugcc

SEQ ID NO: 964114 - RNA, 17 nt, Mycobacterium avium subsp. paratuberculosis
agcccugcagguaggug

SEQ ID NO: 964115 - RNA, 19 nt, Mycobacterium avium subsp. paratuberculosis
agcccugcagguagguggc

SEQ ID NO: 964116 - RNA, 16 nt, Mycobacterium avium subsp. paratuberculosis
agcccugcuugaccgc

SEQ ID NO: 964117 - RNA, 15 nt, Mycobacterium avium subsp. paratuberculosis
agcccucgucgauga

SEQ ID NO: 964118 - RNA, 15 nt, Mycobacterium avium subsp. paratuberculosis
agcccucuucgauca

SEQ ID NO: 964119 - RNA, 19 nt, Mycobacterium avium subsp. paratuberculosis
agcccucuucgaucaggcg

SEQ ID NO: 964120 - RNA, 20 nt, Mycobacterium avium subsp. paratuberculosis
agcccuaccggcucggcccg

SEQ ID NO: 964121 - RNA, 16 nt, Mycobacterium avium subsp. paratuberculosis
agcccguugucgagca

SEQ ID NO: 964122 - RNA, 23 nt, Mycobacterium avium subsp. paratuberculosis
agcccguugucgagcaccgcgau

SEQ ID NO: 964123 - RNA, 19 nt, Mycobacterium avium subsp. paratuberculosis
agcccguuguggcggccag

SEQ ID NO: 964124 - RNA, 20 nt, Mycobacterium avium subsp. paratuberculosis
agcccguuguggcggccagc

SEQ ID NO: 964125 - RNA, 19 nt, Mycobacterium avium subsp. paratuberculosis
agcccgugccgaugccggc

SEQ ID NO: 964126 - RNA, 21 nt, Mycobacterium avium subsp. paratuberculosis
agcccgugccgaugccggccu

SEQ ID NO: 964127 - RNA, 24 nt, Mycobacterium avium subsp. paratuberculosis
agcccgugccgaugccggccuggc

SEQ ID NO: 964128 - RNA, 13 nt, Mycobacterium avium subsp. paratuberculosis
agcccguggccag

SEQ ID NO: 964129 - RNA, 17 nt, Mycobacterium avium subsp. paratuberculosis
agcccguggccagcgcc

SEQ ID NO: 964130 - RNA, 17 nt, Mycobacterium avium subsp. paratuberculosis
agcccguucagugacca

SEQ ID NO: 964131 - RNA, 19 nt, Mycobacterium avium subsp. paratuberculosis
agcccguucagugaccagu

SEQ ID NO: 964132 - RNA, 21 nt, Mycobacterium avium subsp. paratuberculosis
agcccggaaucgucggccacg

SEQ ID NO: 964133 - RNA, 13 nt, Mycobacterium avium subsp. paratuberculosis
agcccggcccgca

SEQ ID NO: 964134 - RNA, 15 nt, Mycobacterium avium subsp. paratuberculosis
agcccggcccgcauc

SEQ ID NO: 964135 - RNA, 12 nt, Mycobacterium avium subsp. paratuberculosis
agcccggcccgu

SEQ ID NO: 964136 - RNA, 13 nt, Mycobacterium avium subsp. paratuberculosis
agcccggcccguc

SEQ ID NO: 964137 - RNA, 15 nt, Mycobacterium avium subsp. paratuberculosis
agcccggcccgucga

SEQ ID NO: 964138 - RNA, 16 nt, Mycobacterium avium subsp. paratuberculosis
agcccggcccgucgag

SEQ ID NO: 964139 - RNA, 13 nt, Mycobacterium avium subsp. paratuberculosis
agcccgucgacgg

SEQ ID NO: 964140 - RNA, 20 nt, Mycobacterium avium subsp. paratuberculosis
agcccgucgacgggccacca

SEQ ID NO: 964141 - RNA, 23 nt, Mycobacterium avium subsp. paratuberculosis
agcccgucgacgggccaccagcg

SEQ ID NO: 964142 - RNA, 13 nt, Mycobacterium avium subsp. paratuberculosis
agcccgucgacgu

SEQ ID NO: 964143 - RNA, 15 nt, Mycobacterium avium subsp. paratuberculosis
agcccgucgacgucg

SEQ ID NO: 964144 - RNA, 15 nt, Mycobacterium avium subsp. paratuberculosis
agcccggccagcacc

SEQ ID NO: 964145 - RNA, 21 nt, Mycobacterium avium subsp. paratuberculosis
agcccggccagcacccgcucg

SEQ ID NO: 964146 - RNA, 15 nt, Mycobacterium avium subsp. paratuberculosis
agcccggccagcggc

SEQ ID NO: 964147 - RNA, 14 nt, Mycobacterium avium subsp. paratuberculosis
agcccggcccagcc

SEQ ID NO: 964148 - RNA, 17 nt, Mycobacterium avium subsp. paratuberculosis
agcccggcccagccggu

SEQ ID NO: 964149 - RNA, 19 nt, Mycobacterium avium subsp. paratuberculosis
agcccggccccaccgccgc

SEQ ID NO: 964150 - RNA, 15 nt, Mycobacterium avium subsp. paratuberculosis
agcccggaccggccg

SEQ ID NO: 964151 - RNA, 18 nt, Mycobacterium avium subsp. paratuberculosis
agcccggaccggccgugc

SEQ ID NO: 964152 - RNA, 17 nt, Mycobacterium avium subsp. paratuberculosis
agcccggaaaaccccac

SEQ ID NO: 964153 - RNA, 21 nt, Mycobacterium avium subsp. paratuberculosis
agcccgcgucguguccgggcc

SEQ ID NO: 964154 - RNA, 21 nt, Mycobacterium avium subsp. paratuberculosis
agcccgagcggcaucaguucg

SEQ ID NO: 964155 - RNA, 17 nt, Mycobacterium avium subsp. paratuberculosis
agcccgcugaccaggcc

SEQ ID NO: 964156 - RNA, 11 nt, Mycobacterium avium subsp. paratuberculosis
agcccgcagcg

SEQ ID NO: 964157 - RNA, 18 nt, Mycobacterium avium subsp. paratuberculosis
agcccgauucagccggcg

SEQ ID NO: 964158 - RNA, 19 nt, Mycobacterium avium subsp. paratuberculosis
agcccgcaaaucagccgag

SEQ ID NO: 964159 - RNA, 21 nt, Mycobacterium avium subsp. paratuberculosis
agcccgcaaaucagccgagcc

SEQ ID NO: 964160 - RNA, 21 nt, Mycobacterium avium subsp. paratuberculosis
agcccgcgccgagcaaccggg

SEQ ID NO: 964161 - RNA, 22 nt, Mycobacterium avium subsp. paratuberculosis
agcccgcgcgagcgcagcgcca

SEQ ID NO: 964162 - RNA, 17 nt, Mycobacterium avium subsp. paratuberculosis
agcccgcggcagccagc

SEQ ID NO: 964163 - RNA, 17 nt, Mycobacterium avium subsp. paratuberculosis
agcccgcguccagcagc

SEQ ID NO: 964164 - RNA, 18 nt, Mycobacterium avium subsp. paratuberculosis
agcccgcguccagcagca

SEQ ID NO: 964165 - RNA, 19 nt, Mycobacterium avium subsp. paratuberculosis
agcccgaugcuggccaucg

SEQ ID NO: 964166 - RNA, 18 nt, Mycobacterium avium subsp. paratuberculosis
agcccgaucucgcggucg

SEQ ID NO: 964167 - RNA, 16 nt, Mycobacterium avium subsp. paratuberculosis
agcccgaugccgccga

SEQ ID NO: 964168 - RNA, 16 nt, Mycobacterium avium subsp. paratuberculosis
agcccgagcaccagcg

SEQ ID NO: 964169 - RNA, 13 nt, Mycobacterium avium subsp. paratuberculosis
agccgcgccacgc

SEQ ID NO: 964170 - RNA, 22 nt, Mycobacterium avium subsp. paratuberculosis
agccgcgccacgcgcagggcga

SEQ ID NO: 964171 - RNA, 19 nt, Mycobacterium avium subsp. paratuberculosis
agccgcgccgacgcccaca

SEQ ID NO: 964172 - RNA, 11 nt, Mycobacterium avium subsp. paratuberculosis
agccgcgccgc

SEQ ID NO: 964173 - RNA, 16 nt, Mycobacterium avium subsp. paratuberculosis
agccgcgcaccacggu

SEQ ID NO: 964174 - RNA, 13 nt, Mycobacterium avium subsp. paratuberculosis
agccgcgaucggc

SEQ ID NO: 964175 - RNA, 18 nt, Mycobacterium avium subsp. paratuberculosis
agccgcgcgacgccguag

SEQ ID NO: 964176 - RNA, 19 nt, Mycobacterium avium subsp. paratuberculosis
agccgcgcccacccgcgca

SEQ ID NO: 964177 - RNA, 13 nt, Mycobacterium avium subsp. paratuberculosis
agccgcgcgccga

SEQ ID NO: 964178 - RNA, 14 nt, Mycobacterium avium subsp. paratuberculosis
agccgcggauggcc

SEQ ID NO: 964179 - RNA, 13 nt, Mycobacterium avium subsp. paratuberculosis
agccgcggacggc

SEQ ID NO: 964180 - RNA, 17 nt, Mycobacterium avium subsp. paratuberculosis
agccgcggacggccagc

SEQ ID NO: 964181 - RNA, 14 nt, Mycobacterium avium subsp. paratuberculosis
agccgcggacggcg

SEQ ID NO: 964182 - RNA, 13 nt, Mycobacterium avium subsp. paratuberculosis
agccgcgcggcgu

SEQ ID NO: 964183 - RNA, 19 nt, Mycobacterium avium subsp. paratuberculosis
agccgcgcggcgucggccg

SEQ ID NO: 964184 - RNA, 23 nt, Mycobacterium avium subsp. paratuberculosis
agccgcgcggcgucggccgggcu

SEQ ID NO: 964185 - RNA, 17 nt, Mycobacterium avium subsp. paratuberculosis
agccgcgcggccgccuc

SEQ ID NO: 964186 - RNA, 15 nt, Mycobacterium avium subsp. paratuberculosis
agccgcgcggccggc

SEQ ID NO: 964187 - RNA, 17 nt, Mycobacterium avium subsp. paratuberculosis
agccgcgcggccggcca

SEQ ID NO: 964188 - RNA, 19 nt, Mycobacterium avium subsp. paratuberculosis
agccgcgcggccggccacg

SEQ ID NO: 964189 - RNA, 15 nt, Mycobacterium avium subsp. paratuberculosis
agccgcgcgccgaga

SEQ ID NO: 964190 - RNA, 20 nt, Mycobacterium avium subsp. paratuberculosis
agccgcgcgugcagccgggc

SEQ ID NO: 964191 - RNA, 23 nt, Mycobacterium avium subsp. paratuberculosis
agccgcgcgugcagccgggcggc

SEQ ID NO: 964192 - RNA, 12 nt, Mycobacterium avium subsp. paratuberculosis
agccgccgagcc

SEQ ID NO: 964193 - RNA, 13 nt, Mycobacterium avium subsp. paratuberculosis
agccgccgagcgu

SEQ ID NO: 964194 - RNA, 13 nt, Mycobacterium avium subsp. paratuberculosis
agccgcccgauca

SEQ ID NO: 964195 - RNA, 23 nt, Mycobacterium avium subsp. paratuberculosis
agccgcccgaucaucucaccgac

SEQ ID NO: 964196 - RNA, 14 nt, Mycobacterium avium subsp. paratuberculosis
agccgccgccgacc

SEQ ID NO: 964197 - RNA, 12 nt, Mycobacterium avium subsp. paratuberculosis
agccgccgccgg

SEQ ID NO: 964198 - RNA, 14 nt, Mycobacterium avium subsp. paratuberculosis
agccgccgccggcg

SEQ ID NO: 964199 - RNA, 19 nt, Mycobacterium avium subsp. paratuberculosis
agccgccgccggcgucgcc

SEQ ID NO: 964200 - RNA, 18 nt, Mycobacterium avium subsp. paratuberculosis
agccgccgcgccaccgag

SEQ ID NO: 964201 - RNA, 13 nt, Mycobacterium avium subsp. paratuberculosis
agccgccgcggca

SEQ ID NO: 964202 - RNA, 22 nt, Mycobacterium avium subsp. paratuberculosis
agccgccgcgggucggcgacgg

SEQ ID NO: 964203 - RNA, 15 nt, Mycobacterium avium subsp. paratuberculosis
agccgccgcguggcc

SEQ ID NO: 964204 - RNA, 23 nt, Mycobacterium avium subsp. paratuberculosis
agccgcgaacgccucggcgagcc

SEQ ID NO: 964205 - RNA, 20 nt, Mycobacterium avium subsp. paratuberculosis
agccgcgacacgugcaucug

SEQ ID NO: 964206 - RNA, 21 nt, Mycobacterium avium subsp. paratuberculosis
agccgcgacggucaguccggg

SEQ ID NO: 964207 - RNA, 16 nt, Mycobacterium avium subsp. paratuberculosis
agccgaucuccaccga

SEQ ID NO: 964208 - RNA, 17 nt, Mycobacterium avium subsp. paratuberculosis
agccgaucuccaccgag

SEQ ID NO: 964209 - RNA, 15 nt, Mycobacterium avium subsp. paratuberculosis
agccgcagcggcggc

SEQ ID NO: 964210 - RNA, 19 nt, Mycobacterium avium subsp. paratuberculosis
agccgcagcggcggcucgu

SEQ ID NO: 964211 - RNA, 20 nt, Mycobacterium avium subsp. paratuberculosis
agccgcagcggcggcucguc

SEQ ID NO: 964212 - RNA, 23 nt, Mycobacterium avium subsp. paratuberculosis
agccgcagcggcggcucguccag

SEQ ID NO: 964213 - RNA, 15 nt, Mycobacterium avium subsp. paratuberculosis
agccgaucgcggcga

SEQ ID NO: 964214 - RNA, 18 nt, Mycobacterium avium subsp. paratuberculosis
agccgcagcagccgcgcc

SEQ ID NO: 964215 - RNA, 19 nt, Mycobacterium avium subsp. paratuberculosis
agccgcagcagccgcgcca

SEQ ID NO: 964216 - RNA, 14 nt, Mycobacterium avium subsp. paratuberculosis
agccgccagccggu

SEQ ID NO: 964217 - RNA, 15 nt, Mycobacterium avium subsp. paratuberculosis
agccgcaucgcaaga

SEQ ID NO: 964218 - RNA, 15 nt, Mycobacterium avium subsp. paratuberculosis
agccgccacagcgcc

SEQ ID NO: 964219 - RNA, 17 nt, Mycobacterium avium subsp. paratuberculosis
agccgcaggugcucgcc

SEQ ID NO: 964220 - RNA, 23 nt, Mycobacterium avium subsp. paratuberculosis
agccgcauggugcggguguccga

SEQ ID NO: 964221 - RNA, 21 nt, Mycobacterium avium subsp. paratuberculosis
agccgcauguugugcccgacg

SEQ ID NO: 964222 - RNA, 17 nt, Mycobacterium avium subsp. paratuberculosis
agccgcagcgcgcgacc

SEQ ID NO: 964223 - RNA, 16 nt, Mycobacterium avium subsp. paratuberculosis
agcccuucaccucggc

SEQ ID NO: 964224 - RNA, 24 nt, Mycobacterium avium subsp. paratuberculosis
agcccuucgcggugugcggcagcu

SEQ ID NO: 964225 - RNA, 15 nt, Mycobacterium avium subsp. paratuberculosis
agcccuugcagcaca

SEQ ID NO: 964226 - RNA, 17 nt, Mycobacterium avium subsp. paratuberculosis
agcccuuuggcggccag

SEQ ID NO: 964227 - RNA, 15 nt, Mycobacterium avium subsp. paratuberculosis
agccgaaacggugcc

SEQ ID NO: 964228 - RNA, 16 nt, Mycobacterium avium subsp. paratuberculosis
agccgaagaucaccgc

SEQ ID NO: 964229 - RNA, 19 nt, Mycobacterium avium subsp. paratuberculosis
agccgaagaucaccgcguc

SEQ ID NO: 964230 - RNA, 20 nt, Mycobacterium avium subsp. paratuberculosis
agccgaagaucaccgcgucg

SEQ ID NO: 964231 - RNA, 22 nt, Mycobacterium avium subsp. paratuberculosis
agccgaagaucaccgcgucggc

SEQ ID NO: 964232 - RNA, 15 nt, Mycobacterium avium subsp. paratuberculosis
agccgaacgcgcugu

SEQ ID NO: 964233 - RNA, 14 nt, Mycobacterium avium subsp. paratuberculosis
agccgaucaccggc

SEQ ID NO: 964234 - RNA, 15 nt, Mycobacterium avium subsp. paratuberculosis
agccgaucaccggcg

SEQ ID NO: 964235 - RNA, 18 nt, Mycobacterium avium subsp. paratuberculosis
agccgaucaccggcgcgu

SEQ ID NO: 964236 - RNA, 23 nt, Mycobacterium avium subsp. paratuberculosis
agccgaucaccggcgcguuggcc

SEQ ID NO: 964237 - RNA, 22 nt, Mycobacterium avium subsp. paratuberculosis
agccgaggcagaaaugcaggcc

SEQ ID NO: 964238 - RNA, 15 nt, Mycobacterium avium subsp. paratuberculosis
agccgaggcgcucgc

SEQ ID NO: 964239 - RNA, 22 nt, Mycobacterium avium subsp. paratuberculosis
agccgaggucgccgacgccguc

SEQ ID NO: 964240 - RNA, 19 nt, Mycobacterium avium subsp. paratuberculosis
agccgaguuugcggugauc

SEQ ID NO: 964241 - RNA, 18 nt, Mycobacterium avium subsp. paratuberculosis
agccgaguuuggcgucga

SEQ ID NO: 964242 - RNA, 22 nt, Mycobacterium avium subsp. paratuberculosis
agccgaguuuggcgucgaugcg

SEQ ID NO: 964243 - RNA, 21 nt, Mycobacterium avium subsp. paratuberculosis
agccugcggugaugcgcggcg

SEQ ID NO: 964244 - RNA, 19 nt, Mycobacterium avium subsp. paratuberculosis
agccugccuccacgucacc

SEQ ID NO: 964245 - RNA, 12 nt, Mycobacterium avium subsp. paratuberculosis
agcgaacccgcc

SEQ ID NO: 964246 - RNA, 21 nt, Mycobacterium avium subsp. paratuberculosis
agccuuugccgugcucggcgg

SEQ ID NO: 964247 - RNA, 21 nt, Mycobacterium avium subsp. paratuberculosis
agcgaaagacguugaugcgau

SEQ ID NO: 964248 - RNA, 23 nt, Mycobacterium avium subsp. paratuberculosis
agccguugggcagcucggcgggc

SEQ ID NO: 964249 - RNA, 15 nt, Mycobacterium avium subsp. paratuberculosis
agccguuuggcgccg

SEQ ID NO: 964250 - RNA, 16 nt, Mycobacterium avium subsp. paratuberculosis
agccguuuggcgccgc

SEQ ID NO: 964251 - RNA, 17 nt, Mycobacterium avium subsp. paratuberculosis
agccgugacccgccgug

SEQ ID NO: 964252 - RNA, 18 nt, Mycobacterium avium subsp. paratuberculosis
agccgugcacgccgucgu

SEQ ID NO: 964253 - RNA, 14 nt, Mycobacterium avium subsp. paratuberculosis
agccgugcagcgcc

SEQ ID NO: 964254 - RNA, 18 nt, Mycobacterium avium subsp. paratuberculosis
agccgugcaucgggcgcu

SEQ ID NO: 964255 - RNA, 13 nt, Mycobacterium avium subsp. paratuberculosis
agccgugccccag

SEQ ID NO: 964256 - RNA, 12 nt, Mycobacterium avium subsp. paratuberculosis
agccgugcccga

SEQ ID NO: 964257 - RNA, 18 nt, Mycobacterium avium subsp. paratuberculosis
agccucagggcgcgcugu

SEQ ID NO: 964258 - RNA, 20 nt, Mycobacterium avium subsp. paratuberculosis
agccucagggcgcgcugucg

SEQ ID NO: 964259 - RNA, 20 nt, Mycobacterium avium subsp. paratuberculosis
agccgucgaaacggcugcug

SEQ ID NO: 964260 - RNA, 22 nt, Mycobacterium avium subsp. paratuberculosis
agccgucgaaacggcugcugcg

SEQ ID NO: 964261 - RNA, 20 nt, Mycobacterium avium subsp. paratuberculosis
agccgggccgcccgcgcgug

SEQ ID NO: 964262 - RNA, 21 nt, Mycobacterium avium subsp. paratuberculosis
agccgggccggguccacgccg

SEQ ID NO: 964263 - RNA, 15 nt, Mycobacterium avium subsp. paratuberculosis
agccgggccugcagc

SEQ ID NO: 964264 - RNA, 17 nt, Mycobacterium avium subsp. paratuberculosis
agccgucgaugccggcg

SEQ ID NO: 964265 - RNA, 20 nt, Mycobacterium avium subsp. paratuberculosis
agccgucgaugccggcgacg

SEQ ID NO: 964266 - RNA, 17 nt, Mycobacterium avium subsp. paratuberculosis
agccgucgcaucagcuc

SEQ ID NO: 964267 - RNA, 20 nt, Mycobacterium avium subsp. paratuberculosis
agccgucgcaucagcucggc

SEQ ID NO: 964268 - RNA, 13 nt, Mycobacterium avium subsp. paratuberculosis
agccgucgccgcg

SEQ ID NO: 964269 - RNA, 14 nt, Mycobacterium avium subsp. paratuberculosis
agccgucgccgcgc

SEQ ID NO: 964270 - RNA, 16 nt, Mycobacterium avium subsp. paratuberculosis
agccgucgccgcgccc

SEQ ID NO: 964271 - RNA, 17 nt, Mycobacterium avium subsp. paratuberculosis
agccgucgaagaugacc

SEQ ID NO: 964272 - RNA, 14 nt, Mycobacterium avium subsp. paratuberculosis
agccgucggcggag

SEQ ID NO: 964273 - RNA, 13 nt, Mycobacterium avium subsp. paratuberculosis
agccgucggcggc

SEQ ID NO: 964274 - RNA, 14 nt, Mycobacterium avium subsp. paratuberculosis
agccgucggcggcc

SEQ ID NO: 964275 - RNA, 17 nt, Mycobacterium avium subsp. paratuberculosis
agccgucgucgcugcag

SEQ ID NO: 964276 - RNA, 22 nt, Mycobacterium avium subsp. paratuberculosis
agccgucguugcgggcggcgcg

SEQ ID NO: 964277 - RNA, 23 nt, Mycobacterium avium subsp. paratuberculosis
agccgucguugcgggcggcgcgg

SEQ ID NO: 964278 - RNA, 15 nt, Mycobacterium avium subsp. paratuberculosis
agccgggcggccagc

SEQ ID NO: 964279 - RNA, 16 nt, Mycobacterium avium subsp. paratuberculosis
agccgggcggccagcg

SEQ ID NO: 964280 - RNA, 17 nt, Mycobacterium avium subsp. paratuberculosis
agccgggcggccagcgu

SEQ ID NO: 964281 - RNA, 13 nt, Mycobacterium avium subsp. paratuberculosis
agccgggcggccu

SEQ ID NO: 964282 - RNA, 18 nt, Mycobacterium avium subsp. paratuberculosis
agccgggcgcgggcgccg

SEQ ID NO: 964283 - RNA, 21 nt, Mycobacterium avium subsp. paratuberculosis
agccgggcgcgggcgccgucg

SEQ ID NO: 964284 - RNA, 22 nt, Mycobacterium avium subsp. paratuberculosis
agccgggcgcgggcgccgucgg

SEQ ID NO: 964285 - RNA, 15 nt, Mycobacterium avium subsp. paratuberculosis
agccgggcggcagca

SEQ ID NO: 964286 - RNA, 13 nt, Mycobacterium avium subsp. paratuberculosis
agccgggcggcgc

SEQ ID NO: 964287 - RNA, 14 nt, Mycobacterium avium subsp. paratuberculosis
agccgggcggcgcc

SEQ ID NO: 964288 - RNA, 15 nt, Mycobacterium avium subsp. paratuberculosis
agccgggcggcgccg

SEQ ID NO: 964289 - RNA, 16 nt, Mycobacterium avium subsp. paratuberculosis
agccgggcggcgccga

SEQ ID NO: 964290 - RNA, 22 nt, Mycobacterium avium subsp. paratuberculosis
agccgggcggcgccgaaccggg

SEQ ID NO: 964291 - RNA, 17 nt, Mycobacterium avium subsp. paratuberculosis
agccgggcggcggccuc

SEQ ID NO: 964292 - RNA, 17 nt, Mycobacterium avium subsp. paratuberculosis
agccgggcggugauggu

SEQ ID NO: 964293 - RNA, 14 nt, Mycobacterium avium subsp. paratuberculosis
agccgggcccgggu

SEQ ID NO: 964294 - RNA, 14 nt, Mycobacterium avium subsp. paratuberculosis
agccgggccgagcg

SEQ ID NO: 964295 - RNA, 22 nt, Mycobacterium avium subsp. paratuberculosis
agccgggccgagcgcgccgccg

SEQ ID NO: 964296 - RNA, 15 nt, Mycobacterium avium subsp. paratuberculosis
agccgggcagcgcga

SEQ ID NO: 964297 - RNA, 16 nt, Mycobacterium avium subsp. paratuberculosis
agccgggcagcgcgac

SEQ ID NO: 964298 - RNA, 20 nt, Mycobacterium avium subsp. paratuberculosis
agccgggccaauuacgcugc

SEQ ID NO: 964299 - RNA, 21 nt, Mycobacterium avium subsp. paratuberculosis
agccgggccagcaacagcagc

SEQ ID NO: 964300 - RNA, 23 nt, Mycobacterium avium subsp. paratuberculosis
agccgggccagcaacagcagcgg

SEQ ID NO: 964301 - RNA, 15 nt, Mycobacterium avium subsp. paratuberculosis
agccgggccagcagc

SEQ ID NO: 964302 - RNA, 15 nt, Mycobacterium avium subsp. paratuberculosis
agccgggccagcccg

SEQ ID NO: 964303 - RNA, 22 nt, Mycobacterium avium subsp. paratuberculosis
agccgggccaggucccaggcgu

SEQ ID NO: 964304 - RNA, 14 nt, Mycobacterium avium subsp. paratuberculosis
agccggaucaccug

SEQ ID NO: 964305 - RNA, 19 nt, Mycobacterium avium subsp. paratuberculosis
agccggaucaccuggugcu

SEQ ID NO: 964306 - RNA, 20 nt, Mycobacterium avium subsp. paratuberculosis
agccggauguccuacggcgg

SEQ ID NO: 964307 - RNA, 23 nt, Mycobacterium avium subsp. paratuberculosis
agccggagccuugcuggcggccu

SEQ ID NO: 964308 - RNA, 20 nt, Mycobacterium avium subsp. paratuberculosis
agccggcacgcgcgccggag

SEQ ID NO: 964309 - RNA, 16 nt, Mycobacterium avium subsp. paratuberculosis
agccggcacggccggc

SEQ ID NO: 964310 - RNA, 21 nt, Mycobacterium avium subsp. paratuberculosis
agccggcagcauucgccgggg

SEQ ID NO: 964311 - RNA, 18 nt, Mycobacterium avium subsp. paratuberculosis
agccggacuauacacgcc

SEQ ID NO: 964312 - RNA, 20 nt, Mycobacterium avium subsp. paratuberculosis
agccggacuauacacgccug

SEQ ID NO: 964313 - RNA, 23 nt, Mycobacterium avium subsp. paratuberculosis
agccggagaaggcgaacgggcug

SEQ ID NO: 964314 - RNA, 13 nt, Mycobacterium avium subsp. paratuberculosis
agccggagccggc

SEQ ID NO: 964315 - RNA, 17 nt, Mycobacterium avium subsp. paratuberculosis
agccggagccggccucg

SEQ ID NO: 964316 - RNA, 17 nt, Mycobacterium avium subsp. paratuberculosis
agccggaccgcuugacg

SEQ ID NO: 964317 - RNA, 22 nt, Mycobacterium avium subsp. paratuberculosis
agccggaccgcuugacgccgcc

SEQ ID NO: 964318 - RNA, 23 nt, Mycobacterium avium subsp. paratuberculosis
agccggaccgcuugacgccgccg

SEQ ID NO: 964319 - RNA, 18 nt, Mycobacterium avium subsp. paratuberculosis
agccggacccauucgucg

SEQ ID NO: 964320 - RNA, 23 nt, Mycobacterium avium subsp. paratuberculosis
agccggacgaacgaguugccccg

SEQ ID NO: 964321 - RNA, 20 nt, Mycobacterium avium subsp. paratuberculosis
agccggacgggaucggcgcg

SEQ ID NO: 964322 - RNA, 14 nt, Mycobacterium avium subsp. paratuberculosis
agccggacagcggg

SEQ ID NO: 964323 - RNA, 20 nt, Mycobacterium avium subsp. paratuberculosis
agccggacaucucccgcacc

SEQ ID NO: 964324 - RNA, 22 nt, Mycobacterium avium subsp. paratuberculosis
agccggacaucucccgcacccg

SEQ ID NO: 964325 - RNA, 22 nt, Mycobacterium avium subsp. paratuberculosis
agccggaaggccaaggccagca

SEQ ID NO: 964326 - RNA, 17 nt, Mycobacterium avium subsp. paratuberculosis
agccgcuuggccgggcg

SEQ ID NO: 964327 - RNA, 15 nt, Mycobacterium avium subsp. paratuberculosis
agccgcuugguggcg

SEQ ID NO: 964328 - RNA, 18 nt, Mycobacterium avium subsp. paratuberculosis
agccgcuugguggcgccg

SEQ ID NO: 964329 - RNA, 21 nt, Mycobacterium avium subsp. paratuberculosis
agccgcugcugggugccgcgu

SEQ ID NO: 964330 - RNA, 15 nt, Mycobacterium avium subsp. paratuberculosis
agccgcugcgacagg

SEQ ID NO: 964331 - RNA, 15 nt, Mycobacterium avium subsp. paratuberculosis
agccgcuggccgcgc

SEQ ID NO: 964332 - RNA, 17 nt, Mycobacterium avium subsp. paratuberculosis
agccgcuggccgcgcca

SEQ ID NO: 964333 - RNA, 19 nt, Mycobacterium avium subsp. paratuberculosis
agccgcuggccgcgccaca

SEQ ID NO: 964334 - RNA, 21 nt, Mycobacterium avium subsp. paratuberculosis
agccgcuggccgcgccacagc

SEQ ID NO: 964335 - RNA, 17 nt, Mycobacterium avium subsp. paratuberculosis
agccgcugacgauggcg

SEQ ID NO: 964336 - RNA, 22 nt, Mycobacterium avium subsp. paratuberculosis
agccgcugcacgcguugcagcg

SEQ ID NO: 964337 - RNA, 14 nt, Mycobacterium avium subsp. paratuberculosis
agccgcugccgcac

SEQ ID NO: 964338 - RNA, 23 nt, Mycobacterium avium subsp. paratuberculosis
agccgcugccguucgccgguacc

SEQ ID NO: 964339 - RNA, 15 nt, Mycobacterium avium subsp. paratuberculosis
agccgcugcagcgcc

SEQ ID NO: 964340 - RNA, 17 nt, Mycobacterium avium subsp. paratuberculosis
agccgcugcagcgccgc

SEQ ID NO: 964341 - RNA, 15 nt, Mycobacterium avium subsp. paratuberculosis
agccgcgggugacga

SEQ ID NO: 964342 - RNA, 12 nt, Mycobacterium avium subsp. paratuberculosis
agccgcggcggc

SEQ ID NO: 964343 - RNA, 12 nt, Mycobacterium avium subsp. paratuberculosis
agccgcggcucg

SEQ ID NO: 964344 - RNA, 18 nt, Mycobacterium avium subsp. paratuberculosis
agccgcggcucgauggac

SEQ ID NO: 964345 - RNA, 20 nt, Mycobacterium avium subsp. paratuberculosis
agccgcggcucgauggacgc

SEQ ID NO: 964346 - RNA, 18 nt, Mycobacterium avium subsp. paratuberculosis
agccggcgguucggcggg

SEQ ID NO: 964347 - RNA, 16 nt, Mycobacterium avium subsp. paratuberculosis
agccggcguacccgcc

SEQ ID NO: 964348 - RNA, 18 nt, Mycobacterium avium subsp. paratuberculosis
agccggcguacccgccca

SEQ ID NO: 964349 - RNA, 22 nt, Mycobacterium avium subsp. paratuberculosis
agccggcguacucgcacagccg

SEQ ID NO: 964350 - RNA, 15 nt, Mycobacterium avium subsp. paratuberculosis
agccggcgucgauga

SEQ ID NO: 964351 - RNA, 12 nt, Mycobacterium avium subsp. paratuberculosis
agccggcgucgc

SEQ ID NO: 964352 - RNA, 16 nt, Mycobacterium avium subsp. paratuberculosis
agccggcgucgccgcu

SEQ ID NO: 964353 - RNA, 17 nt, Mycobacterium avium subsp. paratuberculosis
agccggcucgguaugcg

SEQ ID NO: 964354 - RNA, 22 nt, Mycobacterium avium subsp. paratuberculosis
agccggcucgguaugcggcgac

SEQ ID NO: 964355 - RNA, 23 nt, Mycobacterium avium subsp. paratuberculosis
agccggcucgguaugcggcgacg

SEQ ID NO: 964356 - RNA, 12 nt, Mycobacterium avium subsp. paratuberculosis
agccggcggcgc

SEQ ID NO: 964357 - RNA, 17 nt, Mycobacterium avium subsp. paratuberculosis
agccggcgcccgcaggc

SEQ ID NO: 964358 - RNA, 16 nt, Mycobacterium avium subsp. paratuberculosis
agccggcggcggugcg

SEQ ID NO: 964359 - RNA, 12 nt, Mycobacterium avium subsp. paratuberculosis
agccggcggcgu

SEQ ID NO: 964360 - RNA, 21 nt, Mycobacterium avium subsp. paratuberculosis
agccggcggcugugaucgcug

SEQ ID NO: 964361 - RNA, 14 nt, Mycobacterium avium subsp. paratuberculosis
agccggcgggcgcu

SEQ ID NO: 964362 - RNA, 18 nt, Mycobacterium avium subsp. paratuberculosis
agccggcgggcgcucgau

SEQ ID NO: 964363 - RNA, 16 nt, Mycobacterium avium subsp. paratuberculosis
agccggcgguggccau

SEQ ID NO: 964364 - RNA, 23 nt, Mycobacterium avium subsp. paratuberculosis
agccggcgguggccaugcgcgag

SEQ ID NO: 964365 - RNA, 19 nt, Mycobacterium avium subsp. paratuberculosis
agccggcgacgaccgcacc

SEQ ID NO: 964366 - RNA, 20 nt, Mycobacterium avium subsp. paratuberculosis
agccggcgcaccaggguguc

SEQ ID NO: 964367 - RNA, 18 nt, Mycobacterium avium subsp. paratuberculosis
agccggcgcaccgcgucg

SEQ ID NO: 964368 - RNA, 16 nt, Mycobacterium avium subsp. paratuberculosis
agccggcgcacucccg

SEQ ID NO: 964369 - RNA, 13 nt, Mycobacterium avium subsp. paratuberculosis
agccggccgccga

SEQ ID NO: 964370 - RNA, 22 nt, Mycobacterium avium subsp. paratuberculosis
agccggcccggggugugcccga

SEQ ID NO: 964371 - RNA, 12 nt, Mycobacterium avium subsp. paratuberculosis
agccggccgcgu

SEQ ID NO: 964372 - RNA, 15 nt, Mycobacterium avium subsp. paratuberculosis
agccggccgcgucgc

SEQ ID NO: 964373 - RNA, 16 nt, Mycobacterium avium subsp. paratuberculosis
agccggccgcgucgcc

SEQ ID NO: 964374 - RNA, 18 nt, Mycobacterium avium subsp. paratuberculosis
agccggccgcgucgccga

SEQ ID NO: 964375 - RNA, 19 nt, Mycobacterium avium subsp. paratuberculosis
agccggccgcgucgccgac

SEQ ID NO: 964376 - RNA, 14 nt, Mycobacterium avium subsp. paratuberculosis
agccggccgcugag

SEQ ID NO: 964377 - RNA, 15 nt, Mycobacterium avium subsp. paratuberculosis
agccggccggacacc

SEQ ID NO: 964378 - RNA, 13 nt, Mycobacterium avium subsp. paratuberculosis
agccggccggcag

SEQ ID NO: 964379 - RNA, 23 nt, Mycobacterium avium subsp. paratuberculosis
agccggccggcggacgcggccag

SEQ ID NO: 964380 - RNA, 15 nt, Mycobacterium avium subsp. paratuberculosis
agccggccucgccgg

SEQ ID NO: 964381 - RNA, 17 nt, Mycobacterium avium subsp. paratuberculosis
agccggccucgccggcg

SEQ ID NO: 964382 - RNA, 20 nt, Mycobacterium avium subsp. paratuberculosis
agccggccucgccggcgccg

SEQ ID NO: 964383 - RNA, 23 nt, Mycobacterium avium subsp. paratuberculosis
agccggccucgccggcgccgggc

SEQ ID NO: 964384 - RNA, 21 nt, Mycobacterium avium subsp. paratuberculosis
agccggccugcuuuucggccg

SEQ ID NO: 964385 - RNA, 17 nt, Mycobacterium avium subsp. paratuberculosis
agccggcgagcgcgcug

SEQ ID NO: 964386 - RNA, 13 nt, Mycobacterium avium subsp. paratuberculosis
agccggccgaccg

SEQ ID NO: 964387 - RNA, 18 nt, Mycobacterium avium subsp. paratuberculosis
agccggccgaccgccucg

SEQ ID NO: 964388 - RNA, 18 nt, Mycobacterium avium subsp. paratuberculosis
agccggccgacgcggccu

SEQ ID NO: 964389 - RNA, 19 nt, Mycobacterium avium subsp. paratuberculosis
agccggccgacgcggccuc

SEQ ID NO: 964390 - RNA, 11 nt, Mycobacterium avium subsp. paratuberculosis
agccggcccgc

SEQ ID NO: 964391 - RNA, 16 nt, Mycobacterium avium subsp. paratuberculosis
agccggcccgcagcca

SEQ ID NO: 964392 - RNA, 18 nt, Mycobacterium avium subsp. paratuberculosis
agccggcccgcagccagc

SEQ ID NO: 964393 - RNA, 14 nt, Mycobacterium avium subsp. paratuberculosis
agccggcccgcauc

SEQ ID NO: 964394 - RNA, 20 nt, Mycobacterium avium subsp. paratuberculosis
agccggcccgcaucgcggcg

SEQ ID NO: 964395 - RNA, 22 nt, Mycobacterium avium subsp. paratuberculosis
agccggcccgcaucgcggcgau

SEQ ID NO: 964396 - RNA, 17 nt, Mycobacterium avium subsp. paratuberculosis
agccggccagcgucgcg

SEQ ID NO: 964397 - RNA, 15 nt, Mycobacterium avium subsp. paratuberculosis
agccggccagcucga

SEQ ID NO: 964398 - RNA, 18 nt, Mycobacterium avium subsp. paratuberculosis
agccggccagcucgagca

SEQ ID NO: 964399 - RNA, 21 nt, Mycobacterium avium subsp. paratuberculosis
agccggccaguucccgggcga

SEQ ID NO: 964400 - RNA, 15 nt, Mycobacterium avium subsp. paratuberculosis
agccggccaucucgg

SEQ ID NO: 964401 - RNA, 20 nt, Mycobacterium avium subsp. paratuberculosis
agccggccaacagcagcgcc

SEQ ID NO: 964402 - RNA, 16 nt, Mycobacterium avium subsp. paratuberculosis
agccggccaccucguc

SEQ ID NO: 964403 - RNA, 23 nt, Mycobacterium avium subsp. paratuberculosis
agccggccaccucgucccagcgc

SEQ ID NO: 964404 - RNA, 12 nt, Mycobacterium avium subsp. paratuberculosis
agccggccagca

SEQ ID NO: 964405 - RNA, 16 nt, Mycobacterium avium subsp. paratuberculosis
agccggccagcagcgg

SEQ ID NO: 964406 - RNA, 19 nt, Mycobacterium avium subsp. paratuberculosis
agcgauacccguugcgccc

SEQ ID NO: 964407 - RNA, 13 nt, Mycobacterium avium subsp. paratuberculosis
agcgaucggcggc

SEQ ID NO: 964408 - RNA, 16 nt, Mycobacterium avium subsp. paratuberculosis
agcgaucggcggcucg

SEQ ID NO: 964409 - RNA, 17 nt, Mycobacterium avium subsp. paratuberculosis
agcgaucggugaacccg

SEQ ID NO: 964410 - RNA, 14 nt, Mycobacterium avium subsp. paratuberculosis
agcgauccggcgcg

SEQ ID NO: 964411 - RNA, 17 nt, Mycobacterium avium subsp. paratuberculosis
agcgaugggcgcgauca

SEQ ID NO: 964412 - RNA, 19 nt, Mycobacterium avium subsp. paratuberculosis
agcgauugcggccgccggc

SEQ ID NO: 964413 - RNA, 21 nt, Mycobacterium avium subsp. paratuberculosis
agcgauugcggccgccggcca

SEQ ID NO: 964414 - RNA, 22 nt, Mycobacterium avium subsp. paratuberculosis
agcgauugcggccgccggccag

SEQ ID NO: 964415 - RNA, 23 nt, Mycobacterium avium subsp. paratuberculosis
agcgauuggauuuaucucggcga

SEQ ID NO: 964416 - RNA, 13 nt, Mycobacterium avium subsp. paratuberculosis
agcgauucccgcc

SEQ ID NO: 964417 - RNA, 17 nt, Mycobacterium avium subsp. paratuberculosis
agcgcagaucgcgcauc

SEQ ID NO: 964418 - RNA, 20 nt, Mycobacterium avium subsp. paratuberculosis
agcgcagaucgcgcaucacc

SEQ ID NO: 964419 - RNA, 13 nt, Mycobacterium avium subsp. paratuberculosis
agcgcagcaccag

SEQ ID NO: 964420 - RNA, 15 nt, Mycobacterium avium subsp. paratuberculosis
agcgcagcaccaggc

SEQ ID NO: 964421 - RNA, 16 nt, Mycobacterium avium subsp. paratuberculosis
agcgcagcaccuccga

SEQ ID NO: 964422 - RNA, 13 nt, Mycobacterium avium subsp. paratuberculosis
agcgcagcaggua

SEQ ID NO: 964423 - RNA, 14 nt, Mycobacterium avium subsp. paratuberculosis
agcgcagcaucggc

SEQ ID NO: 964424 - RNA, 16 nt, Mycobacterium avium subsp. paratuberculosis
agcgcagcaucggcag

SEQ ID NO: 964425 - RNA, 14 nt, Mycobacterium avium subsp. paratuberculosis
agcgcaacaccgaa

SEQ ID NO: 964426 - RNA, 22 nt, Mycobacterium avium subsp. paratuberculosis
agcgcaccgggcccgcccgcag

SEQ ID NO: 964427 - RNA, 15 nt, Mycobacterium avium subsp. paratuberculosis
agcgcaccggucagc

SEQ ID NO: 964428 - RNA, 18 nt, Mycobacterium avium subsp. paratuberculosis
agcgcaacggcgucgaca

SEQ ID NO: 964429 - RNA, 21 nt, Mycobacterium avium subsp. paratuberculosis
agcgagaucccgguucccggc

SEQ ID NO: 964430 - RNA, 16 nt, Mycobacterium avium subsp. paratuberculosis
agcgagcacagcggcg

SEQ ID NO: 964431 - RNA, 21 nt, Mycobacterium avium subsp. paratuberculosis
agcgagaccucccggcgccac

SEQ ID NO: 964432 - RNA, 22 nt, Mycobacterium avium subsp. paratuberculosis
agcgagacgaccaggaugccca

SEQ ID NO: 964433 - RNA, 21 nt, Mycobacterium avium subsp. paratuberculosis
agcgagugguaccggguggcc

SEQ ID NO: 964434 - RNA, 17 nt, Mycobacterium avium subsp. paratuberculosis
agcgagucggcgaaggc

SEQ ID NO: 964435 - RNA, 14 nt, Mycobacterium avium subsp. paratuberculosis
agcgagugccggcc

SEQ ID NO: 964436 - RNA, 16 nt, Mycobacterium avium subsp. paratuberculosis
agcgagugccggccag

SEQ ID NO: 964437 - RNA, 21 nt, Mycobacterium avium subsp. paratuberculosis
agcgagugccggccagcucgc

SEQ ID NO: 964438 - RNA, 19 nt, Mycobacterium avium subsp. paratuberculosis
agcgagcaggucaccggau

SEQ ID NO: 964439 - RNA, 16 nt, Mycobacterium avium subsp. paratuberculosis
agcgagcccagcugcg

SEQ ID NO: 964440 - RNA, 23 nt, Mycobacterium avium subsp. paratuberculosis
agcgagccgagacugaugguggc

SEQ ID NO: 964441 - RNA, 19 nt, Mycobacterium avium subsp. paratuberculosis
agcgacucguuggccggcu

SEQ ID NO: 964442 - RNA, 22 nt, Mycobacterium avium subsp. paratuberculosis
agcgacgccagcggcagcgcca

SEQ ID NO: 964443 - RNA, 17 nt, Mycobacterium avium subsp. paratuberculosis
agcgacgcgacgcgcuc

SEQ ID NO: 964444 - RNA, 20 nt, Mycobacterium avium subsp. paratuberculosis
agcgacuugaccagcagcug

SEQ ID NO: 964445 - RNA, 17 nt, Mycobacterium avium subsp. paratuberculosis
agcgacuugccgccggc

SEQ ID NO: 964446 - RNA, 16 nt, Mycobacterium avium subsp. paratuberculosis
agcgagaagucgccga

SEQ ID NO: 964447 - RNA, 19 nt, Mycobacterium avium subsp. paratuberculosis
agcgagaagucgccgacgc

SEQ ID NO: 964448 - RNA, 21 nt, Mycobacterium avium subsp. paratuberculosis
agcgaagccgugacccgccgu

SEQ ID NO: 964449 - RNA, 23 nt, Mycobacterium avium subsp. paratuberculosis
agcgaacugccggcauaggccag

SEQ ID NO: 964450 - RNA, 16 nt, Mycobacterium avium subsp. paratuberculosis
agcgaacacgugcagc

SEQ ID NO: 964451 - RNA, 14 nt, Mycobacterium avium subsp. paratuberculosis
agcgaaccgacaua

SEQ ID NO: 964452 - RNA, 13 nt, Mycobacterium avium subsp. paratuberculosis
agcgaacgcggcu

SEQ ID NO: 964453 - RNA, 14 nt, Mycobacterium avium subsp. paratuberculosis
agcgaccagcgcgc

SEQ ID NO: 964454 - RNA, 19 nt, Mycobacterium avium subsp. paratuberculosis
agcgaccagcgcgccggcc

SEQ ID NO: 964455 - RNA, 22 nt, Mycobacterium avium subsp. paratuberculosis
agcgaccagcgcgccggccagc

SEQ ID NO: 964456 - RNA, 17 nt, Mycobacterium avium subsp. paratuberculosis
agcgaccugguccaccg

SEQ ID NO: 964457 - RNA, 18 nt, Mycobacterium avium subsp. paratuberculosis
agcgaccugguccaccgc

SEQ ID NO: 964458 - RNA, 22 nt, Mycobacterium avium subsp. paratuberculosis
agcgaccugguccaccgcggcg

SEQ ID NO: 964459 - RNA, 14 nt, Mycobacterium avium subsp. paratuberculosis
agcgaaggugccgc

SEQ ID NO: 964460 - RNA, 18 nt, Mycobacterium avium subsp. paratuberculosis
agcgacccgaaccggauc

SEQ ID NO: 964461 - RNA, 13 nt, Mycobacterium avium subsp. paratuberculosis
agcgccaugccgc

SEQ ID NO: 964462 - RNA, 16 nt, Mycobacterium avium subsp. paratuberculosis
agcgccaugccgccga

SEQ ID NO: 964463 - RNA, 13 nt, Mycobacterium avium subsp. paratuberculosis
agcgcccaccgcu

SEQ ID NO: 964464 - RNA, 18 nt, Mycobacterium avium subsp. paratuberculosis
agcgcccccgacaggccc

SEQ ID NO: 964465 - RNA, 23 nt, Mycobacterium avium subsp. paratuberculosis
agcgcccccgaggagacgucggc

SEQ ID NO: 964466 - RNA, 14 nt, Mycobacterium avium subsp. paratuberculosis
agcgcccaggcgug

SEQ ID NO: 964467 - RNA, 12 nt, Mycobacterium avium subsp. paratuberculosis
agcgcccagccg

SEQ ID NO: 964468 - RNA, 13 nt, Mycobacterium avium subsp. paratuberculosis
agcgcccagccga

SEQ ID NO: 964469 - RNA, 14 nt, Mycobacterium avium subsp. paratuberculosis
agcgcccagccgag

SEQ ID NO: 964470 - RNA, 16 nt, Mycobacterium avium subsp. paratuberculosis
agcgcccagccgagcc

SEQ ID NO: 964471 - RNA, 22 nt, Mycobacterium avium subsp. paratuberculosis
agcgccagcagcggcacccggu

SEQ ID NO: 964472 - RNA, 14 nt, Mycobacterium avium subsp. paratuberculosis
agcgccagcaugcc

SEQ ID NO: 964473 - RNA, 14 nt, Mycobacterium avium subsp. paratuberculosis
agcgccagcacggc

SEQ ID NO: 964474 - RNA, 21 nt, Mycobacterium avium subsp. paratuberculosis
agcgccagcacggccaccagc

SEQ ID NO: 964475 - RNA, 22 nt, Mycobacterium avium subsp. paratuberculosis
agcgccagcacggccaccagca

SEQ ID NO: 964476 - RNA, 16 nt, Mycobacterium avium subsp. paratuberculosis
agcgccagcaccgggc

SEQ ID NO: 964477 - RNA, 18 nt, Mycobacterium avium subsp. paratuberculosis
agcgccaccagcaccggg

SEQ ID NO: 964478 - RNA, 17 nt, Mycobacterium avium subsp. paratuberculosis
agcgccagcaccgccug

SEQ ID NO: 964479 - RNA, 21 nt, Mycobacterium avium subsp. paratuberculosis
agcgccagcaacacccagccg

SEQ ID NO: 964480 - RNA, 22 nt, Mycobacterium avium subsp. paratuberculosis
agcgccggaccgauccggcgcc

SEQ ID NO: 964481 - RNA, 13 nt, Mycobacterium avium subsp. paratuberculosis
agcgccggacgcu

SEQ ID NO: 964482 - RNA, 21 nt, Mycobacterium avium subsp. paratuberculosis
agcgccggcaacaacgccagc

SEQ ID NO: 964483 - RNA, 21 nt, Mycobacterium avium subsp. paratuberculosis
agcgccggcaccagcagccgc

SEQ ID NO: 964484 - RNA, 15 nt, Mycobacterium avium subsp. paratuberculosis
agcgccggcagcgcc

SEQ ID NO: 964485 - RNA, 17 nt, Mycobacterium avium subsp. paratuberculosis
agcgccggcagcgccuc

SEQ ID NO: 964486 - RNA, 13 nt, Mycobacterium avium subsp. paratuberculosis
agcgccgcucggc

SEQ ID NO: 964487 - RNA, 18 nt, Mycobacterium avium subsp. paratuberculosis
agcgccgcguucacccgc

SEQ ID NO: 964488 - RNA, 18 nt, Mycobacterium avium subsp. paratuberculosis
agcgccgcguugucggcg

SEQ ID NO: 964489 - RNA, 21 nt, Mycobacterium avium subsp. paratuberculosis
agcgccgcguugucggcgucc

SEQ ID NO: 964490 - RNA, 14 nt, Mycobacterium avium subsp. paratuberculosis
agcgccgcgccgac

SEQ ID NO: 964491 - RNA, 16 nt, Mycobacterium avium subsp. paratuberculosis
agcgccgcgccgaccu

SEQ ID NO: 964492 - RNA, 15 nt, Mycobacterium avium subsp. paratuberculosis
agcgccgcggccagc

SEQ ID NO: 964493 - RNA, 18 nt, Mycobacterium avium subsp. paratuberculosis
agcgccgcggccagccgg

SEQ ID NO: 964494 - RNA, 15 nt, Mycobacterium avium subsp. paratuberculosis
agcgccgcggccggu

SEQ ID NO: 964495 - RNA, 19 nt, Mycobacterium avium subsp. paratuberculosis
agcgccgcggccggugcca

SEQ ID NO: 964496 - RNA, 13 nt, Mycobacterium avium subsp. paratuberculosis
agcgccgcggcga

SEQ ID NO: 964497 - RNA, 21 nt, Mycobacterium avium subsp. paratuberculosis
agcgcccgauuccccggcgug

SEQ ID NO: 964498 - RNA, 23 nt, Mycobacterium avium subsp. paratuberculosis
agcgcccgauuccccggcguguc

SEQ ID NO: 964499 - RNA, 13 nt, Mycobacterium avium subsp. paratuberculosis
agcgccccgccgg

SEQ ID NO: 964500 - RNA, 14 nt, Mycobacterium avium subsp. paratuberculosis
agcgccaacauggc

SEQ ID NO: 964501 - RNA, 17 nt, Mycobacterium avium subsp. paratuberculosis
agcgccaacauggcgca

SEQ ID NO: 964502 - RNA, 19 nt, Mycobacterium avium subsp. paratuberculosis
agcgcaugaugcccaggcc

SEQ ID NO: 964503 - RNA, 21 nt, Mycobacterium avium subsp. paratuberculosis
agcgccaccccgaacccggcc

SEQ ID NO: 964504 - RNA, 22 nt, Mycobacterium avium subsp. paratuberculosis
agcgccaccccgaacccggcca

SEQ ID NO: 964505 - RNA, 18 nt, Mycobacterium avium subsp. paratuberculosis
agcgccacaucagcucgg

SEQ ID NO: 964506 - RNA, 23 nt, Mycobacterium avium subsp. paratuberculosis
agcgcagcccgguuuccaguccg

SEQ ID NO: 964507 - RNA, 12 nt, Mycobacterium avium subsp. paratuberculosis
agcgcagcagcu

SEQ ID NO: 964508 - RNA, 16 nt, Mycobacterium avium subsp. paratuberculosis
agcgcauaggccgcga

SEQ ID NO: 964509 - RNA, 21 nt, Mycobacterium avium subsp. paratuberculosis
agcgcauccaccagggcggug

SEQ ID NO: 964510 - RNA, 12 nt, Mycobacterium avium subsp. paratuberculosis
agcgcauccgac

SEQ ID NO: 964511 - RNA, 20 nt, Mycobacterium avium subsp. paratuberculosis
agcgcauccucauagccggc

SEQ ID NO: 964512 - RNA, 18 nt, Mycobacterium avium subsp. paratuberculosis
agcgcaucgacugcgaca

SEQ ID NO: 964513 - RNA, 23 nt, Mycobacterium avium subsp. paratuberculosis
agcgcaucgacugcgacacccgc

SEQ ID NO: 964514 - RNA, 16 nt, Mycobacterium avium subsp. paratuberculosis
agcgcaucguugccgg

SEQ ID NO: 964515 - RNA, 19 nt, Mycobacterium avium subsp. paratuberculosis
agcgcaucguugccggcgg

SEQ ID NO: 964516 - RNA, 22 nt, Mycobacterium avium subsp. paratuberculosis
agcgcaucguugccggcggcga

SEQ ID NO: 964517 - RNA, 16 nt, Mycobacterium avium subsp. paratuberculosis
agcgcaucgccggcga

SEQ ID NO: 964518 - RNA, 17 nt, Mycobacterium avium subsp. paratuberculosis
agcgcaucggucaccag

SEQ ID NO: 964519 - RNA, 22 nt, Mycobacterium avium subsp. paratuberculosis
uuuugugucugcucgccugacu

SEQ ID NO: 964520 - RNA, 11 nt, Mycobacterium avium subsp. paratuberculosis
uuuuguugacc

SEQ ID NO: 964521 - RNA, 22 nt, Mycobacterium avium subsp. paratuberculosis
uuuucgaaaccggucaacggcu

SEQ ID NO: 964522 - RNA, 18 nt, Mycobacterium avium subsp. paratuberculosis
uuuucgccgucacugcac

SEQ ID NO: 964523 - RNA, 19 nt, Mycobacterium avium subsp. paratuberculosis
ugaacaccaccaggccgua

SEQ ID NO: 964524 - RNA, 12 nt, Mycobacterium avium subsp. paratuberculosis
ugaacagcaccc

SEQ ID NO: 964525 - RNA, 12 nt, Mycobacterium avium subsp. paratuberculosis
ugaacagcagca

SEQ ID NO: 964526 - RNA, 20 nt, Mycobacterium avium subsp. paratuberculosis
ugaacagcgcccggccguga

SEQ ID NO: 964527 - RNA, 13 nt, Mycobacterium avium subsp. paratuberculosis
ugaacagcgcgcc

SEQ ID NO: 964528 - RNA, 18 nt, Mycobacterium avium subsp. paratuberculosis
ugaacagcgcgccgaaca

SEQ ID NO: 964529 - RNA, 20 nt, Mycobacterium avium subsp. paratuberculosis
ugaacaugcccugcacgauc

SEQ ID NO: 964530 - RNA, 13 nt, Mycobacterium avium subsp. paratuberculosis
ugaacccugggcg

SEQ ID NO: 964531 - RNA, 16 nt, Mycobacterium avium subsp. paratuberculosis
ugaaccgcugcugcuc

SEQ ID NO: 964532 - RNA, 21 nt, Mycobacterium avium subsp. paratuberculosis
ugaaccgcugcugcucggccg

SEQ ID NO: 964533 - RNA, 22 nt, Mycobacterium avium subsp. paratuberculosis
ugaaccacuucuggcgcugcuc

SEQ ID NO: 964534 - RNA, 19 nt, Mycobacterium avium subsp. paratuberculosis
ugaaccggucguuggccuc

SEQ ID NO: 964535 - RNA, 15 nt, Mycobacterium avium subsp. paratuberculosis
ugaacgccagcagcc

SEQ ID NO: 964536 - RNA, 22 nt, Mycobacterium avium subsp. paratuberculosis
ugaacgaccugguugacaccac

SEQ ID NO: 964537 - RNA, 19 nt, Mycobacterium avium subsp. paratuberculosis
ugaaacuaacuucacgcuc

SEQ ID NO: 964538 - RNA, 19 nt, Mycobacterium avium subsp. paratuberculosis
ugaaacuagcuucacgcuc

SEQ ID NO: 964539 - RNA, 18 nt, Mycobacterium avium subsp. paratuberculosis
ugaaaccggccagcagca

SEQ ID NO: 964540 - RNA, 20 nt, Mycobacterium avium subsp. paratuberculosis
ugaaaccggcgccgaagccc

SEQ ID NO: 964541 - RNA, 13 nt, Mycobacterium avium subsp. paratuberculosis
ucuugcugggugg

SEQ ID NO: 964542 - RNA, 16 nt, Mycobacterium avium subsp. paratuberculosis
ucuugcugagcugcgc

SEQ ID NO: 964543 - RNA, 16 nt, Mycobacterium avium subsp. paratuberculosis
ucuuguugaccuucuc

SEQ ID NO: 964544 - RNA, 15 nt, Mycobacterium avium subsp. paratuberculosis
ucuuggccagcagcg

SEQ ID NO: 964545 - RNA, 23 nt, Mycobacterium avium subsp. paratuberculosis
ucuuggccaggcccugccagcgc

SEQ ID NO: 964546 - RNA, 12 nt, Mycobacterium avium subsp. paratuberculosis
ucuuggccgcgc

SEQ ID NO: 964547 - RNA, 13 nt, Mycobacterium avium subsp. paratuberculosis
ucuuggccagcag

SEQ ID NO: 964548 - RNA, 17 nt, Mycobacterium avium subsp. paratuberculosis
ucuugggaaugucguag

SEQ ID NO: 964549 - RNA, 17 nt, Mycobacterium avium subsp. paratuberculosis
ucuugggacuggauggc

SEQ ID NO: 964550 - RNA, 23 nt, Mycobacterium avium subsp. paratuberculosis
ucuuggcguaugccuccucggug

SEQ ID NO: 964551 - RNA, 22 nt, Mycobacterium avium subsp. paratuberculosis
ucuuggucagccgcggcggcag

SEQ ID NO: 964552 - RNA, 13 nt, Mycobacterium avium subsp. paratuberculosis
ucuuacggauauc

SEQ ID NO: 964553 - RNA, 12 nt, Mycobacterium avium subsp. paratuberculosis
ucuuccacgccg

SEQ ID NO: 964554 - RNA, 15 nt, Mycobacterium avium subsp. paratuberculosis
ucugcggugcgccca

SEQ ID NO: 964555 - RNA, 23 nt, Mycobacterium avium subsp. paratuberculosis
ucugcagccggcgcggcagggcc

SEQ ID NO: 964556 - RNA, 23 nt, Mycobacterium avium subsp. paratuberculosis
ucugcagagcggugacaucgcca

SEQ ID NO: 964557 - RNA, 12 nt, Mycobacterium avium subsp. paratuberculosis
ucugcaccagcg

SEQ ID NO: 964558 - RNA, 18 nt, Mycobacterium avium subsp. paratuberculosis
ucugcacgacgaacacca

SEQ ID NO: 964559 - RNA, 18 nt, Mycobacterium avium subsp. paratuberculosis
ucugcacucagagcagcg

SEQ ID NO: 964560 - RNA, 18 nt, Mycobacterium avium subsp. paratuberculosis
ucugcucccaggacggcg

SEQ ID NO: 964561 - RNA, 14 nt, Mycobacterium avium subsp. paratuberculosis
ucugguggcagcgg

SEQ ID NO: 964562 - RNA, 22 nt, Mycobacterium avium subsp. paratuberculosis
ucuggcgugacgcucggcgcgu

SEQ ID NO: 964563 - RNA, 15 nt, Mycobacterium avium subsp. paratuberculosis
ucuggcggucccgca

SEQ ID NO: 964564 - RNA, 19 nt, Mycobacterium avium subsp. paratuberculosis
ucuggcggucccgcauguc

SEQ ID NO: 964565 - RNA, 23 nt, Mycobacterium avium subsp. paratuberculosis
ucugucgcgcgaacagccgaccg

SEQ ID NO: 964566 - RNA, 16 nt, Mycobacterium avium subsp. paratuberculosis
ucuccagcagcuucau

SEQ ID NO: 964567 - RNA, 21 nt, Mycobacterium avium subsp. paratuberculosis
ucuccagcagcuucaugcccg

SEQ ID NO: 964568 - RNA, 13 nt, Mycobacterium avium subsp. paratuberculosis
ucuccagcgcggu

SEQ ID NO: 964569 - RNA, 21 nt, Mycobacterium avium subsp. paratuberculosis
ucuccaggcucgacaacugcc

SEQ ID NO: 964570 - RNA, 13 nt, Mycobacterium avium subsp. paratuberculosis
ucuccgccggcag

SEQ ID NO: 964571 - RNA, 13 nt, Mycobacterium avium subsp. paratuberculosis
ucuccucccagcc

SEQ ID NO: 964572 - RNA, 14 nt, Mycobacterium avium subsp. paratuberculosis
ucuccucccagccc

SEQ ID NO: 964573 - RNA, 12 nt, Mycobacterium avium subsp. paratuberculosis
ucuccgcggccg

SEQ ID NO: 964574 - RNA, 17 nt, Mycobacterium avium subsp. paratuberculosis
ucuccggccccgagccg

SEQ ID NO: 964575 - RNA, 12 nt, Mycobacterium avium subsp. paratuberculosis
ucuccggcccgg

SEQ ID NO: 964576 - RNA, 19 nt, Mycobacterium avium subsp. paratuberculosis
ucuccggcgcgguugcccg

SEQ ID NO: 964577 - RNA, 13 nt, Mycobacterium avium subsp. paratuberculosis
ucucgagccggcg

SEQ ID NO: 964578 - RNA, 13 nt, Mycobacterium avium subsp. paratuberculosis
ucucgaccuucuu

SEQ ID NO: 964579 - RNA, 16 nt, Mycobacterium avium subsp. paratuberculosis
ucucgaccaagaacca

SEQ ID NO: 964580 - RNA, 24 nt, Mycobacterium avium subsp. paratuberculosis
ucucgaccaggccguuguccgucg

SEQ ID NO: 964581 - RNA, 17 nt, Mycobacterium avium subsp. paratuberculosis
ucucgacccgggccagg

SEQ ID NO: 964582 - RNA, 14 nt, Mycobacterium avium subsp. paratuberculosis
ucucgauggccacg

SEQ ID NO: 964583 - RNA, 13 nt, Mycobacterium avium subsp. paratuberculosis
ucucggccagccg

SEQ ID NO: 964584 - RNA, 13 nt, Mycobacterium avium subsp. paratuberculosis
ucucggccagcgg

SEQ ID NO: 964585 - RNA, 13 nt, Mycobacterium avium subsp. paratuberculosis
ucucggccggaag

SEQ ID NO: 964586 - RNA, 16 nt, Mycobacterium avium subsp. paratuberculosis
ucucggccggaagguc

SEQ ID NO: 964587 - RNA, 16 nt, Mycobacterium avium subsp. paratuberculosis
ucucggcgaaguagcg

SEQ ID NO: 964588 - RNA, 15 nt, Mycobacterium avium subsp. paratuberculosis
ucucgggcagcagca

SEQ ID NO: 964589 - RNA, 19 nt, Mycobacterium avium subsp. paratuberculosis
ucucgggcagcagcaccag

SEQ ID NO: 964590 - RNA, 20 nt, Mycobacterium avium subsp. paratuberculosis
ucucgggcagcagcaccagc

SEQ ID NO: 964591 - RNA, 13 nt, Mycobacterium avium subsp. paratuberculosis
ucucggcggcgcc

SEQ ID NO: 964592 - RNA, 18 nt, Mycobacterium avium subsp. paratuberculosis
ucucggcggucugucgcg

SEQ ID NO: 964593 - RNA, 19 nt, Mycobacterium avium subsp. paratuberculosis
ucucggcguccccggcggu

SEQ ID NO: 964594 - RNA, 21 nt, Mycobacterium avium subsp. paratuberculosis
ucucggcgugcucggccacga

SEQ ID NO: 964595 - RNA, 14 nt, Mycobacterium avium subsp. paratuberculosis
ucucguagcccacc

SEQ ID NO: 964596 - RNA, 15 nt, Mycobacterium avium subsp. paratuberculosis
ucucgucccacggcg

SEQ ID NO: 964597 - RNA, 18 nt, Mycobacterium avium subsp. paratuberculosis
ucucguccugggccggga

SEQ ID NO: 964598 - RNA, 21 nt, Mycobacterium avium subsp. paratuberculosis
ucucgucgacgauggcccgga

SEQ ID NO: 964599 - RNA, 22 nt, Mycobacterium avium subsp. paratuberculosis
ucucgguggggacgugcacgcg

SEQ ID NO: 964600 - RNA, 23 nt, Mycobacterium avium subsp. paratuberculosis
ucucggugucggacuugucgccg

SEQ ID NO: 964601 - RNA, 14 nt, Mycobacterium avium subsp. paratuberculosis
ucucggugucgucg

SEQ ID NO: 964602 - RNA, 22 nt, Mycobacterium avium subsp. paratuberculosis
ucucuucgaugccgguggccuu

SEQ ID NO: 964603 - RNA, 21 nt, Mycobacterium avium subsp. paratuberculosis
ucucugauuugaaauucaccu

SEQ ID NO: 964604 - RNA, 18 nt, Mycobacterium avium subsp. paratuberculosis
ucugaucgcccagcaccg

SEQ ID NO: 964605 - RNA, 18 nt, Mycobacterium avium subsp. paratuberculosis
ucgugauggcgaaccagc

SEQ ID NO: 964606 - RNA, 16 nt, Mycobacterium avium subsp. paratuberculosis
ucgugaccgaccucca

SEQ ID NO: 964607 - RNA, 19 nt, Mycobacterium avium subsp. paratuberculosis
ucguuguccaccaucaaca

SEQ ID NO: 964608 - RNA, 13 nt, Mycobacterium avium subsp. paratuberculosis
ucguucuggcccg

SEQ ID NO: 964609 - RNA, 22 nt, Mycobacterium avium subsp. paratuberculosis
ucguucgugagcgguggccacg

SEQ ID NO: 964610 - RNA, 14 nt, Mycobacterium avium subsp. paratuberculosis
ucgucguuggcccg

SEQ ID NO: 964611 - RNA, 15 nt, Mycobacterium avium subsp. paratuberculosis
ucgucgugcaccacg

SEQ ID NO: 964612 - RNA, 16 nt, Mycobacterium avium subsp. paratuberculosis
ucgucgggccgcagca

SEQ ID NO: 964613 - RNA, 18 nt, Mycobacterium avium subsp. paratuberculosis
ucgucgggccgcagcacg

SEQ ID NO: 964614 - RNA, 14 nt, Mycobacterium avium subsp. paratuberculosis
ucgucggcggugcc

SEQ ID NO: 964615 - RNA, 21 nt, Mycobacterium avium subsp. paratuberculosis
ucgucggucaggccggcgccg

SEQ ID NO: 964616 - RNA, 18 nt, Mycobacterium avium subsp. paratuberculosis
ucgucggcgcgggccagc

SEQ ID NO: 964617 - RNA, 20 nt, Mycobacterium avium subsp. paratuberculosis
ucgucggcgaacggccaguc

SEQ ID NO: 964618 - RNA, 21 nt, Mycobacterium avium subsp. paratuberculosis
ucgucggcgaagguguccucg

SEQ ID NO: 964619 - RNA, 19 nt, Mycobacterium avium subsp. paratuberculosis
ucgucggacaccagcaugg

SEQ ID NO: 964620 - RNA, 23 nt, Mycobacterium avium subsp. paratuberculosis
ucgucgcuaccucaccacgugcc

SEQ ID NO: 964621 - RNA, 16 nt, Mycobacterium avium subsp. paratuberculosis
ucgucgcuggccaggu

SEQ ID NO: 964622 - RNA, 12 nt, Mycobacterium avium subsp. paratuberculosis
ucgucgcggcca

SEQ ID NO: 964623 - RNA, 14 nt, Mycobacterium avium subsp. paratuberculosis
ucgucgcccacccg

SEQ ID NO: 964624 - RNA, 19 nt, Mycobacterium avium subsp. paratuberculosis
ucguccgugcugccggccg

SEQ ID NO: 964625 - RNA, 22 nt, Mycobacterium avium subsp. paratuberculosis
ucguccgguaggugaucgccuc

SEQ ID NO: 964626 - RNA, 21 nt, Mycobacterium avium subsp. paratuberculosis
ucguccgacagcgccugcccg

SEQ ID NO: 964627 - RNA, 17 nt, Mycobacterium avium subsp. paratuberculosis
ucguccaggguggccag

SEQ ID NO: 964628 - RNA, 18 nt, Mycobacterium avium subsp. paratuberculosis
ucguccaggugcacccgc

SEQ ID NO: 964629 - RNA, 13 nt, Mycobacterium avium subsp. paratuberculosis
ucguacagcagcc

SEQ ID NO: 964630 - RNA, 15 nt, Mycobacterium avium subsp. paratuberculosis
ucguacucccaggau

SEQ ID NO: 964631 - RNA, 19 nt, Mycobacterium avium subsp. paratuberculosis
ucguacucccaggccgcgg

SEQ ID NO: 964632 - RNA, 22 nt, Mycobacterium avium subsp. paratuberculosis
ucguacucccaggccgcggcca

SEQ ID NO: 964633 - RNA, 11 nt, Mycobacterium avium subsp. paratuberculosis
ucguaguugcg

SEQ ID NO: 964634 - RNA, 13 nt, Mycobacterium avium subsp. paratuberculosis
ucggucaccagcg

SEQ ID NO: 964635 - RNA, 13 nt, Mycobacterium avium subsp. paratuberculosis
ucggucaccagcu

SEQ ID NO: 964636 - RNA, 18 nt, Mycobacterium avium subsp. paratuberculosis
ucggucagcaccggggcc

SEQ ID NO: 964637 - RNA, 15 nt, Mycobacterium avium subsp. paratuberculosis
ucggucaccgagcgg

SEQ ID NO: 964638 - RNA, 12 nt, Mycobacterium avium subsp. paratuberculosis
ucggucagggug

SEQ ID NO: 964639 - RNA, 14 nt, Mycobacterium avium subsp. paratuberculosis
ucggucagcucgaa

SEQ ID NO: 964640 - RNA, 21 nt, Mycobacterium avium subsp. paratuberculosis
ucgguccagguggccaugggg

SEQ ID NO: 964641 - RNA, 16 nt, Mycobacterium avium subsp. paratuberculosis
ucgguccagguggggu

SEQ ID NO: 964642 - RNA, 12 nt, Mycobacterium avium subsp. paratuberculosis
ucggucccaguc

SEQ ID NO: 964643 - RNA, 13 nt, Mycobacterium avium subsp. paratuberculosis
ucggucugcaggu

SEQ ID NO: 964644 - RNA, 15 nt, Mycobacterium avium subsp. paratuberculosis
ucggucgccacggcc

SEQ ID NO: 964645 - RNA, 13 nt, Mycobacterium avium subsp. paratuberculosis
ucggucgccagca

SEQ ID NO: 964646 - RNA, 18 nt, Mycobacterium avium subsp. paratuberculosis
ucggucgggcagugcacg

SEQ ID NO: 964647 - RNA, 20 nt, Mycobacterium avium subsp. paratuberculosis
ucggucgcggcgaucggguc

SEQ ID NO: 964648 - RNA, 13 nt, Mycobacterium avium subsp. paratuberculosis
ucggugguggggc

SEQ ID NO: 964649 - RNA, 14 nt, Mycobacterium avium subsp. paratuberculosis
ucgguggggccgcc

SEQ ID NO: 964650 - RNA, 12 nt, Mycobacterium avium subsp. paratuberculosis
ucggugcccagc

SEQ ID NO: 964651 - RNA, 13 nt, Mycobacterium avium subsp. paratuberculosis
ucggugcccaggu

SEQ ID NO: 964652 - RNA, 23 nt, Mycobacterium avium subsp. paratuberculosis
ucggugccgaagcgccacggggc

SEQ ID NO: 964653 - RNA, 16 nt, Mycobacterium avium subsp. paratuberculosis
ucggugccgacggugc

SEQ ID NO: 964654 - RNA, 12 nt, Mycobacterium avium subsp. paratuberculosis
ucggugaugguc

SEQ ID NO: 964655 - RNA, 15 nt, Mycobacterium avium subsp. paratuberculosis
ucggugaucugcacc

SEQ ID NO: 964656 - RNA, 19 nt, Mycobacterium avium subsp. paratuberculosis
ucggugaucugcaccagcg

SEQ ID NO: 964657 - RNA, 16 nt, Mycobacterium avium subsp. paratuberculosis
ucggugaacugcagcc

SEQ ID NO: 964658 - RNA, 22 nt, Mycobacterium avium subsp. paratuberculosis
ucgguguacagcgccauguccu

SEQ ID NO: 964659 - RNA, 20 nt, Mycobacterium avium subsp. paratuberculosis
ucggugucuuugcccuugau

SEQ ID NO: 964660 - RNA, 18 nt, Mycobacterium avium subsp. paratuberculosis
ucggggcccggcccggcg

SEQ ID NO: 964661 - RNA, 14 nt, Mycobacterium avium subsp. paratuberculosis
ucgggccggcagcc

SEQ ID NO: 964662 - RNA, 17 nt, Mycobacterium avium subsp. paratuberculosis
ucgggccgggcgggcac

SEQ ID NO: 964663 - RNA, 22 nt, Mycobacterium avium subsp. paratuberculosis
ucgggcgcagaaaaaggccgcc

SEQ ID NO: 964664 - RNA, 15 nt, Mycobacterium avium subsp. paratuberculosis
ucgggcgccagcccg

SEQ ID NO: 964665 - RNA, 18 nt, Mycobacterium avium subsp. paratuberculosis
ucgggcgccagcccgccc

SEQ ID NO: 964666 - RNA, 15 nt, Mycobacterium avium subsp. paratuberculosis
ucgggcgcgcgcgcc

SEQ ID NO: 964667 - RNA, 18 nt, Mycobacterium avium subsp. paratuberculosis
ucgggcgcucggccagca

SEQ ID NO: 964668 - RNA, 20 nt, Mycobacterium avium subsp. paratuberculosis
ucgggcgucgcagaucccgc

SEQ ID NO: 964669 - RNA, 14 nt, Mycobacterium avium subsp. paratuberculosis
ucggggucggccga

SEQ ID NO: 964670 - RNA, 15 nt, Mycobacterium avium subsp. paratuberculosis
ucggggucgucgacg

SEQ ID NO: 964671 - RNA, 23 nt, Mycobacterium avium subsp. paratuberculosis
ucggggcaucgcagcgcgcggcg

SEQ ID NO: 964672 - RNA, 18 nt, Mycobacterium avium subsp. paratuberculosis
ucggggcgcagcccggcg

SEQ ID NO: 964673 - RNA, 16 nt, Mycobacterium avium subsp. paratuberculosis
ucggggcggaugugcc

SEQ ID NO: 964674 - RNA, 19 nt, Mycobacterium avium subsp. paratuberculosis
ucggggcgucggcggccuu

SEQ ID NO: 964675 - RNA, 20 nt, Mycobacterium avium subsp. paratuberculosis
ucggggcguggcggaagcgc

SEQ ID NO: 964676 - RNA, 23 nt, Mycobacterium avium subsp. paratuberculosis
ucggggguaaaccgccagcagcg

SEQ ID NO: 964677 - RNA, 18 nt, Mycobacterium avium subsp. paratuberculosis
ucggguccgaccagcacc

SEQ ID NO: 964678 - RNA, 14 nt, Mycobacterium avium subsp. paratuberculosis
ucgggucaccggcc

SEQ ID NO: 964679 - RNA, 19 nt, Mycobacterium avium subsp. paratuberculosis
ucggguaacccuccggcgc

SEQ ID NO: 964680 - RNA, 16 nt, Mycobacterium avium subsp. paratuberculosis
ucggguguggacggcg

SEQ ID NO: 964681 - RNA, 18 nt, Mycobacterium avium subsp. paratuberculosis
ucgggucggcgagcagcc

SEQ ID NO: 964682 - RNA, 21 nt, Mycobacterium avium subsp. paratuberculosis
ucgggugaguaguccagcacc

SEQ ID NO: 964683 - RNA, 17 nt, Mycobacterium avium subsp. paratuberculosis
ucgggacccuuguccag

SEQ ID NO: 964684 - RNA, 14 nt, Mycobacterium avium subsp. paratuberculosis
ucgggacgccugcc

SEQ ID NO: 964685 - RNA, 22 nt, Mycobacterium avium subsp. paratuberculosis
ucgggacgcggcaggcgcccca

SEQ ID NO: 964686 - RNA, 15 nt, Mycobacterium avium subsp. paratuberculosis
ucgggacggccagca

SEQ ID NO: 964687 - RNA, 16 nt, Mycobacterium avium subsp. paratuberculosis
ucgggacggccagcag

SEQ ID NO: 964688 - RNA, 20 nt, Mycobacterium avium subsp. paratuberculosis
ucgggacggccagcagggcg

SEQ ID NO: 964689 - RNA, 17 nt, Mycobacterium avium subsp. paratuberculosis
ucgggaaaucggaccca

SEQ ID NO: 964690 - RNA, 20 nt, Mycobacterium avium subsp. paratuberculosis
ucgggaaaucggacccagcc

SEQ ID NO: 964691 - RNA, 16 nt, Mycobacterium avium subsp. paratuberculosis
ucgggaacagcccgcc

SEQ ID NO: 964692 - RNA, 17 nt, Mycobacterium avium subsp. paratuberculosis
ucgggaacagcccgccc

SEQ ID NO: 964693 - RNA, 15 nt, Mycobacterium avium subsp. paratuberculosis
ucgggcaccacggcg

SEQ ID NO: 964694 - RNA, 13 nt, Mycobacterium avium subsp. paratuberculosis
ucgggcaccagca

SEQ ID NO: 964695 - RNA, 17 nt, Mycobacterium avium subsp. paratuberculosis
ucgggcaaucggaccca

SEQ ID NO: 964696 - RNA, 20 nt, Mycobacterium avium subsp. paratuberculosis
ucgggcaaucggacccagcc

SEQ ID NO: 964697 - RNA, 18 nt, Mycobacterium avium subsp. paratuberculosis
ucgggauccucgccgcgg

SEQ ID NO: 964698 - RNA, 21 nt, Mycobacterium avium subsp. paratuberculosis
ucgggaugucgugggcgugcc

SEQ ID NO: 964699 - RNA, 18 nt, Mycobacterium avium subsp. paratuberculosis
ucgggcaacgcgccggcg

SEQ ID NO: 964700 - RNA, 17 nt, Mycobacterium avium subsp. paratuberculosis
ucgggccacaacaaggu

SEQ ID NO: 964701 - RNA, 15 nt, Mycobacterium avium subsp. paratuberculosis
ucgggcccagcagcc

SEQ ID NO: 964702 - RNA, 16 nt, Mycobacterium avium subsp. paratuberculosis
ucgggcccgcgcaccg

SEQ ID NO: 964703 - RNA, 17 nt, Mycobacterium avium subsp. paratuberculosis
ucgggcagugcacgacg

SEQ ID NO: 964704 - RNA, 14 nt, Mycobacterium avium subsp. paratuberculosis
ucgggcagcagcac

SEQ ID NO: 964705 - RNA, 18 nt, Mycobacterium avium subsp. paratuberculosis
ucgggcacguccagcccg

SEQ ID NO: 964706 - RNA, 12 nt, Mycobacterium avium subsp. paratuberculosis
ucgggcaccgcc

SEQ ID NO: 964707 - RNA, 14 nt, Mycobacterium avium subsp. paratuberculosis
ucggcuagcggcug

SEQ ID NO: 964708 - RNA, 14 nt, Mycobacterium avium subsp. paratuberculosis
ucggcguuggucca

SEQ ID NO: 964709 - RNA, 17 nt, Mycobacterium avium subsp. paratuberculosis
ucggcuucguacggccc

SEQ ID NO: 964710 - RNA, 13 nt, Mycobacterium avium subsp. paratuberculosis
ucggcucggccgg

SEQ ID NO: 964711 - RNA, 21 nt, Mycobacterium avium subsp. paratuberculosis
ucggcuguggcgcacagaucg

SEQ ID NO: 964712 - RNA, 22 nt, Mycobacterium avium subsp. paratuberculosis
ucggcggucccgugcgccgccc

SEQ ID NO: 964713 - RNA, 21 nt, Mycobacterium avium subsp. paratuberculosis
ucggcggucugucgcgcgaac

SEQ ID NO: 964714 - RNA, 18 nt, Mycobacterium avium subsp. paratuberculosis
ucggcggugaugcgcgcc

SEQ ID NO: 964715 - RNA, 23 nt, Mycobacterium avium subsp. paratuberculosis
ucggcggggggagaggcgcggcg

SEQ ID NO: 964716 - RNA, 21 nt, Mycobacterium avium subsp. paratuberculosis
ucggcgcgcgcgccccagccc

SEQ ID NO: 964717 - RNA, 13 nt, Mycobacterium avium subsp. paratuberculosis
ucggcgggcaccu

SEQ ID NO: 964718 - RNA, 12 nt, Mycobacterium avium subsp. paratuberculosis
ucggcgggccgg

SEQ ID NO: 964719 - RNA, 15 nt, Mycobacterium avium subsp. paratuberculosis
ucggcguggcaggcg

SEQ ID NO: 964720 - RNA, 22 nt, Mycobacterium avium subsp. paratuberculosis
ucggcguggcgcucagcggcag

SEQ ID NO: 964721 - RNA, 19 nt, Mycobacterium avium subsp. paratuberculosis
ucggcgucgcggcgcaccc

SEQ ID NO: 964722 - RNA, 22 nt, Mycobacterium avium subsp. paratuberculosis
ucggcgucggccaccgcgccuu

SEQ ID NO: 964723 - RNA, 14 nt, Mycobacterium avium subsp. paratuberculosis
ucggcgucgggccg

SEQ ID NO: 964724 - RNA, 19 nt, Mycobacterium avium subsp. paratuberculosis
ucggcgucguacagcagcc

SEQ ID NO: 964725 - RNA, 16 nt, Mycobacterium avium subsp. paratuberculosis
ucggcgucacucuggc

SEQ ID NO: 964726 - RNA, 15 nt, Mycobacterium avium subsp. paratuberculosis
ucggcgucacugccc

SEQ ID NO: 964727 - RNA, 17 nt, Mycobacterium avium subsp. paratuberculosis
ucggcguagggcagccc

SEQ ID NO: 964728 - RNA, 16 nt, Mycobacterium avium subsp. paratuberculosis
ucggcgucgaacggcg

SEQ ID NO: 964729 - RNA, 22 nt, Mycobacterium avium subsp. paratuberculosis
ucggcgacgaccuucuggccuu

SEQ ID NO: 964730 - RNA, 23 nt, Mycobacterium avium subsp. paratuberculosis
ucggcgaugcgcaccaucaccug

SEQ ID NO: 964731 - RNA, 22 nt, Mycobacterium avium subsp. paratuberculosis
ucggcgaugcguugcgccagca

SEQ ID NO: 964732 - RNA, 14 nt, Mycobacterium avium subsp. paratuberculosis
ucggcgagguagac

SEQ ID NO: 964733 - RNA, 22 nt, Mycobacterium avium subsp. paratuberculosis
ucggcgaggucgucgagggcca

SEQ ID NO: 964734 - RNA, 17 nt, Mycobacterium avium subsp. paratuberculosis
ucggcgagugaggccga

SEQ ID NO: 964735 - RNA, 15 nt, Mycobacterium avium subsp. paratuberculosis
ucggcgaucggccgc

SEQ ID NO: 964736 - RNA, 19 nt, Mycobacterium avium subsp. paratuberculosis
ucggcgaucggccgcugcg

SEQ ID NO: 964737 - RNA, 17 nt, Mycobacterium avium subsp. paratuberculosis
ucggcgaucggcgugcc

SEQ ID NO: 964738 - RNA, 14 nt, Mycobacterium avium subsp. paratuberculosis
ucggcgccagcccg

SEQ ID NO: 964739 - RNA, 20 nt, Mycobacterium avium subsp. paratuberculosis
ucggcgccagcccgccgaac

SEQ ID NO: 964740 - RNA, 16 nt, Mycobacterium avium subsp. paratuberculosis
ucggcgccaccccggg

SEQ ID NO: 964741 - RNA, 13 nt, Mycobacterium avium subsp. paratuberculosis
ucggcgccacgac

SEQ ID NO: 964742 - RNA, 13 nt, Mycobacterium avium subsp. paratuberculosis
ucggcgccgaccu

SEQ ID NO: 964743 - RNA, 17 nt, Mycobacterium avium subsp. paratuberculosis
ucggcgccgaugcagca

SEQ ID NO: 964744 - RNA, 14 nt, Mycobacterium avium subsp. paratuberculosis
ucggcgccgccgag

SEQ ID NO: 964745 - RNA, 20 nt, Mycobacterium avium subsp. paratuberculosis
ucggcgccgcgcgccagcgc

SEQ ID NO: 964746 - RNA, 13 nt, Mycobacterium avium subsp. paratuberculosis
ucggcgccggccg

SEQ ID NO: 964747 - RNA, 21 nt, Mycobacterium avium subsp. paratuberculosis
ucggcgccggccgucacgcug

SEQ ID NO: 964748 - RNA, 16 nt, Mycobacterium avium subsp. paratuberculosis
ucggcggcggcgcgcc

SEQ ID NO: 964749 - RNA, 18 nt, Mycobacterium avium subsp. paratuberculosis
ucggcggcgccgucgucg

SEQ ID NO: 964750 - RNA, 18 nt, Mycobacterium avium subsp. paratuberculosis
ucggcggcgcggcccagg

SEQ ID NO: 964751 - RNA, 11 nt, Mycobacterium avium subsp. paratuberculosis
ucggcggccug

SEQ ID NO: 964752 - RNA, 15 nt, Mycobacterium avium subsp. paratuberculosis
ucggcggcgacggcg

SEQ ID NO: 964753 - RNA, 20 nt, Mycobacterium avium subsp. paratuberculosis
ucggcggcgacgugccggcg

SEQ ID NO: 964754 - RNA, 19 nt, Mycobacterium avium subsp. paratuberculosis
ucggcggcggccugcaccu

SEQ ID NO: 964755 - RNA, 16 nt, Mycobacterium avium subsp. paratuberculosis
ucggcggccccuucga

SEQ ID NO: 964756 - RNA, 22 nt, Mycobacterium avium subsp. paratuberculosis
ucggcggaggcgaaugcggcca

SEQ ID NO: 964757 - RNA, 15 nt, Mycobacterium avium subsp. paratuberculosis
ucggcggcaccgccc

SEQ ID NO: 964758 - RNA, 21 nt, Mycobacterium avium subsp. paratuberculosis
ucggcggcgaggacgucgucg

SEQ ID NO: 964759 - RNA, 22 nt, Mycobacterium avium subsp. paratuberculosis
ucggcggacuggcugagcagca

SEQ ID NO: 964760 - RNA, 13 nt, Mycobacterium avium subsp. paratuberculosis
ucggagacccgcc

SEQ ID NO: 964761 - RNA, 18 nt, Mycobacterium avium subsp. paratuberculosis
ucggaguccagcacgccc

SEQ ID NO: 964762 - RNA, 17 nt, Mycobacterium avium subsp. paratuberculosis
ucggagucgcuguuggc

SEQ ID NO: 964763 - RNA, 20 nt, Mycobacterium avium subsp. paratuberculosis
ucggagaucaccggcacccc

SEQ ID NO: 964764 - RNA, 21 nt, Mycobacterium avium subsp. paratuberculosis
ucggaguaguccagcaccgcc

SEQ ID NO: 964765 - RNA, 21 nt, Mycobacterium avium subsp. paratuberculosis
ucgcuggggugcccaccagca

SEQ ID NO: 964766 - RNA, 13 nt, Mycobacterium avium subsp. paratuberculosis
ucgcugugcagcg

SEQ ID NO: 964767 - RNA, 15 nt, Mycobacterium avium subsp. paratuberculosis
ucgcuguuggcgacg

SEQ ID NO: 964768 - RNA, 21 nt, Mycobacterium avium subsp. paratuberculosis
ucgcgcagggucagcgcuucc

SEQ ID NO: 964769 - RNA, 22 nt, Mycobacterium avium subsp. paratuberculosis
ucgcugcucaugagcccuccag

SEQ ID NO: 964770 - RNA, 20 nt, Mycobacterium avium subsp. paratuberculosis
ucgcugcgauugguggcccg

SEQ ID NO: 964771 - RNA, 23 nt, Mycobacterium avium subsp. paratuberculosis
ucgcugcgauugguggcccgguc

SEQ ID NO: 964772 - RNA, 22 nt, Mycobacterium avium subsp. paratuberculosis
ucgcgcaggaacuccagcagcu

SEQ ID NO: 964773 - RNA, 13 nt, Mycobacterium avium subsp. paratuberculosis
ucgcugcggcgca

SEQ ID NO: 964774 - RNA, 23 nt, Mycobacterium avium subsp. paratuberculosis
ucgcgcacuucgcgggcggcgca

SEQ ID NO: 964775 - RNA, 16 nt, Mycobacterium avium subsp. paratuberculosis
ucgcgcacgcuggccg

SEQ ID NO: 964776 - RNA, 19 nt, Mycobacterium avium subsp. paratuberculosis
ucgcgcagcgucaucgcgu

SEQ ID NO: 964777 - RNA, 13 nt, Mycobacterium avium subsp. paratuberculosis
ucgcgcagcgcgu

SEQ ID NO: 964778 - RNA, 23 nt, Mycobacterium avium subsp. paratuberculosis
ucgcgcagcauggcccacaggac

SEQ ID NO: 964779 - RNA, 10 nt, Mycobacterium avium subsp. paratuberculosis
ucgcgcaccg

SEQ ID NO: 964780 - RNA, 17 nt, Mycobacterium avium subsp. paratuberculosis
ucggaugaccaagcccc

SEQ ID NO: 964781 - RNA, 14 nt, Mycobacterium avium subsp. paratuberculosis
ucggccaccaccuc

SEQ ID NO: 964782 - RNA, 19 nt, Mycobacterium avium subsp. paratuberculosis
ucggccagaucggccaggu

SEQ ID NO: 964783 - RNA, 15 nt, Mycobacterium avium subsp. paratuberculosis
ucggcccccgggccc

SEQ ID NO: 964784 - RNA, 18 nt, Mycobacterium avium subsp. paratuberculosis
ucggccaucagcaccgaa

SEQ ID NO: 964785 - RNA, 13 nt, Mycobacterium avium subsp. paratuberculosis
ucggccaucagcc

SEQ ID NO: 964786 - RNA, 22 nt, Mycobacterium avium subsp. paratuberculosis
ucggccaucccggugccgcugg

SEQ ID NO: 964787 - RNA, 16 nt, Mycobacterium avium subsp. paratuberculosis
ucggccaucgacucca

SEQ ID NO: 964788 - RNA, 15 nt, Mycobacterium avium subsp. paratuberculosis
ucggccagcuggucg

SEQ ID NO: 964789 - RNA, 14 nt, Mycobacterium avium subsp. paratuberculosis
ucggccagcgggug

SEQ ID NO: 964790 - RNA, 14 nt, Mycobacterium avium subsp. paratuberculosis
ucggccagcgguug

SEQ ID NO: 964791 - RNA, 11 nt, Mycobacterium avium subsp. paratuberculosis
ucggccagcgc

SEQ ID NO: 964792 - RNA, 20 nt, Mycobacterium avium subsp. paratuberculosis
ucggccagccacgccgacac

SEQ ID NO: 964793 - RNA, 15 nt, Mycobacterium avium subsp. paratuberculosis
ucggccagccacucc

SEQ ID NO: 964794 - RNA, 19 nt, Mycobacterium avium subsp. paratuberculosis
ucggccagccacuccaggg

SEQ ID NO: 964795 - RNA, 13 nt, Mycobacterium avium subsp. paratuberculosis
ucggccagcagca

SEQ ID NO: 964796 - RNA, 14 nt, Mycobacterium avium subsp. paratuberculosis
ucggccucaggcgu

SEQ ID NO: 964797 - RNA, 17 nt, Mycobacterium avium subsp. paratuberculosis
ucggccuccagccggcg

SEQ ID NO: 964798 - RNA, 16 nt, Mycobacterium avium subsp. paratuberculosis
ucggccggguccugga

SEQ ID NO: 964799 - RNA, 14 nt, Mycobacterium avium subsp. paratuberculosis
ucggccgggcugcc

SEQ ID NO: 964800 - RNA, 16 nt, Mycobacterium avium subsp. paratuberculosis
ucggccgcggccggcg

SEQ ID NO: 964801 - RNA, 23 nt, Mycobacterium avium subsp. paratuberculosis
ucggccgcggggccggcgcuggc

SEQ ID NO: 964802 - RNA, 16 nt, Mycobacterium avium subsp. paratuberculosis
ucggccgcgugcaccu

SEQ ID NO: 964803 - RNA, 18 nt, Mycobacterium avium subsp. paratuberculosis
ucggccggcaggccgccc

SEQ ID NO: 964804 - RNA, 15 nt, Mycobacterium avium subsp. paratuberculosis
ucggccgccagggcc

SEQ ID NO: 964805 - RNA, 14 nt, Mycobacterium avium subsp. paratuberculosis
ucggcccgccaccc

SEQ ID NO: 964806 - RNA, 20 nt, Mycobacterium avium subsp. paratuberculosis
ucggcccgccacccgaggcc

SEQ ID NO: 964807 - RNA, 19 nt, Mycobacterium avium subsp. paratuberculosis
ucggccuuggccaccgccu

SEQ ID NO: 964808 - RNA, 22 nt, Mycobacterium avium subsp. paratuberculosis
ucggccgugaucucgugccgca

SEQ ID NO: 964809 - RNA, 15 nt, Mycobacterium avium subsp. paratuberculosis
ucggccugcacgucg

SEQ ID NO: 964810 - RNA, 14 nt, Mycobacterium avium subsp. paratuberculosis
ucggcgaccaugcc

SEQ ID NO: 964811 - RNA, 21 nt, Mycobacterium avium subsp. paratuberculosis
ucggcgaccgccgguggggug

SEQ ID NO: 964812 - RNA, 16 nt, Mycobacterium avium subsp. paratuberculosis
ucggcgacgauggcca

SEQ ID NO: 964813 - RNA, 15 nt, Mycobacterium avium subsp. paratuberculosis
ucggcgagcaaggcg

SEQ ID NO: 964814 - RNA, 18 nt, Mycobacterium avium subsp. paratuberculosis
ucggcgagcaccgugccg

SEQ ID NO: 964815 - RNA, 13 nt, Mycobacterium avium subsp. paratuberculosis
ucggcgagcagca

SEQ ID NO: 964816 - RNA, 21 nt, Mycobacterium avium subsp. paratuberculosis
ucggcgagcagcugcagcguc

SEQ ID NO: 964817 - RNA, 21 nt, Mycobacterium avium subsp. paratuberculosis
ucggcgaaggugccccgcugg

SEQ ID NO: 964818 - RNA, 17 nt, Mycobacterium avium subsp. paratuberculosis
ucgccguugccggcccg

SEQ ID NO: 964819 - RNA, 19 nt, Mycobacterium avium subsp. paratuberculosis
ucgccguuuugccgccgag

SEQ ID NO: 964820 - RNA, 17 nt, Mycobacterium avium subsp. paratuberculosis
ucgccguggcggcccga

SEQ ID NO: 964821 - RNA, 13 nt, Mycobacterium avium subsp. paratuberculosis
ucgccgugcagca

SEQ ID NO: 964822 - RNA, 14 nt, Mycobacterium avium subsp. paratuberculosis
ucgccguccacggg

SEQ ID NO: 964823 - RNA, 21 nt, Mycobacterium avium subsp. paratuberculosis
ucgccgucgaaggccgggcug

SEQ ID NO: 964824 - RNA, 21 nt, Mycobacterium avium subsp. paratuberculosis
ucgccgucgucagccgggcca

SEQ ID NO: 964825 - RNA, 21 nt, Mycobacterium avium subsp. paratuberculosis
ucgccggacagcgggccgacc

SEQ ID NO: 964826 - RNA, 21 nt, Mycobacterium avium subsp. paratuberculosis
ucgccggagagcccgucgucg

SEQ ID NO: 964827 - RNA, 16 nt, Mycobacterium avium subsp. paratuberculosis
ucgccggaucgccgag

SEQ ID NO: 964828 - RNA, 18 nt, Mycobacterium avium subsp. paratuberculosis
ucgccggaucgccgaggu

SEQ ID NO: 964829 - RNA, 18 nt, Mycobacterium avium subsp. paratuberculosis
ucgccggugaccgcgccg

SEQ ID NO: 964830 - RNA, 16 nt, Mycobacterium avium subsp. paratuberculosis
ucgccggugugcagcc

SEQ ID NO: 964831 - RNA, 15 nt, Mycobacterium avium subsp. paratuberculosis
ucgcgcaccgcggcg

SEQ ID NO: 964832 - RNA, 19 nt, Mycobacterium avium subsp. paratuberculosis
ucgcgcaccuucccggccg

SEQ ID NO: 964833 - RNA, 21 nt, Mycobacterium avium subsp. paratuberculosis
ucgccgagucgaucgccagcg

SEQ ID NO: 964834 - RNA, 17 nt, Mycobacterium avium subsp. paratuberculosis
ucgccgaucagcaccag

SEQ ID NO: 964835 - RNA, 16 nt, Mycobacterium avium subsp. paratuberculosis
ucgccgauccagccgu

SEQ ID NO: 964836 - RNA, 17 nt, Mycobacterium avium subsp. paratuberculosis
ucgccgauccggcgccg

SEQ ID NO: 964837 - RNA, 21 nt, Mycobacterium avium subsp. paratuberculosis
ucgccgagccguaggccaggu

SEQ ID NO: 964838 - RNA, 15 nt, Mycobacterium avium subsp. paratuberculosis
ucgccgaccuuggcg

SEQ ID NO: 964839 - RNA, 18 nt, Mycobacterium avium subsp. paratuberculosis
ucgccgagccgcaccgcc

SEQ ID NO: 964840 - RNA, 21 nt, Mycobacterium avium subsp. paratuberculosis
ucgccgaccagccgaggcgcu

SEQ ID NO: 964841 - RNA, 18 nt, Mycobacterium avium subsp. paratuberculosis
ucgccgacgccagcacgu

SEQ ID NO: 964842 - RNA, 17 nt, Mycobacterium avium subsp. paratuberculosis
ucgccgaaccggggccg

SEQ ID NO: 964843 - RNA, 17 nt, Mycobacterium avium subsp. paratuberculosis
ucgccgaacgccaccac

SEQ ID NO: 964844 - RNA, 21 nt, Mycobacterium avium subsp. paratuberculosis
ucgccgaacgugcgcggcgcg

SEQ ID NO: 964845 - RNA, 13 nt, Mycobacterium avium subsp. paratuberculosis
ucgccgcgcgcgu

SEQ ID NO: 964846 - RNA, 16 nt, Mycobacterium avium subsp. paratuberculosis
ucgccgcgcccagcac

SEQ ID NO: 964847 - RNA, 21 nt, Mycobacterium avium subsp. paratuberculosis
ucgccgaugucggccgguccg

SEQ ID NO: 964848 - RNA, 21 nt, Mycobacterium avium subsp. paratuberculosis
ucgccgccaaggggaacaacg

SEQ ID NO: 964849 - RNA, 18 nt, Mycobacterium avium subsp. paratuberculosis
ucgccggaauggcaaggc

SEQ ID NO: 964850 - RNA, 22 nt, Mycobacterium avium subsp. paratuberculosis
ucgccgcgcucaacccgggccg

SEQ ID NO: 964851 - RNA, 15 nt, Mycobacterium avium subsp. paratuberculosis
ucgccaucagcagcg

SEQ ID NO: 964852 - RNA, 19 nt, Mycobacterium avium subsp. paratuberculosis
ucgccaugcuggcacuccu

SEQ ID NO: 964853 - RNA, 15 nt, Mycobacterium avium subsp. paratuberculosis
ucgccaugccgucgc

SEQ ID NO: 964854 - RNA, 15 nt, Mycobacterium avium subsp. paratuberculosis
ucgccccgcuggaac

SEQ ID NO: 964855 - RNA, 19 nt, Mycobacterium avium subsp. paratuberculosis
ucgccccggagaugguggc

SEQ ID NO: 964856 - RNA, 14 nt, Mycobacterium avium subsp. paratuberculosis
ucgcccaucaccag

SEQ ID NO: 964857 - RNA, 21 nt, Mycobacterium avium subsp. paratuberculosis
ucgcccaucaccagcagaccc

SEQ ID NO: 964858 - RNA, 16 nt, Mycobacterium avium subsp. paratuberculosis
ucgcccagugcgcgcc

SEQ ID NO: 964859 - RNA, 19 nt, Mycobacterium avium subsp. paratuberculosis
ucgcccacccgcacgcccg

SEQ ID NO: 964860 - RNA, 18 nt, Mycobacterium avium subsp. paratuberculosis
ucgcccacccgccagccc

SEQ ID NO: 964861 - RNA, 17 nt, Mycobacterium avium subsp. paratuberculosis
ucgcccagcgcggcggc

SEQ ID NO: 964862 - RNA, 21 nt, Mycobacterium avium subsp. paratuberculosis
ucgcccagggcgugcgcggcc

SEQ ID NO: 964863 - RNA, 12 nt, Mycobacterium avium subsp. paratuberculosis
ucgcccuccccg

SEQ ID NO: 964864 - RNA, 14 nt, Mycobacterium avium subsp. paratuberculosis
ucgcccuccccggc

SEQ ID NO: 964865 - RNA, 17 nt, Mycobacterium avium subsp. paratuberculosis
ucgcccuggauauccag

SEQ ID NO: 964866 - RNA, 16 nt, Mycobacterium avium subsp. paratuberculosis
ucgcccggcgcccggc

SEQ ID NO: 964867 - RNA, 22 nt, Mycobacterium avium subsp. paratuberculosis
ucgcccggcguccagugcaugc

SEQ ID NO: 964868 - RNA, 18 nt, Mycobacterium avium subsp. paratuberculosis
ucgcccgggcggcggggc

SEQ ID NO: 964869 - RNA, 19 nt, Mycobacterium avium subsp. paratuberculosis
ucgcccgcgucguggcccu

SEQ ID NO: 964870 - RNA, 22 nt, Mycobacterium avium subsp. paratuberculosis
ucgcaggugccggugacgguca

SEQ ID NO: 964871 - RNA, 18 nt, Mycobacterium avium subsp. paratuberculosis
ucgcagguucgacacgcc

SEQ ID NO: 964872 - RNA, 15 nt, Mycobacterium avium subsp. paratuberculosis
ucgcacaaccgggcc

SEQ ID NO: 964873 - RNA, 18 nt, Mycobacterium avium subsp. paratuberculosis
ucgcacaccagcacggcg

SEQ ID NO: 964874 - RNA, 14 nt, Mycobacterium avium subsp. paratuberculosis
ucgcacagcaccag

SEQ ID NO: 964875 - RNA, 14 nt, Mycobacterium avium subsp. paratuberculosis
ucgcacagccggcg

SEQ ID NO: 964876 - RNA, 22 nt, Mycobacterium avium subsp. paratuberculosis
ucgcacaggaugcccaacagcu

SEQ ID NO: 964877 - RNA, 11 nt, Mycobacterium avium subsp. paratuberculosis
ucgcaccagcg

SEQ ID NO: 964878 - RNA, 20 nt, Mycobacterium avium subsp. paratuberculosis
ucgaugaauuccggugugcc

SEQ ID NO: 964879 - RNA, 19 nt, Mycobacterium avium subsp. paratuberculosis
ucgaugaccucgcgcagcc

SEQ ID NO: 964880 - RNA, 16 nt, Mycobacterium avium subsp. paratuberculosis
ucgaucugggccagga

SEQ ID NO: 964881 - RNA, 17 nt, Mycobacterium avium subsp. paratuberculosis
ucgaucugggccaggau

SEQ ID NO: 964882 - RNA, 17 nt, Mycobacterium avium subsp. paratuberculosis
ucgcaagcagagcagcg

SEQ ID NO: 964883 - RNA, 19 nt, Mycobacterium avium subsp. paratuberculosis
ucgaguuccuccacgacuu

SEQ ID NO: 964884 - RNA, 19 nt, Mycobacterium avium subsp. paratuberculosis
ucgagucccgcgcggcgca

SEQ ID NO: 964885 - RNA, 21 nt, Mycobacterium avium subsp. paratuberculosis
ucgaguaggcgaccacaccgc

SEQ ID NO: 964886 - RNA, 22 nt, Mycobacterium avium subsp. paratuberculosis
ucgaguaccucgcuguaggcca

SEQ ID NO: 964887 - RNA, 15 nt, Mycobacterium avium subsp. paratuberculosis
ucgaggucggccagc

SEQ ID NO: 964888 - RNA, 16 nt, Mycobacterium avium subsp. paratuberculosis
ucgauaguggcgucca

SEQ ID NO: 964889 - RNA, 16 nt, Mycobacterium avium subsp. paratuberculosis
ucgaucagagcgggcc

SEQ ID NO: 964890 - RNA, 20 nt, Mycobacterium avium subsp. paratuberculosis
ucgaucaccucgaccgugag

SEQ ID NO: 964891 - RNA, 14 nt, Mycobacterium avium subsp. paratuberculosis
ucgacgccaugggc

SEQ ID NO: 964892 - RNA, 17 nt, Mycobacterium avium subsp. paratuberculosis
ucgacgcccugccacag

SEQ ID NO: 964893 - RNA, 19 nt, Mycobacterium avium subsp. paratuberculosis
ucgacgcccugccacagcg

SEQ ID NO: 964894 - RNA, 15 nt, Mycobacterium avium subsp. paratuberculosis
ucgacgccgcugccg

SEQ ID NO: 964895 - RNA, 15 nt, Mycobacterium avium subsp. paratuberculosis
ucgacgccgggcucg

SEQ ID NO: 964896 - RNA, 17 nt, Mycobacterium avium subsp. paratuberculosis
ucgacgccgugcugccg

SEQ ID NO: 964897 - RNA, 15 nt, Mycobacterium avium subsp. paratuberculosis
ucgacggcacccggc

SEQ ID NO: 964898 - RNA, 18 nt, Mycobacterium avium subsp. paratuberculosis
ucgacgcguuacacccau

SEQ ID NO: 964899 - RNA, 21 nt, Mycobacterium avium subsp. paratuberculosis
ucgacgcggggcggcggcgcc

SEQ ID NO: 964900 - RNA, 19 nt, Mycobacterium avium subsp. paratuberculosis
ucgaggcccucgacaccgg

SEQ ID NO: 964901 - RNA, 19 nt, Mycobacterium avium subsp. paratuberculosis
ucgaggaucgcggccacgc

SEQ ID NO: 964902 - RNA, 15 nt, Mycobacterium avium subsp. paratuberculosis
ucgaggaauccgguc

SEQ ID NO: 964903 - RNA, 15 nt, Mycobacterium avium subsp. paratuberculosis
ucgagggggucauca

SEQ ID NO: 964904 - RNA, 13 nt, Mycobacterium avium subsp. paratuberculosis
ucgagggccaccg

SEQ ID NO: 964905 - RNA, 20 nt, Mycobacterium avium subsp. paratuberculosis
ucgagggccaccggcuccuu

SEQ ID NO: 964906 - RNA, 18 nt, Mycobacterium avium subsp. paratuberculosis
ucgagggcguccuuccaa

SEQ ID NO: 964907 - RNA, 18 nt, Mycobacterium avium subsp. paratuberculosis
ucgaggcgaucaucgccc

SEQ ID NO: 964908 - RNA, 23 nt, Mycobacterium avium subsp. paratuberculosis
ucgaggccgcgggcguucaucac

SEQ ID NO: 964909 - RNA, 15 nt, Mycobacterium avium subsp. paratuberculosis
ucgaggccggccagc

SEQ ID NO: 964910 - RNA, 19 nt, Mycobacterium avium subsp. paratuberculosis
ucgaggccguaucccacca

SEQ ID NO: 964911 - RNA, 18 nt, Mycobacterium avium subsp. paratuberculosis
uccuuggggcugaccucg

SEQ ID NO: 964912 - RNA, 20 nt, Mycobacterium avium subsp. paratuberculosis
uccuuggggcugaccucgcc

SEQ ID NO: 964913 - RNA, 12 nt, Mycobacterium avium subsp. paratuberculosis
ucgaaucacaag

SEQ ID NO: 964914 - RNA, 16 nt, Mycobacterium avium subsp. paratuberculosis
ucgaccucggccacca

SEQ ID NO: 964915 - RNA, 17 nt, Mycobacterium avium subsp. paratuberculosis
ucgaccucggccaccac

SEQ ID NO: 964916 - RNA, 18 nt, Mycobacterium avium subsp. paratuberculosis
ucgaccgcggcgccgaug

SEQ ID NO: 964917 - RNA, 19 nt, Mycobacterium avium subsp. paratuberculosis
ucgaccggcaccagcagcc

SEQ ID NO: 964918 - RNA, 17 nt, Mycobacterium avium subsp. paratuberculosis
ucgaccggcggaaguag

SEQ ID NO: 964919 - RNA, 20 nt, Mycobacterium avium subsp. paratuberculosis
ucgaccgucacgcuggcgug

SEQ ID NO: 964920 - RNA, 15 nt, Mycobacterium avium subsp. paratuberculosis
ucgaccgccgcgaac

SEQ ID NO: 964921 - RNA, 18 nt, Mycobacterium avium subsp. paratuberculosis
ucgaacccgaaaagcacc

SEQ ID NO: 964922 - RNA, 16 nt, Mycobacterium avium subsp. paratuberculosis
ucgaaccggggcacca

SEQ ID NO: 964923 - RNA, 14 nt, Mycobacterium avium subsp. paratuberculosis
ucgaacagcgcgcc

SEQ ID NO: 964924 - RNA, 13 nt, Mycobacterium avium subsp. paratuberculosis
ucgaacaggaugc

SEQ ID NO: 964925 - RNA, 21 nt, Mycobacterium avium subsp. paratuberculosis
ucgaacggcggaaccgggccg

SEQ ID NO: 964926 - RNA, 13 nt, Mycobacterium avium subsp. paratuberculosis
uccugcuggcgcu

SEQ ID NO: 964927 - RNA, 17 nt, Mycobacterium avium subsp. paratuberculosis
uccugcuggcgcugcca

SEQ ID NO: 964928 - RNA, 18 nt, Mycobacterium avium subsp. paratuberculosis
uccugcuggcgcugccag

SEQ ID NO: 964929 - RNA, 15 nt, Mycobacterium avium subsp. paratuberculosis
uccuggaugaacagc

SEQ ID NO: 964930 - RNA, 17 nt, Mycobacterium avium subsp. paratuberculosis
uccuggaugaacagcac

SEQ ID NO: 964931 - RNA, 13 nt, Mycobacterium avium subsp. paratuberculosis
uccuggccgccgu

SEQ ID NO: 964932 - RNA, 20 nt, Mycobacterium avium subsp. paratuberculosis
ucagcgagcgguuggcgacg

SEQ ID NO: 964933 - RNA, 19 nt, Mycobacterium avium subsp. paratuberculosis
ucagcgacucgaccccgcc

SEQ ID NO: 964934 - RNA, 21 nt, Mycobacterium avium subsp. paratuberculosis
uccugcagcucgccggcgcgc

SEQ ID NO: 964935 - RNA, 12 nt, Mycobacterium avium subsp. paratuberculosis
uccugcaggcag

SEQ ID NO: 964936 - RNA, 20 nt, Mycobacterium avium subsp. paratuberculosis
uccugcaggcaggccggcag

SEQ ID NO: 964937 - RNA, 16 nt, Mycobacterium avium subsp. paratuberculosis
uccuugcggccgccga

SEQ ID NO: 964938 - RNA, 15 nt, Mycobacterium avium subsp. paratuberculosis
uccuugagccgccgc

SEQ ID NO: 964939 - RNA, 19 nt, Mycobacterium avium subsp. paratuberculosis
uccuuaaucgggacguuga

SEQ ID NO: 964940 - RNA, 18 nt, Mycobacterium avium subsp. paratuberculosis
ugaaguacccggucugau

SEQ ID NO: 964941 - RNA, 21 nt, Mycobacterium avium subsp. paratuberculosis
ugaaguccggcggucgcugca

SEQ ID NO: 964942 - RNA, 19 nt, Mycobacterium avium subsp. paratuberculosis
ugaaguuaacuucacgcuc

SEQ ID NO: 964943 - RNA, 19 nt, Mycobacterium avium subsp. paratuberculosis
ugaaguuaguuucacgcug

SEQ ID NO: 964944 - RNA, 11 nt, Mycobacterium avium subsp. paratuberculosis
ugaagcccugc

SEQ ID NO: 964945 - RNA, 19 nt, Mycobacterium avium subsp. paratuberculosis
ugaagccggcgaacuccac

SEQ ID NO: 964946 - RNA, 15 nt, Mycobacterium avium subsp. paratuberculosis
ugaagcccaccgccg

SEQ ID NO: 964947 - RNA, 17 nt, Mycobacterium avium subsp. paratuberculosis
ugaagaucagcaccguc

SEQ ID NO: 964948 - RNA, 18 nt, Mycobacterium avium subsp. paratuberculosis
ugaagaucagcaccgucc

SEQ ID NO: 964949 - RNA, 18 nt, Mycobacterium avium subsp. paratuberculosis
ugaagaucagcgaaggca

SEQ ID NO: 964950 - RNA, 22 nt, Mycobacterium avium subsp. paratuberculosis
ugaagaucagcgaaggcauggg

SEQ ID NO: 964951 - RNA, 15 nt, Mycobacterium avium subsp. paratuberculosis
ugaagaucagcgcgu

SEQ ID NO: 964952 - RNA, 20 nt, Mycobacterium avium subsp. paratuberculosis
ugaagcacaccguucccacc

SEQ ID NO: 964953 - RNA, 17 nt, Mycobacterium avium subsp. paratuberculosis
ugaagcuggccaccgca

SEQ ID NO: 964954 - RNA, 21 nt, Mycobacterium avium subsp. paratuberculosis
ugaaggacuggcccacgcagc

SEQ ID NO: 964955 - RNA, 19 nt, Mycobacterium avium subsp. paratuberculosis
ugaagcuaguuucacgcuc

SEQ ID NO: 964956 - RNA, 15 nt, Mycobacterium avium subsp. paratuberculosis
ugaagcugccgacca

SEQ ID NO: 964957 - RNA, 18 nt, Mycobacterium avium subsp. paratuberculosis
ugaagcugccgaccagga

SEQ ID NO: 964958 - RNA, 17 nt, Mycobacterium avium subsp. paratuberculosis
ugaagcgggacagcaau

SEQ ID NO: 964959 - RNA, 19 nt, Mycobacterium avium subsp. paratuberculosis
ugaagguuguucugcucga

SEQ ID NO: 964960 - RNA, 18 nt, Mycobacterium avium subsp. paratuberculosis
ugaaggccuggaugccgc

SEQ ID NO: 964961 - RNA, 18 nt, Mycobacterium avium subsp. paratuberculosis
ugaaggcgaacaccagcc

SEQ ID NO: 964962 - RNA, 16 nt, Mycobacterium avium subsp. paratuberculosis
ugaacucgccgaucgg

SEQ ID NO: 964963 - RNA, 14 nt, Mycobacterium avium subsp. paratuberculosis
ugaacuguuuuucc

SEQ ID NO: 964964 - RNA, 14 nt, Mycobacterium avium subsp. paratuberculosis
ugaacgggaugaac

SEQ ID NO: 964965 - RNA, 21 nt, Mycobacterium avium subsp. paratuberculosis
ugaacgucccguuggucucga

SEQ ID NO: 964966 - RNA, 15 nt, Mycobacterium avium subsp. paratuberculosis
ugaacgcggccaggg

SEQ ID NO: 964967 - RNA, 19 nt, Mycobacterium avium subsp. paratuberculosis
ugaacgccgccaacagguu

SEQ ID NO: 964968 - RNA, 16 nt, Mycobacterium avium subsp. paratuberculosis
ugaacgccucgggccg

SEQ ID NO: 964969 - RNA, 16 nt, Mycobacterium avium subsp. paratuberculosis
ugacggcggcggugcc

SEQ ID NO: 964970 - RNA, 17 nt, Mycobacterium avium subsp. paratuberculosis
ugacgccgcggugcagc

SEQ ID NO: 964971 - RNA, 18 nt, Mycobacterium avium subsp. paratuberculosis
ugacgccgcucggccagc

SEQ ID NO: 964972 - RNA, 15 nt, Mycobacterium avium subsp. paratuberculosis
ugacgccgccgaacc

SEQ ID NO: 964973 - RNA, 18 nt, Mycobacterium avium subsp. paratuberculosis
ugacgccgaugugcucgg

SEQ ID NO: 964974 - RNA, 15 nt, Mycobacterium avium subsp. paratuberculosis
ugacgacggccaccg

SEQ ID NO: 964975 - RNA, 22 nt, Mycobacterium avium subsp. paratuberculosis
ugacgaugucgaugacggcggc

SEQ ID NO: 964976 - RNA, 15 nt, Mycobacterium avium subsp. paratuberculosis
ugacgcaucaccacg

SEQ ID NO: 964977 - RNA, 17 nt, Mycobacterium avium subsp. paratuberculosis
ugacgcccggcgccggc

SEQ ID NO: 964978 - RNA, 16 nt, Mycobacterium avium subsp. paratuberculosis
ugacgcccuuguccuc

SEQ ID NO: 964979 - RNA, 19 nt, Mycobacterium avium subsp. paratuberculosis
ugacgcccuuguccucgag

SEQ ID NO: 964980 - RNA, 23 nt, Mycobacterium avium subsp. paratuberculosis
ugacgccgacguaggacagcacc

SEQ ID NO: 964981 - RNA, 14 nt, Mycobacterium avium subsp. paratuberculosis
ugacgccgagcagc

SEQ ID NO: 964982 - RNA, 21 nt, Mycobacterium avium subsp. paratuberculosis
ugaccgccgccauccgcgccg

SEQ ID NO: 964983 - RNA, 19 nt, Mycobacterium avium subsp. paratuberculosis
ugaccgccugcuugaugau

SEQ ID NO: 964984 - RNA, 18 nt, Mycobacterium avium subsp. paratuberculosis
ugaccuugucgaagguga

SEQ ID NO: 964985 - RNA, 13 nt, Mycobacterium avium subsp. paratuberculosis
ugacgaacagacu

SEQ ID NO: 964986 - RNA, 16 nt, Mycobacterium avium subsp. paratuberculosis
ugacaucgccaccugg

SEQ ID NO: 964987 - RNA, 21 nt, Mycobacterium avium subsp. paratuberculosis
ugacaugauggacuucgcagg

SEQ ID NO: 964988 - RNA, 14 nt, Mycobacterium avium subsp. paratuberculosis
ugaccagcagcugg

SEQ ID NO: 964989 - RNA, 20 nt, Mycobacterium avium subsp. paratuberculosis
ugaccagcccgcucagagcu

SEQ ID NO: 964990 - RNA, 12 nt, Mycobacterium avium subsp. paratuberculosis
ugaccagcgccc

SEQ ID NO: 964991 - RNA, 14 nt, Mycobacterium avium subsp. paratuberculosis
ugaccagcggcgcg

SEQ ID NO: 964992 - RNA, 16 nt, Mycobacterium avium subsp. paratuberculosis
ugaccagcggcgcgcc

SEQ ID NO: 964993 - RNA, 17 nt, Mycobacterium avium subsp. paratuberculosis
ugaccagcggcgcgccg

SEQ ID NO: 964994 - RNA, 18 nt, Mycobacterium avium subsp. paratuberculosis
ugaccaacgccgccuccg

SEQ ID NO: 964995 - RNA, 20 nt, Mycobacterium avium subsp. paratuberculosis
ugaccagaccgaagaucacc

SEQ ID NO: 964996 - RNA, 18 nt, Mycobacterium avium subsp. paratuberculosis
ugaccgagcggcgcugca

SEQ ID NO: 964997 - RNA, 18 nt, Mycobacterium avium subsp. paratuberculosis
ugaccgccauugucauca

SEQ ID NO: 964998 - RNA, 23 nt, Mycobacterium avium subsp. paratuberculosis
ugaccgccauugucaucauggug

SEQ ID NO: 964999 - RNA, 14 nt, Mycobacterium avium subsp. paratuberculosis
ugaccgcagccuuc

SEQ ID NO: 965000 - RNA, 21 nt, Mycobacterium avium subsp. paratuberculosis
ugacccgggcggccugcugca

SEQ ID NO: 965001 - RNA, 17 nt, Mycobacterium avium subsp. paratuberculosis
ugacccggucgcggccg

SEQ ID NO: 965002 - RNA, 19 nt, Mycobacterium avium subsp. paratuberculosis
ugacccggucgcggccgua

SEQ ID NO: 965003 - RNA, 21 nt, Mycobacterium avium subsp. paratuberculosis
ugacccggccgcacaccacca

SEQ ID NO: 965004 - RNA, 13 nt, Mycobacterium avium subsp. paratuberculosis
ugacccucagcag

SEQ ID NO: 965005 - RNA, 16 nt, Mycobacterium avium subsp. paratuberculosis
ugagcaacgccagcgc

SEQ ID NO: 965006 - RNA, 18 nt, Mycobacterium avium subsp. paratuberculosis
ugagcacacccagcgagc

SEQ ID NO: 965007 - RNA, 14 nt, Mycobacterium avium subsp. paratuberculosis
ugagcacaaagccg

SEQ ID NO: 965008 - RNA, 17 nt, Mycobacterium avium subsp. paratuberculosis
ugagcaggucagccagg

SEQ ID NO: 965009 - RNA, 22 nt, Mycobacterium avium subsp. paratuberculosis
ugagcaccacgaggcugugggc

SEQ ID NO: 965010 - RNA, 14 nt, Mycobacterium avium subsp. paratuberculosis
ugagcaggcuggag

SEQ ID NO: 965011 - RNA, 17 nt, Mycobacterium avium subsp. paratuberculosis
ugacuucgauguagaag

SEQ ID NO: 965012 - RNA, 19 nt, Mycobacterium avium subsp. paratuberculosis
ugacuucgauguagaagcc

SEQ ID NO: 965013 - RNA, 23 nt, Mycobacterium avium subsp. paratuberculosis
ugacuaauccccccgcgccgccc

SEQ ID NO: 965014 - RNA, 20 nt, Mycobacterium avium subsp. paratuberculosis
ugacugagucaagccggcau

SEQ ID NO: 965015 - RNA, 21 nt, Mycobacterium avium subsp. paratuberculosis
ugacgugcaccaccgcguuga

SEQ ID NO: 965016 - RNA, 22 nt, Mycobacterium avium subsp. paratuberculosis
ugacgugcaccggcgaguccgc

SEQ ID NO: 965017 - RNA, 16 nt, Mycobacterium avium subsp. paratuberculosis
ugacgucgucaggucc

SEQ ID NO: 965018 - RNA, 18 nt, Mycobacterium avium subsp. paratuberculosis
ugacgucgcccacccggg

SEQ ID NO: 965019 - RNA, 21 nt, Mycobacterium avium subsp. paratuberculosis
ugacgucgcgccgcucggcca

SEQ ID NO: 965020 - RNA, 17 nt, Mycobacterium avium subsp. paratuberculosis
ugacguacgggcugaag

SEQ ID NO: 965021 - RNA, 16 nt, Mycobacterium avium subsp. paratuberculosis
ugacguccaccagggu

SEQ ID NO: 965022 - RNA, 15 nt, Mycobacterium avium subsp. paratuberculosis
ugacggucagggugu

SEQ ID NO: 965023 - RNA, 20 nt, Mycobacterium avium subsp. paratuberculosis
ugacggucaugccgagccgc

SEQ ID NO: 965024 - RNA, 18 nt, Mycobacterium avium subsp. paratuberculosis
ugacgggccgcggccagc

SEQ ID NO: 965025 - RNA, 21 nt, Mycobacterium avium subsp. paratuberculosis
ugacggggcguugguugcggc

SEQ ID NO: 965026 - RNA, 22 nt, Mycobacterium avium subsp. paratuberculosis
ugcaacacaugguccugcaccg

SEQ ID NO: 965027 - RNA, 20 nt, Mycobacterium avium subsp. paratuberculosis
ugcaaccgcuuuuccaccau

SEQ ID NO: 965028 - RNA, 22 nt, Mycobacterium avium subsp. paratuberculosis
ugcaacucccgcgccgcggcca

SEQ ID NO: 965029 - RNA, 21 nt, Mycobacterium avium subsp. paratuberculosis
ugcaccucgcccugcagccgg

SEQ ID NO: 965030 - RNA, 21 nt, Mycobacterium avium subsp. paratuberculosis
ugcaccgcagucuuguugacc

SEQ ID NO: 965031 - RNA, 16 nt, Mycobacterium avium subsp. paratuberculosis
ugcaccgccagcgcgg

SEQ ID NO: 965032 - RNA, 13 nt, Mycobacterium avium subsp. paratuberculosis
ugcaccgcggcca

SEQ ID NO: 965033 - RNA, 22 nt, Mycobacterium avium subsp. paratuberculosis
ugcaccgcggccaacccgggcg

SEQ ID NO: 965034 - RNA, 18 nt, Mycobacterium avium subsp. paratuberculosis
ugcacgcucggcgggggg

SEQ ID NO: 965035 - RNA, 18 nt, Mycobacterium avium subsp. paratuberculosis
ugcacgcguugcagcgcc

SEQ ID NO: 965036 - RNA, 19 nt, Mycobacterium avium subsp. paratuberculosis
ugcacgcguugcagcgccg

SEQ ID NO: 965037 - RNA, 22 nt, Mycobacterium avium subsp. paratuberculosis
ugcacgcuguuggaaccggcca

SEQ ID NO: 965038 - RNA, 16 nt, Mycobacterium avium subsp. paratuberculosis
ugcacggacagcucac

SEQ ID NO: 965039 - RNA, 24 nt, Mycobacterium avium subsp. paratuberculosis
ugcacggacagcucaccgggcucg

SEQ ID NO: 965040 - RNA, 14 nt, Mycobacterium avium subsp. paratuberculosis
ugcacgcaggccuc

SEQ ID NO: 965041 - RNA, 16 nt, Mycobacterium avium subsp. paratuberculosis
ugcacgcaggccucua

SEQ ID NO: 965042 - RNA, 16 nt, Mycobacterium avium subsp. paratuberculosis
ugcacgccgagcagca

SEQ ID NO: 965043 - RNA, 14 nt, Mycobacterium avium subsp. paratuberculosis
ugcacgccgucgug

SEQ ID NO: 965044 - RNA, 16 nt, Mycobacterium avium subsp. paratuberculosis
ugcaccaccacaccca

SEQ ID NO: 965045 - RNA, 23 nt, Mycobacterium avium subsp. paratuberculosis
ugcaccaccacacccagcgccag

SEQ ID NO: 965046 - RNA, 14 nt, Mycobacterium avium subsp. paratuberculosis
ugcaccacccaggc

SEQ ID NO: 965047 - RNA, 15 nt, Mycobacterium avium subsp. paratuberculosis
ugcaccacccaggcc

SEQ ID NO: 965048 - RNA, 19 nt, Mycobacterium avium subsp. paratuberculosis
ugcaccacccaggccaccc

SEQ ID NO: 965049 - RNA, 19 nt, Mycobacterium avium subsp. paratuberculosis
ugcaccaccgugccgucgc

SEQ ID NO: 965050 - RNA, 12 nt, Mycobacterium avium subsp. paratuberculosis
ugcaccagcacg

SEQ ID NO: 965051 - RNA, 22 nt, Mycobacterium avium subsp. paratuberculosis
ugcaccacgacgucgagccagc

SEQ ID NO: 965052 - RNA, 15 nt, Mycobacterium avium subsp. paratuberculosis
ugcacccgggucagg

SEQ ID NO: 965053 - RNA, 18 nt, Mycobacterium avium subsp. paratuberculosis
ugcacccgguucugggcg

SEQ ID NO: 965054 - RNA, 18 nt, Mycobacterium avium subsp. paratuberculosis
ugcaccaggacgcgaccg

SEQ ID NO: 965055 - RNA, 14 nt, Mycobacterium avium subsp. paratuberculosis
ugcaccagguagau

SEQ ID NO: 965056 - RNA, 23 nt, Mycobacterium avium subsp. paratuberculosis
ugaugccgucacugucggcgcgg

SEQ ID NO: 965057 - RNA, 19 nt, Mycobacterium avium subsp. paratuberculosis
ugaugccgucgaucaccug

SEQ ID NO: 965058 - RNA, 23 nt, Mycobacterium avium subsp. paratuberculosis
ugauuucaucgcggcgacccgcu

SEQ ID NO: 965059 - RNA, 12 nt, Mycobacterium avium subsp. paratuberculosis
ugaucuuggccu

SEQ ID NO: 965060 - RNA, 18 nt, Mycobacterium avium subsp. paratuberculosis
ugaugaaaccggccagca

SEQ ID NO: 965061 - RNA, 21 nt, Mycobacterium avium subsp. paratuberculosis
ugaugaaaccggccagcagca

SEQ ID NO: 965062 - RNA, 22 nt, Mycobacterium avium subsp. paratuberculosis
ugaugaaaccggccagcagcag

SEQ ID NO: 965063 - RNA, 17 nt, Mycobacterium avium subsp. paratuberculosis
ugaugaaaaccgggccc

SEQ ID NO: 965064 - RNA, 14 nt, Mycobacterium avium subsp. paratuberculosis
ugaugaggucgcga

SEQ ID NO: 965065 - RNA, 12 nt, Mycobacterium avium subsp. paratuberculosis
ugaugaugccgc

SEQ ID NO: 965066 - RNA, 21 nt, Mycobacterium avium subsp. paratuberculosis
ugaugaugccgcccaucagca

SEQ ID NO: 965067 - RNA, 22 nt, Mycobacterium avium subsp. paratuberculosis
ugaugaugccgcccaucagcag

SEQ ID NO: 965068 - RNA, 12 nt, Mycobacterium avium subsp. paratuberculosis
ugaugaugcugu

SEQ ID NO: 965069 - RNA, 21 nt, Mycobacterium avium subsp. paratuberculosis
ugaugcccuuggcggccacga

SEQ ID NO: 965070 - RNA, 15 nt, Mycobacterium avium subsp. paratuberculosis
ugaucucaccggcgg

SEQ ID NO: 965071 - RNA, 19 nt, Mycobacterium avium subsp. paratuberculosis
ugaucucggcggucugucg

SEQ ID NO: 965072 - RNA, 19 nt, Mycobacterium avium subsp. paratuberculosis
ugaucaccgccagcgcgcc

SEQ ID NO: 965073 - RNA, 22 nt, Mycobacterium avium subsp. paratuberculosis
ugaucaccaaauagccgucggc

SEQ ID NO: 965074 - RNA, 22 nt, Mycobacterium avium subsp. paratuberculosis
ugauagaucaucccggccaccc

SEQ ID NO: 965075 - RNA, 15 nt, Mycobacterium avium subsp. paratuberculosis
ugauagcggccgcgg

SEQ ID NO: 965076 - RNA, 22 nt, Mycobacterium avium subsp. paratuberculosis
ugauagcccaggccuuguacgc

SEQ ID NO: 965077 - RNA, 14 nt, Mycobacterium avium subsp. paratuberculosis
ugauaggucacgcc

SEQ ID NO: 965078 - RNA, 18 nt, Mycobacterium avium subsp. paratuberculosis
ugauacaggagggccagg

SEQ ID NO: 965079 - RNA, 19 nt, Mycobacterium avium subsp. paratuberculosis
ugauacaggagggccaggg

SEQ ID NO: 965080 - RNA, 20 nt, Mycobacterium avium subsp. paratuberculosis
ugauacaggagggccagggc

SEQ ID NO: 965081 - RNA, 23 nt, Mycobacterium avium subsp. paratuberculosis
ugauacaggagggccagggcuuu

SEQ ID NO: 965082 - RNA, 17 nt, Mycobacterium avium subsp. paratuberculosis
ugauacgacguccgggc

SEQ ID NO: 965083 - RNA, 20 nt, Mycobacterium avium subsp. paratuberculosis
ugaguugcguuccagcaucc

SEQ ID NO: 965084 - RNA, 13 nt, Mycobacterium avium subsp. paratuberculosis
ugagccacaacau

SEQ ID NO: 965085 - RNA, 15 nt, Mycobacterium avium subsp. paratuberculosis
ugcuucagcucgcug

SEQ ID NO: 965086 - RNA, 13 nt, Mycobacterium avium subsp. paratuberculosis
ugcuugaccgcga

SEQ ID NO: 965087 - RNA, 20 nt, Mycobacterium avium subsp. paratuberculosis
ugcuugccgaugucggcguu

SEQ ID NO: 965088 - RNA, 13 nt, Mycobacterium avium subsp. paratuberculosis
ugcugggccacga

SEQ ID NO: 965089 - RNA, 12 nt, Mycobacterium avium subsp. paratuberculosis
ugcugggccggg

SEQ ID NO: 965090 - RNA, 14 nt, Mycobacterium avium subsp. paratuberculosis
ugcugggcgggcag

SEQ ID NO: 965091 - RNA, 22 nt, Mycobacterium avium subsp. paratuberculosis
ugcuggcgcuugcguucccagc

SEQ ID NO: 965092 - RNA, 23 nt, Mycobacterium avium subsp. paratuberculosis
ugcugccgugccgauuccagcaa

SEQ ID NO: 965093 - RNA, 15 nt, Mycobacterium avium subsp. paratuberculosis
ugcugccguugggca

SEQ ID NO: 965094 - RNA, 14 nt, Mycobacterium avium subsp. paratuberculosis
ugcugccggccggc

SEQ ID NO: 965095 - RNA, 17 nt, Mycobacterium avium subsp. paratuberculosis
ugcugccggccggcagc

SEQ ID NO: 965096 - RNA, 22 nt, Mycobacterium avium subsp. paratuberculosis
ugcugcuguagcucacgguguc

SEQ ID NO: 965097 - RNA, 22 nt, Mycobacterium avium subsp. paratuberculosis
ugcucgaugcgcgccagcagcg

SEQ ID NO: 965098 - RNA, 18 nt, Mycobacterium avium subsp. paratuberculosis
ugcucgaccagcgccgag

SEQ ID NO: 965099 - RNA, 21 nt, Mycobacterium avium subsp. paratuberculosis
ugcucagguugcgcagcagcc

SEQ ID NO: 965100 - RNA, 20 nt, Mycobacterium avium subsp. paratuberculosis
ugcucgugcaaaccggaccg

SEQ ID NO: 965101 - RNA, 22 nt, Mycobacterium avium subsp. paratuberculosis
ugcucgucggacucuucuuccu

SEQ ID NO: 965102 - RNA, 13 nt, Mycobacterium avium subsp. paratuberculosis
ugcugauccccag

SEQ ID NO: 965103 - RNA, 14 nt, Mycobacterium avium subsp. paratuberculosis
ugcugcacccaccg

SEQ ID NO: 965104 - RNA, 17 nt, Mycobacterium avium subsp. paratuberculosis
ugcugcagcgcccgggc

SEQ ID NO: 965105 - RNA, 19 nt, Mycobacterium avium subsp. paratuberculosis
ugcugcagcgcgaggcgca

SEQ ID NO: 965106 - RNA, 21 nt, Mycobacterium avium subsp. paratuberculosis
ugcugcagauccgcucgccgu

SEQ ID NO: 965107 - RNA, 13 nt, Mycobacterium avium subsp. paratuberculosis
ugcugcccuugug

SEQ ID NO: 965108 - RNA, 21 nt, Mycobacterium avium subsp. paratuberculosis
ugcugcccagggcguuugcca

SEQ ID NO: 965109 - RNA, 16 nt, Mycobacterium avium subsp. paratuberculosis
ugcgguuggccggccg

SEQ ID NO: 965110 - RNA, 18 nt, Mycobacterium avium subsp. paratuberculosis
ugcgguugucggucaggc

SEQ ID NO: 965111 - RNA, 14 nt, Mycobacterium avium subsp. paratuberculosis
ugcgguuccgggcg

SEQ ID NO: 965112 - RNA, 20 nt, Mycobacterium avium subsp. paratuberculosis
ugcgguguaaccguggcagg

SEQ ID NO: 965113 - RNA, 12 nt, Mycobacterium avium subsp. paratuberculosis
ugcggugcucgu

SEQ ID NO: 965114 - RNA, 14 nt, Mycobacterium avium subsp. paratuberculosis
ugcggugcggccgc

SEQ ID NO: 965115 - RNA, 13 nt, Mycobacterium avium subsp. paratuberculosis
ugcgugaccugcu

SEQ ID NO: 965116 - RNA, 13 nt, Mycobacterium avium subsp. paratuberculosis
ugcgugcgcucga

SEQ ID NO: 965117 - RNA, 21 nt, Mycobacterium avium subsp. paratuberculosis
ugcguucgggauccucgccgc

SEQ ID NO: 965118 - RNA, 18 nt, Mycobacterium avium subsp. paratuberculosis
ugcgucugcucgccguca

SEQ ID NO: 965119 - RNA, 19 nt, Mycobacterium avium subsp. paratuberculosis
ugcggggccuucucgccgu

SEQ ID NO: 965120 - RNA, 15 nt, Mycobacterium avium subsp. paratuberculosis
ugcgggcggcagcca

SEQ ID NO: 965121 - RNA, 16 nt, Mycobacterium avium subsp. paratuberculosis
ugcggggccgcggccg

SEQ ID NO: 965122 - RNA, 12 nt, Mycobacterium avium subsp. paratuberculosis
ugcggugccggg

SEQ ID NO: 965123 - RNA, 15 nt, Mycobacterium avium subsp. paratuberculosis
ugcggugccgggcca

SEQ ID NO: 965124 - RNA, 17 nt, Mycobacterium avium subsp. paratuberculosis
ugcggugccgggccagg

SEQ ID NO: 965125 - RNA, 18 nt, Mycobacterium avium subsp. paratuberculosis
ugcggugccgggccaggu

SEQ ID NO: 965126 - RNA, 17 nt, Mycobacterium avium subsp. paratuberculosis
ugcgguccucgagcugg

SEQ ID NO: 965127 - RNA, 22 nt, Mycobacterium avium subsp. paratuberculosis
ugcggucgaugacgccgcgccg

SEQ ID NO: 965128 - RNA, 22 nt, Mycobacterium avium subsp. paratuberculosis
ugcggcgcagccagcucggcgu

SEQ ID NO: 965129 - RNA, 18 nt, Mycobacterium avium subsp. paratuberculosis
ugcggcgcccacagcagg

SEQ ID NO: 965130 - RNA, 18 nt, Mycobacterium avium subsp. paratuberculosis
ugcggcgcggccaccccg

SEQ ID NO: 965131 - RNA, 19 nt, Mycobacterium avium subsp. paratuberculosis
ugcgggccaggaugucgga

SEQ ID NO: 965132 - RNA, 18 nt, Mycobacterium avium subsp. paratuberculosis
ugcgggccagugauccug

SEQ ID NO: 965133 - RNA, 22 nt, Mycobacterium avium subsp. paratuberculosis
ugcgggcccaccgcgcgcugca

SEQ ID NO: 965134 - RNA, 17 nt, Mycobacterium avium subsp. paratuberculosis
ugcgggccggagccuuc

SEQ ID NO: 965135 - RNA, 19 nt, Mycobacterium avium subsp. paratuberculosis
ugcgggcccgcaacuguuc

SEQ ID NO: 965136 - RNA, 22 nt, Mycobacterium avium subsp. paratuberculosis
ugcggcaggucggccagcgccg

SEQ ID NO: 965137 - RNA, 14 nt, Mycobacterium avium subsp. paratuberculosis
ugcggccagcgcag

SEQ ID NO: 965138 - RNA, 15 nt, Mycobacterium avium subsp. paratuberculosis
ugcggccagcgcagg

SEQ ID NO: 965139 - RNA, 14 nt, Mycobacterium avium subsp. paratuberculosis
ugcggcccagcccg

SEQ ID NO: 965140 - RNA, 16 nt, Mycobacterium avium subsp. paratuberculosis
ugcggcccagcccggc

SEQ ID NO: 965141 - RNA, 17 nt, Mycobacterium avium subsp. paratuberculosis
ugcggccgccggccagc

SEQ ID NO: 965142 - RNA, 15 nt, Mycobacterium avium subsp. paratuberculosis
ugcggccgcgcagcu

SEQ ID NO: 965143 - RNA, 18 nt, Mycobacterium avium subsp. paratuberculosis
ugcggccggcgggcagca

SEQ ID NO: 965144 - RNA, 19 nt, Mycobacterium avium subsp. paratuberculosis
ugcggccggcggugucgua

SEQ ID NO: 965145 - RNA, 17 nt, Mycobacterium avium subsp. paratuberculosis
ugcggcccuugcggccg

SEQ ID NO: 965146 - RNA, 21 nt, Mycobacterium avium subsp. paratuberculosis
ugcggaugaagugcgccagcg

SEQ ID NO: 965147 - RNA, 19 nt, Mycobacterium avium subsp. paratuberculosis
ugcggaugaugguggccag

SEQ ID NO: 965148 - RNA, 16 nt, Mycobacterium avium subsp. paratuberculosis
ugcggaugcgggccac

SEQ ID NO: 965149 - RNA, 14 nt, Mycobacterium avium subsp. paratuberculosis
ugcggauggccccg

SEQ ID NO: 965150 - RNA, 14 nt, Mycobacterium avium subsp. paratuberculosis
ugcggaucgggcgu

SEQ ID NO: 965151 - RNA, 20 nt, Mycobacterium avium subsp. paratuberculosis
ugcggaucggugcaggccgc

SEQ ID NO: 965152 - RNA, 19 nt, Mycobacterium avium subsp. paratuberculosis
ugcggacgcguugaaaguc

SEQ ID NO: 965153 - RNA, 20 nt, Mycobacterium avium subsp. paratuberculosis
ugcgcuugucggcguggccg

SEQ ID NO: 965154 - RNA, 19 nt, Mycobacterium avium subsp. paratuberculosis
ugcgcguucggcgccaccc

SEQ ID NO: 965155 - RNA, 16 nt, Mycobacterium avium subsp. paratuberculosis
ugcgcgugacgcgcgu

SEQ ID NO: 965156 - RNA, 15 nt, Mycobacterium avium subsp. paratuberculosis
ugcgcgucgagcagc

SEQ ID NO: 965157 - RNA, 21 nt, Mycobacterium avium subsp. paratuberculosis
ugcgcgucgagcagcaccacc

SEQ ID NO: 965158 - RNA, 14 nt, Mycobacterium avium subsp. paratuberculosis
ugcgcgucgcggcg

SEQ ID NO: 965159 - RNA, 21 nt, Mycobacterium avium subsp. paratuberculosis
ugcgcgucgcggcgcggaccc

SEQ ID NO: 965160 - RNA, 21 nt, Mycobacterium avium subsp. paratuberculosis
ugcgcgucgcgguggagcaca

SEQ ID NO: 965161 - RNA, 23 nt, Mycobacterium avium subsp. paratuberculosis
ugcgcgucgcgguggagcacagc

SEQ ID NO: 965162 - RNA, 18 nt, Mycobacterium avium subsp. paratuberculosis
ugcgcguugcgcggaccg

SEQ ID NO: 965163 - RNA, 22 nt, Mycobacterium avium subsp. paratuberculosis
ugcgcguuuugaaauccgggcg

SEQ ID NO: 965164 - RNA, 18 nt, Mycobacterium avium subsp. paratuberculosis
ugcgcgagucgagcaccg

SEQ ID NO: 965165 - RNA, 20 nt, Mycobacterium avium subsp. paratuberculosis
ugcgcgccagcagcgcgccg

SEQ ID NO: 965166 - RNA, 19 nt, Mycobacterium avium subsp. paratuberculosis
ugcgcgccgauguggccgg

SEQ ID NO: 965167 - RNA, 12 nt, Mycobacterium avium subsp. paratuberculosis
ugcgcgccgccc

SEQ ID NO: 965168 - RNA, 18 nt, Mycobacterium avium subsp. paratuberculosis
ugcgcggaaacuccuggc

SEQ ID NO: 965169 - RNA, 21 nt, Mycobacterium avium subsp. paratuberculosis
ugcgcggcggcggcgcgggcg

SEQ ID NO: 965170 - RNA, 22 nt, Mycobacterium avium subsp. paratuberculosis
ugcgcggcggcguccgcggccg

SEQ ID NO: 965171 - RNA, 13 nt, Mycobacterium avium subsp. paratuberculosis
ugcgcggccgcgu

SEQ ID NO: 965172 - RNA, 22 nt, Mycobacterium avium subsp. paratuberculosis
ugcgcggcgagcgcguucucca

SEQ ID NO: 965173 - RNA, 15 nt, Mycobacterium avium subsp. paratuberculosis
ugcgcgggcgcggac

SEQ ID NO: 965174 - RNA, 23 nt, Mycobacterium avium subsp. paratuberculosis
ugcgcgggucgccgggcaggugg

SEQ ID NO: 965175 - RNA, 17 nt, Mycobacterium avium subsp. paratuberculosis
ugcgccggguggccggg

SEQ ID NO: 965176 - RNA, 19 nt, Mycobacterium avium subsp. paratuberculosis
ugcgccggguggccggggc

SEQ ID NO: 965177 - RNA, 16 nt, Mycobacterium avium subsp. paratuberculosis
ugcgccggggccgcgg

SEQ ID NO: 965178 - RNA, 22 nt, Mycobacterium avium subsp. paratuberculosis
ugcgccggggccgcggcucgcg

SEQ ID NO: 965179 - RNA, 16 nt, Mycobacterium avium subsp. paratuberculosis
ugcgccggcuccaccg

SEQ ID NO: 965180 - RNA, 21 nt, Mycobacterium avium subsp. paratuberculosis
ugcgccggcuccaccgcgccg

SEQ ID NO: 965181 - RNA, 21 nt, Mycobacterium avium subsp. paratuberculosis
ugcgcgacgcugauggcgagg

SEQ ID NO: 965182 - RNA, 23 nt, Mycobacterium avium subsp. paratuberculosis
ugcgcgaggagauuuuguuugga

SEQ ID NO: 965183 - RNA, 17 nt, Mycobacterium avium subsp. paratuberculosis
ugcgccacugcgggaac

SEQ ID NO: 965184 - RNA, 18 nt, Mycobacterium avium subsp. paratuberculosis
ugcgccacugcgggaacg

SEQ ID NO: 965185 - RNA, 13 nt, Mycobacterium avium subsp. paratuberculosis
ugcgccagcagca

SEQ ID NO: 965186 - RNA, 16 nt, Mycobacterium avium subsp. paratuberculosis
ugcgccagcagcaacg

SEQ ID NO: 965187 - RNA, 15 nt, Mycobacterium avium subsp. paratuberculosis
ugcgccagcagggca

SEQ ID NO: 965188 - RNA, 19 nt, Mycobacterium avium subsp. paratuberculosis
ugcgccagcuccagcagcc

SEQ ID NO: 965189 - RNA, 21 nt, Mycobacterium avium subsp. paratuberculosis
ugcgccagcuccagcagcccg

SEQ ID NO: 965190 - RNA, 13 nt, Mycobacterium avium subsp. paratuberculosis
ugcgccagcgccg

SEQ ID NO: 965191 - RNA, 19 nt, Mycobacterium avium subsp. paratuberculosis
ugcgccaccgacaccaccg

SEQ ID NO: 965192 - RNA, 20 nt, Mycobacterium avium subsp. paratuberculosis
ugcgcccguagcggcggaac

SEQ ID NO: 965193 - RNA, 14 nt, Mycobacterium avium subsp. paratuberculosis
ugcgcccgccgaac

SEQ ID NO: 965194 - RNA, 20 nt, Mycobacterium avium subsp. paratuberculosis
ugcgcccgcgaucaacaccg

SEQ ID NO: 965195 - RNA, 16 nt, Mycobacterium avium subsp. paratuberculosis
ugcgcccacaguccgc

SEQ ID NO: 965196 - RNA, 11 nt, Mycobacterium avium subsp. paratuberculosis
ugcgcccagcg

SEQ ID NO: 965197 - RNA, 15 nt, Mycobacterium avium subsp. paratuberculosis
ugcgccaguggggga

SEQ ID NO: 965198 - RNA, 22 nt, Mycobacterium avium subsp. paratuberculosis
ugcgccauguccggcaggcuca

SEQ ID NO: 965199 - RNA, 23 nt, Mycobacterium avium subsp. paratuberculosis
ugcgccauguccggcaggcucag

SEQ ID NO: 965200 - RNA, 20 nt, Mycobacterium avium subsp. paratuberculosis
ugcgcccugguugauccagc

SEQ ID NO: 965201 - RNA, 22 nt, Mycobacterium avium subsp. paratuberculosis
ugcgccgcaccaguuccugcau

SEQ ID NO: 965202 - RNA, 19 nt, Mycobacterium avium subsp. paratuberculosis
ugcgccgacagcugagcag

SEQ ID NO: 965203 - RNA, 21 nt, Mycobacterium avium subsp. paratuberculosis
ugcgccgacuugaucgcggcg

SEQ ID NO: 965204 - RNA, 14 nt, Mycobacterium avium subsp. paratuberculosis
ugcgccggcggccg

SEQ ID NO: 965205 - RNA, 22 nt, Mycobacterium avium subsp. paratuberculosis
ugcgccggcgguaugcccgggc

SEQ ID NO: 965206 - RNA, 12 nt, Mycobacterium avium subsp. paratuberculosis
ugcgccgcggcg

SEQ ID NO: 965207 - RNA, 20 nt, Mycobacterium avium subsp. paratuberculosis
ugcgccgcgagcgcagcagg

SEQ ID NO: 965208 - RNA, 20 nt, Mycobacterium avium subsp. paratuberculosis
ugcgccgcucgucggccagc

SEQ ID NO: 965209 - RNA, 23 nt, Mycobacterium avium subsp. paratuberculosis
ugccucuucggcgcgccggcgau

SEQ ID NO: 965210 - RNA, 19 nt, Mycobacterium avium subsp. paratuberculosis
ugccuacaggugccggcgg

SEQ ID NO: 965211 - RNA, 21 nt, Mycobacterium avium subsp. paratuberculosis
ugccucgacgauggguguggu

SEQ ID NO: 965212 - RNA, 15 nt, Mycobacterium avium subsp. paratuberculosis
ugccguggugcccuc

SEQ ID NO: 965213 - RNA, 12 nt, Mycobacterium avium subsp. paratuberculosis
ugccgugcucgg

SEQ ID NO: 965214 - RNA, 12 nt, Mycobacterium avium subsp. paratuberculosis
ugccguuccagc

SEQ ID NO: 965215 - RNA, 19 nt, Mycobacterium avium subsp. paratuberculosis
ugccguuccagggugucga

SEQ ID NO: 965216 - RNA, 23 nt, Mycobacterium avium subsp. paratuberculosis
ugccguugaugaagaccuggccg

SEQ ID NO: 965217 - RNA, 16 nt, Mycobacterium avium subsp. paratuberculosis
ugccguugccaggccg

SEQ ID NO: 965218 - RNA, 19 nt, Mycobacterium avium subsp. paratuberculosis
ugccguugccaggccgcga

SEQ ID NO: 965219 - RNA, 17 nt, Mycobacterium avium subsp. paratuberculosis
ugccguugcgccagcgg

SEQ ID NO: 965220 - RNA, 14 nt, Mycobacterium avium subsp. paratuberculosis
ugccguucgcgccg

SEQ ID NO: 965221 - RNA, 23 nt, Mycobacterium avium subsp. paratuberculosis
ugccgguggauauuucgcggccg

SEQ ID NO: 965222 - RNA, 16 nt, Mycobacterium avium subsp. paratuberculosis
ugccggugcugcucga

SEQ ID NO: 965223 - RNA, 21 nt, Mycobacterium avium subsp. paratuberculosis
ugccgggugcugaacgccugc

SEQ ID NO: 965224 - RNA, 15 nt, Mycobacterium avium subsp. paratuberculosis
ugccgggugaugcag

SEQ ID NO: 965225 - RNA, 13 nt, Mycobacterium avium subsp. paratuberculosis
ugccggucaggca

SEQ ID NO: 965226 - RNA, 20 nt, Mycobacterium avium subsp. paratuberculosis
ugccggugaugaacgcgccg

SEQ ID NO: 965227 - RNA, 16 nt, Mycobacterium avium subsp. paratuberculosis
ugccgguccagccgcc

SEQ ID NO: 965228 - RNA, 21 nt, Mycobacterium avium subsp. paratuberculosis
ugccgcgugacaggggcagca

SEQ ID NO: 965229 - RNA, 22 nt, Mycobacterium avium subsp. paratuberculosis
ugccgcgguugaacaggcugcc

SEQ ID NO: 965230 - RNA, 14 nt, Mycobacterium avium subsp. paratuberculosis
ugccgcucggcgcu

SEQ ID NO: 965231 - RNA, 13 nt, Mycobacterium avium subsp. paratuberculosis
ugccgcugggagc

SEQ ID NO: 965232 - RNA, 15 nt, Mycobacterium avium subsp. paratuberculosis
ugccgcgcgccgaca

SEQ ID NO: 965233 - RNA, 13 nt, Mycobacterium avium subsp. paratuberculosis
ugccgcgcggcag

SEQ ID NO: 965234 - RNA, 15 nt, Mycobacterium avium subsp. paratuberculosis
ugccgcgcggcgcca

SEQ ID NO: 965235 - RNA, 17 nt, Mycobacterium avium subsp. paratuberculosis
ugccgcgcggcgccagc

SEQ ID NO: 965236 - RNA, 19 nt, Mycobacterium avium subsp. paratuberculosis
ugccgcgcggcgccagcgg

SEQ ID NO: 965237 - RNA, 14 nt, Mycobacterium avium subsp. paratuberculosis
ugccgcgccccgag

SEQ ID NO: 965238 - RNA, 17 nt, Mycobacterium avium subsp. paratuberculosis
ugccgcgccccgagcag

SEQ ID NO: 965239 - RNA, 18 nt, Mycobacterium avium subsp. paratuberculosis
ugccgcgccccgagcagc

SEQ ID NO: 965240 - RNA, 20 nt, Mycobacterium avium subsp. paratuberculosis
ugccgcggcggcgccgacgg

SEQ ID NO: 965241 - RNA, 14 nt, Mycobacterium avium subsp. paratuberculosis
ugccgcgcaggccg

SEQ ID NO: 965242 - RNA, 21 nt, Mycobacterium avium subsp. paratuberculosis
ugccgcgcaggccguccagca

SEQ ID NO: 965243 - RNA, 16 nt, Mycobacterium avium subsp. paratuberculosis
ugccgcgcaccaccuc

SEQ ID NO: 965244 - RNA, 14 nt, Mycobacterium avium subsp. paratuberculosis
ugccgcgcagcacc

SEQ ID NO: 965245 - RNA, 17 nt, Mycobacterium avium subsp. paratuberculosis
ugccgcgcagcaccguc

SEQ ID NO: 965246 - RNA, 13 nt, Mycobacterium avium subsp. paratuberculosis
ugccgggccaggu

SEQ ID NO: 965247 - RNA, 14 nt, Mycobacterium avium subsp. paratuberculosis
ugccggggugcagc

SEQ ID NO: 965248 - RNA, 17 nt, Mycobacterium avium subsp. paratuberculosis
ugccggggugcagcacc

SEQ ID NO: 965249 - RNA, 18 nt, Mycobacterium avium subsp. paratuberculosis
ugccggggugcagcacca

SEQ ID NO: 965250 - RNA, 19 nt, Mycobacterium avium subsp. paratuberculosis
ugccgggucgcagcggcac

SEQ ID NO: 965251 - RNA, 14 nt, Mycobacterium avium subsp. paratuberculosis
ugccggcgauggug

SEQ ID NO: 965252 - RNA, 23 nt, Mycobacterium avium subsp. paratuberculosis
ugccggcgaugguggcgcugccg

SEQ ID NO: 965253 - RNA, 16 nt, Mycobacterium avium subsp. paratuberculosis
ugccggccgaagugcu

SEQ ID NO: 965254 - RNA, 20 nt, Mycobacterium avium subsp. paratuberculosis
ugccggccugacugagucaa

SEQ ID NO: 965255 - RNA, 19 nt, Mycobacterium avium subsp. paratuberculosis
ugccggcgaacucgcggcg

SEQ ID NO: 965256 - RNA, 14 nt, Mycobacterium avium subsp. paratuberculosis
ugccggcgaccagc

SEQ ID NO: 965257 - RNA, 17 nt, Mycobacterium avium subsp. paratuberculosis
ugccggcgaccagcccc

SEQ ID NO: 965258 - RNA, 20 nt, Mycobacterium avium subsp. paratuberculosis
ugccggcgacgaacgcuucc

SEQ ID NO: 965259 - RNA, 17 nt, Mycobacterium avium subsp. paratuberculosis
ugccggcauaggccagc

SEQ ID NO: 965260 - RNA, 22 nt, Mycobacterium avium subsp. paratuberculosis
ugccggcauaggccagcaccag

SEQ ID NO: 965261 - RNA, 22 nt, Mycobacterium avium subsp. paratuberculosis
ugccggacaccccggccagucc

SEQ ID NO: 965262 - RNA, 13 nt, Mycobacterium avium subsp. paratuberculosis
ugccggccaccgg

SEQ ID NO: 965263 - RNA, 15 nt, Mycobacterium avium subsp. paratuberculosis
ugccggccagcggcc

SEQ ID NO: 965264 - RNA, 20 nt, Mycobacterium avium subsp. paratuberculosis
ugccggccagcucgccgccg

SEQ ID NO: 965265 - RNA, 12 nt, Mycobacterium avium subsp. paratuberculosis
ugccggccaggc

SEQ ID NO: 965266 - RNA, 17 nt, Mycobacterium avium subsp. paratuberculosis
ugccggccaggcacagc

SEQ ID NO: 965267 - RNA, 23 nt, Mycobacterium avium subsp. paratuberculosis
ugccggccaugaccaugucgacg

SEQ ID NO: 965268 - RNA, 14 nt, Mycobacterium avium subsp. paratuberculosis
ugccggaagcggcg

SEQ ID NO: 965269 - RNA, 23 nt, Mycobacterium avium subsp. paratuberculosis
ugcccgcgacggcgagccgggcc

SEQ ID NO: 965270 - RNA, 14 nt, Mycobacterium avium subsp. paratuberculosis
ugcccgcggguggc

SEQ ID NO: 965271 - RNA, 16 nt, Mycobacterium avium subsp. paratuberculosis
ugcccgcggguggccu

SEQ ID NO: 965272 - RNA, 19 nt, Mycobacterium avium subsp. paratuberculosis
ugcccgcgcaggccccggg

SEQ ID NO: 965273 - RNA, 17 nt, Mycobacterium avium subsp. paratuberculosis
ugcccgcgcccaccugg

SEQ ID NO: 965274 - RNA, 21 nt, Mycobacterium avium subsp. paratuberculosis
ugcccgcgccgaccagcgcgu

SEQ ID NO: 965275 - RNA, 15 nt, Mycobacterium avium subsp. paratuberculosis
ugcccgaccgcgccg

SEQ ID NO: 965276 - RNA, 17 nt, Mycobacterium avium subsp. paratuberculosis
ugcccgacuccucacac

SEQ ID NO: 965277 - RNA, 11 nt, Mycobacterium avium subsp. paratuberculosis
ugcccgagcgg

SEQ ID NO: 965278 - RNA, 21 nt, Mycobacterium avium subsp. paratuberculosis
ugcccgagcugaucgcggccg

SEQ ID NO: 965279 - RNA, 21 nt, Mycobacterium avium subsp. paratuberculosis
ugcccgcguccugcagcgccg

SEQ ID NO: 965280 - RNA, 22 nt, Mycobacterium avium subsp. paratuberculosis
ugcccgcugacaaagcacaacu

SEQ ID NO: 965281 - RNA, 14 nt, Mycobacterium avium subsp. paratuberculosis
ugcccgcugcggca

SEQ ID NO: 965282 - RNA, 23 nt, Mycobacterium avium subsp. paratuberculosis
ugcccgucggccucggcgguggc

SEQ ID NO: 965283 - RNA, 18 nt, Mycobacterium avium subsp. paratuberculosis
ugcccgucgggcgcggcg

SEQ ID NO: 965284 - RNA, 16 nt, Mycobacterium avium subsp. paratuberculosis
ugccccagccacagcc

SEQ ID NO: 965285 - RNA, 12 nt, Mycobacterium avium subsp. paratuberculosis
ugccccaggcga

SEQ ID NO: 965286 - RNA, 21 nt, Mycobacterium avium subsp. paratuberculosis
ugccccccuugagccgguccg

SEQ ID NO: 965287 - RNA, 20 nt, Mycobacterium avium subsp. paratuberculosis
ugcccccgaaaugcaucagc

SEQ ID NO: 965288 - RNA, 15 nt, Mycobacterium avium subsp. paratuberculosis
ugcccccgcccggcc

SEQ ID NO: 965289 - RNA, 16 nt, Mycobacterium avium subsp. paratuberculosis
ugcccccgcccggccg

SEQ ID NO: 965290 - RNA, 15 nt, Mycobacterium avium subsp. paratuberculosis
ugcccgaacgcgcgu

SEQ ID NO: 965291 - RNA, 15 nt, Mycobacterium avium subsp. paratuberculosis
ugccccaccaccgcc

SEQ ID NO: 965292 - RNA, 20 nt, Mycobacterium avium subsp. paratuberculosis
ugccccaccaccgccggccc

SEQ ID NO: 965293 - RNA, 16 nt, Mycobacterium avium subsp. paratuberculosis
ugccgaucggggcgca

SEQ ID NO: 965294 - RNA, 16 nt, Mycobacterium avium subsp. paratuberculosis
ugccgcaccagcaccc

SEQ ID NO: 965295 - RNA, 18 nt, Mycobacterium avium subsp. paratuberculosis
ugccgaucugguccagcg

SEQ ID NO: 965296 - RNA, 15 nt, Mycobacterium avium subsp. paratuberculosis
ugccgaucaggcugg

SEQ ID NO: 965297 - RNA, 16 nt, Mycobacterium avium subsp. paratuberculosis
ugccgaucaggcugga

SEQ ID NO: 965298 - RNA, 17 nt, Mycobacterium avium subsp. paratuberculosis
ugcccugguacgcgccg

SEQ ID NO: 965299 - RNA, 14 nt, Mycobacterium avium subsp. paratuberculosis
ugccgaggcacagc

SEQ ID NO: 965300 - RNA, 14 nt, Mycobacterium avium subsp. paratuberculosis
ugccgaggcaguuc

SEQ ID NO: 965301 - RNA, 22 nt, Mycobacterium avium subsp. paratuberculosis
ugccgagcccuuugcgcugccc

SEQ ID NO: 965302 - RNA, 14 nt, Mycobacterium avium subsp. paratuberculosis
ugccgagccggccg

SEQ ID NO: 965303 - RNA, 13 nt, Mycobacterium avium subsp. paratuberculosis
ugcccugaccccg

SEQ ID NO: 965304 - RNA, 24 nt, Mycobacterium avium subsp. paratuberculosis
ugcccucguagaaggaccgguccu

SEQ ID NO: 965305 - RNA, 17 nt, Mycobacterium avium subsp. paratuberculosis
ugcccucguagcggccg

SEQ ID NO: 965306 - RNA, 21 nt, Mycobacterium avium subsp. paratuberculosis
ugcccucgucgaccagggcga

SEQ ID NO: 965307 - RNA, 15 nt, Mycobacterium avium subsp. paratuberculosis
ugcccuccagcaccg

SEQ ID NO: 965308 - RNA, 20 nt, Mycobacterium avium subsp. paratuberculosis
ugcccuccagcaccgucggc

SEQ ID NO: 965309 - RNA, 17 nt, Mycobacterium avium subsp. paratuberculosis
ugcccuccucgccggag

SEQ ID NO: 965310 - RNA, 15 nt, Mycobacterium avium subsp. paratuberculosis
ugccgcagcggcggc

SEQ ID NO: 965311 - RNA, 14 nt, Mycobacterium avium subsp. paratuberculosis
ugccgcagccgucc

SEQ ID NO: 965312 - RNA, 15 nt, Mycobacterium avium subsp. paratuberculosis
ugccgcagccguccc

SEQ ID NO: 965313 - RNA, 20 nt, Mycobacterium avium subsp. paratuberculosis
ugccgcccuugcucgcggcg

SEQ ID NO: 965314 - RNA, 15 nt, Mycobacterium avium subsp. paratuberculosis
ugccgcccucggccg

SEQ ID NO: 965315 - RNA, 13 nt, Mycobacterium avium subsp. paratuberculosis
ugccgccgggcca

SEQ ID NO: 965316 - RNA, 13 nt, Mycobacterium avium subsp. paratuberculosis
ugccgccgagcgu

SEQ ID NO: 965317 - RNA, 20 nt, Mycobacterium avium subsp. paratuberculosis
ugccgccgagggccagcagc

SEQ ID NO: 965318 - RNA, 22 nt, Mycobacterium avium subsp. paratuberculosis
ugccgccgcacacuuccgggaa

SEQ ID NO: 965319 - RNA, 18 nt, Mycobacterium avium subsp. paratuberculosis
ugccaguaccagcggccg

SEQ ID NO: 965320 - RNA, 20 nt, Mycobacterium avium subsp. paratuberculosis
ugccaucgcugguggugaga

SEQ ID NO: 965321 - RNA, 23 nt, Mycobacterium avium subsp. paratuberculosis
ugccauggaaaccggcgggaacu

SEQ ID NO: 965322 - RNA, 19 nt, Mycobacterium avium subsp. paratuberculosis
ugccagacgaacgcggccg

SEQ ID NO: 965323 - RNA, 19 nt, Mycobacterium avium subsp. paratuberculosis
ugccagacgcgcaccgcca

SEQ ID NO: 965324 - RNA, 13 nt, Mycobacterium avium subsp. paratuberculosis
ugccagcgcaccg

SEQ ID NO: 965325 - RNA, 15 nt, Mycobacterium avium subsp. paratuberculosis
ugccagccgugcggc

SEQ ID NO: 965326 - RNA, 18 nt, Mycobacterium avium subsp. paratuberculosis
ugccagccgugcggcggc

SEQ ID NO: 965327 - RNA, 12 nt, Mycobacterium avium subsp. paratuberculosis
ugccagccggcc

SEQ ID NO: 965328 - RNA, 13 nt, Mycobacterium avium subsp. paratuberculosis
ugccagccggccg

SEQ ID NO: 965329 - RNA, 20 nt, Mycobacterium avium subsp. paratuberculosis
ugccagccggccgcugagga

SEQ ID NO: 965330 - RNA, 14 nt, Mycobacterium avium subsp. paratuberculosis
ugccagccgggccg

SEQ ID NO: 965331 - RNA, 19 nt, Mycobacterium avium subsp. paratuberculosis
ugccagccgggccgagcgc

SEQ ID NO: 965332 - RNA, 19 nt, Mycobacterium avium subsp. paratuberculosis
ugccagccggugcugaccc

SEQ ID NO: 965333 - RNA, 16 nt, Mycobacterium avium subsp. paratuberculosis
ugccagggcagcgcga

SEQ ID NO: 965334 - RNA, 20 nt, Mycobacterium avium subsp. paratuberculosis
ugcauucagugcgagaaaau

SEQ ID NO: 965335 - RNA, 15 nt, Mycobacterium avium subsp. paratuberculosis
ugcauucguccaucc

SEQ ID NO: 965336 - RNA, 19 nt, Mycobacterium avium subsp. paratuberculosis
ugcauuucggcguccucga

SEQ ID NO: 965337 - RNA, 17 nt, Mycobacterium avium subsp. paratuberculosis
ugccacggccgcggccc

SEQ ID NO: 965338 - RNA, 22 nt, Mycobacterium avium subsp. paratuberculosis
ugcaugcgcugcuuagccccuc

SEQ ID NO: 965339 - RNA, 15 nt, Mycobacterium avium subsp. paratuberculosis
ugcauguagguggcg

SEQ ID NO: 965340 - RNA, 16 nt, Mycobacterium avium subsp. paratuberculosis
ugcaugugcucggcga

SEQ ID NO: 965341 - RNA, 18 nt, Mycobacterium avium subsp. paratuberculosis
ugcaucaugccgcccauc

SEQ ID NO: 965342 - RNA, 13 nt, Mycobacterium avium subsp. paratuberculosis
ugcauccugggcg

SEQ ID NO: 965343 - RNA, 21 nt, Mycobacterium avium subsp. paratuberculosis
ugcaucgcgaucgacagcucc

SEQ ID NO: 965344 - RNA, 17 nt, Mycobacterium avium subsp. paratuberculosis
ugcaucucgacccgggc

SEQ ID NO: 965345 - RNA, 14 nt, Mycobacterium avium subsp. paratuberculosis
uguugccgugcugg

SEQ ID NO: 965346 - RNA, 19 nt, Mycobacterium avium subsp. paratuberculosis
uuacgcccgaucccgggcc

SEQ ID NO: 965347 - RNA, 16 nt, Mycobacterium avium subsp. paratuberculosis
uuacgaggcgugcagc

SEQ ID NO: 965348 - RNA, 15 nt, Mycobacterium avium subsp. paratuberculosis
uguucggcgccagcc

SEQ ID NO: 965349 - RNA, 22 nt, Mycobacterium avium subsp. paratuberculosis
uguucgccgaggaaccggcagc

SEQ ID NO: 965350 - RNA, 19 nt, Mycobacterium avium subsp. paratuberculosis
uguugaacgccgcguccuc

SEQ ID NO: 965351 - RNA, 19 nt, Mycobacterium avium subsp. paratuberculosis
uguugacgacguuggccag

SEQ ID NO: 965352 - RNA, 20 nt, Mycobacterium avium subsp. paratuberculosis
uguggaucgcuucggccagc

SEQ ID NO: 965353 - RNA, 15 nt, Mycobacterium avium subsp. paratuberculosis
uguggaucuccagca

SEQ ID NO: 965354 - RNA, 18 nt, Mycobacterium avium subsp. paratuberculosis
uguggaucuccagcagcu

SEQ ID NO: 965355 - RNA, 22 nt, Mycobacterium avium subsp. paratuberculosis
uguggaucuccagcagcuucau

SEQ ID NO: 965356 - RNA, 21 nt, Mycobacterium avium subsp. paratuberculosis
uguggagauagugauaucccc

SEQ ID NO: 965357 - RNA, 20 nt, Mycobacterium avium subsp. paratuberculosis
uguggucugaccccccgacg

SEQ ID NO: 965358 - RNA, 16 nt, Mycobacterium avium subsp. paratuberculosis
uguggugccgggucgc

SEQ ID NO: 965359 - RNA, 15 nt, Mycobacterium avium subsp. paratuberculosis
ugugguugggccagg

SEQ ID NO: 965360 - RNA, 12 nt, Mycobacterium avium subsp. paratuberculosis
ugugcaaggcga

SEQ ID NO: 965361 - RNA, 12 nt, Mycobacterium avium subsp. paratuberculosis
ugugccagcccg

SEQ ID NO: 965362 - RNA, 12 nt, Mycobacterium avium subsp. paratuberculosis
ugugcuggccag

SEQ ID NO: 965363 - RNA, 12 nt, Mycobacterium avium subsp. paratuberculosis
ugugcccgcccu

SEQ ID NO: 965364 - RNA, 18 nt, Mycobacterium avium subsp. paratuberculosis
ugugccgcugcauccgca

SEQ ID NO: 965365 - RNA, 12 nt, Mycobacterium avium subsp. paratuberculosis
ugugcugaccca

SEQ ID NO: 965366 - RNA, 22 nt, Mycobacterium avium subsp. paratuberculosis
ugugccgaagggcaaccgcagc

SEQ ID NO: 965367 - RNA, 13 nt, Mycobacterium avium subsp. paratuberculosis
ugucugcucgccu

SEQ ID NO: 965368 - RNA, 18 nt, Mycobacterium avium subsp. paratuberculosis
ugugaucggcggccacca

SEQ ID NO: 965369 - RNA, 22 nt, Mycobacterium avium subsp. paratuberculosis
ugucguccagugacgccugcgg

SEQ ID NO: 965370 - RNA, 19 nt, Mycobacterium avium subsp. paratuberculosis
ugucgucgggcaccacggc

SEQ ID NO: 965371 - RNA, 22 nt, Mycobacterium avium subsp. paratuberculosis
ugucgucgucgccgccggugaa

SEQ ID NO: 965372 - RNA, 19 nt, Mycobacterium avium subsp. paratuberculosis
ugucggugguggggccggc

SEQ ID NO: 965373 - RNA, 19 nt, Mycobacterium avium subsp. paratuberculosis
ugucggaggccuccaggcu

SEQ ID NO: 965374 - RNA, 13 nt, Mycobacterium avium subsp. paratuberculosis
ugucggccggcag

SEQ ID NO: 965375 - RNA, 17 nt, Mycobacterium avium subsp. paratuberculosis
ugucggccagcgcggcg

SEQ ID NO: 965376 - RNA, 16 nt, Mycobacterium avium subsp. paratuberculosis
ugucggcgccaccggg

SEQ ID NO: 965377 - RNA, 17 nt, Mycobacterium avium subsp. paratuberculosis
ugucggcgagcuugccu

SEQ ID NO: 965378 - RNA, 15 nt, Mycobacterium avium subsp. paratuberculosis
ugucgcuguuagccu

SEQ ID NO: 965379 - RNA, 17 nt, Mycobacterium avium subsp. paratuberculosis
ugucgcuguaggccagc

SEQ ID NO: 965380 - RNA, 21 nt, Mycobacterium avium subsp. paratuberculosis
ugucgcugcgaggcgggcaca

SEQ ID NO: 965381 - RNA, 17 nt, Mycobacterium avium subsp. paratuberculosis
ugucgcguucccgggcc

SEQ ID NO: 965382 - RNA, 20 nt, Mycobacterium avium subsp. paratuberculosis
ugucgaacagcaggcccagg

SEQ ID NO: 965383 - RNA, 14 nt, Mycobacterium avium subsp. paratuberculosis
ugucgacaggaucg

SEQ ID NO: 965384 - RNA, 21 nt, Mycobacterium avium subsp. paratuberculosis
ugucgagcgagccgagacuga

SEQ ID NO: 965385 - RNA, 21 nt, Mycobacterium avium subsp. paratuberculosis
ugucgacguggugcaccgcca

SEQ ID NO: 965386 - RNA, 21 nt, Mycobacterium avium subsp. paratuberculosis
ugucgaccaccggguagcccg

SEQ ID NO: 965387 - RNA, 20 nt, Mycobacterium avium subsp. paratuberculosis
ugucgaccucggccaccacc

SEQ ID NO: 965388 - RNA, 23 nt, Mycobacterium avium subsp. paratuberculosis
ugucgacgacguugcgggccagg

SEQ ID NO: 965389 - RNA, 22 nt, Mycobacterium avium subsp. paratuberculosis
ugucgacgcugagccgcucguc

SEQ ID NO: 965390 - RNA, 12 nt, Mycobacterium avium subsp. paratuberculosis
ugucgcccggcg

SEQ ID NO: 965391 - RNA, 20 nt, Mycobacterium avium subsp. paratuberculosis
ugucgcccagcugggccagc

SEQ ID NO: 965392 - RNA, 19 nt, Mycobacterium avium subsp. paratuberculosis
ugucgcgcagcauccgcac

SEQ ID NO: 965393 - RNA, 23 nt, Mycobacterium avium subsp. paratuberculosis
ugucgccgaccagguagcgcugc

SEQ ID NO: 965394 - RNA, 23 nt, Mycobacterium avium subsp. paratuberculosis
ugucgaucgaauacaccugccgc

SEQ ID NO: 965395 - RNA, 14 nt, Mycobacterium avium subsp. paratuberculosis
uguccggcaggcuc

SEQ ID NO: 965396 - RNA, 17 nt, Mycobacterium avium subsp. paratuberculosis
uguccggcucugccugc

SEQ ID NO: 965397 - RNA, 14 nt, Mycobacterium avium subsp. paratuberculosis
ugucccggccgcga

SEQ ID NO: 965398 - RNA, 16 nt, Mycobacterium avium subsp. paratuberculosis
uguccgaccaggaaca

SEQ ID NO: 965399 - RNA, 14 nt, Mycobacterium avium subsp. paratuberculosis
uguccgagccgccc

SEQ ID NO: 965400 - RNA, 23 nt, Mycobacterium avium subsp. paratuberculosis
uguccgagccgcccacguucagc

SEQ ID NO: 965401 - RNA, 19 nt, Mycobacterium avium subsp. paratuberculosis
uguccgaugacgagcagcg

SEQ ID NO: 965402 - RNA, 22 nt, Mycobacterium avium subsp. paratuberculosis
uguccuccugcgccggcaacug

SEQ ID NO: 965403 - RNA, 17 nt, Mycobacterium avium subsp. paratuberculosis
uguccuacggcgggugc

SEQ ID NO: 965404 - RNA, 14 nt, Mycobacterium avium subsp. paratuberculosis
uguccucgggaacc

SEQ ID NO: 965405 - RNA, 21 nt, Mycobacterium avium subsp. paratuberculosis
ugucccaguucccggcgggca

SEQ ID NO: 965406 - RNA, 15 nt, Mycobacterium avium subsp. paratuberculosis
uguccagccggugca

SEQ ID NO: 965407 - RNA, 21 nt, Mycobacterium avium subsp. paratuberculosis
uguacagcgacagcagcgugg

SEQ ID NO: 965408 - RNA, 22 nt, Mycobacterium avium subsp. paratuberculosis
uguaugcgguccucgagcuggc

SEQ ID NO: 965409 - RNA, 20 nt, Mycobacterium avium subsp. paratuberculosis
ugguuccccccauacacggg

SEQ ID NO: 965410 - RNA, 18 nt, Mycobacterium avium subsp. paratuberculosis
ugguuggcccgcaccacc

SEQ ID NO: 965411 - RNA, 19 nt, Mycobacterium avium subsp. paratuberculosis
ugguugccgcccucggccg

SEQ ID NO: 965412 - RNA, 21 nt, Mycobacterium avium subsp. paratuberculosis
ugguagacccggggguccagg

SEQ ID NO: 965413 - RNA, 18 nt, Mycobacterium avium subsp. paratuberculosis
uggggugucagcgcgacc

SEQ ID NO: 965414 - RNA, 13 nt, Mycobacterium avium subsp. paratuberculosis
uggucaccaccac

SEQ ID NO: 965415 - RNA, 14 nt, Mycobacterium avium subsp. paratuberculosis
uggucaccggcaag

SEQ ID NO: 965416 - RNA, 16 nt, Mycobacterium avium subsp. paratuberculosis
uggucaugccgucgac

SEQ ID NO: 965417 - RNA, 19 nt, Mycobacterium avium subsp. paratuberculosis
ugguccacacguccuggac

SEQ ID NO: 965418 - RNA, 12 nt, Mycobacterium avium subsp. paratuberculosis
ugguccaggcgc

SEQ ID NO: 965419 - RNA, 18 nt, Mycobacterium avium subsp. paratuberculosis
uggucccacagcgggguc

SEQ ID NO: 965420 - RNA, 13 nt, Mycobacterium avium subsp. paratuberculosis
uggucaaggugcu

SEQ ID NO: 965421 - RNA, 13 nt, Mycobacterium avium subsp. paratuberculosis
ugguagcccagga

SEQ ID NO: 965422 - RNA, 23 nt, Mycobacterium avium subsp. paratuberculosis
ugguagcccaggauucccgaccc

SEQ ID NO: 965423 - RNA, 21 nt, Mycobacterium avium subsp. paratuberculosis
ugguaggccgccuugggccgg

SEQ ID NO: 965424 - RNA, 16 nt, Mycobacterium avium subsp. paratuberculosis
ugguagcugagcagca

SEQ ID NO: 965425 - RNA, 14 nt, Mycobacterium avium subsp. paratuberculosis
ugguagggguccuc

SEQ ID NO: 965426 - RNA, 19 nt, Mycobacterium avium subsp. paratuberculosis
uggugaugcggaugcccgc

SEQ ID NO: 965427 - RNA, 19 nt, Mycobacterium avium subsp. paratuberculosis
uggugaaaccguuggccug

SEQ ID NO: 965428 - RNA, 16 nt, Mycobacterium avium subsp. paratuberculosis
uggugaagccgugcac

SEQ ID NO: 965429 - RNA, 17 nt, Mycobacterium avium subsp. paratuberculosis
uggucugcgcgagcaga

SEQ ID NO: 965430 - RNA, 17 nt, Mycobacterium avium subsp. paratuberculosis
uggucuugccgugcagc

SEQ ID NO: 965431 - RNA, 13 nt, Mycobacterium avium subsp. paratuberculosis
uggucugccagaa

SEQ ID NO: 965432 - RNA, 15 nt, Mycobacterium avium subsp. paratuberculosis
uggucggcgggcagc

SEQ ID NO: 965433 - RNA, 18 nt, Mycobacterium avium subsp. paratuberculosis
uggucggcgaacugcuug

SEQ ID NO: 965434 - RNA, 19 nt, Mycobacterium avium subsp. paratuberculosis
uggucgggcaugccggccg

SEQ ID NO: 965435 - RNA, 16 nt, Mycobacterium avium subsp. paratuberculosis
uggucggccagcgcgc

SEQ ID NO: 965436 - RNA, 13 nt, Mycobacterium avium subsp. paratuberculosis
uggucggccaggg

SEQ ID NO: 965437 - RNA, 16 nt, Mycobacterium avium subsp. paratuberculosis
uggucggccagggcgu

SEQ ID NO: 965438 - RNA, 15 nt, Mycobacterium avium subsp. paratuberculosis
uggucgcgcagcaug

SEQ ID NO: 965439 - RNA, 13 nt, Mycobacterium avium subsp. paratuberculosis
uggucgcggccuu

SEQ ID NO: 965440 - RNA, 14 nt, Mycobacterium avium subsp. paratuberculosis
ugguccccgggccc

SEQ ID NO: 965441 - RNA, 12 nt, Mycobacterium avium subsp. paratuberculosis
uggugccgccgg

SEQ ID NO: 965442 - RNA, 12 nt, Mycobacterium avium subsp. paratuberculosis
uggugccgccgu

SEQ ID NO: 965443 - RNA, 16 nt, Mycobacterium avium subsp. paratuberculosis
uggugcaccagguaga

SEQ ID NO: 965444 - RNA, 13 nt, Mycobacterium avium subsp. paratuberculosis
uggugcaccgcca

SEQ ID NO: 965445 - RNA, 20 nt, Mycobacterium avium subsp. paratuberculosis
uggugcaccgccagcgcggc

SEQ ID NO: 965446 - RNA, 23 nt, Mycobacterium avium subsp. paratuberculosis
uggugcaccgccagcgcggcggc

SEQ ID NO: 965447 - RNA, 17 nt, Mycobacterium avium subsp. paratuberculosis
uggugcccccgcccggc

SEQ ID NO: 965448 - RNA, 14 nt, Mycobacterium avium subsp. paratuberculosis
uggugccgaucacc

SEQ ID NO: 965449 - RNA, 19 nt, Mycobacterium avium subsp. paratuberculosis
uggugccgaucaccucgcc

SEQ ID NO: 965450 - RNA, 22 nt, Mycobacterium avium subsp. paratuberculosis
uggugccgaucaccucgccggc

SEQ ID NO: 965451 - RNA, 21 nt, Mycobacterium avium subsp. paratuberculosis
ugguggacaacuccuggaucc

SEQ ID NO: 965452 - RNA, 19 nt, Mycobacterium avium subsp. paratuberculosis
uggugggcgaacagcagca

SEQ ID NO: 965453 - RNA, 18 nt, Mycobacterium avium subsp. paratuberculosis
ugguggucgacgcgccgc

SEQ ID NO: 965454 - RNA, 13 nt, Mycobacterium avium subsp. paratuberculosis
ugguggggccggc

SEQ ID NO: 965455 - RNA, 21 nt, Mycobacterium avium subsp. paratuberculosis
ugggaggcgcacaacgaggcc

SEQ ID NO: 965456 - RNA, 22 nt, Mycobacterium avium subsp. paratuberculosis
ugggccaccacguacuccugcg

SEQ ID NO: 965457 - RNA, 15 nt, Mycobacterium avium subsp. paratuberculosis
ugggacggcgggugg

SEQ ID NO: 965458 - RNA, 18 nt, Mycobacterium avium subsp. paratuberculosis
ugggacggcggguggggg

SEQ ID NO: 965459 - RNA, 14 nt, Mycobacterium avium subsp. paratuberculosis
ugggccaggccucc

SEQ ID NO: 965460 - RNA, 21 nt, Mycobacterium avium subsp. paratuberculosis
ugggccaucggcagacccagc

SEQ ID NO: 965461 - RNA, 14 nt, Mycobacterium avium subsp. paratuberculosis
ugggcgauccgcag

SEQ ID NO: 965462 - RNA, 22 nt, Mycobacterium avium subsp. paratuberculosis
ugggcgaucgacaccagcgugu

SEQ ID NO: 965463 - RNA, 17 nt, Mycobacterium avium subsp. paratuberculosis
ugggcgccagcagcacc

SEQ ID NO: 965464 - RNA, 14 nt, Mycobacterium avium subsp. paratuberculosis
ugggcgcagggccg

SEQ ID NO: 965465 - RNA, 16 nt, Mycobacterium avium subsp. paratuberculosis
ugggcgugccggcccg

SEQ ID NO: 965466 - RNA, 16 nt, Mycobacterium avium subsp. paratuberculosis
ugggcgugcaggccgc

SEQ ID NO: 965467 - RNA, 17 nt, Mycobacterium avium subsp. paratuberculosis
uggggacgacgccgaac

SEQ ID NO: 965468 - RNA, 21 nt, Mycobacterium avium subsp. paratuberculosis
ugggcggccaccaacggcagc

SEQ ID NO: 965469 - RNA, 21 nt, Mycobacterium avium subsp. paratuberculosis
ugggcgguccgcuccaccagc

SEQ ID NO: 965470 - RNA, 23 nt, Mycobacterium avium subsp. paratuberculosis
ugggcggccugcacccaggucau

SEQ ID NO: 965471 - RNA, 14 nt, Mycobacterium avium subsp. paratuberculosis
ugggcggcacaccg

SEQ ID NO: 965472 - RNA, 14 nt, Mycobacterium avium subsp. paratuberculosis
ugggcgcgcagcac

SEQ ID NO: 965473 - RNA, 18 nt, Mycobacterium avium subsp. paratuberculosis
ugggcgccgucgccgccg

SEQ ID NO: 965474 - RNA, 14 nt, Mycobacterium avium subsp. paratuberculosis
ugggcgccccuggc

SEQ ID NO: 965475 - RNA, 15 nt, Mycobacterium avium subsp. paratuberculosis
ugggcgcccgcggcg

SEQ ID NO: 965476 - RNA, 20 nt, Mycobacterium avium subsp. paratuberculosis
ugggcgccgaguccgggccg

SEQ ID NO: 965477 - RNA, 23 nt, Mycobacterium avium subsp. paratuberculosis
uggcuggucucgggcaccacgcc

SEQ ID NO: 965478 - RNA, 12 nt, Mycobacterium avium subsp. paratuberculosis
uggcugcccggc

SEQ ID NO: 965479 - RNA, 13 nt, Mycobacterium avium subsp. paratuberculosis
uggcugcccggca

SEQ ID NO: 965480 - RNA, 15 nt, Mycobacterium avium subsp. paratuberculosis
uggcugccugguugg

SEQ ID NO: 965481 - RNA, 18 nt, Mycobacterium avium subsp. paratuberculosis
uggcuuccgccgagacgg

SEQ ID NO: 965482 - RNA, 17 nt, Mycobacterium avium subsp. paratuberculosis
uggcguaggacagcagc

SEQ ID NO: 965483 - RNA, 14 nt, Mycobacterium avium subsp. paratuberculosis
uggcguagucgacu

SEQ ID NO: 965484 - RNA, 14 nt, Mycobacterium avium subsp. paratuberculosis
uggcguagagccgc

SEQ ID NO: 965485 - RNA, 17 nt, Mycobacterium avium subsp. paratuberculosis
uggcgguuggacaggcc

SEQ ID NO: 965486 - RNA, 15 nt, Mycobacterium avium subsp. paratuberculosis
uggcgguccaccacc

SEQ ID NO: 965487 - RNA, 18 nt, Mycobacterium avium subsp. paratuberculosis
uggcggucccgcaugucc

SEQ ID NO: 965488 - RNA, 18 nt, Mycobacterium avium subsp. paratuberculosis
uggcggucggugcgcagc

SEQ ID NO: 965489 - RNA, 18 nt, Mycobacterium avium subsp. paratuberculosis
uggcggguacagccgcag

SEQ ID NO: 965490 - RNA, 15 nt, Mycobacterium avium subsp. paratuberculosis
uggcgggcggcccgc

SEQ ID NO: 965491 - RNA, 14 nt, Mycobacterium avium subsp. paratuberculosis
uggcgggcccgggc

SEQ ID NO: 965492 - RNA, 15 nt, Mycobacterium avium subsp. paratuberculosis
uggcgggcccgggcg

SEQ ID NO: 965493 - RNA, 14 nt, Mycobacterium avium subsp. paratuberculosis
uggcgggccaggcg

SEQ ID NO: 965494 - RNA, 14 nt, Mycobacterium avium subsp. paratuberculosis
uggcggaagcgcgu

SEQ ID NO: 965495 - RNA, 12 nt, Mycobacterium avium subsp. paratuberculosis
uggcggaaggcc

SEQ ID NO: 965496 - RNA, 19 nt, Mycobacterium avium subsp. paratuberculosis
uggcggcgcacuccaucac

SEQ ID NO: 965497 - RNA, 14 nt, Mycobacterium avium subsp. paratuberculosis
uggcggcggcccgc

SEQ ID NO: 965498 - RNA, 14 nt, Mycobacterium avium subsp. paratuberculosis
uggcggcgugcagu

SEQ ID NO: 965499 - RNA, 22 nt, Mycobacterium avium subsp. paratuberculosis
uggcggcgugcagucccagauc

SEQ ID NO: 965500 - RNA, 17 nt, Mycobacterium avium subsp. paratuberculosis
uggcgcgaaucccggcc

SEQ ID NO: 965501 - RNA, 22 nt, Mycobacterium avium subsp. paratuberculosis
uggcgcgcaccagcucggcgcu

SEQ ID NO: 965502 - RNA, 14 nt, Mycobacterium avium subsp. paratuberculosis
uggcgcgccccggc

SEQ ID NO: 965503 - RNA, 15 nt, Mycobacterium avium subsp. paratuberculosis
uggcgcucagcggca

SEQ ID NO: 965504 - RNA, 13 nt, Mycobacterium avium subsp. paratuberculosis
uggcgcuccagcc

SEQ ID NO: 965505 - RNA, 22 nt, Mycobacterium avium subsp. paratuberculosis
uggcgcugccgagcaccucguc

SEQ ID NO: 965506 - RNA, 15 nt, Mycobacterium avium subsp. paratuberculosis
uggcgcuggugcagc

SEQ ID NO: 965507 - RNA, 13 nt, Mycobacterium avium subsp. paratuberculosis
uggcucagcgcac

SEQ ID NO: 965508 - RNA, 17 nt, Mycobacterium avium subsp. paratuberculosis
uggcucagcgcaccgcc

SEQ ID NO: 965509 - RNA, 19 nt, Mycobacterium avium subsp. paratuberculosis
uggcuaccgccgggcgggc

SEQ ID NO: 965510 - RNA, 14 nt, Mycobacterium avium subsp. paratuberculosis
uggcuagcgggcgc

SEQ ID NO: 965511 - RNA, 21 nt, Mycobacterium avium subsp. paratuberculosis
uggcuagcgggcgcgcagcca

SEQ ID NO: 965512 - RNA, 14 nt, Mycobacterium avium subsp. paratuberculosis
uggcucgcgggggc

SEQ ID NO: 965513 - RNA, 15 nt, Mycobacterium avium subsp. paratuberculosis
uggcucggccgauga

SEQ ID NO: 965514 - RNA, 17 nt, Mycobacterium avium subsp. paratuberculosis
uggcguuuuugugggug

SEQ ID NO: 965515 - RNA, 18 nt, Mycobacterium avium subsp. paratuberculosis
uggcgucgaucagcgcgc

SEQ ID NO: 965516 - RNA, 18 nt, Mycobacterium avium subsp. paratuberculosis
uggcgugacgcucggccu

SEQ ID NO: 965517 - RNA, 20 nt, Mycobacterium avium subsp. paratuberculosis
uggcgugacgcucggcgcgu

SEQ ID NO: 965518 - RNA, 14 nt, Mycobacterium avium subsp. paratuberculosis
uggcgucggccagc

SEQ ID NO: 965519 - RNA, 15 nt, Mycobacterium avium subsp. paratuberculosis
uggcgugcagcgcgg

SEQ ID NO: 965520 - RNA, 19 nt, Mycobacterium avium subsp. paratuberculosis
uggcguggauggccggccg

SEQ ID NO: 965521 - RNA, 18 nt, Mycobacterium avium subsp. paratuberculosis
uggcguggcacccgggcg

SEQ ID NO: 965522 - RNA, 15 nt, Mycobacterium avium subsp. paratuberculosis
uggcgugccacagca

SEQ ID NO: 965523 - RNA, 17 nt, Mycobacterium avium subsp. paratuberculosis
uggcgugccacagcaug

SEQ ID NO: 965524 - RNA, 20 nt, Mycobacterium avium subsp. paratuberculosis
uggcgugaaucuuggccagc

SEQ ID NO: 965525 - RNA, 21 nt, Mycobacterium avium subsp. paratuberculosis
uucagcaacccgaaagccccc

SEQ ID NO: 965526 - RNA, 15 nt, Mycobacterium avium subsp. paratuberculosis
uucaccgugcgcgcg

SEQ ID NO: 965527 - RNA, 19 nt, Mycobacterium avium subsp. paratuberculosis
uucaccggcgucauggugc

SEQ ID NO: 965528 - RNA, 22 nt, Mycobacterium avium subsp. paratuberculosis
uucaccgcgccgggcaccacca

SEQ ID NO: 965529 - RNA, 23 nt, Mycobacterium avium subsp. paratuberculosis
uucaccgcgccgggcaccaccac

SEQ ID NO: 965530 - RNA, 22 nt, Mycobacterium avium subsp. paratuberculosis
uucaccccgaucaacaccgcca

SEQ ID NO: 965531 - RNA, 15 nt, Mycobacterium avium subsp. paratuberculosis
uucacgaagaacacu

SEQ ID NO: 965532 - RNA, 11 nt, Mycobacterium avium subsp. paratuberculosis
uucaccucuuc

SEQ ID NO: 965533 - RNA, 14 nt, Mycobacterium avium subsp. paratuberculosis
uucaagccgccgau

SEQ ID NO: 965534 - RNA, 13 nt, Mycobacterium avium subsp. paratuberculosis
uucaccagcgccu

SEQ ID NO: 965535 - RNA, 22 nt, Mycobacterium avium subsp. paratuberculosis
uucacccagcgagcucaggccg

SEQ ID NO: 965536 - RNA, 15 nt, Mycobacterium avium subsp. paratuberculosis
uucaucgccgucgcc

SEQ ID NO: 965537 - RNA, 15 nt, Mycobacterium avium subsp. paratuberculosis
uucaggucaccgcgc

SEQ ID NO: 965538 - RNA, 20 nt, Mycobacterium avium subsp. paratuberculosis
uuccaagccgggcggcagca

SEQ ID NO: 965539 - RNA, 14 nt, Mycobacterium avium subsp. paratuberculosis
uuccaaccaccgug

SEQ ID NO: 965540 - RNA, 18 nt, Mycobacterium avium subsp. paratuberculosis
uuccacagcugcaggcug

SEQ ID NO: 965541 - RNA, 20 nt, Mycobacterium avium subsp. paratuberculosis
uuccacagcccguugcugcg

SEQ ID NO: 965542 - RNA, 16 nt, Mycobacterium avium subsp. paratuberculosis
uuccacaucagguuga

SEQ ID NO: 965543 - RNA, 15 nt, Mycobacterium avium subsp. paratuberculosis
uuccaccagcggccg

SEQ ID NO: 965544 - RNA, 23 nt, Mycobacterium avium subsp. paratuberculosis
uuccaccucgggccgggcgggca

SEQ ID NO: 965545 - RNA, 12 nt, Mycobacterium avium subsp. paratuberculosis
uuccacugccaa

SEQ ID NO: 965546 - RNA, 12 nt, Mycobacterium avium subsp. paratuberculosis
uuccagcggcac

SEQ ID NO: 965547 - RNA, 21 nt, Mycobacterium avium subsp. paratuberculosis
uuccagcgccggcaccagcag

SEQ ID NO: 965548 - RNA, 22 nt, Mycobacterium avium subsp. paratuberculosis
uuccagcgccggcaccagcagc

SEQ ID NO: 965549 - RNA, 14 nt, Mycobacterium avium subsp. paratuberculosis
uuccagaucugucu

SEQ ID NO: 965550 - RNA, 16 nt, Mycobacterium avium subsp. paratuberculosis
uuccagguucagcccg

SEQ ID NO: 965551 - RNA, 13 nt, Mycobacterium avium subsp. paratuberculosis
uuccaucacgccc

SEQ ID NO: 965552 - RNA, 16 nt, Mycobacterium avium subsp. paratuberculosis
uuccauauuggcuagc

SEQ ID NO: 965553 - RNA, 18 nt, Mycobacterium avium subsp. paratuberculosis
uucccgcgagcugccccu

SEQ ID NO: 965554 - RNA, 23 nt, Mycobacterium avium subsp. paratuberculosis
uucccgggcccgcugcagcgccg

SEQ ID NO: 965555 - RNA, 19 nt, Mycobacterium avium subsp. paratuberculosis
uucccgggcgaucagcccg

SEQ ID NO: 965556 - RNA, 16 nt, Mycobacterium avium subsp. paratuberculosis
uuccgccgcgcccguc

SEQ ID NO: 965557 - RNA, 15 nt, Mycobacterium avium subsp. paratuberculosis
uuccgccggagacga

SEQ ID NO: 965558 - RNA, 22 nt, Mycobacterium avium subsp. paratuberculosis
uuccccguugucguucuccccg

SEQ ID NO: 965559 - RNA, 23 nt, Mycobacterium avium subsp. paratuberculosis
uucgacggugaugucgccggcgg

SEQ ID NO: 965560 - RNA, 16 nt, Mycobacterium avium subsp. paratuberculosis
uucgaacgcccgcacc

SEQ ID NO: 965561 - RNA, 20 nt, Mycobacterium avium subsp. paratuberculosis
uucgcagaaccguugagcag

SEQ ID NO: 965562 - RNA, 20 nt, Mycobacterium avium subsp. paratuberculosis
uucgaguuuggccugaacca

SEQ ID NO: 965563 - RNA, 15 nt, Mycobacterium avium subsp. paratuberculosis
uucgaugcccuccag

SEQ ID NO: 965564 - RNA, 20 nt, Mycobacterium avium subsp. paratuberculosis
uucggacaccucggccagcg

SEQ ID NO: 965565 - RNA, 14 nt, Mycobacterium avium subsp. paratuberculosis
uucgccgacagcag

SEQ ID NO: 965566 - RNA, 18 nt, Mycobacterium avium subsp. paratuberculosis
uucgccgacagcagcuca

SEQ ID NO: 965567 - RNA, 18 nt, Mycobacterium avium subsp. paratuberculosis
uucgccgccgcaccggcc

SEQ ID NO: 965568 - RNA, 16 nt, Mycobacterium avium subsp. paratuberculosis
uuccugcgaccgccgc

SEQ ID NO: 965569 - RNA, 21 nt, Mycobacterium avium subsp. paratuberculosis
uuccugggacagccggucgac

SEQ ID NO: 965570 - RNA, 22 nt, Mycobacterium avium subsp. paratuberculosis
uuccuccacgacuucacaggcc

SEQ ID NO: 965571 - RNA, 16 nt, Mycobacterium avium subsp. paratuberculosis
uuccucgcuguccugc

SEQ ID NO: 965572 - RNA, 14 nt, Mycobacterium avium subsp. paratuberculosis
uuccgucuuggcca

SEQ ID NO: 965573 - RNA, 20 nt, Mycobacterium avium subsp. paratuberculosis
uuccgucgaacagcgggcag

SEQ ID NO: 965574 - RNA, 21 nt, Mycobacterium avium subsp. paratuberculosis
uuccggggaaccgcccuucca

SEQ ID NO: 965575 - RNA, 19 nt, Mycobacterium avium subsp. paratuberculosis
uuccggaucaaccacacca

SEQ ID NO: 965576 - RNA, 22 nt, Mycobacterium avium subsp. paratuberculosis
uuccggaucaaccacaccagca

SEQ ID NO: 965577 - RNA, 23 nt, Mycobacterium avium subsp. paratuberculosis
uuguaggagaacgucaggcccag

SEQ ID NO: 965578 - RNA, 20 nt, Mycobacterium avium subsp. paratuberculosis
uuguagucgucgaccgccac

SEQ ID NO: 965579 - RNA, 15 nt, Mycobacterium avium subsp. paratuberculosis
uugucgaaguaguag

SEQ ID NO: 965580 - RNA, 18 nt, Mycobacterium avium subsp. paratuberculosis
uugucgaaguaguagcug

SEQ ID NO: 965581 - RNA, 14 nt, Mycobacterium avium subsp. paratuberculosis
uugucgaccaccag

SEQ ID NO: 965582 - RNA, 13 nt, Mycobacterium avium subsp. paratuberculosis
uugucuguucacu

SEQ ID NO: 965583 - RNA, 21 nt, Mycobacterium avium subsp. paratuberculosis
uuggucucgauggucgccuug

SEQ ID NO: 965584 - RNA, 22 nt, Mycobacterium avium subsp. paratuberculosis
uuggccgugcagggggcgcagc

SEQ ID NO: 965585 - RNA, 16 nt, Mycobacterium avium subsp. paratuberculosis
uuggccucauuggccu

SEQ ID NO: 965586 - RNA, 17 nt, Mycobacterium avium subsp. paratuberculosis
uuggccgcgcgcaggcg

SEQ ID NO: 965587 - RNA, 21 nt, Mycobacterium avium subsp. paratuberculosis
uuggggcugaccucgccgccc

SEQ ID NO: 965588 - RNA, 13 nt, Mycobacterium avium subsp. paratuberculosis
uugcuggcggccu

SEQ ID NO: 965589 - RNA, 15 nt, Mycobacterium avium subsp. paratuberculosis
uuggaagagggccau

SEQ ID NO: 965590 - RNA, 13 nt, Mycobacterium avium subsp. paratuberculosis
uuggaaggggucg

SEQ ID NO: 965591 - RNA, 23 nt, Mycobacterium avium subsp. paratuberculosis
uuggcaaggagguggucgagcuc

SEQ ID NO: 965592 - RNA, 17 nt, Mycobacterium avium subsp. paratuberculosis
uugccacugagcgcagg

SEQ ID NO: 965593 - RNA, 19 nt, Mycobacterium avium subsp. paratuberculosis
uugccguuguccuugagcc

SEQ ID NO: 965594 - RNA, 17 nt, Mycobacterium avium subsp. paratuberculosis
uugcccaucgccacgcc

SEQ ID NO: 965595 - RNA, 16 nt, Mycobacterium avium subsp. paratuberculosis
uugccgguguauccca

SEQ ID NO: 965596 - RNA, 21 nt, Mycobacterium avium subsp. paratuberculosis
uugcggcacgccgaccacccc

SEQ ID NO: 965597 - RNA, 22 nt, Mycobacterium avium subsp. paratuberculosis
uugcggcgcagccagcucggcg

SEQ ID NO: 965598 - RNA, 22 nt, Mycobacterium avium subsp. paratuberculosis
uugcggcggccggccagcagcc

SEQ ID NO: 965599 - RNA, 12 nt, Mycobacterium avium subsp. paratuberculosis
uugcgccagcgg

SEQ ID NO: 965600 - RNA, 13 nt, Mycobacterium avium subsp. paratuberculosis
uugcgcagcagcc

SEQ ID NO: 965601 - RNA, 15 nt, Mycobacterium avium subsp. paratuberculosis
uugcgcagcagccag

SEQ ID NO: 965602 - RNA, 13 nt, Mycobacterium avium subsp. paratuberculosis
uugcgggccaggu

SEQ ID NO: 965603 - RNA, 20 nt, Mycobacterium avium subsp. paratuberculosis
uugcgggccgaacugccgau

SEQ ID NO: 965604 - RNA, 19 nt, Mycobacterium avium subsp. paratuberculosis
uugcgggccggagccuucu

SEQ ID NO: 965605 - RNA, 20 nt, Mycobacterium avium subsp. paratuberculosis
uugcagcccgcguccagcag

SEQ ID NO: 965606 - RNA, 22 nt, Mycobacterium avium subsp. paratuberculosis
uugcagcccgcguccagcagca

SEQ ID NO: 965607 - RNA, 22 nt, Mycobacterium avium subsp. paratuberculosis
uugauugcgcuugucagcggcc

SEQ ID NO: 965608 - RNA, 20 nt, Mycobacterium avium subsp. paratuberculosis
uugaugccgucgguggucca

SEQ ID NO: 965609 - RNA, 17 nt, Mycobacterium avium subsp. paratuberculosis
uugaugaaaaccaccug

SEQ ID NO: 965610 - RNA, 15 nt, Mycobacterium avium subsp. paratuberculosis
uugaugaugcugucg

SEQ ID NO: 965611 - RNA, 19 nt, Mycobacterium avium subsp. paratuberculosis
uugagcguggacaccgcac

SEQ ID NO: 965612 - RNA, 11 nt, Mycobacterium avium subsp. paratuberculosis
uugagcgccag

SEQ ID NO: 965613 - RNA, 14 nt, Mycobacterium avium subsp. paratuberculosis
uugagcgccagcgc

SEQ ID NO: 965614 - RNA, 18 nt, Mycobacterium avium subsp. paratuberculosis
uugagccggcgcaccgcg

SEQ ID NO: 965615 - RNA, 23 nt, Mycobacterium avium subsp. paratuberculosis
uugagccggucgugcgacuccug

SEQ ID NO: 965616 - RNA, 10 nt, Mycobacterium avium subsp. paratuberculosis
uugagcccgg

SEQ ID NO: 965617 - RNA, 18 nt, Mycobacterium avium subsp. paratuberculosis
uugagcauguugaacgcc

SEQ ID NO: 965618 - RNA, 21 nt, Mycobacterium avium subsp. paratuberculosis
uugaguaguagucgauucauc

SEQ ID NO: 965619 - RNA, 23 nt, Mycobacterium avium subsp. paratuberculosis
uugaucgagagcuucaugcccuu

SEQ ID NO: 965620 - RNA, 23 nt, Mycobacterium avium subsp. paratuberculosis
uucuugcugcccgcggccgccgc

SEQ ID NO: 965621 - RNA, 23 nt, Mycobacterium avium subsp. paratuberculosis
uucuugcccgaauugcgcugcac

SEQ ID NO: 965622 - RNA, 13 nt, Mycobacterium avium subsp. paratuberculosis
uucuuggccgcgc

SEQ ID NO: 965623 - RNA, 22 nt, Mycobacterium avium subsp. paratuberculosis
uucuuggccgcgcccuucuucg

SEQ ID NO: 965624 - RNA, 12 nt, Mycobacterium avium subsp. paratuberculosis
uucuuggccgga

SEQ ID NO: 965625 - RNA, 21 nt, Mycobacterium avium subsp. paratuberculosis
uucuuggccggagccuucuuc

SEQ ID NO: 965626 - RNA, 22 nt, Mycobacterium avium subsp. paratuberculosis
uucuuggccggagccuucuucg

SEQ ID NO: 965627 - RNA, 21 nt, Mycobacterium avium subsp. paratuberculosis
uucuuggccggagccuugguc

SEQ ID NO: 965628 - RNA, 15 nt, Mycobacterium avium subsp. paratuberculosis
uucuuggcggccugc

SEQ ID NO: 965629 - RNA, 20 nt, Mycobacterium avium subsp. paratuberculosis
uucuuggcgggcgccuucuu

SEQ ID NO: 965630 - RNA, 21 nt, Mycobacterium avium subsp. paratuberculosis
uucuuggcgggcgccuucuug

SEQ ID NO: 965631 - RNA, 13 nt, Mycobacterium avium subsp. paratuberculosis
uugacgccgccga

SEQ ID NO: 965632 - RNA, 19 nt, Mycobacterium avium subsp. paratuberculosis
uugaccuucucgaccaggc

SEQ ID NO: 965633 - RNA, 23 nt, Mycobacterium avium subsp. paratuberculosis
uugaccuugaccagcuugaagcc

SEQ ID NO: 965634 - RNA, 22 nt, Mycobacterium avium subsp. paratuberculosis
uugaacgcguccgacggcuggg

SEQ ID NO: 965635 - RNA, 17 nt, Mycobacterium avium subsp. paratuberculosis
uucuucagccgcagcug

SEQ ID NO: 965636 - RNA, 21 nt, Mycobacterium avium subsp. paratuberculosis
uucuugaccgcagccuucuuc

SEQ ID NO: 965637 - RNA, 22 nt, Mycobacterium avium subsp. paratuberculosis
uucuugaccgcagccuucuucg

SEQ ID NO: 965638 - RNA, 14 nt, Mycobacterium avium subsp. paratuberculosis
uucuugaccaccuu

SEQ ID NO: 965639 - RNA, 16 nt, Mycobacterium avium subsp. paratuberculosis
uucucgccgugcagca

SEQ ID NO: 965640 - RNA, 17 nt, Mycobacterium avium subsp. paratuberculosis
uucucgaccaggcucac

SEQ ID NO: 965641 - RNA, 14 nt, Mycobacterium avium subsp. paratuberculosis
uucggccgcagcgg

SEQ ID NO: 965642 - RNA, 15 nt, Mycobacterium avium subsp. paratuberculosis
uucggccggcagcgg

SEQ ID NO: 965643 - RNA, 17 nt, Mycobacterium avium subsp. paratuberculosis
uucggccggccccgccc

SEQ ID NO: 965644 - RNA, 22 nt, Mycobacterium avium subsp. paratuberculosis
uucgguggcgauggugcugccc

SEQ ID NO: 965645 - RNA, 22 nt, Mycobacterium avium subsp. paratuberculosis
uucguaccuagggcccacgcuc

SEQ ID NO: 965646 - RNA, 20 nt, Mycobacterium avium subsp. paratuberculosis
uucgugugguacagcgccag

SEQ ID NO: 965647 - RNA, 12 nt, Mycobacterium avium subsp. paratuberculosis
uucgugcuguga

SEQ ID NO: 965648 - RNA, 22 nt, Mycobacterium avium subsp. paratuberculosis
uucgugagcgguggccacgccc

SEQ ID NO: 965649 - RNA, 14 nt, Mycobacterium avium subsp. paratuberculosis
uucgucggguucga

SEQ ID NO: 965650 - RNA, 23 nt, Mycobacterium avium subsp. paratuberculosis
uucgucgccggccgccagcgccc

SEQ ID NO: 965651 - RNA, 15 nt, Mycobacterium avium subsp. paratuberculosis
uucgucgccggugag

SEQ ID NO: 965652 - RNA, 14 nt, Mycobacterium avium subsp. paratuberculosis
uucgucgaacagga

SEQ ID NO: 965653 - RNA, 18 nt, Mycobacterium avium subsp. paratuberculosis
uucgucgaaguagggccg

SEQ ID NO: 965654 - RNA, 18 nt, Mycobacterium avium subsp. paratuberculosis
uucuccucccagcccucg

SEQ ID NO: 965655 - RNA, 14 nt, Mycobacterium avium subsp. paratuberculosis
gcacguugcccagg

SEQ ID NO: 965656 - RNA, 14 nt, Mycobacterium avium subsp. paratuberculosis
gcacguugugcucg

SEQ ID NO: 965657 - RNA, 21 nt, Mycobacterium avium subsp. paratuberculosis
gcacguugugcuucuggcuca

SEQ ID NO: 965658 - RNA, 13 nt, Mycobacterium avium subsp. paratuberculosis
gcacgugaugcag

SEQ ID NO: 965659 - RNA, 17 nt, Mycobacterium avium subsp. paratuberculosis
gcacgugaugcagcuga

SEQ ID NO: 965660 - RNA, 18 nt, Mycobacterium avium subsp. paratuberculosis
gcacgugcgcgccgaccg

SEQ ID NO: 965661 - RNA, 24 nt, Mycobacterium avium subsp. paratuberculosis
gcacgugcgcgccgaccgcgagca

SEQ ID NO: 965662 - RNA, 13 nt, Mycobacterium avium subsp. paratuberculosis
gcacgugcccgcc

SEQ ID NO: 965663 - RNA, 18 nt, Mycobacterium avium subsp. paratuberculosis
gcacgugcccgccgugcg

SEQ ID NO: 965664 - RNA, 19 nt, Mycobacterium avium subsp. paratuberculosis
gcacuaccgccucgccagc

SEQ ID NO: 965665 - RNA, 18 nt, Mycobacterium avium subsp. paratuberculosis
gcacugagcggcagaagu

SEQ ID NO: 965666 - RNA, 16 nt, Mycobacterium avium subsp. paratuberculosis
gcacuccugguuucgg

SEQ ID NO: 965667 - RNA, 23 nt, Mycobacterium avium subsp. paratuberculosis
gcacucgaucagcaccgccacgc

SEQ ID NO: 965668 - RNA, 23 nt, Mycobacterium avium subsp. paratuberculosis
gcacuggagugcugcagaccgaa

SEQ ID NO: 965669 - RNA, 13 nt, Mycobacterium avium subsp. paratuberculosis
gcacugcgguuca

SEQ ID NO: 965670 - RNA, 21 nt, Mycobacterium avium subsp. paratuberculosis
gcacgggaugaucggcgccuu

SEQ ID NO: 965671 - RNA, 11 nt, Mycobacterium avium subsp. paratuberculosis
gcacggcggcg

SEQ ID NO: 965672 - RNA, 14 nt, Mycobacterium avium subsp. paratuberculosis
gcacgggcggcggg

SEQ ID NO: 965673 - RNA, 21 nt, Mycobacterium avium subsp. paratuberculosis
gcacgggcguguaguccaggu

SEQ ID NO: 965674 - RNA, 18 nt, Mycobacterium avium subsp. paratuberculosis
gcacggcgaacggccgcg

SEQ ID NO: 965675 - RNA, 19 nt, Mycobacterium avium subsp. paratuberculosis
gcacggcgaacggccgcga

SEQ ID NO: 965676 - RNA, 19 nt, Mycobacterium avium subsp. paratuberculosis
gcacggcgaccagcgagcc

SEQ ID NO: 965677 - RNA, 22 nt, Mycobacterium avium subsp. paratuberculosis
gcacggggacgcugaacagccc

SEQ ID NO: 965678 - RNA, 14 nt, Mycobacterium avium subsp. paratuberculosis
gcacggucagcggc

SEQ ID NO: 965679 - RNA, 18 nt, Mycobacterium avium subsp. paratuberculosis
gcacggucagcggccagc

SEQ ID NO: 965680 - RNA, 22 nt, Mycobacterium avium subsp. paratuberculosis
gcacggugcgccggcagcggcc

SEQ ID NO: 965681 - RNA, 15 nt, Mycobacterium avium subsp. paratuberculosis
gcacggugcagcagc

SEQ ID NO: 965682 - RNA, 18 nt, Mycobacterium avium subsp. paratuberculosis
gcacggugcagcagcgcc

SEQ ID NO: 965683 - RNA, 20 nt, Mycobacterium avium subsp. paratuberculosis
gcacggugcagcagcgccgc

SEQ ID NO: 965684 - RNA, 15 nt, Mycobacterium avium subsp. paratuberculosis
gcacguagcccagcg

SEQ ID NO: 965685 - RNA, 19 nt, Mycobacterium avium subsp. paratuberculosis
gcacgucaccgcgcuugcc

SEQ ID NO: 965686 - RNA, 23 nt, Mycobacterium avium subsp. paratuberculosis
gcacgucaccgcgcuugccgcga

SEQ ID NO: 965687 - RNA, 16 nt, Mycobacterium avium subsp. paratuberculosis
gcacgucgggguggcc

SEQ ID NO: 965688 - RNA, 21 nt, Mycobacterium avium subsp. paratuberculosis
gcacgucgacgccggucucga

SEQ ID NO: 965689 - RNA, 17 nt, Mycobacterium avium subsp. paratuberculosis
gcacgucgagcaccgcg

SEQ ID NO: 965690 - RNA, 14 nt, Mycobacterium avium subsp. paratuberculosis
gcacgucgccgccg

SEQ ID NO: 965691 - RNA, 16 nt, Mycobacterium avium subsp. paratuberculosis
gcacgucgccgccgca

SEQ ID NO: 965692 - RNA, 14 nt, Mycobacterium avium subsp. paratuberculosis
gcacgucggccacg

SEQ ID NO: 965693 - RNA, 15 nt, Mycobacterium avium subsp. paratuberculosis
gcacguccccgugca

SEQ ID NO: 965694 - RNA, 15 nt, Mycobacterium avium subsp. paratuberculosis
gcacgucccgcccgg

SEQ ID NO: 965695 - RNA, 17 nt, Mycobacterium avium subsp. paratuberculosis
gcacguccuugggcucc

SEQ ID NO: 965696 - RNA, 13 nt, Mycobacterium avium subsp. paratuberculosis
gcacgccggccgg

SEQ ID NO: 965697 - RNA, 15 nt, Mycobacterium avium subsp. paratuberculosis
gcacgccggccggcg

SEQ ID NO: 965698 - RNA, 21 nt, Mycobacterium avium subsp. paratuberculosis
gcacgccgcggaaggccagcu

SEQ ID NO: 965699 - RNA, 11 nt, Mycobacterium avium subsp. paratuberculosis
gcacgccgagg

SEQ ID NO: 965700 - RNA, 23 nt, Mycobacterium avium subsp. paratuberculosis
gcacgccgaggcgugccgcuggg

SEQ ID NO: 965701 - RNA, 23 nt, Mycobacterium avium subsp. paratuberculosis
gcacgcuguuggaaccggccacc

SEQ ID NO: 965702 - RNA, 13 nt, Mycobacterium avium subsp. paratuberculosis
gcacggccggccg

SEQ ID NO: 965703 - RNA, 14 nt, Mycobacterium avium subsp. paratuberculosis
gcacggcccgugca

SEQ ID NO: 965704 - RNA, 15 nt, Mycobacterium avium subsp. paratuberculosis
gcacggccgcggcca

SEQ ID NO: 965705 - RNA, 20 nt, Mycobacterium avium subsp. paratuberculosis
gcacggccucggucacgguc

SEQ ID NO: 965706 - RNA, 16 nt, Mycobacterium avium subsp. paratuberculosis
gcacggcaccgcgagc

SEQ ID NO: 965707 - RNA, 17 nt, Mycobacterium avium subsp. paratuberculosis
gcacggcaccgcgagca

SEQ ID NO: 965708 - RNA, 18 nt, Mycobacterium avium subsp. paratuberculosis
gcacggccaccagcagcg

SEQ ID NO: 965709 - RNA, 14 nt, Mycobacterium avium subsp. paratuberculosis
gcacggccacugcc

SEQ ID NO: 965710 - RNA, 15 nt, Mycobacterium avium subsp. paratuberculosis
gcaccugcagccggu

SEQ ID NO: 965711 - RNA, 18 nt, Mycobacterium avium subsp. paratuberculosis
gcaccugaacggccgcgc

SEQ ID NO: 965712 - RNA, 19 nt, Mycobacterium avium subsp. paratuberculosis
gcaccugaacggccgcgca

SEQ ID NO: 965713 - RNA, 19 nt, Mycobacterium avium subsp. paratuberculosis
gcaccugaccgucggccag

SEQ ID NO: 965714 - RNA, 12 nt, Mycobacterium avium subsp. paratuberculosis
gcaccucggccg

SEQ ID NO: 965715 - RNA, 14 nt, Mycobacterium avium subsp. paratuberculosis
gcaccucgcccggc

SEQ ID NO: 965716 - RNA, 14 nt, Mycobacterium avium subsp. paratuberculosis
gcaccucgcccugc

SEQ ID NO: 965717 - RNA, 15 nt, Mycobacterium avium subsp. paratuberculosis
gcaccucgcgcagca

SEQ ID NO: 965718 - RNA, 23 nt, Mycobacterium avium subsp. paratuberculosis
gcaccucgcgcucuugggcggcc

SEQ ID NO: 965719 - RNA, 18 nt, Mycobacterium avium subsp. paratuberculosis
gcaccucgcggcagccuu

SEQ ID NO: 965720 - RNA, 17 nt, Mycobacterium avium subsp. paratuberculosis
gcaccucgcucagcccg

SEQ ID NO: 965721 - RNA, 19 nt, Mycobacterium avium subsp. paratuberculosis
gcaccucgcucagcccgga

SEQ ID NO: 965722 - RNA, 14 nt, Mycobacterium avium subsp. paratuberculosis
gcaccgugccgccc

SEQ ID NO: 965723 - RNA, 19 nt, Mycobacterium avium subsp. paratuberculosis
gcaccgucgucgcaccggc

SEQ ID NO: 965724 - RNA, 18 nt, Mycobacterium avium subsp. paratuberculosis
gcaccgucgugccagcgc

SEQ ID NO: 965725 - RNA, 14 nt, Mycobacterium avium subsp. paratuberculosis
gcaccuccagcccg

SEQ ID NO: 965726 - RNA, 20 nt, Mycobacterium avium subsp. paratuberculosis
gcaccuccgacaucaggccc

SEQ ID NO: 965727 - RNA, 15 nt, Mycobacterium avium subsp. paratuberculosis
gcaccucgaaaccca

SEQ ID NO: 965728 - RNA, 15 nt, Mycobacterium avium subsp. paratuberculosis
gcaccucgaagccga

SEQ ID NO: 965729 - RNA, 19 nt, Mycobacterium avium subsp. paratuberculosis
gcaccguccacagccggcg

SEQ ID NO: 965730 - RNA, 15 nt, Mycobacterium avium subsp. paratuberculosis
gcaccgucgccggcg

SEQ ID NO: 965731 - RNA, 16 nt, Mycobacterium avium subsp. paratuberculosis
gcaccgucaccgccuc

SEQ ID NO: 965732 - RNA, 21 nt, Mycobacterium avium subsp. paratuberculosis
gcaccgucaccgccuccuggc

SEQ ID NO: 965733 - RNA, 22 nt, Mycobacterium avium subsp. paratuberculosis
gcaccggguacaccggcucgcu

SEQ ID NO: 965734 - RNA, 19 nt, Mycobacterium avium subsp. paratuberculosis
gcaccgggcugucgggcag

SEQ ID NO: 965735 - RNA, 20 nt, Mycobacterium avium subsp. paratuberculosis
gcaccggggccaacuccggc

SEQ ID NO: 965736 - RNA, 22 nt, Mycobacterium avium subsp. paratuberculosis
gcaccgggaacagccaggcgaa

SEQ ID NO: 965737 - RNA, 19 nt, Mycobacterium avium subsp. paratuberculosis
gcaccgggaccagcgcggu

SEQ ID NO: 965738 - RNA, 14 nt, Mycobacterium avium subsp. paratuberculosis
gcaccgggcccagc

SEQ ID NO: 965739 - RNA, 15 nt, Mycobacterium avium subsp. paratuberculosis
gcaccgggcccagcu

SEQ ID NO: 965740 - RNA, 16 nt, Mycobacterium avium subsp. paratuberculosis
gcaccgggcccagcuc

SEQ ID NO: 965741 - RNA, 21 nt, Mycobacterium avium subsp. paratuberculosis
gcaccgggcccagcucgguga

SEQ ID NO: 965742 - RNA, 14 nt, Mycobacterium avium subsp. paratuberculosis
gcaccggcuggccg

SEQ ID NO: 965743 - RNA, 19 nt, Mycobacterium avium subsp. paratuberculosis
gcaccggcuggccgagcgg

SEQ ID NO: 965744 - RNA, 15 nt, Mycobacterium avium subsp. paratuberculosis
gcaccggcuggugca

SEQ ID NO: 965745 - RNA, 20 nt, Mycobacterium avium subsp. paratuberculosis
gcaccggcuggugcagcagc

SEQ ID NO: 965746 - RNA, 13 nt, Mycobacterium avium subsp. paratuberculosis
gcaccggcugccc

SEQ ID NO: 965747 - RNA, 17 nt, Mycobacterium avium subsp. paratuberculosis
gcaccggcugccccagg

SEQ ID NO: 965748 - RNA, 18 nt, Mycobacterium avium subsp. paratuberculosis
gcaccggcugccccaggg

SEQ ID NO: 965749 - RNA, 18 nt, Mycobacterium avium subsp. paratuberculosis
gcaccuuggucagcuccc

SEQ ID NO: 965750 - RNA, 18 nt, Mycobacterium avium subsp. paratuberculosis
gcaccuuggugagcaccg

SEQ ID NO: 965751 - RNA, 15 nt, Mycobacterium avium subsp. paratuberculosis
gcacgacgccgccga

SEQ ID NO: 965752 - RNA, 22 nt, Mycobacterium avium subsp. paratuberculosis
gcacgaccaugucggcgacccg

SEQ ID NO: 965753 - RNA, 21 nt, Mycobacterium avium subsp. paratuberculosis
gcacgaaauaaccgcgcggcg

SEQ ID NO: 965754 - RNA, 18 nt, Mycobacterium avium subsp. paratuberculosis
gcacgagcacccagaaac

SEQ ID NO: 965755 - RNA, 15 nt, Mycobacterium avium subsp. paratuberculosis
gcacgaucccgccgc

SEQ ID NO: 965756 - RNA, 20 nt, Mycobacterium avium subsp. paratuberculosis
gcacgcccagcccgcgggcg

SEQ ID NO: 965757 - RNA, 15 nt, Mycobacterium avium subsp. paratuberculosis
gcacgcccacagcug

SEQ ID NO: 965758 - RNA, 13 nt, Mycobacterium avium subsp. paratuberculosis
gcacgccagcauc

SEQ ID NO: 965759 - RNA, 22 nt, Mycobacterium avium subsp. paratuberculosis
gcacgcccccgcuggcccggcg

SEQ ID NO: 965760 - RNA, 17 nt, Mycobacterium avium subsp. paratuberculosis
gcacgcccgggcaugcc

SEQ ID NO: 965761 - RNA, 21 nt, Mycobacterium avium subsp. paratuberculosis
gcaccagaucgucgggcaccu

SEQ ID NO: 965762 - RNA, 19 nt, Mycobacterium avium subsp. paratuberculosis
gcaccagauucaccagcgc

SEQ ID NO: 965763 - RNA, 19 nt, Mycobacterium avium subsp. paratuberculosis
gcaccacguugcgcccggc

SEQ ID NO: 965764 - RNA, 18 nt, Mycobacterium avium subsp. paratuberculosis
gcaccacuuccagcaccg

SEQ ID NO: 965765 - RNA, 14 nt, Mycobacterium avium subsp. paratuberculosis
gcaccaggcccucc

SEQ ID NO: 965766 - RNA, 13 nt, Mycobacterium avium subsp. paratuberculosis
gcaccagcggcgc

SEQ ID NO: 965767 - RNA, 20 nt, Mycobacterium avium subsp. paratuberculosis
gcaccagcgucgacgcggug

SEQ ID NO: 965768 - RNA, 18 nt, Mycobacterium avium subsp. paratuberculosis
gcaccagcguggccggca

SEQ ID NO: 965769 - RNA, 13 nt, Mycobacterium avium subsp. paratuberculosis
gcacccucugcca

SEQ ID NO: 965770 - RNA, 14 nt, Mycobacterium avium subsp. paratuberculosis
gcacccgggccugc

SEQ ID NO: 965771 - RNA, 19 nt, Mycobacterium avium subsp. paratuberculosis
gcacccgggccugcggcgg

SEQ ID NO: 965772 - RNA, 20 nt, Mycobacterium avium subsp. paratuberculosis
gcacccgguuccaccgggcc

SEQ ID NO: 965773 - RNA, 21 nt, Mycobacterium avium subsp. paratuberculosis
gcacccgguucugggcgggcu

SEQ ID NO: 965774 - RNA, 16 nt, Mycobacterium avium subsp. paratuberculosis
gcacccgggugcccgg

SEQ ID NO: 965775 - RNA, 22 nt, Mycobacterium avium subsp. paratuberculosis
gcacccguaacacgaucacccc

SEQ ID NO: 965776 - RNA, 17 nt, Mycobacterium avium subsp. paratuberculosis
gcaccaggcgggucacc

SEQ ID NO: 965777 - RNA, 11 nt, Mycobacterium avium subsp. paratuberculosis
gcaccaggcug

SEQ ID NO: 965778 - RNA, 20 nt, Mycobacterium avium subsp. paratuberculosis
gcaccaggcugaccagcgcc

SEQ ID NO: 965779 - RNA, 17 nt, Mycobacterium avium subsp. paratuberculosis
gcaccaggcgccacagc

SEQ ID NO: 965780 - RNA, 21 nt, Mycobacterium avium subsp. paratuberculosis
gcaccaggcgccacagcagca

SEQ ID NO: 965781 - RNA, 17 nt, Mycobacterium avium subsp. paratuberculosis
gcaccaggcgcaccagc

SEQ ID NO: 965782 - RNA, 20 nt, Mycobacterium avium subsp. paratuberculosis
gcaccaggcgcaccagcuga

SEQ ID NO: 965783 - RNA, 13 nt, Mycobacterium avium subsp. paratuberculosis
gcacccggccggc

SEQ ID NO: 965784 - RNA, 14 nt, Mycobacterium avium subsp. paratuberculosis
gcacccggccggcg

SEQ ID NO: 965785 - RNA, 17 nt, Mycobacterium avium subsp. paratuberculosis
gcacccggcgcggccgc

SEQ ID NO: 965786 - RNA, 16 nt, Mycobacterium avium subsp. paratuberculosis
gcacccggcggggacc

SEQ ID NO: 965787 - RNA, 17 nt, Mycobacterium avium subsp. paratuberculosis
gcaccagggccugcagc

SEQ ID NO: 965788 - RNA, 22 nt, Mycobacterium avium subsp. paratuberculosis
gcaccagggccugcagcaccag

SEQ ID NO: 965789 - RNA, 19 nt, Mycobacterium avium subsp. paratuberculosis
gcaccgccgacaucgcccg

SEQ ID NO: 965790 - RNA, 14 nt, Mycobacterium avium subsp. paratuberculosis
gcaccgccgagccg

SEQ ID NO: 965791 - RNA, 14 nt, Mycobacterium avium subsp. paratuberculosis
gcaccgcccgcggu

SEQ ID NO: 965792 - RNA, 23 nt, Mycobacterium avium subsp. paratuberculosis
gcaccgcccgcggugugcuggcc

SEQ ID NO: 965793 - RNA, 19 nt, Mycobacterium avium subsp. paratuberculosis
gcaccgcccccgcggcggc

SEQ ID NO: 965794 - RNA, 16 nt, Mycobacterium avium subsp. paratuberculosis
gcaccgccgcggccgc

SEQ ID NO: 965795 - RNA, 17 nt, Mycobacterium avium subsp. paratuberculosis
gcaccgccaucgcggcg

SEQ ID NO: 965796 - RNA, 22 nt, Mycobacterium avium subsp. paratuberculosis
gcaccggcguggggacccccuc

SEQ ID NO: 965797 - RNA, 20 nt, Mycobacterium avium subsp. paratuberculosis
gcaccggcgacggcgguucg

SEQ ID NO: 965798 - RNA, 15 nt, Mycobacterium avium subsp. paratuberculosis
gcaccggcgccgcca

SEQ ID NO: 965799 - RNA, 12 nt, Mycobacterium avium subsp. paratuberculosis
gcaccggcggca

SEQ ID NO: 965800 - RNA, 19 nt, Mycobacterium avium subsp. paratuberculosis
gcaccggcggcagcgacuc

SEQ ID NO: 965801 - RNA, 15 nt, Mycobacterium avium subsp. paratuberculosis
gcaccggccggcccc

SEQ ID NO: 965802 - RNA, 13 nt, Mycobacterium avium subsp. paratuberculosis
gcaccgccgggca

SEQ ID NO: 965803 - RNA, 17 nt, Mycobacterium avium subsp. paratuberculosis
gcaccgccgggcauccg

SEQ ID NO: 965804 - RNA, 22 nt, Mycobacterium avium subsp. paratuberculosis
gcaccgccgggcauccgggccg

SEQ ID NO: 965805 - RNA, 16 nt, Mycobacterium avium subsp. paratuberculosis
gcaccgccgcgcggcc

SEQ ID NO: 965806 - RNA, 21 nt, Mycobacterium avium subsp. paratuberculosis
gcaccgauaguagccagcauc

SEQ ID NO: 965807 - RNA, 22 nt, Mycobacterium avium subsp. paratuberculosis
gcaccgauggguuggccgucgc

SEQ ID NO: 965808 - RNA, 16 nt, Mycobacterium avium subsp. paratuberculosis
gcaccgccagccacca

SEQ ID NO: 965809 - RNA, 13 nt, Mycobacterium avium subsp. paratuberculosis
gcaccgccagcgc

SEQ ID NO: 965810 - RNA, 14 nt, Mycobacterium avium subsp. paratuberculosis
gcaccgccagcgcc

SEQ ID NO: 965811 - RNA, 17 nt, Mycobacterium avium subsp. paratuberculosis
gcaccgccagcgcggcg

SEQ ID NO: 965812 - RNA, 21 nt, Mycobacterium avium subsp. paratuberculosis
gcaccgccaccggcccggccg

SEQ ID NO: 965813 - RNA, 21 nt, Mycobacterium avium subsp. paratuberculosis
gcaccgccacgucugcuugca

SEQ ID NO: 965814 - RNA, 13 nt, Mycobacterium avium subsp. paratuberculosis
gcaccgccagcac

SEQ ID NO: 965815 - RNA, 15 nt, Mycobacterium avium subsp. paratuberculosis
gcaccgccagcaccg

SEQ ID NO: 965816 - RNA, 18 nt, Mycobacterium avium subsp. paratuberculosis
gcaccgaguugaacgcgu

SEQ ID NO: 965817 - RNA, 13 nt, Mycobacterium avium subsp. paratuberculosis
gcaccgagccugg

SEQ ID NO: 965818 - RNA, 18 nt, Mycobacterium avium subsp. paratuberculosis
gcaaugcgucgcggcggc

SEQ ID NO: 965819 - RNA, 16 nt, Mycobacterium avium subsp. paratuberculosis
gcaagcaccggcuggc

SEQ ID NO: 965820 - RNA, 15 nt, Mycobacterium avium subsp. paratuberculosis
gcaagcagagcagcg

SEQ ID NO: 965821 - RNA, 21 nt, Mycobacterium avium subsp. paratuberculosis
gcaagggcgacauguccggga

SEQ ID NO: 965822 - RNA, 19 nt, Mycobacterium avium subsp. paratuberculosis
gcaaggugccguccggguc

SEQ ID NO: 965823 - RNA, 13 nt, Mycobacterium avium subsp. paratuberculosis
gcaaggugauucg

SEQ ID NO: 965824 - RNA, 15 nt, Mycobacterium avium subsp. paratuberculosis
gcaagcagcggcagc

SEQ ID NO: 965825 - RNA, 19 nt, Mycobacterium avium subsp. paratuberculosis
gcaagcgaagccgugaccc

SEQ ID NO: 965826 - RNA, 14 nt, Mycobacterium avium subsp. paratuberculosis
gcacaucacggugg

SEQ ID NO: 965827 - RNA, 16 nt, Mycobacterium avium subsp. paratuberculosis
gcacaucacgguggcc

SEQ ID NO: 965828 - RNA, 23 nt, Mycobacterium avium subsp. paratuberculosis
gcaccaaggcaaucaggcggucg

SEQ ID NO: 965829 - RNA, 21 nt, Mycobacterium avium subsp. paratuberculosis
gcaccaaccggccccgagcgu

SEQ ID NO: 965830 - RNA, 14 nt, Mycobacterium avium subsp. paratuberculosis
gcaccacgagcagc

SEQ ID NO: 965831 - RNA, 21 nt, Mycobacterium avium subsp. paratuberculosis
gcaccacgaggcugugggcca

SEQ ID NO: 965832 - RNA, 20 nt, Mycobacterium avium subsp. paratuberculosis
gcaccacgaucaccagaccg

SEQ ID NO: 965833 - RNA, 20 nt, Mycobacterium avium subsp. paratuberculosis
gcaccacgaugaagccgugc

SEQ ID NO: 965834 - RNA, 18 nt, Mycobacterium avium subsp. paratuberculosis
gcaccacggcccgcgccc

SEQ ID NO: 965835 - RNA, 18 nt, Mycobacterium avium subsp. paratuberculosis
gcaccacgguggcgccgc

SEQ ID NO: 965836 - RNA, 14 nt, Mycobacterium avium subsp. paratuberculosis
gcaccacccagccc

SEQ ID NO: 965837 - RNA, 18 nt, Mycobacterium avium subsp. paratuberculosis
gcaccacccagcccuugg

SEQ ID NO: 965838 - RNA, 14 nt, Mycobacterium avium subsp. paratuberculosis
gcaccacccaggcc

SEQ ID NO: 965839 - RNA, 22 nt, Mycobacterium avium subsp. paratuberculosis
gcaccacccgcaccucgcccgg

SEQ ID NO: 965840 - RNA, 14 nt, Mycobacterium avium subsp. paratuberculosis
gcaccacccgcggc

SEQ ID NO: 965841 - RNA, 18 nt, Mycobacterium avium subsp. paratuberculosis
gcaccacccgcggccggc

SEQ ID NO: 965842 - RNA, 23 nt, Mycobacterium avium subsp. paratuberculosis
gcaccacccgcggccggcccagc

SEQ ID NO: 965843 - RNA, 14 nt, Mycobacterium avium subsp. paratuberculosis
gcaccaccgcccgg

SEQ ID NO: 965844 - RNA, 15 nt, Mycobacterium avium subsp. paratuberculosis
gcaccaccgcccgga

SEQ ID NO: 965845 - RNA, 23 nt, Mycobacterium avium subsp. paratuberculosis
gcaccaccgcggugagcggccgc

SEQ ID NO: 965846 - RNA, 23 nt, Mycobacterium avium subsp. paratuberculosis
gcaccaccgucaccgccgcaccg

SEQ ID NO: 965847 - RNA, 13 nt, Mycobacterium avium subsp. paratuberculosis
gcacauagcucag

SEQ ID NO: 965848 - RNA, 22 nt, Mycobacterium avium subsp. paratuberculosis
gcacagaucgucucggccagcc

SEQ ID NO: 965849 - RNA, 11 nt, Mycobacterium avium subsp. paratuberculosis
gcacaccacca

SEQ ID NO: 965850 - RNA, 13 nt, Mycobacterium avium subsp. paratuberculosis
gcacaccagcacg

SEQ ID NO: 965851 - RNA, 18 nt, Mycobacterium avium subsp. paratuberculosis
gcacaccagcacggcggc

SEQ ID NO: 965852 - RNA, 18 nt, Mycobacterium avium subsp. paratuberculosis
gcacacgcggacagggcg

SEQ ID NO: 965853 - RNA, 20 nt, Mycobacterium avium subsp. paratuberculosis
gcacacgcggacagggcggc

SEQ ID NO: 965854 - RNA, 13 nt, Mycobacterium avium subsp. paratuberculosis
gcacacagcagca

SEQ ID NO: 965855 - RNA, 19 nt, Mycobacterium avium subsp. paratuberculosis
gcacacagcgugacccugc

SEQ ID NO: 965856 - RNA, 23 nt, Mycobacterium avium subsp. paratuberculosis
gcacacggccucgcccagcgccg

SEQ ID NO: 965857 - RNA, 18 nt, Mycobacterium avium subsp. paratuberculosis
gcacacaccguaccgagg

SEQ ID NO: 965858 - RNA, 17 nt, Mycobacterium avium subsp. paratuberculosis
gcaaugguugcggcggg

SEQ ID NO: 965859 - RNA, 16 nt, Mycobacterium avium subsp. paratuberculosis
gcauccagcgccgcca

SEQ ID NO: 965860 - RNA, 23 nt, Mycobacterium avium subsp. paratuberculosis
gcauccagcgccgccaaccaggu

SEQ ID NO: 965861 - RNA, 17 nt, Mycobacterium avium subsp. paratuberculosis
gcauccagccguccagc

SEQ ID NO: 965862 - RNA, 18 nt, Mycobacterium avium subsp. paratuberculosis
gcauccaccagggcggug

SEQ ID NO: 965863 - RNA, 18 nt, Mycobacterium avium subsp. paratuberculosis
gcaucccgucgaccagga

SEQ ID NO: 965864 - RNA, 17 nt, Mycobacterium avium subsp. paratuberculosis
gcauccgacaccgccuu

SEQ ID NO: 965865 - RNA, 17 nt, Mycobacterium avium subsp. paratuberculosis
gcauccgccgggcggcg

SEQ ID NO: 965866 - RNA, 19 nt, Mycobacterium avium subsp. paratuberculosis
gcauccgcagcaccagggu

SEQ ID NO: 965867 - RNA, 18 nt, Mycobacterium avium subsp. paratuberculosis
gcauccugcuggccgggc

SEQ ID NO: 965868 - RNA, 19 nt, Mycobacterium avium subsp. paratuberculosis
gcaucgauggcgggcgcgc

SEQ ID NO: 965869 - RNA, 18 nt, Mycobacterium avium subsp. paratuberculosis
gcaucgacaugcccggcg

SEQ ID NO: 965870 - RNA, 23 nt, Mycobacterium avium subsp. paratuberculosis
gcaucgacaugcccggcgacggc

SEQ ID NO: 965871 - RNA, 14 nt, Mycobacterium avium subsp. paratuberculosis
gcauccgcuggugc

SEQ ID NO: 965872 - RNA, 23 nt, Mycobacterium avium subsp. paratuberculosis
gcauccggaaccgggcacccggc

SEQ ID NO: 965873 - RNA, 19 nt, Mycobacterium avium subsp. paratuberculosis
gcauccggcucagaaggcg

SEQ ID NO: 965874 - RNA, 17 nt, Mycobacterium avium subsp. paratuberculosis
gcauccgggaggccagc

SEQ ID NO: 965875 - RNA, 20 nt, Mycobacterium avium subsp. paratuberculosis
gcauccgggaggccagcacc

SEQ ID NO: 965876 - RNA, 21 nt, Mycobacterium avium subsp. paratuberculosis
gcauccgggaggccagcaccu

SEQ ID NO: 965877 - RNA, 16 nt, Mycobacterium avium subsp. paratuberculosis
gcauccgggccgccgc

SEQ ID NO: 965878 - RNA, 18 nt, Mycobacterium avium subsp. paratuberculosis
gcauccggugccgagcgc

SEQ ID NO: 965879 - RNA, 13 nt, Mycobacterium avium subsp. paratuberculosis
gcaucaccuucug

SEQ ID NO: 965880 - RNA, 22 nt, Mycobacterium avium subsp. paratuberculosis
gcaucaccgccuuccgccacgc

SEQ ID NO: 965881 - RNA, 17 nt, Mycobacterium avium subsp. paratuberculosis
gcaucaacugcaccagc

SEQ ID NO: 965882 - RNA, 22 nt, Mycobacterium avium subsp. paratuberculosis
gcaucaacugcaccagcggcgc

SEQ ID NO: 965883 - RNA, 20 nt, Mycobacterium avium subsp. paratuberculosis
gcaucagcaccuccggcagc

SEQ ID NO: 965884 - RNA, 17 nt, Mycobacterium avium subsp. paratuberculosis
gcaucagcucggcagcc

SEQ ID NO: 965885 - RNA, 20 nt, Mycobacterium avium subsp. paratuberculosis
gcaucagcucggcagccccg

SEQ ID NO: 965886 - RNA, 16 nt, Mycobacterium avium subsp. paratuberculosis
gcaucagcgagacgac

SEQ ID NO: 965887 - RNA, 13 nt, Mycobacterium avium subsp. paratuberculosis
gcaucagcgccac

SEQ ID NO: 965888 - RNA, 14 nt, Mycobacterium avium subsp. paratuberculosis
gcaucagggccagc

SEQ ID NO: 965889 - RNA, 15 nt, Mycobacterium avium subsp. paratuberculosis
gcaucagggccagcc

SEQ ID NO: 965890 - RNA, 14 nt, Mycobacterium avium subsp. paratuberculosis
gcaucaucgcccag

SEQ ID NO: 965891 - RNA, 20 nt, Mycobacterium avium subsp. paratuberculosis
gcaucaucgcccagcgcagc

SEQ ID NO: 965892 - RNA, 22 nt, Mycobacterium avium subsp. paratuberculosis
gcaucaucgcuacaccccaccg

SEQ ID NO: 965893 - RNA, 22 nt, Mycobacterium avium subsp. paratuberculosis
gcaucaguucguucauccgggu

SEQ ID NO: 965894 - RNA, 23 nt, Mycobacterium avium subsp. paratuberculosis
gcaucaguucguucauccggguu

SEQ ID NO: 965895 - RNA, 17 nt, Mycobacterium avium subsp. paratuberculosis
gcagucggccugcagcu

SEQ ID NO: 965896 - RNA, 13 nt, Mycobacterium avium subsp. paratuberculosis
gcaguccgccgga

SEQ ID NO: 965897 - RNA, 14 nt, Mycobacterium avium subsp. paratuberculosis
gcaguccccgccuu

SEQ ID NO: 965898 - RNA, 22 nt, Mycobacterium avium subsp. paratuberculosis
gcagucccucgaucagccacac

SEQ ID NO: 965899 - RNA, 20 nt, Mycobacterium avium subsp. paratuberculosis
gcagguuguccagccggugc

SEQ ID NO: 965900 - RNA, 22 nt, Mycobacterium avium subsp. paratuberculosis
gcaguagcgacgcgacgcgcuc

SEQ ID NO: 965901 - RNA, 13 nt, Mycobacterium avium subsp. paratuberculosis
gcagggacgggcg

SEQ ID NO: 965902 - RNA, 18 nt, Mycobacterium avium subsp. paratuberculosis
gcagggcaucucccgcgc

SEQ ID NO: 965903 - RNA, 17 nt, Mycobacterium avium subsp. paratuberculosis
gcagggauucggccaug

SEQ ID NO: 965904 - RNA, 23 nt, Mycobacterium avium subsp. paratuberculosis
gcagggauucggccaugccgcgc

SEQ ID NO: 965905 - RNA, 17 nt, Mycobacterium avium subsp. paratuberculosis
gcaggucgggccggccg

SEQ ID NO: 965906 - RNA, 18 nt, Mycobacterium avium subsp. paratuberculosis
gcaggucgggcucgcgca

SEQ ID NO: 965907 - RNA, 21 nt, Mycobacterium avium subsp. paratuberculosis
gcaggucggccagcgccgccc

SEQ ID NO: 965908 - RNA, 16 nt, Mycobacterium avium subsp. paratuberculosis
gcaggucggccagcug

SEQ ID NO: 965909 - RNA, 11 nt, Mycobacterium avium subsp. paratuberculosis
gcagggccacc

SEQ ID NO: 965910 - RNA, 14 nt, Mycobacterium avium subsp. paratuberculosis
gcagggccagcagc

SEQ ID NO: 965911 - RNA, 16 nt, Mycobacterium avium subsp. paratuberculosis
gcagggccagcagccc

SEQ ID NO: 965912 - RNA, 17 nt, Mycobacterium avium subsp. paratuberculosis
gcagguugcgcuggaug

SEQ ID NO: 965913 - RNA, 18 nt, Mycobacterium avium subsp. paratuberculosis
gcagguugcgcuggauga

SEQ ID NO: 965914 - RNA, 15 nt, Mycobacterium avium subsp. paratuberculosis
gcaggugcgccgcuc

SEQ ID NO: 965915 - RNA, 24 nt, Mycobacterium avium subsp. paratuberculosis
gcagguugcgguguugcgcagcga

SEQ ID NO: 965916 - RNA, 21 nt, Mycobacterium avium subsp. paratuberculosis
gcaggucgucgacguccucga

SEQ ID NO: 965917 - RNA, 14 nt, Mycobacterium avium subsp. paratuberculosis
gcaggucgucgauc

SEQ ID NO: 965918 - RNA, 20 nt, Mycobacterium avium subsp. paratuberculosis
gcaggucgucgaucagggcg

SEQ ID NO: 965919 - RNA, 21 nt, Mycobacterium avium subsp. paratuberculosis
gcaggucgucgucgccgcgcg

SEQ ID NO: 965920 - RNA, 16 nt, Mycobacterium avium subsp. paratuberculosis
gcaggugagccgggug

SEQ ID NO: 965921 - RNA, 22 nt, Mycobacterium avium subsp. paratuberculosis
gcaggugagccgggugcccgcg

SEQ ID NO: 965922 - RNA, 20 nt, Mycobacterium avium subsp. paratuberculosis
gcaggugaucuugcccagcc

SEQ ID NO: 965923 - RNA, 17 nt, Mycobacterium avium subsp. paratuberculosis
gcaggugcaucgccacc

SEQ ID NO: 965924 - RNA, 14 nt, Mycobacterium avium subsp. paratuberculosis
gcaggugcaccacc

SEQ ID NO: 965925 - RNA, 15 nt, Mycobacterium avium subsp. paratuberculosis
gcaggugcaccaccc

SEQ ID NO: 965926 - RNA, 22 nt, Mycobacterium avium subsp. paratuberculosis
gcaggugcaccacccaggccac

SEQ ID NO: 965927 - RNA, 16 nt, Mycobacterium avium subsp. paratuberculosis
gcagugccgcaccagc

SEQ ID NO: 965928 - RNA, 21 nt, Mycobacterium avium subsp. paratuberculosis
gcagcuugacgucggucagca

SEQ ID NO: 965929 - RNA, 18 nt, Mycobacterium avium subsp. paratuberculosis
gcagcuugaucgccgggg

SEQ ID NO: 965930 - RNA, 15 nt, Mycobacterium avium subsp. paratuberculosis
gcaggccacgcccac

SEQ ID NO: 965931 - RNA, 16 nt, Mycobacterium avium subsp. paratuberculosis
gcaggccaggugcagc

SEQ ID NO: 965932 - RNA, 20 nt, Mycobacterium avium subsp. paratuberculosis
gcaggccccuccagcuggag

SEQ ID NO: 965933 - RNA, 18 nt, Mycobacterium avium subsp. paratuberculosis
gcaggcccgagcccgacg

SEQ ID NO: 965934 - RNA, 17 nt, Mycobacterium avium subsp. paratuberculosis
gcaggccaucagcccgg

SEQ ID NO: 965935 - RNA, 16 nt, Mycobacterium avium subsp. paratuberculosis
gcaggcgaaggugggc

SEQ ID NO: 965936 - RNA, 17 nt, Mycobacterium avium subsp. paratuberculosis
gcaggccguuguggcca

SEQ ID NO: 965937 - RNA, 18 nt, Mycobacterium avium subsp. paratuberculosis
gcaggccguuguggccac

SEQ ID NO: 965938 - RNA, 18 nt, Mycobacterium avium subsp. paratuberculosis
gcaggcccgggcggcgag

SEQ ID NO: 965939 - RNA, 21 nt, Mycobacterium avium subsp. paratuberculosis
gcaggcccgguagauauggcc

SEQ ID NO: 965940 - RNA, 17 nt, Mycobacterium avium subsp. paratuberculosis
gcaggcccucggccagc

SEQ ID NO: 965941 - RNA, 23 nt, Mycobacterium avium subsp. paratuberculosis
gcaggcccucggccagccaggcc

SEQ ID NO: 965942 - RNA, 22 nt, Mycobacterium avium subsp. paratuberculosis
gcaggcguccuugauccgggcg

SEQ ID NO: 965943 - RNA, 16 nt, Mycobacterium avium subsp. paratuberculosis
gcaggcguccagggcc

SEQ ID NO: 965944 - RNA, 19 nt, Mycobacterium avium subsp. paratuberculosis
gcaggcggggaaggacuca

SEQ ID NO: 965945 - RNA, 14 nt, Mycobacterium avium subsp. paratuberculosis
gcaggcgguggugg

SEQ ID NO: 965946 - RNA, 20 nt, Mycobacterium avium subsp. paratuberculosis
gcagcuggaaauaggccggg

SEQ ID NO: 965947 - RNA, 20 nt, Mycobacterium avium subsp. paratuberculosis
gcagcuggaacaccacggcc

SEQ ID NO: 965948 - RNA, 15 nt, Mycobacterium avium subsp. paratuberculosis
gcagcugcgccgcgu

SEQ ID NO: 965949 - RNA, 17 nt, Mycobacterium avium subsp. paratuberculosis
gcagcugcugcggccgg

SEQ ID NO: 965950 - RNA, 17 nt, Mycobacterium avium subsp. paratuberculosis
gcagcugcgggaccagc

SEQ ID NO: 965951 - RNA, 17 nt, Mycobacterium avium subsp. paratuberculosis
gcagcugauagcccgcc

SEQ ID NO: 965952 - RNA, 19 nt, Mycobacterium avium subsp. paratuberculosis
gcagcugauagcccgccgc

SEQ ID NO: 965953 - RNA, 22 nt, Mycobacterium avium subsp. paratuberculosis
gcagcucguugugaauccagcc

SEQ ID NO: 965954 - RNA, 18 nt, Mycobacterium avium subsp. paratuberculosis
gcagcucggugcgcaccc

SEQ ID NO: 965955 - RNA, 12 nt, Mycobacterium avium subsp. paratuberculosis
gcagcucggugg

SEQ ID NO: 965956 - RNA, 15 nt, Mycobacterium avium subsp. paratuberculosis
gcagcgggcccgggc

SEQ ID NO: 965957 - RNA, 17 nt, Mycobacterium avium subsp. paratuberculosis
gcagcgucuugcccagc

SEQ ID NO: 965958 - RNA, 16 nt, Mycobacterium avium subsp. paratuberculosis
gcagcggugcagcccc

SEQ ID NO: 965959 - RNA, 18 nt, Mycobacterium avium subsp. paratuberculosis
gcagcggugccgcccgga

SEQ ID NO: 965960 - RNA, 16 nt, Mycobacterium avium subsp. paratuberculosis
gcagcggucggcggcu

SEQ ID NO: 965961 - RNA, 22 nt, Mycobacterium avium subsp. paratuberculosis
gcagcggggaggcccagcccgc

SEQ ID NO: 965962 - RNA, 22 nt, Mycobacterium avium subsp. paratuberculosis
gcagcggguugcgguccccgga

SEQ ID NO: 965963 - RNA, 22 nt, Mycobacterium avium subsp. paratuberculosis
gcagcgucgccagccgccggcu

SEQ ID NO: 965964 - RNA, 20 nt, Mycobacterium avium subsp. paratuberculosis
gcagcgucaucgcguagugg

SEQ ID NO: 965965 - RNA, 16 nt, Mycobacterium avium subsp. paratuberculosis
gcagcgucccgucggc

SEQ ID NO: 965966 - RNA, 15 nt, Mycobacterium avium subsp. paratuberculosis
gcagcgcuuccaagu

SEQ ID NO: 965967 - RNA, 13 nt, Mycobacterium avium subsp. paratuberculosis
gcagcgcggcgga

SEQ ID NO: 965968 - RNA, 14 nt, Mycobacterium avium subsp. paratuberculosis
gcagcgcuccugca

SEQ ID NO: 965969 - RNA, 21 nt, Mycobacterium avium subsp. paratuberculosis
gcagcggcagccacggcagcu

SEQ ID NO: 965970 - RNA, 19 nt, Mycobacterium avium subsp. paratuberculosis
gcagcggaugccggaggcg

SEQ ID NO: 965971 - RNA, 19 nt, Mycobacterium avium subsp. paratuberculosis
gcagcggaaucgcccgggc

SEQ ID NO: 965972 - RNA, 15 nt, Mycobacterium avium subsp. paratuberculosis
gcagcggacccgguc

SEQ ID NO: 965973 - RNA, 13 nt, Mycobacterium avium subsp. paratuberculosis
gcagcggccggcg

SEQ ID NO: 965974 - RNA, 17 nt, Mycobacterium avium subsp. paratuberculosis
gcagcggccggcgcagc

SEQ ID NO: 965975 - RNA, 13 nt, Mycobacterium avium subsp. paratuberculosis
gcagcggcggcuc

SEQ ID NO: 965976 - RNA, 17 nt, Mycobacterium avium subsp. paratuberculosis
gcagcggcucggccuuc

SEQ ID NO: 965977 - RNA, 20 nt, Mycobacterium avium subsp. paratuberculosis
gcagcggcugcugcagcgcc

SEQ ID NO: 965978 - RNA, 23 nt, Mycobacterium avium subsp. paratuberculosis
gcagcggcugcugcagcgcccgg

SEQ ID NO: 965979 - RNA, 20 nt, Mycobacterium avium subsp. paratuberculosis
gcagcgcgucgcgcccggcg

SEQ ID NO: 965980 - RNA, 22 nt, Mycobacterium avium subsp. paratuberculosis
gcagcgcgucgcgggcccgggc

SEQ ID NO: 965981 - RNA, 20 nt, Mycobacterium avium subsp. paratuberculosis
gcagcgcgucgucggucagg

SEQ ID NO: 965982 - RNA, 22 nt, Mycobacterium avium subsp. paratuberculosis
gcagcgcgucgucggucaggcc

SEQ ID NO: 965983 - RNA, 20 nt, Mycobacterium avium subsp. paratuberculosis
gcagcgcggcguucagcagc

SEQ ID NO: 965984 - RNA, 17 nt, Mycobacterium avium subsp. paratuberculosis
gcagcgcgcgagacacc

SEQ ID NO: 965985 - RNA, 14 nt, Mycobacterium avium subsp. paratuberculosis
gcagcgcgcgggug

SEQ ID NO: 965986 - RNA, 19 nt, Mycobacterium avium subsp. paratuberculosis
gcagcgcgcccaggcugaa

SEQ ID NO: 965987 - RNA, 21 nt, Mycobacterium avium subsp. paratuberculosis
gcagcgcgauccggggggcgg

SEQ ID NO: 965988 - RNA, 20 nt, Mycobacterium avium subsp. paratuberculosis
gcagcgcgaugccggccagg

SEQ ID NO: 965989 - RNA, 15 nt, Mycobacterium avium subsp. paratuberculosis
gcagcgccugcugcc

SEQ ID NO: 965990 - RNA, 22 nt, Mycobacterium avium subsp. paratuberculosis
gcagcgccugcugccaggacag

SEQ ID NO: 965991 - RNA, 13 nt, Mycobacterium avium subsp. paratuberculosis
gcagcgccuuggg

SEQ ID NO: 965992 - RNA, 15 nt, Mycobacterium avium subsp. paratuberculosis
gcagcgcgaccagcc

SEQ ID NO: 965993 - RNA, 20 nt, Mycobacterium avium subsp. paratuberculosis
gcagcgcgaccagcccggcc

SEQ ID NO: 965994 - RNA, 20 nt, Mycobacterium avium subsp. paratuberculosis
gcagcgccucgccgggcccg

SEQ ID NO: 965995 - RNA, 21 nt, Mycobacterium avium subsp. paratuberculosis
gcagcgccucggcggccccuu

SEQ ID NO: 965996 - RNA, 18 nt, Mycobacterium avium subsp. paratuberculosis
gcagcgccucggcgggcc

SEQ ID NO: 965997 - RNA, 21 nt, Mycobacterium avium subsp. paratuberculosis
gcagcgccucggcguggcagg

SEQ ID NO: 965998 - RNA, 15 nt, Mycobacterium avium subsp. paratuberculosis
gcagcacauccagcc

SEQ ID NO: 965999 - RNA, 21 nt, Mycobacterium avium subsp. paratuberculosis
gcagcaacaugauuccgccgg

SEQ ID NO: 966000 - RNA, 20 nt, Mycobacterium avium subsp. paratuberculosis
gcagcaguuccggagcgcgg

SEQ ID NO: 966001 - RNA, 20 nt, Mycobacterium avium subsp. paratuberculosis
gcagcaucaaauucaggaag

SEQ ID NO: 966002 - RNA, 20 nt, Mycobacterium avium subsp. paratuberculosis
gcagcauccagguggcgccu

SEQ ID NO: 966003 - RNA, 22 nt, Mycobacterium avium subsp. paratuberculosis
gcagcauccagguggcgccucc

SEQ ID NO: 966004 - RNA, 17 nt, Mycobacterium avium subsp. paratuberculosis
gcagcaggucggccagc

SEQ ID NO: 966005 - RNA, 19 nt, Mycobacterium avium subsp. paratuberculosis
gcagcaggucggcgugcuc

SEQ ID NO: 966006 - RNA, 16 nt, Mycobacterium avium subsp. paratuberculosis
gcagcagcgccgccac

SEQ ID NO: 966007 - RNA, 23 nt, Mycobacterium avium subsp. paratuberculosis
gcagcagcgacuugaccagcagc

SEQ ID NO: 966008 - RNA, 20 nt, Mycobacterium avium subsp. paratuberculosis
gcagcagcgccagcagcggc

SEQ ID NO: 966009 - RNA, 16 nt, Mycobacterium avium subsp. paratuberculosis
gcagcagccacgccag

SEQ ID NO: 966010 - RNA, 17 nt, Mycobacterium avium subsp. paratuberculosis
gcagcagccgcagcggc

SEQ ID NO: 966011 - RNA, 13 nt, Mycobacterium avium subsp. paratuberculosis
gcagcagccgccg

SEQ ID NO: 966012 - RNA, 13 nt, Mycobacterium avium subsp. paratuberculosis
gcagcagccgcgc

SEQ ID NO: 966013 - RNA, 18 nt, Mycobacterium avium subsp. paratuberculosis
gcagcaccgaaccggcgg

SEQ ID NO: 966014 - RNA, 23 nt, Mycobacterium avium subsp. paratuberculosis
gcagcacccgggccugcggcggc

SEQ ID NO: 966015 - RNA, 23 nt, Mycobacterium avium subsp. paratuberculosis
gcagcaccagaugcaccucgccc

SEQ ID NO: 966016 - RNA, 14 nt, Mycobacterium avium subsp. paratuberculosis
gcagcaccagcgcc

SEQ ID NO: 966017 - RNA, 17 nt, Mycobacterium avium subsp. paratuberculosis
gcagcaccaccucgugc

SEQ ID NO: 966018 - RNA, 13 nt, Mycobacterium avium subsp. paratuberculosis
gcagcaccaggcc

SEQ ID NO: 966019 - RNA, 16 nt, Mycobacterium avium subsp. paratuberculosis
gcagcaccaggcccuc

SEQ ID NO: 966020 - RNA, 15 nt, Mycobacterium avium subsp. paratuberculosis
gcagcaccaggcuga

SEQ ID NO: 966021 - RNA, 20 nt, Mycobacterium avium subsp. paratuberculosis
gcagcaccaggcugaccagc

SEQ ID NO: 966022 - RNA, 15 nt, Mycobacterium avium subsp. paratuberculosis
gcagcaccgccgagc

SEQ ID NO: 966023 - RNA, 13 nt, Mycobacterium avium subsp. paratuberculosis
gcagcagcccgcc

SEQ ID NO: 966024 - RNA, 14 nt, Mycobacterium avium subsp. paratuberculosis
gcagcagcccgccg

SEQ ID NO: 966025 - RNA, 14 nt, Mycobacterium avium subsp. paratuberculosis
gcagcagcaccccg

SEQ ID NO: 966026 - RNA, 13 nt, Mycobacterium avium subsp. paratuberculosis
gcagcaccgccag

SEQ ID NO: 966027 - RNA, 20 nt, Mycobacterium avium subsp. paratuberculosis
gcagccggaucaccuggugc

SEQ ID NO: 966028 - RNA, 20 nt, Mycobacterium avium subsp. paratuberculosis
gcagccggaucucgucgggc

SEQ ID NO: 966029 - RNA, 15 nt, Mycobacterium avium subsp. paratuberculosis
gcagccgcugcuggg

SEQ ID NO: 966030 - RNA, 16 nt, Mycobacterium avium subsp. paratuberculosis
gcagccgcugcugggu

SEQ ID NO: 966031 - RNA, 23 nt, Mycobacterium avium subsp. paratuberculosis
gcagccgcuggccgcgccacagc

SEQ ID NO: 966032 - RNA, 16 nt, Mycobacterium avium subsp. paratuberculosis
gcagccggaaggccaa

SEQ ID NO: 966033 - RNA, 20 nt, Mycobacterium avium subsp. paratuberculosis
gcagccggaaggccaaggcc

SEQ ID NO: 966034 - RNA, 15 nt, Mycobacterium avium subsp. paratuberculosis
gcagccggccggcag

SEQ ID NO: 966035 - RNA, 13 nt, Mycobacterium avium subsp. paratuberculosis
gcagccggcgccc

SEQ ID NO: 966036 - RNA, 14 nt, Mycobacterium avium subsp. paratuberculosis
gcagccggcgcggu

SEQ ID NO: 966037 - RNA, 15 nt, Mycobacterium avium subsp. paratuberculosis
gcagccggccaccuc

SEQ ID NO: 966038 - RNA, 16 nt, Mycobacterium avium subsp. paratuberculosis
gcagccgggcggcggc

SEQ ID NO: 966039 - RNA, 20 nt, Mycobacterium avium subsp. paratuberculosis
gcagccgggcggcggccucc

SEQ ID NO: 966040 - RNA, 14 nt, Mycobacterium avium subsp. paratuberculosis
gcagccgggcggug

SEQ ID NO: 966041 - RNA, 22 nt, Mycobacterium avium subsp. paratuberculosis
gcagccggcguacucgcacagc

SEQ ID NO: 966042 - RNA, 15 nt, Mycobacterium avium subsp. paratuberculosis
gcagccggcugagca

SEQ ID NO: 966043 - RNA, 18 nt, Mycobacterium avium subsp. paratuberculosis
gcagccggcugagcagcc

SEQ ID NO: 966044 - RNA, 15 nt, Mycobacterium avium subsp. paratuberculosis
gcagccgggccagca

SEQ ID NO: 966045 - RNA, 17 nt, Mycobacterium avium subsp. paratuberculosis
gcagccgggccugcagc

SEQ ID NO: 966046 - RNA, 17 nt, Mycobacterium avium subsp. paratuberculosis
gcagccgggccugcggc

SEQ ID NO: 966047 - RNA, 23 nt, Mycobacterium avium subsp. paratuberculosis
gcagccgggccugcggcgcggcc

SEQ ID NO: 966048 - RNA, 20 nt, Mycobacterium avium subsp. paratuberculosis
gcagccgggcgaucauccag

SEQ ID NO: 966049 - RNA, 21 nt, Mycobacterium avium subsp. paratuberculosis
gcagccgcucguaguuggggc

SEQ ID NO: 966050 - RNA, 13 nt, Mycobacterium avium subsp. paratuberculosis
gcagcgcagcacc

SEQ ID NO: 966051 - RNA, 13 nt, Mycobacterium avium subsp. paratuberculosis
gcagcgccgcggc

SEQ ID NO: 966052 - RNA, 14 nt, Mycobacterium avium subsp. paratuberculosis
gcagcgccgcggcg

SEQ ID NO: 966053 - RNA, 16 nt, Mycobacterium avium subsp. paratuberculosis
gcagcgccgcggcgcc

SEQ ID NO: 966054 - RNA, 21 nt, Mycobacterium avium subsp. paratuberculosis
gcagcgccgaggccagcacgc

SEQ ID NO: 966055 - RNA, 14 nt, Mycobacterium avium subsp. paratuberculosis
gcagcgccgccacc

SEQ ID NO: 966056 - RNA, 14 nt, Mycobacterium avium subsp. paratuberculosis
gcagcgccaggcag

SEQ ID NO: 966057 - RNA, 13 nt, Mycobacterium avium subsp. paratuberculosis
gcagcgcccagcc

SEQ ID NO: 966058 - RNA, 23 nt, Mycobacterium avium subsp. paratuberculosis
gcagcgcccagccgagccgggcc

SEQ ID NO: 966059 - RNA, 20 nt, Mycobacterium avium subsp. paratuberculosis
gcagcgccagcgcgcccgcc

SEQ ID NO: 966060 - RNA, 18 nt, Mycobacterium avium subsp. paratuberculosis
gcagcgccacaauggauc

SEQ ID NO: 966061 - RNA, 17 nt, Mycobacterium avium subsp. paratuberculosis
gcagcgccaccagcucc

SEQ ID NO: 966062 - RNA, 14 nt, Mycobacterium avium subsp. paratuberculosis
gcagcgccagcacc

SEQ ID NO: 966063 - RNA, 22 nt, Mycobacterium avium subsp. paratuberculosis
gcagcgcaucguugccggcggc

SEQ ID NO: 966064 - RNA, 21 nt, Mycobacterium avium subsp. paratuberculosis
gcagcgccaacauggcgcaga

SEQ ID NO: 966065 - RNA, 14 nt, Mycobacterium avium subsp. paratuberculosis
gcagcccgccagga

SEQ ID NO: 966066 - RNA, 16 nt, Mycobacterium avium subsp. paratuberculosis
gcagccacgacaccag

SEQ ID NO: 966067 - RNA, 23 nt, Mycobacterium avium subsp. paratuberculosis
gcagcccgaacagccgggccagc

SEQ ID NO: 966068 - RNA, 20 nt, Mycobacterium avium subsp. paratuberculosis
gcagcccgaacagccgggcg

SEQ ID NO: 966069 - RNA, 16 nt, Mycobacterium avium subsp. paratuberculosis
gcagcccgaccaccuc

SEQ ID NO: 966070 - RNA, 21 nt, Mycobacterium avium subsp. paratuberculosis
gcagcccgaccuucugcugca

SEQ ID NO: 966071 - RNA, 17 nt, Mycobacterium avium subsp. paratuberculosis
gcagcccgcguccagca

SEQ ID NO: 966072 - RNA, 14 nt, Mycobacterium avium subsp. paratuberculosis
gcagcccgccgacc

SEQ ID NO: 966073 - RNA, 14 nt, Mycobacterium avium subsp. paratuberculosis
gcagcccgccggga

SEQ ID NO: 966074 - RNA, 18 nt, Mycobacterium avium subsp. paratuberculosis
gcagcccgccgggaugcg

SEQ ID NO: 966075 - RNA, 16 nt, Mycobacterium avium subsp. paratuberculosis
gcagcccggcugcgca

SEQ ID NO: 966076 - RNA, 17 nt, Mycobacterium avium subsp. paratuberculosis
gcagccgcuccggcccg

SEQ ID NO: 966077 - RNA, 15 nt, Mycobacterium avium subsp. paratuberculosis
gcagccgcgcggccg

SEQ ID NO: 966078 - RNA, 18 nt, Mycobacterium avium subsp. paratuberculosis
gcagccgcgcgugcagcc

SEQ ID NO: 966079 - RNA, 20 nt, Mycobacterium avium subsp. paratuberculosis
gcagcccgucccggcccaug

SEQ ID NO: 966080 - RNA, 23 nt, Mycobacterium avium subsp. paratuberculosis
gcagcauguuggcguaguggguc

SEQ ID NO: 966081 - RNA, 24 nt, Mycobacterium avium subsp. paratuberculosis
gcagcauguuggcguagugggucg

SEQ ID NO: 966082 - RNA, 16 nt, Mycobacterium avium subsp. paratuberculosis
gcagcauucgccgggg

SEQ ID NO: 966083 - RNA, 15 nt, Mycobacterium avium subsp. paratuberculosis
gcagccaaccgccgg

SEQ ID NO: 966084 - RNA, 18 nt, Mycobacterium avium subsp. paratuberculosis
gcagcauggcccacagga

SEQ ID NO: 966085 - RNA, 16 nt, Mycobacterium avium subsp. paratuberculosis
gcagcaucucuugaug

SEQ ID NO: 966086 - RNA, 18 nt, Mycobacterium avium subsp. paratuberculosis
gcagcaucuccgagucgg

SEQ ID NO: 966087 - RNA, 18 nt, Mycobacterium avium subsp. paratuberculosis
gcaaagcguugccgcgcg

SEQ ID NO: 966088 - RNA, 21 nt, Mycobacterium avium subsp. paratuberculosis
gcaaacccagcaccaacagcg

SEQ ID NO: 966089 - RNA, 16 nt, Mycobacterium avium subsp. paratuberculosis
gcaaagaucggugccu

SEQ ID NO: 966090 - RNA, 20 nt, Mycobacterium avium subsp. paratuberculosis
gcaaacgaaucgagccgccu

SEQ ID NO: 966091 - RNA, 17 nt, Mycobacterium avium subsp. paratuberculosis
gcaaaccggaccgccgc

SEQ ID NO: 966092 - RNA, 16 nt, Mycobacterium avium subsp. paratuberculosis
gauuggaagagggcca

SEQ ID NO: 966093 - RNA, 22 nt, Mycobacterium avium subsp. paratuberculosis
gauugcggccgccggccagcuc

SEQ ID NO: 966094 - RNA, 22 nt, Mycobacterium avium subsp. paratuberculosis
gauucugguucagccguucuag

SEQ ID NO: 966095 - RNA, 16 nt, Mycobacterium avium subsp. paratuberculosis
gauucugcagccgcac

SEQ ID NO: 966096 - RNA, 14 nt, Mycobacterium avium subsp. paratuberculosis
gaugucgcccggcg

SEQ ID NO: 966097 - RNA, 15 nt, Mycobacterium avium subsp. paratuberculosis
gaugucgcccggcgc

SEQ ID NO: 966098 - RNA, 18 nt, Mycobacterium avium subsp. paratuberculosis
gaugucgcccggcggcac

SEQ ID NO: 966099 - RNA, 14 nt, Mycobacterium avium subsp. paratuberculosis
gaugucgccgcaga

SEQ ID NO: 966100 - RNA, 20 nt, Mycobacterium avium subsp. paratuberculosis
gaugucgccggcgaccgccu

SEQ ID NO: 966101 - RNA, 21 nt, Mycobacterium avium subsp. paratuberculosis
gaugucgacgaugcgcugcug

SEQ ID NO: 966102 - RNA, 11 nt, Mycobacterium avium subsp. paratuberculosis
gauuacuccuc

SEQ ID NO: 966103 - RNA, 22 nt, Mycobacterium avium subsp. paratuberculosis
gauggugcgccgggucgcggug

SEQ ID NO: 966104 - RNA, 14 nt, Mycobacterium avium subsp. paratuberculosis
gauggugugcagca

SEQ ID NO: 966105 - RNA, 23 nt, Mycobacterium avium subsp. paratuberculosis
gauggugaucucgccgcgguggu

SEQ ID NO: 966106 - RNA, 20 nt, Mycobacterium avium subsp. paratuberculosis
gauggugaccaaccacagcu

SEQ ID NO: 966107 - RNA, 21 nt, Mycobacterium avium subsp. paratuberculosis
gauggucgccuuguuggccca

SEQ ID NO: 966108 - RNA, 15 nt, Mycobacterium avium subsp. paratuberculosis
gauggucgucggguu

SEQ ID NO: 966109 - RNA, 19 nt, Mycobacterium avium subsp. paratuberculosis
gaugguggccgucggccug

SEQ ID NO: 966110 - RNA, 16 nt, Mycobacterium avium subsp. paratuberculosis
gaugguggcgcgcauc

SEQ ID NO: 966111 - RNA, 20 nt, Mycobacterium avium subsp. paratuberculosis
gaugguggcgcugccgagca

SEQ ID NO: 966112 - RNA, 15 nt, Mycobacterium avium subsp. paratuberculosis
gauggugggcaccgc

SEQ ID NO: 966113 - RNA, 15 nt, Mycobacterium avium subsp. paratuberculosis
gaugucacguugaug

SEQ ID NO: 966114 - RNA, 12 nt, Mycobacterium avium subsp. paratuberculosis
gauguaucagga

SEQ ID NO: 966115 - RNA, 15 nt, Mycobacterium avium subsp. paratuberculosis
gauggcgaccgcgca

SEQ ID NO: 966116 - RNA, 19 nt, Mycobacterium avium subsp. paratuberculosis
gauggcgcccggcagccgc

SEQ ID NO: 966117 - RNA, 21 nt, Mycobacterium avium subsp. paratuberculosis
gauggcgcccggcagccgcuc

SEQ ID NO: 966118 - RNA, 17 nt, Mycobacterium avium subsp. paratuberculosis
gauggcggccugcagga

SEQ ID NO: 966119 - RNA, 10 nt, Mycobacterium avium subsp. paratuberculosis
gauggcggcg

SEQ ID NO: 966120 - RNA, 21 nt, Mycobacterium avium subsp. paratuberculosis
gauggcggcguugcgggugga

SEQ ID NO: 966121 - RNA, 14 nt, Mycobacterium avium subsp. paratuberculosis
gauggcgcggccca

SEQ ID NO: 966122 - RNA, 18 nt, Mycobacterium avium subsp. paratuberculosis
gauggucgagggcguucg

SEQ ID NO: 966123 - RNA, 14 nt, Mycobacterium avium subsp. paratuberculosis
gauggucagccgca

SEQ ID NO: 966124 - RNA, 15 nt, Mycobacterium avium subsp. paratuberculosis
gauggucagccgcac

SEQ ID NO: 966125 - RNA, 12 nt, Mycobacterium avium subsp. paratuberculosis
gaugggucaggu

SEQ ID NO: 966126 - RNA, 14 nt, Mycobacterium avium subsp. paratuberculosis
gaugggucugcgcc

SEQ ID NO: 966127 - RNA, 12 nt, Mycobacterium avium subsp. paratuberculosis
gauggguguggu

SEQ ID NO: 966128 - RNA, 14 nt, Mycobacterium avium subsp. paratuberculosis
gaugggugugguca

SEQ ID NO: 966129 - RNA, 16 nt, Mycobacterium avium subsp. paratuberculosis
gauggagccgcccaug

SEQ ID NO: 966130 - RNA, 14 nt, Mycobacterium avium subsp. paratuberculosis
gauggaggucccga

SEQ ID NO: 966131 - RNA, 16 nt, Mycobacterium avium subsp. paratuberculosis
gauggacgcgguggug

SEQ ID NO: 966132 - RNA, 15 nt, Mycobacterium avium subsp. paratuberculosis
gauggacggggcgau

SEQ ID NO: 966133 - RNA, 15 nt, Mycobacterium avium subsp. paratuberculosis
gauggacagggcgac

SEQ ID NO: 966134 - RNA, 16 nt, Mycobacterium avium subsp. paratuberculosis
gauggaaggugcugaa

SEQ ID NO: 966135 - RNA, 22 nt, Mycobacterium avium subsp. paratuberculosis
gaugcggucgaugagcuggugc

SEQ ID NO: 966136 - RNA, 15 nt, Mycobacterium avium subsp. paratuberculosis
gaugcggucggcgcg

SEQ ID NO: 966137 - RNA, 14 nt, Mycobacterium avium subsp. paratuberculosis
gaugcugugcgcuu

SEQ ID NO: 966138 - RNA, 17 nt, Mycobacterium avium subsp. paratuberculosis
gaugccgagcagcucgg

SEQ ID NO: 966139 - RNA, 18 nt, Mycobacterium avium subsp. paratuberculosis
gaugccgagcagcucggc

SEQ ID NO: 966140 - RNA, 21 nt, Mycobacterium avium subsp. paratuberculosis
gaugccgcccaucagcaggac

SEQ ID NO: 966141 - RNA, 17 nt, Mycobacterium avium subsp. paratuberculosis
gaugccgcccaccaccg

SEQ ID NO: 966142 - RNA, 14 nt, Mycobacterium avium subsp. paratuberculosis
gaugccgcccagca

SEQ ID NO: 966143 - RNA, 18 nt, Mycobacterium avium subsp. paratuberculosis
gaugccgccgaagcggcg

SEQ ID NO: 966144 - RNA, 23 nt, Mycobacterium avium subsp. paratuberculosis
gaugccgaccgacagccgcacca

SEQ ID NO: 966145 - RNA, 19 nt, Mycobacterium avium subsp. paratuberculosis
gaugccgaacgucaccaac

SEQ ID NO: 966146 - RNA, 16 nt, Mycobacterium avium subsp. paratuberculosis
gaugcccugccccauc

SEQ ID NO: 966147 - RNA, 18 nt, Mycobacterium avium subsp. paratuberculosis
gaugcccuuggccagcag

SEQ ID NO: 966148 - RNA, 20 nt, Mycobacterium avium subsp. paratuberculosis
gaugcccuuggcggccacga

SEQ ID NO: 966149 - RNA, 16 nt, Mycobacterium avium subsp. paratuberculosis
gaugcccgggccgucc

SEQ ID NO: 966150 - RNA, 19 nt, Mycobacterium avium subsp. paratuberculosis
gaugcccgggccguccggg

SEQ ID NO: 966151 - RNA, 16 nt, Mycobacterium avium subsp. paratuberculosis
gaugcggcucccaccg

SEQ ID NO: 966152 - RNA, 14 nt, Mycobacterium avium subsp. paratuberculosis
gaugcgagccagcu

SEQ ID NO: 966153 - RNA, 15 nt, Mycobacterium avium subsp. paratuberculosis
gaugcgcaacagcau

SEQ ID NO: 966154 - RNA, 19 nt, Mycobacterium avium subsp. paratuberculosis
gaugcgcaccugcggcccc

SEQ ID NO: 966155 - RNA, 17 nt, Mycobacterium avium subsp. paratuberculosis
gaugccuuccucggcgc

SEQ ID NO: 966156 - RNA, 21 nt, Mycobacterium avium subsp. paratuberculosis
gaugaugaaaccggccagcag

SEQ ID NO: 966157 - RNA, 23 nt, Mycobacterium avium subsp. paratuberculosis
gaugaugccgucacugucggcgc

SEQ ID NO: 966158 - RNA, 14 nt, Mycobacterium avium subsp. paratuberculosis
gaugagccgcagcc

SEQ ID NO: 966159 - RNA, 23 nt, Mycobacterium avium subsp. paratuberculosis
gaugaucgucucggccgcggugc

SEQ ID NO: 966160 - RNA, 14 nt, Mycobacterium avium subsp. paratuberculosis
gaugaucucgaugc

SEQ ID NO: 966161 - RNA, 16 nt, Mycobacterium avium subsp. paratuberculosis
gaugaucucgccgagc

SEQ ID NO: 966162 - RNA, 15 nt, Mycobacterium avium subsp. paratuberculosis
gaugauccgcggcgc

SEQ ID NO: 966163 - RNA, 15 nt, Mycobacterium avium subsp. paratuberculosis
gaucgguuucuccac

SEQ ID NO: 966164 - RNA, 13 nt, Mycobacterium avium subsp. paratuberculosis
gaucggugcaggc

SEQ ID NO: 966165 - RNA, 15 nt, Mycobacterium avium subsp. paratuberculosis
gaucggugcgcggcg

SEQ ID NO: 966166 - RNA, 23 nt, Mycobacterium avium subsp. paratuberculosis
gaucgucgaacucgggcccgagg

SEQ ID NO: 966167 - RNA, 15 nt, Mycobacterium avium subsp. paratuberculosis
gaucgucgaccacca

SEQ ID NO: 966168 - RNA, 20 nt, Mycobacterium avium subsp. paratuberculosis
gaucgucgaccaccacgacc

SEQ ID NO: 966169 - RNA, 22 nt, Mycobacterium avium subsp. paratuberculosis
gaucgucggcagcgacgcggug

SEQ ID NO: 966170 - RNA, 20 nt, Mycobacterium avium subsp. paratuberculosis
gaucgugucccggcgcccuu

SEQ ID NO: 966171 - RNA, 20 nt, Mycobacterium avium subsp. paratuberculosis
gaugaauccgcgcagcagcg

SEQ ID NO: 966172 - RNA, 15 nt, Mycobacterium avium subsp. paratuberculosis
gaugacgugguugcg

SEQ ID NO: 966173 - RNA, 13 nt, Mycobacterium avium subsp. paratuberculosis
gaucgccggggcg

SEQ ID NO: 966174 - RNA, 19 nt, Mycobacterium avium subsp. paratuberculosis
gaucgccggacagcgggcc

SEQ ID NO: 966175 - RNA, 12 nt, Mycobacterium avium subsp. paratuberculosis
gaucgccgcgca

SEQ ID NO: 966176 - RNA, 16 nt, Mycobacterium avium subsp. paratuberculosis
gaucgcgcaucacccg

SEQ ID NO: 966177 - RNA, 16 nt, Mycobacterium avium subsp. paratuberculosis
gaucgcggcccgccgc

SEQ ID NO: 966178 - RNA, 15 nt, Mycobacterium avium subsp. paratuberculosis
gaucgcggcccgcgg

SEQ ID NO: 966179 - RNA, 14 nt, Mycobacterium avium subsp. paratuberculosis
gaucgcggccggcg

SEQ ID NO: 966180 - RNA, 18 nt, Mycobacterium avium subsp. paratuberculosis
gaucgcggcgaucagccc

SEQ ID NO: 966181 - RNA, 21 nt, Mycobacterium avium subsp. paratuberculosis
gaucgcgagcagggcgggcag

SEQ ID NO: 966182 - RNA, 13 nt, Mycobacterium avium subsp. paratuberculosis
gaucgccagcgcg

SEQ ID NO: 966183 - RNA, 18 nt, Mycobacterium avium subsp. paratuberculosis
gaucgccaguccggcgcc

SEQ ID NO: 966184 - RNA, 22 nt, Mycobacterium avium subsp. paratuberculosis
gaucgagaccaugucggccagg

SEQ ID NO: 966185 - RNA, 13 nt, Mycobacterium avium subsp. paratuberculosis
gaucgaggccagc

SEQ ID NO: 966186 - RNA, 16 nt, Mycobacterium avium subsp. paratuberculosis
gaucgaggccagcgcg

SEQ ID NO: 966187 - RNA, 19 nt, Mycobacterium avium subsp. paratuberculosis
gaucgaggccagcgcgauc

SEQ ID NO: 966188 - RNA, 20 nt, Mycobacterium avium subsp. paratuberculosis
gaucgaucccuuggcggcgg

SEQ ID NO: 966189 - RNA, 18 nt, Mycobacterium avium subsp. paratuberculosis
gaucgaugaauccgcgca

SEQ ID NO: 966190 - RNA, 13 nt, Mycobacterium avium subsp. paratuberculosis
gaucgcggcgguc

SEQ ID NO: 966191 - RNA, 18 nt, Mycobacterium avium subsp. paratuberculosis
gaucgcuucggccagcgc

SEQ ID NO: 966192 - RNA, 17 nt, Mycobacterium avium subsp. paratuberculosis
gaucgcugaugcgcaac

SEQ ID NO: 966193 - RNA, 15 nt, Mycobacterium avium subsp. paratuberculosis
gaucggaccgcacca

SEQ ID NO: 966194 - RNA, 19 nt, Mycobacterium avium subsp. paratuberculosis
gaucggagacguccucggu

SEQ ID NO: 966195 - RNA, 14 nt, Mycobacterium avium subsp. paratuberculosis
gaucggggcgcagc

SEQ ID NO: 966196 - RNA, 15 nt, Mycobacterium avium subsp. paratuberculosis
gaucgggaaguccuc

SEQ ID NO: 966197 - RNA, 13 nt, Mycobacterium avium subsp. paratuberculosis
gaucggucugccu

SEQ ID NO: 966198 - RNA, 12 nt, Mycobacterium avium subsp. paratuberculosis
gaucgggcgguc

SEQ ID NO: 966199 - RNA, 16 nt, Mycobacterium avium subsp. paratuberculosis
gaucggcuccagcgcc

SEQ ID NO: 966200 - RNA, 18 nt, Mycobacterium avium subsp. paratuberculosis
gaucggcucggcgcccca

SEQ ID NO: 966201 - RNA, 15 nt, Mycobacterium avium subsp. paratuberculosis
gaucggcgcccaccg

SEQ ID NO: 966202 - RNA, 19 nt, Mycobacterium avium subsp. paratuberculosis
gaucggccgcugcccgggc

SEQ ID NO: 966203 - RNA, 14 nt, Mycobacterium avium subsp. paratuberculosis
gaucggccgggaga

SEQ ID NO: 966204 - RNA, 17 nt, Mycobacterium avium subsp. paratuberculosis
gauccaccaucuuccau

SEQ ID NO: 966205 - RNA, 17 nt, Mycobacterium avium subsp. paratuberculosis
gauccacgccuccggca

SEQ ID NO: 966206 - RNA, 16 nt, Mycobacterium avium subsp. paratuberculosis
gauccacuccagcacc

SEQ ID NO: 966207 - RNA, 20 nt, Mycobacterium avium subsp. paratuberculosis
gauccacuccgaggucagcg

SEQ ID NO: 966208 - RNA, 11 nt, Mycobacterium avium subsp. paratuberculosis
gauccacggcg

SEQ ID NO: 966209 - RNA, 15 nt, Mycobacterium avium subsp. paratuberculosis
gauccagagcaucag

SEQ ID NO: 966210 - RNA, 22 nt, Mycobacterium avium subsp. paratuberculosis
gauccaccgcgcggccagcggc

SEQ ID NO: 966211 - RNA, 22 nt, Mycobacterium avium subsp. paratuberculosis
gauccagccgucguugcgggcg

SEQ ID NO: 966212 - RNA, 16 nt, Mycobacterium avium subsp. paratuberculosis
gaucccgaugccgcgc

SEQ ID NO: 966213 - RNA, 17 nt, Mycobacterium avium subsp. paratuberculosis
gauccgaggguucggug

SEQ ID NO: 966214 - RNA, 17 nt, Mycobacterium avium subsp. paratuberculosis
gaucccuuggcggcggc

SEQ ID NO: 966215 - RNA, 16 nt, Mycobacterium avium subsp. paratuberculosis
gauccgaucagcagca

SEQ ID NO: 966216 - RNA, 15 nt, Mycobacterium avium subsp. paratuberculosis
gauccgaugcagggc

SEQ ID NO: 966217 - RNA, 22 nt, Mycobacterium avium subsp. paratuberculosis
gauccgcgccgcgaugcaacac

SEQ ID NO: 966218 - RNA, 22 nt, Mycobacterium avium subsp. paratuberculosis
gauccgcgcggccaccagcgcg

SEQ ID NO: 966219 - RNA, 13 nt, Mycobacterium avium subsp. paratuberculosis
gauccgcgcggcg

SEQ ID NO: 966220 - RNA, 20 nt, Mycobacterium avium subsp. paratuberculosis
gaucccggcgagcacgccgc

SEQ ID NO: 966221 - RNA, 14 nt, Mycobacterium avium subsp. paratuberculosis
gaucccggccagca

SEQ ID NO: 966222 - RNA, 16 nt, Mycobacterium avium subsp. paratuberculosis
gaucccggccagcacc

SEQ ID NO: 966223 - RNA, 15 nt, Mycobacterium avium subsp. paratuberculosis
gaucccggggcgcgc

SEQ ID NO: 966224 - RNA, 20 nt, Mycobacterium avium subsp. paratuberculosis
gaucccggugaugccggcau

SEQ ID NO: 966225 - RNA, 19 nt, Mycobacterium avium subsp. paratuberculosis
gaucccguaggucgccucc

SEQ ID NO: 966226 - RNA, 18 nt, Mycobacterium avium subsp. paratuberculosis
gauccuuugcggccccaa

SEQ ID NO: 966227 - RNA, 19 nt, Mycobacterium avium subsp. paratuberculosis
gauccuuugcggccccaau

SEQ ID NO: 966228 - RNA, 12 nt, Mycobacterium avium subsp. paratuberculosis
gaucgaaaggac

SEQ ID NO: 966229 - RNA, 15 nt, Mycobacterium avium subsp. paratuberculosis
gaucgaaaggacggg

SEQ ID NO: 966230 - RNA, 17 nt, Mycobacterium avium subsp. paratuberculosis
gaucgaaaugaccgcgc

SEQ ID NO: 966231 - RNA, 13 nt, Mycobacterium avium subsp. paratuberculosis
gaucgaacagggc

SEQ ID NO: 966232 - RNA, 22 nt, Mycobacterium avium subsp. paratuberculosis
gaucgacgccaugggcccagca

SEQ ID NO: 966233 - RNA, 21 nt, Mycobacterium avium subsp. paratuberculosis
gauccgcccggcccgcaugca

SEQ ID NO: 966234 - RNA, 18 nt, Mycobacterium avium subsp. paratuberculosis
gauccggcgccgcgggcg

SEQ ID NO: 966235 - RNA, 17 nt, Mycobacterium avium subsp. paratuberculosis
gauccgggcacgcagcg

SEQ ID NO: 966236 - RNA, 17 nt, Mycobacterium avium subsp. paratuberculosis
gauccggcuccacagca

SEQ ID NO: 966237 - RNA, 13 nt, Mycobacterium avium subsp. paratuberculosis
gauccggggcacg

SEQ ID NO: 966238 - RNA, 15 nt, Mycobacterium avium subsp. paratuberculosis
gauccgguccagccc

SEQ ID NO: 966239 - RNA, 16 nt, Mycobacterium avium subsp. paratuberculosis
gauccggugaccgcga

SEQ ID NO: 966240 - RNA, 20 nt, Mycobacterium avium subsp. paratuberculosis
gauccucgccgcgggccagc

SEQ ID NO: 966241 - RNA, 14 nt, Mycobacterium avium subsp. paratuberculosis
gauaucggccgcgg

SEQ ID NO: 966242 - RNA, 14 nt, Mycobacterium avium subsp. paratuberculosis
gauauccagccuug

SEQ ID NO: 966243 - RNA, 15 nt, Mycobacterium avium subsp. paratuberculosis
gauauccagccuugc

SEQ ID NO: 966244 - RNA, 22 nt, Mycobacterium avium subsp. paratuberculosis
gauauccagccuugcagccgcu

SEQ ID NO: 966245 - RNA, 22 nt, Mycobacterium avium subsp. paratuberculosis
gauaugcgccugcacggugccg

SEQ ID NO: 966246 - RNA, 22 nt, Mycobacterium avium subsp. paratuberculosis
gauaugcugcaacggcuggcgc

SEQ ID NO: 966247 - RNA, 14 nt, Mycobacterium avium subsp. paratuberculosis
gaucaacagccgcc

SEQ ID NO: 966248 - RNA, 22 nt, Mycobacterium avium subsp. paratuberculosis
gaucaacaccgccagcaccgcc

SEQ ID NO: 966249 - RNA, 23 nt, Mycobacterium avium subsp. paratuberculosis
gaucaacaccaacgacagcgacg

SEQ ID NO: 966250 - RNA, 18 nt, Mycobacterium avium subsp. paratuberculosis
gaucaacugaucgagcuc

SEQ ID NO: 966251 - RNA, 14 nt, Mycobacterium avium subsp. paratuberculosis
gaucaaccacacca

SEQ ID NO: 966252 - RNA, 18 nt, Mycobacterium avium subsp. paratuberculosis
gaucaaccacaccagcau

SEQ ID NO: 966253 - RNA, 13 nt, Mycobacterium avium subsp. paratuberculosis
gaucagcagcagg

SEQ ID NO: 966254 - RNA, 14 nt, Mycobacterium avium subsp. paratuberculosis
gaucagcagccggg

SEQ ID NO: 966255 - RNA, 18 nt, Mycobacterium avium subsp. paratuberculosis
gaucagcccgcccaccac

SEQ ID NO: 966256 - RNA, 12 nt, Mycobacterium avium subsp. paratuberculosis
gaucagcccggg

SEQ ID NO: 966257 - RNA, 23 nt, Mycobacterium avium subsp. paratuberculosis
gaucagcgccugguccucccggg

SEQ ID NO: 966258 - RNA, 14 nt, Mycobacterium avium subsp. paratuberculosis
gaucagcgccagca

SEQ ID NO: 966259 - RNA, 21 nt, Mycobacterium avium subsp. paratuberculosis
gaucagcgccagcaacaccca

SEQ ID NO: 966260 - RNA, 16 nt, Mycobacterium avium subsp. paratuberculosis
gaucagcgccaggugg

SEQ ID NO: 966261 - RNA, 20 nt, Mycobacterium avium subsp. paratuberculosis
gaucagcgccagguggguga

SEQ ID NO: 966262 - RNA, 14 nt, Mycobacterium avium subsp. paratuberculosis
gaucagcgacggcc

SEQ ID NO: 966263 - RNA, 17 nt, Mycobacterium avium subsp. paratuberculosis
gaucauuugaccgcaca

SEQ ID NO: 966264 - RNA, 18 nt, Mycobacterium avium subsp. paratuberculosis
gaucauggucggcgacgc

SEQ ID NO: 966265 - RNA, 22 nt, Mycobacterium avium subsp. paratuberculosis
gaucagggugucgaacagcagg

SEQ ID NO: 966266 - RNA, 20 nt, Mycobacterium avium subsp. paratuberculosis
gaucaggucgccgauccagc

SEQ ID NO: 966267 - RNA, 18 nt, Mycobacterium avium subsp. paratuberculosis
gaucaggaucggcgggcg

SEQ ID NO: 966268 - RNA, 14 nt, Mycobacterium avium subsp. paratuberculosis
gaucaggaugacgc

SEQ ID NO: 966269 - RNA, 15 nt, Mycobacterium avium subsp. paratuberculosis
gaucaggccccaccc

SEQ ID NO: 966270 - RNA, 13 nt, Mycobacterium avium subsp. paratuberculosis
gaucagggcggcg

SEQ ID NO: 966271 - RNA, 14 nt, Mycobacterium avium subsp. paratuberculosis
gaucagggcggcgc

SEQ ID NO: 966272 - RNA, 23 nt, Mycobacterium avium subsp. paratuberculosis
gaucagggcggcgccgcggcccu

SEQ ID NO: 966273 - RNA, 17 nt, Mycobacterium avium subsp. paratuberculosis
gaucagggcccacagca

SEQ ID NO: 966274 - RNA, 20 nt, Mycobacterium avium subsp. paratuberculosis
gaucagggcccacagcagcc

SEQ ID NO: 966275 - RNA, 15 nt, Mycobacterium avium subsp. paratuberculosis
gaucagcgguccacc

SEQ ID NO: 966276 - RNA, 17 nt, Mycobacterium avium subsp. paratuberculosis
gaucagcgggacgaggg

SEQ ID NO: 966277 - RNA, 12 nt, Mycobacterium avium subsp. paratuberculosis
gaucagcuccuc

SEQ ID NO: 966278 - RNA, 16 nt, Mycobacterium avium subsp. paratuberculosis
gaucagcguggucagc

SEQ ID NO: 966279 - RNA, 17 nt, Mycobacterium avium subsp. paratuberculosis
gaucagcguggucagcg

SEQ ID NO: 966280 - RNA, 13 nt, Mycobacterium avium subsp. paratuberculosis
gaucagcucgccg

SEQ ID NO: 966281 - RNA, 17 nt, Mycobacterium avium subsp. paratuberculosis
gauacccgggagcaucg

SEQ ID NO: 966282 - RNA, 18 nt, Mycobacterium avium subsp. paratuberculosis
gauacccguugcgcccca

SEQ ID NO: 966283 - RNA, 18 nt, Mycobacterium avium subsp. paratuberculosis
gauacccaugaucgccag

SEQ ID NO: 966284 - RNA, 17 nt, Mycobacterium avium subsp. paratuberculosis
gauacaggagggccagg

SEQ ID NO: 966285 - RNA, 13 nt, Mycobacterium avium subsp. paratuberculosis
gauaccagccgcg

SEQ ID NO: 966286 - RNA, 21 nt, Mycobacterium avium subsp. paratuberculosis
gauacgcccggccaccuggcc

SEQ ID NO: 966287 - RNA, 19 nt, Mycobacterium avium subsp. paratuberculosis
gaguucgaccuccacccgc

SEQ ID NO: 966288 - RNA, 17 nt, Mycobacterium avium subsp. paratuberculosis
gaguucgaccucgguga

SEQ ID NO: 966289 - RNA, 22 nt, Mycobacterium avium subsp. paratuberculosis
gaguucugguaggcggccggga

SEQ ID NO: 966290 - RNA, 20 nt, Mycobacterium avium subsp. paratuberculosis
gaguucggugaacugcagcc

SEQ ID NO: 966291 - RNA, 16 nt, Mycobacterium avium subsp. paratuberculosis
gagucaagccggcaug

SEQ ID NO: 966292 - RNA, 14 nt, Mycobacterium avium subsp. paratuberculosis
gagugcggcgcggu

SEQ ID NO: 966293 - RNA, 17 nt, Mycobacterium avium subsp. paratuberculosis
gagugcgccgugcagca

SEQ ID NO: 966294 - RNA, 21 nt, Mycobacterium avium subsp. paratuberculosis
gagugcgccgugcagcacgcc

SEQ ID NO: 966295 - RNA, 16 nt, Mycobacterium avium subsp. paratuberculosis
gagugccggccagcuc

SEQ ID NO: 966296 - RNA, 14 nt, Mycobacterium avium subsp. paratuberculosis
gagucgcugcagca

SEQ ID NO: 966297 - RNA, 13 nt, Mycobacterium avium subsp. paratuberculosis
gagucggccaccg

SEQ ID NO: 966298 - RNA, 21 nt, Mycobacterium avium subsp. paratuberculosis
gagucgggaaaucggacccag

SEQ ID NO: 966299 - RNA, 13 nt, Mycobacterium avium subsp. paratuberculosis
gagucaucgccac

SEQ ID NO: 966300 - RNA, 14 nt, Mycobacterium avium subsp. paratuberculosis
gagucaucgccacc

SEQ ID NO: 966301 - RNA, 14 nt, Mycobacterium avium subsp. paratuberculosis
gccguccaccagau

SEQ ID NO: 966302 - RNA, 17 nt, Mycobacterium avium subsp. paratuberculosis
gccgucaucaccgccga

SEQ ID NO: 966303 - RNA, 20 nt, Mycobacterium avium subsp. paratuberculosis
gccgucaucaccgccgaggg

SEQ ID NO: 966304 - RNA, 22 nt, Mycobacterium avium subsp. paratuberculosis
gccgucaucaccgccgagggcc

SEQ ID NO: 966305 - RNA, 15 nt, Mycobacterium avium subsp. paratuberculosis
gccgucccagccgga

SEQ ID NO: 966306 - RNA, 17 nt, Mycobacterium avium subsp. paratuberculosis
gccguccaggccgcuga

SEQ ID NO: 966307 - RNA, 21 nt, Mycobacterium avium subsp. paratuberculosis
gccguccacccggcccaccac

SEQ ID NO: 966308 - RNA, 20 nt, Mycobacterium avium subsp. paratuberculosis
gccgucaccggccauccgcu

SEQ ID NO: 966309 - RNA, 13 nt, Mycobacterium avium subsp. paratuberculosis
gccgucacgcugg

SEQ ID NO: 966310 - RNA, 19 nt, Mycobacterium avium subsp. paratuberculosis
gccgucaggaacgccggcu

SEQ ID NO: 966311 - RNA, 16 nt, Mycobacterium avium subsp. paratuberculosis
gccgucacaccgcggc

SEQ ID NO: 966312 - RNA, 20 nt, Mycobacterium avium subsp. paratuberculosis
gccguagcggucgccccaga

SEQ ID NO: 966313 - RNA, 21 nt, Mycobacterium avium subsp. paratuberculosis
gccguagcggucgccccagaa

SEQ ID NO: 966314 - RNA, 23 nt, Mycobacterium avium subsp. paratuberculosis
gccguagcgcugggugaacaccc

SEQ ID NO: 966315 - RNA, 22 nt, Mycobacterium avium subsp. paratuberculosis
gccguagcgcaugaugcccagg

SEQ ID NO: 966316 - RNA, 14 nt, Mycobacterium avium subsp. paratuberculosis
gccguagcgccggc

SEQ ID NO: 966317 - RNA, 21 nt, Mycobacterium avium subsp. paratuberculosis
gccguagaucucgcgccgcgc

SEQ ID NO: 966318 - RNA, 15 nt, Mycobacterium avium subsp. paratuberculosis
gccguacgcgccggc

SEQ ID NO: 966319 - RNA, 19 nt, Mycobacterium avium subsp. paratuberculosis
gccguaaguggcgccgcgg

SEQ ID NO: 966320 - RNA, 23 nt, Mycobacterium avium subsp. paratuberculosis
gccguacagcugguccggccggc

SEQ ID NO: 966321 - RNA, 16 nt, Mycobacterium avium subsp. paratuberculosis
gccguacacggcggcg

SEQ ID NO: 966322 - RNA, 23 nt, Mycobacterium avium subsp. paratuberculosis
gccgguuucgucggucugcaggu

SEQ ID NO: 966323 - RNA, 19 nt, Mycobacterium avium subsp. paratuberculosis
gccggugggcggcgcccga

SEQ ID NO: 966324 - RNA, 13 nt, Mycobacterium avium subsp. paratuberculosis
gccggugucgggg

SEQ ID NO: 966325 - RNA, 19 nt, Mycobacterium avium subsp. paratuberculosis
gccggugucggugcgaccc

SEQ ID NO: 966326 - RNA, 14 nt, Mycobacterium avium subsp. paratuberculosis
gccgguggccgcgc

SEQ ID NO: 966327 - RNA, 17 nt, Mycobacterium avium subsp. paratuberculosis
gccgguggccgcgcugg

SEQ ID NO: 966328 - RNA, 13 nt, Mycobacterium avium subsp. paratuberculosis
gccgguggccggu

SEQ ID NO: 966329 - RNA, 18 nt, Mycobacterium avium subsp. paratuberculosis
gccgguugacccucagca

SEQ ID NO: 966330 - RNA, 21 nt, Mycobacterium avium subsp. paratuberculosis
gccgguugacccucagcaggg

SEQ ID NO: 966331 - RNA, 14 nt, Mycobacterium avium subsp. paratuberculosis
gccgguuccuccga

SEQ ID NO: 966332 - RNA, 15 nt, Mycobacterium avium subsp. paratuberculosis
gccgguuccuccgac

SEQ ID NO: 966333 - RNA, 16 nt, Mycobacterium avium subsp. paratuberculosis
gccguggacccgcccc

SEQ ID NO: 966334 - RNA, 20 nt, Mycobacterium avium subsp. paratuberculosis
gccguggcccauguggccug

SEQ ID NO: 966335 - RNA, 18 nt, Mycobacterium avium subsp. paratuberculosis
gccguggcccgcccagcg

SEQ ID NO: 966336 - RNA, 13 nt, Mycobacterium avium subsp. paratuberculosis
gccguggcaggca

SEQ ID NO: 966337 - RNA, 23 nt, Mycobacterium avium subsp. paratuberculosis
gccgugaguguugaagccgcgga

SEQ ID NO: 966338 - RNA, 15 nt, Mycobacterium avium subsp. paratuberculosis
gccgugcgccccgcc

SEQ ID NO: 966339 - RNA, 13 nt, Mycobacterium avium subsp. paratuberculosis
gccgugcgcagca

SEQ ID NO: 966340 - RNA, 13 nt, Mycobacterium avium subsp. paratuberculosis
gccguccccgcgc

SEQ ID NO: 966341 - RNA, 15 nt, Mycobacterium avium subsp. paratuberculosis
gccguccgcggcggc

SEQ ID NO: 966342 - RNA, 18 nt, Mycobacterium avium subsp. paratuberculosis
gccguccgcggcggccag

SEQ ID NO: 966343 - RNA, 13 nt, Mycobacterium avium subsp. paratuberculosis
gccguccggggcc

SEQ ID NO: 966344 - RNA, 14 nt, Mycobacterium avium subsp. paratuberculosis
gccguccggggccg

SEQ ID NO: 966345 - RNA, 16 nt, Mycobacterium avium subsp. paratuberculosis
gccgucgagccuggug

SEQ ID NO: 966346 - RNA, 17 nt, Mycobacterium avium subsp. paratuberculosis
gccgucgacggugauca

SEQ ID NO: 966347 - RNA, 17 nt, Mycobacterium avium subsp. paratuberculosis
gccgucgaccccgccgg

SEQ ID NO: 966348 - RNA, 18 nt, Mycobacterium avium subsp. paratuberculosis
gccgucgaccccgccggc

SEQ ID NO: 966349 - RNA, 15 nt, Mycobacterium avium subsp. paratuberculosis
gccgucgaccacgau

SEQ ID NO: 966350 - RNA, 17 nt, Mycobacterium avium subsp. paratuberculosis
gccgucgauccacccac

SEQ ID NO: 966351 - RNA, 16 nt, Mycobacterium avium subsp. paratuberculosis
gccgucgaucgcccgc

SEQ ID NO: 966352 - RNA, 18 nt, Mycobacterium avium subsp. paratuberculosis
gccgucgaucgcccgcuc

SEQ ID NO: 966353 - RNA, 19 nt, Mycobacterium avium subsp. paratuberculosis
gccgucgauggcgcggccc

SEQ ID NO: 966354 - RNA, 21 nt, Mycobacterium avium subsp. paratuberculosis
gccgucgccgcgcccgccggc

SEQ ID NO: 966355 - RNA, 17 nt, Mycobacterium avium subsp. paratuberculosis
gccgucgaggcgcugca

SEQ ID NO: 966356 - RNA, 14 nt, Mycobacterium avium subsp. paratuberculosis
gccgucgcaucagc

SEQ ID NO: 966357 - RNA, 16 nt, Mycobacterium avium subsp. paratuberculosis
gccgucgcgcaccacc

SEQ ID NO: 966358 - RNA, 15 nt, Mycobacterium avium subsp. paratuberculosis
gccgucgccgggcgg

SEQ ID NO: 966359 - RNA, 22 nt, Mycobacterium avium subsp. paratuberculosis
gccgucgcgggagagcgcgggc

SEQ ID NO: 966360 - RNA, 17 nt, Mycobacterium avium subsp. paratuberculosis
gccgucggccagcagcg

SEQ ID NO: 966361 - RNA, 14 nt, Mycobacterium avium subsp. paratuberculosis
gccgucggccgccg

SEQ ID NO: 966362 - RNA, 15 nt, Mycobacterium avium subsp. paratuberculosis
gccgucggcgccgcc

SEQ ID NO: 966363 - RNA, 17 nt, Mycobacterium avium subsp. paratuberculosis
gccgucggcgccgccga

SEQ ID NO: 966364 - RNA, 20 nt, Mycobacterium avium subsp. paratuberculosis
gccgucggcgccgccgagcc

SEQ ID NO: 966365 - RNA, 19 nt, Mycobacterium avium subsp. paratuberculosis
gccgucucgucggccgcga

SEQ ID NO: 966366 - RNA, 15 nt, Mycobacterium avium subsp. paratuberculosis
gccgggaacagcgac

SEQ ID NO: 966367 - RNA, 21 nt, Mycobacterium avium subsp. paratuberculosis
gccgggaacagcgacgcccag

SEQ ID NO: 966368 - RNA, 14 nt, Mycobacterium avium subsp. paratuberculosis
gccggcucagcggc

SEQ ID NO: 966369 - RNA, 22 nt, Mycobacterium avium subsp. paratuberculosis
gccggcucagcggcaacugcag

SEQ ID NO: 966370 - RNA, 19 nt, Mycobacterium avium subsp. paratuberculosis
gccgggacgggcauccggc

SEQ ID NO: 966371 - RNA, 14 nt, Mycobacterium avium subsp. paratuberculosis
gccgggaaguuggc

SEQ ID NO: 966372 - RNA, 17 nt, Mycobacterium avium subsp. paratuberculosis
gccgggaaguuggccuc

SEQ ID NO: 966373 - RNA, 18 nt, Mycobacterium avium subsp. paratuberculosis
gccgggaaguuggccucc

SEQ ID NO: 966374 - RNA, 18 nt, Mycobacterium avium subsp. paratuberculosis
gccgggaaugucgcgcag

SEQ ID NO: 966375 - RNA, 20 nt, Mycobacterium avium subsp. paratuberculosis
gccgggauagagcaccgcgc

SEQ ID NO: 966376 - RNA, 20 nt, Mycobacterium avium subsp. paratuberculosis
gccgggauauucgcccagcg

SEQ ID NO: 966377 - RNA, 19 nt, Mycobacterium avium subsp. paratuberculosis
gccgggaucggcagcgcgc

SEQ ID NO: 966378 - RNA, 20 nt, Mycobacterium avium subsp. paratuberculosis
gccgggaucggcagcgcgcc

SEQ ID NO: 966379 - RNA, 15 nt, Mycobacterium avium subsp. paratuberculosis
gccgggaucggcggg

SEQ ID NO: 966380 - RNA, 18 nt, Mycobacterium avium subsp. paratuberculosis
gccgggauggugagcccg

SEQ ID NO: 966381 - RNA, 17 nt, Mycobacterium avium subsp. paratuberculosis
gccgggcgcgggcgccg

SEQ ID NO: 966382 - RNA, 19 nt, Mycobacterium avium subsp. paratuberculosis
gccggcgguggugccgccg

SEQ ID NO: 966383 - RNA, 16 nt, Mycobacterium avium subsp. paratuberculosis
gccggcgucacucugg

SEQ ID NO: 966384 - RNA, 14 nt, Mycobacterium avium subsp. paratuberculosis
gccggcguccagcg

SEQ ID NO: 966385 - RNA, 19 nt, Mycobacterium avium subsp. paratuberculosis
gccggcguccagcgccgcc

SEQ ID NO: 966386 - RNA, 18 nt, Mycobacterium avium subsp. paratuberculosis
gccggcguccaggcgcac

SEQ ID NO: 966387 - RNA, 16 nt, Mycobacterium avium subsp. paratuberculosis
gccggcgggugagccg

SEQ ID NO: 966388 - RNA, 20 nt, Mycobacterium avium subsp. paratuberculosis
gccggcgguaugcccgggcc

SEQ ID NO: 966389 - RNA, 20 nt, Mycobacterium avium subsp. paratuberculosis
gccggcgguaccgccgaucg

SEQ ID NO: 966390 - RNA, 16 nt, Mycobacterium avium subsp. paratuberculosis
gccggcguuguccagg

SEQ ID NO: 966391 - RNA, 15 nt, Mycobacterium avium subsp. paratuberculosis
gccggcgugcugggc

SEQ ID NO: 966392 - RNA, 20 nt, Mycobacterium avium subsp. paratuberculosis
gccggcguuauuugugcgcu

SEQ ID NO: 966393 - RNA, 23 nt, Mycobacterium avium subsp. paratuberculosis
gccggcgugucggcgccaccggg

SEQ ID NO: 966394 - RNA, 17 nt, Mycobacterium avium subsp. paratuberculosis
gccggcggugcggcggg

SEQ ID NO: 966395 - RNA, 15 nt, Mycobacterium avium subsp. paratuberculosis
gccggcgucgccgcu

SEQ ID NO: 966396 - RNA, 16 nt, Mycobacterium avium subsp. paratuberculosis
gccggcgucgccgcuc

SEQ ID NO: 966397 - RNA, 14 nt, Mycobacterium avium subsp. paratuberculosis
gccggcgucgggac

SEQ ID NO: 966398 - RNA, 19 nt, Mycobacterium avium subsp. paratuberculosis
gccggcgucgucgucgcag

SEQ ID NO: 966399 - RNA, 21 nt, Mycobacterium avium subsp. paratuberculosis
gccggcgugcacaggccgccg

SEQ ID NO: 966400 - RNA, 22 nt, Mycobacterium avium subsp. paratuberculosis
gccggcgugcacaggccgccgc

SEQ ID NO: 966401 - RNA, 17 nt, Mycobacterium avium subsp. paratuberculosis
gccggcgcggccagcug

SEQ ID NO: 966402 - RNA, 20 nt, Mycobacterium avium subsp. paratuberculosis
gccggcggcgcccgcggccu

SEQ ID NO: 966403 - RNA, 14 nt, Mycobacterium avium subsp. paratuberculosis
gccggcggcgcggc

SEQ ID NO: 966404 - RNA, 15 nt, Mycobacterium avium subsp. paratuberculosis
gccggcggccuccgc

SEQ ID NO: 966405 - RNA, 17 nt, Mycobacterium avium subsp. paratuberculosis
gccggcggccuccgcca

SEQ ID NO: 966406 - RNA, 14 nt, Mycobacterium avium subsp. paratuberculosis
gccggcggccgccg

SEQ ID NO: 966407 - RNA, 16 nt, Mycobacterium avium subsp. paratuberculosis
gccggcggccgccgcc

SEQ ID NO: 966408 - RNA, 17 nt, Mycobacterium avium subsp. paratuberculosis
gccggcggccgccgccc

SEQ ID NO: 966409 - RNA, 19 nt, Mycobacterium avium subsp. paratuberculosis
gccggcggccgccgcccgc

SEQ ID NO: 966410 - RNA, 14 nt, Mycobacterium avium subsp. paratuberculosis
gccggcgcgcgagc

SEQ ID NO: 966411 - RNA, 17 nt, Mycobacterium avium subsp. paratuberculosis
gccggcgcgcaacagcg

SEQ ID NO: 966412 - RNA, 18 nt, Mycobacterium avium subsp. paratuberculosis
gccggcgcgcaccccggc

SEQ ID NO: 966413 - RNA, 13 nt, Mycobacterium avium subsp. paratuberculosis
gccggcgccgucg

SEQ ID NO: 966414 - RNA, 23 nt, Mycobacterium avium subsp. paratuberculosis
gccggcgccgucgauccacccac

SEQ ID NO: 966415 - RNA, 20 nt, Mycobacterium avium subsp. paratuberculosis
gccggcgccggugccgcagc

SEQ ID NO: 966416 - RNA, 15 nt, Mycobacterium avium subsp. paratuberculosis
gccggcgccggcggu

SEQ ID NO: 966417 - RNA, 16 nt, Mycobacterium avium subsp. paratuberculosis
gccggcgccgcgggug

SEQ ID NO: 966418 - RNA, 20 nt, Mycobacterium avium subsp. paratuberculosis
gccggcgccgcgggugcggc

SEQ ID NO: 966419 - RNA, 15 nt, Mycobacterium avium subsp. paratuberculosis
gccggcgccggaggg

SEQ ID NO: 966420 - RNA, 12 nt, Mycobacterium avium subsp. paratuberculosis
gccggcgccggc

SEQ ID NO: 966421 - RNA, 14 nt, Mycobacterium avium subsp. paratuberculosis
gccggcgccgccgg

SEQ ID NO: 966422 - RNA, 15 nt, Mycobacterium avium subsp. paratuberculosis
gccggccaggccggc

SEQ ID NO: 966423 - RNA, 14 nt, Mycobacterium avium subsp. paratuberculosis
gccggccaggcgac

SEQ ID NO: 966424 - RNA, 12 nt, Mycobacterium avium subsp. paratuberculosis
gccggccaggca

SEQ ID NO: 966425 - RNA, 16 nt, Mycobacterium avium subsp. paratuberculosis
gccggccaggcacagc

SEQ ID NO: 966426 - RNA, 19 nt, Mycobacterium avium subsp. paratuberculosis
gccggccagcgucgcgccg

SEQ ID NO: 966427 - RNA, 13 nt, Mycobacterium avium subsp. paratuberculosis
gccggccagcucc

SEQ ID NO: 966428 - RNA, 23 nt, Mycobacterium avium subsp. paratuberculosis
gccggccagcuuuccggccgccu

SEQ ID NO: 966429 - RNA, 13 nt, Mycobacterium avium subsp. paratuberculosis
gccggccagcggc

SEQ ID NO: 966430 - RNA, 14 nt, Mycobacterium avium subsp. paratuberculosis
gccggccagccgcg

SEQ ID NO: 966431 - RNA, 15 nt, Mycobacterium avium subsp. paratuberculosis
gccggccagccgcgc

SEQ ID NO: 966432 - RNA, 17 nt, Mycobacterium avium subsp. paratuberculosis
gccggccagccggcucu

SEQ ID NO: 966433 - RNA, 13 nt, Mycobacterium avium subsp. paratuberculosis
gccggccagcagc

SEQ ID NO: 966434 - RNA, 15 nt, Mycobacterium avium subsp. paratuberculosis
gccggccagcagcag

SEQ ID NO: 966435 - RNA, 18 nt, Mycobacterium avium subsp. paratuberculosis
gccggccagcacacccuc

SEQ ID NO: 966436 - RNA, 13 nt, Mycobacterium avium subsp. paratuberculosis
gccggccagcacc

SEQ ID NO: 966437 - RNA, 16 nt, Mycobacterium avium subsp. paratuberculosis
gccggccaccggcgcg

SEQ ID NO: 966438 - RNA, 13 nt, Mycobacterium avium subsp. paratuberculosis
gccggccaaggca

SEQ ID NO: 966439 - RNA, 18 nt, Mycobacterium avium subsp. paratuberculosis
gccggugcguccgccggc

SEQ ID NO: 966440 - RNA, 15 nt, Mycobacterium avium subsp. paratuberculosis
gccggugcgcagcuu

SEQ ID NO: 966441 - RNA, 16 nt, Mycobacterium avium subsp. paratuberculosis
gccggugcgccgaccg

SEQ ID NO: 966442 - RNA, 22 nt, Mycobacterium avium subsp. paratuberculosis
gccgguggacaggugcauccag

SEQ ID NO: 966443 - RNA, 14 nt, Mycobacterium avium subsp. paratuberculosis
gccggugcggccgc

SEQ ID NO: 966444 - RNA, 16 nt, Mycobacterium avium subsp. paratuberculosis
gccggugcggccgcga

SEQ ID NO: 966445 - RNA, 18 nt, Mycobacterium avium subsp. paratuberculosis
gccggugcgagccgcuga

SEQ ID NO: 966446 - RNA, 16 nt, Mycobacterium avium subsp. paratuberculosis
gccggugcagcaccuc

SEQ ID NO: 966447 - RNA, 17 nt, Mycobacterium avium subsp. paratuberculosis
gccggugaucgcggcgc

SEQ ID NO: 966448 - RNA, 23 nt, Mycobacterium avium subsp. paratuberculosis
gccggugaucucccgugcggucc

SEQ ID NO: 966449 - RNA, 16 nt, Mycobacterium avium subsp. paratuberculosis
gccggugacggucagg

SEQ ID NO: 966450 - RNA, 20 nt, Mycobacterium avium subsp. paratuberculosis
gccggugacggucagggugu

SEQ ID NO: 966451 - RNA, 16 nt, Mycobacterium avium subsp. paratuberculosis
gccggugacuccuccu

SEQ ID NO: 966452 - RNA, 19 nt, Mycobacterium avium subsp. paratuberculosis
gccggugaaaccggcgccg

SEQ ID NO: 966453 - RNA, 21 nt, Mycobacterium avium subsp. paratuberculosis
gccggucgugcgacuccuggg

SEQ ID NO: 966454 - RNA, 22 nt, Mycobacterium avium subsp. paratuberculosis
gccggucuccaugucgucggcg

SEQ ID NO: 966455 - RNA, 13 nt, Mycobacterium avium subsp. paratuberculosis
gccggucgggauc

SEQ ID NO: 966456 - RNA, 14 nt, Mycobacterium avium subsp. paratuberculosis
gccggucgccgggc

SEQ ID NO: 966457 - RNA, 14 nt, Mycobacterium avium subsp. paratuberculosis
gccggucgccugcu

SEQ ID NO: 966458 - RNA, 13 nt, Mycobacterium avium subsp. paratuberculosis
gccggucgcgcau

SEQ ID NO: 966459 - RNA, 18 nt, Mycobacterium avium subsp. paratuberculosis
gccgguccgaccagcggc

SEQ ID NO: 966460 - RNA, 22 nt, Mycobacterium avium subsp. paratuberculosis
gccgguccgaccgccaccaccc

SEQ ID NO: 966461 - RNA, 18 nt, Mycobacterium avium subsp. paratuberculosis
gccgguccgacggcugcg

SEQ ID NO: 966462 - RNA, 15 nt, Mycobacterium avium subsp. paratuberculosis
gccgguccgcccaga

SEQ ID NO: 966463 - RNA, 23 nt, Mycobacterium avium subsp. paratuberculosis
gccgguccugggccuccggcggc

SEQ ID NO: 966464 - RNA, 19 nt, Mycobacterium avium subsp. paratuberculosis
gccgguccuuggccugcuu

SEQ ID NO: 966465 - RNA, 19 nt, Mycobacterium avium subsp. paratuberculosis
gccggucgaacgccagcgc

SEQ ID NO: 966466 - RNA, 22 nt, Mycobacterium avium subsp. paratuberculosis
gccggucgaacgccagcgccgc

SEQ ID NO: 966467 - RNA, 18 nt, Mycobacterium avium subsp. paratuberculosis
gccggucgaaggccccgg

SEQ ID NO: 966468 - RNA, 21 nt, Mycobacterium avium subsp. paratuberculosis
gccggucgacgcggggcggcg

SEQ ID NO: 966469 - RNA, 17 nt, Mycobacterium avium subsp. paratuberculosis
gccggucgaggucgccg

SEQ ID NO: 966470 - RNA, 17 nt, Mycobacterium avium subsp. paratuberculosis
gccgggcugagcugugc

SEQ ID NO: 966471 - RNA, 18 nt, Mycobacterium avium subsp. paratuberculosis
gccgggcugcccaccacc

SEQ ID NO: 966472 - RNA, 22 nt, Mycobacterium avium subsp. paratuberculosis
gccgguagccgcucgcccagcg

SEQ ID NO: 966473 - RNA, 15 nt, Mycobacterium avium subsp. paratuberculosis
gccgguaggcgcggg

SEQ ID NO: 966474 - RNA, 18 nt, Mycobacterium avium subsp. paratuberculosis
gccgguaggcggccagcg

SEQ ID NO: 966475 - RNA, 22 nt, Mycobacterium avium subsp. paratuberculosis
gccgggcggccucggcguccgc

SEQ ID NO: 966476 - RNA, 21 nt, Mycobacterium avium subsp. paratuberculosis
gccgggcggcgccgaaccggg

SEQ ID NO: 966477 - RNA, 17 nt, Mycobacterium avium subsp. paratuberculosis
gccgggcgggccgcagc

SEQ ID NO: 966478 - RNA, 21 nt, Mycobacterium avium subsp. paratuberculosis
gccgggcgguacgcgccgcgc

SEQ ID NO: 966479 - RNA, 17 nt, Mycobacterium avium subsp. paratuberculosis
gccgggcgucacucugg

SEQ ID NO: 966480 - RNA, 16 nt, Mycobacterium avium subsp. paratuberculosis
gccgggcgucgcgcuc

SEQ ID NO: 966481 - RNA, 20 nt, Mycobacterium avium subsp. paratuberculosis
gccgggcgugcccggcgcac

SEQ ID NO: 966482 - RNA, 17 nt, Mycobacterium avium subsp. paratuberculosis
gccgggcuccgcguucg

SEQ ID NO: 966483 - RNA, 19 nt, Mycobacterium avium subsp. paratuberculosis
gccgggcucgagggcggcg

SEQ ID NO: 966484 - RNA, 15 nt, Mycobacterium avium subsp. paratuberculosis
gccgguagugcuugc

SEQ ID NO: 966485 - RNA, 16 nt, Mycobacterium avium subsp. paratuberculosis
gccgguauccauccgc

SEQ ID NO: 966486 - RNA, 21 nt, Mycobacterium avium subsp. paratuberculosis
gccggucagcgcuccuggccg

SEQ ID NO: 966487 - RNA, 16 nt, Mycobacterium avium subsp. paratuberculosis
gccggucacggcgucg

SEQ ID NO: 966488 - RNA, 24 nt, Mycobacterium avium subsp. paratuberculosis
gccgguaucgggucaccgugcggg

SEQ ID NO: 966489 - RNA, 19 nt, Mycobacterium avium subsp. paratuberculosis
gccgguaucgagcaccagc

SEQ ID NO: 966490 - RNA, 17 nt, Mycobacterium avium subsp. paratuberculosis
gccgguccagccgccgc

SEQ ID NO: 966491 - RNA, 19 nt, Mycobacterium avium subsp. paratuberculosis
gccgguccagccgccgcgu

SEQ ID NO: 966492 - RNA, 18 nt, Mycobacterium avium subsp. paratuberculosis
gccggucauaggccgcgc

SEQ ID NO: 966493 - RNA, 19 nt, Mycobacterium avium subsp. paratuberculosis
gccggucauaggccgcgca

SEQ ID NO: 966494 - RNA, 20 nt, Mycobacterium avium subsp. paratuberculosis
gccggucauaggccgcgcag

SEQ ID NO: 966495 - RNA, 21 nt, Mycobacterium avium subsp. paratuberculosis
gccggucauaggccgcgcaga

SEQ ID NO: 966496 - RNA, 15 nt, Mycobacterium avium subsp. paratuberculosis
gccgguccggcggca

SEQ ID NO: 966497 - RNA, 20 nt, Mycobacterium avium subsp. paratuberculosis
gccgguccggcggcaccacc

SEQ ID NO: 966498 - RNA, 21 nt, Mycobacterium avium subsp. paratuberculosis
gccgguccggcggcaccaccc

SEQ ID NO: 966499 - RNA, 17 nt, Mycobacterium avium subsp. paratuberculosis
gccggucccgcggcggc

SEQ ID NO: 966500 - RNA, 19 nt, Mycobacterium avium subsp. paratuberculosis
gccggacuugaugcugccc

SEQ ID NO: 966501 - RNA, 22 nt, Mycobacterium avium subsp. paratuberculosis
gccggagaucccguaggucgcc

SEQ ID NO: 966502 - RNA, 18 nt, Mycobacterium avium subsp. paratuberculosis
gccggagcggugcggcuc

SEQ ID NO: 966503 - RNA, 21 nt, Mycobacterium avium subsp. paratuberculosis
gccggagcggugcggcucggg

SEQ ID NO: 966504 - RNA, 22 nt, Mycobacterium avium subsp. paratuberculosis
gccggagccggccucgccggcg

SEQ ID NO: 966505 - RNA, 17 nt, Mycobacterium avium subsp. paratuberculosis
gccggagccuucuucgc

SEQ ID NO: 966506 - RNA, 13 nt, Mycobacterium avium subsp. paratuberculosis
gccggagcgcccc

SEQ ID NO: 966507 - RNA, 14 nt, Mycobacterium avium subsp. paratuberculosis
gccggagccgaucg

SEQ ID NO: 966508 - RNA, 22 nt, Mycobacterium avium subsp. paratuberculosis
gccggagccgaucgccuccguc

SEQ ID NO: 966509 - RNA, 14 nt, Mycobacterium avium subsp. paratuberculosis
gccggauggccagc

SEQ ID NO: 966510 - RNA, 17 nt, Mycobacterium avium subsp. paratuberculosis
gccggauggccagcagg

SEQ ID NO: 966511 - RNA, 14 nt, Mycobacterium avium subsp. paratuberculosis
gccggaugggcgca

SEQ ID NO: 966512 - RNA, 12 nt, Mycobacterium avium subsp. paratuberculosis
gccggaugccag

SEQ ID NO: 966513 - RNA, 17 nt, Mycobacterium avium subsp. paratuberculosis
gccggaugccagcaggu

SEQ ID NO: 966514 - RNA, 15 nt, Mycobacterium avium subsp. paratuberculosis
gccggaugccgcgcg

SEQ ID NO: 966515 - RNA, 18 nt, Mycobacterium avium subsp. paratuberculosis
gccggaugccgcgcggcg

SEQ ID NO: 966516 - RNA, 21 nt, Mycobacterium avium subsp. paratuberculosis
gccggcaccucgaagggcgcc

SEQ ID NO: 966517 - RNA, 24 nt, Mycobacterium avium subsp. paratuberculosis
gccggcaccucgaagggcgccagc

SEQ ID NO: 966518 - RNA, 14 nt, Mycobacterium avium subsp. paratuberculosis
gccggcacgauggc

SEQ ID NO: 966519 - RNA, 19 nt, Mycobacterium avium subsp. paratuberculosis
gccggcacgauggcgcggc

SEQ ID NO: 966520 - RNA, 20 nt, Mycobacterium avium subsp. paratuberculosis
gccggcacgauggcgcggcg

SEQ ID NO: 966521 - RNA, 21 nt, Mycobacterium avium subsp. paratuberculosis
gccggcacgcaccuuggacga

SEQ ID NO: 966522 - RNA, 15 nt, Mycobacterium avium subsp. paratuberculosis
gccggcagccggcca

SEQ ID NO: 966523 - RNA, 20 nt, Mycobacterium avium subsp. paratuberculosis
gccggcagcaaccggcggcu

SEQ ID NO: 966524 - RNA, 18 nt, Mycobacterium avium subsp. paratuberculosis
gccggcacggccggccgg

SEQ ID NO: 966525 - RNA, 21 nt, Mycobacterium avium subsp. paratuberculosis
gccggcacucgucguggcggu

SEQ ID NO: 966526 - RNA, 16 nt, Mycobacterium avium subsp. paratuberculosis
gccggcacgcgcgccg

SEQ ID NO: 966527 - RNA, 18 nt, Mycobacterium avium subsp. paratuberculosis
gccggcacgcgcgccgga

SEQ ID NO: 966528 - RNA, 15 nt, Mycobacterium avium subsp. paratuberculosis
gccggaagcggcggu

SEQ ID NO: 966529 - RNA, 18 nt, Mycobacterium avium subsp. paratuberculosis
gccggaaggccaaggcca

SEQ ID NO: 966530 - RNA, 20 nt, Mycobacterium avium subsp. paratuberculosis
gccggaaguucucgccgugc

SEQ ID NO: 966531 - RNA, 21 nt, Mycobacterium avium subsp. paratuberculosis
gccgcuuggccgggcggaagu

SEQ ID NO: 966532 - RNA, 15 nt, Mycobacterium avium subsp. paratuberculosis
gccggacaccccggc

SEQ ID NO: 966533 - RNA, 16 nt, Mycobacterium avium subsp. paratuberculosis
gccggacaccccggcc

SEQ ID NO: 966534 - RNA, 19 nt, Mycobacterium avium subsp. paratuberculosis
gccggacaccccggccagu

SEQ ID NO: 966535 - RNA, 20 nt, Mycobacterium avium subsp. paratuberculosis
gccggaauggcaaggccagc

SEQ ID NO: 966536 - RNA, 19 nt, Mycobacterium avium subsp. paratuberculosis
gccgcuucgucgccggccg

SEQ ID NO: 966537 - RNA, 16 nt, Mycobacterium avium subsp. paratuberculosis
gccgcuuggcgcgccg

SEQ ID NO: 966538 - RNA, 20 nt, Mycobacterium avium subsp. paratuberculosis
gccgcugucgucgaagagcu

SEQ ID NO: 966539 - RNA, 14 nt, Mycobacterium avium subsp. paratuberculosis
gccgcugcgcgcgc

SEQ ID NO: 966540 - RNA, 14 nt, Mycobacterium avium subsp. paratuberculosis
gccgcugcgggcgg

SEQ ID NO: 966541 - RNA, 18 nt, Mycobacterium avium subsp. paratuberculosis
gccgcugcgggcgggccg

SEQ ID NO: 966542 - RNA, 24 nt, Mycobacterium avium subsp. paratuberculosis
gccgcugcgacaggucggcggucg

SEQ ID NO: 966543 - RNA, 16 nt, Mycobacterium avium subsp. paratuberculosis
gccgcugcgccggcgc

SEQ ID NO: 966544 - RNA, 13 nt, Mycobacterium avium subsp. paratuberculosis
gccgcuccgcggc

SEQ ID NO: 966545 - RNA, 14 nt, Mycobacterium avium subsp. paratuberculosis
gccgcuccgcggcg

SEQ ID NO: 966546 - RNA, 18 nt, Mycobacterium avium subsp. paratuberculosis
gccgcuccggcccgagca

SEQ ID NO: 966547 - RNA, 23 nt, Mycobacterium avium subsp. paratuberculosis
gccgcuccggcccgagcaccacc

SEQ ID NO: 966548 - RNA, 16 nt, Mycobacterium avium subsp. paratuberculosis
gccgcugcagcgccgc

SEQ ID NO: 966549 - RNA, 17 nt, Mycobacterium avium subsp. paratuberculosis
gccgcugcagcgccgcc

SEQ ID NO: 966550 - RNA, 15 nt, Mycobacterium avium subsp. paratuberculosis
gccgcugcccgccgc

SEQ ID NO: 966551 - RNA, 17 nt, Mycobacterium avium subsp. paratuberculosis
gccgcugcccgccgcgu

SEQ ID NO: 966552 - RNA, 14 nt, Mycobacterium avium subsp. paratuberculosis
gccgcugcauccgc

SEQ ID NO: 966553 - RNA, 15 nt, Mycobacterium avium subsp. paratuberculosis
gccgcugcauccgca

SEQ ID NO: 966554 - RNA, 18 nt, Mycobacterium avium subsp. paratuberculosis
gccgcguggccucccggu

SEQ ID NO: 966555 - RNA, 19 nt, Mycobacterium avium subsp. paratuberculosis
gccgcgugggagagcggga

SEQ ID NO: 966556 - RNA, 22 nt, Mycobacterium avium subsp. paratuberculosis
gccgcgugggagagcgggaccg

SEQ ID NO: 966557 - RNA, 19 nt, Mycobacterium avium subsp. paratuberculosis
gccgcucaccgccgagccg

SEQ ID NO: 966558 - RNA, 14 nt, Mycobacterium avium subsp. paratuberculosis
gccgcucagcgggc

SEQ ID NO: 966559 - RNA, 15 nt, Mycobacterium avium subsp. paratuberculosis
gccgcgucagcggcg

SEQ ID NO: 966560 - RNA, 22 nt, Mycobacterium avium subsp. paratuberculosis
gccgcgucgccgccgggcgcca

SEQ ID NO: 966561 - RNA, 23 nt, Mycobacterium avium subsp. paratuberculosis
gccgcgucggcggucgccagcgc

SEQ ID NO: 966562 - RNA, 15 nt, Mycobacterium avium subsp. paratuberculosis
gccgcgcucgcacca

SEQ ID NO: 966563 - RNA, 14 nt, Mycobacterium avium subsp. paratuberculosis
gccgcgcucggcca

SEQ ID NO: 966564 - RNA, 17 nt, Mycobacterium avium subsp. paratuberculosis
gccgcgcuugcgaccgc

SEQ ID NO: 966565 - RNA, 19 nt, Mycobacterium avium subsp. paratuberculosis
gccgcgcuugcgaucgccg

SEQ ID NO: 966566 - RNA, 14 nt, Mycobacterium avium subsp. paratuberculosis
gccgcgcuggcgca

SEQ ID NO: 966567 - RNA, 16 nt, Mycobacterium avium subsp. paratuberculosis
gccgcgcuggcgcagg

SEQ ID NO: 966568 - RNA, 17 nt, Mycobacterium avium subsp. paratuberculosis
gccgcggaagccccagg

SEQ ID NO: 966569 - RNA, 17 nt, Mycobacterium avium subsp. paratuberculosis
gccgcggaaggccagcu

SEQ ID NO: 966570 - RNA, 19 nt, Mycobacterium avium subsp. paratuberculosis
gccgcggaaggccagcucc

SEQ ID NO: 966571 - RNA, 14 nt, Mycobacterium avium subsp. paratuberculosis
gccgcggcaccuuc

SEQ ID NO: 966572 - RNA, 17 nt, Mycobacterium avium subsp. paratuberculosis
gccgcggcaacgccagc

SEQ ID NO: 966573 - RNA, 18 nt, Mycobacterium avium subsp. paratuberculosis
gccgcggcaacgccagcc

SEQ ID NO: 966574 - RNA, 16 nt, Mycobacterium avium subsp. paratuberculosis
gccgcggacggccagc

SEQ ID NO: 966575 - RNA, 16 nt, Mycobacterium avium subsp. paratuberculosis
gccgcggauggccucg

SEQ ID NO: 966576 - RNA, 16 nt, Mycobacterium avium subsp. paratuberculosis
gccgcggcgcccggcg

SEQ ID NO: 966577 - RNA, 15 nt, Mycobacterium avium subsp. paratuberculosis
gccgcggcccugcag

SEQ ID NO: 966578 - RNA, 21 nt, Mycobacterium avium subsp. paratuberculosis
gccgcggcgcccucgccggcg

SEQ ID NO: 966579 - RNA, 22 nt, Mycobacterium avium subsp. paratuberculosis
gccgcggcgcggcccggcccgc

SEQ ID NO: 966580 - RNA, 14 nt, Mycobacterium avium subsp. paratuberculosis
gccgcggcgcggcc

SEQ ID NO: 966581 - RNA, 11 nt, Mycobacterium avium subsp. paratuberculosis
gccgcggcggc

SEQ ID NO: 966582 - RNA, 20 nt, Mycobacterium avium subsp. paratuberculosis
gccgcggcggcagcacccgc

SEQ ID NO: 966583 - RNA, 14 nt, Mycobacterium avium subsp. paratuberculosis
gccgcggcggccug

SEQ ID NO: 966584 - RNA, 13 nt, Mycobacterium avium subsp. paratuberculosis
gccgcggcggcuc

SEQ ID NO: 966585 - RNA, 15 nt, Mycobacterium avium subsp. paratuberculosis
gccgcggcgggcgcg

SEQ ID NO: 966586 - RNA, 19 nt, Mycobacterium avium subsp. paratuberculosis
gccgcgucacgucggccug

SEQ ID NO: 966587 - RNA, 13 nt, Mycobacterium avium subsp. paratuberculosis
gccgcggccuugc

SEQ ID NO: 966588 - RNA, 14 nt, Mycobacterium avium subsp. paratuberculosis
gccgcggccuugcg

SEQ ID NO: 966589 - RNA, 18 nt, Mycobacterium avium subsp. paratuberculosis
gccgcggcgaccggggcg

SEQ ID NO: 966590 - RNA, 13 nt, Mycobacterium avium subsp. paratuberculosis
gccgcggccggcg

SEQ ID NO: 966591 - RNA, 14 nt, Mycobacterium avium subsp. paratuberculosis
gccgcggccgccgc

SEQ ID NO: 966592 - RNA, 16 nt, Mycobacterium avium subsp. paratuberculosis
gccgcggccgccgcga

SEQ ID NO: 966593 - RNA, 14 nt, Mycobacterium avium subsp. paratuberculosis
gccgcggccgccuc

SEQ ID NO: 966594 - RNA, 12 nt, Mycobacterium avium subsp. paratuberculosis
gccgcggccgcg

SEQ ID NO: 966595 - RNA, 13 nt, Mycobacterium avium subsp. paratuberculosis
gccgcggccgcga

SEQ ID NO: 966596 - RNA, 13 nt, Mycobacterium avium subsp. paratuberculosis
gccgcggccgccg

SEQ ID NO: 966597 - RNA, 16 nt, Mycobacterium avium subsp. paratuberculosis
gccgcggccagccggu

SEQ ID NO: 966598 - RNA, 13 nt, Mycobacterium avium subsp. paratuberculosis
gccgcggccagcg

SEQ ID NO: 966599 - RNA, 13 nt, Mycobacterium avium subsp. paratuberculosis
gccgcggccagcu

SEQ ID NO: 966600 - RNA, 15 nt, Mycobacterium avium subsp. paratuberculosis
gccgcggccagcugc

SEQ ID NO: 966601 - RNA, 16 nt, Mycobacterium avium subsp. paratuberculosis
gccgcggccagcugcc

SEQ ID NO: 966602 - RNA, 12 nt, Mycobacterium avium subsp. paratuberculosis
gccgcggccagg

SEQ ID NO: 966603 - RNA, 17 nt, Mycobacterium avium subsp. paratuberculosis
gccgcggccaccggguc

SEQ ID NO: 966604 - RNA, 15 nt, Mycobacterium avium subsp. paratuberculosis
gccgcggccacgcuc

SEQ ID NO: 966605 - RNA, 21 nt, Mycobacterium avium subsp. paratuberculosis
gccgcaauacggugcccgccg

SEQ ID NO: 966606 - RNA, 24 nt, Mycobacterium avium subsp. paratuberculosis
gccgcaauacggugcccgccgcga

SEQ ID NO: 966607 - RNA, 16 nt, Mycobacterium avium subsp. paratuberculosis
gccgcaaucggcgccg

SEQ ID NO: 966608 - RNA, 15 nt, Mycobacterium avium subsp. paratuberculosis
gccgcacaccgcgca

SEQ ID NO: 966609 - RNA, 16 nt, Mycobacterium avium subsp. paratuberculosis
gccgcacaccgcggcg

SEQ ID NO: 966610 - RNA, 21 nt, Mycobacterium avium subsp. paratuberculosis
gccgccgaagcccgagcguca

SEQ ID NO: 966611 - RNA, 19 nt, Mycobacterium avium subsp. paratuberculosis
gccgccgaaccccagcucc

SEQ ID NO: 966612 - RNA, 18 nt, Mycobacterium avium subsp. paratuberculosis
gccgccgaaagccuccgc

SEQ ID NO: 966613 - RNA, 16 nt, Mycobacterium avium subsp. paratuberculosis
gccgccgaacagccgg

SEQ ID NO: 966614 - RNA, 17 nt, Mycobacterium avium subsp. paratuberculosis
gccgcacagccggcggc

SEQ ID NO: 966615 - RNA, 18 nt, Mycobacterium avium subsp. paratuberculosis
gccgcccuugcucgcggc

SEQ ID NO: 966616 - RNA, 19 nt, Mycobacterium avium subsp. paratuberculosis
gccgccgaucaacaggccc

SEQ ID NO: 966617 - RNA, 19 nt, Mycobacterium avium subsp. paratuberculosis
gccgccgaugacggcgcga

SEQ ID NO: 966618 - RNA, 13 nt, Mycobacterium avium subsp. paratuberculosis
gccgccgaggaca

SEQ ID NO: 966619 - RNA, 13 nt, Mycobacterium avium subsp. paratuberculosis
gccgccgagggcc

SEQ ID NO: 966620 - RNA, 16 nt, Mycobacterium avium subsp. paratuberculosis
gccgccgagggccagc

SEQ ID NO: 966621 - RNA, 17 nt, Mycobacterium avium subsp. paratuberculosis
gccgccgagggccagca

SEQ ID NO: 966622 - RNA, 23 nt, Mycobacterium avium subsp. paratuberculosis
gccgccgagggccagcagccagc

SEQ ID NO: 966623 - RNA, 24 nt, Mycobacterium avium subsp. paratuberculosis
gccgccgagcaacagcccgaccgu

SEQ ID NO: 966624 - RNA, 14 nt, Mycobacterium avium subsp. paratuberculosis
gccgccgagccggc

SEQ ID NO: 966625 - RNA, 21 nt, Mycobacterium avium subsp. paratuberculosis
gccgccgagccggcacggccg

SEQ ID NO: 966626 - RNA, 16 nt, Mycobacterium avium subsp. paratuberculosis
gccgccgaccgcccgc

SEQ ID NO: 966627 - RNA, 17 nt, Mycobacterium avium subsp. paratuberculosis
gccgccgaccgccgagc

SEQ ID NO: 966628 - RNA, 17 nt, Mycobacterium avium subsp. paratuberculosis
gccgccgacgacggcga

SEQ ID NO: 966629 - RNA, 21 nt, Mycobacterium avium subsp. paratuberculosis
gccgccgacgguggcccccac

SEQ ID NO: 966630 - RNA, 15 nt, Mycobacterium avium subsp. paratuberculosis
gccgccgacuccccg

SEQ ID NO: 966631 - RNA, 18 nt, Mycobacterium avium subsp. paratuberculosis
gccgccgaagcggcgcac

SEQ ID NO: 966632 - RNA, 21 nt, Mycobacterium avium subsp. paratuberculosis
gccgccgaccacgccgcgcuu

SEQ ID NO: 966633 - RNA, 14 nt, Mycobacterium avium subsp. paratuberculosis
gccgccgcguggcc

SEQ ID NO: 966634 - RNA, 19 nt, Mycobacterium avium subsp. paratuberculosis
gccgccggauuacucgccg

SEQ ID NO: 966635 - RNA, 15 nt, Mycobacterium avium subsp. paratuberculosis
gccgccggggcgucg

SEQ ID NO: 966636 - RNA, 22 nt, Mycobacterium avium subsp. paratuberculosis
gccgccggggugcaccguggug

SEQ ID NO: 966637 - RNA, 15 nt, Mycobacterium avium subsp. paratuberculosis
gccgccggggcgccg

SEQ ID NO: 966638 - RNA, 18 nt, Mycobacterium avium subsp. paratuberculosis
gccgccggggcgccgccg

SEQ ID NO: 966639 - RNA, 15 nt, Mycobacterium avium subsp. paratuberculosis
gccgccggggcgggc

SEQ ID NO: 966640 - RNA, 17 nt, Mycobacterium avium subsp. paratuberculosis
gccgccggggcgggcag

SEQ ID NO: 966641 - RNA, 19 nt, Mycobacterium avium subsp. paratuberculosis
gccgccgggcuuccccaac

SEQ ID NO: 966642 - RNA, 13 nt, Mycobacterium avium subsp. paratuberculosis
gccgccggggacc

SEQ ID NO: 966643 - RNA, 14 nt, Mycobacterium avium subsp. paratuberculosis
gccgccgggcgcca

SEQ ID NO: 966644 - RNA, 16 nt, Mycobacterium avium subsp. paratuberculosis
gccgccgggcgccacc

SEQ ID NO: 966645 - RNA, 13 nt, Mycobacterium avium subsp. paratuberculosis
gccgccggccagc

SEQ ID NO: 966646 - RNA, 12 nt, Mycobacterium avium subsp. paratuberculosis
gccgccggccgc

SEQ ID NO: 966647 - RNA, 14 nt, Mycobacterium avium subsp. paratuberculosis
gccgccggccgcgg

SEQ ID NO: 966648 - RNA, 18 nt, Mycobacterium avium subsp. paratuberculosis
gccgccggccgcggcgug

SEQ ID NO: 966649 - RNA, 17 nt, Mycobacterium avium subsp. paratuberculosis
gccgccggccgcucgcg

SEQ ID NO: 966650 - RNA, 21 nt, Mycobacterium avium subsp. paratuberculosis
gccgccggccgcucgcgggcc

SEQ ID NO: 966651 - RNA, 22 nt, Mycobacterium avium subsp. paratuberculosis
gccgccgaugugaucggcggcc

SEQ ID NO: 966652 - RNA, 19 nt, Mycobacterium avium subsp. paratuberculosis
gccgccgauuccggccggc

SEQ ID NO: 966653 - RNA, 14 nt, Mycobacterium avium subsp. paratuberculosis
gccgccgccgcggc

SEQ ID NO: 966654 - RNA, 16 nt, Mycobacterium avium subsp. paratuberculosis
gccgccgccggcgucg

SEQ ID NO: 966655 - RNA, 15 nt, Mycobacterium avium subsp. paratuberculosis
gccgccgcgcaggcc

SEQ ID NO: 966656 - RNA, 18 nt, Mycobacterium avium subsp. paratuberculosis
gccgccgcgcauccgcac

SEQ ID NO: 966657 - RNA, 23 nt, Mycobacterium avium subsp. paratuberculosis
gccgccgcgccaccgaggccagc

SEQ ID NO: 966658 - RNA, 22 nt, Mycobacterium avium subsp. paratuberculosis
gccgccgcgaucuugccgccgc

SEQ ID NO: 966659 - RNA, 18 nt, Mycobacterium avium subsp. paratuberculosis
gccgccgccugagcccgc

SEQ ID NO: 966660 - RNA, 23 nt, Mycobacterium avium subsp. paratuberculosis
gccgccgcggacauucugcacga

SEQ ID NO: 966661 - RNA, 13 nt, Mycobacterium avium subsp. paratuberculosis
gccgccgcggguc

SEQ ID NO: 966662 - RNA, 20 nt, Mycobacterium avium subsp. paratuberculosis
gccgccgcggguggccagcc

SEQ ID NO: 966663 - RNA, 18 nt, Mycobacterium avium subsp. paratuberculosis
gccgccgcguaggccagg

SEQ ID NO: 966664 - RNA, 16 nt, Mycobacterium avium subsp. paratuberculosis
gccgccgcggccacac

SEQ ID NO: 966665 - RNA, 19 nt, Mycobacterium avium subsp. paratuberculosis
gccgcgaaaauaccgccgg

SEQ ID NO: 966666 - RNA, 21 nt, Mycobacterium avium subsp. paratuberculosis
gccgcgaaaauaccgccggcc

SEQ ID NO: 966667 - RNA, 22 nt, Mycobacterium avium subsp. paratuberculosis
gccgcgaaaauaccgccggccg

SEQ ID NO: 966668 - RNA, 23 nt, Mycobacterium avium subsp. paratuberculosis
gccgcgaaaauaccgccggccgc

SEQ ID NO: 966669 - RNA, 14 nt, Mycobacterium avium subsp. paratuberculosis
gccgccuugggccg

SEQ ID NO: 966670 - RNA, 14 nt, Mycobacterium avium subsp. paratuberculosis
gccgcgagcgcagc

SEQ ID NO: 966671 - RNA, 15 nt, Mycobacterium avium subsp. paratuberculosis
gccgcgagcgcagca

SEQ ID NO: 966672 - RNA, 15 nt, Mycobacterium avium subsp. paratuberculosis
gccgcgagcccggcg

SEQ ID NO: 966673 - RNA, 14 nt, Mycobacterium avium subsp. paratuberculosis
gccgcgagccgccc

SEQ ID NO: 966674 - RNA, 15 nt, Mycobacterium avium subsp. paratuberculosis
gccgcgaucuugccg

SEQ ID NO: 966675 - RNA, 15 nt, Mycobacterium avium subsp. paratuberculosis
gccgcgaugucggug

SEQ ID NO: 966676 - RNA, 13 nt, Mycobacterium avium subsp. paratuberculosis
gccgcgauccagc

SEQ ID NO: 966677 - RNA, 21 nt, Mycobacterium avium subsp. paratuberculosis
gccgcgauccagcgcuggccg

SEQ ID NO: 966678 - RNA, 15 nt, Mycobacterium avium subsp. paratuberculosis
gccgcgaugcccgcc

SEQ ID NO: 966679 - RNA, 17 nt, Mycobacterium avium subsp. paratuberculosis
gccgcgaugcccgccgg

SEQ ID NO: 966680 - RNA, 18 nt, Mycobacterium avium subsp. paratuberculosis
gccgcgaugcccgccggc

SEQ ID NO: 966681 - RNA, 19 nt, Mycobacterium avium subsp. paratuberculosis
gccgcgaugcccgccggcc

SEQ ID NO: 966682 - RNA, 19 nt, Mycobacterium avium subsp. paratuberculosis
gccgccuugacgccgggca

SEQ ID NO: 966683 - RNA, 22 nt, Mycobacterium avium subsp. paratuberculosis
gccgccgguggagauggccagc

SEQ ID NO: 966684 - RNA, 23 nt, Mycobacterium avium subsp. paratuberculosis
gccgccgguggagauggccagca

SEQ ID NO: 966685 - RNA, 15 nt, Mycobacterium avium subsp. paratuberculosis
gccgcgcccgccggc

SEQ ID NO: 966686 - RNA, 23 nt, Mycobacterium avium subsp. paratuberculosis
gccgcgcccgccggcccagcucc

SEQ ID NO: 966687 - RNA, 15 nt, Mycobacterium avium subsp. paratuberculosis
gccgcgccccgagca

SEQ ID NO: 966688 - RNA, 20 nt, Mycobacterium avium subsp. paratuberculosis
gccgcgccccggcgcgccug

SEQ ID NO: 966689 - RNA, 16 nt, Mycobacterium avium subsp. paratuberculosis
gccgcgccgccgcccu

SEQ ID NO: 966690 - RNA, 16 nt, Mycobacterium avium subsp. paratuberculosis
gccgcgccgggcgccc

SEQ ID NO: 966691 - RNA, 20 nt, Mycobacterium avium subsp. paratuberculosis
gccgcgccguugaccgcggc

SEQ ID NO: 966692 - RNA, 22 nt, Mycobacterium avium subsp. paratuberculosis
gccgcgccgaggaacugcagcg

SEQ ID NO: 966693 - RNA, 23 nt, Mycobacterium avium subsp. paratuberculosis
gccgcgccgaucacgaacagguc

SEQ ID NO: 966694 - RNA, 15 nt, Mycobacterium avium subsp. paratuberculosis
gccgcgccgcgccgc

SEQ ID NO: 966695 - RNA, 17 nt, Mycobacterium avium subsp. paratuberculosis
gccgcgccgcgccgccu

SEQ ID NO: 966696 - RNA, 15 nt, Mycobacterium avium subsp. paratuberculosis
gccgcgcgcgcggcc

SEQ ID NO: 966697 - RNA, 16 nt, Mycobacterium avium subsp. paratuberculosis
gccgcgcgcgcggccu

SEQ ID NO: 966698 - RNA, 17 nt, Mycobacterium avium subsp. paratuberculosis
gccgcgcgccagcgcgu

SEQ ID NO: 966699 - RNA, 13 nt, Mycobacterium avium subsp. paratuberculosis
gccgcgcgcccgc

SEQ ID NO: 966700 - RNA, 14 nt, Mycobacterium avium subsp. paratuberculosis
gccgcgcggccgcc

SEQ ID NO: 966701 - RNA, 15 nt, Mycobacterium avium subsp. paratuberculosis
gccgcgcggccggcc

SEQ ID NO: 966702 - RNA, 17 nt, Mycobacterium avium subsp. paratuberculosis
gccgcgcggcccgcgac

SEQ ID NO: 966703 - RNA, 15 nt, Mycobacterium avium subsp. paratuberculosis
gccgcgcgggcggcg

SEQ ID NO: 966704 - RNA, 18 nt, Mycobacterium avium subsp. paratuberculosis
gccgcgcgugcagccggg

SEQ ID NO: 966705 - RNA, 23 nt, Mycobacterium avium subsp. paratuberculosis
gccgcgcgugcagccgggcggcg

SEQ ID NO: 966706 - RNA, 13 nt, Mycobacterium avium subsp. paratuberculosis
gccgcgcggugcu

SEQ ID NO: 966707 - RNA, 20 nt, Mycobacterium avium subsp. paratuberculosis
gccgacgugaugcacccgga

SEQ ID NO: 966708 - RNA, 19 nt, Mycobacterium avium subsp. paratuberculosis
gccgacuagcgcggcggcc

SEQ ID NO: 966709 - RNA, 16 nt, Mycobacterium avium subsp. paratuberculosis
gccgacgucugguugg

SEQ ID NO: 966710 - RNA, 23 nt, Mycobacterium avium subsp. paratuberculosis
gccgacgucaggggugccggagg

SEQ ID NO: 966711 - RNA, 18 nt, Mycobacterium avium subsp. paratuberculosis
gccgacugauccaccauc

SEQ ID NO: 966712 - RNA, 23 nt, Mycobacterium avium subsp. paratuberculosis
gccgacugccccgcuccuccucg

SEQ ID NO: 966713 - RNA, 17 nt, Mycobacterium avium subsp. paratuberculosis
gccgacuccccgcccgg

SEQ ID NO: 966714 - RNA, 20 nt, Mycobacterium avium subsp. paratuberculosis
gccgacgcgcugcgcgccgc

SEQ ID NO: 966715 - RNA, 22 nt, Mycobacterium avium subsp. paratuberculosis
gccgacgcgcugcgcgccgccc

SEQ ID NO: 966716 - RNA, 22 nt, Mycobacterium avium subsp. paratuberculosis
gccgacgccggccaccaacagg

SEQ ID NO: 966717 - RNA, 14 nt, Mycobacterium avium subsp. paratuberculosis
gccgacggccgcgc

SEQ ID NO: 966718 - RNA, 14 nt, Mycobacterium avium subsp. paratuberculosis
gccgacggugcgug

SEQ ID NO: 966719 - RNA, 17 nt, Mycobacterium avium subsp. paratuberculosis
gccgacgguggcgaagc

SEQ ID NO: 966720 - RNA, 21 nt, Mycobacterium avium subsp. paratuberculosis
gccgacguaaccguacggccc

SEQ ID NO: 966721 - RNA, 18 nt, Mycobacterium avium subsp. paratuberculosis
gccgacguaggacagcac

SEQ ID NO: 966722 - RNA, 22 nt, Mycobacterium avium subsp. paratuberculosis
gccgacguaggacagcaccaca

SEQ ID NO: 966723 - RNA, 16 nt, Mycobacterium avium subsp. paratuberculosis
gccgacgggcccgcgc

SEQ ID NO: 966724 - RNA, 20 nt, Mycobacterium avium subsp. paratuberculosis
gccgacgaugagggccagca

SEQ ID NO: 966725 - RNA, 15 nt, Mycobacterium avium subsp. paratuberculosis
gccgacgccagcacg

SEQ ID NO: 966726 - RNA, 14 nt, Mycobacterium avium subsp. paratuberculosis
gccgacgcccagca

SEQ ID NO: 966727 - RNA, 14 nt, Mycobacterium avium subsp. paratuberculosis
gccgacgcccagcg

SEQ ID NO: 966728 - RNA, 20 nt, Mycobacterium avium subsp. paratuberculosis
gccgacgauccgcgccgcga

SEQ ID NO: 966729 - RNA, 16 nt, Mycobacterium avium subsp. paratuberculosis
gccgacgacgucgcgc

SEQ ID NO: 966730 - RNA, 17 nt, Mycobacterium avium subsp. paratuberculosis
gccgacgagcucgccgc

SEQ ID NO: 966731 - RNA, 15 nt, Mycobacterium avium subsp. paratuberculosis
gccgaccuggcggcc

SEQ ID NO: 966732 - RNA, 23 nt, Mycobacterium avium subsp. paratuberculosis
gccgaccugggcggccaccgcgc

SEQ ID NO: 966733 - RNA, 13 nt, Mycobacterium avium subsp. paratuberculosis
gccgaccuugacc

SEQ ID NO: 966734 - RNA, 18 nt, Mycobacterium avium subsp. paratuberculosis
gccgacgaagaugcgccc

SEQ ID NO: 966735 - RNA, 17 nt, Mycobacterium avium subsp. paratuberculosis
gccgaccucggccagcg

SEQ ID NO: 966736 - RNA, 15 nt, Mycobacterium avium subsp. paratuberculosis
gccgacuuggugcca

SEQ ID NO: 966737 - RNA, 21 nt, Mycobacterium avium subsp. paratuberculosis
gccgacuuggugccaugccgg

SEQ ID NO: 966738 - RNA, 22 nt, Mycobacterium avium subsp. paratuberculosis
gccgagaacaggccgagcgcgc

SEQ ID NO: 966739 - RNA, 22 nt, Mycobacterium avium subsp. paratuberculosis
gccgagacugaugguggcgcgc

SEQ ID NO: 966740 - RNA, 19 nt, Mycobacterium avium subsp. paratuberculosis
gccgagagcucuugcgccc

SEQ ID NO: 966741 - RNA, 21 nt, Mycobacterium avium subsp. paratuberculosis
gccgagauuggacgacaccac

SEQ ID NO: 966742 - RNA, 17 nt, Mycobacterium avium subsp. paratuberculosis
gccgagauccaccgcgc

SEQ ID NO: 966743 - RNA, 21 nt, Mycobacterium avium subsp. paratuberculosis
gccgagcacaccgucgcccgc

SEQ ID NO: 966744 - RNA, 13 nt, Mycobacterium avium subsp. paratuberculosis
gccgagcaccccg

SEQ ID NO: 966745 - RNA, 22 nt, Mycobacterium avium subsp. paratuberculosis
gccgagcaccccgucgagcagc

SEQ ID NO: 966746 - RNA, 18 nt, Mycobacterium avium subsp. paratuberculosis
gccgagcaccggcagcac

SEQ ID NO: 966747 - RNA, 12 nt, Mycobacterium avium subsp. paratuberculosis
gccgagcaccuc

SEQ ID NO: 966748 - RNA, 16 nt, Mycobacterium avium subsp. paratuberculosis
gccgagcaccuccgac

SEQ ID NO: 966749 - RNA, 22 nt, Mycobacterium avium subsp. paratuberculosis
gccgagcaccucgucgccgucg

SEQ ID NO: 966750 - RNA, 13 nt, Mycobacterium avium subsp. paratuberculosis
gccgagcaccugg

SEQ ID NO: 966751 - RNA, 19 nt, Mycobacterium avium subsp. paratuberculosis
gccgagcacgcagccgcgc

SEQ ID NO: 966752 - RNA, 23 nt, Mycobacterium avium subsp. paratuberculosis
gccgagcacgcagccgcgcccga

SEQ ID NO: 966753 - RNA, 14 nt, Mycobacterium avium subsp. paratuberculosis
gccgagcacgcggc

SEQ ID NO: 966754 - RNA, 14 nt, Mycobacterium avium subsp. paratuberculosis
gccgagcagagcua

SEQ ID NO: 966755 - RNA, 14 nt, Mycobacterium avium subsp. paratuberculosis
gccgagcgccgcgu

SEQ ID NO: 966756 - RNA, 17 nt, Mycobacterium avium subsp. paratuberculosis
gccgagcgccgcguuca

SEQ ID NO: 966757 - RNA, 16 nt, Mycobacterium avium subsp. paratuberculosis
gccgagcgcgccgagc

SEQ ID NO: 966758 - RNA, 15 nt, Mycobacterium avium subsp. paratuberculosis
gccgagcgcgccgcc

SEQ ID NO: 966759 - RNA, 16 nt, Mycobacterium avium subsp. paratuberculosis
gccgagcgcgccgccg

SEQ ID NO: 966760 - RNA, 13 nt, Mycobacterium avium subsp. paratuberculosis
gccgagccgcacc

SEQ ID NO: 966761 - RNA, 17 nt, Mycobacterium avium subsp. paratuberculosis
gccgagccgcgccacgc

SEQ ID NO: 966762 - RNA, 13 nt, Mycobacterium avium subsp. paratuberculosis
gccgagccggccg

SEQ ID NO: 966763 - RNA, 22 nt, Mycobacterium avium subsp. paratuberculosis
gccgagccggccgaagcguucc

SEQ ID NO: 966764 - RNA, 18 nt, Mycobacterium avium subsp. paratuberculosis
gccgagccggcguacccg

SEQ ID NO: 966765 - RNA, 19 nt, Mycobacterium avium subsp. paratuberculosis
gccgagccgggcggccagc

SEQ ID NO: 966766 - RNA, 23 nt, Mycobacterium avium subsp. paratuberculosis
gccgagccgggucauccagccgu

SEQ ID NO: 966767 - RNA, 15 nt, Mycobacterium avium subsp. paratuberculosis
gccgagcccgccggc

SEQ ID NO: 966768 - RNA, 12 nt, Mycobacterium avium subsp. paratuberculosis
gccgagcagccg

SEQ ID NO: 966769 - RNA, 16 nt, Mycobacterium avium subsp. paratuberculosis
gccgagcagcucggcg

SEQ ID NO: 966770 - RNA, 15 nt, Mycobacterium avium subsp. paratuberculosis
gccgagcagcucagc

SEQ ID NO: 966771 - RNA, 18 nt, Mycobacterium avium subsp. paratuberculosis
gccgauucggcgccgcga

SEQ ID NO: 966772 - RNA, 16 nt, Mycobacterium avium subsp. paratuberculosis
gccgauuccagcaacu

SEQ ID NO: 966773 - RNA, 19 nt, Mycobacterium avium subsp. paratuberculosis
gccgaugugaucggcggcc

SEQ ID NO: 966774 - RNA, 20 nt, Mycobacterium avium subsp. paratuberculosis
gccgaugugaucggcggcca

SEQ ID NO: 966775 - RNA, 15 nt, Mycobacterium avium subsp. paratuberculosis
gccgauguggcgggc

SEQ ID NO: 966776 - RNA, 19 nt, Mycobacterium avium subsp. paratuberculosis
gccgcaacggcggucgugc

SEQ ID NO: 966777 - RNA, 15 nt, Mycobacterium avium subsp. paratuberculosis
gccgcaacagccggc

SEQ ID NO: 966778 - RNA, 18 nt, Mycobacterium avium subsp. paratuberculosis
gccgaucccggccagcac

SEQ ID NO: 966779 - RNA, 14 nt, Mycobacterium avium subsp. paratuberculosis
gccgauccgcagcc

SEQ ID NO: 966780 - RNA, 16 nt, Mycobacterium avium subsp. paratuberculosis
gccgauccgcagccgc

SEQ ID NO: 966781 - RNA, 15 nt, Mycobacterium avium subsp. paratuberculosis
gccgauccggcgccg

SEQ ID NO: 966782 - RNA, 22 nt, Mycobacterium avium subsp. paratuberculosis
gccgaucgagacgaugcggucc

SEQ ID NO: 966783 - RNA, 14 nt, Mycobacterium avium subsp. paratuberculosis
gccgaucaggcugg

SEQ ID NO: 966784 - RNA, 17 nt, Mycobacterium avium subsp. paratuberculosis
gccgaucagugccgcgc

SEQ ID NO: 966785 - RNA, 21 nt, Mycobacterium avium subsp. paratuberculosis
gccgaucagugccgcgccaac

SEQ ID NO: 966786 - RNA, 22 nt, Mycobacterium avium subsp. paratuberculosis
gccgaucagcugcucggccacc

SEQ ID NO: 966787 - RNA, 15 nt, Mycobacterium avium subsp. paratuberculosis
gccgaucagcuggcu

SEQ ID NO: 966788 - RNA, 18 nt, Mycobacterium avium subsp. paratuberculosis
gccgaggaggccgcggcg

SEQ ID NO: 966789 - RNA, 20 nt, Mycobacterium avium subsp. paratuberculosis
gccgaggacacguuggccag

SEQ ID NO: 966790 - RNA, 15 nt, Mycobacterium avium subsp. paratuberculosis
gccgagcgugaaacu

SEQ ID NO: 966791 - RNA, 22 nt, Mycobacterium avium subsp. paratuberculosis
gccgagcucgugaugguccagc

SEQ ID NO: 966792 - RNA, 17 nt, Mycobacterium avium subsp. paratuberculosis
gccgagcgucacgcugg

SEQ ID NO: 966793 - RNA, 13 nt, Mycobacterium avium subsp. paratuberculosis
gccgagcgcuggu

SEQ ID NO: 966794 - RNA, 19 nt, Mycobacterium avium subsp. paratuberculosis
gccgaguuccugcgaccgc

SEQ ID NO: 966795 - RNA, 21 nt, Mycobacterium avium subsp. paratuberculosis
gccgagucgacgugcucggcg

SEQ ID NO: 966796 - RNA, 19 nt, Mycobacterium avium subsp. paratuberculosis
gccgagucgaucgccagcg

SEQ ID NO: 966797 - RNA, 20 nt, Mycobacterium avium subsp. paratuberculosis
gccgagucgaucgccagcgc

SEQ ID NO: 966798 - RNA, 15 nt, Mycobacterium avium subsp. paratuberculosis
gccgagucgcgccgc

SEQ ID NO: 966799 - RNA, 17 nt, Mycobacterium avium subsp. paratuberculosis
gccgagucgcgccgcgu

SEQ ID NO: 966800 - RNA, 19 nt, Mycobacterium avium subsp. paratuberculosis
gccgaggucgccgguguca

SEQ ID NO: 966801 - RNA, 15 nt, Mycobacterium avium subsp. paratuberculosis
gccgagguggcccgc

SEQ ID NO: 966802 - RNA, 21 nt, Mycobacterium avium subsp. paratuberculosis
gccgagguggccgccagcacc

SEQ ID NO: 966803 - RNA, 16 nt, Mycobacterium avium subsp. paratuberculosis
gccgaggccuccaggu

SEQ ID NO: 966804 - RNA, 20 nt, Mycobacterium avium subsp. paratuberculosis
gccgaggcgagugaggacga

SEQ ID NO: 966805 - RNA, 14 nt, Mycobacterium avium subsp. paratuberculosis
gccgaggcgcucgc

SEQ ID NO: 966806 - RNA, 16 nt, Mycobacterium avium subsp. paratuberculosis
gccgagggcccgggca

SEQ ID NO: 966807 - RNA, 17 nt, Mycobacterium avium subsp. paratuberculosis
gccgagggcccgggcag

SEQ ID NO: 966808 - RNA, 18 nt, Mycobacterium avium subsp. paratuberculosis
gccgagggcccgggcagg

SEQ ID NO: 966809 - RNA, 20 nt, Mycobacterium avium subsp. paratuberculosis
gccgagggcccgggcaggca

SEQ ID NO: 966810 - RNA, 13 nt, Mycobacterium avium subsp. paratuberculosis
gccgagggcggcg

SEQ ID NO: 966811 - RNA, 14 nt, Mycobacterium avium subsp. paratuberculosis
gccgagggcggcgg

SEQ ID NO: 966812 - RNA, 16 nt, Mycobacterium avium subsp. paratuberculosis
gccgagggcggcggcu

SEQ ID NO: 966813 - RNA, 16 nt, Mycobacterium avium subsp. paratuberculosis
gccgaggguuccagcc

SEQ ID NO: 966814 - RNA, 20 nt, Mycobacterium avium subsp. paratuberculosis
gccgagguagucggccuccu

SEQ ID NO: 966815 - RNA, 19 nt, Mycobacterium avium subsp. paratuberculosis
gcccuugcagcacaccggc

SEQ ID NO: 966816 - RNA, 21 nt, Mycobacterium avium subsp. paratuberculosis
gcccuugaacggcaccagcgg

SEQ ID NO: 966817 - RNA, 16 nt, Mycobacterium avium subsp. paratuberculosis
gcccuuguugauggug

SEQ ID NO: 966818 - RNA, 16 nt, Mycobacterium avium subsp. paratuberculosis
gcccuuuacccggacg

SEQ ID NO: 966819 - RNA, 16 nt, Mycobacterium avium subsp. paratuberculosis
gcccuugucgcuggcg

SEQ ID NO: 966820 - RNA, 21 nt, Mycobacterium avium subsp. paratuberculosis
gcccuuggcggccacgacggc

SEQ ID NO: 966821 - RNA, 16 nt, Mycobacterium avium subsp. paratuberculosis
gcccuuggccagcagu

SEQ ID NO: 966822 - RNA, 18 nt, Mycobacterium avium subsp. paratuberculosis
gcccuuggcgaagcguuu

SEQ ID NO: 966823 - RNA, 17 nt, Mycobacterium avium subsp. paratuberculosis
gcccuuggacaccugca

SEQ ID NO: 966824 - RNA, 14 nt, Mycobacterium avium subsp. paratuberculosis
gcccuuggccagca

SEQ ID NO: 966825 - RNA, 12 nt, Mycobacterium avium subsp. paratuberculosis
gcccuuccagca

SEQ ID NO: 966826 - RNA, 14 nt, Mycobacterium avium subsp. paratuberculosis
gcccuuccagcacc

SEQ ID NO: 966827 - RNA, 17 nt, Mycobacterium avium subsp. paratuberculosis
gcccuuccccggcggcc

SEQ ID NO: 966828 - RNA, 16 nt, Mycobacterium avium subsp. paratuberculosis
gcccuucgcggugugc

SEQ ID NO: 966829 - RNA, 18 nt, Mycobacterium avium subsp. paratuberculosis
gcccuugaccgccugcuu

SEQ ID NO: 966830 - RNA, 22 nt, Mycobacterium avium subsp. paratuberculosis
gccgaaacggugcccgcagcau

SEQ ID NO: 966831 - RNA, 23 nt, Mycobacterium avium subsp. paratuberculosis
gccgaaacggugcccgcagcauc

SEQ ID NO: 966832 - RNA, 23 nt, Mycobacterium avium subsp. paratuberculosis
gccgaaaugccgugccagccggc

SEQ ID NO: 966833 - RNA, 20 nt, Mycobacterium avium subsp. paratuberculosis
gccgaacaacagggccgcgc

SEQ ID NO: 966834 - RNA, 19 nt, Mycobacterium avium subsp. paratuberculosis
gccgaacaccacgccgagc

SEQ ID NO: 966835 - RNA, 20 nt, Mycobacterium avium subsp. paratuberculosis
gccgaacaccacgccgagca

SEQ ID NO: 966836 - RNA, 21 nt, Mycobacterium avium subsp. paratuberculosis
gccgaacacggccgccuccag

SEQ ID NO: 966837 - RNA, 19 nt, Mycobacterium avium subsp. paratuberculosis
gccgaacacguacagcggc

SEQ ID NO: 966838 - RNA, 17 nt, Mycobacterium avium subsp. paratuberculosis
gccgaaccgcagccgga

SEQ ID NO: 966839 - RNA, 18 nt, Mycobacterium avium subsp. paratuberculosis
gccgaaccgcuccccgag

SEQ ID NO: 966840 - RNA, 16 nt, Mycobacterium avium subsp. paratuberculosis
gccgaacaccugcggc

SEQ ID NO: 966841 - RNA, 14 nt, Mycobacterium avium subsp. paratuberculosis
gccgaacaggcgca

SEQ ID NO: 966842 - RNA, 20 nt, Mycobacterium avium subsp. paratuberculosis
gccgaaguuccagccgaucg

SEQ ID NO: 966843 - RNA, 22 nt, Mycobacterium avium subsp. paratuberculosis
gccgaaguauccggucagcgcc

SEQ ID NO: 966844 - RNA, 16 nt, Mycobacterium avium subsp. paratuberculosis
gccgaaguccuugacc

SEQ ID NO: 966845 - RNA, 18 nt, Mycobacterium avium subsp. paratuberculosis
gccgaaggcggcgccggc

SEQ ID NO: 966846 - RNA, 22 nt, Mycobacterium avium subsp. paratuberculosis
gccgaaggcggcgccggccggg

SEQ ID NO: 966847 - RNA, 12 nt, Mycobacterium avium subsp. paratuberculosis
gccgaaggcuuu

SEQ ID NO: 966848 - RNA, 15 nt, Mycobacterium avium subsp. paratuberculosis
gccgacaacauccgc

SEQ ID NO: 966849 - RNA, 14 nt, Mycobacterium avium subsp. paratuberculosis
gccgaauccgggca

SEQ ID NO: 966850 - RNA, 23 nt, Mycobacterium avium subsp. paratuberculosis
gccgaacgugcugugcgggcggu

SEQ ID NO: 966851 - RNA, 16 nt, Mycobacterium avium subsp. paratuberculosis
gccgaacgccuccgcc

SEQ ID NO: 966852 - RNA, 19 nt, Mycobacterium avium subsp. paratuberculosis
gccgaacgccuccgccgcc

SEQ ID NO: 966853 - RNA, 16 nt, Mycobacterium avium subsp. paratuberculosis
gccgaaccgggcgcgc

SEQ ID NO: 966854 - RNA, 15 nt, Mycobacterium avium subsp. paratuberculosis
gccgaaccggggccg

SEQ ID NO: 966855 - RNA, 15 nt, Mycobacterium avium subsp. paratuberculosis
gccgaacgacagcag

SEQ ID NO: 966856 - RNA, 14 nt, Mycobacterium avium subsp. paratuberculosis
gccgaagcgccgca

SEQ ID NO: 966857 - RNA, 17 nt, Mycobacterium avium subsp. paratuberculosis
gccgaagcggcgcacgc

SEQ ID NO: 966858 - RNA, 15 nt, Mycobacterium avium subsp. paratuberculosis
gccgaagcccgcagc

SEQ ID NO: 966859 - RNA, 17 nt, Mycobacterium avium subsp. paratuberculosis
gccgaagccggcgcagg

SEQ ID NO: 966860 - RNA, 17 nt, Mycobacterium avium subsp. paratuberculosis
gccgaagauggccagcg

SEQ ID NO: 966861 - RNA, 22 nt, Mycobacterium avium subsp. paratuberculosis
gccgaagauggccagcgcggcg

SEQ ID NO: 966862 - RNA, 23 nt, Mycobacterium avium subsp. paratuberculosis
gccgaagaacgacuggcggcggc

SEQ ID NO: 966863 - RNA, 18 nt, Mycobacterium avium subsp. paratuberculosis
gccgaagaucagcgcguc

SEQ ID NO: 966864 - RNA, 14 nt, Mycobacterium avium subsp. paratuberculosis
gccgacagcugagc

SEQ ID NO: 966865 - RNA, 23 nt, Mycobacterium avium subsp. paratuberculosis
gccgacagguagcaggcgcgcag

SEQ ID NO: 966866 - RNA, 15 nt, Mycobacterium avium subsp. paratuberculosis
gccgacagucgcggg

SEQ ID NO: 966867 - RNA, 14 nt, Mycobacterium avium subsp. paratuberculosis
gccgacaccggguc

SEQ ID NO: 966868 - RNA, 17 nt, Mycobacterium avium subsp. paratuberculosis
gccgacacguaggccgc

SEQ ID NO: 966869 - RNA, 17 nt, Mycobacterium avium subsp. paratuberculosis
gccgacagaugcggcac

SEQ ID NO: 966870 - RNA, 21 nt, Mycobacterium avium subsp. paratuberculosis
gccgacagaugcggcaccagc

SEQ ID NO: 966871 - RNA, 21 nt, Mycobacterium avium subsp. paratuberculosis
gccgacagcaccucgcccugc

SEQ ID NO: 966872 - RNA, 14 nt, Mycobacterium avium subsp. paratuberculosis
gccgacaucgcggc

SEQ ID NO: 966873 - RNA, 14 nt, Mycobacterium avium subsp. paratuberculosis
gccgacaugcuggg

SEQ ID NO: 966874 - RNA, 16 nt, Mycobacterium avium subsp. paratuberculosis
gccgaccacgccgcgc

SEQ ID NO: 966875 - RNA, 14 nt, Mycobacterium avium subsp. paratuberculosis
gccgaccaccccca

SEQ ID NO: 966876 - RNA, 19 nt, Mycobacterium avium subsp. paratuberculosis
gccgaccagcgcguugaug

SEQ ID NO: 966877 - RNA, 15 nt, Mycobacterium avium subsp. paratuberculosis
gccgacccccgccgc

SEQ ID NO: 966878 - RNA, 17 nt, Mycobacterium avium subsp. paratuberculosis
gccgacccccgccgcgu

SEQ ID NO: 966879 - RNA, 22 nt, Mycobacterium avium subsp. paratuberculosis
gccgacccgcccgccgggcacc

SEQ ID NO: 966880 - RNA, 13 nt, Mycobacterium avium subsp. paratuberculosis
gccgaccgcccgc

SEQ ID NO: 966881 - RNA, 13 nt, Mycobacterium avium subsp. paratuberculosis
gccgaccgccgcc

SEQ ID NO: 966882 - RNA, 14 nt, Mycobacterium avium subsp. paratuberculosis
gccgaccgccgcca

SEQ ID NO: 966883 - RNA, 13 nt, Mycobacterium avium subsp. paratuberculosis
gccgacccgcugc

SEQ ID NO: 966884 - RNA, 12 nt, Mycobacterium avium subsp. paratuberculosis
gccgacccgggc

SEQ ID NO: 966885 - RNA, 23 nt, Mycobacterium avium subsp. paratuberculosis
gccgacccugcguccggcccggc

SEQ ID NO: 966886 - RNA, 22 nt, Mycobacterium avium subsp. paratuberculosis
gccgaccgacccggccagcggc

SEQ ID NO: 966887 - RNA, 16 nt, Mycobacterium avium subsp. paratuberculosis
gccgaccgagggcgcg

SEQ ID NO: 966888 - RNA, 23 nt, Mycobacterium avium subsp. paratuberculosis
gcccuggaucgcgccuugggcca

SEQ ID NO: 966889 - RNA, 19 nt, Mycobacterium avium subsp. paratuberculosis
gcccugguugauccagcgg

SEQ ID NO: 966890 - RNA, 18 nt, Mycobacterium avium subsp. paratuberculosis
gcccugcuugaacagcac

SEQ ID NO: 966891 - RNA, 19 nt, Mycobacterium avium subsp. paratuberculosis
gcccugcacccagccgugc

SEQ ID NO: 966892 - RNA, 22 nt, Mycobacterium avium subsp. paratuberculosis
gcccugcagguagguggccagc

SEQ ID NO: 966893 - RNA, 23 nt, Mycobacterium avium subsp. paratuberculosis
gcccugcagguagguggccagcc

SEQ ID NO: 966894 - RNA, 14 nt, Mycobacterium avium subsp. paratuberculosis
gcccugcagcgcga

SEQ ID NO: 966895 - RNA, 13 nt, Mycobacterium avium subsp. paratuberculosis
gcccugccacagc

SEQ ID NO: 966896 - RNA, 17 nt, Mycobacterium avium subsp. paratuberculosis
gcccugccacagcgaca

SEQ ID NO: 966897 - RNA, 22 nt, Mycobacterium avium subsp. paratuberculosis
gcccuagucgacgccgauggug

SEQ ID NO: 966898 - RNA, 14 nt, Mycobacterium avium subsp. paratuberculosis
gcccgugcgacggc

SEQ ID NO: 966899 - RNA, 13 nt, Mycobacterium avium subsp. paratuberculosis
gcccguggccagc

SEQ ID NO: 966900 - RNA, 16 nt, Mycobacterium avium subsp. paratuberculosis
gcccguggccagcgcc

SEQ ID NO: 966901 - RNA, 18 nt, Mycobacterium avium subsp. paratuberculosis
gcccgugccgcaccuggu

SEQ ID NO: 966902 - RNA, 14 nt, Mycobacterium avium subsp. paratuberculosis
gcccucgccccgga

SEQ ID NO: 966903 - RNA, 20 nt, Mycobacterium avium subsp. paratuberculosis
gcccucgccgaaccggggcc

SEQ ID NO: 966904 - RNA, 12 nt, Mycobacterium avium subsp. paratuberculosis
gcccucgccggc

SEQ ID NO: 966905 - RNA, 20 nt, Mycobacterium avium subsp. paratuberculosis
gcccucgcucaacccgucgc

SEQ ID NO: 966906 - RNA, 17 nt, Mycobacterium avium subsp. paratuberculosis
gcccucgcugccgcccc

SEQ ID NO: 966907 - RNA, 20 nt, Mycobacterium avium subsp. paratuberculosis
gcccucgcugccgcccccgc

SEQ ID NO: 966908 - RNA, 19 nt, Mycobacterium avium subsp. paratuberculosis
gcccucggaggugccgcgc

SEQ ID NO: 966909 - RNA, 15 nt, Mycobacterium avium subsp. paratuberculosis
gcccucaauagcggg

SEQ ID NO: 966910 - RNA, 17 nt, Mycobacterium avium subsp. paratuberculosis
gcccucgaagcagaacu

SEQ ID NO: 966911 - RNA, 20 nt, Mycobacterium avium subsp. paratuberculosis
gcccucgaaguagagccgcu

SEQ ID NO: 966912 - RNA, 22 nt, Mycobacterium avium subsp. paratuberculosis
gcccucgaaguagagccgcugc

SEQ ID NO: 966913 - RNA, 23 nt, Mycobacterium avium subsp. paratuberculosis
gcccucgaaguagagccgcugca

SEQ ID NO: 966914 - RNA, 19 nt, Mycobacterium avium subsp. paratuberculosis
gcccucgauaauggcggcc

SEQ ID NO: 966915 - RNA, 16 nt, Mycobacterium avium subsp. paratuberculosis
gcccggccaccaggga

SEQ ID NO: 966916 - RNA, 14 nt, Mycobacterium avium subsp. paratuberculosis
gcccggccaacuac

SEQ ID NO: 966917 - RNA, 23 nt, Mycobacterium avium subsp. paratuberculosis
gcccggcagccgcuccggcccga

SEQ ID NO: 966918 - RNA, 18 nt, Mycobacterium avium subsp. paratuberculosis
gcccggcagccggggugc

SEQ ID NO: 966919 - RNA, 16 nt, Mycobacterium avium subsp. paratuberculosis
gcccggcagcggggcg

SEQ ID NO: 966920 - RNA, 21 nt, Mycobacterium avium subsp. paratuberculosis
gcccggcgaugccgagcccuu

SEQ ID NO: 966921 - RNA, 14 nt, Mycobacterium avium subsp. paratuberculosis
gcccggcgccccgc

SEQ ID NO: 966922 - RNA, 18 nt, Mycobacterium avium subsp. paratuberculosis
gcccggcgcccggcgcgc

SEQ ID NO: 966923 - RNA, 15 nt, Mycobacterium avium subsp. paratuberculosis
gcccggcgcccugca

SEQ ID NO: 966924 - RNA, 21 nt, Mycobacterium avium subsp. paratuberculosis
gcccggcgcccugcacccagc

SEQ ID NO: 966925 - RNA, 14 nt, Mycobacterium avium subsp. paratuberculosis
gcccggcgagcagc

SEQ ID NO: 966926 - RNA, 17 nt, Mycobacterium avium subsp. paratuberculosis
gcccggcgagcagcccg

SEQ ID NO: 966927 - RNA, 18 nt, Mycobacterium avium subsp. paratuberculosis
gcccggcgaaucagcagc

SEQ ID NO: 966928 - RNA, 19 nt, Mycobacterium avium subsp. paratuberculosis
gcccggcgaaucagcagcu

SEQ ID NO: 966929 - RNA, 20 nt, Mycobacterium avium subsp. paratuberculosis
gcccggcgaccaccagccgc

SEQ ID NO: 966930 - RNA, 23 nt, Mycobacterium avium subsp. paratuberculosis
gcccggcgaccaccagccgcagg

SEQ ID NO: 966931 - RNA, 13 nt, Mycobacterium avium subsp. paratuberculosis
gcccggcgacggc

SEQ ID NO: 966932 - RNA, 14 nt, Mycobacterium avium subsp. paratuberculosis
gcccggcgacggcg

SEQ ID NO: 966933 - RNA, 23 nt, Mycobacterium avium subsp. paratuberculosis
gcccgggaaaauuuccuggccga

SEQ ID NO: 966934 - RNA, 23 nt, Mycobacterium avium subsp. paratuberculosis
gcccgggaaguucacguccuugg

SEQ ID NO: 966935 - RNA, 18 nt, Mycobacterium avium subsp. paratuberculosis
gcccggcuucgccgccgc

SEQ ID NO: 966936 - RNA, 13 nt, Mycobacterium avium subsp. paratuberculosis
gcccggcucgccg

SEQ ID NO: 966937 - RNA, 15 nt, Mycobacterium avium subsp. paratuberculosis
gcccggcugcgccgc

SEQ ID NO: 966938 - RNA, 17 nt, Mycobacterium avium subsp. paratuberculosis
gcccggcgcgccgcagg

SEQ ID NO: 966939 - RNA, 23 nt, Mycobacterium avium subsp. paratuberculosis
gcccggcucgaaguggcagcgcu

SEQ ID NO: 966940 - RNA, 22 nt, Mycobacterium avium subsp. paratuberculosis
gcccggcgcuaaagccgaccgc

SEQ ID NO: 966941 - RNA, 13 nt, Mycobacterium avium subsp. paratuberculosis
gcccggcgcggcc

SEQ ID NO: 966942 - RNA, 13 nt, Mycobacterium avium subsp. paratuberculosis
gcccggcgcggca

SEQ ID NO: 966943 - RNA, 19 nt, Mycobacterium avium subsp. paratuberculosis
gcccggcgcgcagcccagc

SEQ ID NO: 966944 - RNA, 13 nt, Mycobacterium avium subsp. paratuberculosis
gcccggcgcgccg

SEQ ID NO: 966945 - RNA, 20 nt, Mycobacterium avium subsp. paratuberculosis
gcccggcgccggcccgcggc

SEQ ID NO: 966946 - RNA, 14 nt, Mycobacterium avium subsp. paratuberculosis
gcccggcgccggcg

SEQ ID NO: 966947 - RNA, 16 nt, Mycobacterium avium subsp. paratuberculosis
gcccgguuccagcggc

SEQ ID NO: 966948 - RNA, 17 nt, Mycobacterium avium subsp. paratuberculosis
gcccguagacccacagc

SEQ ID NO: 966949 - RNA, 16 nt, Mycobacterium avium subsp. paratuberculosis
gcccgucgggcgcggc

SEQ ID NO: 966950 - RNA, 19 nt, Mycobacterium avium subsp. paratuberculosis
gcccgucgggcgcggcggc

SEQ ID NO: 966951 - RNA, 23 nt, Mycobacterium avium subsp. paratuberculosis
gcccgucgggcgcggcggcaacc

SEQ ID NO: 966952 - RNA, 15 nt, Mycobacterium avium subsp. paratuberculosis
gcccgucgucgccga

SEQ ID NO: 966953 - RNA, 17 nt, Mycobacterium avium subsp. paratuberculosis
gcccgucucggcgugcu

SEQ ID NO: 966954 - RNA, 17 nt, Mycobacterium avium subsp. paratuberculosis
gcccggucaccaucagc

SEQ ID NO: 966955 - RNA, 15 nt, Mycobacterium avium subsp. paratuberculosis
gcccgguaggccgcc

SEQ ID NO: 966956 - RNA, 17 nt, Mycobacterium avium subsp. paratuberculosis
gcccgguaggccgccgc

SEQ ID NO: 966957 - RNA, 17 nt, Mycobacterium avium subsp. paratuberculosis
gcccgguacagcgccgc

SEQ ID NO: 966958 - RNA, 19 nt, Mycobacterium avium subsp. paratuberculosis
gcccgguacagcgccgcgg

SEQ ID NO: 966959 - RNA, 17 nt, Mycobacterium avium subsp. paratuberculosis
gcccgggccacccgcga

SEQ ID NO: 966960 - RNA, 18 nt, Mycobacterium avium subsp. paratuberculosis
gcccggucugcggccgcg

SEQ ID NO: 966961 - RNA, 17 nt, Mycobacterium avium subsp. paratuberculosis
gcccggugaucgccgcc

SEQ ID NO: 966962 - RNA, 18 nt, Mycobacterium avium subsp. paratuberculosis
gcccggugaucgccgccc

SEQ ID NO: 966963 - RNA, 20 nt, Mycobacterium avium subsp. paratuberculosis
gcccggucccgcgucacauc

SEQ ID NO: 966964 - RNA, 13 nt, Mycobacterium avium subsp. paratuberculosis
gcccgguccgcug

SEQ ID NO: 966965 - RNA, 17 nt, Mycobacterium avium subsp. paratuberculosis
gcccggucgaccagggu

SEQ ID NO: 966966 - RNA, 19 nt, Mycobacterium avium subsp. paratuberculosis
gcccggucggaguccagca

SEQ ID NO: 966967 - RNA, 19 nt, Mycobacterium avium subsp. paratuberculosis
gcccggugcgacgccgcgc

SEQ ID NO: 966968 - RNA, 18 nt, Mycobacterium avium subsp. paratuberculosis
gcccgaaacgucgcagcc

SEQ ID NO: 966969 - RNA, 15 nt, Mycobacterium avium subsp. paratuberculosis
gcccgaacaccuccu

SEQ ID NO: 966970 - RNA, 23 nt, Mycobacterium avium subsp. paratuberculosis
gcccgaacagccgggccagcagc

SEQ ID NO: 966971 - RNA, 17 nt, Mycobacterium avium subsp. paratuberculosis
gcccgaacagccgggcg

SEQ ID NO: 966972 - RNA, 21 nt, Mycobacterium avium subsp. paratuberculosis
gcccgaacagccgggcggccg

SEQ ID NO: 966973 - RNA, 21 nt, Mycobacterium avium subsp. paratuberculosis
gcccgaacaucgccucggccg

SEQ ID NO: 966974 - RNA, 14 nt, Mycobacterium avium subsp. paratuberculosis
gcccgaacgcgcgu

SEQ ID NO: 966975 - RNA, 21 nt, Mycobacterium avium subsp. paratuberculosis
gcccgauagcuugagccccgc

SEQ ID NO: 966976 - RNA, 17 nt, Mycobacterium avium subsp. paratuberculosis
gcccgaucaccaggccc

SEQ ID NO: 966977 - RNA, 14 nt, Mycobacterium avium subsp. paratuberculosis
gcccgaucgcggcg

SEQ ID NO: 966978 - RNA, 13 nt, Mycobacterium avium subsp. paratuberculosis
gcccgaucggcac

SEQ ID NO: 966979 - RNA, 19 nt, Mycobacterium avium subsp. paratuberculosis
gcccgaucgugcgcccauc

SEQ ID NO: 966980 - RNA, 15 nt, Mycobacterium avium subsp. paratuberculosis
gcccgaucacccccg

SEQ ID NO: 966981 - RNA, 16 nt, Mycobacterium avium subsp. paratuberculosis
gcccgaucacccccga

SEQ ID NO: 966982 - RNA, 15 nt, Mycobacterium avium subsp. paratuberculosis
gcccgaucagccggg

SEQ ID NO: 966983 - RNA, 14 nt, Mycobacterium avium subsp. paratuberculosis
gcccgaucccgggc

SEQ ID NO: 966984 - RNA, 23 nt, Mycobacterium avium subsp. paratuberculosis
gcccgaagcugagguggccuccc

SEQ ID NO: 966985 - RNA, 12 nt, Mycobacterium avium subsp. paratuberculosis
gcccgagucacc

SEQ ID NO: 966986 - RNA, 22 nt, Mycobacterium avium subsp. paratuberculosis
gcccgagcugaucgcggccggc

SEQ ID NO: 966987 - RNA, 16 nt, Mycobacterium avium subsp. paratuberculosis
gcccagcuuggcgccc

SEQ ID NO: 966988 - RNA, 20 nt, Mycobacterium avium subsp. paratuberculosis
gcccaggaacgcgccggcgc

SEQ ID NO: 966989 - RNA, 16 nt, Mycobacterium avium subsp. paratuberculosis
gcccagcugggccagc

SEQ ID NO: 966990 - RNA, 17 nt, Mycobacterium avium subsp. paratuberculosis
gcccagcugggccagcg

SEQ ID NO: 966991 - RNA, 19 nt, Mycobacterium avium subsp. paratuberculosis
gcccagcugggccagcgcg

SEQ ID NO: 966992 - RNA, 13 nt, Mycobacterium avium subsp. paratuberculosis
gcccagcgcggcg

SEQ ID NO: 966993 - RNA, 22 nt, Mycobacterium avium subsp. paratuberculosis
gcccagcgcggcgaacccgagc

SEQ ID NO: 966994 - RNA, 23 nt, Mycobacterium avium subsp. paratuberculosis
gcccagcucggugaugaucgccg

SEQ ID NO: 966995 - RNA, 23 nt, Mycobacterium avium subsp. paratuberculosis
gcccagcucggugcgcauggcgu

SEQ ID NO: 966996 - RNA, 14 nt, Mycobacterium avium subsp. paratuberculosis
gcccagcugggcca

SEQ ID NO: 966997 - RNA, 19 nt, Mycobacterium avium subsp. paratuberculosis
gcccagcugcacccaccgg

SEQ ID NO: 966998 - RNA, 16 nt, Mycobacterium avium subsp. paratuberculosis
gcccaggaucaccggg

SEQ ID NO: 966999 - RNA, 19 nt, Mycobacterium avium subsp. paratuberculosis
gcccaggauucucagcagc

SEQ ID NO: 967000 - RNA, 20 nt, Mycobacterium avium subsp. paratuberculosis
gcccaggauucucagcagcg

SEQ ID NO: 967001 - RNA, 22 nt, Mycobacterium avium subsp. paratuberculosis
gcccaggcagacccccagcagc

SEQ ID NO: 967002 - RNA, 16 nt, Mycobacterium avium subsp. paratuberculosis
gcccaggccaacagca

SEQ ID NO: 967003 - RNA, 18 nt, Mycobacterium avium subsp. paratuberculosis
gcccaggccaacagcagc

SEQ ID NO: 967004 - RNA, 15 nt, Mycobacterium avium subsp. paratuberculosis
gccccggucaccccg

SEQ ID NO: 967005 - RNA, 18 nt, Mycobacterium avium subsp. paratuberculosis
gccccguccggcgccagc

SEQ ID NO: 967006 - RNA, 20 nt, Mycobacterium avium subsp. paratuberculosis
gccccguccggcgccagccc

SEQ ID NO: 967007 - RNA, 16 nt, Mycobacterium avium subsp. paratuberculosis
gccccuccagccgccg

SEQ ID NO: 967008 - RNA, 17 nt, Mycobacterium avium subsp. paratuberculosis
gccccuccagccgccgg

SEQ ID NO: 967009 - RNA, 23 nt, Mycobacterium avium subsp. paratuberculosis
gccccuccagccgccgguccagu

SEQ ID NO: 967010 - RNA, 13 nt, Mycobacterium avium subsp. paratuberculosis
gccccuccagcug

SEQ ID NO: 967011 - RNA, 14 nt, Mycobacterium avium subsp. paratuberculosis
gccccuccaggcau

SEQ ID NO: 967012 - RNA, 16 nt, Mycobacterium avium subsp. paratuberculosis
gccccuaccgccgagc

SEQ ID NO: 967013 - RNA, 13 nt, Mycobacterium avium subsp. paratuberculosis
gccccuccucggu

SEQ ID NO: 967014 - RNA, 20 nt, Mycobacterium avium subsp. paratuberculosis
gccccucggggcugcgcggc

SEQ ID NO: 967015 - RNA, 16 nt, Mycobacterium avium subsp. paratuberculosis
gccccucgaccaccuc

SEQ ID NO: 967016 - RNA, 22 nt, Mycobacterium avium subsp. paratuberculosis
gccccucgacgaacgcggcgga

SEQ ID NO: 967017 - RNA, 22 nt, Mycobacterium avium subsp. paratuberculosis
gccccucgacguccaggccggc

SEQ ID NO: 967018 - RNA, 23 nt, Mycobacterium avium subsp. paratuberculosis
gccccucgacguccaggccggcg

SEQ ID NO: 967019 - RNA, 19 nt, Mycobacterium avium subsp. paratuberculosis
gcccggacgaugccgcggc

SEQ ID NO: 967020 - RNA, 18 nt, Mycobacterium avium subsp. paratuberculosis
gcccggacccgcucgccg

SEQ ID NO: 967021 - RNA, 16 nt, Mycobacterium avium subsp. paratuberculosis
gcccggaccgccgcgg

SEQ ID NO: 967022 - RNA, 14 nt, Mycobacterium avium subsp. paratuberculosis
gcccggaccggccg

SEQ ID NO: 967023 - RNA, 15 nt, Mycobacterium avium subsp. paratuberculosis
gcccggaccggccgu

SEQ ID NO: 967024 - RNA, 20 nt, Mycobacterium avium subsp. paratuberculosis
gcccggaaagcgcgggcagc

SEQ ID NO: 967025 - RNA, 18 nt, Mycobacterium avium subsp. paratuberculosis
gcccggauucgcggcggc

SEQ ID NO: 967026 - RNA, 15 nt, Mycobacterium avium subsp. paratuberculosis
gcccggcaccgggac

SEQ ID NO: 967027 - RNA, 15 nt, Mycobacterium avium subsp. paratuberculosis
gcccggcacuggcga

SEQ ID NO: 967028 - RNA, 21 nt, Mycobacterium avium subsp. paratuberculosis
gcccggaugccggcgcccagc

SEQ ID NO: 967029 - RNA, 12 nt, Mycobacterium avium subsp. paratuberculosis
gcccgcggccau

SEQ ID NO: 967030 - RNA, 15 nt, Mycobacterium avium subsp. paratuberculosis
gcccgcggccgccgc

SEQ ID NO: 967031 - RNA, 23 nt, Mycobacterium avium subsp. paratuberculosis
gcccgcggaucgcguaguccagc

SEQ ID NO: 967032 - RNA, 15 nt, Mycobacterium avium subsp. paratuberculosis
gcccgcggcacgcug

SEQ ID NO: 967033 - RNA, 18 nt, Mycobacterium avium subsp. paratuberculosis
gcccgcggccuccagccg

SEQ ID NO: 967034 - RNA, 12 nt, Mycobacterium avium subsp. paratuberculosis
gcccgcggcgga

SEQ ID NO: 967035 - RNA, 16 nt, Mycobacterium avium subsp. paratuberculosis
gcccgcggcagccagc

SEQ ID NO: 967036 - RNA, 14 nt, Mycobacterium avium subsp. paratuberculosis
gcccgcgcggcggu

SEQ ID NO: 967037 - RNA, 21 nt, Mycobacterium avium subsp. paratuberculosis
gcccgcgcgggcugcagggcc

SEQ ID NO: 967038 - RNA, 16 nt, Mycobacterium avium subsp. paratuberculosis
gcccgcgcgugggcca

SEQ ID NO: 967039 - RNA, 17 nt, Mycobacterium avium subsp. paratuberculosis
gcccgcgcgugguccca

SEQ ID NO: 967040 - RNA, 14 nt, Mycobacterium avium subsp. paratuberculosis
gcccgcgcggccgc

SEQ ID NO: 967041 - RNA, 12 nt, Mycobacterium avium subsp. paratuberculosis
gcccgcgcggcg

SEQ ID NO: 967042 - RNA, 19 nt, Mycobacterium avium subsp. paratuberculosis
gcccgcgcgaucggcgagc

SEQ ID NO: 967043 - RNA, 15 nt, Mycobacterium avium subsp. paratuberculosis
gcccgauuccccggc

SEQ ID NO: 967044 - RNA, 16 nt, Mycobacterium avium subsp. paratuberculosis
gcccgauucagccggc

SEQ ID NO: 967045 - RNA, 20 nt, Mycobacterium avium subsp. paratuberculosis
gcccgauggugaagccgugc

SEQ ID NO: 967046 - RNA, 23 nt, Mycobacterium avium subsp. paratuberculosis
gcccgauggaggugccgcgcagc

SEQ ID NO: 967047 - RNA, 15 nt, Mycobacterium avium subsp. paratuberculosis
gcccgaugccgccga

SEQ ID NO: 967048 - RNA, 15 nt, Mycobacterium avium subsp. paratuberculosis
gcccgcaacuccaca

SEQ ID NO: 967049 - RNA, 19 nt, Mycobacterium avium subsp. paratuberculosis
gcccgcaaaucagccgagc

SEQ ID NO: 967050 - RNA, 20 nt, Mycobacterium avium subsp. paratuberculosis
gcccgccgggcgccacgcug

SEQ ID NO: 967051 - RNA, 23 nt, Mycobacterium avium subsp. paratuberculosis
gcccgccucggcggccgccuugg

SEQ ID NO: 967052 - RNA, 13 nt, Mycobacterium avium subsp. paratuberculosis
gcccgccgggccg

SEQ ID NO: 967053 - RNA, 21 nt, Mycobacterium avium subsp. paratuberculosis
gcccgccggcgucugcauccg

SEQ ID NO: 967054 - RNA, 15 nt, Mycobacterium avium subsp. paratuberculosis
gcccgccgggcaccc

SEQ ID NO: 967055 - RNA, 15 nt, Mycobacterium avium subsp. paratuberculosis
gcccgccggcccagc

SEQ ID NO: 967056 - RNA, 19 nt, Mycobacterium avium subsp. paratuberculosis
gcccgcccgagaguccgcc

SEQ ID NO: 967057 - RNA, 20 nt, Mycobacterium avium subsp. paratuberculosis
gcccgcccgagcgucauucc

SEQ ID NO: 967058 - RNA, 15 nt, Mycobacterium avium subsp. paratuberculosis
gcccgcccgcagcgg

SEQ ID NO: 967059 - RNA, 13 nt, Mycobacterium avium subsp. paratuberculosis
gcccgcccggcac

SEQ ID NO: 967060 - RNA, 16 nt, Mycobacterium avium subsp. paratuberculosis
gcccgcccggcccggc

SEQ ID NO: 967061 - RNA, 14 nt, Mycobacterium avium subsp. paratuberculosis
gcccgcccggcggc

SEQ ID NO: 967062 - RNA, 18 nt, Mycobacterium avium subsp. paratuberculosis
gcccgcccggacaccccg

SEQ ID NO: 967063 - RNA, 12 nt, Mycobacterium avium subsp. paratuberculosis
gcccgcccggca

SEQ ID NO: 967064 - RNA, 16 nt, Mycobacterium avium subsp. paratuberculosis
gcccgccccgcccggc

SEQ ID NO: 967065 - RNA, 19 nt, Mycobacterium avium subsp. paratuberculosis
gcccgccccgcccggcggc

SEQ ID NO: 967066 - RNA, 13 nt, Mycobacterium avium subsp. paratuberculosis
gcccgcccagcgc

SEQ ID NO: 967067 - RNA, 16 nt, Mycobacterium avium subsp. paratuberculosis
gcccgcccagcgcagc

SEQ ID NO: 967068 - RNA, 14 nt, Mycobacterium avium subsp. paratuberculosis
gcccgcccagcgcc

SEQ ID NO: 967069 - RNA, 14 nt, Mycobacterium avium subsp. paratuberculosis
gcccgcccagcugc

SEQ ID NO: 967070 - RNA, 12 nt, Mycobacterium avium subsp. paratuberculosis
gcccgcccaggc

SEQ ID NO: 967071 - RNA, 13 nt, Mycobacterium avium subsp. paratuberculosis
gcccgcccaggcc

SEQ ID NO: 967072 - RNA, 22 nt, Mycobacterium avium subsp. paratuberculosis
gccaucgucacuucgccgggcu

SEQ ID NO: 967073 - RNA, 18 nt, Mycobacterium avium subsp. paratuberculosis
gccaucgucuuccccguu

SEQ ID NO: 967074 - RNA, 20 nt, Mycobacterium avium subsp. paratuberculosis
gccaucgugggcgccgucgc

SEQ ID NO: 967075 - RNA, 19 nt, Mycobacterium avium subsp. paratuberculosis
gccaucgacuccagcaccg

SEQ ID NO: 967076 - RNA, 13 nt, Mycobacterium avium subsp. paratuberculosis
gccauccggccgg

SEQ ID NO: 967077 - RNA, 18 nt, Mycobacterium avium subsp. paratuberculosis
gccaucagcccggcgucc

SEQ ID NO: 967078 - RNA, 17 nt, Mycobacterium avium subsp. paratuberculosis
gccauccgggcggcauc

SEQ ID NO: 967079 - RNA, 23 nt, Mycobacterium avium subsp. paratuberculosis
gccaucaaccgauuucggccagc

SEQ ID NO: 967080 - RNA, 23 nt, Mycobacterium avium subsp. paratuberculosis
gccaucaccagcgcguagagcau

SEQ ID NO: 967081 - RNA, 23 nt, Mycobacterium avium subsp. paratuberculosis
gccaucaccuccuuggccaggcg

SEQ ID NO: 967082 - RNA, 17 nt, Mycobacterium avium subsp. paratuberculosis
gccagguuggcggcggc

SEQ ID NO: 967083 - RNA, 22 nt, Mycobacterium avium subsp. paratuberculosis
gccagguuguaggugcccgauu

SEQ ID NO: 967084 - RNA, 15 nt, Mycobacterium avium subsp. paratuberculosis
gccaguccaggccgc

SEQ ID NO: 967085 - RNA, 14 nt, Mycobacterium avium subsp. paratuberculosis
gccagucaagcgcu

SEQ ID NO: 967086 - RNA, 22 nt, Mycobacterium avium subsp. paratuberculosis
gccaugaagccguugccgccgc

SEQ ID NO: 967087 - RNA, 15 nt, Mycobacterium avium subsp. paratuberculosis
gccauggccaggaac

SEQ ID NO: 967088 - RNA, 18 nt, Mycobacterium avium subsp. paratuberculosis
gccaugggguugaccuug

SEQ ID NO: 967089 - RNA, 22 nt, Mycobacterium avium subsp. paratuberculosis
gccauggcccacgacgucuggg

SEQ ID NO: 967090 - RNA, 20 nt, Mycobacterium avium subsp. paratuberculosis
gccauggcggcccgcgccgg

SEQ ID NO: 967091 - RNA, 18 nt, Mycobacterium avium subsp. paratuberculosis
gccauguccggcaggcuc

SEQ ID NO: 967092 - RNA, 19 nt, Mycobacterium avium subsp. paratuberculosis
gccauguccggcaggcuca

SEQ ID NO: 967093 - RNA, 22 nt, Mycobacterium avium subsp. paratuberculosis
gccauguccggcaggcucagca

SEQ ID NO: 967094 - RNA, 17 nt, Mycobacterium avium subsp. paratuberculosis
gcccaaugaucugggcc

SEQ ID NO: 967095 - RNA, 18 nt, Mycobacterium avium subsp. paratuberculosis
gcccaauucguaggcgag

SEQ ID NO: 967096 - RNA, 22 nt, Mycobacterium avium subsp. paratuberculosis
gcccacaccggauggcugugga

SEQ ID NO: 967097 - RNA, 22 nt, Mycobacterium avium subsp. paratuberculosis
gcccacagcaacgacauccaga

SEQ ID NO: 967098 - RNA, 12 nt, Mycobacterium avium subsp. paratuberculosis
gcccacagcagc

SEQ ID NO: 967099 - RNA, 15 nt, Mycobacterium avium subsp. paratuberculosis
gcccacagcagccgc

SEQ ID NO: 967100 - RNA, 17 nt, Mycobacterium avium subsp. paratuberculosis
gcccacagcgccagcac

SEQ ID NO: 967101 - RNA, 18 nt, Mycobacterium avium subsp. paratuberculosis
gcccacagcgccagcacg

SEQ ID NO: 967102 - RNA, 20 nt, Mycobacterium avium subsp. paratuberculosis
gcccacagcugacgggccgg

SEQ ID NO: 967103 - RNA, 14 nt, Mycobacterium avium subsp. paratuberculosis
gcccacaguccgcc

SEQ ID NO: 967104 - RNA, 22 nt, Mycobacterium avium subsp. paratuberculosis
gcccacaguccgcccagcgagu

SEQ ID NO: 967105 - RNA, 16 nt, Mycobacterium avium subsp. paratuberculosis
gcccacauacaccggg

SEQ ID NO: 967106 - RNA, 18 nt, Mycobacterium avium subsp. paratuberculosis
gcccaccaccggcuuggc

SEQ ID NO: 967107 - RNA, 20 nt, Mycobacterium avium subsp. paratuberculosis
gcccaccaccggcuuggcca

SEQ ID NO: 967108 - RNA, 13 nt, Mycobacterium avium subsp. paratuberculosis
gcccaccaccugc

SEQ ID NO: 967109 - RNA, 22 nt, Mycobacterium avium subsp. paratuberculosis
gcccaccacgaaccaggcgccg

SEQ ID NO: 967110 - RNA, 19 nt, Mycobacterium avium subsp. paratuberculosis
gcccaccacgaacgcgccg

SEQ ID NO: 967111 - RNA, 19 nt, Mycobacterium avium subsp. paratuberculosis
gcccaccagcacaccggau

SEQ ID NO: 967112 - RNA, 14 nt, Mycobacterium avium subsp. paratuberculosis
gcccaccagcaggu

SEQ ID NO: 967113 - RNA, 15 nt, Mycobacterium avium subsp. paratuberculosis
gcccaccagccggcc

SEQ ID NO: 967114 - RNA, 17 nt, Mycobacterium avium subsp. paratuberculosis
gcccaccagccggccgg

SEQ ID NO: 967115 - RNA, 19 nt, Mycobacterium avium subsp. paratuberculosis
gcccaccagccggccggcg

SEQ ID NO: 967116 - RNA, 19 nt, Mycobacterium avium subsp. paratuberculosis
gccauugucaucaugguga

SEQ ID NO: 967117 - RNA, 21 nt, Mycobacterium avium subsp. paratuberculosis
gcccaaaaacgagaugcccca

SEQ ID NO: 967118 - RNA, 23 nt, Mycobacterium avium subsp. paratuberculosis
gcccaaaacgugauagcggccgc

SEQ ID NO: 967119 - RNA, 16 nt, Mycobacterium avium subsp. paratuberculosis
gcccaacacgcccugc

SEQ ID NO: 967120 - RNA, 19 nt, Mycobacterium avium subsp. paratuberculosis
gcccaacacgcccugcagg

SEQ ID NO: 967121 - RNA, 20 nt, Mycobacterium avium subsp. paratuberculosis
gcccaaccggaucggcuagc

SEQ ID NO: 967122 - RNA, 23 nt, Mycobacterium avium subsp. paratuberculosis
gcccaaccggaucggcuagcagc

SEQ ID NO: 967123 - RNA, 17 nt, Mycobacterium avium subsp. paratuberculosis
gcccaacuacccgccga

SEQ ID NO: 967124 - RNA, 23 nt, Mycobacterium avium subsp. paratuberculosis
gcccacccgaugaccggcccggc

SEQ ID NO: 967125 - RNA, 16 nt, Mycobacterium avium subsp. paratuberculosis
gcccacccgcacgccc

SEQ ID NO: 967126 - RNA, 16 nt, Mycobacterium avium subsp. paratuberculosis
gcccacccgccagccc

SEQ ID NO: 967127 - RNA, 21 nt, Mycobacterium avium subsp. paratuberculosis
gcccaccagcugggaggcgca

SEQ ID NO: 967128 - RNA, 19 nt, Mycobacterium avium subsp. paratuberculosis
gcccacccguuggcaggcc

SEQ ID NO: 967129 - RNA, 21 nt, Mycobacterium avium subsp. paratuberculosis
gcccaccgaaucacccacggc

SEQ ID NO: 967130 - RNA, 17 nt, Mycobacterium avium subsp. paratuberculosis
gcccaccaucccgccgc

SEQ ID NO: 967131 - RNA, 17 nt, Mycobacterium avium subsp. paratuberculosis
gcccaccgucgccacga

SEQ ID NO: 967132 - RNA, 15 nt, Mycobacterium avium subsp. paratuberculosis
gcccaccggcccggc

SEQ ID NO: 967133 - RNA, 19 nt, Mycobacterium avium subsp. paratuberculosis
gcccaccggcccggcgggc

SEQ ID NO: 967134 - RNA, 17 nt, Mycobacterium avium subsp. paratuberculosis
gcccaccgcgcccagcc

SEQ ID NO: 967135 - RNA, 22 nt, Mycobacterium avium subsp. paratuberculosis
gcccaccgcgcccagccccagc

SEQ ID NO: 967136 - RNA, 16 nt, Mycobacterium avium subsp. paratuberculosis
gcccaccgcggcgcgc

SEQ ID NO: 967137 - RNA, 22 nt, Mycobacterium avium subsp. paratuberculosis
gcccaccgcggcgcgcggccgc

SEQ ID NO: 967138 - RNA, 22 nt, Mycobacterium avium subsp. paratuberculosis
gcccaccgcggugaccgcccgc

SEQ ID NO: 967139 - RNA, 13 nt, Mycobacterium avium subsp. paratuberculosis
gcccacgccgagg

SEQ ID NO: 967140 - RNA, 19 nt, Mycobacterium avium subsp. paratuberculosis
gcccacgccgagggugccg

SEQ ID NO: 967141 - RNA, 22 nt, Mycobacterium avium subsp. paratuberculosis
gcccacgccgagggugccggcc

SEQ ID NO: 967142 - RNA, 23 nt, Mycobacterium avium subsp. paratuberculosis
gcccacgccgucgacccguuccc

SEQ ID NO: 967143 - RNA, 22 nt, Mycobacterium avium subsp. paratuberculosis
gcccacgacgucugggccgccg

SEQ ID NO: 967144 - RNA, 23 nt, Mycobacterium avium subsp. paratuberculosis
gcccacgaagaugaucagcgcgc

SEQ ID NO: 967145 - RNA, 22 nt, Mycobacterium avium subsp. paratuberculosis
gcccaccugguucucccgucgc

SEQ ID NO: 967146 - RNA, 18 nt, Mycobacterium avium subsp. paratuberculosis
gcccacgccgcccaggcc

SEQ ID NO: 967147 - RNA, 14 nt, Mycobacterium avium subsp. paratuberculosis
gcccagaacugggc

SEQ ID NO: 967148 - RNA, 19 nt, Mycobacterium avium subsp. paratuberculosis
gcccagaacugggccgccg

SEQ ID NO: 967149 - RNA, 14 nt, Mycobacterium avium subsp. paratuberculosis
gcccagcgcagcgc

SEQ ID NO: 967150 - RNA, 16 nt, Mycobacterium avium subsp. paratuberculosis
gcccagcgcagcgccu

SEQ ID NO: 967151 - RNA, 21 nt, Mycobacterium avium subsp. paratuberculosis
gcccagccaggccgccgggcc

SEQ ID NO: 967152 - RNA, 15 nt, Mycobacterium avium subsp. paratuberculosis
gcccagccccagcac

SEQ ID NO: 967153 - RNA, 23 nt, Mycobacterium avium subsp. paratuberculosis
gcccagccccucgacguccaggc

SEQ ID NO: 967154 - RNA, 13 nt, Mycobacterium avium subsp. paratuberculosis
gcccagcccgccg

SEQ ID NO: 967155 - RNA, 16 nt, Mycobacterium avium subsp. paratuberculosis
gcccagcccgccgcgu

SEQ ID NO: 967156 - RNA, 21 nt, Mycobacterium avium subsp. paratuberculosis
gcccagcccgccgcguccggg

SEQ ID NO: 967157 - RNA, 17 nt, Mycobacterium avium subsp. paratuberculosis
gcccagcccgcgcgagc

SEQ ID NO: 967158 - RNA, 13 nt, Mycobacterium avium subsp. paratuberculosis
gcccagcccgcgg

SEQ ID NO: 967159 - RNA, 21 nt, Mycobacterium avium subsp. paratuberculosis
gcccagccagccgguggcggc

SEQ ID NO: 967160 - RNA, 17 nt, Mycobacterium avium subsp. paratuberculosis
gcccagcaucgccgcga

SEQ ID NO: 967161 - RNA, 19 nt, Mycobacterium avium subsp. paratuberculosis
gcccagcgcauccaccagg

SEQ ID NO: 967162 - RNA, 12 nt, Mycobacterium avium subsp. paratuberculosis
gcccagcgccac

SEQ ID NO: 967163 - RNA, 13 nt, Mycobacterium avium subsp. paratuberculosis
gcccagcgccccg

SEQ ID NO: 967164 - RNA, 13 nt, Mycobacterium avium subsp. paratuberculosis
gcccagcgccacg

SEQ ID NO: 967165 - RNA, 14 nt, Mycobacterium avium subsp. paratuberculosis
gcccagcgccgcgg

SEQ ID NO: 967166 - RNA, 16 nt, Mycobacterium avium subsp. paratuberculosis
gcccagcgccgcggcg

SEQ ID NO: 967167 - RNA, 19 nt, Mycobacterium avium subsp. paratuberculosis
gcccagacaggccggccgc

SEQ ID NO: 967168 - RNA, 13 nt, Mycobacterium avium subsp. paratuberculosis
gcccagacgcggg

SEQ ID NO: 967169 - RNA, 19 nt, Mycobacterium avium subsp. paratuberculosis
gcccagacgcgggcgccca

SEQ ID NO: 967170 - RNA, 21 nt, Mycobacterium avium subsp. paratuberculosis
gcccagacgcgggcgcccagc

SEQ ID NO: 967171 - RNA, 19 nt, Mycobacterium avium subsp. paratuberculosis
gcccagacgguuccaccgg

SEQ ID NO: 967172 - RNA, 15 nt, Mycobacterium avium subsp. paratuberculosis
gcccagauagaucgc

SEQ ID NO: 967173 - RNA, 21 nt, Mycobacterium avium subsp. paratuberculosis
gcccagaucgacgccgaccgc

SEQ ID NO: 967174 - RNA, 20 nt, Mycobacterium avium subsp. paratuberculosis
gcccagaucgcgguccacca

SEQ ID NO: 967175 - RNA, 15 nt, Mycobacterium avium subsp. paratuberculosis
gcccagaugccgccg

SEQ ID NO: 967176 - RNA, 16 nt, Mycobacterium avium subsp. paratuberculosis
gcccagcagcgggccc

SEQ ID NO: 967177 - RNA, 18 nt, Mycobacterium avium subsp. paratuberculosis
gcccagcagcgggcccgg

SEQ ID NO: 967178 - RNA, 20 nt, Mycobacterium avium subsp. paratuberculosis
gcccagcagcccggccagcc

SEQ ID NO: 967179 - RNA, 22 nt, Mycobacterium avium subsp. paratuberculosis
gcccagcagcccggccagccgg

SEQ ID NO: 967180 - RNA, 16 nt, Mycobacterium avium subsp. paratuberculosis
gcccagcagccugccc

SEQ ID NO: 967181 - RNA, 18 nt, Mycobacterium avium subsp. paratuberculosis
gcccagcagcgcaccggc

SEQ ID NO: 967182 - RNA, 23 nt, Mycobacterium avium subsp. paratuberculosis
gcccagcaguccggcggucagca

SEQ ID NO: 967183 - RNA, 18 nt, Mycobacterium avium subsp. paratuberculosis
gccagcguuuccagcgcc

SEQ ID NO: 967184 - RNA, 20 nt, Mycobacterium avium subsp. paratuberculosis
gccagcguuuggccugcggc

SEQ ID NO: 967185 - RNA, 16 nt, Mycobacterium avium subsp. paratuberculosis
gccagcguggcgcgcc

SEQ ID NO: 967186 - RNA, 21 nt, Mycobacterium avium subsp. paratuberculosis
gccagcguggcgcgccccggc

SEQ ID NO: 967187 - RNA, 23 nt, Mycobacterium avium subsp. paratuberculosis
gccagcguggcgcgccccggccc

SEQ ID NO: 967188 - RNA, 22 nt, Mycobacterium avium subsp. paratuberculosis
gccagcucgucgagccggccgg

SEQ ID NO: 967189 - RNA, 13 nt, Mycobacterium avium subsp. paratuberculosis
gccagcugcaccg

SEQ ID NO: 967190 - RNA, 16 nt, Mycobacterium avium subsp. paratuberculosis
gccagcugcaccgggg

SEQ ID NO: 967191 - RNA, 17 nt, Mycobacterium avium subsp. paratuberculosis
gccagcugcaccggggc

SEQ ID NO: 967192 - RNA, 15 nt, Mycobacterium avium subsp. paratuberculosis
gccagcugcccgccg

SEQ ID NO: 967193 - RNA, 14 nt, Mycobacterium avium subsp. paratuberculosis
gccagcugccgcga

SEQ ID NO: 967194 - RNA, 18 nt, Mycobacterium avium subsp. paratuberculosis
gccagcugauagccgccc

SEQ ID NO: 967195 - RNA, 22 nt, Mycobacterium avium subsp. paratuberculosis
gccagcggcgccgaaaaacgcg

SEQ ID NO: 967196 - RNA, 15 nt, Mycobacterium avium subsp. paratuberculosis
gccagcgugaacacc

SEQ ID NO: 967197 - RNA, 18 nt, Mycobacterium avium subsp. paratuberculosis
gccagcgugaacaccgcg

SEQ ID NO: 967198 - RNA, 19 nt, Mycobacterium avium subsp. paratuberculosis
gccagcgugacgcccggcg

SEQ ID NO: 967199 - RNA, 15 nt, Mycobacterium avium subsp. paratuberculosis
gccagcggccagccc

SEQ ID NO: 967200 - RNA, 14 nt, Mycobacterium avium subsp. paratuberculosis
gccagcggcagcga

SEQ ID NO: 967201 - RNA, 21 nt, Mycobacterium avium subsp. paratuberculosis
gccagcggcaacugggcggcc

SEQ ID NO: 967202 - RNA, 17 nt, Mycobacterium avium subsp. paratuberculosis
gccagcgcgacggccuc

SEQ ID NO: 967203 - RNA, 15 nt, Mycobacterium avium subsp. paratuberculosis
gccagccgcgcggcg

SEQ ID NO: 967204 - RNA, 19 nt, Mycobacterium avium subsp. paratuberculosis
gccagccgcucccggcgca

SEQ ID NO: 967205 - RNA, 14 nt, Mycobacterium avium subsp. paratuberculosis
gccagccgcgcggc

SEQ ID NO: 967206 - RNA, 15 nt, Mycobacterium avium subsp. paratuberculosis
gccagccgcccagca

SEQ ID NO: 967207 - RNA, 16 nt, Mycobacterium avium subsp. paratuberculosis
gccagccgcagcaggc

SEQ ID NO: 967208 - RNA, 14 nt, Mycobacterium avium subsp. paratuberculosis
gccagccgccgccg

SEQ ID NO: 967209 - RNA, 21 nt, Mycobacterium avium subsp. paratuberculosis
gccagcgcccgauucgcggcc

SEQ ID NO: 967210 - RNA, 15 nt, Mycobacterium avium subsp. paratuberculosis
gccagcgccgccagc

SEQ ID NO: 967211 - RNA, 18 nt, Mycobacterium avium subsp. paratuberculosis
gccagcgccccgccgggg

SEQ ID NO: 967212 - RNA, 22 nt, Mycobacterium avium subsp. paratuberculosis
gccagcgcccgcgcgugggcca

SEQ ID NO: 967213 - RNA, 14 nt, Mycobacterium avium subsp. paratuberculosis
gccagcgcccgcgg

SEQ ID NO: 967214 - RNA, 15 nt, Mycobacterium avium subsp. paratuberculosis
gccagcgcccgcggg

SEQ ID NO: 967215 - RNA, 14 nt, Mycobacterium avium subsp. paratuberculosis
gccagcgcccggcg

SEQ ID NO: 967216 - RNA, 20 nt, Mycobacterium avium subsp. paratuberculosis
gccagcgagaagucgcucag

SEQ ID NO: 967217 - RNA, 16 nt, Mycobacterium avium subsp. paratuberculosis
gccagcgaguccagcc

SEQ ID NO: 967218 - RNA, 19 nt, Mycobacterium avium subsp. paratuberculosis
gccagcgaguccagccagc

SEQ ID NO: 967219 - RNA, 17 nt, Mycobacterium avium subsp. paratuberculosis
gccagcgagugggugaa

SEQ ID NO: 967220 - RNA, 19 nt, Mycobacterium avium subsp. paratuberculosis
gccagcgccaugccgccga

SEQ ID NO: 967221 - RNA, 14 nt, Mycobacterium avium subsp. paratuberculosis
gccagcgccgcgcg

SEQ ID NO: 967222 - RNA, 20 nt, Mycobacterium avium subsp. paratuberculosis
gccagcgccgcgcgcgcggc

SEQ ID NO: 967223 - RNA, 13 nt, Mycobacterium avium subsp. paratuberculosis
gccagcgccgcgc

SEQ ID NO: 967224 - RNA, 18 nt, Mycobacterium avium subsp. paratuberculosis
gccagcgccgcccgggcg

SEQ ID NO: 967225 - RNA, 13 nt, Mycobacterium avium subsp. paratuberculosis
gccagcgccucca

SEQ ID NO: 967226 - RNA, 14 nt, Mycobacterium avium subsp. paratuberculosis
gccagcgccuccag

SEQ ID NO: 967227 - RNA, 15 nt, Mycobacterium avium subsp. paratuberculosis
gccagcgccuccagc

SEQ ID NO: 967228 - RNA, 18 nt, Mycobacterium avium subsp. paratuberculosis
gccagcgccuccagccgc

SEQ ID NO: 967229 - RNA, 16 nt, Mycobacterium avium subsp. paratuberculosis
gccagggucucgggca

SEQ ID NO: 967230 - RNA, 19 nt, Mycobacterium avium subsp. paratuberculosis
gccagggucucgggcagca

SEQ ID NO: 967231 - RNA, 23 nt, Mycobacterium avium subsp. paratuberculosis
gccagggucucgggcagcagcac

SEQ ID NO: 967232 - RNA, 23 nt, Mycobacterium avium subsp. paratuberculosis
gccaggugcacgccgagcagcac

SEQ ID NO: 967233 - RNA, 21 nt, Mycobacterium avium subsp. paratuberculosis
gccaggguggggaucacgucg

SEQ ID NO: 967234 - RNA, 17 nt, Mycobacterium avium subsp. paratuberculosis
gccagggugucccagcg

SEQ ID NO: 967235 - RNA, 19 nt, Mycobacterium avium subsp. paratuberculosis
gccagggugucccagcgcc

SEQ ID NO: 967236 - RNA, 13 nt, Mycobacterium avium subsp. paratuberculosis
gccagguggguga

SEQ ID NO: 967237 - RNA, 13 nt, Mycobacterium avium subsp. paratuberculosis
gccagguggugaa

SEQ ID NO: 967238 - RNA, 14 nt, Mycobacterium avium subsp. paratuberculosis
gccaggugugcccg

SEQ ID NO: 967239 - RNA, 17 nt, Mycobacterium avium subsp. paratuberculosis
gccaggugugcccgccc

SEQ ID NO: 967240 - RNA, 13 nt, Mycobacterium avium subsp. paratuberculosis
gccaggcggguga

SEQ ID NO: 967241 - RNA, 14 nt, Mycobacterium avium subsp. paratuberculosis
gccaggcuggccag

SEQ ID NO: 967242 - RNA, 12 nt, Mycobacterium avium subsp. paratuberculosis
gccagggcggcg

SEQ ID NO: 967243 - RNA, 17 nt, Mycobacterium avium subsp. paratuberculosis
gccagggcggcgccggc

SEQ ID NO: 967244 - RNA, 18 nt, Mycobacterium avium subsp. paratuberculosis
gccagggcucgugcagcc

SEQ ID NO: 967245 - RNA, 13 nt, Mycobacterium avium subsp. paratuberculosis
gccaggcagaagc

SEQ ID NO: 967246 - RNA, 13 nt, Mycobacterium avium subsp. paratuberculosis
gccaggccgccgg

SEQ ID NO: 967247 - RNA, 16 nt, Mycobacterium avium subsp. paratuberculosis
gccaggccgccgggcc

SEQ ID NO: 967248 - RNA, 15 nt, Mycobacterium avium subsp. paratuberculosis
gccaggccgcgagca

SEQ ID NO: 967249 - RNA, 19 nt, Mycobacterium avium subsp. paratuberculosis
gccaggccgucggcgcggc

SEQ ID NO: 967250 - RNA, 17 nt, Mycobacterium avium subsp. paratuberculosis
gccaggccggccugccg

SEQ ID NO: 967251 - RNA, 18 nt, Mycobacterium avium subsp. paratuberculosis
gccaggccggccugccgg

SEQ ID NO: 967252 - RNA, 12 nt, Mycobacterium avium subsp. paratuberculosis
gccaggccggcg

SEQ ID NO: 967253 - RNA, 13 nt, Mycobacterium avium subsp. paratuberculosis
gccaggcgcgcgc

SEQ ID NO: 967254 - RNA, 14 nt, Mycobacterium avium subsp. paratuberculosis
gccaggcgcgcgcu

SEQ ID NO: 967255 - RNA, 15 nt, Mycobacterium avium subsp. paratuberculosis
gccaggcgcgcgcug

SEQ ID NO: 967256 - RNA, 19 nt, Mycobacterium avium subsp. paratuberculosis
gccaggcgacuguccaggc

SEQ ID NO: 967257 - RNA, 16 nt, Mycobacterium avium subsp. paratuberculosis
gccaggauccgcccgc

SEQ ID NO: 967258 - RNA, 17 nt, Mycobacterium avium subsp. paratuberculosis
gccaggaucugcucggc

SEQ ID NO: 967259 - RNA, 14 nt, Mycobacterium avium subsp. paratuberculosis
gccaggcacagcag

SEQ ID NO: 967260 - RNA, 19 nt, Mycobacterium avium subsp. paratuberculosis
gccaggaugaccgcccagg

SEQ ID NO: 967261 - RNA, 20 nt, Mycobacterium avium subsp. paratuberculosis
gccaggaugaccgcccagga

SEQ ID NO: 967262 - RNA, 21 nt, Mycobacterium avium subsp. paratuberculosis
gccaggaugaccgcccaggac

SEQ ID NO: 967263 - RNA, 12 nt, Mycobacterium avium subsp. paratuberculosis
gccaggauggag

SEQ ID NO: 967264 - RNA, 17 nt, Mycobacterium avium subsp. paratuberculosis
gccaggauggagcugac

SEQ ID NO: 967265 - RNA, 15 nt, Mycobacterium avium subsp. paratuberculosis
gccagcugggugguc

SEQ ID NO: 967266 - RNA, 22 nt, Mycobacterium avium subsp. paratuberculosis
gccagcuggguggucaccagcg

SEQ ID NO: 967267 - RNA, 18 nt, Mycobacterium avium subsp. paratuberculosis
gccagcugcgcgucggcc

SEQ ID NO: 967268 - RNA, 19 nt, Mycobacterium avium subsp. paratuberculosis
gccagcugcgcgucggccg

SEQ ID NO: 967269 - RNA, 21 nt, Mycobacterium avium subsp. paratuberculosis
gccagcugcgcgucggccgca

SEQ ID NO: 967270 - RNA, 15 nt, Mycobacterium avium subsp. paratuberculosis
gccagacgguggggc

SEQ ID NO: 967271 - RNA, 14 nt, Mycobacterium avium subsp. paratuberculosis
gccagacguccagc

SEQ ID NO: 967272 - RNA, 18 nt, Mycobacterium avium subsp. paratuberculosis
gccagacucacggcggca

SEQ ID NO: 967273 - RNA, 22 nt, Mycobacterium avium subsp. paratuberculosis
gccagacugaugcccucgccgg

SEQ ID NO: 967274 - RNA, 23 nt, Mycobacterium avium subsp. paratuberculosis
gccagacugcgcaccgccagcac

SEQ ID NO: 967275 - RNA, 20 nt, Mycobacterium avium subsp. paratuberculosis
gccagagcgcgaaaaccagc

SEQ ID NO: 967276 - RNA, 17 nt, Mycobacterium avium subsp. paratuberculosis
gccagcaccagcagccg

SEQ ID NO: 967277 - RNA, 16 nt, Mycobacterium avium subsp. paratuberculosis
gccagcaccagcgcgc

SEQ ID NO: 967278 - RNA, 15 nt, Mycobacterium avium subsp. paratuberculosis
gccagcaccaggaag

SEQ ID NO: 967279 - RNA, 15 nt, Mycobacterium avium subsp. paratuberculosis
gccagcaacaccagc

SEQ ID NO: 967280 - RNA, 17 nt, Mycobacterium avium subsp. paratuberculosis
gccagcaacaccagcug

SEQ ID NO: 967281 - RNA, 15 nt, Mycobacterium avium subsp. paratuberculosis
gccagcaacagcagc

SEQ ID NO: 967282 - RNA, 16 nt, Mycobacterium avium subsp. paratuberculosis
gccagcaaccccgcgg

SEQ ID NO: 967283 - RNA, 17 nt, Mycobacterium avium subsp. paratuberculosis
gccagcaaccccgcggu

SEQ ID NO: 967284 - RNA, 21 nt, Mycobacterium avium subsp. paratuberculosis
gccagcaacgacccggccacc

SEQ ID NO: 967285 - RNA, 20 nt, Mycobacterium avium subsp. paratuberculosis
gccacugggcgucggcgccc

SEQ ID NO: 967286 - RNA, 17 nt, Mycobacterium avium subsp. paratuberculosis
gccaccgcugggcggcg

SEQ ID NO: 967287 - RNA, 17 nt, Mycobacterium avium subsp. paratuberculosis
gccacccucgccgccgc

SEQ ID NO: 967288 - RNA, 14 nt, Mycobacterium avium subsp. paratuberculosis
gccaccggcccggc

SEQ ID NO: 967289 - RNA, 19 nt, Mycobacterium avium subsp. paratuberculosis
gccaccggcccggccggcg

SEQ ID NO: 967290 - RNA, 20 nt, Mycobacterium avium subsp. paratuberculosis
gccaccggcccggccggcgc

SEQ ID NO: 967291 - RNA, 13 nt, Mycobacterium avium subsp. paratuberculosis
gccaccggcgcca

SEQ ID NO: 967292 - RNA, 18 nt, Mycobacterium avium subsp. paratuberculosis
gccagcaugaucaccgcc

SEQ ID NO: 967293 - RNA, 22 nt, Mycobacterium avium subsp. paratuberculosis
gccagcaccgacagucccacca

SEQ ID NO: 967294 - RNA, 14 nt, Mycobacterium avium subsp. paratuberculosis
gccagcaccgcggc

SEQ ID NO: 967295 - RNA, 21 nt, Mycobacterium avium subsp. paratuberculosis
gccagcaccgcgggggcggcc

SEQ ID NO: 967296 - RNA, 16 nt, Mycobacterium avium subsp. paratuberculosis
gccagcaccauccagu

SEQ ID NO: 967297 - RNA, 14 nt, Mycobacterium avium subsp. paratuberculosis
gccagcacccgcug

SEQ ID NO: 967298 - RNA, 21 nt, Mycobacterium avium subsp. paratuberculosis
gccagcacccgcugauccagc

SEQ ID NO: 967299 - RNA, 18 nt, Mycobacterium avium subsp. paratuberculosis
gccagcaccuucgggccg

SEQ ID NO: 967300 - RNA, 16 nt, Mycobacterium avium subsp. paratuberculosis
gccagcaccgucagcc

SEQ ID NO: 967301 - RNA, 18 nt, Mycobacterium avium subsp. paratuberculosis
gccagcaccucggcgacc

SEQ ID NO: 967302 - RNA, 14 nt, Mycobacterium avium subsp. paratuberculosis
gccagcagccagcu

SEQ ID NO: 967303 - RNA, 15 nt, Mycobacterium avium subsp. paratuberculosis
gccagcagccagcug

SEQ ID NO: 967304 - RNA, 14 nt, Mycobacterium avium subsp. paratuberculosis
gccagcagccgcga

SEQ ID NO: 967305 - RNA, 15 nt, Mycobacterium avium subsp. paratuberculosis
gccagcagccgcgcg

SEQ ID NO: 967306 - RNA, 23 nt, Mycobacterium avium subsp. paratuberculosis
gccagcagccgcgcgagcaucac

SEQ ID NO: 967307 - RNA, 14 nt, Mycobacterium avium subsp. paratuberculosis
gccagcagcgcaag

SEQ ID NO: 967308 - RNA, 13 nt, Mycobacterium avium subsp. paratuberculosis
gccagcagcggca

SEQ ID NO: 967309 - RNA, 18 nt, Mycobacterium avium subsp. paratuberculosis
gccagcagcgcgccgcgc

SEQ ID NO: 967310 - RNA, 15 nt, Mycobacterium avium subsp. paratuberculosis
gccagcagcgcggcg

SEQ ID NO: 967311 - RNA, 22 nt, Mycobacterium avium subsp. paratuberculosis
gccagcagcgcgucgcgggccc

SEQ ID NO: 967312 - RNA, 23 nt, Mycobacterium avium subsp. paratuberculosis
gccagccaggcgaugaagccggc

SEQ ID NO: 967313 - RNA, 13 nt, Mycobacterium avium subsp. paratuberculosis
gccagcccagccg

SEQ ID NO: 967314 - RNA, 22 nt, Mycobacterium avium subsp. paratuberculosis
gccagcccgggaaagcggguga

SEQ ID NO: 967315 - RNA, 17 nt, Mycobacterium avium subsp. paratuberculosis
gccagcccguggccagc

SEQ ID NO: 967316 - RNA, 18 nt, Mycobacterium avium subsp. paratuberculosis
gccagcccguggccagcg

SEQ ID NO: 967317 - RNA, 16 nt, Mycobacterium avium subsp. paratuberculosis
gccagcccguuguggc

SEQ ID NO: 967318 - RNA, 20 nt, Mycobacterium avium subsp. paratuberculosis
gccagcccguuguggcggcc

SEQ ID NO: 967319 - RNA, 12 nt, Mycobacterium avium subsp. paratuberculosis
gccagcccgcgc

SEQ ID NO: 967320 - RNA, 20 nt, Mycobacterium avium subsp. paratuberculosis
gccagcccgcggcagccagc

SEQ ID NO: 967321 - RNA, 15 nt, Mycobacterium avium subsp. paratuberculosis
gccagcccgcccagc

SEQ ID NO: 967322 - RNA, 12 nt, Mycobacterium avium subsp. paratuberculosis
gccagcccgccg

SEQ ID NO: 967323 - RNA, 20 nt, Mycobacterium avium subsp. paratuberculosis
gccagccccgggaaccagcc

SEQ ID NO: 967324 - RNA, 16 nt, Mycobacterium avium subsp. paratuberculosis
gccagccccaccggcc

SEQ ID NO: 967325 - RNA, 22 nt, Mycobacterium avium subsp. paratuberculosis
gccaaugguuuucgucgaucag

SEQ ID NO: 967326 - RNA, 21 nt, Mycobacterium avium subsp. paratuberculosis
gccacaacuggucgugcucgu

SEQ ID NO: 967327 - RNA, 19 nt, Mycobacterium avium subsp. paratuberculosis
gccacaaacagcgcggccg

SEQ ID NO: 967328 - RNA, 13 nt, Mycobacterium avium subsp. paratuberculosis
gccaauaaagcgg

SEQ ID NO: 967329 - RNA, 16 nt, Mycobacterium avium subsp. paratuberculosis
gccaauaaagcgggcc

SEQ ID NO: 967330 - RNA, 20 nt, Mycobacterium avium subsp. paratuberculosis
gccacaccgaucagcaugcc

SEQ ID NO: 967331 - RNA, 16 nt, Mycobacterium avium subsp. paratuberculosis
gccacaccgccgcggc

SEQ ID NO: 967332 - RNA, 23 nt, Mycobacterium avium subsp. paratuberculosis
gccacaccgccgcggcgguggcc

SEQ ID NO: 967333 - RNA, 18 nt, Mycobacterium avium subsp. paratuberculosis
gccacaccgccggcgcgg

SEQ ID NO: 967334 - RNA, 17 nt, Mycobacterium avium subsp. paratuberculosis
gccacacuggccaugcu

SEQ ID NO: 967335 - RNA, 24 nt, Mycobacterium avium subsp. paratuberculosis
gccacacuggcgugacgcucggcc

SEQ ID NO: 967336 - RNA, 17 nt, Mycobacterium avium subsp. paratuberculosis
gccacagcucgggcagc

SEQ ID NO: 967337 - RNA, 21 nt, Mycobacterium avium subsp. paratuberculosis
gccacagcggcgacagcggcc

SEQ ID NO: 967338 - RNA, 12 nt, Mycobacterium avium subsp. paratuberculosis
gccacagccggu

SEQ ID NO: 967339 - RNA, 19 nt, Mycobacterium avium subsp. paratuberculosis
gccaccaacggcagcagca

SEQ ID NO: 967340 - RNA, 19 nt, Mycobacterium avium subsp. paratuberculosis
gccaccacaguggccgcca

SEQ ID NO: 967341 - RNA, 16 nt, Mycobacterium avium subsp. paratuberculosis
gccaccaccacggagc

SEQ ID NO: 967342 - RNA, 20 nt, Mycobacterium avium subsp. paratuberculosis
gccaccaccacggagcgccc

SEQ ID NO: 967343 - RNA, 20 nt, Mycobacterium avium subsp. paratuberculosis
gccaccaccacggccgccga

SEQ ID NO: 967344 - RNA, 17 nt, Mycobacterium avium subsp. paratuberculosis
gccaccaucaggccggc

SEQ ID NO: 967345 - RNA, 21 nt, Mycobacterium avium subsp. paratuberculosis
gccaccaucaggccggccugc

SEQ ID NO: 967346 - RNA, 22 nt, Mycobacterium avium subsp. paratuberculosis
gccaccgcggggcugggcgcca

SEQ ID NO: 967347 - RNA, 23 nt, Mycobacterium avium subsp. paratuberculosis
gccaccgccugcgcgaucgccgg

SEQ ID NO: 967348 - RNA, 13 nt, Mycobacterium avium subsp. paratuberculosis
gccaccgcgccuu

SEQ ID NO: 967349 - RNA, 13 nt, Mycobacterium avium subsp. paratuberculosis
gccaccgcggcca

SEQ ID NO: 967350 - RNA, 15 nt, Mycobacterium avium subsp. paratuberculosis
gccaccgcggccagc

SEQ ID NO: 967351 - RNA, 22 nt, Mycobacterium avium subsp. paratuberculosis
gccaccgcgaacgucucgcggg

SEQ ID NO: 967352 - RNA, 17 nt, Mycobacterium avium subsp. paratuberculosis
gccaccgcgacgcccag

SEQ ID NO: 967353 - RNA, 20 nt, Mycobacterium avium subsp. paratuberculosis
gccacccgaggccguucagg

SEQ ID NO: 967354 - RNA, 16 nt, Mycobacterium avium subsp. paratuberculosis
gccacccgcgccucca

SEQ ID NO: 967355 - RNA, 15 nt, Mycobacterium avium subsp. paratuberculosis
gccaccccgcgccac

SEQ ID NO: 967356 - RNA, 21 nt, Mycobacterium avium subsp. paratuberculosis
gccaaaguuggcaucccgcgc

SEQ ID NO: 967357 - RNA, 15 nt, Mycobacterium avium subsp. paratuberculosis
gccaaagagcuuggc

SEQ ID NO: 967358 - RNA, 13 nt, Mycobacterium avium subsp. paratuberculosis
gccaacagcagca

SEQ ID NO: 967359 - RNA, 21 nt, Mycobacterium avium subsp. paratuberculosis
gccaacagcagcagaaccagc

SEQ ID NO: 967360 - RNA, 22 nt, Mycobacterium avium subsp. paratuberculosis
gccaacagcagcagaaccagca

SEQ ID NO: 967361 - RNA, 20 nt, Mycobacterium avium subsp. paratuberculosis
gccaacagcagcgccgcggc

SEQ ID NO: 967362 - RNA, 12 nt, Mycobacterium avium subsp. paratuberculosis
gccaaccagguc

SEQ ID NO: 967363 - RNA, 12 nt, Mycobacterium avium subsp. paratuberculosis
gccaacccgggc

SEQ ID NO: 967364 - RNA, 16 nt, Mycobacterium avium subsp. paratuberculosis
gccaaccgggcaggca

SEQ ID NO: 967365 - RNA, 18 nt, Mycobacterium avium subsp. paratuberculosis
gccaaccgggcaggcacg

SEQ ID NO: 967366 - RNA, 18 nt, Mycobacterium avium subsp. paratuberculosis
gccaacgguucggccgcu

SEQ ID NO: 967367 - RNA, 14 nt, Mycobacterium avium subsp. paratuberculosis
gccaacgagcgcgc

SEQ ID NO: 967368 - RNA, 16 nt, Mycobacterium avium subsp. paratuberculosis
gccaacgagcgcgccg

SEQ ID NO: 967369 - RNA, 22 nt, Mycobacterium avium subsp. paratuberculosis
gccaacucgaccugcccgggcc

SEQ ID NO: 967370 - RNA, 18 nt, Mycobacterium avium subsp. paratuberculosis
gccaacugguccugcggc

SEQ ID NO: 967371 - RNA, 15 nt, Mycobacterium avium subsp. paratuberculosis
gccaacuccggcggc

SEQ ID NO: 967372 - RNA, 16 nt, Mycobacterium avium subsp. paratuberculosis
gccaacuccggcggca

SEQ ID NO: 967373 - RNA, 13 nt, Mycobacterium avium subsp. paratuberculosis
gccaagacacgcu

SEQ ID NO: 967374 - RNA, 20 nt, Mycobacterium avium subsp. paratuberculosis
gccaagacguccgcgucggc

SEQ ID NO: 967375 - RNA, 15 nt, Mycobacterium avium subsp. paratuberculosis
gcauuggugccggcc

SEQ ID NO: 967376 - RNA, 20 nt, Mycobacterium avium subsp. paratuberculosis
gcauugcagcggaugccgga

SEQ ID NO: 967377 - RNA, 22 nt, Mycobacterium avium subsp. paratuberculosis
gcauugcccaucgccacgccgu

SEQ ID NO: 967378 - RNA, 22 nt, Mycobacterium avium subsp. paratuberculosis
gcauuggcgauggccuuucugg

SEQ ID NO: 967379 - RNA, 19 nt, Mycobacterium avium subsp. paratuberculosis
gcauuggcagcucgggcag

SEQ ID NO: 967380 - RNA, 20 nt, Mycobacterium avium subsp. paratuberculosis
gcauuggcagcucgggcagc

SEQ ID NO: 967381 - RNA, 21 nt, Mycobacterium avium subsp. paratuberculosis
gcauucaccagcugucccagu

SEQ ID NO: 967382 - RNA, 17 nt, Mycobacterium avium subsp. paratuberculosis
gcauuccgucuuggcca

SEQ ID NO: 967383 - RNA, 21 nt, Mycobacterium avium subsp. paratuberculosis
gcauuccgucuuggccaggcc

SEQ ID NO: 967384 - RNA, 18 nt, Mycobacterium avium subsp. paratuberculosis
gcauguugaacgccgcgu

SEQ ID NO: 967385 - RNA, 14 nt, Mycobacterium avium subsp. paratuberculosis
gcaugugccacagg

SEQ ID NO: 967386 - RNA, 15 nt, Mycobacterium avium subsp. paratuberculosis
gcauguggccgucgc

SEQ ID NO: 967387 - RNA, 21 nt, Mycobacterium avium subsp. paratuberculosis
gcauguagguggcgaccaccg

SEQ ID NO: 967388 - RNA, 14 nt, Mycobacterium avium subsp. paratuberculosis
gcaugucgcccgcg

SEQ ID NO: 967389 - RNA, 20 nt, Mycobacterium avium subsp. paratuberculosis
gcaugucgccgaacgccacc

SEQ ID NO: 967390 - RNA, 15 nt, Mycobacterium avium subsp. paratuberculosis
gcaugggaucagcag

SEQ ID NO: 967391 - RNA, 20 nt, Mycobacterium avium subsp. paratuberculosis
gcauggcgaugaccagcgcg

SEQ ID NO: 967392 - RNA, 17 nt, Mycobacterium avium subsp. paratuberculosis
gcauggacacgcccugg

SEQ ID NO: 967393 - RNA, 13 nt, Mycobacterium avium subsp. paratuberculosis
gcaugcgccagag

SEQ ID NO: 967394 - RNA, 18 nt, Mycobacterium avium subsp. paratuberculosis
gcaucguugccggcggcg

SEQ ID NO: 967395 - RNA, 19 nt, Mycobacterium avium subsp. paratuberculosis
gcaucguugccggcggcga

SEQ ID NO: 967396 - RNA, 23 nt, Mycobacterium avium subsp. paratuberculosis
gcaucgucgcggcgcuaaagcca

SEQ ID NO: 967397 - RNA, 20 nt, Mycobacterium avium subsp. paratuberculosis
gcaucucuugaugcagcgcc

SEQ ID NO: 967398 - RNA, 15 nt, Mycobacterium avium subsp. paratuberculosis
gcaucucgacccggg

SEQ ID NO: 967399 - RNA, 14 nt, Mycobacterium avium subsp. paratuberculosis
gcaucucggccgga

SEQ ID NO: 967400 - RNA, 18 nt, Mycobacterium avium subsp. paratuberculosis
gcaucgccgaaccgggcg

SEQ ID NO: 967401 - RNA, 15 nt, Mycobacterium avium subsp. paratuberculosis
gcaucgccgcggugc

SEQ ID NO: 967402 - RNA, 22 nt, Mycobacterium avium subsp. paratuberculosis
gcaucgccggcgaugcgcgccu

SEQ ID NO: 967403 - RNA, 16 nt, Mycobacterium avium subsp. paratuberculosis
gcaucgccggcgcgcu

SEQ ID NO: 967404 - RNA, 15 nt, Mycobacterium avium subsp. paratuberculosis
gcaucgcgcgcggcg

SEQ ID NO: 967405 - RNA, 21 nt, Mycobacterium avium subsp. paratuberculosis
gcaucgcgcgcggcggccacc

SEQ ID NO: 967406 - RNA, 14 nt, Mycobacterium avium subsp. paratuberculosis
gcaucgccgucguc

SEQ ID NO: 967407 - RNA, 16 nt, Mycobacterium avium subsp. paratuberculosis
gcaucggaugccgggg

SEQ ID NO: 967408 - RNA, 16 nt, Mycobacterium avium subsp. paratuberculosis
gcaucggugagacgac

SEQ ID NO: 967409 - RNA, 14 nt, Mycobacterium avium subsp. paratuberculosis
gcaucggucccagu

SEQ ID NO: 967410 - RNA, 17 nt, Mycobacterium avium subsp. paratuberculosis
gcaucggguugccggcg

SEQ ID NO: 967411 - RNA, 22 nt, Mycobacterium avium subsp. paratuberculosis
gcaucgggcgacaucucgguga

SEQ ID NO: 967412 - RNA, 17 nt, Mycobacterium avium subsp. paratuberculosis
gcaucgggcgcucggcc

SEQ ID NO: 967413 - RNA, 20 nt, Mycobacterium avium subsp. paratuberculosis
gcaucgggcgcucggccagc

SEQ ID NO: 967414 - RNA, 20 nt, Mycobacterium avium subsp. paratuberculosis
gcaucggcucguagcgggcg

SEQ ID NO: 967415 - RNA, 15 nt, Mycobacterium avium subsp. paratuberculosis
gcaugccggaacacc

SEQ ID NO: 967416 - RNA, 15 nt, Mycobacterium avium subsp. paratuberculosis
gcaugccggccggca

SEQ ID NO: 967417 - RNA, 21 nt, Mycobacterium avium subsp. paratuberculosis
gcaugccgaacaacagggccg

SEQ ID NO: 967418 - RNA, 20 nt, Mycobacterium avium subsp. paratuberculosis
gcaugccggucauccgggcc

SEQ ID NO: 967419 - RNA, 13 nt, Mycobacterium avium subsp. paratuberculosis
gcaugaugaacug

SEQ ID NO: 967420 - RNA, 21 nt, Mycobacterium avium subsp. paratuberculosis
gcaugaucaccgccagcgcgc

SEQ ID NO: 967421 - RNA, 14 nt, Mycobacterium avium subsp. paratuberculosis
gcaugcaccggugc

SEQ ID NO: 967422 - RNA, 22 nt, Mycobacterium avium subsp. paratuberculosis
gcaugcaccggugcaccgcgcg

SEQ ID NO: 967423 - RNA, 15 nt, Mycobacterium avium subsp. paratuberculosis
gcaugaagaucagca

SEQ ID NO: 967424 - RNA, 15 nt, Mycobacterium avium subsp. paratuberculosis
gcaugaccggccagc

SEQ ID NO: 967425 - RNA, 20 nt, Mycobacterium avium subsp. paratuberculosis
gcaugacgaacucguuggcg

SEQ ID NO: 967426 - RNA, 17 nt, Mycobacterium avium subsp. paratuberculosis
gcgguagaugucggguc

SEQ ID NO: 967427 - RNA, 20 nt, Mycobacterium avium subsp. paratuberculosis
gcgguccagcgagcccuucg

SEQ ID NO: 967428 - RNA, 19 nt, Mycobacterium avium subsp. paratuberculosis
gcgguccaccaccacaccc

SEQ ID NO: 967429 - RNA, 11 nt, Mycobacterium avium subsp. paratuberculosis
gcgguccagga

SEQ ID NO: 967430 - RNA, 19 nt, Mycobacterium avium subsp. paratuberculosis
gcgguccaggauccgcacc

SEQ ID NO: 967431 - RNA, 19 nt, Mycobacterium avium subsp. paratuberculosis
gcgguccaguacaccgcga

SEQ ID NO: 967432 - RNA, 13 nt, Mycobacterium avium subsp. paratuberculosis
gcggucccgcggg

SEQ ID NO: 967433 - RNA, 21 nt, Mycobacterium avium subsp. paratuberculosis
gcggucccgugcgccgcccac

SEQ ID NO: 967434 - RNA, 22 nt, Mycobacterium avium subsp. paratuberculosis
gcggucccgugcgccgcccaca

SEQ ID NO: 967435 - RNA, 13 nt, Mycobacterium avium subsp. paratuberculosis
gcgguccgccgca

SEQ ID NO: 967436 - RNA, 15 nt, Mycobacterium avium subsp. paratuberculosis
gcgguccgccgcagc

SEQ ID NO: 967437 - RNA, 16 nt, Mycobacterium avium subsp. paratuberculosis
gcggucgacgggaaga

SEQ ID NO: 967438 - RNA, 18 nt, Mycobacterium avium subsp. paratuberculosis
gcggucgaacgcggcgcc

SEQ ID NO: 967439 - RNA, 17 nt, Mycobacterium avium subsp. paratuberculosis
gcggucgugcggcugcc

SEQ ID NO: 967440 - RNA, 16 nt, Mycobacterium avium subsp. paratuberculosis
gcggucugucgcgcga

SEQ ID NO: 967441 - RNA, 16 nt, Mycobacterium avium subsp. paratuberculosis
gcggucuuggcggcca

SEQ ID NO: 967442 - RNA, 15 nt, Mycobacterium avium subsp. paratuberculosis
gcggucugagcccgg

SEQ ID NO: 967443 - RNA, 15 nt, Mycobacterium avium subsp. paratuberculosis
gcggugaagucggug

SEQ ID NO: 967444 - RNA, 21 nt, Mycobacterium avium subsp. paratuberculosis
gcggugaagucggugcccagc

SEQ ID NO: 967445 - RNA, 15 nt, Mycobacterium avium subsp. paratuberculosis
gcggugaccgcccgc

SEQ ID NO: 967446 - RNA, 21 nt, Mycobacterium avium subsp. paratuberculosis
gcggugaccgcgccgcgggug

SEQ ID NO: 967447 - RNA, 22 nt, Mycobacterium avium subsp. paratuberculosis
gcggugaccuugcgggcgguca

SEQ ID NO: 967448 - RNA, 15 nt, Mycobacterium avium subsp. paratuberculosis
gcggugacgcgccgg

SEQ ID NO: 967449 - RNA, 16 nt, Mycobacterium avium subsp. paratuberculosis
gcggugacgcgccggc

SEQ ID NO: 967450 - RNA, 19 nt, Mycobacterium avium subsp. paratuberculosis
gcggguuuggccgcgggcg

SEQ ID NO: 967451 - RNA, 22 nt, Mycobacterium avium subsp. paratuberculosis
gcggguuuggccgcgggcgggc

SEQ ID NO: 967452 - RNA, 17 nt, Mycobacterium avium subsp. paratuberculosis
gcgguacaucccgccgg

SEQ ID NO: 967453 - RNA, 16 nt, Mycobacterium avium subsp. paratuberculosis
gcgguaccgaugacca

SEQ ID NO: 967454 - RNA, 13 nt, Mycobacterium avium subsp. paratuberculosis
gcgggugcgcucg

SEQ ID NO: 967455 - RNA, 21 nt, Mycobacterium avium subsp. paratuberculosis
gcgggugccuucuuggcggcg

SEQ ID NO: 967456 - RNA, 14 nt, Mycobacterium avium subsp. paratuberculosis
gcgggugcgacggc

SEQ ID NO: 967457 - RNA, 23 nt, Mycobacterium avium subsp. paratuberculosis
gcgggugaugccguacaugguga

SEQ ID NO: 967458 - RNA, 22 nt, Mycobacterium avium subsp. paratuberculosis
gcgggugauggccgccgcaggc

SEQ ID NO: 967459 - RNA, 14 nt, Mycobacterium avium subsp. paratuberculosis
gcgggugcaacgug

SEQ ID NO: 967460 - RNA, 14 nt, Mycobacterium avium subsp. paratuberculosis
gcggguggccuuca

SEQ ID NO: 967461 - RNA, 15 nt, Mycobacterium avium subsp. paratuberculosis
gcgggugcuggucag

SEQ ID NO: 967462 - RNA, 21 nt, Mycobacterium avium subsp. paratuberculosis
gcggguggagaaguggcuggu

SEQ ID NO: 967463 - RNA, 16 nt, Mycobacterium avium subsp. paratuberculosis
gcgggugcggccagcg

SEQ ID NO: 967464 - RNA, 13 nt, Mycobacterium avium subsp. paratuberculosis
gcgggugcgggcg

SEQ ID NO: 967465 - RNA, 18 nt, Mycobacterium avium subsp. paratuberculosis
gcggguaaccgcagccgg

SEQ ID NO: 967466 - RNA, 21 nt, Mycobacterium avium subsp. paratuberculosis
gcggguaaccgcagccgggug

SEQ ID NO: 967467 - RNA, 15 nt, Mycobacterium avium subsp. paratuberculosis
gcggguacagccgca

SEQ ID NO: 967468 - RNA, 17 nt, Mycobacterium avium subsp. paratuberculosis
gcggguacagccgcagg

SEQ ID NO: 967469 - RNA, 17 nt, Mycobacterium avium subsp. paratuberculosis
gcgggugaggccaggcg

SEQ ID NO: 967470 - RNA, 16 nt, Mycobacterium avium subsp. paratuberculosis
gcgggugaggggcgcg

SEQ ID NO: 967471 - RNA, 19 nt, Mycobacterium avium subsp. paratuberculosis
gcgggugaggggcgcgcgc

SEQ ID NO: 967472 - RNA, 22 nt, Mycobacterium avium subsp. paratuberculosis
gcgggugaucccgaugccgcgc

SEQ ID NO: 967473 - RNA, 17 nt, Mycobacterium avium subsp. paratuberculosis
gcgggugaccgacagca

SEQ ID NO: 967474 - RNA, 15 nt, Mycobacterium avium subsp. paratuberculosis
gcgggccgcccggcg

SEQ ID NO: 967475 - RNA, 18 nt, Mycobacterium avium subsp. paratuberculosis
gcgggccgcccggcgcgc

SEQ ID NO: 967476 - RNA, 19 nt, Mycobacterium avium subsp. paratuberculosis
gcgggccgcccggcgcgcc

SEQ ID NO: 967477 - RNA, 23 nt, Mycobacterium avium subsp. paratuberculosis
gcgggcgcauaccagcgcuggua

SEQ ID NO: 967478 - RNA, 14 nt, Mycobacterium avium subsp. paratuberculosis
gcgggcgccgaaga

SEQ ID NO: 967479 - RNA, 21 nt, Mycobacterium avium subsp. paratuberculosis
gcgggcgccgaagauggccag

SEQ ID NO: 967480 - RNA, 15 nt, Mycobacterium avium subsp. paratuberculosis
gcgggccggagccuu

SEQ ID NO: 967481 - RNA, 17 nt, Mycobacterium avium subsp. paratuberculosis
gcgggccggcgccggug

SEQ ID NO: 967482 - RNA, 17 nt, Mycobacterium avium subsp. paratuberculosis
gcgggaggcccaguagc

SEQ ID NO: 967483 - RNA, 21 nt, Mycobacterium avium subsp. paratuberculosis
gcgggccgaagaccgggccga

SEQ ID NO: 967484 - RNA, 18 nt, Mycobacterium avium subsp. paratuberculosis
gcgggccgacagcacgcc

SEQ ID NO: 967485 - RNA, 23 nt, Mycobacterium avium subsp. paratuberculosis
gcgggccgacagcacgccgggca

SEQ ID NO: 967486 - RNA, 15 nt, Mycobacterium avium subsp. paratuberculosis
gcgggccgaccuggc

SEQ ID NO: 967487 - RNA, 21 nt, Mycobacterium avium subsp. paratuberculosis
gcgggcccgggccacccgcga

SEQ ID NO: 967488 - RNA, 16 nt, Mycobacterium avium subsp. paratuberculosis
gcgggccgagcguucg

SEQ ID NO: 967489 - RNA, 13 nt, Mycobacterium avium subsp. paratuberculosis
gcgggacccgcga

SEQ ID NO: 967490 - RNA, 16 nt, Mycobacterium avium subsp. paratuberculosis
gcgggaauggccgcgc

SEQ ID NO: 967491 - RNA, 16 nt, Mycobacterium avium subsp. paratuberculosis
gcgggacgaggggcag

SEQ ID NO: 967492 - RNA, 22 nt, Mycobacterium avium subsp. paratuberculosis
gcgggacgaucugcgucaugga

SEQ ID NO: 967493 - RNA, 16 nt, Mycobacterium avium subsp. paratuberculosis
gcgggacacggcggcg

SEQ ID NO: 967494 - RNA, 20 nt, Mycobacterium avium subsp. paratuberculosis
gcgggacacggcggcgcggg

SEQ ID NO: 967495 - RNA, 12 nt, Mycobacterium avium subsp. paratuberculosis
gcgggagccggc

SEQ ID NO: 967496 - RNA, 13 nt, Mycobacterium avium subsp. paratuberculosis
gcgggagccggcg

SEQ ID NO: 967497 - RNA, 17 nt, Mycobacterium avium subsp. paratuberculosis
gcgggagccggcggcgg

SEQ ID NO: 967498 - RNA, 18 nt, Mycobacterium avium subsp. paratuberculosis
gcgggagcgcuggucggc

SEQ ID NO: 967499 - RNA, 23 nt, Mycobacterium avium subsp. paratuberculosis
gcgggagaacagguaggacaccg

SEQ ID NO: 967500 - RNA, 22 nt, Mycobacterium avium subsp. paratuberculosis
gcgggacguggcucagcggcag

SEQ ID NO: 967501 - RNA, 20 nt, Mycobacterium avium subsp. paratuberculosis
gcgggacguugucuguucac

SEQ ID NO: 967502 - RNA, 14 nt, Mycobacterium avium subsp. paratuberculosis
gcgggacggcggcg

SEQ ID NO: 967503 - RNA, 20 nt, Mycobacterium avium subsp. paratuberculosis
gcgggaaguugcccaacugg

SEQ ID NO: 967504 - RNA, 21 nt, Mycobacterium avium subsp. paratuberculosis
gcgggaacucgaugcggcagc

SEQ ID NO: 967505 - RNA, 17 nt, Mycobacterium avium subsp. paratuberculosis
gcgggaagccgaggucg

SEQ ID NO: 967506 - RNA, 16 nt, Mycobacterium avium subsp. paratuberculosis
gcgggaagccgccgcc

SEQ ID NO: 967507 - RNA, 12 nt, Mycobacterium avium subsp. paratuberculosis
gcgggaagcugc

SEQ ID NO: 967508 - RNA, 15 nt, Mycobacterium avium subsp. paratuberculosis
gcgggaagggcccgg

SEQ ID NO: 967509 - RNA, 22 nt, Mycobacterium avium subsp. paratuberculosis
gcgggaagggcccgggaugggc

SEQ ID NO: 967510 - RNA, 24 nt, Mycobacterium avium subsp. paratuberculosis
gcgggaagggcccgggaugggccu

SEQ ID NO: 967511 - RNA, 23 nt, Mycobacterium avium subsp. paratuberculosis
gcgggaaucacgccccaggcgcc

SEQ ID NO: 967512 - RNA, 16 nt, Mycobacterium avium subsp. paratuberculosis
gcgggaauuggcaccg

SEQ ID NO: 967513 - RNA, 20 nt, Mycobacterium avium subsp. paratuberculosis
gcggggguucguugcgccgc

SEQ ID NO: 967514 - RNA, 21 nt, Mycobacterium avium subsp. paratuberculosis
gcggggguucguugcgccgcc

SEQ ID NO: 967515 - RNA, 12 nt, Mycobacterium avium subsp. paratuberculosis
gcggggucccaa

SEQ ID NO: 967516 - RNA, 12 nt, Mycobacterium avium subsp. paratuberculosis
gcggggucgggc

SEQ ID NO: 967517 - RNA, 17 nt, Mycobacterium avium subsp. paratuberculosis
gcggggggagaggcgcg

SEQ ID NO: 967518 - RNA, 20 nt, Mycobacterium avium subsp. paratuberculosis
gcggggugugcucggcggcg

SEQ ID NO: 967519 - RNA, 18 nt, Mycobacterium avium subsp. paratuberculosis
gcgggguguucaccgcgc

SEQ ID NO: 967520 - RNA, 15 nt, Mycobacterium avium subsp. paratuberculosis
gcggggugggcaccu

SEQ ID NO: 967521 - RNA, 15 nt, Mycobacterium avium subsp. paratuberculosis
gcggggugcccggcg

SEQ ID NO: 967522 - RNA, 15 nt, Mycobacterium avium subsp. paratuberculosis
gcggggugcgcggcg

SEQ ID NO: 967523 - RNA, 23 nt, Mycobacterium avium subsp. paratuberculosis
gcgggcuaggcucggcagccggc

SEQ ID NO: 967524 - RNA, 16 nt, Mycobacterium avium subsp. paratuberculosis
gcgggcguuggcuucc

SEQ ID NO: 967525 - RNA, 20 nt, Mycobacterium avium subsp. paratuberculosis
gcgggcuccgcacgaccuga

SEQ ID NO: 967526 - RNA, 14 nt, Mycobacterium avium subsp. paratuberculosis
gcgggcucgccggc

SEQ ID NO: 967527 - RNA, 15 nt, Mycobacterium avium subsp. paratuberculosis
gcgggcucgccggcc

SEQ ID NO: 967528 - RNA, 17 nt, Mycobacterium avium subsp. paratuberculosis
gcgggcucgcgcuggcg

SEQ ID NO: 967529 - RNA, 14 nt, Mycobacterium avium subsp. paratuberculosis
gcgggcucggacga

SEQ ID NO: 967530 - RNA, 22 nt, Mycobacterium avium subsp. paratuberculosis
gcgggcucggaguugcgcagcc

SEQ ID NO: 967531 - RNA, 13 nt, Mycobacterium avium subsp. paratuberculosis
gcgggcugcggcg

SEQ ID NO: 967532 - RNA, 12 nt, Mycobacterium avium subsp. paratuberculosis
gcgggcugcagc

SEQ ID NO: 967533 - RNA, 22 nt, Mycobacterium avium subsp. paratuberculosis
gcgggcgcguugaugccgugcg

SEQ ID NO: 967534 - RNA, 16 nt, Mycobacterium avium subsp. paratuberculosis
gcgggcggccagccgc

SEQ ID NO: 967535 - RNA, 17 nt, Mycobacterium avium subsp. paratuberculosis
gcgggcggccccgggcg

SEQ ID NO: 967536 - RNA, 22 nt, Mycobacterium avium subsp. paratuberculosis
gcgggcggcccgcacggccgcc

SEQ ID NO: 967537 - RNA, 18 nt, Mycobacterium avium subsp. paratuberculosis
gcgggcggggcccgggcc

SEQ ID NO: 967538 - RNA, 17 nt, Mycobacterium avium subsp. paratuberculosis
gcgggcguccacgaaac

SEQ ID NO: 967539 - RNA, 13 nt, Mycobacterium avium subsp. paratuberculosis
gcgggcgucgggc

SEQ ID NO: 967540 - RNA, 20 nt, Mycobacterium avium subsp. paratuberculosis
gcgggcguggcggucggugc

SEQ ID NO: 967541 - RNA, 16 nt, Mycobacterium avium subsp. paratuberculosis
gcgggcgcgcgccgcc

SEQ ID NO: 967542 - RNA, 13 nt, Mycobacterium avium subsp. paratuberculosis
gcgggcgcgcgcc

SEQ ID NO: 967543 - RNA, 14 nt, Mycobacterium avium subsp. paratuberculosis
gcgggcgcgcagcc

SEQ ID NO: 967544 - RNA, 12 nt, Mycobacterium avium subsp. paratuberculosis
gcgggcgccggc

SEQ ID NO: 967545 - RNA, 14 nt, Mycobacterium avium subsp. paratuberculosis
gcgggcgccggucg

SEQ ID NO: 967546 - RNA, 16 nt, Mycobacterium avium subsp. paratuberculosis
gcgggcgccggucggc

SEQ ID NO: 967547 - RNA, 18 nt, Mycobacterium avium subsp. paratuberculosis
gcggcuaguuggccggcu

SEQ ID NO: 967548 - RNA, 20 nt, Mycobacterium avium subsp. paratuberculosis
gcggcucacagcgcggcggu

SEQ ID NO: 967549 - RNA, 18 nt, Mycobacterium avium subsp. paratuberculosis
gcggcucacaugggcgcg

SEQ ID NO: 967550 - RNA, 20 nt, Mycobacterium avium subsp. paratuberculosis
gcggcucagcaacccgccga

SEQ ID NO: 967551 - RNA, 16 nt, Mycobacterium avium subsp. paratuberculosis
gcggcuccagcagcgg

SEQ ID NO: 967552 - RNA, 15 nt, Mycobacterium avium subsp. paratuberculosis
gcggcugcgcguucg

SEQ ID NO: 967553 - RNA, 14 nt, Mycobacterium avium subsp. paratuberculosis
gcggcucgcgggcg

SEQ ID NO: 967554 - RNA, 17 nt, Mycobacterium avium subsp. paratuberculosis
gcggcuguagcacccgg

SEQ ID NO: 967555 - RNA, 14 nt, Mycobacterium avium subsp. paratuberculosis
gcggcuggcccggc

SEQ ID NO: 967556 - RNA, 17 nt, Mycobacterium avium subsp. paratuberculosis
gcggcuggugccgccgg

SEQ ID NO: 967557 - RNA, 18 nt, Mycobacterium avium subsp. paratuberculosis
gcggcuggugccgccggc

SEQ ID NO: 967558 - RNA, 21 nt, Mycobacterium avium subsp. paratuberculosis
gcggcgucgaguucgccgucg

SEQ ID NO: 967559 - RNA, 20 nt, Mycobacterium avium subsp. paratuberculosis
gcggcgucgaccgccccgcc

SEQ ID NO: 967560 - RNA, 22 nt, Mycobacterium avium subsp. paratuberculosis
gcggcgucgaccgccccgccgg

SEQ ID NO: 967561 - RNA, 14 nt, Mycobacterium avium subsp. paratuberculosis
gcggcgucgggaug

SEQ ID NO: 967562 - RNA, 21 nt, Mycobacterium avium subsp. paratuberculosis
gcggcgucggguagggcgccg

SEQ ID NO: 967563 - RNA, 13 nt, Mycobacterium avium subsp. paratuberculosis
gcggcgucggccu

SEQ ID NO: 967564 - RNA, 14 nt, Mycobacterium avium subsp. paratuberculosis
gcggcgucggccug

SEQ ID NO: 967565 - RNA, 16 nt, Mycobacterium avium subsp. paratuberculosis
gcggcgucggccugcc

SEQ ID NO: 967566 - RNA, 16 nt, Mycobacterium avium subsp. paratuberculosis
gcggcgucggcgacgg

SEQ ID NO: 967567 - RNA, 21 nt, Mycobacterium avium subsp. paratuberculosis
gcggcgucguaguugcggccg

SEQ ID NO: 967568 - RNA, 22 nt, Mycobacterium avium subsp. paratuberculosis
gcggcgucgaugucgcccggcg

SEQ ID NO: 967569 - RNA, 21 nt, Mycobacterium avium subsp. paratuberculosis
gcggcguccgcggccgcggcg

SEQ ID NO: 967570 - RNA, 17 nt, Mycobacterium avium subsp. paratuberculosis
gcggcguccucgaccac

SEQ ID NO: 967571 - RNA, 23 nt, Mycobacterium avium subsp. paratuberculosis
gcggcgucaggggugccagccgu

SEQ ID NO: 967572 - RNA, 15 nt, Mycobacterium avium subsp. paratuberculosis
gcggcguccaccagc

SEQ ID NO: 967573 - RNA, 15 nt, Mycobacterium avium subsp. paratuberculosis
gcggcguaggugggc

SEQ ID NO: 967574 - RNA, 16 nt, Mycobacterium avium subsp. paratuberculosis
gcggcguagucgccgg

SEQ ID NO: 967575 - RNA, 16 nt, Mycobacterium avium subsp. paratuberculosis
gcggcguacugcgcga

SEQ ID NO: 967576 - RNA, 16 nt, Mycobacterium avium subsp. paratuberculosis
gcggcguagccgccgg

SEQ ID NO: 967577 - RNA, 16 nt, Mycobacterium avium subsp. paratuberculosis
gcggcguugccgccgg

SEQ ID NO: 967578 - RNA, 18 nt, Mycobacterium avium subsp. paratuberculosis
gcggcguugccgccggcg

SEQ ID NO: 967579 - RNA, 21 nt, Mycobacterium avium subsp. paratuberculosis
gcggcguucagcagcgcgguc

SEQ ID NO: 967580 - RNA, 22 nt, Mycobacterium avium subsp. paratuberculosis
gcggcguucggugcccgggguc

SEQ ID NO: 967581 - RNA, 21 nt, Mycobacterium avium subsp. paratuberculosis
gcggcguucuccagcacccgc

SEQ ID NO: 967582 - RNA, 18 nt, Mycobacterium avium subsp. paratuberculosis
gcggcgugcaccgcccgc

SEQ ID NO: 967583 - RNA, 21 nt, Mycobacterium avium subsp. paratuberculosis
gcggcgugggguucccggccg

SEQ ID NO: 967584 - RNA, 19 nt, Mycobacterium avium subsp. paratuberculosis
gcggcgugguagccgccgu

SEQ ID NO: 967585 - RNA, 19 nt, Mycobacterium avium subsp. paratuberculosis
gcggcguguuguagucaga

SEQ ID NO: 967586 - RNA, 18 nt, Mycobacterium avium subsp. paratuberculosis
gcggcgguuuuggucggc

SEQ ID NO: 967587 - RNA, 20 nt, Mycobacterium avium subsp. paratuberculosis
gcggcgguuuuggucggcac

SEQ ID NO: 967588 - RNA, 17 nt, Mycobacterium avium subsp. paratuberculosis
gcggcggugcgucgggc

SEQ ID NO: 967589 - RNA, 21 nt, Mycobacterium avium subsp. paratuberculosis
gcggcggugcucgcgccgggc

SEQ ID NO: 967590 - RNA, 22 nt, Mycobacterium avium subsp. paratuberculosis
gcggcggugcucgcgccgggcg

SEQ ID NO: 967591 - RNA, 13 nt, Mycobacterium avium subsp. paratuberculosis
gcggcgguggccu

SEQ ID NO: 967592 - RNA, 16 nt, Mycobacterium avium subsp. paratuberculosis
gcggcgguggccugcc

SEQ ID NO: 967593 - RNA, 21 nt, Mycobacterium avium subsp. paratuberculosis
gcggcgguggccugcccggcg

SEQ ID NO: 967594 - RNA, 12 nt, Mycobacterium avium subsp. paratuberculosis
gcggcggugggc

SEQ ID NO: 967595 - RNA, 18 nt, Mycobacterium avium subsp. paratuberculosis
gcggcggugggcugggcg

SEQ ID NO: 967596 - RNA, 22 nt, Mycobacterium avium subsp. paratuberculosis
gcggcggucuucuuggcgggcg

SEQ ID NO: 967597 - RNA, 19 nt, Mycobacterium avium subsp. paratuberculosis
gcggcggucgcgcgccggc

SEQ ID NO: 967598 - RNA, 20 nt, Mycobacterium avium subsp. paratuberculosis
gcggcggucgcgcgccggcg

SEQ ID NO: 967599 - RNA, 24 nt, Mycobacterium avium subsp. paratuberculosis
gcggcggucggcauagcgccgcuc

SEQ ID NO: 967600 - RNA, 13 nt, Mycobacterium avium subsp. paratuberculosis
gcggcgggggcgg

SEQ ID NO: 967601 - RNA, 15 nt, Mycobacterium avium subsp. paratuberculosis
gcggcggggugacgg

SEQ ID NO: 967602 - RNA, 14 nt, Mycobacterium avium subsp. paratuberculosis
gcggcgggcgcguc

SEQ ID NO: 967603 - RNA, 15 nt, Mycobacterium avium subsp. paratuberculosis
gcggcgggggcgggc

SEQ ID NO: 967604 - RNA, 16 nt, Mycobacterium avium subsp. paratuberculosis
gcggcgggggcgggcc

SEQ ID NO: 967605 - RNA, 19 nt, Mycobacterium avium subsp. paratuberculosis
gcggcgggggcgggcccca

SEQ ID NO: 967606 - RNA, 21 nt, Mycobacterium avium subsp. paratuberculosis
gcggcggaggucagcggcccg

SEQ ID NO: 967607 - RNA, 18 nt, Mycobacterium avium subsp. paratuberculosis
gcggcggcaaccagcucc

SEQ ID NO: 967608 - RNA, 22 nt, Mycobacterium avium subsp. paratuberculosis
gcggcgccugcacgcaggccuc

SEQ ID NO: 967609 - RNA, 18 nt, Mycobacterium avium subsp. paratuberculosis
gcggcgccgucgaccagc

SEQ ID NO: 967610 - RNA, 16 nt, Mycobacterium avium subsp. paratuberculosis
gcggcggccggccagc

SEQ ID NO: 967611 - RNA, 12 nt, Mycobacterium avium subsp. paratuberculosis
gcggcgggcccg

SEQ ID NO: 967612 - RNA, 13 nt, Mycobacterium avium subsp. paratuberculosis
gcggcggccgacg

SEQ ID NO: 967613 - RNA, 14 nt, Mycobacterium avium subsp. paratuberculosis
gcggcggccaacgc

SEQ ID NO: 967614 - RNA, 14 nt, Mycobacterium avium subsp. paratuberculosis
gcggcggccgcagc

SEQ ID NO: 967615 - RNA, 13 nt, Mycobacterium avium subsp. paratuberculosis
gcggcggccaggg

SEQ ID NO: 967616 - RNA, 13 nt, Mycobacterium avium subsp. paratuberculosis
gcggcggcccgcc

SEQ ID NO: 967617 - RNA, 15 nt, Mycobacterium avium subsp. paratuberculosis
gcggcggcccgccgc

SEQ ID NO: 967618 - RNA, 17 nt, Mycobacterium avium subsp. paratuberculosis
gcggcggcccgccgcgc

SEQ ID NO: 967619 - RNA, 14 nt, Mycobacterium avium subsp. paratuberculosis
gcggcggcccgcgc

SEQ ID NO: 967620 - RNA, 21 nt, Mycobacterium avium subsp. paratuberculosis
gcggcggcccguccgccccgc

SEQ ID NO: 967621 - RNA, 19 nt, Mycobacterium avium subsp. paratuberculosis
gcggcggccagcgagucga

SEQ ID NO: 967622 - RNA, 21 nt, Mycobacterium avium subsp. paratuberculosis
gcggcggccagcucggcccgc

SEQ ID NO: 967623 - RNA, 13 nt, Mycobacterium avium subsp. paratuberculosis
gcggcggccagga

SEQ ID NO: 967624 - RNA, 15 nt, Mycobacterium avium subsp. paratuberculosis
gcggcggcagucgca

SEQ ID NO: 967625 - RNA, 17 nt, Mycobacterium avium subsp. paratuberculosis
gcggcggcagucgcagc

SEQ ID NO: 967626 - RNA, 14 nt, Mycobacterium avium subsp. paratuberculosis
gcggcgcagccagc

SEQ ID NO: 967627 - RNA, 17 nt, Mycobacterium avium subsp. paratuberculosis
gcggcgcagggcggccg

SEQ ID NO: 967628 - RNA, 18 nt, Mycobacterium avium subsp. paratuberculosis
gcggcgcagggcggccgg

SEQ ID NO: 967629 - RNA, 17 nt, Mycobacterium avium subsp. paratuberculosis
gcggcgcagucggccgg

SEQ ID NO: 967630 - RNA, 14 nt, Mycobacterium avium subsp. paratuberculosis
gcggcgcccacagc

SEQ ID NO: 967631 - RNA, 18 nt, Mycobacterium avium subsp. paratuberculosis
gcggcgcccacagcaggu

SEQ ID NO: 967632 - RNA, 17 nt, Mycobacterium avium subsp. paratuberculosis
gcggcgccaggucgggg

SEQ ID NO: 967633 - RNA, 17 nt, Mycobacterium avium subsp. paratuberculosis
gcggcgccgggcggccc

SEQ ID NO: 967634 - RNA, 17 nt, Mycobacterium avium subsp. paratuberculosis
gcggcgccgggucaccg

SEQ ID NO: 967635 - RNA, 17 nt, Mycobacterium avium subsp. paratuberculosis
gcggcgccggccgggcu

SEQ ID NO: 967636 - RNA, 17 nt, Mycobacterium avium subsp. paratuberculosis
gcggcgccgcggcccug

SEQ ID NO: 967637 - RNA, 14 nt, Mycobacterium avium subsp. paratuberculosis
gcggcgccgcggcg

SEQ ID NO: 967638 - RNA, 13 nt, Mycobacterium avium subsp. paratuberculosis
gcggcgccgcagc

SEQ ID NO: 967639 - RNA, 14 nt, Mycobacterium avium subsp. paratuberculosis
gcggcgccgcagca

SEQ ID NO: 967640 - RNA, 17 nt, Mycobacterium avium subsp. paratuberculosis
gcggcgcccgcggccuc

SEQ ID NO: 967641 - RNA, 13 nt, Mycobacterium avium subsp. paratuberculosis
gcggcgcccggcg

SEQ ID NO: 967642 - RNA, 18 nt, Mycobacterium avium subsp. paratuberculosis
gcggcgcccucgccggcg

SEQ ID NO: 967643 - RNA, 22 nt, Mycobacterium avium subsp. paratuberculosis
gcggcgcccucgccggcggcgc

SEQ ID NO: 967644 - RNA, 13 nt, Mycobacterium avium subsp. paratuberculosis
gcggcgcccugcg

SEQ ID NO: 967645 - RNA, 19 nt, Mycobacterium avium subsp. paratuberculosis
gcggcgcccgacauccagg

SEQ ID NO: 967646 - RNA, 21 nt, Mycobacterium avium subsp. paratuberculosis
gcggcgcccuucccggucggc

SEQ ID NO: 967647 - RNA, 18 nt, Mycobacterium avium subsp. paratuberculosis
gcggcgccgacguccugg

SEQ ID NO: 967648 - RNA, 17 nt, Mycobacterium avium subsp. paratuberculosis
gcggcgcacccgggcag

SEQ ID NO: 967649 - RNA, 16 nt, Mycobacterium avium subsp. paratuberculosis
gcggcgcaccgcccgc

SEQ ID NO: 967650 - RNA, 16 nt, Mycobacterium avium subsp. paratuberculosis
gcggcacggcgagguc

SEQ ID NO: 967651 - RNA, 17 nt, Mycobacterium avium subsp. paratuberculosis
gcggcacgggccguucg

SEQ ID NO: 967652 - RNA, 22 nt, Mycobacterium avium subsp. paratuberculosis
gcggcacgcugcgccagccguc

SEQ ID NO: 967653 - RNA, 17 nt, Mycobacterium avium subsp. paratuberculosis
gcggcacgcgucaccgg

SEQ ID NO: 967654 - RNA, 14 nt, Mycobacterium avium subsp. paratuberculosis
gcggcaccuccagc

SEQ ID NO: 967655 - RNA, 20 nt, Mycobacterium avium subsp. paratuberculosis
gcggcaccuccagcccggcg

SEQ ID NO: 967656 - RNA, 14 nt, Mycobacterium avium subsp. paratuberculosis
gcggcaccgcggcu

SEQ ID NO: 967657 - RNA, 13 nt, Mycobacterium avium subsp. paratuberculosis
gcguauuccagcg

SEQ ID NO: 967658 - RNA, 15 nt, Mycobacterium avium subsp. paratuberculosis
gcguaggguucgccg

SEQ ID NO: 967659 - RNA, 14 nt, Mycobacterium avium subsp. paratuberculosis
gcguagcgccgccc

SEQ ID NO: 967660 - RNA, 13 nt, Mycobacterium avium subsp. paratuberculosis
gcguaggccagga

SEQ ID NO: 967661 - RNA, 15 nt, Mycobacterium avium subsp. paratuberculosis
gcguagcgaggugug

SEQ ID NO: 967662 - RNA, 23 nt, Mycobacterium avium subsp. paratuberculosis
gcggugcaacgccgccgacagca

SEQ ID NO: 967663 - RNA, 17 nt, Mycobacterium avium subsp. paratuberculosis
gcggugcaccgcggcgc

SEQ ID NO: 967664 - RNA, 22 nt, Mycobacterium avium subsp. paratuberculosis
gcggugcaccgcggcgcgcauc

SEQ ID NO: 967665 - RNA, 15 nt, Mycobacterium avium subsp. paratuberculosis
gcggugaugcgcgcc

SEQ ID NO: 967666 - RNA, 20 nt, Mycobacterium avium subsp. paratuberculosis
gcggugaugcgcggcgacgg

SEQ ID NO: 967667 - RNA, 17 nt, Mycobacterium avium subsp. paratuberculosis
gcggugauccgcccggc

SEQ ID NO: 967668 - RNA, 15 nt, Mycobacterium avium subsp. paratuberculosis
gcggugagcagcaug

SEQ ID NO: 967669 - RNA, 22 nt, Mycobacterium avium subsp. paratuberculosis
gcggugagcagcaugccgagca

SEQ ID NO: 967670 - RNA, 17 nt, Mycobacterium avium subsp. paratuberculosis
gcggugagcgcgccggc

SEQ ID NO: 967671 - RNA, 14 nt, Mycobacterium avium subsp. paratuberculosis
gcggugagcgcguc

SEQ ID NO: 967672 - RNA, 16 nt, Mycobacterium avium subsp. paratuberculosis
gcggugcagccgggug

SEQ ID NO: 967673 - RNA, 23 nt, Mycobacterium avium subsp. paratuberculosis
gcggugcagccgggugcggugca

SEQ ID NO: 967674 - RNA, 19 nt, Mycobacterium avium subsp. paratuberculosis
gcggugcagucggucgguc

SEQ ID NO: 967675 - RNA, 13 nt, Mycobacterium avium subsp. paratuberculosis
gcggugcccagcc

SEQ ID NO: 967676 - RNA, 23 nt, Mycobacterium avium subsp. paratuberculosis
gcggugccgaaccggaucuggcc

SEQ ID NO: 967677 - RNA, 17 nt, Mycobacterium avium subsp. paratuberculosis
gcggugccgagcccgcc

SEQ ID NO: 967678 - RNA, 19 nt, Mycobacterium avium subsp. paratuberculosis
gcggugccgagcccgccgg

SEQ ID NO: 967679 - RNA, 14 nt, Mycobacterium avium subsp. paratuberculosis
gcggugccgcagcu

SEQ ID NO: 967680 - RNA, 15 nt, Mycobacterium avium subsp. paratuberculosis
gcggugccgcggcgg

SEQ ID NO: 967681 - RNA, 19 nt, Mycobacterium avium subsp. paratuberculosis
gcgucagggcgacuccggc

SEQ ID NO: 967682 - RNA, 17 nt, Mycobacterium avium subsp. paratuberculosis
gcgucaggucaccgagc

SEQ ID NO: 967683 - RNA, 18 nt, Mycobacterium avium subsp. paratuberculosis
gcgucagcaccgcgacgg

SEQ ID NO: 967684 - RNA, 15 nt, Mycobacterium avium subsp. paratuberculosis
gcgucagcggcgggc

SEQ ID NO: 967685 - RNA, 12 nt, Mycobacterium avium subsp. paratuberculosis
gcgucagcaucg

SEQ ID NO: 967686 - RNA, 17 nt, Mycobacterium avium subsp. paratuberculosis
gcgucaccccaccgagc

SEQ ID NO: 967687 - RNA, 12 nt, Mycobacterium avium subsp. paratuberculosis
gcgucacgccag

SEQ ID NO: 967688 - RNA, 23 nt, Mycobacterium avium subsp. paratuberculosis
gcgucacgccaguguggccgcgg

SEQ ID NO: 967689 - RNA, 16 nt, Mycobacterium avium subsp. paratuberculosis
gcgucacgccgcgccc

SEQ ID NO: 967690 - RNA, 11 nt, Mycobacterium avium subsp. paratuberculosis
gcgucacgcug

SEQ ID NO: 967691 - RNA, 12 nt, Mycobacterium avium subsp. paratuberculosis
gcgucacgcugg

SEQ ID NO: 967692 - RNA, 15 nt, Mycobacterium avium subsp. paratuberculosis
gcgucacgcuggcgu

SEQ ID NO: 967693 - RNA, 17 nt, Mycobacterium avium subsp. paratuberculosis
gcgucacgcuggcguga

SEQ ID NO: 967694 - RNA, 15 nt, Mycobacterium avium subsp. paratuberculosis
gcgucgcacguggug

SEQ ID NO: 967695 - RNA, 20 nt, Mycobacterium avium subsp. paratuberculosis
gcgucgcagaucccgccggc

SEQ ID NO: 967696 - RNA, 23 nt, Mycobacterium avium subsp. paratuberculosis
gcgucgcagaucccgccggcggc

SEQ ID NO: 967697 - RNA, 18 nt, Mycobacterium avium subsp. paratuberculosis
gcgucgaugcgcgccacc

SEQ ID NO: 967698 - RNA, 17 nt, Mycobacterium avium subsp. paratuberculosis
gcgucgaugcgggcccg

SEQ ID NO: 967699 - RNA, 20 nt, Mycobacterium avium subsp. paratuberculosis
gcgucgaugugggccgcagc

SEQ ID NO: 967700 - RNA, 21 nt, Mycobacterium avium subsp. paratuberculosis
gcgucgaugugggccgcagca

SEQ ID NO: 967701 - RNA, 14 nt, Mycobacterium avium subsp. paratuberculosis
gcgucgccagccgc

SEQ ID NO: 967702 - RNA, 14 nt, Mycobacterium avium subsp. paratuberculosis
gcgucgcccgccga

SEQ ID NO: 967703 - RNA, 17 nt, Mycobacterium avium subsp. paratuberculosis
gcgucgcccgccgacgg

SEQ ID NO: 967704 - RNA, 16 nt, Mycobacterium avium subsp. paratuberculosis
gcgucgaucagcgcgc

SEQ ID NO: 967705 - RNA, 13 nt, Mycobacterium avium subsp. paratuberculosis
gcgucgaucgccg

SEQ ID NO: 967706 - RNA, 14 nt, Mycobacterium avium subsp. paratuberculosis
gcgucgacgacggc

SEQ ID NO: 967707 - RNA, 17 nt, Mycobacterium avium subsp. paratuberculosis
gcgucgacgugcgcggc

SEQ ID NO: 967708 - RNA, 23 nt, Mycobacterium avium subsp. paratuberculosis
gcgucgacguucgccgccagcac

SEQ ID NO: 967709 - RNA, 12 nt, Mycobacterium avium subsp. paratuberculosis
gcgucgacgcgc

SEQ ID NO: 967710 - RNA, 16 nt, Mycobacterium avium subsp. paratuberculosis
gcgucgacggcaagca

SEQ ID NO: 967711 - RNA, 15 nt, Mycobacterium avium subsp. paratuberculosis
gcgucgaccagccgc

SEQ ID NO: 967712 - RNA, 17 nt, Mycobacterium avium subsp. paratuberculosis
gcgucgacacccgggcg

SEQ ID NO: 967713 - RNA, 21 nt, Mycobacterium avium subsp. paratuberculosis
gcgucgaccgccccgccggug

SEQ ID NO: 967714 - RNA, 21 nt, Mycobacterium avium subsp. paratuberculosis
gcguccgcgggcggggccugc

SEQ ID NO: 967715 - RNA, 17 nt, Mycobacterium avium subsp. paratuberculosis
gcguccggagaaccgcu

SEQ ID NO: 967716 - RNA, 20 nt, Mycobacterium avium subsp. paratuberculosis
gcguccggaggugccggccg

SEQ ID NO: 967717 - RNA, 20 nt, Mycobacterium avium subsp. paratuberculosis
gcguccggcgcuacgccggc

SEQ ID NO: 967718 - RNA, 15 nt, Mycobacterium avium subsp. paratuberculosis
gcguccggcccggcg

SEQ ID NO: 967719 - RNA, 14 nt, Mycobacterium avium subsp. paratuberculosis
gcguccgggcgcug

SEQ ID NO: 967720 - RNA, 23 nt, Mycobacterium avium subsp. paratuberculosis
gcguccgggcgcugcgcgguggc

SEQ ID NO: 967721 - RNA, 16 nt, Mycobacterium avium subsp. paratuberculosis
gcguccuccucguccg

SEQ ID NO: 967722 - RNA, 23 nt, Mycobacterium avium subsp. paratuberculosis
gcguccuccucguccgcggcggc

SEQ ID NO: 967723 - RNA, 23 nt, Mycobacterium avium subsp. paratuberculosis
gcguccucgaccacccgcugguc

SEQ ID NO: 967724 - RNA, 16 nt, Mycobacterium avium subsp. paratuberculosis
gcgucgaacagccggg

SEQ ID NO: 967725 - RNA, 19 nt, Mycobacterium avium subsp. paratuberculosis
gcgucgaacagccgggccg

SEQ ID NO: 967726 - RNA, 19 nt, Mycobacterium avium subsp. paratuberculosis
gcgucgaacggcgucuggc

SEQ ID NO: 967727 - RNA, 15 nt, Mycobacterium avium subsp. paratuberculosis
gcgucgaacgggccg

SEQ ID NO: 967728 - RNA, 18 nt, Mycobacterium avium subsp. paratuberculosis
gcgucgaacgggccgggc

SEQ ID NO: 967729 - RNA, 21 nt, Mycobacterium avium subsp. paratuberculosis
gcguccuugauccgggcgcca

SEQ ID NO: 967730 - RNA, 16 nt, Mycobacterium avium subsp. paratuberculosis
gcguccuucuccgccg

SEQ ID NO: 967731 - RNA, 20 nt, Mycobacterium avium subsp. paratuberculosis
gcguccuucuccgccgggcu

SEQ ID NO: 967732 - RNA, 15 nt, Mycobacterium avium subsp. paratuberculosis
gcguccugcagcagc

SEQ ID NO: 967733 - RNA, 16 nt, Mycobacterium avium subsp. paratuberculosis
gcgucaucgggcccga

SEQ ID NO: 967734 - RNA, 19 nt, Mycobacterium avium subsp. paratuberculosis
gcgucauuccgccgcgccc

SEQ ID NO: 967735 - RNA, 22 nt, Mycobacterium avium subsp. paratuberculosis
gcguccaaccgcggacuggcca

SEQ ID NO: 967736 - RNA, 19 nt, Mycobacterium avium subsp. paratuberculosis
gcguccaccagcacgccgu

SEQ ID NO: 967737 - RNA, 17 nt, Mycobacterium avium subsp. paratuberculosis
gcguccaggcgcaccgc

SEQ ID NO: 967738 - RNA, 15 nt, Mycobacterium avium subsp. paratuberculosis
gcguccagcgcggug

SEQ ID NO: 967739 - RNA, 13 nt, Mycobacterium avium subsp. paratuberculosis
gcguccagcgagg

SEQ ID NO: 967740 - RNA, 13 nt, Mycobacterium avium subsp. paratuberculosis
gcguccagcagca

SEQ ID NO: 967741 - RNA, 12 nt, Mycobacterium avium subsp. paratuberculosis
gcguccagcaug

SEQ ID NO: 967742 - RNA, 20 nt, Mycobacterium avium subsp. paratuberculosis
gcguccacgaccccggcggc

SEQ ID NO: 967743 - RNA, 19 nt, Mycobacterium avium subsp. paratuberculosis
gcguccagugcaugccggc

SEQ ID NO: 967744 - RNA, 22 nt, Mycobacterium avium subsp. paratuberculosis
gcguccagucgaugucgguggc

SEQ ID NO: 967745 - RNA, 15 nt, Mycobacterium avium subsp. paratuberculosis
gcguccagggccacc

SEQ ID NO: 967746 - RNA, 17 nt, Mycobacterium avium subsp. paratuberculosis
gcguccaggucgcccuc

SEQ ID NO: 967747 - RNA, 22 nt, Mycobacterium avium subsp. paratuberculosis
gcguccauggucgagccgcagu

SEQ ID NO: 967748 - RNA, 18 nt, Mycobacterium avium subsp. paratuberculosis
gcgucccacaucuccuug

SEQ ID NO: 967749 - RNA, 16 nt, Mycobacterium avium subsp. paratuberculosis
gcgucccagugcucga

SEQ ID NO: 967750 - RNA, 14 nt, Mycobacterium avium subsp. paratuberculosis
gcgucccgcgccac

SEQ ID NO: 967751 - RNA, 16 nt, Mycobacterium avium subsp. paratuberculosis
gcguccgagcagcagc

SEQ ID NO: 967752 - RNA, 17 nt, Mycobacterium avium subsp. paratuberculosis
gcguccgagcagcagcc

SEQ ID NO: 967753 - RNA, 17 nt, Mycobacterium avium subsp. paratuberculosis
gcguccgacggcugggu

SEQ ID NO: 967754 - RNA, 21 nt, Mycobacterium avium subsp. paratuberculosis
gcguccgacggcuggguggcg

SEQ ID NO: 967755 - RNA, 17 nt, Mycobacterium avium subsp. paratuberculosis
gcgucccgggccuuggc

SEQ ID NO: 967756 - RNA, 21 nt, Mycobacterium avium subsp. paratuberculosis
gcgucccguccugggccuggc

SEQ ID NO: 967757 - RNA, 14 nt, Mycobacterium avium subsp. paratuberculosis
gcguccgcggcgga

SEQ ID NO: 967758 - RNA, 16 nt, Mycobacterium avium subsp. paratuberculosis
gcguugcagaacgcgc

SEQ ID NO: 967759 - RNA, 13 nt, Mycobacterium avium subsp. paratuberculosis
gcguugcccgccg

SEQ ID NO: 967760 - RNA, 21 nt, Mycobacterium avium subsp. paratuberculosis
gcguuccagguucagcccggc

SEQ ID NO: 967761 - RNA, 16 nt, Mycobacterium avium subsp. paratuberculosis
gcguucccagcccggc

SEQ ID NO: 967762 - RNA, 19 nt, Mycobacterium avium subsp. paratuberculosis
gcguugcgucccgcgccgg

SEQ ID NO: 967763 - RNA, 14 nt, Mycobacterium avium subsp. paratuberculosis
gcguugcgcggcgg

SEQ ID NO: 967764 - RNA, 16 nt, Mycobacterium avium subsp. paratuberculosis
gcguugcgccagcagg

SEQ ID NO: 967765 - RNA, 23 nt, Mycobacterium avium subsp. paratuberculosis
gcguuggcccgugucgcggccuc

SEQ ID NO: 967766 - RNA, 14 nt, Mycobacterium avium subsp. paratuberculosis
gcguuggccgagca

SEQ ID NO: 967767 - RNA, 21 nt, Mycobacterium avium subsp. paratuberculosis
gcguuggcgccgacgucaggg

SEQ ID NO: 967768 - RNA, 12 nt, Mycobacterium avium subsp. paratuberculosis
gcguuggccagc

SEQ ID NO: 967769 - RNA, 18 nt, Mycobacterium avium subsp. paratuberculosis
gcguuggacuccaccgcc

SEQ ID NO: 967770 - RNA, 22 nt, Mycobacterium avium subsp. paratuberculosis
gcguugguugcggccccgccag

SEQ ID NO: 967771 - RNA, 18 nt, Mycobacterium avium subsp. paratuberculosis
gcguguuccuugcggccg

SEQ ID NO: 967772 - RNA, 22 nt, Mycobacterium avium subsp. paratuberculosis
gcguguuccuugcggccgccga

SEQ ID NO: 967773 - RNA, 15 nt, Mycobacterium avium subsp. paratuberculosis
gcguguggcccugcg

SEQ ID NO: 967774 - RNA, 13 nt, Mycobacterium avium subsp. paratuberculosis
gcgugugcccgcc

SEQ ID NO: 967775 - RNA, 17 nt, Mycobacterium avium subsp. paratuberculosis
gcguggcgucggcgcgc

SEQ ID NO: 967776 - RNA, 17 nt, Mycobacterium avium subsp. paratuberculosis
gcguggcgccggcgcgc

SEQ ID NO: 967777 - RNA, 19 nt, Mycobacterium avium subsp. paratuberculosis
gcguggcucggcccgccgg

SEQ ID NO: 967778 - RNA, 18 nt, Mycobacterium avium subsp. paratuberculosis
gcgugggcaccggcaccg

SEQ ID NO: 967779 - RNA, 14 nt, Mycobacterium avium subsp. paratuberculosis
gcguggcgcgcccc

SEQ ID NO: 967780 - RNA, 14 nt, Mycobacterium avium subsp. paratuberculosis
gcguggcgcacagc

SEQ ID NO: 967781 - RNA, 19 nt, Mycobacterium avium subsp. paratuberculosis
gcguggcccagccggugcg

SEQ ID NO: 967782 - RNA, 12 nt, Mycobacterium avium subsp. paratuberculosis
gcguggcaggcg

SEQ ID NO: 967783 - RNA, 19 nt, Mycobacterium avium subsp. paratuberculosis
gcguggcaggcgauggcgu

SEQ ID NO: 967784 - RNA, 16 nt, Mycobacterium avium subsp. paratuberculosis
gcgugcgagccgagca

SEQ ID NO: 967785 - RNA, 18 nt, Mycobacterium avium subsp. paratuberculosis
gcgucguugaacgcgcgg

SEQ ID NO: 967786 - RNA, 16 nt, Mycobacterium avium subsp. paratuberculosis
gcgucguugagugcgc

SEQ ID NO: 967787 - RNA, 22 nt, Mycobacterium avium subsp. paratuberculosis
gcgucguugucgucgccggccg

SEQ ID NO: 967788 - RNA, 17 nt, Mycobacterium avium subsp. paratuberculosis
gcgucguguccgggccc

SEQ ID NO: 967789 - RNA, 18 nt, Mycobacterium avium subsp. paratuberculosis
gcgucguguccgggcccg

SEQ ID NO: 967790 - RNA, 19 nt, Mycobacterium avium subsp. paratuberculosis
gcgucguguccgggcccga

SEQ ID NO: 967791 - RNA, 16 nt, Mycobacterium avium subsp. paratuberculosis
gcgucgugcggccggc

SEQ ID NO: 967792 - RNA, 23 nt, Mycobacterium avium subsp. paratuberculosis
gcgucgugcgggcuccgcacgac

SEQ ID NO: 967793 - RNA, 13 nt, Mycobacterium avium subsp. paratuberculosis
gcgucucgacggc

SEQ ID NO: 967794 - RNA, 19 nt, Mycobacterium avium subsp. paratuberculosis
gcgugacaggggcagcagc

SEQ ID NO: 967795 - RNA, 13 nt, Mycobacterium avium subsp. paratuberculosis
gcgugaccggcug

SEQ ID NO: 967796 - RNA, 15 nt, Mycobacterium avium subsp. paratuberculosis
gcgugaccugcuggg

SEQ ID NO: 967797 - RNA, 20 nt, Mycobacterium avium subsp. paratuberculosis
gcgugaucggugcccgcggg

SEQ ID NO: 967798 - RNA, 18 nt, Mycobacterium avium subsp. paratuberculosis
gcgugaugaccagggccu

SEQ ID NO: 967799 - RNA, 19 nt, Mycobacterium avium subsp. paratuberculosis
gcgugaugacggcggcggu

SEQ ID NO: 967800 - RNA, 20 nt, Mycobacterium avium subsp. paratuberculosis
gcgugccgaucgagaccaug

SEQ ID NO: 967801 - RNA, 16 nt, Mycobacterium avium subsp. paratuberculosis
gcgugccggcgcugcc

SEQ ID NO: 967802 - RNA, 15 nt, Mycobacterium avium subsp. paratuberculosis
gcgugccggcggcgg

SEQ ID NO: 967803 - RNA, 15 nt, Mycobacterium avium subsp. paratuberculosis
gcgugccggacaccg

SEQ ID NO: 967804 - RNA, 19 nt, Mycobacterium avium subsp. paratuberculosis
gcgugccgcgcaccaccuc

SEQ ID NO: 967805 - RNA, 14 nt, Mycobacterium avium subsp. paratuberculosis
gcgugacgcucggc

SEQ ID NO: 967806 - RNA, 23 nt, Mycobacterium avium subsp. paratuberculosis
gcgugacggaugugacgcgggac

SEQ ID NO: 967807 - RNA, 17 nt, Mycobacterium avium subsp. paratuberculosis
gcgugauccggaaugcg

SEQ ID NO: 967808 - RNA, 16 nt, Mycobacterium avium subsp. paratuberculosis
gcgucgcggcgcaccc

SEQ ID NO: 967809 - RNA, 13 nt, Mycobacterium avium subsp. paratuberculosis
gcgucgcggcggc

SEQ ID NO: 967810 - RNA, 14 nt, Mycobacterium avium subsp. paratuberculosis
gcgucgcggcggcg

SEQ ID NO: 967811 - RNA, 15 nt, Mycobacterium avium subsp. paratuberculosis
gcgucgcggcggcgc

SEQ ID NO: 967812 - RNA, 14 nt, Mycobacterium avium subsp. paratuberculosis
gcgucggcaccagc

SEQ ID NO: 967813 - RNA, 16 nt, Mycobacterium avium subsp. paratuberculosis
gcgucgccuuccugcg

SEQ ID NO: 967814 - RNA, 14 nt, Mycobacterium avium subsp. paratuberculosis
gcgucgccgugccg

SEQ ID NO: 967815 - RNA, 16 nt, Mycobacterium avium subsp. paratuberculosis
gcgucgccgccgggcg

SEQ ID NO: 967816 - RNA, 15 nt, Mycobacterium avium subsp. paratuberculosis
gcgucgccgccggug

SEQ ID NO: 967817 - RNA, 13 nt, Mycobacterium avium subsp. paratuberculosis
gcgucgccgacca

SEQ ID NO: 967818 - RNA, 12 nt, Mycobacterium avium subsp. paratuberculosis
gcgucgccgccc

SEQ ID NO: 967819 - RNA, 13 nt, Mycobacterium avium subsp. paratuberculosis
gcgucgccgcccc

SEQ ID NO: 967820 - RNA, 13 nt, Mycobacterium avium subsp. paratuberculosis
gcgucgccgccgg

SEQ ID NO: 967821 - RNA, 20 nt, Mycobacterium avium subsp. paratuberculosis
gcgucgucggucaggccggc

SEQ ID NO: 967822 - RNA, 21 nt, Mycobacterium avium subsp. paratuberculosis
gcgucgucggucaggccggcg

SEQ ID NO: 967823 - RNA, 20 nt, Mycobacterium avium subsp. paratuberculosis
gcgucgucgucgagccgcuc

SEQ ID NO: 967824 - RNA, 15 nt, Mycobacterium avium subsp. paratuberculosis
gcgucgucuuggccu

SEQ ID NO: 967825 - RNA, 17 nt, Mycobacterium avium subsp. paratuberculosis
gcgucgucuuggccugc

SEQ ID NO: 967826 - RNA, 12 nt, Mycobacterium avium subsp. paratuberculosis
gcgucgugaccg

SEQ ID NO: 967827 - RNA, 15 nt, Mycobacterium avium subsp. paratuberculosis
gcgucgugccgagcg

SEQ ID NO: 967828 - RNA, 16 nt, Mycobacterium avium subsp. paratuberculosis
gcgucgugccgagcgu

SEQ ID NO: 967829 - RNA, 16 nt, Mycobacterium avium subsp. paratuberculosis
gcgucggucagcggcg

SEQ ID NO: 967830 - RNA, 14 nt, Mycobacterium avium subsp. paratuberculosis
gcgucgggccgggg

SEQ ID NO: 967831 - RNA, 22 nt, Mycobacterium avium subsp. paratuberculosis
gcgucgggcuugcgcaacagcg

SEQ ID NO: 967832 - RNA, 22 nt, Mycobacterium avium subsp. paratuberculosis
gcgucggugaacucguccaugc

SEQ ID NO: 967833 - RNA, 22 nt, Mycobacterium avium subsp. paratuberculosis
gcgucguacaccucggucgggg

SEQ ID NO: 967834 - RNA, 18 nt, Mycobacterium avium subsp. paratuberculosis
gcgucguacagcagcccc

SEQ ID NO: 967835 - RNA, 18 nt, Mycobacterium avium subsp. paratuberculosis
gcgucguagagcugacgg

SEQ ID NO: 967836 - RNA, 18 nt, Mycobacterium avium subsp. paratuberculosis
gcgucggcguagggcagc

SEQ ID NO: 967837 - RNA, 21 nt, Mycobacterium avium subsp. paratuberculosis
gcgucgggaccgucgcgcagc

SEQ ID NO: 967838 - RNA, 17 nt, Mycobacterium avium subsp. paratuberculosis
gcgucggcggucgccag

SEQ ID NO: 967839 - RNA, 13 nt, Mycobacterium avium subsp. paratuberculosis
gcgucgggcaccu

SEQ ID NO: 967840 - RNA, 19 nt, Mycobacterium avium subsp. paratuberculosis
gcgucggccaccgcgccuu

SEQ ID NO: 967841 - RNA, 13 nt, Mycobacterium avium subsp. paratuberculosis
gcgucggcggccu

SEQ ID NO: 967842 - RNA, 16 nt, Mycobacterium avium subsp. paratuberculosis
gcgucggcggccugcu

SEQ ID NO: 967843 - RNA, 22 nt, Mycobacterium avium subsp. paratuberculosis
gcgucggcggccugcuccagcg

SEQ ID NO: 967844 - RNA, 14 nt, Mycobacterium avium subsp. paratuberculosis
gcgucggcggcggc

SEQ ID NO: 967845 - RNA, 15 nt, Mycobacterium avium subsp. paratuberculosis
gcgucggccgggcug

SEQ ID NO: 967846 - RNA, 23 nt, Mycobacterium avium subsp. paratuberculosis
gcgucggccgggcugcccaccac

SEQ ID NO: 967847 - RNA, 16 nt, Mycobacterium avium subsp. paratuberculosis
gcgucggcgaccgcgc

SEQ ID NO: 967848 - RNA, 14 nt, Mycobacterium avium subsp. paratuberculosis
gcgucggcgacggc

SEQ ID NO: 967849 - RNA, 14 nt, Mycobacterium avium subsp. paratuberculosis
gcgucggcgccccc

SEQ ID NO: 967850 - RNA, 14 nt, Mycobacterium avium subsp. paratuberculosis
gcgucggcgccggc

SEQ ID NO: 967851 - RNA, 21 nt, Mycobacterium avium subsp. paratuberculosis
gcucugguuuuacacaccagc

SEQ ID NO: 967852 - RNA, 21 nt, Mycobacterium avium subsp. paratuberculosis
gcucugccgggccgcauccag

SEQ ID NO: 967853 - RNA, 16 nt, Mycobacterium avium subsp. paratuberculosis
gcucuugcgggcggca

SEQ ID NO: 967854 - RNA, 15 nt, Mycobacterium avium subsp. paratuberculosis
gcucuuggugguggu

SEQ ID NO: 967855 - RNA, 14 nt, Mycobacterium avium subsp. paratuberculosis
gcucuucgauggcc

SEQ ID NO: 967856 - RNA, 21 nt, Mycobacterium avium subsp. paratuberculosis
gcucuucagcgcgacagccaa

SEQ ID NO: 967857 - RNA, 23 nt, Mycobacterium avium subsp. paratuberculosis
gcucuugaaucgguucggccaga

SEQ ID NO: 967858 - RNA, 20 nt, Mycobacterium avium subsp. paratuberculosis
gcucuugacggccgcggcgg

SEQ ID NO: 967859 - RNA, 16 nt, Mycobacterium avium subsp. paratuberculosis
gcucuucucguucugc

SEQ ID NO: 967860 - RNA, 20 nt, Mycobacterium avium subsp. paratuberculosis
gcucuccugcuugaccgugg

SEQ ID NO: 967861 - RNA, 14 nt, Mycobacterium avium subsp. paratuberculosis
gcucguugugcaug

SEQ ID NO: 967862 - RNA, 16 nt, Mycobacterium avium subsp. paratuberculosis
gcucguugagcacaca

SEQ ID NO: 967863 - RNA, 17 nt, Mycobacterium avium subsp. paratuberculosis
gcucgucgugauggcga

SEQ ID NO: 967864 - RNA, 14 nt, Mycobacterium avium subsp. paratuberculosis
gcucgucgugggug

SEQ ID NO: 967865 - RNA, 21 nt, Mycobacterium avium subsp. paratuberculosis
gcucgucguugcgcagcgagu

SEQ ID NO: 967866 - RNA, 18 nt, Mycobacterium avium subsp. paratuberculosis
gcucgugaugguccagca

SEQ ID NO: 967867 - RNA, 22 nt, Mycobacterium avium subsp. paratuberculosis
gcucguaacgccacggcggccg

SEQ ID NO: 967868 - RNA, 13 nt, Mycobacterium avium subsp. paratuberculosis
gcucgccgcgcau

SEQ ID NO: 967869 - RNA, 16 nt, Mycobacterium avium subsp. paratuberculosis
gcucgccgcgcggccc

SEQ ID NO: 967870 - RNA, 14 nt, Mycobacterium avium subsp. paratuberculosis
gcucgccgcggcca

SEQ ID NO: 967871 - RNA, 14 nt, Mycobacterium avium subsp. paratuberculosis
gcucgccggcccga

SEQ ID NO: 967872 - RNA, 17 nt, Mycobacterium avium subsp. paratuberculosis
gcucgccggccgcgggc

SEQ ID NO: 967873 - RNA, 16 nt, Mycobacterium avium subsp. paratuberculosis
gcucgucgacguccuc

SEQ ID NO: 967874 - RNA, 17 nt, Mycobacterium avium subsp. paratuberculosis
gcucgucagcgcgggcc

SEQ ID NO: 967875 - RNA, 21 nt, Mycobacterium avium subsp. paratuberculosis
gcucgucgcggaacagccggc

SEQ ID NO: 967876 - RNA, 23 nt, Mycobacterium avium subsp. paratuberculosis
gcucgucgcggaacagccggcuc

SEQ ID NO: 967877 - RNA, 16 nt, Mycobacterium avium subsp. paratuberculosis
gcucgucggcgaacag

SEQ ID NO: 967878 - RNA, 21 nt, Mycobacterium avium subsp. paratuberculosis
gcucgucggcgcgggccagca

SEQ ID NO: 967879 - RNA, 15 nt, Mycobacterium avium subsp. paratuberculosis
gcugaacgccagcag

SEQ ID NO: 967880 - RNA, 16 nt, Mycobacterium avium subsp. paratuberculosis
gcugaacgccagcagc

SEQ ID NO: 967881 - RNA, 18 nt, Mycobacterium avium subsp. paratuberculosis
gcugaagaucaacagccg

SEQ ID NO: 967882 - RNA, 14 nt, Mycobacterium avium subsp. paratuberculosis
gcugaagaucgaaa

SEQ ID NO: 967883 - RNA, 18 nt, Mycobacterium avium subsp. paratuberculosis
gcugaagcccaccgccgu

SEQ ID NO: 967884 - RNA, 17 nt, Mycobacterium avium subsp. paratuberculosis
gcugaagccgaacgcgc

SEQ ID NO: 967885 - RNA, 13 nt, Mycobacterium avium subsp. paratuberculosis
gcugaacagcagc

SEQ ID NO: 967886 - RNA, 13 nt, Mycobacterium avium subsp. paratuberculosis
gcugaacagcgcg

SEQ ID NO: 967887 - RNA, 15 nt, Mycobacterium avium subsp. paratuberculosis
gcugaacagcgcgcc

SEQ ID NO: 967888 - RNA, 22 nt, Mycobacterium avium subsp. paratuberculosis
gcugaacacgaacccggcggcc

SEQ ID NO: 967889 - RNA, 20 nt, Mycobacterium avium subsp. paratuberculosis
gcugaaucccuccggcaggc

SEQ ID NO: 967890 - RNA, 15 nt, Mycobacterium avium subsp. paratuberculosis
gcugacccgcccggg

SEQ ID NO: 967891 - RNA, 14 nt, Mycobacterium avium subsp. paratuberculosis
gcugaccgccagga

SEQ ID NO: 967892 - RNA, 13 nt, Mycobacterium avium subsp. paratuberculosis
gcugaccgccauu

SEQ ID NO: 967893 - RNA, 18 nt, Mycobacterium avium subsp. paratuberculosis
gcugaccaggaagaugcc

SEQ ID NO: 967894 - RNA, 16 nt, Mycobacterium avium subsp. paratuberculosis
gcugacgcgaccgcgc

SEQ ID NO: 967895 - RNA, 15 nt, Mycobacterium avium subsp. paratuberculosis
gcugacgauggcgac

SEQ ID NO: 967896 - RNA, 18 nt, Mycobacterium avium subsp. paratuberculosis
gcugaccugugcgcccca

SEQ ID NO: 967897 - RNA, 20 nt, Mycobacterium avium subsp. paratuberculosis
gcugaccugugcgccccacg

SEQ ID NO: 967898 - RNA, 22 nt, Mycobacterium avium subsp. paratuberculosis
gcugaccuucuuggucagcggc

SEQ ID NO: 967899 - RNA, 16 nt, Mycobacterium avium subsp. paratuberculosis
gcugaccggccaccuc

SEQ ID NO: 967900 - RNA, 21 nt, Mycobacterium avium subsp. paratuberculosis
gcugacccgggcggccugcug

SEQ ID NO: 967901 - RNA, 23 nt, Mycobacterium avium subsp. paratuberculosis
gcugaguucggugaacugcagcc

SEQ ID NO: 967902 - RNA, 20 nt, Mycobacterium avium subsp. paratuberculosis
gcugagucuacuuggccagc

SEQ ID NO: 967903 - RNA, 21 nt, Mycobacterium avium subsp. paratuberculosis
gcugagucuacuuggccagcu

SEQ ID NO: 967904 - RNA, 22 nt, Mycobacterium avium subsp. paratuberculosis
gcugagucuacuuggccagcug

SEQ ID NO: 967905 - RNA, 18 nt, Mycobacterium avium subsp. paratuberculosis
gcugaucagccggcgagc

SEQ ID NO: 967906 - RNA, 13 nt, Mycobacterium avium subsp. paratuberculosis
gcugaucaugaag

SEQ ID NO: 967907 - RNA, 22 nt, Mycobacterium avium subsp. paratuberculosis
gcugaugccgccgaagcggcgc

SEQ ID NO: 967908 - RNA, 19 nt, Mycobacterium avium subsp. paratuberculosis
gcugauccagcagcgccuc

SEQ ID NO: 967909 - RNA, 16 nt, Mycobacterium avium subsp. paratuberculosis
gcugauccccagcggc

SEQ ID NO: 967910 - RNA, 17 nt, Mycobacterium avium subsp. paratuberculosis
gcugaucgcggccggcg

SEQ ID NO: 967911 - RNA, 16 nt, Mycobacterium avium subsp. paratuberculosis
gcugaugcggccggaa

SEQ ID NO: 967912 - RNA, 18 nt, Mycobacterium avium subsp. paratuberculosis
gcugaucugcggcaccac

SEQ ID NO: 967913 - RNA, 18 nt, Mycobacterium avium subsp. paratuberculosis
gcugaggaugguggugca

SEQ ID NO: 967914 - RNA, 19 nt, Mycobacterium avium subsp. paratuberculosis
gcugagcggguaaccgcag

SEQ ID NO: 967915 - RNA, 14 nt, Mycobacterium avium subsp. paratuberculosis
gcugagcgccaggc

SEQ ID NO: 967916 - RNA, 15 nt, Mycobacterium avium subsp. paratuberculosis
gcugagccgccgagc

SEQ ID NO: 967917 - RNA, 16 nt, Mycobacterium avium subsp. paratuberculosis
gcugagccggcccugc

SEQ ID NO: 967918 - RNA, 20 nt, Mycobacterium avium subsp. paratuberculosis
gcugagccggcccugcggcc

SEQ ID NO: 967919 - RNA, 18 nt, Mycobacterium avium subsp. paratuberculosis
gcugagcagcacccgacu

SEQ ID NO: 967920 - RNA, 17 nt, Mycobacterium avium subsp. paratuberculosis
gcugagcacccgcccgg

SEQ ID NO: 967921 - RNA, 22 nt, Mycobacterium avium subsp. paratuberculosis
gcugacgucgaugccggccagc

SEQ ID NO: 967922 - RNA, 15 nt, Mycobacterium avium subsp. paratuberculosis
gcugacgggccggcg

SEQ ID NO: 967923 - RNA, 17 nt, Mycobacterium avium subsp. paratuberculosis
gcucagcucccgagcau

SEQ ID NO: 967924 - RNA, 13 nt, Mycobacterium avium subsp. paratuberculosis
gcucagcgcggcc

SEQ ID NO: 967925 - RNA, 16 nt, Mycobacterium avium subsp. paratuberculosis
gcucagcgcggcgggc

SEQ ID NO: 967926 - RNA, 11 nt, Mycobacterium avium subsp. paratuberculosis
gcucagcggca

SEQ ID NO: 967927 - RNA, 22 nt, Mycobacterium avium subsp. paratuberculosis
gcucagcggccaucgccgccau

SEQ ID NO: 967928 - RNA, 15 nt, Mycobacterium avium subsp. paratuberculosis
gcucagcgggcggcc

SEQ ID NO: 967929 - RNA, 17 nt, Mycobacterium avium subsp. paratuberculosis
gcucagcgggcggccag

SEQ ID NO: 967930 - RNA, 21 nt, Mycobacterium avium subsp. paratuberculosis
gcucagcgggcggccagccgc

SEQ ID NO: 967931 - RNA, 21 nt, Mycobacterium avium subsp. paratuberculosis
gcucagcgcaccgccgucggg

SEQ ID NO: 967932 - RNA, 17 nt, Mycobacterium avium subsp. paratuberculosis
gcucagccuagccuugg

SEQ ID NO: 967933 - RNA, 16 nt, Mycobacterium avium subsp. paratuberculosis
gcucagcccggcgcuc

SEQ ID NO: 967934 - RNA, 15 nt, Mycobacterium avium subsp. paratuberculosis
gcucagccgcacgga

SEQ ID NO: 967935 - RNA, 23 nt, Mycobacterium avium subsp. paratuberculosis
gcucacguagucgaccgggaucg

SEQ ID NO: 967936 - RNA, 13 nt, Mycobacterium avium subsp. paratuberculosis
gcuccacagcagu

SEQ ID NO: 967937 - RNA, 18 nt, Mycobacterium avium subsp. paratuberculosis
gcucaugcccgccacggc

SEQ ID NO: 967938 - RNA, 20 nt, Mycobacterium avium subsp. paratuberculosis
gcucaugucguacgggcgca

SEQ ID NO: 967939 - RNA, 19 nt, Mycobacterium avium subsp. paratuberculosis
gcucaugugauuacuccuc

SEQ ID NO: 967940 - RNA, 21 nt, Mycobacterium avium subsp. paratuberculosis
gcucaugugauuacuccucgc

SEQ ID NO: 967941 - RNA, 17 nt, Mycobacterium avium subsp. paratuberculosis
gcucaugagcccuccag

SEQ ID NO: 967942 - RNA, 12 nt, Mycobacterium avium subsp. paratuberculosis
gcucccaguccc

SEQ ID NO: 967943 - RNA, 18 nt, Mycobacterium avium subsp. paratuberculosis
gcucccaggacgcgguga

SEQ ID NO: 967944 - RNA, 16 nt, Mycobacterium avium subsp. paratuberculosis
gcuccaccgaaaagcc

SEQ ID NO: 967945 - RNA, 22 nt, Mycobacterium avium subsp. paratuberculosis
gcuccaccgaaaagcccgccgc

SEQ ID NO: 967946 - RNA, 16 nt, Mycobacterium avium subsp. paratuberculosis
gcuccaccgcgccggc

SEQ ID NO: 967947 - RNA, 15 nt, Mycobacterium avium subsp. paratuberculosis
gcuccacaucugccg

SEQ ID NO: 967948 - RNA, 18 nt, Mycobacterium avium subsp. paratuberculosis
gcuccagcggguccagcc

SEQ ID NO: 967949 - RNA, 20 nt, Mycobacterium avium subsp. paratuberculosis
gcuccagcggguccagccgc

SEQ ID NO: 967950 - RNA, 22 nt, Mycobacterium avium subsp. paratuberculosis
gcuccagcggguccagccgccg

SEQ ID NO: 967951 - RNA, 23 nt, Mycobacterium avium subsp. paratuberculosis
gcuccagcggguccagccgccgg

SEQ ID NO: 967952 - RNA, 13 nt, Mycobacterium avium subsp. paratuberculosis
gcucgacggccug

SEQ ID NO: 967953 - RNA, 23 nt, Mycobacterium avium subsp. paratuberculosis
gcucgacguagucgcgcaccauc

SEQ ID NO: 967954 - RNA, 18 nt, Mycobacterium avium subsp. paratuberculosis
gcuccuugcgccgcaaca

SEQ ID NO: 967955 - RNA, 16 nt, Mycobacterium avium subsp. paratuberculosis
gcucgagccccaguuc

SEQ ID NO: 967956 - RNA, 16 nt, Mycobacterium avium subsp. paratuberculosis
gcucgagcaacaccac

SEQ ID NO: 967957 - RNA, 21 nt, Mycobacterium avium subsp. paratuberculosis
gcuccuugagccgccgcggca

SEQ ID NO: 967958 - RNA, 15 nt, Mycobacterium avium subsp. paratuberculosis
gcuccuggccggacg

SEQ ID NO: 967959 - RNA, 19 nt, Mycobacterium avium subsp. paratuberculosis
gcucgcccagcgcggcggc

SEQ ID NO: 967960 - RNA, 20 nt, Mycobacterium avium subsp. paratuberculosis
gcucgcccagcgcggcggcc

SEQ ID NO: 967961 - RNA, 19 nt, Mycobacterium avium subsp. paratuberculosis
gcucgagggcggcgaccug

SEQ ID NO: 967962 - RNA, 17 nt, Mycobacterium avium subsp. paratuberculosis
gcucgagugccggcagc

SEQ ID NO: 967963 - RNA, 15 nt, Mycobacterium avium subsp. paratuberculosis
gcucgaucagcgacu

SEQ ID NO: 967964 - RNA, 15 nt, Mycobacterium avium subsp. paratuberculosis
gcucgaucgccgcgc

SEQ ID NO: 967965 - RNA, 15 nt, Mycobacterium avium subsp. paratuberculosis
gcucgaucggcgcgc

SEQ ID NO: 967966 - RNA, 16 nt, Mycobacterium avium subsp. paratuberculosis
gcucgaucggcgcgcc

SEQ ID NO: 967967 - RNA, 16 nt, Mycobacterium avium subsp. paratuberculosis
gcucgaucgucaggaa

SEQ ID NO: 967968 - RNA, 17 nt, Mycobacterium avium subsp. paratuberculosis
gcucgaucgucaggaau

SEQ ID NO: 967969 - RNA, 23 nt, Mycobacterium avium subsp. paratuberculosis
gcucccccgacaccgccagcagc

SEQ ID NO: 967970 - RNA, 22 nt, Mycobacterium avium subsp. paratuberculosis
gcucccgauggcucgcgggggc

SEQ ID NO: 967971 - RNA, 23 nt, Mycobacterium avium subsp. paratuberculosis
gcucccgauggcucgcgggggcc

SEQ ID NO: 967972 - RNA, 23 nt, Mycobacterium avium subsp. paratuberculosis
gcucccgcagcggggcgcugucc

SEQ ID NO: 967973 - RNA, 14 nt, Mycobacterium avium subsp. paratuberculosis
gcucccggcgcagc

SEQ ID NO: 967974 - RNA, 14 nt, Mycobacterium avium subsp. paratuberculosis
gcucccgggcggcg

SEQ ID NO: 967975 - RNA, 14 nt, Mycobacterium avium subsp. paratuberculosis
gcuccgcggccagc

SEQ ID NO: 967976 - RNA, 20 nt, Mycobacterium avium subsp. paratuberculosis
gcuccggcaacgaggccagg

SEQ ID NO: 967977 - RNA, 23 nt, Mycobacterium avium subsp. paratuberculosis
gcuccggcaacgaggccagggcc

SEQ ID NO: 967978 - RNA, 14 nt, Mycobacterium avium subsp. paratuberculosis
gcuccgcggcgggc

SEQ ID NO: 967979 - RNA, 14 nt, Mycobacterium avium subsp. paratuberculosis
gcuccgcgggcagc

SEQ ID NO: 967980 - RNA, 13 nt, Mycobacterium avium subsp. paratuberculosis
gcuccggccgcgc

SEQ ID NO: 967981 - RNA, 21 nt, Mycobacterium avium subsp. paratuberculosis
gcuccggcggacccagcuccu

SEQ ID NO: 967982 - RNA, 23 nt, Mycobacterium avium subsp. paratuberculosis
gcuccugcaggccgagccgccgg

SEQ ID NO: 967983 - RNA, 15 nt, Mycobacterium avium subsp. paratuberculosis
gcuccugccagcggc

SEQ ID NO: 967984 - RNA, 20 nt, Mycobacterium avium subsp. paratuberculosis
gcuccugccagcggcgcaac

SEQ ID NO: 967985 - RNA, 15 nt, Mycobacterium avium subsp. paratuberculosis
gcucaacagcauugg

SEQ ID NO: 967986 - RNA, 23 nt, Mycobacterium avium subsp. paratuberculosis
gcucaccucgcuggaaaccucuu

SEQ ID NO: 967987 - RNA, 15 nt, Mycobacterium avium subsp. paratuberculosis
gcucaccugcggccc

SEQ ID NO: 967988 - RNA, 21 nt, Mycobacterium avium subsp. paratuberculosis
gcuauucgggccugaccaagg

SEQ ID NO: 967989 - RNA, 14 nt, Mycobacterium avium subsp. paratuberculosis
gcuagcgugacagu

SEQ ID NO: 967990 - RNA, 14 nt, Mycobacterium avium subsp. paratuberculosis
gcuaucgcccggcg

SEQ ID NO: 967991 - RNA, 19 nt, Mycobacterium avium subsp. paratuberculosis
gcgcaucguugccggcggc

SEQ ID NO: 967992 - RNA, 21 nt, Mycobacterium avium subsp. paratuberculosis
gcgcaucguugccggcggcga

SEQ ID NO: 967993 - RNA, 15 nt, Mycobacterium avium subsp. paratuberculosis
gcgcaucugcucggc

SEQ ID NO: 967994 - RNA, 18 nt, Mycobacterium avium subsp. paratuberculosis
gcgcaucgccucggcggc

SEQ ID NO: 967995 - RNA, 19 nt, Mycobacterium avium subsp. paratuberculosis
gcgcaucgacugcgacacc

SEQ ID NO: 967996 - RNA, 13 nt, Mycobacterium avium subsp. paratuberculosis
gcgcaucgccggc

SEQ ID NO: 967997 - RNA, 18 nt, Mycobacterium avium subsp. paratuberculosis
gcgcaucgccggcgcgcu

SEQ ID NO: 967998 - RNA, 19 nt, Mycobacterium avium subsp. paratuberculosis
gcgcaucgccggcgcgcug

SEQ ID NO: 967999 - RNA, 21 nt, Mycobacterium avium subsp. paratuberculosis
gcgcaugaccgauccgccggc

SEQ ID NO: 968000 - RNA, 15 nt, Mycobacterium avium subsp. paratuberculosis
gcgccaccagcuccu

SEQ ID NO: 968001 - RNA, 18 nt, Mycobacterium avium subsp. paratuberculosis
gcgccaccgacaccaccg

SEQ ID NO: 968002 - RNA, 22 nt, Mycobacterium avium subsp. paratuberculosis
gcgccaccgacaccaccggccg

SEQ ID NO: 968003 - RNA, 20 nt, Mycobacterium avium subsp. paratuberculosis
gcgccaccgaggccagcaga

SEQ ID NO: 968004 - RNA, 20 nt, Mycobacterium avium subsp. paratuberculosis
gcgccaccgcggggcugggc

SEQ ID NO: 968005 - RNA, 24 nt, Mycobacterium avium subsp. paratuberculosis
gcgccacagccggggaucgcgcag

SEQ ID NO: 968006 - RNA, 17 nt, Mycobacterium avium subsp. paratuberculosis
gcgccacaucagcucgg

SEQ ID NO: 968007 - RNA, 22 nt, Mycobacterium avium subsp. paratuberculosis
gcgccacaucagcucggcggcc

SEQ ID NO: 968008 - RNA, 22 nt, Mycobacterium avium subsp. paratuberculosis
gcgccaacugaauuccuggccg

SEQ ID NO: 968009 - RNA, 13 nt, Mycobacterium avium subsp. paratuberculosis
gcgccaggccaug

SEQ ID NO: 968010 - RNA, 15 nt, Mycobacterium avium subsp. paratuberculosis
gcgccaggccauggc

SEQ ID NO: 968011 - RNA, 16 nt, Mycobacterium avium subsp. paratuberculosis
gcgccaggcaggcggc

SEQ ID NO: 968012 - RNA, 17 nt, Mycobacterium avium subsp. paratuberculosis
gcgccaggauccgcccg

SEQ ID NO: 968013 - RNA, 16 nt, Mycobacterium avium subsp. paratuberculosis
gcgccaguugcucggg

SEQ ID NO: 968014 - RNA, 14 nt, Mycobacterium avium subsp. paratuberculosis
gcgccauccgcagc

SEQ ID NO: 968015 - RNA, 21 nt, Mycobacterium avium subsp. paratuberculosis
gcgccaucuucacgugcgcgg

SEQ ID NO: 968016 - RNA, 23 nt, Mycobacterium avium subsp. paratuberculosis
gcgccaugaacggcggggccucc

SEQ ID NO: 968017 - RNA, 21 nt, Mycobacterium avium subsp. paratuberculosis
gcgccaugaacuccgacucca

SEQ ID NO: 968018 - RNA, 13 nt, Mycobacterium avium subsp. paratuberculosis
gcgccagcacggc

SEQ ID NO: 968019 - RNA, 14 nt, Mycobacterium avium subsp. paratuberculosis
gcgccagcccgccc

SEQ ID NO: 968020 - RNA, 19 nt, Mycobacterium avium subsp. paratuberculosis
gcgccagcccgcccagcgc

SEQ ID NO: 968021 - RNA, 19 nt, Mycobacterium avium subsp. paratuberculosis
gcgccagcucggcggccgg

SEQ ID NO: 968022 - RNA, 16 nt, Mycobacterium avium subsp. paratuberculosis
gcgccagcucggcggc

SEQ ID NO: 968023 - RNA, 15 nt, Mycobacterium avium subsp. paratuberculosis
gcgccagcugggugg

SEQ ID NO: 968024 - RNA, 17 nt, Mycobacterium avium subsp. paratuberculosis
gcgccagcugggugguc

SEQ ID NO: 968025 - RNA, 15 nt, Mycobacterium avium subsp. paratuberculosis
gcgccagcuccagca

SEQ ID NO: 968026 - RNA, 17 nt, Mycobacterium avium subsp. paratuberculosis
gcgccagcuccagcagc

SEQ ID NO: 968027 - RNA, 13 nt, Mycobacterium avium subsp. paratuberculosis
gcgccacgcuggc

SEQ ID NO: 968028 - RNA, 21 nt, Mycobacterium avium subsp. paratuberculosis
gcgccacggguugagccagac

SEQ ID NO: 968029 - RNA, 13 nt, Mycobacterium avium subsp. paratuberculosis
gcgccacgguggc

SEQ ID NO: 968030 - RNA, 20 nt, Mycobacterium avium subsp. paratuberculosis
gcgccacgcucaugcccgcc

SEQ ID NO: 968031 - RNA, 17 nt, Mycobacterium avium subsp. paratuberculosis
gcgccacgcccgcagcg

SEQ ID NO: 968032 - RNA, 16 nt, Mycobacterium avium subsp. paratuberculosis
gcgccacgcgcagggc

SEQ ID NO: 968033 - RNA, 11 nt, Mycobacterium avium subsp. paratuberculosis
gcgccagcagc

SEQ ID NO: 968034 - RNA, 12 nt, Mycobacterium avium subsp. paratuberculosis
gcgccagcagca

SEQ ID NO: 968035 - RNA, 24 nt, Mycobacterium avium subsp. paratuberculosis
gcgccagcagcagcgcggcauggc

SEQ ID NO: 968036 - RNA, 17 nt, Mycobacterium avium subsp. paratuberculosis
gcgccagcaccgggccc

SEQ ID NO: 968037 - RNA, 19 nt, Mycobacterium avium subsp. paratuberculosis
gcgccaccggcuggccgga

SEQ ID NO: 968038 - RNA, 17 nt, Mycobacterium avium subsp. paratuberculosis
gcgccacgacauccccg

SEQ ID NO: 968039 - RNA, 19 nt, Mycobacterium avium subsp. paratuberculosis
gcgccacgaccagcggcag

SEQ ID NO: 968040 - RNA, 21 nt, Mycobacterium avium subsp. paratuberculosis
gcgccacgaccagcggcagca

SEQ ID NO: 968041 - RNA, 18 nt, Mycobacterium avium subsp. paratuberculosis
gcgccacgacugcgcggc

SEQ ID NO: 968042 - RNA, 15 nt, Mycobacterium avium subsp. paratuberculosis
gcgccaccagcaccg

SEQ ID NO: 968043 - RNA, 14 nt, Mycobacterium avium subsp. paratuberculosis
gcgcagacccggug

SEQ ID NO: 968044 - RNA, 21 nt, Mycobacterium avium subsp. paratuberculosis
gcgcagacccgguggccgagg

SEQ ID NO: 968045 - RNA, 22 nt, Mycobacterium avium subsp. paratuberculosis
gcgcagaacaccaccgccaggu

SEQ ID NO: 968046 - RNA, 15 nt, Mycobacterium avium subsp. paratuberculosis
gcgcagaaccgcacc

SEQ ID NO: 968047 - RNA, 20 nt, Mycobacterium avium subsp. paratuberculosis
gcgcagaaaaaggccgccgc

SEQ ID NO: 968048 - RNA, 20 nt, Mycobacterium avium subsp. paratuberculosis
gcgcacuucgcgggcggcgc

SEQ ID NO: 968049 - RNA, 16 nt, Mycobacterium avium subsp. paratuberculosis
gcgcaccgugccgccc

SEQ ID NO: 968050 - RNA, 16 nt, Mycobacterium avium subsp. paratuberculosis
gcgcaccugcggcccc

SEQ ID NO: 968051 - RNA, 18 nt, Mycobacterium avium subsp. paratuberculosis
gcgcaccugcggccccug

SEQ ID NO: 968052 - RNA, 15 nt, Mycobacterium avium subsp. paratuberculosis
gcgcaccuucccggc

SEQ ID NO: 968053 - RNA, 15 nt, Mycobacterium avium subsp. paratuberculosis
gcgcacgaucgggcg

SEQ ID NO: 968054 - RNA, 19 nt, Mycobacterium avium subsp. paratuberculosis
gcgcacgaucugcaggccg

SEQ ID NO: 968055 - RNA, 24 nt, Mycobacterium avium subsp. paratuberculosis
gcgcacgaucugcaggccgaggcu

SEQ ID NO: 968056 - RNA, 15 nt, Mycobacterium avium subsp. paratuberculosis
gcgcaccgccagcac

SEQ ID NO: 968057 - RNA, 16 nt, Mycobacterium avium subsp. paratuberculosis
gcgcaccgccagcacc

SEQ ID NO: 968058 - RNA, 13 nt, Mycobacterium avium subsp. paratuberculosis
gcgcaccgcccaa

SEQ ID NO: 968059 - RNA, 15 nt, Mycobacterium avium subsp. paratuberculosis
gcgcaccgccccgcc

SEQ ID NO: 968060 - RNA, 15 nt, Mycobacterium avium subsp. paratuberculosis
gcgcaccgcccgcgg

SEQ ID NO: 968061 - RNA, 23 nt, Mycobacterium avium subsp. paratuberculosis
gcgcaccgccgucggggcgucgg

SEQ ID NO: 968062 - RNA, 12 nt, Mycobacterium avium subsp. paratuberculosis
gcgcaccgcgcg

SEQ ID NO: 968063 - RNA, 14 nt, Mycobacterium avium subsp. paratuberculosis
gcgcaccgcgcgcc

SEQ ID NO: 968064 - RNA, 15 nt, Mycobacterium avium subsp. paratuberculosis
gcgcacccggccacg

SEQ ID NO: 968065 - RNA, 16 nt, Mycobacterium avium subsp. paratuberculosis
gcgcacccgguccggc

SEQ ID NO: 968066 - RNA, 20 nt, Mycobacterium avium subsp. paratuberculosis
gcgcacccgguccggcuggu

SEQ ID NO: 968067 - RNA, 22 nt, Mycobacterium avium subsp. paratuberculosis
gcgcaccgguuugucggcgccc

SEQ ID NO: 968068 - RNA, 23 nt, Mycobacterium avium subsp. paratuberculosis
gcgcaccgguuugucggcgcccu

SEQ ID NO: 968069 - RNA, 14 nt, Mycobacterium avium subsp. paratuberculosis
gcgcaccgggacgg

SEQ ID NO: 968070 - RNA, 14 nt, Mycobacterium avium subsp. paratuberculosis
gcgcaccgggcccg

SEQ ID NO: 968071 - RNA, 17 nt, Mycobacterium avium subsp. paratuberculosis
gcgcaccgccugugcga

SEQ ID NO: 968072 - RNA, 16 nt, Mycobacterium avium subsp. paratuberculosis
gcgcaccgcggcgugc

SEQ ID NO: 968073 - RNA, 12 nt, Mycobacterium avium subsp. paratuberculosis
gcgcacccccgg

SEQ ID NO: 968074 - RNA, 17 nt, Mycobacterium avium subsp. paratuberculosis
gcgcaccccgaaccagu

SEQ ID NO: 968075 - RNA, 22 nt, Mycobacterium avium subsp. paratuberculosis
gcgcaccccgaaccgcccgccc

SEQ ID NO: 968076 - RNA, 19 nt, Mycobacterium avium subsp. paratuberculosis
gcgcaccccguugccgccg

SEQ ID NO: 968077 - RNA, 21 nt, Mycobacterium avium subsp. paratuberculosis
gcgcacccgcacgugcgcgcc

SEQ ID NO: 968078 - RNA, 22 nt, Mycobacterium avium subsp. paratuberculosis
gcgcacccgcacgugcgcgccg

SEQ ID NO: 968079 - RNA, 13 nt, Mycobacterium avium subsp. paratuberculosis
gcgcacccgcggg

SEQ ID NO: 968080 - RNA, 12 nt, Mycobacterium avium subsp. paratuberculosis
gcgcacccgcgg

SEQ ID NO: 968081 - RNA, 17 nt, Mycobacterium avium subsp. paratuberculosis
gcgcaccaucaccugua

SEQ ID NO: 968082 - RNA, 19 nt, Mycobacterium avium subsp. paratuberculosis
gcgcaccagggccgcgagc

SEQ ID NO: 968083 - RNA, 22 nt, Mycobacterium avium subsp. paratuberculosis
gcgcaccaggccgacgcuggcc

SEQ ID NO: 968084 - RNA, 22 nt, Mycobacterium avium subsp. paratuberculosis
gcgcaccagcucgaggccgcgg

SEQ ID NO: 968085 - RNA, 13 nt, Mycobacterium avium subsp. paratuberculosis
gcgcaccaccucu

SEQ ID NO: 968086 - RNA, 17 nt, Mycobacterium avium subsp. paratuberculosis
gcgcaccacgucggguu

SEQ ID NO: 968087 - RNA, 16 nt, Mycobacterium avium subsp. paratuberculosis
gcgcacagcuuucggg

SEQ ID NO: 968088 - RNA, 20 nt, Mycobacterium avium subsp. paratuberculosis
gcgcacagcuuucgggcggc

SEQ ID NO: 968089 - RNA, 16 nt, Mycobacterium avium subsp. paratuberculosis
gcgcacaacagccaug

SEQ ID NO: 968090 - RNA, 15 nt, Mycobacterium avium subsp. paratuberculosis
gcgcacacagcagca

SEQ ID NO: 968091 - RNA, 16 nt, Mycobacterium avium subsp. paratuberculosis
gcgcaacucguccacc

SEQ ID NO: 968092 - RNA, 21 nt, Mycobacterium avium subsp. paratuberculosis
gcgcaacucguccaccagcuc

SEQ ID NO: 968093 - RNA, 18 nt, Mycobacterium avium subsp. paratuberculosis
gcgaugcgcuccagcagg

SEQ ID NO: 968094 - RNA, 15 nt, Mycobacterium avium subsp. paratuberculosis
gcgaugcggcccggc

SEQ ID NO: 968095 - RNA, 16 nt, Mycobacterium avium subsp. paratuberculosis
gcgaugcggcucacca

SEQ ID NO: 968096 - RNA, 19 nt, Mycobacterium avium subsp. paratuberculosis
gcgcaacuggguggucaca

SEQ ID NO: 968097 - RNA, 16 nt, Mycobacterium avium subsp. paratuberculosis
gcgcagguacgcggcg

SEQ ID NO: 968098 - RNA, 16 nt, Mycobacterium avium subsp. paratuberculosis
gcgcagguagccgccg

SEQ ID NO: 968099 - RNA, 17 nt, Mycobacterium avium subsp. paratuberculosis
gcgcagguagccgccgu

SEQ ID NO: 968100 - RNA, 20 nt, Mycobacterium avium subsp. paratuberculosis
gcgcagguccggcagcgcgc

SEQ ID NO: 968101 - RNA, 21 nt, Mycobacterium avium subsp. paratuberculosis
gcgcagguccggcagcgcgcc

SEQ ID NO: 968102 - RNA, 23 nt, Mycobacterium avium subsp. paratuberculosis
gcgcagguccguggugaucgccg

SEQ ID NO: 968103 - RNA, 13 nt, Mycobacterium avium subsp. paratuberculosis
gcgcaggucgggc

SEQ ID NO: 968104 - RNA, 15 nt, Mycobacterium avium subsp. paratuberculosis
gcgcaggucgggccg

SEQ ID NO: 968105 - RNA, 14 nt, Mycobacterium avium subsp. paratuberculosis
gcgcagggucagcg

SEQ ID NO: 968106 - RNA, 14 nt, Mycobacterium avium subsp. paratuberculosis
gcgcagggcggccg

SEQ ID NO: 968107 - RNA, 15 nt, Mycobacterium avium subsp. paratuberculosis
gcgcagggcgaacgg

SEQ ID NO: 968108 - RNA, 19 nt, Mycobacterium avium subsp. paratuberculosis
gcgcagcgccucggcggcc

SEQ ID NO: 968109 - RNA, 20 nt, Mycobacterium avium subsp. paratuberculosis
gcgcagcgccucggcggccc

SEQ ID NO: 968110 - RNA, 16 nt, Mycobacterium avium subsp. paratuberculosis
gcgcaggcgcugagcg

SEQ ID NO: 968111 - RNA, 14 nt, Mycobacterium avium subsp. paratuberculosis
gcgcaggcggcgcg

SEQ ID NO: 968112 - RNA, 13 nt, Mycobacterium avium subsp. paratuberculosis
gcgcagccgccgg

SEQ ID NO: 968113 - RNA, 16 nt, Mycobacterium avium subsp. paratuberculosis
gcgcagccgcgguggc

SEQ ID NO: 968114 - RNA, 14 nt, Mycobacterium avium subsp. paratuberculosis
gcgcagaucgccag

SEQ ID NO: 968115 - RNA, 18 nt, Mycobacterium avium subsp. paratuberculosis
gcgcagccggccaccgcc

SEQ ID NO: 968116 - RNA, 17 nt, Mycobacterium avium subsp. paratuberculosis
gcgcagccggccgaccg

SEQ ID NO: 968117 - RNA, 13 nt, Mycobacterium avium subsp. paratuberculosis
gcgcagccgggcg

SEQ ID NO: 968118 - RNA, 16 nt, Mycobacterium avium subsp. paratuberculosis
gcgcagccgggcggcg

SEQ ID NO: 968119 - RNA, 18 nt, Mycobacterium avium subsp. paratuberculosis
gcgcagccgggcggcgcu

SEQ ID NO: 968120 - RNA, 19 nt, Mycobacterium avium subsp. paratuberculosis
gcgcagcgccaggcagaag

SEQ ID NO: 968121 - RNA, 20 nt, Mycobacterium avium subsp. paratuberculosis
gcgcaguccagggugguggu

SEQ ID NO: 968122 - RNA, 13 nt, Mycobacterium avium subsp. paratuberculosis
gcgcaguggacgg

SEQ ID NO: 968123 - RNA, 14 nt, Mycobacterium avium subsp. paratuberculosis
gcgcagucgcaggc

SEQ ID NO: 968124 - RNA, 16 nt, Mycobacterium avium subsp. paratuberculosis
gcgcagucggccggau

SEQ ID NO: 968125 - RNA, 15 nt, Mycobacterium avium subsp. paratuberculosis
gcgcagucggcgucg

SEQ ID NO: 968126 - RNA, 21 nt, Mycobacterium avium subsp. paratuberculosis
gcgcaggugugcggcaagcga

SEQ ID NO: 968127 - RNA, 17 nt, Mycobacterium avium subsp. paratuberculosis
gcgcagguugucggcca

SEQ ID NO: 968128 - RNA, 20 nt, Mycobacterium avium subsp. paratuberculosis
gcgcaucacccggcgcgcgg

SEQ ID NO: 968129 - RNA, 14 nt, Mycobacterium avium subsp. paratuberculosis
gcgcaucagcgggg

SEQ ID NO: 968130 - RNA, 14 nt, Mycobacterium avium subsp. paratuberculosis
gcgcaucagcucuu

SEQ ID NO: 968131 - RNA, 19 nt, Mycobacterium avium subsp. paratuberculosis
gcgcaucaucgcccagcgc

SEQ ID NO: 968132 - RNA, 18 nt, Mycobacterium avium subsp. paratuberculosis
gcgcaucccgucgaccag

SEQ ID NO: 968133 - RNA, 17 nt, Mycobacterium avium subsp. paratuberculosis
gcgcauccgacaccgcc

SEQ ID NO: 968134 - RNA, 14 nt, Mycobacterium avium subsp. paratuberculosis
gcgcauaccagcgc

SEQ ID NO: 968135 - RNA, 18 nt, Mycobacterium avium subsp. paratuberculosis
gcgacuugguggccagca

SEQ ID NO: 968136 - RNA, 20 nt, Mycobacterium avium subsp. paratuberculosis
gcgacuugguggccagcacc

SEQ ID NO: 968137 - RNA, 15 nt, Mycobacterium avium subsp. paratuberculosis
gcgacuugcgcgccg

SEQ ID NO: 968138 - RNA, 14 nt, Mycobacterium avium subsp. paratuberculosis
gcgacucggccagg

SEQ ID NO: 968139 - RNA, 14 nt, Mycobacterium avium subsp. paratuberculosis
gcgagaagucgccg

SEQ ID NO: 968140 - RNA, 17 nt, Mycobacterium avium subsp. paratuberculosis
gcgagacgagccgccgc

SEQ ID NO: 968141 - RNA, 14 nt, Mycobacterium avium subsp. paratuberculosis
gcgagcagcccggc

SEQ ID NO: 968142 - RNA, 21 nt, Mycobacterium avium subsp. paratuberculosis
gcgagcagcgcccgggugcgc

SEQ ID NO: 968143 - RNA, 16 nt, Mycobacterium avium subsp. paratuberculosis
gcgagcagaucgcgga

SEQ ID NO: 968144 - RNA, 14 nt, Mycobacterium avium subsp. paratuberculosis
gcgagcacgccgcc

SEQ ID NO: 968145 - RNA, 16 nt, Mycobacterium avium subsp. paratuberculosis
gcgagcacgccgccgg

SEQ ID NO: 968146 - RNA, 19 nt, Mycobacterium avium subsp. paratuberculosis
gcgagcaccgcgaucgccg

SEQ ID NO: 968147 - RNA, 22 nt, Mycobacterium avium subsp. paratuberculosis
gcgagcaccgcgaucgccgacg

SEQ ID NO: 968148 - RNA, 18 nt, Mycobacterium avium subsp. paratuberculosis
gcgagcgcguucuccacc

SEQ ID NO: 968149 - RNA, 18 nt, Mycobacterium avium subsp. paratuberculosis
gcgagcgcuucgggagca

SEQ ID NO: 968150 - RNA, 21 nt, Mycobacterium avium subsp. paratuberculosis
gcgagcgcgcggugaugaccu

SEQ ID NO: 968151 - RNA, 16 nt, Mycobacterium avium subsp. paratuberculosis
gcgagcgcgcuguagg

SEQ ID NO: 968152 - RNA, 13 nt, Mycobacterium avium subsp. paratuberculosis
gcgagcccagcug

SEQ ID NO: 968153 - RNA, 13 nt, Mycobacterium avium subsp. paratuberculosis
gcgagccagcugc

SEQ ID NO: 968154 - RNA, 19 nt, Mycobacterium avium subsp. paratuberculosis
gcgacuccagcagcgccag

SEQ ID NO: 968155 - RNA, 20 nt, Mycobacterium avium subsp. paratuberculosis
gcgacuccagcagcgccagc

SEQ ID NO: 968156 - RNA, 16 nt, Mycobacterium avium subsp. paratuberculosis
gcgacgguuguucagc

SEQ ID NO: 968157 - RNA, 15 nt, Mycobacterium avium subsp. paratuberculosis
gcgacgggccgggca

SEQ ID NO: 968158 - RNA, 20 nt, Mycobacterium avium subsp. paratuberculosis
gcgacggucgugcugggccg

SEQ ID NO: 968159 - RNA, 18 nt, Mycobacterium avium subsp. paratuberculosis
gcgacggucugccgggac

SEQ ID NO: 968160 - RNA, 16 nt, Mycobacterium avium subsp. paratuberculosis
gcgacgguggacccga

SEQ ID NO: 968161 - RNA, 22 nt, Mycobacterium avium subsp. paratuberculosis
gcgacgguggcgcccagcgagc

SEQ ID NO: 968162 - RNA, 17 nt, Mycobacterium avium subsp. paratuberculosis
gcgacgguggcgggccg

SEQ ID NO: 968163 - RNA, 21 nt, Mycobacterium avium subsp. paratuberculosis
gcgacgguggcgggccgccgg

SEQ ID NO: 968164 - RNA, 18 nt, Mycobacterium avium subsp. paratuberculosis
gcgacgucgucgcccacc

SEQ ID NO: 968165 - RNA, 18 nt, Mycobacterium avium subsp. paratuberculosis
gcgacgucguggcccgga

SEQ ID NO: 968166 - RNA, 23 nt, Mycobacterium avium subsp. paratuberculosis
gcgacgugauggucgucguggug

SEQ ID NO: 968167 - RNA, 14 nt, Mycobacterium avium subsp. paratuberculosis
gcgacgugccggcg

SEQ ID NO: 968168 - RNA, 16 nt, Mycobacterium avium subsp. paratuberculosis
gcgacgugccggcggc

SEQ ID NO: 968169 - RNA, 14 nt, Mycobacterium avium subsp. paratuberculosis
gcgacgucgacggc

SEQ ID NO: 968170 - RNA, 16 nt, Mycobacterium avium subsp. paratuberculosis
gcgacgucgacggcag

SEQ ID NO: 968171 - RNA, 21 nt, Mycobacterium avium subsp. paratuberculosis
gcgacgucgccggccugcccg

SEQ ID NO: 968172 - RNA, 16 nt, Mycobacterium avium subsp. paratuberculosis
gcgacggaccagugca

SEQ ID NO: 968173 - RNA, 19 nt, Mycobacterium avium subsp. paratuberculosis
gcgacggcaauccggcccc

SEQ ID NO: 968174 - RNA, 16 nt, Mycobacterium avium subsp. paratuberculosis
gcgacggcaccgccgg

SEQ ID NO: 968175 - RNA, 17 nt, Mycobacterium avium subsp. paratuberculosis
gcgacggaucggccgcg

SEQ ID NO: 968176 - RNA, 14 nt, Mycobacterium avium subsp. paratuberculosis
gcgacgcucaggcg

SEQ ID NO: 968177 - RNA, 18 nt, Mycobacterium avium subsp. paratuberculosis
gcgacgcugaacagcagc

SEQ ID NO: 968178 - RNA, 15 nt, Mycobacterium avium subsp. paratuberculosis
gcgacgcugagcgcc

SEQ ID NO: 968179 - RNA, 17 nt, Mycobacterium avium subsp. paratuberculosis
gcgacgcugagcgccag

SEQ ID NO: 968180 - RNA, 14 nt, Mycobacterium avium subsp. paratuberculosis
gcgacgggcugcug

SEQ ID NO: 968181 - RNA, 18 nt, Mycobacterium avium subsp. paratuberculosis
gcgacgggcugcugcacg

SEQ ID NO: 968182 - RNA, 17 nt, Mycobacterium avium subsp. paratuberculosis
gcgacggcguccgggcg

SEQ ID NO: 968183 - RNA, 21 nt, Mycobacterium avium subsp. paratuberculosis
gcgacggcucuucgcggcggg

SEQ ID NO: 968184 - RNA, 13 nt, Mycobacterium avium subsp. paratuberculosis
gcgacggcggcga

SEQ ID NO: 968185 - RNA, 18 nt, Mycobacterium avium subsp. paratuberculosis
gcgacggcggcgacguga

SEQ ID NO: 968186 - RNA, 18 nt, Mycobacterium avium subsp. paratuberculosis
gcgacggcgagccgggcc

SEQ ID NO: 968187 - RNA, 19 nt, Mycobacterium avium subsp. paratuberculosis
gcgacggcgagccgggccg

SEQ ID NO: 968188 - RNA, 15 nt, Mycobacterium avium subsp. paratuberculosis
gcgacggccggggcc

SEQ ID NO: 968189 - RNA, 21 nt, Mycobacterium avium subsp. paratuberculosis
gcgacggccggggccagcacc

SEQ ID NO: 968190 - RNA, 19 nt, Mycobacterium avium subsp. paratuberculosis
gcgaucucgucccacggcg

SEQ ID NO: 968191 - RNA, 14 nt, Mycobacterium avium subsp. paratuberculosis
gcgaucucgagcau

SEQ ID NO: 968192 - RNA, 22 nt, Mycobacterium avium subsp. paratuberculosis
gcgaucucgccgaaggccgggu

SEQ ID NO: 968193 - RNA, 24 nt, Mycobacterium avium subsp. paratuberculosis
gcgaucucgccgaaggccgggucg

SEQ ID NO: 968194 - RNA, 20 nt, Mycobacterium avium subsp. paratuberculosis
gcgaucuuugcggccguggc

SEQ ID NO: 968195 - RNA, 21 nt, Mycobacterium avium subsp. paratuberculosis
gcgaucuugucccgcauggcc

SEQ ID NO: 968196 - RNA, 20 nt, Mycobacterium avium subsp. paratuberculosis
gcgaugcccgugaucgccac

SEQ ID NO: 968197 - RNA, 21 nt, Mycobacterium avium subsp. paratuberculosis
gcgaugccuuccucggcgcuc

SEQ ID NO: 968198 - RNA, 14 nt, Mycobacterium avium subsp. paratuberculosis
gcgaugcgcacguc

SEQ ID NO: 968199 - RNA, 20 nt, Mycobacterium avium subsp. paratuberculosis
gcgaucaccuugcggccggc

SEQ ID NO: 968200 - RNA, 21 nt, Mycobacterium avium subsp. paratuberculosis
gcgaucaccuugcggccggcg

SEQ ID NO: 968201 - RNA, 15 nt, Mycobacterium avium subsp. paratuberculosis
gcgaucagcccggcc

SEQ ID NO: 968202 - RNA, 21 nt, Mycobacterium avium subsp. paratuberculosis
gcgaucgggaacagcccgccc

SEQ ID NO: 968203 - RNA, 19 nt, Mycobacterium avium subsp. paratuberculosis
gcgaucggugaacccgccg

SEQ ID NO: 968204 - RNA, 14 nt, Mycobacterium avium subsp. paratuberculosis
gcgaucagcuggau

SEQ ID NO: 968205 - RNA, 16 nt, Mycobacterium avium subsp. paratuberculosis
gcgaucaccgccgcgg

SEQ ID NO: 968206 - RNA, 20 nt, Mycobacterium avium subsp. paratuberculosis
gcgauaaccucggcggcggc

SEQ ID NO: 968207 - RNA, 16 nt, Mycobacterium avium subsp. paratuberculosis
gcgaguucgaugacgu

SEQ ID NO: 968208 - RNA, 21 nt, Mycobacterium avium subsp. paratuberculosis
gcgagucgaugaccucgcgcc

SEQ ID NO: 968209 - RNA, 22 nt, Mycobacterium avium subsp. paratuberculosis
gcgagucgaugaccucgcgccc

SEQ ID NO: 968210 - RNA, 19 nt, Mycobacterium avium subsp. paratuberculosis
gcgagucaucgccacccgc

SEQ ID NO: 968211 - RNA, 20 nt, Mycobacterium avium subsp. paratuberculosis
gcgaguccagccagccgcgc

SEQ ID NO: 968212 - RNA, 22 nt, Mycobacterium avium subsp. paratuberculosis
gcgagucgaagccguccaggcc

SEQ ID NO: 968213 - RNA, 13 nt, Mycobacterium avium subsp. paratuberculosis
gcgagucgaaggc

SEQ ID NO: 968214 - RNA, 14 nt, Mycobacterium avium subsp. paratuberculosis
gcgagugaggacga

SEQ ID NO: 968215 - RNA, 19 nt, Mycobacterium avium subsp. paratuberculosis
gcgagugcaccuugaucuc

SEQ ID NO: 968216 - RNA, 23 nt, Mycobacterium avium subsp. paratuberculosis
gcgagucguacuucgcccccgga

SEQ ID NO: 968217 - RNA, 14 nt, Mycobacterium avium subsp. paratuberculosis
gcgagcugccggcg

SEQ ID NO: 968218 - RNA, 16 nt, Mycobacterium avium subsp. paratuberculosis
gcgagcugccggcggc

SEQ ID NO: 968219 - RNA, 15 nt, Mycobacterium avium subsp. paratuberculosis
gcgagcuuggcgggc

SEQ ID NO: 968220 - RNA, 20 nt, Mycobacterium avium subsp. paratuberculosis
gcgagcuggccgcccaccac

SEQ ID NO: 968221 - RNA, 14 nt, Mycobacterium avium subsp. paratuberculosis
gcgagcugcgggug

SEQ ID NO: 968222 - RNA, 19 nt, Mycobacterium avium subsp. paratuberculosis
gcgagcugcuucgucgccg

SEQ ID NO: 968223 - RNA, 23 nt, Mycobacterium avium subsp. paratuberculosis
gcgagcugcuucgucgccgggcu

SEQ ID NO: 968224 - RNA, 16 nt, Mycobacterium avium subsp. paratuberculosis
gcgagcgucgccgcgu

SEQ ID NO: 968225 - RNA, 16 nt, Mycobacterium avium subsp. paratuberculosis
gcgagcgggcacgccg

SEQ ID NO: 968226 - RNA, 23 nt, Mycobacterium avium subsp. paratuberculosis
gcgaggugguuucggggucgccg

SEQ ID NO: 968227 - RNA, 22 nt, Mycobacterium avium subsp. paratuberculosis
gcgaggugugaggagucgggca

SEQ ID NO: 968228 - RNA, 16 nt, Mycobacterium avium subsp. paratuberculosis
gcgaguacccgccgca

SEQ ID NO: 968229 - RNA, 17 nt, Mycobacterium avium subsp. paratuberculosis
gcgaguacccgccgcac

SEQ ID NO: 968230 - RNA, 18 nt, Mycobacterium avium subsp. paratuberculosis
gcgaguaaggccgaggcg

SEQ ID NO: 968231 - RNA, 19 nt, Mycobacterium avium subsp. paratuberculosis
gcgaguaaggccgaggcga

SEQ ID NO: 968232 - RNA, 16 nt, Mycobacterium avium subsp. paratuberculosis
gcgaguacaccucgag

SEQ ID NO: 968233 - RNA, 18 nt, Mycobacterium avium subsp. paratuberculosis
gcgagucaccggcucgcg

SEQ ID NO: 968234 - RNA, 14 nt, Mycobacterium avium subsp. paratuberculosis
gcgaccgcggccgc

SEQ ID NO: 968235 - RNA, 14 nt, Mycobacterium avium subsp. paratuberculosis
gcgaccgcgcaggc

SEQ ID NO: 968236 - RNA, 16 nt, Mycobacterium avium subsp. paratuberculosis
gcgaccgcgcaggcgg

SEQ ID NO: 968237 - RNA, 15 nt, Mycobacterium avium subsp. paratuberculosis
gcgaccgcccggggc

SEQ ID NO: 968238 - RNA, 23 nt, Mycobacterium avium subsp. paratuberculosis
gcgaccgcccggggcgcggaccg

SEQ ID NO: 968239 - RNA, 16 nt, Mycobacterium avium subsp. paratuberculosis
gcgaccagcaggucga

SEQ ID NO: 968240 - RNA, 15 nt, Mycobacterium avium subsp. paratuberculosis
gcgaccgcagcaggc

SEQ ID NO: 968241 - RNA, 22 nt, Mycobacterium avium subsp. paratuberculosis
gcgaccgcagcaggcggacggc

SEQ ID NO: 968242 - RNA, 22 nt, Mycobacterium avium subsp. paratuberculosis
gcgaccaauugcgagcaggccg

SEQ ID NO: 968243 - RNA, 18 nt, Mycobacterium avium subsp. paratuberculosis
gcgaccacaccgccggcc

SEQ ID NO: 968244 - RNA, 21 nt, Mycobacterium avium subsp. paratuberculosis
gcgaccaccaccgcccacagc

SEQ ID NO: 968245 - RNA, 20 nt, Mycobacterium avium subsp. paratuberculosis
gcgaccaccacggccgcagc

SEQ ID NO: 968246 - RNA, 21 nt, Mycobacterium avium subsp. paratuberculosis
gcgaccaccacggccgcagcg

SEQ ID NO: 968247 - RNA, 20 nt, Mycobacterium avium subsp. paratuberculosis
gcgaccacguccagcugggc

SEQ ID NO: 968248 - RNA, 18 nt, Mycobacterium avium subsp. paratuberculosis
gcgaccaccggccgaccg

SEQ ID NO: 968249 - RNA, 22 nt, Mycobacterium avium subsp. paratuberculosis
gcgacgccgcggaagccccagg

SEQ ID NO: 968250 - RNA, 23 nt, Mycobacterium avium subsp. paratuberculosis
gcgacgccgcggaagccccaggc

SEQ ID NO: 968251 - RNA, 17 nt, Mycobacterium avium subsp. paratuberculosis
gcgacgcccaggugcac

SEQ ID NO: 968252 - RNA, 23 nt, Mycobacterium avium subsp. paratuberculosis
gcgacgccagcaccuucgggccg

SEQ ID NO: 968253 - RNA, 19 nt, Mycobacterium avium subsp. paratuberculosis
gcgacgcgaucgaggugau

SEQ ID NO: 968254 - RNA, 14 nt, Mycobacterium avium subsp. paratuberculosis
gcgacgcgcucggc

SEQ ID NO: 968255 - RNA, 18 nt, Mycobacterium avium subsp. paratuberculosis
gcgacgccgacgcccagc

SEQ ID NO: 968256 - RNA, 14 nt, Mycobacterium avium subsp. paratuberculosis
gcgaccgccgccgc

SEQ ID NO: 968257 - RNA, 14 nt, Mycobacterium avium subsp. paratuberculosis
gcgacgcacgccgg

SEQ ID NO: 968258 - RNA, 16 nt, Mycobacterium avium subsp. paratuberculosis
gcgaccggggcgguga

SEQ ID NO: 968259 - RNA, 18 nt, Mycobacterium avium subsp. paratuberculosis
gcgacaucaccgcgggcg

SEQ ID NO: 968260 - RNA, 22 nt, Mycobacterium avium subsp. paratuberculosis
gcgacaucaccgcgggcgcgcc

SEQ ID NO: 968261 - RNA, 18 nt, Mycobacterium avium subsp. paratuberculosis
gcgacaugcgcagcgccc

SEQ ID NO: 968262 - RNA, 15 nt, Mycobacterium avium subsp. paratuberculosis
gcgacaugcccgcgg

SEQ ID NO: 968263 - RNA, 12 nt, Mycobacterium avium subsp. paratuberculosis
gcgacaucgccg

SEQ ID NO: 968264 - RNA, 15 nt, Mycobacterium avium subsp. paratuberculosis
gcgacaucgccggcg

SEQ ID NO: 968265 - RNA, 20 nt, Mycobacterium avium subsp. paratuberculosis
gcgaaucgccuuggcucggg

SEQ ID NO: 968266 - RNA, 19 nt, Mycobacterium avium subsp. paratuberculosis
gcgaaucgauaacgcgcgc

SEQ ID NO: 968267 - RNA, 16 nt, Mycobacterium avium subsp. paratuberculosis
gcgaauccgggccucc

SEQ ID NO: 968268 - RNA, 21 nt, Mycobacterium avium subsp. paratuberculosis
gccguuucggauccauugcga

SEQ ID NO: 968269 - RNA, 16 nt, Mycobacterium avium subsp. paratuberculosis
gccguucggccagcgc

SEQ ID NO: 968270 - RNA, 16 nt, Mycobacterium avium subsp. paratuberculosis
gcgaacagcgccgacu

SEQ ID NO: 968271 - RNA, 14 nt, Mycobacterium avium subsp. paratuberculosis
gcgaacagguccuu

SEQ ID NO: 968272 - RNA, 21 nt, Mycobacterium avium subsp. paratuberculosis
gcgaacagguccuugcccagc

SEQ ID NO: 968273 - RNA, 14 nt, Mycobacterium avium subsp. paratuberculosis
gcgaaagcgucggc

SEQ ID NO: 968274 - RNA, 12 nt, Mycobacterium avium subsp. paratuberculosis
gcgaacagcagc

SEQ ID NO: 968275 - RNA, 19 nt, Mycobacterium avium subsp. paratuberculosis
gcgaagcacgaccacaccc

SEQ ID NO: 968276 - RNA, 13 nt, Mycobacterium avium subsp. paratuberculosis
gcgaagagcggca

SEQ ID NO: 968277 - RNA, 18 nt, Mycobacterium avium subsp. paratuberculosis
gcgaagacccgaaacugg

SEQ ID NO: 968278 - RNA, 17 nt, Mycobacterium avium subsp. paratuberculosis
gcgaacccugaccgugc

SEQ ID NO: 968279 - RNA, 15 nt, Mycobacterium avium subsp. paratuberculosis
gcgaaccgcggcggc

SEQ ID NO: 968280 - RNA, 21 nt, Mycobacterium avium subsp. paratuberculosis
gcgaaccgcggcggcagcagc

SEQ ID NO: 968281 - RNA, 14 nt, Mycobacterium avium subsp. paratuberculosis
gcgaaccagcaugc

SEQ ID NO: 968282 - RNA, 16 nt, Mycobacterium avium subsp. paratuberculosis
gcgaacauggcggcca

SEQ ID NO: 968283 - RNA, 13 nt, Mycobacterium avium subsp. paratuberculosis
gcgaacagugcac

SEQ ID NO: 968284 - RNA, 16 nt, Mycobacterium avium subsp. paratuberculosis
gcgaacaucgccagca

SEQ ID NO: 968285 - RNA, 17 nt, Mycobacterium avium subsp. paratuberculosis
gcgaacaucgccagcaa

SEQ ID NO: 968286 - RNA, 23 nt, Mycobacterium avium subsp. paratuberculosis
gcgaacaucuuggucagccgcgg

SEQ ID NO: 968287 - RNA, 19 nt, Mycobacterium avium subsp. paratuberculosis
gcgaauaccagggcgagga

SEQ ID NO: 968288 - RNA, 19 nt, Mycobacterium avium subsp. paratuberculosis
gcgaagccggccccgcccg

SEQ ID NO: 968289 - RNA, 17 nt, Mycobacterium avium subsp. paratuberculosis
gcggauagcccagcgug

SEQ ID NO: 968290 - RNA, 14 nt, Mycobacterium avium subsp. paratuberculosis
gcggaucagcagga

SEQ ID NO: 968291 - RNA, 18 nt, Mycobacterium avium subsp. paratuberculosis
gcggaguuuggacaucac

SEQ ID NO: 968292 - RNA, 15 nt, Mycobacterium avium subsp. paratuberculosis
gcggagugaccgcca

SEQ ID NO: 968293 - RNA, 17 nt, Mycobacterium avium subsp. paratuberculosis
gcggagugaccgccagc

SEQ ID NO: 968294 - RNA, 19 nt, Mycobacterium avium subsp. paratuberculosis
gcggagugaccgccagcac

SEQ ID NO: 968295 - RNA, 20 nt, Mycobacterium avium subsp. paratuberculosis
gcggaggucauggcgaccgc

SEQ ID NO: 968296 - RNA, 21 nt, Mycobacterium avium subsp. paratuberculosis
gcggaggaugccggccagcuu

SEQ ID NO: 968297 - RNA, 20 nt, Mycobacterium avium subsp. paratuberculosis
gcggaggccugcgcggccgc

SEQ ID NO: 968298 - RNA, 13 nt, Mycobacterium avium subsp. paratuberculosis
gcggagcggcggu

SEQ ID NO: 968299 - RNA, 22 nt, Mycobacterium avium subsp. paratuberculosis
gcggagcguuccagguucagcc

SEQ ID NO: 968300 - RNA, 12 nt, Mycobacterium avium subsp. paratuberculosis
gcggagaucacc

SEQ ID NO: 968301 - RNA, 14 nt, Mycobacterium avium subsp. paratuberculosis
gcggagaucacccc

SEQ ID NO: 968302 - RNA, 21 nt, Mycobacterium avium subsp. paratuberculosis
gcggagaucaccccuggcggg

SEQ ID NO: 968303 - RNA, 17 nt, Mycobacterium avium subsp. paratuberculosis
gcggagaucgugcugug

SEQ ID NO: 968304 - RNA, 14 nt, Mycobacterium avium subsp. paratuberculosis
gcggagaugcuggu

SEQ ID NO: 968305 - RNA, 14 nt, Mycobacterium avium subsp. paratuberculosis
gcggacuggugggc

SEQ ID NO: 968306 - RNA, 22 nt, Mycobacterium avium subsp. paratuberculosis
gcggacgggaccacccgcagcg

SEQ ID NO: 968307 - RNA, 13 nt, Mycobacterium avium subsp. paratuberculosis
gcggacgggccgc

SEQ ID NO: 968308 - RNA, 19 nt, Mycobacterium avium subsp. paratuberculosis
gcggacggguugggcgcca

SEQ ID NO: 968309 - RNA, 17 nt, Mycobacterium avium subsp. paratuberculosis
gcggacggucgccgacg

SEQ ID NO: 968310 - RNA, 18 nt, Mycobacterium avium subsp. paratuberculosis
gcggaagucggugcccuu

SEQ ID NO: 968311 - RNA, 15 nt, Mycobacterium avium subsp. paratuberculosis
gcggaaucgcccggg

SEQ ID NO: 968312 - RNA, 20 nt, Mycobacterium avium subsp. paratuberculosis
gcggaaugaacgcggccagg

SEQ ID NO: 968313 - RNA, 20 nt, Mycobacterium avium subsp. paratuberculosis
gcggacagccccgagccgcg

SEQ ID NO: 968314 - RNA, 13 nt, Mycobacterium avium subsp. paratuberculosis
gcggacagcgcgg

SEQ ID NO: 968315 - RNA, 15 nt, Mycobacterium avium subsp. paratuberculosis
gcggacacggccggg

SEQ ID NO: 968316 - RNA, 14 nt, Mycobacterium avium subsp. paratuberculosis
gcggacagggcggc

SEQ ID NO: 968317 - RNA, 17 nt, Mycobacterium avium subsp. paratuberculosis
gcggaccccagugcagg

SEQ ID NO: 968318 - RNA, 21 nt, Mycobacterium avium subsp. paratuberculosis
gcggaccaucuacgaccucga

SEQ ID NO: 968319 - RNA, 22 nt, Mycobacterium avium subsp. paratuberculosis
gcggacgauguccgccggccgg

SEQ ID NO: 968320 - RNA, 22 nt, Mycobacterium avium subsp. paratuberculosis
gcggacggaucgagucccgcgc

SEQ ID NO: 968321 - RNA, 14 nt, Mycobacterium avium subsp. paratuberculosis
gcggacggccagcc

SEQ ID NO: 968322 - RNA, 14 nt, Mycobacterium avium subsp. paratuberculosis
gcggacgccucgcc

SEQ ID NO: 968323 - RNA, 19 nt, Mycobacterium avium subsp. paratuberculosis
gcggacgcguugaaagucc

SEQ ID NO: 968324 - RNA, 20 nt, Mycobacterium avium subsp. paratuberculosis
gcggaccggcggccgccauc

SEQ ID NO: 968325 - RNA, 15 nt, Mycobacterium avium subsp. paratuberculosis
gcggacgacggccag

SEQ ID NO: 968326 - RNA, 15 nt, Mycobacterium avium subsp. paratuberculosis
gcggacccagcuccu

SEQ ID NO: 968327 - RNA, 12 nt, Mycobacterium avium subsp. paratuberculosis
gcggaccugggu

SEQ ID NO: 968328 - RNA, 16 nt, Mycobacterium avium subsp. paratuberculosis
gcggaccugggugcgc

SEQ ID NO: 968329 - RNA, 15 nt, Mycobacterium avium subsp. paratuberculosis
gcggauggcgacggc

SEQ ID NO: 968330 - RNA, 17 nt, Mycobacterium avium subsp. paratuberculosis
gcggaugccggaggcgc

SEQ ID NO: 968331 - RNA, 19 nt, Mycobacterium avium subsp. paratuberculosis
gcggaugcccaggccggcg

SEQ ID NO: 968332 - RNA, 15 nt, Mycobacterium avium subsp. paratuberculosis
gcggaugcccgccgg

SEQ ID NO: 968333 - RNA, 16 nt, Mycobacterium avium subsp. paratuberculosis
gcggaugcccgccggc

SEQ ID NO: 968334 - RNA, 17 nt, Mycobacterium avium subsp. paratuberculosis
gcggaugcccgccggcg

SEQ ID NO: 968335 - RNA, 16 nt, Mycobacterium avium subsp. paratuberculosis
gcggaucucgucgggc

SEQ ID NO: 968336 - RNA, 16 nt, Mycobacterium avium subsp. paratuberculosis
gcggaugaccaggucg

SEQ ID NO: 968337 - RNA, 18 nt, Mycobacterium avium subsp. paratuberculosis
gcggaugaccaggucgcc

SEQ ID NO: 968338 - RNA, 22 nt, Mycobacterium avium subsp. paratuberculosis
gcggaugaccaggucgccggcg

SEQ ID NO: 968339 - RNA, 16 nt, Mycobacterium avium subsp. paratuberculosis
gcggaucuucuccgcc

SEQ ID NO: 968340 - RNA, 20 nt, Mycobacterium avium subsp. paratuberculosis
gcggaucuugguguccagcg

SEQ ID NO: 968341 - RNA, 13 nt, Mycobacterium avium subsp. paratuberculosis
gcggaucaggucg

SEQ ID NO: 968342 - RNA, 21 nt, Mycobacterium avium subsp. paratuberculosis
gcggauccagguggggcacgg

SEQ ID NO: 968343 - RNA, 18 nt, Mycobacterium avium subsp. paratuberculosis
gcggauccccgcgcuggg

SEQ ID NO: 968344 - RNA, 21 nt, Mycobacterium avium subsp. paratuberculosis
gcggaucgaacagggcggcgg

SEQ ID NO: 968345 - RNA, 14 nt, Mycobacterium avium subsp. paratuberculosis
gcggcaccaccagc

SEQ ID NO: 968346 - RNA, 20 nt, Mycobacterium avium subsp. paratuberculosis
gcggcaccacccgcggccgg

SEQ ID NO: 968347 - RNA, 21 nt, Mycobacterium avium subsp. paratuberculosis
gcggcacccgguccggcccgg

SEQ ID NO: 968348 - RNA, 22 nt, Mycobacterium avium subsp. paratuberculosis
gcggcacccgguccggcccggg

SEQ ID NO: 968349 - RNA, 15 nt, Mycobacterium avium subsp. paratuberculosis
gcggcaccgcccggg

SEQ ID NO: 968350 - RNA, 18 nt, Mycobacterium avium subsp. paratuberculosis
gcggcaccagcccgccgu

SEQ ID NO: 968351 - RNA, 20 nt, Mycobacterium avium subsp. paratuberculosis
gcggcaccagcccgccgucg

SEQ ID NO: 968352 - RNA, 14 nt, Mycobacterium avium subsp. paratuberculosis
gcggcaaccagcuc

SEQ ID NO: 968353 - RNA, 20 nt, Mycobacterium avium subsp. paratuberculosis
gcggcaacacgccggcggcc

SEQ ID NO: 968354 - RNA, 17 nt, Mycobacterium avium subsp. paratuberculosis
gcggauuucucagcggc

SEQ ID NO: 968355 - RNA, 23 nt, Mycobacterium avium subsp. paratuberculosis
gcggauucucgcucugccgggcc

SEQ ID NO: 968356 - RNA, 16 nt, Mycobacterium avium subsp. paratuberculosis
gcggcaaaacgcuggg

SEQ ID NO: 968357 - RNA, 17 nt, Mycobacterium avium subsp. paratuberculosis
gcggcaaaacgcugggc

SEQ ID NO: 968358 - RNA, 18 nt, Mycobacterium avium subsp. paratuberculosis
gcggcaaaacgcugggcg

SEQ ID NO: 968359 - RNA, 21 nt, Mycobacterium avium subsp. paratuberculosis
gcggcaaaacgcugggcgccg

SEQ ID NO: 968360 - RNA, 16 nt, Mycobacterium avium subsp. paratuberculosis
gcgcuuucgcgcacgc

SEQ ID NO: 968361 - RNA, 17 nt, Mycobacterium avium subsp. paratuberculosis
gcgcuuuggaccagggc

SEQ ID NO: 968362 - RNA, 21 nt, Mycobacterium avium subsp. paratuberculosis
gcggaagaacaguuccucggc

SEQ ID NO: 968363 - RNA, 15 nt, Mycobacterium avium subsp. paratuberculosis
gcggaaggcccccgg

SEQ ID NO: 968364 - RNA, 14 nt, Mycobacterium avium subsp. paratuberculosis
gcggaagcgcguuc

SEQ ID NO: 968365 - RNA, 12 nt, Mycobacterium avium subsp. paratuberculosis
gcggaacaccgc

SEQ ID NO: 968366 - RNA, 14 nt, Mycobacterium avium subsp. paratuberculosis
gcggaacagccggc

SEQ ID NO: 968367 - RNA, 15 nt, Mycobacterium avium subsp. paratuberculosis
gcggaacgcgccggg

SEQ ID NO: 968368 - RNA, 16 nt, Mycobacterium avium subsp. paratuberculosis
gcggaacugcucccag

SEQ ID NO: 968369 - RNA, 22 nt, Mycobacterium avium subsp. paratuberculosis
gcggaacggucggggcggcggg

SEQ ID NO: 968370 - RNA, 22 nt, Mycobacterium avium subsp. paratuberculosis
gcggaacccacgugcggcgccc

SEQ ID NO: 968371 - RNA, 23 nt, Mycobacterium avium subsp. paratuberculosis
gcggaacccacgugcggcgcccu

SEQ ID NO: 968372 - RNA, 15 nt, Mycobacterium avium subsp. paratuberculosis
gcggaaccggccggg

SEQ ID NO: 968373 - RNA, 20 nt, Mycobacterium avium subsp. paratuberculosis
gcggaaccggccggggcgcc

SEQ ID NO: 968374 - RNA, 14 nt, Mycobacterium avium subsp. paratuberculosis
gcggaaccgggccg

SEQ ID NO: 968375 - RNA, 16 nt, Mycobacterium avium subsp. paratuberculosis
gcggaaccgggccgcu

SEQ ID NO: 968376 - RNA, 18 nt, Mycobacterium avium subsp. paratuberculosis
gcgcuugucagcggccuc

SEQ ID NO: 968377 - RNA, 16 nt, Mycobacterium avium subsp. paratuberculosis
gcgcuugcgaucgccg

SEQ ID NO: 968378 - RNA, 22 nt, Mycobacterium avium subsp. paratuberculosis
gcgcuugaccucgccgagcagc

SEQ ID NO: 968379 - RNA, 19 nt, Mycobacterium avium subsp. paratuberculosis
gcgcgguguacagcgcgcc

SEQ ID NO: 968380 - RNA, 18 nt, Mycobacterium avium subsp. paratuberculosis
gcgcggugugcggcggcu

SEQ ID NO: 968381 - RNA, 19 nt, Mycobacterium avium subsp. paratuberculosis
gcgcgguguuuggccgcgc

SEQ ID NO: 968382 - RNA, 22 nt, Mycobacterium avium subsp. paratuberculosis
gcgcgguguuuggccgcgcagc

SEQ ID NO: 968383 - RNA, 23 nt, Mycobacterium avium subsp. paratuberculosis
gcgcgguguuuggccgcgcagcu

SEQ ID NO: 968384 - RNA, 22 nt, Mycobacterium avium subsp. paratuberculosis
gcgcgguucuuggcguaguggu

SEQ ID NO: 968385 - RNA, 21 nt, Mycobacterium avium subsp. paratuberculosis
gcgcgguuucggcgucgccuu

SEQ ID NO: 968386 - RNA, 21 nt, Mycobacterium avium subsp. paratuberculosis
gcgcgucauggccgucggguc

SEQ ID NO: 968387 - RNA, 19 nt, Mycobacterium avium subsp. paratuberculosis
gcgcguagucggcgucggc

SEQ ID NO: 968388 - RNA, 15 nt, Mycobacterium avium subsp. paratuberculosis
gcgcucgccgcgcgg

SEQ ID NO: 968389 - RNA, 16 nt, Mycobacterium avium subsp. paratuberculosis
gcgcucgccgcgcggc

SEQ ID NO: 968390 - RNA, 23 nt, Mycobacterium avium subsp. paratuberculosis
gcgcucgccgucggccagcagcg

SEQ ID NO: 968391 - RNA, 20 nt, Mycobacterium avium subsp. paratuberculosis
gcgcucgcacaacccgcccg

SEQ ID NO: 968392 - RNA, 15 nt, Mycobacterium avium subsp. paratuberculosis
gcgcucgcaccagcg

SEQ ID NO: 968393 - RNA, 17 nt, Mycobacterium avium subsp. paratuberculosis
gcgcucgcaccagcgcu

SEQ ID NO: 968394 - RNA, 18 nt, Mycobacterium avium subsp. paratuberculosis
gcgcucgcaccagcgcuu

SEQ ID NO: 968395 - RNA, 16 nt, Mycobacterium avium subsp. paratuberculosis
gcgcguccauggucga

SEQ ID NO: 968396 - RNA, 19 nt, Mycobacterium avium subsp. paratuberculosis
gcgcguccauggucgagcc

SEQ ID NO: 968397 - RNA, 13 nt, Mycobacterium avium subsp. paratuberculosis
gcgcucgcgggug

SEQ ID NO: 968398 - RNA, 18 nt, Mycobacterium avium subsp. paratuberculosis
gcgcuggccgcgaacggc

SEQ ID NO: 968399 - RNA, 20 nt, Mycobacterium avium subsp. paratuberculosis
gcgcuggccagcgcgacggc

SEQ ID NO: 968400 - RNA, 15 nt, Mycobacterium avium subsp. paratuberculosis
gcgcuggaucugccc

SEQ ID NO: 968401 - RNA, 13 nt, Mycobacterium avium subsp. paratuberculosis
gcgcuggcggcca

SEQ ID NO: 968402 - RNA, 20 nt, Mycobacterium avium subsp. paratuberculosis
gcgcuggcgaacaugguggu

SEQ ID NO: 968403 - RNA, 18 nt, Mycobacterium avium subsp. paratuberculosis
gcgcuggcgaccaucagc

SEQ ID NO: 968404 - RNA, 21 nt, Mycobacterium avium subsp. paratuberculosis
gcgcugagcggguaaccgcag

SEQ ID NO: 968405 - RNA, 22 nt, Mycobacterium avium subsp. paratuberculosis
gcgcugagcggguaaccgcagc

SEQ ID NO: 968406 - RNA, 16 nt, Mycobacterium avium subsp. paratuberculosis
gcgccuucgacccggu

SEQ ID NO: 968407 - RNA, 20 nt, Mycobacterium avium subsp. paratuberculosis
gcgccuuggccucgguggcg

SEQ ID NO: 968408 - RNA, 15 nt, Mycobacterium avium subsp. paratuberculosis
gcgccugcgcggcgg

SEQ ID NO: 968409 - RNA, 16 nt, Mycobacterium avium subsp. paratuberculosis
gcgccugcgcggcggc

SEQ ID NO: 968410 - RNA, 16 nt, Mycobacterium avium subsp. paratuberculosis
gcgccucguugagcac

SEQ ID NO: 968411 - RNA, 21 nt, Mycobacterium avium subsp. paratuberculosis
gcgccucggccugcgcccggc

SEQ ID NO: 968412 - RNA, 13 nt, Mycobacterium avium subsp. paratuberculosis
gcgccucggcggc

SEQ ID NO: 968413 - RNA, 15 nt, Mycobacterium avium subsp. paratuberculosis
gcgccucggcggccc

SEQ ID NO: 968414 - RNA, 19 nt, Mycobacterium avium subsp. paratuberculosis
gcgccucggcgggccgccc

SEQ ID NO: 968415 - RNA, 18 nt, Mycobacterium avium subsp. paratuberculosis
gcgccucgcuaaucgccg

SEQ ID NO: 968416 - RNA, 23 nt, Mycobacterium avium subsp. paratuberculosis
gcgccucgaucaacgccgggucg

SEQ ID NO: 968417 - RNA, 17 nt, Mycobacterium avium subsp. paratuberculosis
gcgccucgaugcgggug

SEQ ID NO: 968418 - RNA, 23 nt, Mycobacterium avium subsp. paratuberculosis
gcgccucgagcaacggccgcagc

SEQ ID NO: 968419 - RNA, 13 nt, Mycobacterium avium subsp. paratuberculosis
gcgccggucagcg

SEQ ID NO: 968420 - RNA, 17 nt, Mycobacterium avium subsp. paratuberculosis
gcgccggggccgcggcu

SEQ ID NO: 968421 - RNA, 18 nt, Mycobacterium avium subsp. paratuberculosis
gcgccgggguccucucgg

SEQ ID NO: 968422 - RNA, 21 nt, Mycobacterium avium subsp. paratuberculosis
gcgccggggcgggcggcggcu

SEQ ID NO: 968423 - RNA, 14 nt, Mycobacterium avium subsp. paratuberculosis
gcgccggggugggc

SEQ ID NO: 968424 - RNA, 22 nt, Mycobacterium avium subsp. paratuberculosis
gcgccgggucauccccgugcgg

SEQ ID NO: 968425 - RNA, 16 nt, Mycobacterium avium subsp. paratuberculosis
gcgccgguagagcgcc

SEQ ID NO: 968426 - RNA, 18 nt, Mycobacterium avium subsp. paratuberculosis
gcgccgguagagcgccag

SEQ ID NO: 968427 - RNA, 17 nt, Mycobacterium avium subsp. paratuberculosis
gcgccgguaggccgcgc

SEQ ID NO: 968428 - RNA, 20 nt, Mycobacterium avium subsp. paratuberculosis
gcgccgguaggcgcggguga

SEQ ID NO: 968429 - RNA, 18 nt, Mycobacterium avium subsp. paratuberculosis
gcgccgguaggcggccag

SEQ ID NO: 968430 - RNA, 20 nt, Mycobacterium avium subsp. paratuberculosis
gcgccgguaggcggccagcg

SEQ ID NO: 968431 - RNA, 20 nt, Mycobacterium avium subsp. paratuberculosis
gcgccggguggccggggcca

SEQ ID NO: 968432 - RNA, 22 nt, Mycobacterium avium subsp. paratuberculosis
gcgccggguugcaggcgcccag

SEQ ID NO: 968433 - RNA, 16 nt, Mycobacterium avium subsp. paratuberculosis
gcgccgcgcgcgcggc

SEQ ID NO: 968434 - RNA, 13 nt, Mycobacterium avium subsp. paratuberculosis
gcgccgcucggcc

SEQ ID NO: 968435 - RNA, 20 nt, Mycobacterium avium subsp. paratuberculosis
gcgccgcucggccagcagca

SEQ ID NO: 968436 - RNA, 15 nt, Mycobacterium avium subsp. paratuberculosis
gcgccgcgccgaccu

SEQ ID NO: 968437 - RNA, 15 nt, Mycobacterium avium subsp. paratuberculosis
gcgccgcgccgccuu

SEQ ID NO: 968438 - RNA, 21 nt, Mycobacterium avium subsp. paratuberculosis
gcgccggacucgaagaucgcc

SEQ ID NO: 968439 - RNA, 17 nt, Mycobacterium avium subsp. paratuberculosis
gcgccgcuucgucgccg

SEQ ID NO: 968440 - RNA, 19 nt, Mycobacterium avium subsp. paratuberculosis
gcgccgcuucgucgccggc

SEQ ID NO: 968441 - RNA, 21 nt, Mycobacterium avium subsp. paratuberculosis
gcgccgcuucgucgccggccg

SEQ ID NO: 968442 - RNA, 13 nt, Mycobacterium avium subsp. paratuberculosis
gcgccgggcacca

SEQ ID NO: 968443 - RNA, 19 nt, Mycobacterium avium subsp. paratuberculosis
gcgccgggcagcccgccgc

SEQ ID NO: 968444 - RNA, 23 nt, Mycobacterium avium subsp. paratuberculosis
gcgccgggaucacacgcgcgccc

SEQ ID NO: 968445 - RNA, 21 nt, Mycobacterium avium subsp. paratuberculosis
gcgccgggcauuucggcuucc

SEQ ID NO: 968446 - RNA, 13 nt, Mycobacterium avium subsp. paratuberculosis
gcgccgggcggcc

SEQ ID NO: 968447 - RNA, 17 nt, Mycobacterium avium subsp. paratuberculosis
gcgccgggcggcccgcc

SEQ ID NO: 968448 - RNA, 21 nt, Mycobacterium avium subsp. paratuberculosis
gcgccgggcguugcccgccgc

SEQ ID NO: 968449 - RNA, 14 nt, Mycobacterium avium subsp. paratuberculosis
gcgccggcuccgca

SEQ ID NO: 968450 - RNA, 23 nt, Mycobacterium avium subsp. paratuberculosis
gcgccggcgguaugcccgggccg

SEQ ID NO: 968451 - RNA, 19 nt, Mycobacterium avium subsp. paratuberculosis
gcgccggcggugcggcggg

SEQ ID NO: 968452 - RNA, 17 nt, Mycobacterium avium subsp. paratuberculosis
gcgcccagcaaacccag

SEQ ID NO: 968453 - RNA, 16 nt, Mycobacterium avium subsp. paratuberculosis
gcgcccagccccagca

SEQ ID NO: 968454 - RNA, 16 nt, Mycobacterium avium subsp. paratuberculosis
gcgcccagcccgagca

SEQ ID NO: 968455 - RNA, 15 nt, Mycobacterium avium subsp. paratuberculosis
gcgcccagccgagcc

SEQ ID NO: 968456 - RNA, 14 nt, Mycobacterium avium subsp. paratuberculosis
gcgcccagcgagcu

SEQ ID NO: 968457 - RNA, 18 nt, Mycobacterium avium subsp. paratuberculosis
gcgcccaccuggaggcca

SEQ ID NO: 968458 - RNA, 16 nt, Mycobacterium avium subsp. paratuberculosis
gcgcccacccgcgccg

SEQ ID NO: 968459 - RNA, 20 nt, Mycobacterium avium subsp. paratuberculosis
gcgcccacccguuggcaggc

SEQ ID NO: 968460 - RNA, 18 nt, Mycobacterium avium subsp. paratuberculosis
gcgcccaccgcggcgcgc

SEQ ID NO: 968461 - RNA, 17 nt, Mycobacterium avium subsp. paratuberculosis
gcgccgccgccgcccac

SEQ ID NO: 968462 - RNA, 19 nt, Mycobacterium avium subsp. paratuberculosis
gcgccgccgaacagcagcg

SEQ ID NO: 968463 - RNA, 20 nt, Mycobacterium avium subsp. paratuberculosis
gcgccgccgaccgcccgcug

SEQ ID NO: 968464 - RNA, 13 nt, Mycobacterium avium subsp. paratuberculosis
gcgccgccgagcc

SEQ ID NO: 968465 - RNA, 14 nt, Mycobacterium avium subsp. paratuberculosis
gcgccgccgagccg

SEQ ID NO: 968466 - RNA, 20 nt, Mycobacterium avium subsp. paratuberculosis
gcgccgccgagccgcgggug

SEQ ID NO: 968467 - RNA, 21 nt, Mycobacterium avium subsp. paratuberculosis
gcgccgccgagccgcggguga

SEQ ID NO: 968468 - RNA, 20 nt, Mycobacterium avium subsp. paratuberculosis
gcgcccaggaacgcgccggc

SEQ ID NO: 968469 - RNA, 18 nt, Mycobacterium avium subsp. paratuberculosis
gcgccgccguucgccggc

SEQ ID NO: 968470 - RNA, 12 nt, Mycobacterium avium subsp. paratuberculosis
gcgccgcgcagc

SEQ ID NO: 968471 - RNA, 15 nt, Mycobacterium avium subsp. paratuberculosis
gcgccgccuccgggc

SEQ ID NO: 968472 - RNA, 20 nt, Mycobacterium avium subsp. paratuberculosis
gcgccgccuccgggcugccg

SEQ ID NO: 968473 - RNA, 14 nt, Mycobacterium avium subsp. paratuberculosis
gcgccgccggggcg

SEQ ID NO: 968474 - RNA, 21 nt, Mycobacterium avium subsp. paratuberculosis
gcgccgccgcgucgugccgag

SEQ ID NO: 968475 - RNA, 18 nt, Mycobacterium avium subsp. paratuberculosis
gcgcggcggucgcgcgcc

SEQ ID NO: 968476 - RNA, 22 nt, Mycobacterium avium subsp. paratuberculosis
gcgcggcggucgcgcgccggcg

SEQ ID NO: 968477 - RNA, 12 nt, Mycobacterium avium subsp. paratuberculosis
gcgcggcgguga

SEQ ID NO: 968478 - RNA, 14 nt, Mycobacterium avium subsp. paratuberculosis
gcgcggcggccagc

SEQ ID NO: 968479 - RNA, 23 nt, Mycobacterium avium subsp. paratuberculosis
gcgcggcuaguuggccggcuucu

SEQ ID NO: 968480 - RNA, 23 nt, Mycobacterium avium subsp. paratuberculosis
gcgcggcgucaggggugccagcc

SEQ ID NO: 968481 - RNA, 14 nt, Mycobacterium avium subsp. paratuberculosis
gcgcggcguccacc

SEQ ID NO: 968482 - RNA, 23 nt, Mycobacterium avium subsp. paratuberculosis
gcgcggcguccaccagcacgccg

SEQ ID NO: 968483 - RNA, 21 nt, Mycobacterium avium subsp. paratuberculosis
gcgcggcguucuccagcaccc

SEQ ID NO: 968484 - RNA, 22 nt, Mycobacterium avium subsp. paratuberculosis
gcgcgggguggcgccggccagc

SEQ ID NO: 968485 - RNA, 18 nt, Mycobacterium avium subsp. paratuberculosis
gcgcggggugucgcggcu

SEQ ID NO: 968486 - RNA, 19 nt, Mycobacterium avium subsp. paratuberculosis
gcgcggggugucgcggcug

SEQ ID NO: 968487 - RNA, 21 nt, Mycobacterium avium subsp. paratuberculosis
gcgcggggugucgcggcugcg

SEQ ID NO: 968488 - RNA, 20 nt, Mycobacterium avium subsp. paratuberculosis
gcgcggguucacccuggcga

SEQ ID NO: 968489 - RNA, 13 nt, Mycobacterium avium subsp. paratuberculosis
gcgcgggucgccg

SEQ ID NO: 968490 - RNA, 18 nt, Mycobacterium avium subsp. paratuberculosis
gcgcgggucggcgccggc

SEQ ID NO: 968491 - RNA, 22 nt, Mycobacterium avium subsp. paratuberculosis
gcgcgggucggcgccggccagc

SEQ ID NO: 968492 - RNA, 18 nt, Mycobacterium avium subsp. paratuberculosis
gcgcggguacggcggccg

SEQ ID NO: 968493 - RNA, 23 nt, Mycobacterium avium subsp. paratuberculosis
gcgcggguagacguucuccccgc

SEQ ID NO: 968494 - RNA, 22 nt, Mycobacterium avium subsp. paratuberculosis
gcgcgggggcggccugagccgc

SEQ ID NO: 968495 - RNA, 15 nt, Mycobacterium avium subsp. paratuberculosis
gcgcggugcucgccc

SEQ ID NO: 968496 - RNA, 17 nt, Mycobacterium avium subsp. paratuberculosis
gcgcggugcgccagcgc

SEQ ID NO: 968497 - RNA, 22 nt, Mycobacterium avium subsp. paratuberculosis
gcgcggugcgccgacagcugag

SEQ ID NO: 968498 - RNA, 22 nt, Mycobacterium avium subsp. paratuberculosis
gcgcggugcccggaacggcggg

SEQ ID NO: 968499 - RNA, 17 nt, Mycobacterium avium subsp. paratuberculosis
gcgcggugaugugcagg

SEQ ID NO: 968500 - RNA, 15 nt, Mycobacterium avium subsp. paratuberculosis
gcgcggugccgaccu

SEQ ID NO: 968501 - RNA, 17 nt, Mycobacterium avium subsp. paratuberculosis
gcgcggucagcgcgucc

SEQ ID NO: 968502 - RNA, 14 nt, Mycobacterium avium subsp. paratuberculosis
gcgcggucaucguc

SEQ ID NO: 968503 - RNA, 15 nt, Mycobacterium avium subsp. paratuberculosis
gcgcggucgcaggcc

SEQ ID NO: 968504 - RNA, 18 nt, Mycobacterium avium subsp. paratuberculosis
gcgcgguccacgguggcg

SEQ ID NO: 968505 - RNA, 13 nt, Mycobacterium avium subsp. paratuberculosis
gcgcgcgggcgcg

SEQ ID NO: 968506 - RNA, 16 nt, Mycobacterium avium subsp. paratuberculosis
gcgcgcgggcgcgcgc

SEQ ID NO: 968507 - RNA, 19 nt, Mycobacterium avium subsp. paratuberculosis
gcgcgcgggcgcgcgccgc

SEQ ID NO: 968508 - RNA, 12 nt, Mycobacterium avium subsp. paratuberculosis
gcgcgcgggcgu

SEQ ID NO: 968509 - RNA, 17 nt, Mycobacterium avium subsp. paratuberculosis
gcgcgcggcgcggagcc

SEQ ID NO: 968510 - RNA, 22 nt, Mycobacterium avium subsp. paratuberculosis
gcgcgcggcgcggagccggccg

SEQ ID NO: 968511 - RNA, 13 nt, Mycobacterium avium subsp. paratuberculosis
gcgcgcggcgacg

SEQ ID NO: 968512 - RNA, 13 nt, Mycobacterium avium subsp. paratuberculosis
gcgcgcggggccg

SEQ ID NO: 968513 - RNA, 17 nt, Mycobacterium avium subsp. paratuberculosis
gcgcgcggggccggcgc

SEQ ID NO: 968514 - RNA, 15 nt, Mycobacterium avium subsp. paratuberculosis
gcgcggccuccagcc

SEQ ID NO: 968515 - RNA, 17 nt, Mycobacterium avium subsp. paratuberculosis
gcgcggccuccagccgc

SEQ ID NO: 968516 - RNA, 12 nt, Mycobacterium avium subsp. paratuberculosis
gcgcggccggcg

SEQ ID NO: 968517 - RNA, 13 nt, Mycobacterium avium subsp. paratuberculosis
gcgcggccgggcg

SEQ ID NO: 968518 - RNA, 16 nt, Mycobacterium avium subsp. paratuberculosis
gcgcggccgggcgccc

SEQ ID NO: 968519 - RNA, 13 nt, Mycobacterium avium subsp. paratuberculosis
gcgcggccgggcu

SEQ ID NO: 968520 - RNA, 15 nt, Mycobacterium avium subsp. paratuberculosis
gcgcggccgggcucc

SEQ ID NO: 968521 - RNA, 12 nt, Mycobacterium avium subsp. paratuberculosis
gcgcggccgcga

SEQ ID NO: 968522 - RNA, 12 nt, Mycobacterium avium subsp. paratuberculosis
gcgcggccgccc

SEQ ID NO: 968523 - RNA, 15 nt, Mycobacterium avium subsp. paratuberculosis
gcgcggccgcccagc

SEQ ID NO: 968524 - RNA, 13 nt, Mycobacterium avium subsp. paratuberculosis
gcgcggcccgcgg

SEQ ID NO: 968525 - RNA, 15 nt, Mycobacterium avium subsp. paratuberculosis
gcgcggcccgcggcg

SEQ ID NO: 968526 - RNA, 15 nt, Mycobacterium avium subsp. paratuberculosis
gcgcggcccggcccg

SEQ ID NO: 968527 - RNA, 12 nt, Mycobacterium avium subsp. paratuberculosis
gcgcggcccguu

SEQ ID NO: 968528 - RNA, 14 nt, Mycobacterium avium subsp. paratuberculosis
gcgcgcgaccgcga

SEQ ID NO: 968529 - RNA, 14 nt, Mycobacterium avium subsp. paratuberculosis
gcgcgcgaucgccg

SEQ ID NO: 968530 - RNA, 20 nt, Mycobacterium avium subsp. paratuberculosis
gcgcgcgaucgguguccagc

SEQ ID NO: 968531 - RNA, 14 nt, Mycobacterium avium subsp. paratuberculosis
gcgcgcggccaccg

SEQ ID NO: 968532 - RNA, 13 nt, Mycobacterium avium subsp. paratuberculosis
gcgcgcgccgccc

SEQ ID NO: 968533 - RNA, 17 nt, Mycobacterium avium subsp. paratuberculosis
gcgcgcgccgcccccgc

SEQ ID NO: 968534 - RNA, 13 nt, Mycobacterium avium subsp. paratuberculosis
gcgcgcgacggcg

SEQ ID NO: 968535 - RNA, 20 nt, Mycobacterium avium subsp. paratuberculosis
gcgcgcgauggacagcagcc

SEQ ID NO: 968536 - RNA, 19 nt, Mycobacterium avium subsp. paratuberculosis
gcgcgccccggucccgccg

SEQ ID NO: 968537 - RNA, 18 nt, Mycobacterium avium subsp. paratuberculosis
gcgcgccgaccgcgagca

SEQ ID NO: 968538 - RNA, 21 nt, Mycobacterium avium subsp. paratuberculosis
gcgcgcccggaaagcgcgggc

SEQ ID NO: 968539 - RNA, 15 nt, Mycobacterium avium subsp. paratuberculosis
gcgcgcccggcaccg

SEQ ID NO: 968540 - RNA, 14 nt, Mycobacterium avium subsp. paratuberculosis
gcgcgcccgcggcc

SEQ ID NO: 968541 - RNA, 13 nt, Mycobacterium avium subsp. paratuberculosis
gcgcgcccgacgg

SEQ ID NO: 968542 - RNA, 13 nt, Mycobacterium avium subsp. paratuberculosis
gcgcgcccgagca

SEQ ID NO: 968543 - RNA, 23 nt, Mycobacterium avium subsp. paratuberculosis
gcgcgcccgagcauuucgcgcac

SEQ ID NO: 968544 - RNA, 18 nt, Mycobacterium avium subsp. paratuberculosis
gcgcgccccggcccggcg

SEQ ID NO: 968545 - RNA, 14 nt, Mycobacterium avium subsp. paratuberculosis
gcgcgccccagccc

SEQ ID NO: 968546 - RNA, 12 nt, Mycobacterium avium subsp. paratuberculosis
gcgcgcccaggc

SEQ ID NO: 968547 - RNA, 20 nt, Mycobacterium avium subsp. paratuberculosis
gcgcgaaaaaacggcggcgg

SEQ ID NO: 968548 - RNA, 18 nt, Mycobacterium avium subsp. paratuberculosis
gcgcgaaaaccagcaccg

SEQ ID NO: 968549 - RNA, 20 nt, Mycobacterium avium subsp. paratuberculosis
gcgccuuuugcacccgccau

SEQ ID NO: 968550 - RNA, 15 nt, Mycobacterium avium subsp. paratuberculosis
gcgcgaucgccggga

SEQ ID NO: 968551 - RNA, 20 nt, Mycobacterium avium subsp. paratuberculosis
gcgcgauccggggggcgggg

SEQ ID NO: 968552 - RNA, 13 nt, Mycobacterium avium subsp. paratuberculosis
gcgcgaucggcag

SEQ ID NO: 968553 - RNA, 23 nt, Mycobacterium avium subsp. paratuberculosis
gcgcgaaagcagcaacggcggcg

SEQ ID NO: 968554 - RNA, 16 nt, Mycobacterium avium subsp. paratuberculosis
gcgcgaaagcgcgagg

SEQ ID NO: 968555 - RNA, 14 nt, Mycobacterium avium subsp. paratuberculosis
gcgcgaaacccccg

SEQ ID NO: 968556 - RNA, 21 nt, Mycobacterium avium subsp. paratuberculosis
gcgcgauggcgugccggcgcu

SEQ ID NO: 968557 - RNA, 20 nt, Mycobacterium avium subsp. paratuberculosis
gcgcgcaacgaggcgguggu

SEQ ID NO: 968558 - RNA, 17 nt, Mycobacterium avium subsp. paratuberculosis
gcgcgaucgucgaccac

SEQ ID NO: 968559 - RNA, 14 nt, Mycobacterium avium subsp. paratuberculosis
gcgcgaugcggcuc

SEQ ID NO: 968560 - RNA, 14 nt, Mycobacterium avium subsp. paratuberculosis
gcgcgaugcgggcg

SEQ ID NO: 968561 - RNA, 14 nt, Mycobacterium avium subsp. paratuberculosis
gcgcgcacagcgcc

SEQ ID NO: 968562 - RNA, 15 nt, Mycobacterium avium subsp. paratuberculosis
gcgcgcacagcgcca

SEQ ID NO: 968563 - RNA, 22 nt, Mycobacterium avium subsp. paratuberculosis
gcgcgcaacucguccaccagcu

SEQ ID NO: 968564 - RNA, 16 nt, Mycobacterium avium subsp. paratuberculosis
gcgcgcagcaggcgcc

SEQ ID NO: 968565 - RNA, 13 nt, Mycobacterium avium subsp. paratuberculosis
gcgcgcacggcag

SEQ ID NO: 968566 - RNA, 21 nt, Mycobacterium avium subsp. paratuberculosis
gcgcgcagcaauugacgccga

SEQ ID NO: 968567 - RNA, 20 nt, Mycobacterium avium subsp. paratuberculosis
gcgcgcaccugaaccgcgca

SEQ ID NO: 968568 - RNA, 13 nt, Mycobacterium avium subsp. paratuberculosis
gcgcgcacgcgga

SEQ ID NO: 968569 - RNA, 12 nt, Mycobacterium avium subsp. paratuberculosis
gcgcgcacuucc

SEQ ID NO: 968570 - RNA, 18 nt, Mycobacterium avium subsp. paratuberculosis
gcgcgcagaacaccaccg

SEQ ID NO: 968571 - RNA, 16 nt, Mycobacterium avium subsp. paratuberculosis
gcgcgcaucgcgggcc

SEQ ID NO: 968572 - RNA, 19 nt, Mycobacterium avium subsp. paratuberculosis
gcgcgcccacccgcgccgg

SEQ ID NO: 968573 - RNA, 14 nt, Mycobacterium avium subsp. paratuberculosis
gcgcgcaggcuggc

SEQ ID NO: 968574 - RNA, 17 nt, Mycobacterium avium subsp. paratuberculosis
gcgcgcaguugcgcggc

SEQ ID NO: 968575 - RNA, 19 nt, Mycobacterium avium subsp. paratuberculosis
gcgcgcaucaccgagguca

SEQ ID NO: 968576 - RNA, 22 nt, Mycobacterium avium subsp. paratuberculosis
gcgcgcaucaccgaggucaccg

SEQ ID NO: 968577 - RNA, 18 nt, Mycobacterium avium subsp. paratuberculosis
gcgcgcagucgcaggccc

SEQ ID NO: 968578 - RNA, 16 nt, Mycobacterium avium subsp. paratuberculosis
gcgcgcaggcgcgcgg

SEQ ID NO: 968579 - RNA, 13 nt, Mycobacterium avium subsp. paratuberculosis
gcgcgcaggcgcu

SEQ ID NO: 968580 - RNA, 22 nt, Mycobacterium avium subsp. paratuberculosis
ggcaguccgccggagaccagca

SEQ ID NO: 968581 - RNA, 15 nt, Mycobacterium avium subsp. paratuberculosis
ggcaguccgcgccgg

SEQ ID NO: 968582 - RNA, 21 nt, Mycobacterium avium subsp. paratuberculosis
ggcaguccggacacggccagc

SEQ ID NO: 968583 - RNA, 15 nt, Mycobacterium avium subsp. paratuberculosis
ggcaguacgcgccgg

SEQ ID NO: 968584 - RNA, 19 nt, Mycobacterium avium subsp. paratuberculosis
ggcaguagcaucggggaug

SEQ ID NO: 968585 - RNA, 21 nt, Mycobacterium avium subsp. paratuberculosis
ggcaguagccgaucuccaccg

SEQ ID NO: 968586 - RNA, 22 nt, Mycobacterium avium subsp. paratuberculosis
ggcaguagugguccaccgccgc

SEQ ID NO: 968587 - RNA, 19 nt, Mycobacterium avium subsp. paratuberculosis
ggcaguaucuuguucgccg

SEQ ID NO: 968588 - RNA, 15 nt, Mycobacterium avium subsp. paratuberculosis
ggcaggcggcgcgcc

SEQ ID NO: 968589 - RNA, 20 nt, Mycobacterium avium subsp. paratuberculosis
ggcaggcgauggcgucggcc

SEQ ID NO: 968590 - RNA, 15 nt, Mycobacterium avium subsp. paratuberculosis
ggcaucgcgugccga

SEQ ID NO: 968591 - RNA, 19 nt, Mycobacterium avium subsp. paratuberculosis
ggcaucgaggaccggcgcc

SEQ ID NO: 968592 - RNA, 19 nt, Mycobacterium avium subsp. paratuberculosis
ggcauggacacgcccuggu

SEQ ID NO: 968593 - RNA, 14 nt, Mycobacterium avium subsp. paratuberculosis
ggcaugccgcccgg

SEQ ID NO: 968594 - RNA, 15 nt, Mycobacterium avium subsp. paratuberculosis
ggcaugccgggccag

SEQ ID NO: 968595 - RNA, 16 nt, Mycobacterium avium subsp. paratuberculosis
ggcaugccgggccagc

SEQ ID NO: 968596 - RNA, 19 nt, Mycobacterium avium subsp. paratuberculosis
ggcaugccgggccagccgg

SEQ ID NO: 968597 - RNA, 16 nt, Mycobacterium avium subsp. paratuberculosis
ggcaugccgucggcgc

SEQ ID NO: 968598 - RNA, 14 nt, Mycobacterium avium subsp. paratuberculosis
ggcaugggaucagc

SEQ ID NO: 968599 - RNA, 15 nt, Mycobacterium avium subsp. paratuberculosis
ggcaugggaucagca

SEQ ID NO: 968600 - RNA, 15 nt, Mycobacterium avium subsp. paratuberculosis
ggcaugguucccccc

SEQ ID NO: 968601 - RNA, 22 nt, Mycobacterium avium subsp. paratuberculosis
ggcagcggugucaccgacgcca

SEQ ID NO: 968602 - RNA, 16 nt, Mycobacterium avium subsp. paratuberculosis
ggcagcggugccgccc

SEQ ID NO: 968603 - RNA, 18 nt, Mycobacterium avium subsp. paratuberculosis
ggcagcggugccgcccgg

SEQ ID NO: 968604 - RNA, 21 nt, Mycobacterium avium subsp. paratuberculosis
ggcagcgucgccagccgccgg

SEQ ID NO: 968605 - RNA, 22 nt, Mycobacterium avium subsp. paratuberculosis
ggcagcggcugcugcagcgccc

SEQ ID NO: 968606 - RNA, 16 nt, Mycobacterium avium subsp. paratuberculosis
ggcagcgcggccagca

SEQ ID NO: 968607 - RNA, 14 nt, Mycobacterium avium subsp. paratuberculosis
ggcagcgcucgucg

SEQ ID NO: 968608 - RNA, 20 nt, Mycobacterium avium subsp. paratuberculosis
ggcagcggacccggucggcc

SEQ ID NO: 968609 - RNA, 23 nt, Mycobacterium avium subsp. paratuberculosis
ggcagcggacccggucggccgcg

SEQ ID NO: 968610 - RNA, 20 nt, Mycobacterium avium subsp. paratuberculosis
ggcagccgucgaugccggcg

SEQ ID NO: 968611 - RNA, 23 nt, Mycobacterium avium subsp. paratuberculosis
ggcagccgucgaugccggcgacg

SEQ ID NO: 968612 - RNA, 13 nt, Mycobacterium avium subsp. paratuberculosis
ggcagccggccgg

SEQ ID NO: 968613 - RNA, 19 nt, Mycobacterium avium subsp. paratuberculosis
ggcagccggcgcccgcagg

SEQ ID NO: 968614 - RNA, 18 nt, Mycobacterium avium subsp. paratuberculosis
ggcagccggggugcccgg

SEQ ID NO: 968615 - RNA, 20 nt, Mycobacterium avium subsp. paratuberculosis
ggcagccggggugcccgggc

SEQ ID NO: 968616 - RNA, 17 nt, Mycobacterium avium subsp. paratuberculosis
ggcagcgaaucgggguc

SEQ ID NO: 968617 - RNA, 18 nt, Mycobacterium avium subsp. paratuberculosis
ggcagcgagcacagcggc

SEQ ID NO: 968618 - RNA, 21 nt, Mycobacterium avium subsp. paratuberculosis
ggcagcgagcacagcggcgga

SEQ ID NO: 968619 - RNA, 23 nt, Mycobacterium avium subsp. paratuberculosis
ggcagcgcgaccagcccggccgc

SEQ ID NO: 968620 - RNA, 15 nt, Mycobacterium avium subsp. paratuberculosis
ggcagcgcgacuggg

SEQ ID NO: 968621 - RNA, 19 nt, Mycobacterium avium subsp. paratuberculosis
ggcagcgcgauccgggggg

SEQ ID NO: 968622 - RNA, 21 nt, Mycobacterium avium subsp. paratuberculosis
ggcagcgcgauccggggggcg

SEQ ID NO: 968623 - RNA, 13 nt, Mycobacterium avium subsp. paratuberculosis
ggcagcgccacca

SEQ ID NO: 968624 - RNA, 16 nt, Mycobacterium avium subsp. paratuberculosis
ggcagcgccagcggga

SEQ ID NO: 968625 - RNA, 23 nt, Mycobacterium avium subsp. paratuberculosis
ggcagcgccagcgggauacccau

SEQ ID NO: 968626 - RNA, 15 nt, Mycobacterium avium subsp. paratuberculosis
ggcagcgccucgagc

SEQ ID NO: 968627 - RNA, 17 nt, Mycobacterium avium subsp. paratuberculosis
ggcagcgccucggcggg

SEQ ID NO: 968628 - RNA, 18 nt, Mycobacterium avium subsp. paratuberculosis
ggcagcgccucggcgggc

SEQ ID NO: 968629 - RNA, 14 nt, Mycobacterium avium subsp. paratuberculosis
ggcagcucggcggc

SEQ ID NO: 968630 - RNA, 15 nt, Mycobacterium avium subsp. paratuberculosis
ggcagcucgguggcc

SEQ ID NO: 968631 - RNA, 16 nt, Mycobacterium avium subsp. paratuberculosis
ggcagcucgucggcgc

SEQ ID NO: 968632 - RNA, 12 nt, Mycobacterium avium subsp. paratuberculosis
ggcaggaaagcg

SEQ ID NO: 968633 - RNA, 23 nt, Mycobacterium avium subsp. paratuberculosis
ggcaggaagcgaauccggguguc

SEQ ID NO: 968634 - RNA, 15 nt, Mycobacterium avium subsp. paratuberculosis
ggcaggacgggggcc

SEQ ID NO: 968635 - RNA, 15 nt, Mycobacterium avium subsp. paratuberculosis
ggcaggcacgagcga

SEQ ID NO: 968636 - RNA, 16 nt, Mycobacterium avium subsp. paratuberculosis
ggcaggccgcggccgu

SEQ ID NO: 968637 - RNA, 20 nt, Mycobacterium avium subsp. paratuberculosis
ggcagcauucgccggggucg

SEQ ID NO: 968638 - RNA, 16 nt, Mycobacterium avium subsp. paratuberculosis
ggcagccacgcgcaac

SEQ ID NO: 968639 - RNA, 20 nt, Mycobacterium avium subsp. paratuberculosis
ggcagccacggcagcugcag

SEQ ID NO: 968640 - RNA, 20 nt, Mycobacterium avium subsp. paratuberculosis
ggcagccagccuggcggcga

SEQ ID NO: 968641 - RNA, 13 nt, Mycobacterium avium subsp. paratuberculosis
ggcagccagcccg

SEQ ID NO: 968642 - RNA, 19 nt, Mycobacterium avium subsp. paratuberculosis
ggcagcccgccgaccaccu

SEQ ID NO: 968643 - RNA, 20 nt, Mycobacterium avium subsp. paratuberculosis
ggcagccgcacaccgcggcg

SEQ ID NO: 968644 - RNA, 22 nt, Mycobacterium avium subsp. paratuberculosis
ggcagccgcacaccgcggcggc

SEQ ID NO: 968645 - RNA, 14 nt, Mycobacterium avium subsp. paratuberculosis
ggcagccccgucgg

SEQ ID NO: 968646 - RNA, 13 nt, Mycobacterium avium subsp. paratuberculosis
ggcagccgcgccc

SEQ ID NO: 968647 - RNA, 18 nt, Mycobacterium avium subsp. paratuberculosis
ggcagccgcuuggccggg

SEQ ID NO: 968648 - RNA, 20 nt, Mycobacterium avium subsp. paratuberculosis
ggcagccgcuuggccgggcg

SEQ ID NO: 968649 - RNA, 14 nt, Mycobacterium avium subsp. paratuberculosis
ggcagccggccacc

SEQ ID NO: 968650 - RNA, 15 nt, Mycobacterium avium subsp. paratuberculosis
ggcagccggccaccu

SEQ ID NO: 968651 - RNA, 15 nt, Mycobacterium avium subsp. paratuberculosis
ggcagcaccagcggc

SEQ ID NO: 968652 - RNA, 17 nt, Mycobacterium avium subsp. paratuberculosis
ggcagcaccagcggcac

SEQ ID NO: 968653 - RNA, 15 nt, Mycobacterium avium subsp. paratuberculosis
ggcagcaccggcagc

SEQ ID NO: 968654 - RNA, 16 nt, Mycobacterium avium subsp. paratuberculosis
ggcagcagcaccagcg

SEQ ID NO: 968655 - RNA, 18 nt, Mycobacterium avium subsp. paratuberculosis
ggcagcagggugccgccg

SEQ ID NO: 968656 - RNA, 12 nt, Mycobacterium avium subsp. paratuberculosis
ggcagcaggugc

SEQ ID NO: 968657 - RNA, 13 nt, Mycobacterium avium subsp. paratuberculosis
ggcagcagcgcgu

SEQ ID NO: 968658 - RNA, 17 nt, Mycobacterium avium subsp. paratuberculosis
ggcagcaaccggcggcu

SEQ ID NO: 968659 - RNA, 20 nt, Mycobacterium avium subsp. paratuberculosis
ggcagcaaccggcggcuggg

SEQ ID NO: 968660 - RNA, 15 nt, Mycobacterium avium subsp. paratuberculosis
ggcagcaaccggguc

SEQ ID NO: 968661 - RNA, 14 nt, Mycobacterium avium subsp. paratuberculosis
ggcagaucgcggcc

SEQ ID NO: 968662 - RNA, 15 nt, Mycobacterium avium subsp. paratuberculosis
ggcagaucgcggccc

SEQ ID NO: 968663 - RNA, 18 nt, Mycobacterium avium subsp. paratuberculosis
ggcagauggucgccgacg

SEQ ID NO: 968664 - RNA, 22 nt, Mycobacterium avium subsp. paratuberculosis
ggcacugcccgcaucgcacaga

SEQ ID NO: 968665 - RNA, 14 nt, Mycobacterium avium subsp. paratuberculosis
ggcacucgcccagg

SEQ ID NO: 968666 - RNA, 16 nt, Mycobacterium avium subsp. paratuberculosis
ggcacguugcccagga

SEQ ID NO: 968667 - RNA, 14 nt, Mycobacterium avium subsp. paratuberculosis
ggcacuaccgccuc

SEQ ID NO: 968668 - RNA, 15 nt, Mycobacterium avium subsp. paratuberculosis
ggcagaccgguggcg

SEQ ID NO: 968669 - RNA, 22 nt, Mycobacterium avium subsp. paratuberculosis
ggcagaccgugugccagcccgu

SEQ ID NO: 968670 - RNA, 17 nt, Mycobacterium avium subsp. paratuberculosis
ggcagacccccagcagc

SEQ ID NO: 968671 - RNA, 15 nt, Mycobacterium avium subsp. paratuberculosis
ggcagaccaggacca

SEQ ID NO: 968672 - RNA, 21 nt, Mycobacterium avium subsp. paratuberculosis
ggcagaccaggaccagguugg

SEQ ID NO: 968673 - RNA, 15 nt, Mycobacterium avium subsp. paratuberculosis
ggcagacccagcagc

SEQ ID NO: 968674 - RNA, 22 nt, Mycobacterium avium subsp. paratuberculosis
ggcaccaacccgaucggcccgg

SEQ ID NO: 968675 - RNA, 12 nt, Mycobacterium avium subsp. paratuberculosis
ggcaccagcagc

SEQ ID NO: 968676 - RNA, 22 nt, Mycobacterium avium subsp. paratuberculosis
ggcaccagcgacagcacccgcu

SEQ ID NO: 968677 - RNA, 13 nt, Mycobacterium avium subsp. paratuberculosis
ggcaccagcgcga

SEQ ID NO: 968678 - RNA, 20 nt, Mycobacterium avium subsp. paratuberculosis
ggcaccagguaccggcgggc

SEQ ID NO: 968679 - RNA, 21 nt, Mycobacterium avium subsp. paratuberculosis
ggcaccagcggaucggcgguc

SEQ ID NO: 968680 - RNA, 16 nt, Mycobacterium avium subsp. paratuberculosis
ggcaccaccacggugg

SEQ ID NO: 968681 - RNA, 14 nt, Mycobacterium avium subsp. paratuberculosis
ggcaccaccagcgu

SEQ ID NO: 968682 - RNA, 15 nt, Mycobacterium avium subsp. paratuberculosis
ggcaccacggcggca

SEQ ID NO: 968683 - RNA, 17 nt, Mycobacterium avium subsp. paratuberculosis
ggcaccagcagccagcc

SEQ ID NO: 968684 - RNA, 22 nt, Mycobacterium avium subsp. paratuberculosis
ggcaccagcagccagcccagcc

SEQ ID NO: 968685 - RNA, 17 nt, Mycobacterium avium subsp. paratuberculosis
ggcaccagcagccgcag

SEQ ID NO: 968686 - RNA, 13 nt, Mycobacterium avium subsp. paratuberculosis
ggcaccagcaggc

SEQ ID NO: 968687 - RNA, 23 nt, Mycobacterium avium subsp. paratuberculosis
ggcacagcagggcaccgacggcc

SEQ ID NO: 968688 - RNA, 21 nt, Mycobacterium avium subsp. paratuberculosis
ggcacaccggugcucuccugc

SEQ ID NO: 968689 - RNA, 21 nt, Mycobacterium avium subsp. paratuberculosis
ggcaccgcggucugcgccagc

SEQ ID NO: 968690 - RNA, 22 nt, Mycobacterium avium subsp. paratuberculosis
ggcaccgcggucugcgccagcu

SEQ ID NO: 968691 - RNA, 22 nt, Mycobacterium avium subsp. paratuberculosis
ggcaccgccgcgcggccgggcu

SEQ ID NO: 968692 - RNA, 19 nt, Mycobacterium avium subsp. paratuberculosis
ggcaccgccggcggccucc

SEQ ID NO: 968693 - RNA, 20 nt, Mycobacterium avium subsp. paratuberculosis
ggcaccgccggcggccuccg

SEQ ID NO: 968694 - RNA, 19 nt, Mycobacterium avium subsp. paratuberculosis
ggcaccagcggcaucgccg

SEQ ID NO: 968695 - RNA, 23 nt, Mycobacterium avium subsp. paratuberculosis
ggcaccgccaucggcaucgcgcg

SEQ ID NO: 968696 - RNA, 16 nt, Mycobacterium avium subsp. paratuberculosis
ggcaccgcccccgcgg

SEQ ID NO: 968697 - RNA, 12 nt, Mycobacterium avium subsp. paratuberculosis
ggcaccgcccgg

SEQ ID NO: 968698 - RNA, 20 nt, Mycobacterium avium subsp. paratuberculosis
ggcaccgauaguagccagca

SEQ ID NO: 968699 - RNA, 22 nt, Mycobacterium avium subsp. paratuberculosis
ggcaccgauaguagccagcauc

SEQ ID NO: 968700 - RNA, 22 nt, Mycobacterium avium subsp. paratuberculosis
ggcaccgacgaggagaccuccu

SEQ ID NO: 968701 - RNA, 19 nt, Mycobacterium avium subsp. paratuberculosis
ggcaccgacggagccgagc

SEQ ID NO: 968702 - RNA, 20 nt, Mycobacterium avium subsp. paratuberculosis
ggcaccgacggagccgagca

SEQ ID NO: 968703 - RNA, 18 nt, Mycobacterium avium subsp. paratuberculosis
ggcaccagucgcgcagcg

SEQ ID NO: 968704 - RNA, 19 nt, Mycobacterium avium subsp. paratuberculosis
ggcacgacggucagcacgc

SEQ ID NO: 968705 - RNA, 16 nt, Mycobacterium avium subsp. paratuberculosis
ggcacgaucggcagcg

SEQ ID NO: 968706 - RNA, 19 nt, Mycobacterium avium subsp. paratuberculosis
ggcacgaugaacuccucga

SEQ ID NO: 968707 - RNA, 15 nt, Mycobacterium avium subsp. paratuberculosis
ggcacgauggcgcgg

SEQ ID NO: 968708 - RNA, 16 nt, Mycobacterium avium subsp. paratuberculosis
ggcacgcagcggcguc

SEQ ID NO: 968709 - RNA, 19 nt, Mycobacterium avium subsp. paratuberculosis
ggcacgucgacgcccugcc

SEQ ID NO: 968710 - RNA, 20 nt, Mycobacterium avium subsp. paratuberculosis
ggcacgucgagcuccucggc

SEQ ID NO: 968711 - RNA, 15 nt, Mycobacterium avium subsp. paratuberculosis
ggcacgucggccacg

SEQ ID NO: 968712 - RNA, 19 nt, Mycobacterium avium subsp. paratuberculosis
ggcacgucggccacgccgg

SEQ ID NO: 968713 - RNA, 14 nt, Mycobacterium avium subsp. paratuberculosis
ggcacgccggggcc

SEQ ID NO: 968714 - RNA, 20 nt, Mycobacterium avium subsp. paratuberculosis
ggcacgguuggccggcccgc

SEQ ID NO: 968715 - RNA, 20 nt, Mycobacterium avium subsp. paratuberculosis
ggcacgccgcucgucgggca

SEQ ID NO: 968716 - RNA, 18 nt, Mycobacterium avium subsp. paratuberculosis
ggccaccacggcaccgcc

SEQ ID NO: 968717 - RNA, 21 nt, Mycobacterium avium subsp. paratuberculosis
ggcaugucgguggacagcgcg

SEQ ID NO: 968718 - RNA, 14 nt, Mycobacterium avium subsp. paratuberculosis
ggccaccagcgcgg

SEQ ID NO: 968719 - RNA, 21 nt, Mycobacterium avium subsp. paratuberculosis
ggccaccagcgcggccaccac

SEQ ID NO: 968720 - RNA, 13 nt, Mycobacterium avium subsp. paratuberculosis
ggccaccagcggc

SEQ ID NO: 968721 - RNA, 23 nt, Mycobacterium avium subsp. paratuberculosis
ggccaccagggucucgcgcagca

SEQ ID NO: 968722 - RNA, 17 nt, Mycobacterium avium subsp. paratuberculosis
ggccaccaucaggccgg

SEQ ID NO: 968723 - RNA, 16 nt, Mycobacterium avium subsp. paratuberculosis
ggccaccaugggcggg

SEQ ID NO: 968724 - RNA, 22 nt, Mycobacterium avium subsp. paratuberculosis
ggccaccaugucggcgucgccg

SEQ ID NO: 968725 - RNA, 18 nt, Mycobacterium avium subsp. paratuberculosis
ggccacccgggcgccggc

SEQ ID NO: 968726 - RNA, 16 nt, Mycobacterium avium subsp. paratuberculosis
ggccaccgcaucgccg

SEQ ID NO: 968727 - RNA, 22 nt, Mycobacterium avium subsp. paratuberculosis
ggccaccgcaucgccgagggcg

SEQ ID NO: 968728 - RNA, 20 nt, Mycobacterium avium subsp. paratuberculosis
ggccaccgccgccagcagca

SEQ ID NO: 968729 - RNA, 13 nt, Mycobacterium avium subsp. paratuberculosis
ggccacgcccacg

SEQ ID NO: 968730 - RNA, 18 nt, Mycobacterium avium subsp. paratuberculosis
ggccaccgggucgccaag

SEQ ID NO: 968731 - RNA, 13 nt, Mycobacterium avium subsp. paratuberculosis
ggccaccggcgcc

SEQ ID NO: 968732 - RNA, 12 nt, Mycobacterium avium subsp. paratuberculosis
ggccaccgcguc

SEQ ID NO: 968733 - RNA, 17 nt, Mycobacterium avium subsp. paratuberculosis
ggccaccgcguccgcgg

SEQ ID NO: 968734 - RNA, 17 nt, Mycobacterium avium subsp. paratuberculosis
ggccaccgcgacgcugc

SEQ ID NO: 968735 - RNA, 19 nt, Mycobacterium avium subsp. paratuberculosis
ggccaccgcgacgcugccg

SEQ ID NO: 968736 - RNA, 12 nt, Mycobacterium avium subsp. paratuberculosis
ggccaccgcgcg

SEQ ID NO: 968737 - RNA, 18 nt, Mycobacterium avium subsp. paratuberculosis
ggccaccgcgcgcugccg

SEQ ID NO: 968738 - RNA, 15 nt, Mycobacterium avium subsp. paratuberculosis
ggccaccgcggccag

SEQ ID NO: 968739 - RNA, 17 nt, Mycobacterium avium subsp. paratuberculosis
ggccaccgcggccagcu

SEQ ID NO: 968740 - RNA, 19 nt, Mycobacterium avium subsp. paratuberculosis
ggccaccgcggccagcugc

SEQ ID NO: 968741 - RNA, 19 nt, Mycobacterium avium subsp. paratuberculosis
ggccagcaaccgccguggc

SEQ ID NO: 968742 - RNA, 19 nt, Mycobacterium avium subsp. paratuberculosis
ggccagcaacaccagcugg

SEQ ID NO: 968743 - RNA, 17 nt, Mycobacterium avium subsp. paratuberculosis
ggccagcaacagcagcg

SEQ ID NO: 968744 - RNA, 20 nt, Mycobacterium avium subsp. paratuberculosis
ggccagcaccaccgcgagcg

SEQ ID NO: 968745 - RNA, 16 nt, Mycobacterium avium subsp. paratuberculosis
ggccagcaccagcagc

SEQ ID NO: 968746 - RNA, 19 nt, Mycobacterium avium subsp. paratuberculosis
ggccagcaccagcagccgg

SEQ ID NO: 968747 - RNA, 15 nt, Mycobacterium avium subsp. paratuberculosis
ggccagcaccagcgc

SEQ ID NO: 968748 - RNA, 20 nt, Mycobacterium avium subsp. paratuberculosis
ggccagcaccagcgcgcggg

SEQ ID NO: 968749 - RNA, 17 nt, Mycobacterium avium subsp. paratuberculosis
ggccagcaccaggaagg

SEQ ID NO: 968750 - RNA, 18 nt, Mycobacterium avium subsp. paratuberculosis
ggccagcacccgcucgcg

SEQ ID NO: 968751 - RNA, 23 nt, Mycobacterium avium subsp. paratuberculosis
ggccagcacccgcucgcgggccc

SEQ ID NO: 968752 - RNA, 22 nt, Mycobacterium avium subsp. paratuberculosis
ggccagcacccgcugauccagc

SEQ ID NO: 968753 - RNA, 11 nt, Mycobacterium avium subsp. paratuberculosis
ggccagcaccg

SEQ ID NO: 968754 - RNA, 13 nt, Mycobacterium avium subsp. paratuberculosis
ggccagcaccgcg

SEQ ID NO: 968755 - RNA, 16 nt, Mycobacterium avium subsp. paratuberculosis
ggccagcaccgcggcg

SEQ ID NO: 968756 - RNA, 23 nt, Mycobacterium avium subsp. paratuberculosis
ggccagcaccgcggcgaucgccg

SEQ ID NO: 968757 - RNA, 18 nt, Mycobacterium avium subsp. paratuberculosis
ggccagccagccgcccag

SEQ ID NO: 968758 - RNA, 19 nt, Mycobacterium avium subsp. paratuberculosis
ggccagccagccgcccagc

SEQ ID NO: 968759 - RNA, 18 nt, Mycobacterium avium subsp. paratuberculosis
ggccagccacuccagggu

SEQ ID NO: 968760 - RNA, 23 nt, Mycobacterium avium subsp. paratuberculosis
ggccagcaguucguccacgcugg

SEQ ID NO: 968761 - RNA, 22 nt, Mycobacterium avium subsp. paratuberculosis
ggccagcagguagaagccgcga

SEQ ID NO: 968762 - RNA, 14 nt, Mycobacterium avium subsp. paratuberculosis
ggccagcaggucga

SEQ ID NO: 968763 - RNA, 22 nt, Mycobacterium avium subsp. paratuberculosis
ggccagcaggucgaaggcggcc

SEQ ID NO: 968764 - RNA, 22 nt, Mycobacterium avium subsp. paratuberculosis
ggccagcagucgugacgcggcg

SEQ ID NO: 968765 - RNA, 20 nt, Mycobacterium avium subsp. paratuberculosis
ggccagcagugccaccacca

SEQ ID NO: 968766 - RNA, 19 nt, Mycobacterium avium subsp. paratuberculosis
ggccacgcuggcguccagg

SEQ ID NO: 968767 - RNA, 19 nt, Mycobacterium avium subsp. paratuberculosis
ggccacgcccuggccgccg

SEQ ID NO: 968768 - RNA, 14 nt, Mycobacterium avium subsp. paratuberculosis
ggccacgcucgcca

SEQ ID NO: 968769 - RNA, 23 nt, Mycobacterium avium subsp. paratuberculosis
ggccacgcucgggccggcgccga

SEQ ID NO: 968770 - RNA, 16 nt, Mycobacterium avium subsp. paratuberculosis
ggccagaucggccagg

SEQ ID NO: 968771 - RNA, 17 nt, Mycobacterium avium subsp. paratuberculosis
ggccagaucggccaggu

SEQ ID NO: 968772 - RNA, 17 nt, Mycobacterium avium subsp. paratuberculosis
ggccagauacuccucgg

SEQ ID NO: 968773 - RNA, 22 nt, Mycobacterium avium subsp. paratuberculosis
ggccaucagcccggcguccugc

SEQ ID NO: 968774 - RNA, 15 nt, Mycobacterium avium subsp. paratuberculosis
ggccaucagccgccg

SEQ ID NO: 968775 - RNA, 17 nt, Mycobacterium avium subsp. paratuberculosis
ggccaucagccgccguc

SEQ ID NO: 968776 - RNA, 22 nt, Mycobacterium avium subsp. paratuberculosis
ggccaugccucuucggcgcgcc

SEQ ID NO: 968777 - RNA, 23 nt, Mycobacterium avium subsp. paratuberculosis
ggccaugccucuucggcgcgccg

SEQ ID NO: 968778 - RNA, 16 nt, Mycobacterium avium subsp. paratuberculosis
ggccaucaccuccuug

SEQ ID NO: 968779 - RNA, 17 nt, Mycobacterium avium subsp. paratuberculosis
ggccaucacggugccga

SEQ ID NO: 968780 - RNA, 14 nt, Mycobacterium avium subsp. paratuberculosis
ggccaggucgcuga

SEQ ID NO: 968781 - RNA, 16 nt, Mycobacterium avium subsp. paratuberculosis
ggccaggugcacgccg

SEQ ID NO: 968782 - RNA, 14 nt, Mycobacterium avium subsp. paratuberculosis
ggccaggucgccgc

SEQ ID NO: 968783 - RNA, 14 nt, Mycobacterium avium subsp. paratuberculosis
ggccaggucgagcg

SEQ ID NO: 968784 - RNA, 20 nt, Mycobacterium avium subsp. paratuberculosis
ggccagccccgggaaccagc

SEQ ID NO: 968785 - RNA, 22 nt, Mycobacterium avium subsp. paratuberculosis
ggccagcgccgcgcgcgcggcc

SEQ ID NO: 968786 - RNA, 19 nt, Mycobacterium avium subsp. paratuberculosis
ggccagcgccuccagccgc

SEQ ID NO: 968787 - RNA, 17 nt, Mycobacterium avium subsp. paratuberculosis
ggccagcgccuucucca

SEQ ID NO: 968788 - RNA, 23 nt, Mycobacterium avium subsp. paratuberculosis
ggccagcgccuucuccagcuccu

SEQ ID NO: 968789 - RNA, 15 nt, Mycobacterium avium subsp. paratuberculosis
ggccagcgcgcggcc

SEQ ID NO: 968790 - RNA, 23 nt, Mycobacterium avium subsp. paratuberculosis
ggccagcgcgcgggcgcgcgccg

SEQ ID NO: 968791 - RNA, 19 nt, Mycobacterium avium subsp. paratuberculosis
ggccagcgcgcgcagcgcu

SEQ ID NO: 968792 - RNA, 16 nt, Mycobacterium avium subsp. paratuberculosis
ggccagcgcgacggcc

SEQ ID NO: 968793 - RNA, 13 nt, Mycobacterium avium subsp. paratuberculosis
ggccagcgcgccg

SEQ ID NO: 968794 - RNA, 22 nt, Mycobacterium avium subsp. paratuberculosis
ggccagcucggcguggucgagg

SEQ ID NO: 968795 - RNA, 17 nt, Mycobacterium avium subsp. paratuberculosis
ggccagcucggucgcgg

SEQ ID NO: 968796 - RNA, 13 nt, Mycobacterium avium subsp. paratuberculosis
ggccagcucgucg

SEQ ID NO: 968797 - RNA, 19 nt, Mycobacterium avium subsp. paratuberculosis
ggccagcugcaccggggcc

SEQ ID NO: 968798 - RNA, 16 nt, Mycobacterium avium subsp. paratuberculosis
ggccagcugcccgccg

SEQ ID NO: 968799 - RNA, 12 nt, Mycobacterium avium subsp. paratuberculosis
ggccagcugcgu

SEQ ID NO: 968800 - RNA, 14 nt, Mycobacterium avium subsp. paratuberculosis
ggccagcggcagcg

SEQ ID NO: 968801 - RNA, 23 nt, Mycobacterium avium subsp. paratuberculosis
ggccagcggcagcgacagcgcgu

SEQ ID NO: 968802 - RNA, 16 nt, Mycobacterium avium subsp. paratuberculosis
ggccagcggcagcggc

SEQ ID NO: 968803 - RNA, 21 nt, Mycobacterium avium subsp. paratuberculosis
ggccagcgcggugugcggcgg

SEQ ID NO: 968804 - RNA, 20 nt, Mycobacterium avium subsp. paratuberculosis
ggccagcgcgucggccagca

SEQ ID NO: 968805 - RNA, 23 nt, Mycobacterium avium subsp. paratuberculosis
ggccagcgcgucggccagcacca

SEQ ID NO: 968806 - RNA, 13 nt, Mycobacterium avium subsp. paratuberculosis
ggccagcgcggcc

SEQ ID NO: 968807 - RNA, 12 nt, Mycobacterium avium subsp. paratuberculosis
ggccagcgcggc

SEQ ID NO: 968808 - RNA, 12 nt, Mycobacterium avium subsp. paratuberculosis
ggccagggugac

SEQ ID NO: 968809 - RNA, 14 nt, Mycobacterium avium subsp. paratuberculosis
ggccagggugccga

SEQ ID NO: 968810 - RNA, 17 nt, Mycobacterium avium subsp. paratuberculosis
ggccagggugucccagc

SEQ ID NO: 968811 - RNA, 13 nt, Mycobacterium avium subsp. paratuberculosis
ggccagggcgugg

SEQ ID NO: 968812 - RNA, 15 nt, Mycobacterium avium subsp. paratuberculosis
ggccagggcggcgcc

SEQ ID NO: 968813 - RNA, 12 nt, Mycobacterium avium subsp. paratuberculosis
ggccagggcggc

SEQ ID NO: 968814 - RNA, 14 nt, Mycobacterium avium subsp. paratuberculosis
ggccagggcgagga

SEQ ID NO: 968815 - RNA, 18 nt, Mycobacterium avium subsp. paratuberculosis
ggccaggaucucgucggg

SEQ ID NO: 968816 - RNA, 21 nt, Mycobacterium avium subsp. paratuberculosis
ggccaggaucuugucggcggc

SEQ ID NO: 968817 - RNA, 20 nt, Mycobacterium avium subsp. paratuberculosis
ggccaggaugaccgcccagg

SEQ ID NO: 968818 - RNA, 23 nt, Mycobacterium avium subsp. paratuberculosis
ggccaggauggagcugaccuggc

SEQ ID NO: 968819 - RNA, 18 nt, Mycobacterium avium subsp. paratuberculosis
ggccagcuuuccggccgc

SEQ ID NO: 968820 - RNA, 20 nt, Mycobacterium avium subsp. paratuberculosis
ggccagcuucaccggucggg

SEQ ID NO: 968821 - RNA, 13 nt, Mycobacterium avium subsp. paratuberculosis
ggccagcugcucg

SEQ ID NO: 968822 - RNA, 13 nt, Mycobacterium avium subsp. paratuberculosis
ggcccaucgcggu

SEQ ID NO: 968823 - RNA, 15 nt, Mycobacterium avium subsp. paratuberculosis
ggcccaucaccagcg

SEQ ID NO: 968824 - RNA, 17 nt, Mycobacterium avium subsp. paratuberculosis
ggcccaucaccagcggc

SEQ ID NO: 968825 - RNA, 20 nt, Mycobacterium avium subsp. paratuberculosis
ggcccaucaccagcggcugc

SEQ ID NO: 968826 - RNA, 21 nt, Mycobacterium avium subsp. paratuberculosis
ggcccaucaccggaccggcca

SEQ ID NO: 968827 - RNA, 18 nt, Mycobacterium avium subsp. paratuberculosis
ggcccagggcgcucugga

SEQ ID NO: 968828 - RNA, 23 nt, Mycobacterium avium subsp. paratuberculosis
ggcccaggcacagcgaaagcgcu

SEQ ID NO: 968829 - RNA, 17 nt, Mycobacterium avium subsp. paratuberculosis
ggcccaggcagaccccc

SEQ ID NO: 968830 - RNA, 12 nt, Mycobacterium avium subsp. paratuberculosis
ggcccaggcagu

SEQ ID NO: 968831 - RNA, 18 nt, Mycobacterium avium subsp. paratuberculosis
ggcccaggcaguagccga

SEQ ID NO: 968832 - RNA, 17 nt, Mycobacterium avium subsp. paratuberculosis
ggcccaggccggcggug

SEQ ID NO: 968833 - RNA, 17 nt, Mycobacterium avium subsp. paratuberculosis
ggcccaguccagucgcg

SEQ ID NO: 968834 - RNA, 17 nt, Mycobacterium avium subsp. paratuberculosis
ggcccaguccugcagcu

SEQ ID NO: 968835 - RNA, 22 nt, Mycobacterium avium subsp. paratuberculosis
ggcccaguccugcagcucgccg

SEQ ID NO: 968836 - RNA, 21 nt, Mycobacterium avium subsp. paratuberculosis
ggcccagacaggccggccgcu

SEQ ID NO: 968837 - RNA, 15 nt, Mycobacterium avium subsp. paratuberculosis
ggcccacggugauuc

SEQ ID NO: 968838 - RNA, 22 nt, Mycobacterium avium subsp. paratuberculosis
ggcccagcccaccgaucgcgag

SEQ ID NO: 968839 - RNA, 16 nt, Mycobacterium avium subsp. paratuberculosis
ggcccagcagccugcc

SEQ ID NO: 968840 - RNA, 17 nt, Mycobacterium avium subsp. paratuberculosis
ggcccagcagccugccc

SEQ ID NO: 968841 - RNA, 19 nt, Mycobacterium avium subsp. paratuberculosis
ggcccagcagcgcaccggc

SEQ ID NO: 968842 - RNA, 23 nt, Mycobacterium avium subsp. paratuberculosis
ggcccagcucguugccggcggcc

SEQ ID NO: 968843 - RNA, 13 nt, Mycobacterium avium subsp. paratuberculosis
ggcccagcggcug

SEQ ID NO: 968844 - RNA, 24 nt, Mycobacterium avium subsp. paratuberculosis
ggcccagcggcuguagcacccggc

SEQ ID NO: 968845 - RNA, 23 nt, Mycobacterium avium subsp. paratuberculosis
ggcccagcgcgguguacagcgcg

SEQ ID NO: 968846 - RNA, 12 nt, Mycobacterium avium subsp. paratuberculosis
ggcccagcgcgg

SEQ ID NO: 968847 - RNA, 23 nt, Mycobacterium avium subsp. paratuberculosis
ggcccagccgcgucacgucggcc

SEQ ID NO: 968848 - RNA, 21 nt, Mycobacterium avium subsp. paratuberculosis
ggcccagccgcugcgacaggu

SEQ ID NO: 968849 - RNA, 20 nt, Mycobacterium avium subsp. paratuberculosis
ggcccagcgaggcggccagc

SEQ ID NO: 968850 - RNA, 23 nt, Mycobacterium avium subsp. paratuberculosis
ggcccagcgaggcggccagcggc

SEQ ID NO: 968851 - RNA, 22 nt, Mycobacterium avium subsp. paratuberculosis
ggcccagccggccgacgcggcc

SEQ ID NO: 968852 - RNA, 16 nt, Mycobacterium avium subsp. paratuberculosis
ggcccagccggcggug

SEQ ID NO: 968853 - RNA, 22 nt, Mycobacterium avium subsp. paratuberculosis
ggcccagccggcggugcagggu

SEQ ID NO: 968854 - RNA, 22 nt, Mycobacterium avium subsp. paratuberculosis
ggcccagccggugcgagccgcu

SEQ ID NO: 968855 - RNA, 20 nt, Mycobacterium avium subsp. paratuberculosis
ggccccacgggccauguccc

SEQ ID NO: 968856 - RNA, 22 nt, Mycobacterium avium subsp. paratuberculosis
ggccccagccaccguggcccca

SEQ ID NO: 968857 - RNA, 15 nt, Mycobacterium avium subsp. paratuberculosis
ggccccagaaccgcu

SEQ ID NO: 968858 - RNA, 13 nt, Mycobacterium avium subsp. paratuberculosis
ggccccagccgcc

SEQ ID NO: 968859 - RNA, 20 nt, Mycobacterium avium subsp. paratuberculosis
ggccccgcgugacggccgcg

SEQ ID NO: 968860 - RNA, 22 nt, Mycobacterium avium subsp. paratuberculosis
ggccccgcugccguccggcggc

SEQ ID NO: 968861 - RNA, 18 nt, Mycobacterium avium subsp. paratuberculosis
ggccccggauccgucgcc

SEQ ID NO: 968862 - RNA, 15 nt, Mycobacterium avium subsp. paratuberculosis
ggccccgcccggcgc

SEQ ID NO: 968863 - RNA, 19 nt, Mycobacterium avium subsp. paratuberculosis
ggccccgcccggggcggcg

SEQ ID NO: 968864 - RNA, 20 nt, Mycobacterium avium subsp. paratuberculosis
ggcccccggcucgaucgcgg

SEQ ID NO: 968865 - RNA, 22 nt, Mycobacterium avium subsp. paratuberculosis
ggccccgccagauagggcagcg

SEQ ID NO: 968866 - RNA, 13 nt, Mycobacterium avium subsp. paratuberculosis
ggcccgcggggcg

SEQ ID NO: 968867 - RNA, 22 nt, Mycobacterium avium subsp. paratuberculosis
ggcccgcggggcguacgcgcug

SEQ ID NO: 968868 - RNA, 21 nt, Mycobacterium avium subsp. paratuberculosis
ggcccgccacccgaggccguu

SEQ ID NO: 968869 - RNA, 22 nt, Mycobacterium avium subsp. paratuberculosis
ggcccgcguaaccggcggcggu

SEQ ID NO: 968870 - RNA, 22 nt, Mycobacterium avium subsp. paratuberculosis
ggcccgcggcggauccagcacc

SEQ ID NO: 968871 - RNA, 20 nt, Mycobacterium avium subsp. paratuberculosis
ggcccgcgggaucagcgugu

SEQ ID NO: 968872 - RNA, 13 nt, Mycobacterium avium subsp. paratuberculosis
ggcccgcagcgcc

SEQ ID NO: 968873 - RNA, 14 nt, Mycobacterium avium subsp. paratuberculosis
ggcccgcagcgccu

SEQ ID NO: 968874 - RNA, 17 nt, Mycobacterium avium subsp. paratuberculosis
ggcccgcagcgccucgg

SEQ ID NO: 968875 - RNA, 15 nt, Mycobacterium avium subsp. paratuberculosis
ggcccgcagccagcg

SEQ ID NO: 968876 - RNA, 14 nt, Mycobacterium avium subsp. paratuberculosis
ggcccgcaccaccc

SEQ ID NO: 968877 - RNA, 17 nt, Mycobacterium avium subsp. paratuberculosis
ggcccgcaccacccagc

SEQ ID NO: 968878 - RNA, 22 nt, Mycobacterium avium subsp. paratuberculosis
ggcccgcaacuguucgcggcug

SEQ ID NO: 968879 - RNA, 17 nt, Mycobacterium avium subsp. paratuberculosis
ggccccggccgagccgg

SEQ ID NO: 968880 - RNA, 13 nt, Mycobacterium avium subsp. paratuberculosis
ggcccgaucgcgg

SEQ ID NO: 968881 - RNA, 20 nt, Mycobacterium avium subsp. paratuberculosis
ggcccgaucucgcgcggguc

SEQ ID NO: 968882 - RNA, 20 nt, Mycobacterium avium subsp. paratuberculosis
ggcccgauggcggccugcag

SEQ ID NO: 968883 - RNA, 22 nt, Mycobacterium avium subsp. paratuberculosis
ggcccgauggcggccugcagga

SEQ ID NO: 968884 - RNA, 19 nt, Mycobacterium avium subsp. paratuberculosis
ggccgauggucagcugccg

SEQ ID NO: 968885 - RNA, 14 nt, Mycobacterium avium subsp. paratuberculosis
ggccgauggcccag

SEQ ID NO: 968886 - RNA, 23 nt, Mycobacterium avium subsp. paratuberculosis
ggccgcaauacggugcccgccgc

SEQ ID NO: 968887 - RNA, 18 nt, Mycobacterium avium subsp. paratuberculosis
ggccgauggcgcccagcg

SEQ ID NO: 968888 - RNA, 16 nt, Mycobacterium avium subsp. paratuberculosis
ggccgaucagcugcuc

SEQ ID NO: 968889 - RNA, 23 nt, Mycobacterium avium subsp. paratuberculosis
ggccgaucagcugcucggccacc

SEQ ID NO: 968890 - RNA, 17 nt, Mycobacterium avium subsp. paratuberculosis
ggccgaucagcggcggg

SEQ ID NO: 968891 - RNA, 17 nt, Mycobacterium avium subsp. paratuberculosis
ggccgaugaccgcggcg

SEQ ID NO: 968892 - RNA, 19 nt, Mycobacterium avium subsp. paratuberculosis
ggccgaugaccgcggcggg

SEQ ID NO: 968893 - RNA, 20 nt, Mycobacterium avium subsp. paratuberculosis
ggccgaugaccgcggcgggc

SEQ ID NO: 968894 - RNA, 20 nt, Mycobacterium avium subsp. paratuberculosis
ggccgaugaccucgcacagc

SEQ ID NO: 968895 - RNA, 12 nt, Mycobacterium avium subsp. paratuberculosis
ggccgaggcugu

SEQ ID NO: 968896 - RNA, 23 nt, Mycobacterium avium subsp. paratuberculosis
ggccgaggcugucggaggccucc

SEQ ID NO: 968897 - RNA, 21 nt, Mycobacterium avium subsp. paratuberculosis
ggccgaggauggggucgcggg

SEQ ID NO: 968898 - RNA, 20 nt, Mycobacterium avium subsp. paratuberculosis
ggccgaguauccgcgcagcg

SEQ ID NO: 968899 - RNA, 15 nt, Mycobacterium avium subsp. paratuberculosis
ggccgaggcgaguga

SEQ ID NO: 968900 - RNA, 18 nt, Mycobacterium avium subsp. paratuberculosis
ggccgaggcgagugagga

SEQ ID NO: 968901 - RNA, 15 nt, Mycobacterium avium subsp. paratuberculosis
ggccgaggucaccac

SEQ ID NO: 968902 - RNA, 19 nt, Mycobacterium avium subsp. paratuberculosis
ggccgacauggacgcggcc

SEQ ID NO: 968903 - RNA, 19 nt, Mycobacterium avium subsp. paratuberculosis
ggccgagccgaugcccagc

SEQ ID NO: 968904 - RNA, 12 nt, Mycobacterium avium subsp. paratuberculosis
ggccgagccgcc

SEQ ID NO: 968905 - RNA, 13 nt, Mycobacterium avium subsp. paratuberculosis
ggccgagccgccg

SEQ ID NO: 968906 - RNA, 14 nt, Mycobacterium avium subsp. paratuberculosis
ggccgagcgcgccg

SEQ ID NO: 968907 - RNA, 18 nt, Mycobacterium avium subsp. paratuberculosis
ggccgagcgcgccgccgc

SEQ ID NO: 968908 - RNA, 14 nt, Mycobacterium avium subsp. paratuberculosis
ggccgagcgcgcug

SEQ ID NO: 968909 - RNA, 12 nt, Mycobacterium avium subsp. paratuberculosis
ggccgagcgcgc

SEQ ID NO: 968910 - RNA, 13 nt, Mycobacterium avium subsp. paratuberculosis
ggccgagcgcagc

SEQ ID NO: 968911 - RNA, 14 nt, Mycobacterium avium subsp. paratuberculosis
ggccgagccgggcg

SEQ ID NO: 968912 - RNA, 16 nt, Mycobacterium avium subsp. paratuberculosis
ggccgagccgggcggc

SEQ ID NO: 968913 - RNA, 21 nt, Mycobacterium avium subsp. paratuberculosis
ggccgagccgggcggccagcg

SEQ ID NO: 968914 - RNA, 15 nt, Mycobacterium avium subsp. paratuberculosis
ggccgagcgcaccgc

SEQ ID NO: 968915 - RNA, 17 nt, Mycobacterium avium subsp. paratuberculosis
ggcccgcucaccugcgg

SEQ ID NO: 968916 - RNA, 17 nt, Mycobacterium avium subsp. paratuberculosis
ggcccggauggccgggc

SEQ ID NO: 968917 - RNA, 13 nt, Mycobacterium avium subsp. paratuberculosis
ggcccggcaccgg

SEQ ID NO: 968918 - RNA, 22 nt, Mycobacterium avium subsp. paratuberculosis
ggcccggaucgucuugcggccc

SEQ ID NO: 968919 - RNA, 15 nt, Mycobacterium avium subsp. paratuberculosis
ggcccgcugcgcggc

SEQ ID NO: 968920 - RNA, 16 nt, Mycobacterium avium subsp. paratuberculosis
ggcccgcugcggcugg

SEQ ID NO: 968921 - RNA, 17 nt, Mycobacterium avium subsp. paratuberculosis
ggcccgcugcggcuggg

SEQ ID NO: 968922 - RNA, 21 nt, Mycobacterium avium subsp. paratuberculosis
ggcccucgcucaacccgucgc

SEQ ID NO: 968923 - RNA, 12 nt, Mycobacterium avium subsp. paratuberculosis
ggcccucggcca

SEQ ID NO: 968924 - RNA, 14 nt, Mycobacterium avium subsp. paratuberculosis
ggcccucggccagc

SEQ ID NO: 968925 - RNA, 20 nt, Mycobacterium avium subsp. paratuberculosis
ggcccucggccagccaggcc

SEQ ID NO: 968926 - RNA, 20 nt, Mycobacterium avium subsp. paratuberculosis
ggcccucgucggcgagcagc

SEQ ID NO: 968927 - RNA, 14 nt, Mycobacterium avium subsp. paratuberculosis
ggcccuccagcacc

SEQ ID NO: 968928 - RNA, 12 nt, Mycobacterium avium subsp. paratuberculosis
ggcccggccacu

SEQ ID NO: 968929 - RNA, 14 nt, Mycobacterium avium subsp. paratuberculosis
ggcccugcagcgcc

SEQ ID NO: 968930 - RNA, 15 nt, Mycobacterium avium subsp. paratuberculosis
ggcccugcagcgccu

SEQ ID NO: 968931 - RNA, 15 nt, Mycobacterium avium subsp. paratuberculosis
ggcccugccagcgcc

SEQ ID NO: 968932 - RNA, 17 nt, Mycobacterium avium subsp. paratuberculosis
ggccgaaccgcucgucg

SEQ ID NO: 968933 - RNA, 22 nt, Mycobacterium avium subsp. paratuberculosis
ggcccugcucuucgcgcgcggc

SEQ ID NO: 968934 - RNA, 14 nt, Mycobacterium avium subsp. paratuberculosis
ggcccugcgcggcc

SEQ ID NO: 968935 - RNA, 21 nt, Mycobacterium avium subsp. paratuberculosis
ggcccugcgcggccugcagca

SEQ ID NO: 968936 - RNA, 15 nt, Mycobacterium avium subsp. paratuberculosis
ggcccugcggccagu

SEQ ID NO: 968937 - RNA, 17 nt, Mycobacterium avium subsp. paratuberculosis
ggccgaacugccgaugc

SEQ ID NO: 968938 - RNA, 23 nt, Mycobacterium avium subsp. paratuberculosis
ggccgaacugccgaugcugagcg

SEQ ID NO: 968939 - RNA, 22 nt, Mycobacterium avium subsp. paratuberculosis
ggccgaauccggccggagaccg

SEQ ID NO: 968940 - RNA, 14 nt, Mycobacterium avium subsp. paratuberculosis
ggccgaaggcggcg

SEQ ID NO: 968941 - RNA, 19 nt, Mycobacterium avium subsp. paratuberculosis
ggccgaaggcggcgccggc

SEQ ID NO: 968942 - RNA, 23 nt, Mycobacterium avium subsp. paratuberculosis
ggccgacaccccgaugccgaacu

SEQ ID NO: 968943 - RNA, 17 nt, Mycobacterium avium subsp. paratuberculosis
ggauucucagcagcggg

SEQ ID NO: 968944 - RNA, 16 nt, Mycobacterium avium subsp. paratuberculosis
ggauucgcggcggcgc

SEQ ID NO: 968945 - RNA, 21 nt, Mycobacterium avium subsp. paratuberculosis
ggauucggguggcgucgccgc

SEQ ID NO: 968946 - RNA, 21 nt, Mycobacterium avium subsp. paratuberculosis
ggauucccgaacagggcgacg

SEQ ID NO: 968947 - RNA, 20 nt, Mycobacterium avium subsp. paratuberculosis
ggauucccgaccccgccagc

SEQ ID NO: 968948 - RNA, 21 nt, Mycobacterium avium subsp. paratuberculosis
ggauucccgaccccgccagca

SEQ ID NO: 968949 - RNA, 14 nt, Mycobacterium avium subsp. paratuberculosis
ggauuccagcgcgu

SEQ ID NO: 968950 - RNA, 20 nt, Mycobacterium avium subsp. paratuberculosis
ggcaaaauagcugcgacaga

SEQ ID NO: 968951 - RNA, 23 nt, Mycobacterium avium subsp. paratuberculosis
ggcaaaauagcugcgacagaaau

SEQ ID NO: 968952 - RNA, 17 nt, Mycobacterium avium subsp. paratuberculosis
ggauggugaccagcgcc

SEQ ID NO: 968953 - RNA, 23 nt, Mycobacterium avium subsp. paratuberculosis
ggauggugcccaccgggcagccg

SEQ ID NO: 968954 - RNA, 17 nt, Mycobacterium avium subsp. paratuberculosis
ggaugguuuccacugcc

SEQ ID NO: 968955 - RNA, 14 nt, Mycobacterium avium subsp. paratuberculosis
ggaugguccccggg

SEQ ID NO: 968956 - RNA, 19 nt, Mycobacterium avium subsp. paratuberculosis
ggauguacccgcaggccau

SEQ ID NO: 968957 - RNA, 11 nt, Mycobacterium avium subsp. paratuberculosis
ggaugggcucg

SEQ ID NO: 968958 - RNA, 20 nt, Mycobacterium avium subsp. paratuberculosis
ggaugugccuggcccagaca

SEQ ID NO: 968959 - RNA, 12 nt, Mycobacterium avium subsp. paratuberculosis
ggaugucgccgc

SEQ ID NO: 968960 - RNA, 21 nt, Mycobacterium avium subsp. paratuberculosis
ggaugucguccucggucaggc

SEQ ID NO: 968961 - RNA, 20 nt, Mycobacterium avium subsp. paratuberculosis
ggaucggggcgaccuggacg

SEQ ID NO: 968962 - RNA, 14 nt, Mycobacterium avium subsp. paratuberculosis
ggaucggcggcggg

SEQ ID NO: 968963 - RNA, 14 nt, Mycobacterium avium subsp. paratuberculosis
ggaucggcggggcg

SEQ ID NO: 968964 - RNA, 17 nt, Mycobacterium avium subsp. paratuberculosis
ggaucgcuucggccagc

SEQ ID NO: 968965 - RNA, 19 nt, Mycobacterium avium subsp. paratuberculosis
ggaucgcuucggccagcgc

SEQ ID NO: 968966 - RNA, 13 nt, Mycobacterium avium subsp. paratuberculosis
ggaucggccggcg

SEQ ID NO: 968967 - RNA, 19 nt, Mycobacterium avium subsp. paratuberculosis
ggaucggcugcgggccagc

SEQ ID NO: 968968 - RNA, 13 nt, Mycobacterium avium subsp. paratuberculosis
ggaucgggaaguc

SEQ ID NO: 968969 - RNA, 18 nt, Mycobacterium avium subsp. paratuberculosis
ggaucgggaccgggaagc

SEQ ID NO: 968970 - RNA, 15 nt, Mycobacterium avium subsp. paratuberculosis
ggaucgugucuggcc

SEQ ID NO: 968971 - RNA, 16 nt, Mycobacterium avium subsp. paratuberculosis
ggaucgucgccgggcu

SEQ ID NO: 968972 - RNA, 14 nt, Mycobacterium avium subsp. paratuberculosis
ggaucggugcaggc

SEQ ID NO: 968973 - RNA, 20 nt, Mycobacterium avium subsp. paratuberculosis
ggaugccggcgcccagcggc

SEQ ID NO: 968974 - RNA, 14 nt, Mycobacterium avium subsp. paratuberculosis
ggaugacgccgcgg

SEQ ID NO: 968975 - RNA, 16 nt, Mycobacterium avium subsp. paratuberculosis
ggaugaacucgugcgg

SEQ ID NO: 968976 - RNA, 17 nt, Mycobacterium avium subsp. paratuberculosis
ggaugaacucgugcggc

SEQ ID NO: 968977 - RNA, 20 nt, Mycobacterium avium subsp. paratuberculosis
ggaugaaggucgcggacugg

SEQ ID NO: 968978 - RNA, 16 nt, Mycobacterium avium subsp. paratuberculosis
ggaugcgggccacaca

SEQ ID NO: 968979 - RNA, 19 nt, Mycobacterium avium subsp. paratuberculosis
ggaugcggcccuggcgggc

SEQ ID NO: 968980 - RNA, 18 nt, Mycobacterium avium subsp. paratuberculosis
ggaugcgagccagcugcg

SEQ ID NO: 968981 - RNA, 17 nt, Mycobacterium avium subsp. paratuberculosis
ggaugccugcccgcgca

SEQ ID NO: 968982 - RNA, 15 nt, Mycobacterium avium subsp. paratuberculosis
ggauacccgcggccu

SEQ ID NO: 968983 - RNA, 23 nt, Mycobacterium avium subsp. paratuberculosis
ggaucagacccagcgucaggaug

SEQ ID NO: 968984 - RNA, 20 nt, Mycobacterium avium subsp. paratuberculosis
ggaucagcguuccggcggcc

SEQ ID NO: 968985 - RNA, 12 nt, Mycobacterium avium subsp. paratuberculosis
ggaucagcagca

SEQ ID NO: 968986 - RNA, 20 nt, Mycobacterium avium subsp. paratuberculosis
ggaucagcagcaccggcgcc

SEQ ID NO: 968987 - RNA, 23 nt, Mycobacterium avium subsp. paratuberculosis
ggaucgacagguucuuggcggcc

SEQ ID NO: 968988 - RNA, 14 nt, Mycobacterium avium subsp. paratuberculosis
ggaucgaacagggc

SEQ ID NO: 968989 - RNA, 20 nt, Mycobacterium avium subsp. paratuberculosis
ggaucgaacagggcggcggg

SEQ ID NO: 968990 - RNA, 15 nt, Mycobacterium avium subsp. paratuberculosis
ggauccgggcgccgg

SEQ ID NO: 968991 - RNA, 21 nt, Mycobacterium avium subsp. paratuberculosis
ggaucgccgagguagccgcgc

SEQ ID NO: 968992 - RNA, 22 nt, Mycobacterium avium subsp. paratuberculosis
ggaucgccgagguagccgcgca

SEQ ID NO: 968993 - RNA, 23 nt, Mycobacterium avium subsp. paratuberculosis
ggauccggacgaccugggcgccg

SEQ ID NO: 968994 - RNA, 19 nt, Mycobacterium avium subsp. paratuberculosis
ggauccggauugccgggca

SEQ ID NO: 968995 - RNA, 22 nt, Mycobacterium avium subsp. paratuberculosis
ggauccggauugccgggcagcg

SEQ ID NO: 968996 - RNA, 21 nt, Mycobacterium avium subsp. paratuberculosis
ggauccgaggguucgguggcc

SEQ ID NO: 968997 - RNA, 21 nt, Mycobacterium avium subsp. paratuberculosis
ggauccgaugacgcugccgcg

SEQ ID NO: 968998 - RNA, 20 nt, Mycobacterium avium subsp. paratuberculosis
ggaucccgaacugccgcgca

SEQ ID NO: 968999 - RNA, 20 nt, Mycobacterium avium subsp. paratuberculosis
ggauccgcccgccgguggcc

SEQ ID NO: 969000 - RNA, 15 nt, Mycobacterium avium subsp. paratuberculosis
ggauccggcgcgccg

SEQ ID NO: 969001 - RNA, 16 nt, Mycobacterium avium subsp. paratuberculosis
ggauccccgcgcuggg

SEQ ID NO: 969002 - RNA, 17 nt, Mycobacterium avium subsp. paratuberculosis
ggauccccgcgcugggc

SEQ ID NO: 969003 - RNA, 17 nt, Mycobacterium avium subsp. paratuberculosis
ggauccccguccagccc

SEQ ID NO: 969004 - RNA, 22 nt, Mycobacterium avium subsp. paratuberculosis
ggaucccagaauucgccggggc

SEQ ID NO: 969005 - RNA, 15 nt, Mycobacterium avium subsp. paratuberculosis
ggauccagguggggc

SEQ ID NO: 969006 - RNA, 23 nt, Mycobacterium avium subsp. paratuberculosis
ggaggucgucgcguccagcaugc

SEQ ID NO: 969007 - RNA, 13 nt, Mycobacterium avium subsp. paratuberculosis
ggaggugccgcgc

SEQ ID NO: 969008 - RNA, 14 nt, Mycobacterium avium subsp. paratuberculosis
ggaggugccgcgcg

SEQ ID NO: 969009 - RNA, 14 nt, Mycobacterium avium subsp. paratuberculosis
ggaggugccggccg

SEQ ID NO: 969010 - RNA, 19 nt, Mycobacterium avium subsp. paratuberculosis
ggaguugcgcagccgggcg

SEQ ID NO: 969011 - RNA, 17 nt, Mycobacterium avium subsp. paratuberculosis
ggaggguuuucggggcg

SEQ ID NO: 969012 - RNA, 16 nt, Mycobacterium avium subsp. paratuberculosis
ggagggugucggcggg

SEQ ID NO: 969013 - RNA, 13 nt, Mycobacterium avium subsp. paratuberculosis
ggaggucagcggc

SEQ ID NO: 969014 - RNA, 20 nt, Mycobacterium avium subsp. paratuberculosis
ggaggcguugcgucccgcgc

SEQ ID NO: 969015 - RNA, 16 nt, Mycobacterium avium subsp. paratuberculosis
ggaggcgucgacgcgc

SEQ ID NO: 969016 - RNA, 13 nt, Mycobacterium avium subsp. paratuberculosis
ggagggccagggc

SEQ ID NO: 969017 - RNA, 17 nt, Mycobacterium avium subsp. paratuberculosis
ggaggacagcaccgcca

SEQ ID NO: 969018 - RNA, 21 nt, Mycobacterium avium subsp. paratuberculosis
ggaggacagggaggacagcac

SEQ ID NO: 969019 - RNA, 12 nt, Mycobacterium avium subsp. paratuberculosis
ggaggcggcggu

SEQ ID NO: 969020 - RNA, 17 nt, Mycobacterium avium subsp. paratuberculosis
ggagcugcccgcacugg

SEQ ID NO: 969021 - RNA, 19 nt, Mycobacterium avium subsp. paratuberculosis
ggagcugcgcgccccggcc

SEQ ID NO: 969022 - RNA, 20 nt, Mycobacterium avium subsp. paratuberculosis
ggagcguucuccacccgccc

SEQ ID NO: 969023 - RNA, 13 nt, Mycobacterium avium subsp. paratuberculosis
ggagccggccagg

SEQ ID NO: 969024 - RNA, 14 nt, Mycobacterium avium subsp. paratuberculosis
ggagccggccaggu

SEQ ID NO: 969025 - RNA, 16 nt, Mycobacterium avium subsp. paratuberculosis
ggagccggccucgccg

SEQ ID NO: 969026 - RNA, 19 nt, Mycobacterium avium subsp. paratuberculosis
ggagccggccucgccggcg

SEQ ID NO: 969027 - RNA, 21 nt, Mycobacterium avium subsp. paratuberculosis
ggagccggccucgccggcgcc

SEQ ID NO: 969028 - RNA, 19 nt, Mycobacterium avium subsp. paratuberculosis
ggagccggcggcggugcgu

SEQ ID NO: 969029 - RNA, 22 nt, Mycobacterium avium subsp. paratuberculosis
ggagccgucggcuuccuccucg

SEQ ID NO: 969030 - RNA, 14 nt, Mycobacterium avium subsp. paratuberculosis
ggagccgugcagcg

SEQ ID NO: 969031 - RNA, 17 nt, Mycobacterium avium subsp. paratuberculosis
ggagccgugcagcgccc

SEQ ID NO: 969032 - RNA, 20 nt, Mycobacterium avium subsp. paratuberculosis
ggagccgugcagcgcccagc

SEQ ID NO: 969033 - RNA, 21 nt, Mycobacterium avium subsp. paratuberculosis
ggagccgugcagcgcccagcc

SEQ ID NO: 969034 - RNA, 22 nt, Mycobacterium avium subsp. paratuberculosis
ggagccuucuucgccgcagccu

SEQ ID NO: 969035 - RNA, 21 nt, Mycobacterium avium subsp. paratuberculosis
ggagccuucuugaccgcagcc

SEQ ID NO: 969036 - RNA, 17 nt, Mycobacterium avium subsp. paratuberculosis
ggagccuugcuggcggc

SEQ ID NO: 969037 - RNA, 19 nt, Mycobacterium avium subsp. paratuberculosis
ggagcggugcggcucgggc

SEQ ID NO: 969038 - RNA, 23 nt, Mycobacterium avium subsp. paratuberculosis
ggagcggugcggcucgggcggug

SEQ ID NO: 969039 - RNA, 13 nt, Mycobacterium avium subsp. paratuberculosis
ggagccguccggg

SEQ ID NO: 969040 - RNA, 16 nt, Mycobacterium avium subsp. paratuberculosis
ggagccgaccagcgcg

SEQ ID NO: 969041 - RNA, 21 nt, Mycobacterium avium subsp. paratuberculosis
ggagccgacgaagaucccgcu

SEQ ID NO: 969042 - RNA, 19 nt, Mycobacterium avium subsp. paratuberculosis
ggagccgagcaccaggcgc

SEQ ID NO: 969043 - RNA, 15 nt, Mycobacterium avium subsp. paratuberculosis
ggagccgagcaccgg

SEQ ID NO: 969044 - RNA, 16 nt, Mycobacterium avium subsp. paratuberculosis
ggagccgagcaccggg

SEQ ID NO: 969045 - RNA, 16 nt, Mycobacterium avium subsp. paratuberculosis
ggagccgaucgccucc

SEQ ID NO: 969046 - RNA, 17 nt, Mycobacterium avium subsp. paratuberculosis
ggagcaggacgguggcc

SEQ ID NO: 969047 - RNA, 21 nt, Mycobacterium avium subsp. paratuberculosis
ggagcagcacgaucgagccgg

SEQ ID NO: 969048 - RNA, 22 nt, Mycobacterium avium subsp. paratuberculosis
ggagcagcacgaucgagccggu

SEQ ID NO: 969049 - RNA, 14 nt, Mycobacterium avium subsp. paratuberculosis
ggacaggucgggca

SEQ ID NO: 969050 - RNA, 23 nt, Mycobacterium avium subsp. paratuberculosis
ggacagguagcggugcucgaugu

SEQ ID NO: 969051 - RNA, 13 nt, Mycobacterium avium subsp. paratuberculosis
ggacagggcggcg

SEQ ID NO: 969052 - RNA, 13 nt, Mycobacterium avium subsp. paratuberculosis
ggacgcgcccggc

SEQ ID NO: 969053 - RNA, 14 nt, Mycobacterium avium subsp. paratuberculosis
ggacgcgcccggcg

SEQ ID NO: 969054 - RNA, 14 nt, Mycobacterium avium subsp. paratuberculosis
ggacgcgaccaggc

SEQ ID NO: 969055 - RNA, 15 nt, Mycobacterium avium subsp. paratuberculosis
ggacgcggccgagcc

SEQ ID NO: 969056 - RNA, 16 nt, Mycobacterium avium subsp. paratuberculosis
ggacgcgguccagcuu

SEQ ID NO: 969057 - RNA, 19 nt, Mycobacterium avium subsp. paratuberculosis
ggacaucggcagcagggug

SEQ ID NO: 969058 - RNA, 22 nt, Mycobacterium avium subsp. paratuberculosis
ggacgccguugacaccgggugc

SEQ ID NO: 969059 - RNA, 16 nt, Mycobacterium avium subsp. paratuberculosis
ggacgccucgcgcagc

SEQ ID NO: 969060 - RNA, 22 nt, Mycobacterium avium subsp. paratuberculosis
ggacauccgugagggaccucca

SEQ ID NO: 969061 - RNA, 18 nt, Mycobacterium avium subsp. paratuberculosis
ggacguugaggcggcggc

SEQ ID NO: 969062 - RNA, 15 nt, Mycobacterium avium subsp. paratuberculosis
ggacggccagcaggg

SEQ ID NO: 969063 - RNA, 16 nt, Mycobacterium avium subsp. paratuberculosis
ggacggccagcagggc

SEQ ID NO: 969064 - RNA, 17 nt, Mycobacterium avium subsp. paratuberculosis
ggacggccagcagggcg

SEQ ID NO: 969065 - RNA, 17 nt, Mycobacterium avium subsp. paratuberculosis
ggacggcgacggcagcg

SEQ ID NO: 969066 - RNA, 18 nt, Mycobacterium avium subsp. paratuberculosis
ggacggcgagcggcccug

SEQ ID NO: 969067 - RNA, 16 nt, Mycobacterium avium subsp. paratuberculosis
ggacggcgcgguggcg

SEQ ID NO: 969068 - RNA, 13 nt, Mycobacterium avium subsp. paratuberculosis
ggacgugucgggg

SEQ ID NO: 969069 - RNA, 12 nt, Mycobacterium avium subsp. paratuberculosis
ggacggccagca

SEQ ID NO: 969070 - RNA, 14 nt, Mycobacterium avium subsp. paratuberculosis
ggacggccagcagg

SEQ ID NO: 969071 - RNA, 18 nt, Mycobacterium avium subsp. paratuberculosis
ggacggagccgugcccga

SEQ ID NO: 969072 - RNA, 16 nt, Mycobacterium avium subsp. paratuberculosis
ggagacgaccaggucc

SEQ ID NO: 969073 - RNA, 20 nt, Mycobacterium avium subsp. paratuberculosis
ggagaccucuucgacccgca

SEQ ID NO: 969074 - RNA, 13 nt, Mycobacterium avium subsp. paratuberculosis
ggagaccagcagc

SEQ ID NO: 969075 - RNA, 16 nt, Mycobacterium avium subsp. paratuberculosis
ggagaccagcagcuug

SEQ ID NO: 969076 - RNA, 17 nt, Mycobacterium avium subsp. paratuberculosis
ggagaccagguccccuu

SEQ ID NO: 969077 - RNA, 23 nt, Mycobacterium avium subsp. paratuberculosis
ggagaaguccuuguggcccaggc

SEQ ID NO: 969078 - RNA, 19 nt, Mycobacterium avium subsp. paratuberculosis
ggacuccagcaccagcacg

SEQ ID NO: 969079 - RNA, 15 nt, Mycobacterium avium subsp. paratuberculosis
ggagacgucggccgg

SEQ ID NO: 969080 - RNA, 17 nt, Mycobacterium avium subsp. paratuberculosis
ggagacguggcggcggu

SEQ ID NO: 969081 - RNA, 14 nt, Mycobacterium avium subsp. paratuberculosis
ggagacuuccacuu

SEQ ID NO: 969082 - RNA, 19 nt, Mycobacterium avium subsp. paratuberculosis
ggagaggcgcggcgcgagg

SEQ ID NO: 969083 - RNA, 11 nt, Mycobacterium avium subsp. paratuberculosis
ggacacccccg

SEQ ID NO: 969084 - RNA, 16 nt, Mycobacterium avium subsp. paratuberculosis
ggacaccccggccagu

SEQ ID NO: 969085 - RNA, 14 nt, Mycobacterium avium subsp. paratuberculosis
ggacaccaccgcgg

SEQ ID NO: 969086 - RNA, 21 nt, Mycobacterium avium subsp. paratuberculosis
ggacaccacgguggcguccag

SEQ ID NO: 969087 - RNA, 20 nt, Mycobacterium avium subsp. paratuberculosis
ggaauuuucgccgucacugc

SEQ ID NO: 969088 - RNA, 23 nt, Mycobacterium avium subsp. paratuberculosis
ggacaccgcuggccgaggccucc

SEQ ID NO: 969089 - RNA, 16 nt, Mycobacterium avium subsp. paratuberculosis
ggacaccgcacccaga

SEQ ID NO: 969090 - RNA, 23 nt, Mycobacterium avium subsp. paratuberculosis
ggacaccgcacccagaaacgaca

SEQ ID NO: 969091 - RNA, 16 nt, Mycobacterium avium subsp. paratuberculosis
ggacaggcccagcggc

SEQ ID NO: 969092 - RNA, 19 nt, Mycobacterium avium subsp. paratuberculosis
ggacaccuuggcggccacc

SEQ ID NO: 969093 - RNA, 14 nt, Mycobacterium avium subsp. paratuberculosis
ggacacggccggga

SEQ ID NO: 969094 - RNA, 15 nt, Mycobacterium avium subsp. paratuberculosis
ggaauucgucggcgg

SEQ ID NO: 969095 - RNA, 12 nt, Mycobacterium avium subsp. paratuberculosis
ggaauuccagcg

SEQ ID NO: 969096 - RNA, 16 nt, Mycobacterium avium subsp. paratuberculosis
ggaaugucgcgcagca

SEQ ID NO: 969097 - RNA, 21 nt, Mycobacterium avium subsp. paratuberculosis
ggaauugaagcccugcucggu

SEQ ID NO: 969098 - RNA, 10 nt, Mycobacterium avium subsp. paratuberculosis
ggaauugcuu

SEQ ID NO: 969099 - RNA, 12 nt, Mycobacterium avium subsp. paratuberculosis
ggaauccacagc

SEQ ID NO: 969100 - RNA, 18 nt, Mycobacterium avium subsp. paratuberculosis
ggaaucacuuccgcggca

SEQ ID NO: 969101 - RNA, 13 nt, Mycobacterium avium subsp. paratuberculosis
ggaauggggcccg

SEQ ID NO: 969102 - RNA, 18 nt, Mycobacterium avium subsp. paratuberculosis
ggaauggcaaggccagca

SEQ ID NO: 969103 - RNA, 12 nt, Mycobacterium avium subsp. paratuberculosis
ggaauggcagca

SEQ ID NO: 969104 - RNA, 13 nt, Mycobacterium avium subsp. paratuberculosis
ggaauggcagcag

SEQ ID NO: 969105 - RNA, 13 nt, Mycobacterium avium subsp. paratuberculosis
ggaagccgcagca

SEQ ID NO: 969106 - RNA, 14 nt, Mycobacterium avium subsp. paratuberculosis
ggaagccgccgccc

SEQ ID NO: 969107 - RNA, 15 nt, Mycobacterium avium subsp. paratuberculosis
ggaagccaugccggg

SEQ ID NO: 969108 - RNA, 14 nt, Mycobacterium avium subsp. paratuberculosis
ggaacgggccggcg

SEQ ID NO: 969109 - RNA, 22 nt, Mycobacterium avium subsp. paratuberculosis
ggaacgggccggcguccaguug

SEQ ID NO: 969110 - RNA, 21 nt, Mycobacterium avium subsp. paratuberculosis
ggaacggccggauggccagca

SEQ ID NO: 969111 - RNA, 17 nt, Mycobacterium avium subsp. paratuberculosis
ggaacgcgucgaacacc

SEQ ID NO: 969112 - RNA, 19 nt, Mycobacterium avium subsp. paratuberculosis
ggaacgcgucgcccacgcc

SEQ ID NO: 969113 - RNA, 13 nt, Mycobacterium avium subsp. paratuberculosis
ggaacgagccgga

SEQ ID NO: 969114 - RNA, 14 nt, Mycobacterium avium subsp. paratuberculosis
ggaacgcgccggcg

SEQ ID NO: 969115 - RNA, 15 nt, Mycobacterium avium subsp. paratuberculosis
ggaacgcgccgggca

SEQ ID NO: 969116 - RNA, 22 nt, Mycobacterium avium subsp. paratuberculosis
ggaacgcgccgggcaacagcgc

SEQ ID NO: 969117 - RNA, 20 nt, Mycobacterium avium subsp. paratuberculosis
ggaacgcggacagcucgccg

SEQ ID NO: 969118 - RNA, 13 nt, Mycobacterium avium subsp. paratuberculosis
ggaacuccugcag

SEQ ID NO: 969119 - RNA, 15 nt, Mycobacterium avium subsp. paratuberculosis
ggaacuccugcagga

SEQ ID NO: 969120 - RNA, 14 nt, Mycobacterium avium subsp. paratuberculosis
ggaacuccagcagc

SEQ ID NO: 969121 - RNA, 15 nt, Mycobacterium avium subsp. paratuberculosis
ggaacucggccggca

SEQ ID NO: 969122 - RNA, 17 nt, Mycobacterium avium subsp. paratuberculosis
ggaacugcagcgacugg

SEQ ID NO: 969123 - RNA, 12 nt, Mycobacterium avium subsp. paratuberculosis
ggaaaggcagca

SEQ ID NO: 969124 - RNA, 16 nt, Mycobacterium avium subsp. paratuberculosis
ggaaauaggccgggca

SEQ ID NO: 969125 - RNA, 16 nt, Mycobacterium avium subsp. paratuberculosis
ggaaaucggacccagc

SEQ ID NO: 969126 - RNA, 14 nt, Mycobacterium avium subsp. paratuberculosis
ggaaaugcccgcgc

SEQ ID NO: 969127 - RNA, 21 nt, Mycobacterium avium subsp. paratuberculosis
ggaacgacacguggaccgagc

SEQ ID NO: 969128 - RNA, 23 nt, Mycobacterium avium subsp. paratuberculosis
ggaaccgggggccgucacaggcc

SEQ ID NO: 969129 - RNA, 18 nt, Mycobacterium avium subsp. paratuberculosis
ggaaccgggucagcacca

SEQ ID NO: 969130 - RNA, 17 nt, Mycobacterium avium subsp. paratuberculosis
ggaacccacgugcggcg

SEQ ID NO: 969131 - RNA, 15 nt, Mycobacterium avium subsp. paratuberculosis
ggaaccagcccaggu

SEQ ID NO: 969132 - RNA, 16 nt, Mycobacterium avium subsp. paratuberculosis
ggaaccagcccagguc

SEQ ID NO: 969133 - RNA, 14 nt, Mycobacterium avium subsp. paratuberculosis
ggaacagcuuggcg

SEQ ID NO: 969134 - RNA, 19 nt, Mycobacterium avium subsp. paratuberculosis
ggaacaccggcgaggugaa

SEQ ID NO: 969135 - RNA, 14 nt, Mycobacterium avium subsp. paratuberculosis
ggaacagacucagc

SEQ ID NO: 969136 - RNA, 14 nt, Mycobacterium avium subsp. paratuberculosis
ggaacagccaggcg

SEQ ID NO: 969137 - RNA, 13 nt, Mycobacterium avium subsp. paratuberculosis
ggaacagccggcu

SEQ ID NO: 969138 - RNA, 20 nt, Mycobacterium avium subsp. paratuberculosis
ggaaagcgcgggcagcccag

SEQ ID NO: 969139 - RNA, 18 nt, Mycobacterium avium subsp. paratuberculosis
ggaaaccccucagccgga

SEQ ID NO: 969140 - RNA, 22 nt, Mycobacterium avium subsp. paratuberculosis
ggaaaaccccaccccgagcagg

SEQ ID NO: 969141 - RNA, 13 nt, Mycobacterium avium subsp. paratuberculosis
gcuuucgcugguc

SEQ ID NO: 969142 - RNA, 23 nt, Mycobacterium avium subsp. paratuberculosis
gcuuucggcgccaacaacucgac

SEQ ID NO: 969143 - RNA, 22 nt, Mycobacterium avium subsp. paratuberculosis
gcuuuuugcggacccaggcagc

SEQ ID NO: 969144 - RNA, 15 nt, Mycobacterium avium subsp. paratuberculosis
gcuuuuugaccaccg

SEQ ID NO: 969145 - RNA, 23 nt, Mycobacterium avium subsp. paratuberculosis
gcuuuuugaccaccggcaccacg

SEQ ID NO: 969146 - RNA, 16 nt, Mycobacterium avium subsp. paratuberculosis
gcuuuugccgucggug

SEQ ID NO: 969147 - RNA, 18 nt, Mycobacterium avium subsp. paratuberculosis
gcuuuggucgccagcacc

SEQ ID NO: 969148 - RNA, 14 nt, Mycobacterium avium subsp. paratuberculosis
gcuuggcccgccgc

SEQ ID NO: 969149 - RNA, 16 nt, Mycobacterium avium subsp. paratuberculosis
gcuuggcgguggccug

SEQ ID NO: 969150 - RNA, 13 nt, Mycobacterium avium subsp. paratuberculosis
gcuuggcggccug

SEQ ID NO: 969151 - RNA, 14 nt, Mycobacterium avium subsp. paratuberculosis
gcuugggucgccgg

SEQ ID NO: 969152 - RNA, 19 nt, Mycobacterium avium subsp. paratuberculosis
gcuuggucuccggccccga

SEQ ID NO: 969153 - RNA, 13 nt, Mycobacterium avium subsp. paratuberculosis
gcuuggcaggcgg

SEQ ID NO: 969154 - RNA, 21 nt, Mycobacterium avium subsp. paratuberculosis
gcuugcucuucaggaacccga

SEQ ID NO: 969155 - RNA, 14 nt, Mycobacterium avium subsp. paratuberculosis
gcuugcguucccag

SEQ ID NO: 969156 - RNA, 20 nt, Mycobacterium avium subsp. paratuberculosis
gcuugcguucccagcccggc

SEQ ID NO: 969157 - RNA, 16 nt, Mycobacterium avium subsp. paratuberculosis
gcuugcgacuggaugg

SEQ ID NO: 969158 - RNA, 20 nt, Mycobacterium avium subsp. paratuberculosis
gcuugcagcuuggcgguggc

SEQ ID NO: 969159 - RNA, 20 nt, Mycobacterium avium subsp. paratuberculosis
gcuugccggauugcgagccg

SEQ ID NO: 969160 - RNA, 14 nt, Mycobacterium avium subsp. paratuberculosis
gcuugccgaucugg

SEQ ID NO: 969161 - RNA, 16 nt, Mycobacterium avium subsp. paratuberculosis
gcuugccgaucugguc

SEQ ID NO: 969162 - RNA, 21 nt, Mycobacterium avium subsp. paratuberculosis
gcuugcccugguacgcgccgu

SEQ ID NO: 969163 - RNA, 13 nt, Mycobacterium avium subsp. paratuberculosis
gcuugagcgcguc

SEQ ID NO: 969164 - RNA, 17 nt, Mycobacterium avium subsp. paratuberculosis
gcuugaucagcgggcug

SEQ ID NO: 969165 - RNA, 14 nt, Mycobacterium avium subsp. paratuberculosis
gcuugauggcggcg

SEQ ID NO: 969166 - RNA, 19 nt, Mycobacterium avium subsp. paratuberculosis
gcuugaugaugucggcggc

SEQ ID NO: 969167 - RNA, 20 nt, Mycobacterium avium subsp. paratuberculosis
gcuugaucucgaccuucuug

SEQ ID NO: 969168 - RNA, 18 nt, Mycobacterium avium subsp. paratuberculosis
gcuucccauuucggcgaa

SEQ ID NO: 969169 - RNA, 15 nt, Mycobacterium avium subsp. paratuberculosis
gcuucccacccgguc

SEQ ID NO: 969170 - RNA, 19 nt, Mycobacterium avium subsp. paratuberculosis
gcuucccacagucgcuggg

SEQ ID NO: 969171 - RNA, 15 nt, Mycobacterium avium subsp. paratuberculosis
gcuuccagcaccacc

SEQ ID NO: 969172 - RNA, 15 nt, Mycobacterium avium subsp. paratuberculosis
gcuuccgccgagacg

SEQ ID NO: 969173 - RNA, 22 nt, Mycobacterium avium subsp. paratuberculosis
gcuuccgccgagacggcguggc

SEQ ID NO: 969174 - RNA, 19 nt, Mycobacterium avium subsp. paratuberculosis
gcuucggguuguuguccga

SEQ ID NO: 969175 - RNA, 15 nt, Mycobacterium avium subsp. paratuberculosis
gcuucgggagcaagg

SEQ ID NO: 969176 - RNA, 13 nt, Mycobacterium avium subsp. paratuberculosis
gcuucgucgccgg

SEQ ID NO: 969177 - RNA, 22 nt, Mycobacterium avium subsp. paratuberculosis
gcuucugcgccgguucgcuggc

SEQ ID NO: 969178 - RNA, 13 nt, Mycobacterium avium subsp. paratuberculosis
gcuugaacagcac

SEQ ID NO: 969179 - RNA, 20 nt, Mycobacterium avium subsp. paratuberculosis
gcuugacccgcuccagcggc

SEQ ID NO: 969180 - RNA, 21 nt, Mycobacterium avium subsp. paratuberculosis
gcuucacggucggagcccagc

SEQ ID NO: 969181 - RNA, 19 nt, Mycobacterium avium subsp. paratuberculosis
gcuucauaugacgccggcc

SEQ ID NO: 969182 - RNA, 20 nt, Mycobacterium avium subsp. paratuberculosis
gcuucauaugacgccggccu

SEQ ID NO: 969183 - RNA, 19 nt, Mycobacterium avium subsp. paratuberculosis
gcuuaaucgcccaacaacu

SEQ ID NO: 969184 - RNA, 22 nt, Mycobacterium avium subsp. paratuberculosis
gcugggacagcgucaccaaugc

SEQ ID NO: 969185 - RNA, 19 nt, Mycobacterium avium subsp. paratuberculosis
gcugggcagccagaucucc

SEQ ID NO: 969186 - RNA, 15 nt, Mycobacterium avium subsp. paratuberculosis
gcugggcagccgcgc

SEQ ID NO: 969187 - RNA, 15 nt, Mycobacterium avium subsp. paratuberculosis
gcugggccacgaucc

SEQ ID NO: 969188 - RNA, 13 nt, Mycobacterium avium subsp. paratuberculosis
gcugggccgccag

SEQ ID NO: 969189 - RNA, 18 nt, Mycobacterium avium subsp. paratuberculosis
gcugggcuccgaccguga

SEQ ID NO: 969190 - RNA, 21 nt, Mycobacterium avium subsp. paratuberculosis
gcugggcucgagugccggcag

SEQ ID NO: 969191 - RNA, 23 nt, Mycobacterium avium subsp. paratuberculosis
gcugggcucgagugccggcagcc

SEQ ID NO: 969192 - RNA, 16 nt, Mycobacterium avium subsp. paratuberculosis
gcugggcggcgcgcug

SEQ ID NO: 969193 - RNA, 15 nt, Mycobacterium avium subsp. paratuberculosis
gcugggcguggugcg

SEQ ID NO: 969194 - RNA, 16 nt, Mycobacterium avium subsp. paratuberculosis
gcugggucggucccga

SEQ ID NO: 969195 - RNA, 20 nt, Mycobacterium avium subsp. paratuberculosis
gcugggugcgggcugcacca

SEQ ID NO: 969196 - RNA, 17 nt, Mycobacterium avium subsp. paratuberculosis
gcuggguggucaccagc

SEQ ID NO: 969197 - RNA, 21 nt, Mycobacterium avium subsp. paratuberculosis
gcuggguccgauugcccgacu

SEQ ID NO: 969198 - RNA, 15 nt, Mycobacterium avium subsp. paratuberculosis
gcuggggcgcaccgc

SEQ ID NO: 969199 - RNA, 18 nt, Mycobacterium avium subsp. paratuberculosis
gcuggggcgcaccgccug

SEQ ID NO: 969200 - RNA, 18 nt, Mycobacterium avium subsp. paratuberculosis
gcuggucggcgggcagcg

SEQ ID NO: 969201 - RNA, 23 nt, Mycobacterium avium subsp. paratuberculosis
gcuggugcagcagggcgcgcauc

SEQ ID NO: 969202 - RNA, 20 nt, Mycobacterium avium subsp. paratuberculosis
gcuggucuugccgugcagca

SEQ ID NO: 969203 - RNA, 17 nt, Mycobacterium avium subsp. paratuberculosis
gcuggucucgggcacca

SEQ ID NO: 969204 - RNA, 13 nt, Mycobacterium avium subsp. paratuberculosis
gcugguccucggg

SEQ ID NO: 969205 - RNA, 14 nt, Mycobacterium avium subsp. paratuberculosis
gcugguagcugcug

SEQ ID NO: 969206 - RNA, 13 nt, Mycobacterium avium subsp. paratuberculosis
gcuggcgaccauc

SEQ ID NO: 969207 - RNA, 19 nt, Mycobacterium avium subsp. paratuberculosis
gcuggcgaccaucagccug

SEQ ID NO: 969208 - RNA, 19 nt, Mycobacterium avium subsp. paratuberculosis
gcuggcgccggcguccagc

SEQ ID NO: 969209 - RNA, 16 nt, Mycobacterium avium subsp. paratuberculosis
gcuggcgcaggugugc

SEQ ID NO: 969210 - RNA, 19 nt, Mycobacterium avium subsp. paratuberculosis
gcuggcguacgccaugaac

SEQ ID NO: 969211 - RNA, 18 nt, Mycobacterium avium subsp. paratuberculosis
gcuggcguagagccgcuc

SEQ ID NO: 969212 - RNA, 17 nt, Mycobacterium avium subsp. paratuberculosis
gcuggcguaggacagca

SEQ ID NO: 969213 - RNA, 23 nt, Mycobacterium avium subsp. paratuberculosis
gcuggcgugaaucuuggccagca

SEQ ID NO: 969214 - RNA, 14 nt, Mycobacterium avium subsp. paratuberculosis
gcuggcgugacagu

SEQ ID NO: 969215 - RNA, 18 nt, Mycobacterium avium subsp. paratuberculosis
gcuggcgugacgcucgcc

SEQ ID NO: 969216 - RNA, 16 nt, Mycobacterium avium subsp. paratuberculosis
gcuggcgugacguucg

SEQ ID NO: 969217 - RNA, 17 nt, Mycobacterium avium subsp. paratuberculosis
gcuggcguggcgccggc

SEQ ID NO: 969218 - RNA, 12 nt, Mycobacterium avium subsp. paratuberculosis
gcuggcgcuggg

SEQ ID NO: 969219 - RNA, 14 nt, Mycobacterium avium subsp. paratuberculosis
gcuggcgcugccag

SEQ ID NO: 969220 - RNA, 12 nt, Mycobacterium avium subsp. paratuberculosis
gcuggcgcugga

SEQ ID NO: 969221 - RNA, 16 nt, Mycobacterium avium subsp. paratuberculosis
gcuggccgcggccagc

SEQ ID NO: 969222 - RNA, 18 nt, Mycobacterium avium subsp. paratuberculosis
gcuggccgcggccagcug

SEQ ID NO: 969223 - RNA, 22 nt, Mycobacterium avium subsp. paratuberculosis
gcuggccgcggcgaucggcggu

SEQ ID NO: 969224 - RNA, 11 nt, Mycobacterium avium subsp. paratuberculosis
gcuggccgcgg

SEQ ID NO: 969225 - RNA, 23 nt, Mycobacterium avium subsp. paratuberculosis
gcuggccgcgaacggcccgccgc

SEQ ID NO: 969226 - RNA, 12 nt, Mycobacterium avium subsp. paratuberculosis
gcuggcccggcg

SEQ ID NO: 969227 - RNA, 13 nt, Mycobacterium avium subsp. paratuberculosis
gcuggcccggcgc

SEQ ID NO: 969228 - RNA, 22 nt, Mycobacterium avium subsp. paratuberculosis
gcuggccggguuggcauccagg

SEQ ID NO: 969229 - RNA, 17 nt, Mycobacterium avium subsp. paratuberculosis
gcuggccaucgcgggug

SEQ ID NO: 969230 - RNA, 22 nt, Mycobacterium avium subsp. paratuberculosis
gcuggccacgauccggggcagc

SEQ ID NO: 969231 - RNA, 11 nt, Mycobacterium avium subsp. paratuberculosis
gcuggccaccg

SEQ ID NO: 969232 - RNA, 19 nt, Mycobacterium avium subsp. paratuberculosis
gcuggcaggacgggcacca

SEQ ID NO: 969233 - RNA, 18 nt, Mycobacterium avium subsp. paratuberculosis
gcugucggggucgcggcc

SEQ ID NO: 969234 - RNA, 15 nt, Mycobacterium avium subsp. paratuberculosis
gcugugggccagcag

SEQ ID NO: 969235 - RNA, 13 nt, Mycobacterium avium subsp. paratuberculosis
gcugugcggcccg

SEQ ID NO: 969236 - RNA, 17 nt, Mycobacterium avium subsp. paratuberculosis
gcugugcugccugccgu

SEQ ID NO: 969237 - RNA, 18 nt, Mycobacterium avium subsp. paratuberculosis
gcuguugaccacggccug

SEQ ID NO: 969238 - RNA, 22 nt, Mycobacterium avium subsp. paratuberculosis
gcuguugacgggccgcggccag

SEQ ID NO: 969239 - RNA, 14 nt, Mycobacterium avium subsp. paratuberculosis
gcuguuggcgacgg

SEQ ID NO: 969240 - RNA, 19 nt, Mycobacterium avium subsp. paratuberculosis
gcuggugauggccaucugg

SEQ ID NO: 969241 - RNA, 16 nt, Mycobacterium avium subsp. paratuberculosis
gcuggugcgggccagc

SEQ ID NO: 969242 - RNA, 19 nt, Mycobacterium avium subsp. paratuberculosis
gcuggugcgggccagcacg

SEQ ID NO: 969243 - RNA, 14 nt, Mycobacterium avium subsp. paratuberculosis
gcuggugugacgcu

SEQ ID NO: 969244 - RNA, 20 nt, Mycobacterium avium subsp. paratuberculosis
gcuguacgacaacagugccu

SEQ ID NO: 969245 - RNA, 13 nt, Mycobacterium avium subsp. paratuberculosis
gcuguagagcagu

SEQ ID NO: 969246 - RNA, 15 nt, Mycobacterium avium subsp. paratuberculosis
gcuguccucccagcg

SEQ ID NO: 969247 - RNA, 14 nt, Mycobacterium avium subsp. paratuberculosis
gcuguccucgagcg

SEQ ID NO: 969248 - RNA, 15 nt, Mycobacterium avium subsp. paratuberculosis
gcuguccugccgggc

SEQ ID NO: 969249 - RNA, 15 nt, Mycobacterium avium subsp. paratuberculosis
gcuguccgcguggcc

SEQ ID NO: 969250 - RNA, 13 nt, Mycobacterium avium subsp. paratuberculosis
gcuguccaccugc

SEQ ID NO: 969251 - RNA, 23 nt, Mycobacterium avium subsp. paratuberculosis
gcugcgucggcaccagcggcauc

SEQ ID NO: 969252 - RNA, 16 nt, Mycobacterium avium subsp. paratuberculosis
gcugcgguuccgggcg

SEQ ID NO: 969253 - RNA, 16 nt, Mycobacterium avium subsp. paratuberculosis
gcugcgggucagcagc

SEQ ID NO: 969254 - RNA, 18 nt, Mycobacterium avium subsp. paratuberculosis
gcugcgggugcggccagc

SEQ ID NO: 969255 - RNA, 15 nt, Mycobacterium avium subsp. paratuberculosis
gcugcucgcgcugcc

SEQ ID NO: 969256 - RNA, 19 nt, Mycobacterium avium subsp. paratuberculosis
gcugcucgagcaucuccag

SEQ ID NO: 969257 - RNA, 20 nt, Mycobacterium avium subsp. paratuberculosis
gcugcucgagcaucuccagc

SEQ ID NO: 969258 - RNA, 21 nt, Mycobacterium avium subsp. paratuberculosis
gcugcucaugagcccuccagc

SEQ ID NO: 969259 - RNA, 16 nt, Mycobacterium avium subsp. paratuberculosis
gcugcgcccagcgcgc

SEQ ID NO: 969260 - RNA, 20 nt, Mycobacterium avium subsp. paratuberculosis
gcugcgcccagcgcgcgauc

SEQ ID NO: 969261 - RNA, 19 nt, Mycobacterium avium subsp. paratuberculosis
gcugcgcagcagcgccagc

SEQ ID NO: 969262 - RNA, 21 nt, Mycobacterium avium subsp. paratuberculosis
gcugcgcagcagcgccagcag

SEQ ID NO: 969263 - RNA, 16 nt, Mycobacterium avium subsp. paratuberculosis
gcugcgcagcgcagca

SEQ ID NO: 969264 - RNA, 14 nt, Mycobacterium avium subsp. paratuberculosis
gcugcgcgccggcg

SEQ ID NO: 969265 - RNA, 13 nt, Mycobacterium avium subsp. paratuberculosis
gcugcgcgccccg

SEQ ID NO: 969266 - RNA, 15 nt, Mycobacterium avium subsp. paratuberculosis
gcugcgggccaggcg

SEQ ID NO: 969267 - RNA, 18 nt, Mycobacterium avium subsp. paratuberculosis
gcugcgggccaggcggga

SEQ ID NO: 969268 - RNA, 13 nt, Mycobacterium avium subsp. paratuberculosis
gcugcggcgcagu

SEQ ID NO: 969269 - RNA, 15 nt, Mycobacterium avium subsp. paratuberculosis
gcugcggcgccgggc

SEQ ID NO: 969270 - RNA, 22 nt, Mycobacterium avium subsp. paratuberculosis
gcugcggaacccacgugcggcg

SEQ ID NO: 969271 - RNA, 19 nt, Mycobacterium avium subsp. paratuberculosis
gcugcgcgucggccgcaca

SEQ ID NO: 969272 - RNA, 22 nt, Mycobacterium avium subsp. paratuberculosis
gcugcgcguucggcgccacccc

SEQ ID NO: 969273 - RNA, 19 nt, Mycobacterium avium subsp. paratuberculosis
gcugcgcgggcgcggccag

SEQ ID NO: 969274 - RNA, 22 nt, Mycobacterium avium subsp. paratuberculosis
gcugcgcgggucggcgccggcc

SEQ ID NO: 969275 - RNA, 19 nt, Mycobacterium avium subsp. paratuberculosis
gcugcggaaaugcccgcgc

SEQ ID NO: 969276 - RNA, 17 nt, Mycobacterium avium subsp. paratuberculosis
gcuggaaauaggccggg

SEQ ID NO: 969277 - RNA, 21 nt, Mycobacterium avium subsp. paratuberculosis
gcuggaacaccacggccggca

SEQ ID NO: 969278 - RNA, 23 nt, Mycobacterium avium subsp. paratuberculosis
gcugcugcacgacgaccgcgacg

SEQ ID NO: 969279 - RNA, 12 nt, Mycobacterium avium subsp. paratuberculosis
gcugcugcagcg

SEQ ID NO: 969280 - RNA, 17 nt, Mycobacterium avium subsp. paratuberculosis
gcugcugcgcggcacgg

SEQ ID NO: 969281 - RNA, 15 nt, Mycobacterium avium subsp. paratuberculosis
gcugcugcgcggcgg

SEQ ID NO: 969282 - RNA, 18 nt, Mycobacterium avium subsp. paratuberculosis
gcugcugcgcggcggcgg

SEQ ID NO: 969283 - RNA, 23 nt, Mycobacterium avium subsp. paratuberculosis
gcugcuguucguccgugcugccg

SEQ ID NO: 969284 - RNA, 15 nt, Mycobacterium avium subsp. paratuberculosis
gcugcuuagccccuc

SEQ ID NO: 969285 - RNA, 21 nt, Mycobacterium avium subsp. paratuberculosis
gcuggagugaggggauccagc

SEQ ID NO: 969286 - RNA, 13 nt, Mycobacterium avium subsp. paratuberculosis
gcuggagugguca

SEQ ID NO: 969287 - RNA, 16 nt, Mycobacterium avium subsp. paratuberculosis
gcuggagcggaucccg

SEQ ID NO: 969288 - RNA, 14 nt, Mycobacterium avium subsp. paratuberculosis
gcuggacggcccga

SEQ ID NO: 969289 - RNA, 16 nt, Mycobacterium avium subsp. paratuberculosis
gcuggagauguugauc

SEQ ID NO: 969290 - RNA, 22 nt, Mycobacterium avium subsp. paratuberculosis
gcuggaugaaggucgcggacug

SEQ ID NO: 969291 - RNA, 22 nt, Mycobacterium avium subsp. paratuberculosis
gcuggauucgucgcuggccagg

SEQ ID NO: 969292 - RNA, 23 nt, Mycobacterium avium subsp. paratuberculosis
gcuggauucgucgcuggccaggu

SEQ ID NO: 969293 - RNA, 20 nt, Mycobacterium avium subsp. paratuberculosis
gcugcauccgcagcaccagg

SEQ ID NO: 969294 - RNA, 16 nt, Mycobacterium avium subsp. paratuberculosis
gcugcaucuccagccg

SEQ ID NO: 969295 - RNA, 21 nt, Mycobacterium avium subsp. paratuberculosis
gcugccaagauugggccacag

SEQ ID NO: 969296 - RNA, 15 nt, Mycobacterium avium subsp. paratuberculosis
gcugccagggccggg

SEQ ID NO: 969297 - RNA, 20 nt, Mycobacterium avium subsp. paratuberculosis
gcugcagcuccucggcggcc

SEQ ID NO: 969298 - RNA, 13 nt, Mycobacterium avium subsp. paratuberculosis
gcugcagcugcuc

SEQ ID NO: 969299 - RNA, 18 nt, Mycobacterium avium subsp. paratuberculosis
gcugcagcugcucguccu

SEQ ID NO: 969300 - RNA, 17 nt, Mycobacterium avium subsp. paratuberculosis
gcugcaucaugccgccc

SEQ ID NO: 969301 - RNA, 18 nt, Mycobacterium avium subsp. paratuberculosis
gcugcagguggcccacac

SEQ ID NO: 969302 - RNA, 12 nt, Mycobacterium avium subsp. paratuberculosis
gcugcagcagcc

SEQ ID NO: 969303 - RNA, 22 nt, Mycobacterium avium subsp. paratuberculosis
gcugcagcagcccgaucacccc

SEQ ID NO: 969304 - RNA, 19 nt, Mycobacterium avium subsp. paratuberculosis
gcugcagauccgcucgccg

SEQ ID NO: 969305 - RNA, 12 nt, Mycobacterium avium subsp. paratuberculosis
gcugcagcgaga

SEQ ID NO: 969306 - RNA, 15 nt, Mycobacterium avium subsp. paratuberculosis
gcugcagcgagaccu

SEQ ID NO: 969307 - RNA, 18 nt, Mycobacterium avium subsp. paratuberculosis
gcugcagcgagaccuccc

SEQ ID NO: 969308 - RNA, 15 nt, Mycobacterium avium subsp. paratuberculosis
gcugcagcgcccggg

SEQ ID NO: 969309 - RNA, 20 nt, Mycobacterium avium subsp. paratuberculosis
gcugcagcgccgaggccagc

SEQ ID NO: 969310 - RNA, 16 nt, Mycobacterium avium subsp. paratuberculosis
gcugcagcgcgaagga

SEQ ID NO: 969311 - RNA, 22 nt, Mycobacterium avium subsp. paratuberculosis
gcugauggcacccucggugcuc

SEQ ID NO: 969312 - RNA, 12 nt, Mycobacterium avium subsp. paratuberculosis
gcugcaaccggu

SEQ ID NO: 969313 - RNA, 15 nt, Mycobacterium avium subsp. paratuberculosis
gcugcacccaccggc

SEQ ID NO: 969314 - RNA, 18 nt, Mycobacterium avium subsp. paratuberculosis
gcugcacccucugccacg

SEQ ID NO: 969315 - RNA, 16 nt, Mycobacterium avium subsp. paratuberculosis
gcugcaccggguacac

SEQ ID NO: 969316 - RNA, 22 nt, Mycobacterium avium subsp. paratuberculosis
gcugcaccggguacaccggcuc

SEQ ID NO: 969317 - RNA, 19 nt, Mycobacterium avium subsp. paratuberculosis
gcugcaccguuuccggugc

SEQ ID NO: 969318 - RNA, 20 nt, Mycobacterium avium subsp. paratuberculosis
gcugcacgucacgggccagg

SEQ ID NO: 969319 - RNA, 15 nt, Mycobacterium avium subsp. paratuberculosis
gcugccguugggcac

SEQ ID NO: 969320 - RNA, 17 nt, Mycobacterium avium subsp. paratuberculosis
gcugccgcgccccgagc

SEQ ID NO: 969321 - RNA, 14 nt, Mycobacterium avium subsp. paratuberculosis
gcugccgccgcagc

SEQ ID NO: 969322 - RNA, 21 nt, Mycobacterium avium subsp. paratuberculosis
gcugccgccgccggcgguggc

SEQ ID NO: 969323 - RNA, 13 nt, Mycobacterium avium subsp. paratuberculosis
gcugccgcuggcg

SEQ ID NO: 969324 - RNA, 19 nt, Mycobacterium avium subsp. paratuberculosis
gcugccggacaccccggcc

SEQ ID NO: 969325 - RNA, 21 nt, Mycobacterium avium subsp. paratuberculosis
gcugccggggcgcagcugcag

SEQ ID NO: 969326 - RNA, 19 nt, Mycobacterium avium subsp. paratuberculosis
gcugccggggugcagcacc

SEQ ID NO: 969327 - RNA, 18 nt, Mycobacterium avium subsp. paratuberculosis
gcugccggugcugcugua

SEQ ID NO: 969328 - RNA, 15 nt, Mycobacterium avium subsp. paratuberculosis
gcugccggccggcag

SEQ ID NO: 969329 - RNA, 19 nt, Mycobacterium avium subsp. paratuberculosis
gcugccggcgaccagcccc

SEQ ID NO: 969330 - RNA, 21 nt, Mycobacterium avium subsp. paratuberculosis
gcugccgaccucgauggcgac

SEQ ID NO: 969331 - RNA, 15 nt, Mycobacterium avium subsp. paratuberculosis
gcugcccucuuccuc

SEQ ID NO: 969332 - RNA, 22 nt, Mycobacterium avium subsp. paratuberculosis
gcugcccucuuccucgcugucc

SEQ ID NO: 969333 - RNA, 13 nt, Mycobacterium avium subsp. paratuberculosis
gcugcccgcggcc

SEQ ID NO: 969334 - RNA, 23 nt, Mycobacterium avium subsp. paratuberculosis
gcugcccggcccgccgcugcagc

SEQ ID NO: 969335 - RNA, 12 nt, Mycobacterium avium subsp. paratuberculosis
gcugcccggcgc

SEQ ID NO: 969336 - RNA, 18 nt, Mycobacterium avium subsp. paratuberculosis
gcugcccggcgcggacag

SEQ ID NO: 969337 - RNA, 15 nt, Mycobacterium avium subsp. paratuberculosis
gcugcccgccgacgc

SEQ ID NO: 969338 - RNA, 14 nt, Mycobacterium avium subsp. paratuberculosis
gcugcccaccacca

SEQ ID NO: 969339 - RNA, 23 nt, Mycobacterium avium subsp. paratuberculosis
gcugcccaccaccaggggcagcu

SEQ ID NO: 969340 - RNA, 13 nt, Mycobacterium avium subsp. paratuberculosis
gcugcccaccagc

SEQ ID NO: 969341 - RNA, 10 nt, Mycobacterium avium subsp. paratuberculosis
gcugccccuc

SEQ ID NO: 969342 - RNA, 22 nt, Mycobacterium avium subsp. paratuberculosis
gcugcccgagcggcgacuccag

SEQ ID NO: 969343 - RNA, 19 nt, Mycobacterium avium subsp. paratuberculosis
gcugcccauccaggccagc

SEQ ID NO: 969344 - RNA, 22 nt, Mycobacterium avium subsp. paratuberculosis
gcugcccauccaggccagcacc

SEQ ID NO: 969345 - RNA, 20 nt, Mycobacterium avium subsp. paratuberculosis
gcugcccagauacgccgcga

SEQ ID NO: 969346 - RNA, 19 nt, Mycobacterium avium subsp. paratuberculosis
uacaggugccggcggcgcg

SEQ ID NO: 969347 - RNA, 15 nt, Mycobacterium avium subsp. paratuberculosis
uacagcuaggccagc

SEQ ID NO: 969348 - RNA, 16 nt, Mycobacterium avium subsp. paratuberculosis
uacagcgucugcugga

SEQ ID NO: 969349 - RNA, 21 nt, Mycobacterium avium subsp. paratuberculosis
uacacgaugcccuuggccagc

SEQ ID NO: 969350 - RNA, 18 nt, Mycobacterium avium subsp. paratuberculosis
uacacguagcgguccagc

SEQ ID NO: 969351 - RNA, 13 nt, Mycobacterium avium subsp. paratuberculosis
uacagcaccgccg

SEQ ID NO: 969352 - RNA, 14 nt, Mycobacterium avium subsp. paratuberculosis
uacagcagccccug

SEQ ID NO: 969353 - RNA, 15 nt, Mycobacterium avium subsp. paratuberculosis
uacacauagcccauc

SEQ ID NO: 969354 - RNA, 13 nt, Mycobacterium avium subsp. paratuberculosis
uacaccacccggu

SEQ ID NO: 969355 - RNA, 22 nt, Mycobacterium avium subsp. paratuberculosis
uacaccgggaucggggugccgc

SEQ ID NO: 969356 - RNA, 23 nt, Mycobacterium avium subsp. paratuberculosis
uacacagggcggcgacacgccga

SEQ ID NO: 969357 - RNA, 23 nt, Mycobacterium avium subsp. paratuberculosis
uaacggaauucgggugcggcgug

SEQ ID NO: 969358 - RNA, 14 nt, Mycobacterium avium subsp. paratuberculosis
uacugcuugccgcc

SEQ ID NO: 969359 - RNA, 16 nt, Mycobacterium avium subsp. paratuberculosis
uacucgguguagagca

SEQ ID NO: 969360 - RNA, 21 nt, Mycobacterium avium subsp. paratuberculosis
uacuccucggugugcugaccc

SEQ ID NO: 969361 - RNA, 22 nt, Mycobacterium avium subsp. paratuberculosis
uacuccgacagauacuucgucg

SEQ ID NO: 969362 - RNA, 16 nt, Mycobacterium avium subsp. paratuberculosis
uacucaaaccgggccu

SEQ ID NO: 969363 - RNA, 16 nt, Mycobacterium avium subsp. paratuberculosis
uacccgaacccagcgc

SEQ ID NO: 969364 - RNA, 18 nt, Mycobacterium avium subsp. paratuberculosis
uacccgaacccagcgccu

SEQ ID NO: 969365 - RNA, 14 nt, Mycobacterium avium subsp. paratuberculosis
uaccgcaacaccga

SEQ ID NO: 969366 - RNA, 16 nt, Mycobacterium avium subsp. paratuberculosis
uaccgccgggcgggcc

SEQ ID NO: 969367 - RNA, 18 nt, Mycobacterium avium subsp. paratuberculosis
uaccggguggccagcacc

SEQ ID NO: 969368 - RNA, 16 nt, Mycobacterium avium subsp. paratuberculosis
uaccagggcagcgccu

SEQ ID NO: 969369 - RNA, 15 nt, Mycobacterium avium subsp. paratuberculosis
uaccagccgcggacg

SEQ ID NO: 969370 - RNA, 15 nt, Mycobacterium avium subsp. paratuberculosis
uaccacuugaaggag

SEQ ID NO: 969371 - RNA, 16 nt, Mycobacterium avium subsp. paratuberculosis
uacgggcgcaccgcgc

SEQ ID NO: 969372 - RNA, 15 nt, Mycobacterium avium subsp. paratuberculosis
uacgggcgcagcgcc

SEQ ID NO: 969373 - RNA, 17 nt, Mycobacterium avium subsp. paratuberculosis
uacggcucguggguggu

SEQ ID NO: 969374 - RNA, 18 nt, Mycobacterium avium subsp. paratuberculosis
uacggcucaacggccggc

SEQ ID NO: 969375 - RNA, 18 nt, Mycobacterium avium subsp. paratuberculosis
uacggaugccccuugacg

SEQ ID NO: 969376 - RNA, 11 nt, Mycobacterium avium subsp. paratuberculosis
uacgcgcugcc

SEQ ID NO: 969377 - RNA, 14 nt, Mycobacterium avium subsp. paratuberculosis
uaggugugcagcca

SEQ ID NO: 969378 - RNA, 16 nt, Mycobacterium avium subsp. paratuberculosis
uaggugugcagccagg

SEQ ID NO: 969379 - RNA, 20 nt, Mycobacterium avium subsp. paratuberculosis
uagguccggcgcgaccaggu

SEQ ID NO: 969380 - RNA, 21 nt, Mycobacterium avium subsp. paratuberculosis
uagguccggcgcgaccagguu

SEQ ID NO: 969381 - RNA, 16 nt, Mycobacterium avium subsp. paratuberculosis
uaggucgccuccaggu

SEQ ID NO: 969382 - RNA, 23 nt, Mycobacterium avium subsp. paratuberculosis
uaguagccggggacggugcagcc

SEQ ID NO: 969383 - RNA, 20 nt, Mycobacterium avium subsp. paratuberculosis
uaguccgacgauccgggccg

SEQ ID NO: 969384 - RNA, 20 nt, Mycobacterium avium subsp. paratuberculosis
uagucgccgauggagaccuc

SEQ ID NO: 969385 - RNA, 18 nt, Mycobacterium avium subsp. paratuberculosis
uaguucugcuugagccgc

SEQ ID NO: 969386 - RNA, 20 nt, Mycobacterium avium subsp. paratuberculosis
uagcuggugcgcagcccgcc

SEQ ID NO: 969387 - RNA, 19 nt, Mycobacterium avium subsp. paratuberculosis
uagcugggccccuccagcc

SEQ ID NO: 969388 - RNA, 17 nt, Mycobacterium avium subsp. paratuberculosis
uaggacgccgcaccgca

SEQ ID NO: 969389 - RNA, 12 nt, Mycobacterium avium subsp. paratuberculosis
uaggacagcacc

SEQ ID NO: 969390 - RNA, 13 nt, Mycobacterium avium subsp. paratuberculosis
uaggacagcagcc

SEQ ID NO: 969391 - RNA, 20 nt, Mycobacterium avium subsp. paratuberculosis
uaggacaggaacgggccggc

SEQ ID NO: 969392 - RNA, 19 nt, Mycobacterium avium subsp. paratuberculosis
uaggacaccgucaugccgu

SEQ ID NO: 969393 - RNA, 19 nt, Mycobacterium avium subsp. paratuberculosis
uaggcccaguccugcagcu

SEQ ID NO: 969394 - RNA, 21 nt, Mycobacterium avium subsp. paratuberculosis
uaggccagccgggaauaucca

SEQ ID NO: 969395 - RNA, 21 nt, Mycobacterium avium subsp. paratuberculosis
uaggccagguucaggcugauc

SEQ ID NO: 969396 - RNA, 21 nt, Mycobacterium avium subsp. paratuberculosis
uaggcgucgaacgggccgggc

SEQ ID NO: 969397 - RNA, 16 nt, Mycobacterium avium subsp. paratuberculosis
uaggcgucgcgcagca

SEQ ID NO: 969398 - RNA, 19 nt, Mycobacterium avium subsp. paratuberculosis
uaggcgucgcgcagcagcg

SEQ ID NO: 969399 - RNA, 20 nt, Mycobacterium avium subsp. paratuberculosis
uaggcauccugcuggccggg

SEQ ID NO: 969400 - RNA, 13 nt, Mycobacterium avium subsp. paratuberculosis
uaggccagcagcg

SEQ ID NO: 969401 - RNA, 21 nt, Mycobacterium avium subsp. paratuberculosis
uaggccagcccggcgugcagg

SEQ ID NO: 969402 - RNA, 13 nt, Mycobacterium avium subsp. paratuberculosis
uagcgcuggguga

SEQ ID NO: 969403 - RNA, 19 nt, Mycobacterium avium subsp. paratuberculosis
uagcgcgcgaaggcucgcc

SEQ ID NO: 969404 - RNA, 16 nt, Mycobacterium avium subsp. paratuberculosis
uagcgcaacaccgaaa

SEQ ID NO: 969405 - RNA, 14 nt, Mycobacterium avium subsp. paratuberculosis
uagccgaccgaccc

SEQ ID NO: 969406 - RNA, 17 nt, Mycobacterium avium subsp. paratuberculosis
uagcggcucgccaccuc

SEQ ID NO: 969407 - RNA, 12 nt, Mycobacterium avium subsp. paratuberculosis
uagcggcccagg

SEQ ID NO: 969408 - RNA, 15 nt, Mycobacterium avium subsp. paratuberculosis
uagcggcgccaccgg

SEQ ID NO: 969409 - RNA, 21 nt, Mycobacterium avium subsp. paratuberculosis
uagcggcgcaccuggcgcagc

SEQ ID NO: 969410 - RNA, 18 nt, Mycobacterium avium subsp. paratuberculosis
uagcggacgacggccagc

SEQ ID NO: 969411 - RNA, 20 nt, Mycobacterium avium subsp. paratuberculosis
uagcggacgacggccagcug

SEQ ID NO: 969412 - RNA, 19 nt, Mycobacterium avium subsp. paratuberculosis
uagcggcagauggucucga

SEQ ID NO: 969413 - RNA, 23 nt, Mycobacterium avium subsp. paratuberculosis
uagcccaucagcacgcccucguc

SEQ ID NO: 969414 - RNA, 11 nt, Mycobacterium avium subsp. paratuberculosis
uagcccagcca

SEQ ID NO: 969415 - RNA, 14 nt, Mycobacterium avium subsp. paratuberculosis
uagccccucccacc

SEQ ID NO: 969416 - RNA, 23 nt, Mycobacterium avium subsp. paratuberculosis
uagcccgccgcggcgaccggggc

SEQ ID NO: 969417 - RNA, 15 nt, Mycobacterium avium subsp. paratuberculosis
uagcagcgcggcuug

SEQ ID NO: 969418 - RNA, 21 nt, Mycobacterium avium subsp. paratuberculosis
uagcagcgcggcuuggccacc

SEQ ID NO: 969419 - RNA, 13 nt, Mycobacterium avium subsp. paratuberculosis
uagauguugcggc

SEQ ID NO: 969420 - RNA, 17 nt, Mycobacterium avium subsp. paratuberculosis
uagauguugcggccggc

SEQ ID NO: 969421 - RNA, 21 nt, Mycobacterium avium subsp. paratuberculosis
uagaugcguuccaggugugcc

SEQ ID NO: 969422 - RNA, 13 nt, Mycobacterium avium subsp. paratuberculosis
uaugucggugcgg

SEQ ID NO: 969423 - RNA, 13 nt, Mycobacterium avium subsp. paratuberculosis
ucagccacaccgc

SEQ ID NO: 969424 - RNA, 20 nt, Mycobacterium avium subsp. paratuberculosis
ucagccagaucgaggccagc

SEQ ID NO: 969425 - RNA, 19 nt, Mycobacterium avium subsp. paratuberculosis
ucagccagguguagaccac

SEQ ID NO: 969426 - RNA, 16 nt, Mycobacterium avium subsp. paratuberculosis
ucagccguucgcugcc

SEQ ID NO: 969427 - RNA, 17 nt, Mycobacterium avium subsp. paratuberculosis
ucagccguucgcugccc

SEQ ID NO: 969428 - RNA, 19 nt, Mycobacterium avium subsp. paratuberculosis
ucagccggguagcgccgcc

SEQ ID NO: 969429 - RNA, 22 nt, Mycobacterium avium subsp. paratuberculosis
ucagcgaaggcaugggcgugcc

SEQ ID NO: 969430 - RNA, 21 nt, Mycobacterium avium subsp. paratuberculosis
ucagccgcggcggcagcaccc

SEQ ID NO: 969431 - RNA, 18 nt, Mycobacterium avium subsp. paratuberculosis
ucagccgcccuuguugau

SEQ ID NO: 969432 - RNA, 14 nt, Mycobacterium avium subsp. paratuberculosis
ucagcccggcgcug

SEQ ID NO: 969433 - RNA, 16 nt, Mycobacterium avium subsp. paratuberculosis
ucagcccggcccagcc

SEQ ID NO: 969434 - RNA, 16 nt, Mycobacterium avium subsp. paratuberculosis
ucagcccgcccaccac

SEQ ID NO: 969435 - RNA, 19 nt, Mycobacterium avium subsp. paratuberculosis
ucagccccucggggcugcg

SEQ ID NO: 969436 - RNA, 23 nt, Mycobacterium avium subsp. paratuberculosis
ucagcaacagcucuugaaucggu

SEQ ID NO: 969437 - RNA, 16 nt, Mycobacterium avium subsp. paratuberculosis
ucagcaacccgccgag

SEQ ID NO: 969438 - RNA, 17 nt, Mycobacterium avium subsp. paratuberculosis
ucagcaccgccucggcc

SEQ ID NO: 969439 - RNA, 18 nt, Mycobacterium avium subsp. paratuberculosis
ucagcaccgcgcggcggu

SEQ ID NO: 969440 - RNA, 14 nt, Mycobacterium avium subsp. paratuberculosis
ucagcaccgcggag

SEQ ID NO: 969441 - RNA, 12 nt, Mycobacterium avium subsp. paratuberculosis
ucagcaccaggu

SEQ ID NO: 969442 - RNA, 20 nt, Mycobacterium avium subsp. paratuberculosis
ucagcaccagguugucgccg

SEQ ID NO: 969443 - RNA, 17 nt, Mycobacterium avium subsp. paratuberculosis
ucagcacggccgcggcc

SEQ ID NO: 969444 - RNA, 22 nt, Mycobacterium avium subsp. paratuberculosis
ucagcacgcggaucgcgcugac

SEQ ID NO: 969445 - RNA, 14 nt, Mycobacterium avium subsp. paratuberculosis
ucagcacgcugauc

SEQ ID NO: 969446 - RNA, 14 nt, Mycobacterium avium subsp. paratuberculosis
ucagcaccggcgug

SEQ ID NO: 969447 - RNA, 14 nt, Mycobacterium avium subsp. paratuberculosis
ucagcaccggguga

SEQ ID NO: 969448 - RNA, 17 nt, Mycobacterium avium subsp. paratuberculosis
ucagcaccgucaccgcc

SEQ ID NO: 969449 - RNA, 17 nt, Mycobacterium avium subsp. paratuberculosis
ucagcaccguccacagc

SEQ ID NO: 969450 - RNA, 17 nt, Mycobacterium avium subsp. paratuberculosis
ucagcaccgugggcccg

SEQ ID NO: 969451 - RNA, 17 nt, Mycobacterium avium subsp. paratuberculosis
ucagcagggcggcaccg

SEQ ID NO: 969452 - RNA, 16 nt, Mycobacterium avium subsp. paratuberculosis
ucagcaggaccaggcc

SEQ ID NO: 969453 - RNA, 22 nt, Mycobacterium avium subsp. paratuberculosis
ucagcagugccccguccggcgc

SEQ ID NO: 969454 - RNA, 15 nt, Mycobacterium avium subsp. paratuberculosis
ucagcagcacccggg

SEQ ID NO: 969455 - RNA, 22 nt, Mycobacterium avium subsp. paratuberculosis
ucagcagcaccgcauggggcag

SEQ ID NO: 969456 - RNA, 14 nt, Mycobacterium avium subsp. paratuberculosis
ucagcagcgcggcc

SEQ ID NO: 969457 - RNA, 12 nt, Mycobacterium avium subsp. paratuberculosis
ucagcagcgcgu

SEQ ID NO: 969458 - RNA, 23 nt, Mycobacterium avium subsp. paratuberculosis
ucagcagcuagcccagaacugcu

SEQ ID NO: 969459 - RNA, 15 nt, Mycobacterium avium subsp. paratuberculosis
ucagcagcagguccu

SEQ ID NO: 969460 - RNA, 12 nt, Mycobacterium avium subsp. paratuberculosis
ucagcagcgccu

SEQ ID NO: 969461 - RNA, 13 nt, Mycobacterium avium subsp. paratuberculosis
ucagcagcgccuc

SEQ ID NO: 969462 - RNA, 21 nt, Mycobacterium avium subsp. paratuberculosis
ucagcagcgccucgccgggcc

SEQ ID NO: 969463 - RNA, 12 nt, Mycobacterium avium subsp. paratuberculosis
ucagcagcgcga

SEQ ID NO: 969464 - RNA, 16 nt, Mycobacterium avium subsp. paratuberculosis
ucagaaccggggccag

SEQ ID NO: 969465 - RNA, 16 nt, Mycobacterium avium subsp. paratuberculosis
ucacguagcgcggccg

SEQ ID NO: 969466 - RNA, 18 nt, Mycobacterium avium subsp. paratuberculosis
ucacguugauccgaugca

SEQ ID NO: 969467 - RNA, 17 nt, Mycobacterium avium subsp. paratuberculosis
ucacguugucgcggccc

SEQ ID NO: 969468 - RNA, 23 nt, Mycobacterium avium subsp. paratuberculosis
ucacuacccgcgauggcacacag

SEQ ID NO: 969469 - RNA, 19 nt, Mycobacterium avium subsp. paratuberculosis
ucacuccagcggcggcccu

SEQ ID NO: 969470 - RNA, 23 nt, Mycobacterium avium subsp. paratuberculosis
ucacucaggccacaugggccacg

SEQ ID NO: 969471 - RNA, 15 nt, Mycobacterium avium subsp. paratuberculosis
ucacucuggcgugac

SEQ ID NO: 969472 - RNA, 22 nt, Mycobacterium avium subsp. paratuberculosis
ucacugcccagccaucugcuga

SEQ ID NO: 969473 - RNA, 21 nt, Mycobacterium avium subsp. paratuberculosis
ucacgaggccgggcuggcgcu

SEQ ID NO: 969474 - RNA, 22 nt, Mycobacterium avium subsp. paratuberculosis
ucacgaggccgggcuggcgcug

SEQ ID NO: 969475 - RNA, 18 nt, Mycobacterium avium subsp. paratuberculosis
ucacgaccggcagcaccg

SEQ ID NO: 969476 - RNA, 20 nt, Mycobacterium avium subsp. paratuberculosis
ucacgauauggaucagaccc

SEQ ID NO: 969477 - RNA, 17 nt, Mycobacterium avium subsp. paratuberculosis
ucacgaacuccuugacc

SEQ ID NO: 969478 - RNA, 17 nt, Mycobacterium avium subsp. paratuberculosis
ucaccuugucgcugacc

SEQ ID NO: 969479 - RNA, 21 nt, Mycobacterium avium subsp. paratuberculosis
ucaccuugcggccggcggcgu

SEQ ID NO: 969480 - RNA, 14 nt, Mycobacterium avium subsp. paratuberculosis
ucaccucgccggcc

SEQ ID NO: 969481 - RNA, 20 nt, Mycobacterium avium subsp. paratuberculosis
ucaccucgccggccgggcgg

SEQ ID NO: 969482 - RNA, 17 nt, Mycobacterium avium subsp. paratuberculosis
ucaccuccuuggccagg

SEQ ID NO: 969483 - RNA, 19 nt, Mycobacterium avium subsp. paratuberculosis
ucacgcagaacucgucgcc

SEQ ID NO: 969484 - RNA, 22 nt, Mycobacterium avium subsp. paratuberculosis
ucacgccaguguggccgcggcg

SEQ ID NO: 969485 - RNA, 18 nt, Mycobacterium avium subsp. paratuberculosis
ucacgcaucagggccagc

SEQ ID NO: 969486 - RNA, 14 nt, Mycobacterium avium subsp. paratuberculosis
ucacgccccggcgu

SEQ ID NO: 969487 - RNA, 18 nt, Mycobacterium avium subsp. paratuberculosis
ucacgguccaucagcacc

SEQ ID NO: 969488 - RNA, 23 nt, Mycobacterium avium subsp. paratuberculosis
ucacggugacgguuuuggucugc

SEQ ID NO: 969489 - RNA, 13 nt, Mycobacterium avium subsp. paratuberculosis
ucacgggccaggc

SEQ ID NO: 969490 - RNA, 19 nt, Mycobacterium avium subsp. paratuberculosis
ucacggauacccgcggccu

SEQ ID NO: 969491 - RNA, 16 nt, Mycobacterium avium subsp. paratuberculosis
ucacggccgccagcag

SEQ ID NO: 969492 - RNA, 17 nt, Mycobacterium avium subsp. paratuberculosis
ucacggccgccagcagc

SEQ ID NO: 969493 - RNA, 18 nt, Mycobacterium avium subsp. paratuberculosis
ucacggccgccagcagca

SEQ ID NO: 969494 - RNA, 23 nt, Mycobacterium avium subsp. paratuberculosis
ucacggccgccagcagcacggca

SEQ ID NO: 969495 - RNA, 15 nt, Mycobacterium avium subsp. paratuberculosis
ucacgcugcgcgccg

SEQ ID NO: 969496 - RNA, 15 nt, Mycobacterium avium subsp. paratuberculosis
ucacgcucggcaggc

SEQ ID NO: 969497 - RNA, 19 nt, Mycobacterium avium subsp. paratuberculosis
ucacgcucggccaggguga

SEQ ID NO: 969498 - RNA, 23 nt, Mycobacterium avium subsp. paratuberculosis
ucacgccgggguagaggccgcgg

SEQ ID NO: 969499 - RNA, 18 nt, Mycobacterium avium subsp. paratuberculosis
ucaccaccaccaguucca

SEQ ID NO: 969500 - RNA, 15 nt, Mycobacterium avium subsp. paratuberculosis
ucaccaccaccgccg

SEQ ID NO: 969501 - RNA, 17 nt, Mycobacterium avium subsp. paratuberculosis
ucaccacgauccaaccg

SEQ ID NO: 969502 - RNA, 12 nt, Mycobacterium avium subsp. paratuberculosis
ucaccagcggcu

SEQ ID NO: 969503 - RNA, 18 nt, Mycobacterium avium subsp. paratuberculosis
ucaccagcggcugcagca

SEQ ID NO: 969504 - RNA, 22 nt, Mycobacterium avium subsp. paratuberculosis
ucaccacggucagggccagcaa

SEQ ID NO: 969505 - RNA, 18 nt, Mycobacterium avium subsp. paratuberculosis
ucaccccaccgagcagcu

SEQ ID NO: 969506 - RNA, 23 nt, Mycobacterium avium subsp. paratuberculosis
ucaccccaccgagcagcugcaug

SEQ ID NO: 969507 - RNA, 15 nt, Mycobacterium avium subsp. paratuberculosis
ucaccaucagcaccg

SEQ ID NO: 969508 - RNA, 13 nt, Mycobacterium avium subsp. paratuberculosis
ucaccaucagcgg

SEQ ID NO: 969509 - RNA, 15 nt, Mycobacterium avium subsp. paratuberculosis
ucaccaucagcggcu

SEQ ID NO: 969510 - RNA, 13 nt, Mycobacterium avium subsp. paratuberculosis
ucaccaugaucag

SEQ ID NO: 969511 - RNA, 17 nt, Mycobacterium avium subsp. paratuberculosis
ucaccgcgucagcagcg

SEQ ID NO: 969512 - RNA, 23 nt, Mycobacterium avium subsp. paratuberculosis
ucaccgcgcgaagucccacugcc

SEQ ID NO: 969513 - RNA, 16 nt, Mycobacterium avium subsp. paratuberculosis
ucaccgcggccaccac

SEQ ID NO: 969514 - RNA, 18 nt, Mycobacterium avium subsp. paratuberculosis
ucaccgcgggccaggccc

SEQ ID NO: 969515 - RNA, 16 nt, Mycobacterium avium subsp. paratuberculosis
ucaccgccuccuggcu

SEQ ID NO: 969516 - RNA, 18 nt, Mycobacterium avium subsp. paratuberculosis
ucaccggggugccgccca

SEQ ID NO: 969517 - RNA, 17 nt, Mycobacterium avium subsp. paratuberculosis
ucaccggugucacgcug

SEQ ID NO: 969518 - RNA, 13 nt, Mycobacterium avium subsp. paratuberculosis
ucaccggccaggg

SEQ ID NO: 969519 - RNA, 16 nt, Mycobacterium avium subsp. paratuberculosis
ucaccggccauccgcu

SEQ ID NO: 969520 - RNA, 19 nt, Mycobacterium avium subsp. paratuberculosis
ucaccgccaccagcaggcc

SEQ ID NO: 969521 - RNA, 13 nt, Mycobacterium avium subsp. paratuberculosis
ucaccgccagcgc

SEQ ID NO: 969522 - RNA, 17 nt, Mycobacterium avium subsp. paratuberculosis
ucaccgccagcgcgccg

SEQ ID NO: 969523 - RNA, 17 nt, Mycobacterium avium subsp. paratuberculosis
ucacccggcccaccggc

SEQ ID NO: 969524 - RNA, 20 nt, Mycobacterium avium subsp. paratuberculosis
ucacccggcccccgagcuuc

SEQ ID NO: 969525 - RNA, 18 nt, Mycobacterium avium subsp. paratuberculosis
ucacccgguugagcaccg

SEQ ID NO: 969526 - RNA, 18 nt, Mycobacterium avium subsp. paratuberculosis
ucacccgugggccgaccg

SEQ ID NO: 969527 - RNA, 15 nt, Mycobacterium avium subsp. paratuberculosis
ucaccccggccaggg

SEQ ID NO: 969528 - RNA, 17 nt, Mycobacterium avium subsp. paratuberculosis
ucaccccggcgcggaac

SEQ ID NO: 969529 - RNA, 12 nt, Mycobacterium avium subsp. paratuberculosis
ucaccaaggcga

SEQ ID NO: 969530 - RNA, 23 nt, Mycobacterium avium subsp. paratuberculosis
ucaccaaggcgauuucgggaucc

SEQ ID NO: 969531 - RNA, 22 nt, Mycobacterium avium subsp. paratuberculosis
ucacauacgccucaccccagcg

SEQ ID NO: 969532 - RNA, 22 nt, Mycobacterium avium subsp. paratuberculosis
ucacacagccgcuuggcgcgcc

SEQ ID NO: 969533 - RNA, 18 nt, Mycobacterium avium subsp. paratuberculosis
ucacaccgcggccagcgc

SEQ ID NO: 969534 - RNA, 17 nt, Mycobacterium avium subsp. paratuberculosis
ucacacggggcagaccg

SEQ ID NO: 969535 - RNA, 15 nt, Mycobacterium avium subsp. paratuberculosis
ucacagcgcggcggu

SEQ ID NO: 969536 - RNA, 19 nt, Mycobacterium avium subsp. paratuberculosis
ucacagcgcggcggugagc

SEQ ID NO: 969537 - RNA, 16 nt, Mycobacterium avium subsp. paratuberculosis
ucacagcucaccugcg

SEQ ID NO: 969538 - RNA, 15 nt, Mycobacterium avium subsp. paratuberculosis
ucaaugauggucagc

SEQ ID NO: 969539 - RNA, 21 nt, Mycobacterium avium subsp. paratuberculosis
ucaauucgaagcccgugccga

SEQ ID NO: 969540 - RNA, 12 nt, Mycobacterium avium subsp. paratuberculosis
ucaaggugcuga

SEQ ID NO: 969541 - RNA, 13 nt, Mycobacterium avium subsp. paratuberculosis
ucaaggugcugaa

SEQ ID NO: 969542 - RNA, 19 nt, Mycobacterium avium subsp. paratuberculosis
ucaagguggacgagcagcc

SEQ ID NO: 969543 - RNA, 19 nt, Mycobacterium avium subsp. paratuberculosis
ucaagcgcuuucgccgaau

SEQ ID NO: 969544 - RNA, 14 nt, Mycobacterium avium subsp. paratuberculosis
ucaaguccucccaa

SEQ ID NO: 969545 - RNA, 23 nt, Mycobacterium avium subsp. paratuberculosis
ucaacccgagcaccgggccgaag

SEQ ID NO: 969546 - RNA, 14 nt, Mycobacterium avium subsp. paratuberculosis
ucaacaggcccagc

SEQ ID NO: 969547 - RNA, 15 nt, Mycobacterium avium subsp. paratuberculosis
ucaacugcaccagcg

SEQ ID NO: 969548 - RNA, 16 nt, Mycobacterium avium subsp. paratuberculosis
ucaacucgucgggggu

SEQ ID NO: 969549 - RNA, 22 nt, Mycobacterium avium subsp. paratuberculosis
ucaacggcuugaugaugcuguc

SEQ ID NO: 969550 - RNA, 20 nt, Mycobacterium avium subsp. paratuberculosis
ucaacgugaccaccgugcug

SEQ ID NO: 969551 - RNA, 14 nt, Mycobacterium avium subsp. paratuberculosis
ucaaccgcccagcg

SEQ ID NO: 969552 - RNA, 21 nt, Mycobacterium avium subsp. paratuberculosis
ucaagccggcaugguuccccc

SEQ ID NO: 969553 - RNA, 18 nt, Mycobacterium avium subsp. paratuberculosis
ucaagccggccagcagcg

SEQ ID NO: 969554 - RNA, 18 nt, Mycobacterium avium subsp. paratuberculosis
ucaagaugauugcgugcc

SEQ ID NO: 969555 - RNA, 23 nt, Mycobacterium avium subsp. paratuberculosis
ucaagaacgcaaucgcccagucc

SEQ ID NO: 969556 - RNA, 18 nt, Mycobacterium avium subsp. paratuberculosis
uauucgcgggaggacagc

SEQ ID NO: 969557 - RNA, 12 nt, Mycobacterium avium subsp. paratuberculosis
uauucgcccacc

SEQ ID NO: 969558 - RNA, 19 nt, Mycobacterium avium subsp. paratuberculosis
uaaccguacggcccgaaca

SEQ ID NO: 969559 - RNA, 14 nt, Mycobacterium avium subsp. paratuberculosis
uaaccguggcaggc

SEQ ID NO: 969560 - RNA, 17 nt, Mycobacterium avium subsp. paratuberculosis
uaaccggcuuccgagac

SEQ ID NO: 969561 - RNA, 13 nt, Mycobacterium avium subsp. paratuberculosis
guuuuucugcucu

SEQ ID NO: 969562 - RNA, 22 nt, Mycobacterium avium subsp. paratuberculosis
guuuucggugugccgcugcauc

SEQ ID NO: 969563 - RNA, 17 nt, Mycobacterium avium subsp. paratuberculosis
guuuuccuucggugcgu

SEQ ID NO: 969564 - RNA, 17 nt, Mycobacterium avium subsp. paratuberculosis
guuugcgggucgguggg

SEQ ID NO: 969565 - RNA, 13 nt, Mycobacterium avium subsp. paratuberculosis
guuuggccagcac

SEQ ID NO: 969566 - RNA, 15 nt, Mycobacterium avium subsp. paratuberculosis
guuugguguucgggc

SEQ ID NO: 969567 - RNA, 14 nt, Mycobacterium avium subsp. paratuberculosis
guuugggcgugcgg

SEQ ID NO: 969568 - RNA, 22 nt, Mycobacterium avium subsp. paratuberculosis
guuuggccugcggcaacagcac

SEQ ID NO: 969569 - RNA, 13 nt, Mycobacterium avium subsp. paratuberculosis
guucugcgugcgg

SEQ ID NO: 969570 - RNA, 13 nt, Mycobacterium avium subsp. paratuberculosis
guucugcucgaag

SEQ ID NO: 969571 - RNA, 19 nt, Mycobacterium avium subsp. paratuberculosis
guucugcucgaucucggcc

SEQ ID NO: 969572 - RNA, 16 nt, Mycobacterium avium subsp. paratuberculosis
guucugcuuggcaggc

SEQ ID NO: 969573 - RNA, 17 nt, Mycobacterium avium subsp. paratuberculosis
guucuggaugcccaggg

SEQ ID NO: 969574 - RNA, 18 nt, Mycobacterium avium subsp. paratuberculosis
guuguccacccccgcggu

SEQ ID NO: 969575 - RNA, 14 nt, Mycobacterium avium subsp. paratuberculosis
guuguccagcagcg

SEQ ID NO: 969576 - RNA, 12 nt, Mycobacterium avium subsp. paratuberculosis
guuguccaggua

SEQ ID NO: 969577 - RNA, 17 nt, Mycobacterium avium subsp. paratuberculosis
guugucggucaggcacu

SEQ ID NO: 969578 - RNA, 18 nt, Mycobacterium avium subsp. paratuberculosis
guugucgcggcccagcac

SEQ ID NO: 969579 - RNA, 18 nt, Mycobacterium avium subsp. paratuberculosis
guugucgccgcgccagcc

SEQ ID NO: 969580 - RNA, 20 nt, Mycobacterium avium subsp. paratuberculosis
guugucgaccaccaggugcg

SEQ ID NO: 969581 - RNA, 14 nt, Mycobacterium avium subsp. paratuberculosis
guugugcugcaccg

SEQ ID NO: 969582 - RNA, 14 nt, Mycobacterium avium subsp. paratuberculosis
guuucgguccaggu

SEQ ID NO: 969583 - RNA, 16 nt, Mycobacterium avium subsp. paratuberculosis
guuucggcccuccagc

SEQ ID NO: 969584 - RNA, 17 nt, Mycobacterium avium subsp. paratuberculosis
guuuccagcgccggcac

SEQ ID NO: 969585 - RNA, 20 nt, Mycobacterium avium subsp. paratuberculosis
guuccggcgagaucuucucc

SEQ ID NO: 969586 - RNA, 18 nt, Mycobacterium avium subsp. paratuberculosis
guuccuugcggccgccga

SEQ ID NO: 969587 - RNA, 23 nt, Mycobacterium avium subsp. paratuberculosis
guuccgggcgaccccggccagga

SEQ ID NO: 969588 - RNA, 14 nt, Mycobacterium avium subsp. paratuberculosis
guuccggcgguccu

SEQ ID NO: 969589 - RNA, 21 nt, Mycobacterium avium subsp. paratuberculosis
guucgaccccaacccgaaggu

SEQ ID NO: 969590 - RNA, 21 nt, Mycobacterium avium subsp. paratuberculosis
guucgaccggcaccagcagcc

SEQ ID NO: 969591 - RNA, 17 nt, Mycobacterium avium subsp. paratuberculosis
guuccuugcgcagcacc

SEQ ID NO: 969592 - RNA, 14 nt, Mycobacterium avium subsp. paratuberculosis
guucguccagcccg

SEQ ID NO: 969593 - RNA, 15 nt, Mycobacterium avium subsp. paratuberculosis
guucgguggccccgg

SEQ ID NO: 969594 - RNA, 14 nt, Mycobacterium avium subsp. paratuberculosis
guucgguggggccg

SEQ ID NO: 969595 - RNA, 18 nt, Mycobacterium avium subsp. paratuberculosis
guucgguggggccgccgu

SEQ ID NO: 969596 - RNA, 21 nt, Mycobacterium avium subsp. paratuberculosis
guucugauacaccacccggug

SEQ ID NO: 969597 - RNA, 14 nt, Mycobacterium avium subsp. paratuberculosis
guucugcacguccu

SEQ ID NO: 969598 - RNA, 11 nt, Mycobacterium avium subsp. paratuberculosis
guucugcaccg

SEQ ID NO: 969599 - RNA, 12 nt, Mycobacterium avium subsp. paratuberculosis
guucuccagcac

SEQ ID NO: 969600 - RNA, 13 nt, Mycobacterium avium subsp. paratuberculosis
guucuccucgaac

SEQ ID NO: 969601 - RNA, 17 nt, Mycobacterium avium subsp. paratuberculosis
guucucgcgcaggucac

SEQ ID NO: 969602 - RNA, 18 nt, Mycobacterium avium subsp. paratuberculosis
guuccaucgggcccagca

SEQ ID NO: 969603 - RNA, 20 nt, Mycobacterium avium subsp. paratuberculosis
guuccaucgggcccagcagc

SEQ ID NO: 969604 - RNA, 14 nt, Mycobacterium avium subsp. paratuberculosis
guuccagcggcacc

SEQ ID NO: 969605 - RNA, 16 nt, Mycobacterium avium subsp. paratuberculosis
guucauccacucggcc

SEQ ID NO: 969606 - RNA, 18 nt, Mycobacterium avium subsp. paratuberculosis
guucauccacucggccac

SEQ ID NO: 969607 - RNA, 11 nt, Mycobacterium avium subsp. paratuberculosis
guucaugaucg

SEQ ID NO: 969608 - RNA, 17 nt, Mycobacterium avium subsp. paratuberculosis
guuccagaagaucuuca

SEQ ID NO: 969609 - RNA, 20 nt, Mycobacterium avium subsp. paratuberculosis
guucacaguaggcggcuguc

SEQ ID NO: 969610 - RNA, 20 nt, Mycobacterium avium subsp. paratuberculosis
guucaccccgaucaacaccg

SEQ ID NO: 969611 - RNA, 18 nt, Mycobacterium avium subsp. paratuberculosis
guucacccguggcugacc

SEQ ID NO: 969612 - RNA, 15 nt, Mycobacterium avium subsp. paratuberculosis
guucaccgcgccggg

SEQ ID NO: 969613 - RNA, 15 nt, Mycobacterium avium subsp. paratuberculosis
guucacgcggcuggc

SEQ ID NO: 969614 - RNA, 11 nt, Mycobacterium avium subsp. paratuberculosis
guuaguuucac

SEQ ID NO: 969615 - RNA, 18 nt, Mycobacterium avium subsp. paratuberculosis
guuagguacgcggcuggc

SEQ ID NO: 969616 - RNA, 13 nt, Mycobacterium avium subsp. paratuberculosis
guuaccagcucac

SEQ ID NO: 969617 - RNA, 17 nt, Mycobacterium avium subsp. paratuberculosis
guguggcgccgugcagg

SEQ ID NO: 969618 - RNA, 23 nt, Mycobacterium avium subsp. paratuberculosis
guguucagccccucguccaggug

SEQ ID NO: 969619 - RNA, 14 nt, Mycobacterium avium subsp. paratuberculosis
guguucgagggcgc

SEQ ID NO: 969620 - RNA, 20 nt, Mycobacterium avium subsp. paratuberculosis
guguccagaacucggcggcg

SEQ ID NO: 969621 - RNA, 17 nt, Mycobacterium avium subsp. paratuberculosis
guguccaggucguugga

SEQ ID NO: 969622 - RNA, 14 nt, Mycobacterium avium subsp. paratuberculosis
gugucacgcuggcg

SEQ ID NO: 969623 - RNA, 13 nt, Mycobacterium avium subsp. paratuberculosis
guguaggccgcgu

SEQ ID NO: 969624 - RNA, 13 nt, Mycobacterium avium subsp. paratuberculosis
guguagccgaccg

SEQ ID NO: 969625 - RNA, 18 nt, Mycobacterium avium subsp. paratuberculosis
guguggcccugcgucauc

SEQ ID NO: 969626 - RNA, 12 nt, Mycobacterium avium subsp. paratuberculosis
guguggccgcgg

SEQ ID NO: 969627 - RNA, 20 nt, Mycobacterium avium subsp. paratuberculosis
guguggcucgugggaaugcg

SEQ ID NO: 969628 - RNA, 15 nt, Mycobacterium avium subsp. paratuberculosis
gugucgccgagccgc

SEQ ID NO: 969629 - RNA, 16 nt, Mycobacterium avium subsp. paratuberculosis
gugucggugcccaggu

SEQ ID NO: 969630 - RNA, 14 nt, Mycobacterium avium subsp. paratuberculosis
gugucggcgggcgg

SEQ ID NO: 969631 - RNA, 20 nt, Mycobacterium avium subsp. paratuberculosis
gugucgaacagcaggcccag

SEQ ID NO: 969632 - RNA, 14 nt, Mycobacterium avium subsp. paratuberculosis
guguccagccgcac

SEQ ID NO: 969633 - RNA, 17 nt, Mycobacterium avium subsp. paratuberculosis
gugucccggauggagcg

SEQ ID NO: 969634 - RNA, 14 nt, Mycobacterium avium subsp. paratuberculosis
guguccgagcgggc

SEQ ID NO: 969635 - RNA, 17 nt, Mycobacterium avium subsp. paratuberculosis
guggaacaccgcgcuga

SEQ ID NO: 969636 - RNA, 22 nt, Mycobacterium avium subsp. paratuberculosis
guggaacaccgcgcugagcagg

SEQ ID NO: 969637 - RNA, 19 nt, Mycobacterium avium subsp. paratuberculosis
guggaacaguucggugcgg

SEQ ID NO: 969638 - RNA, 20 nt, Mycobacterium avium subsp. paratuberculosis
guggaacaguucggugcggg

SEQ ID NO: 969639 - RNA, 13 nt, Mycobacterium avium subsp. paratuberculosis
guggaacaucucc

SEQ ID NO: 969640 - RNA, 15 nt, Mycobacterium avium subsp. paratuberculosis
guggaacaucuccag

SEQ ID NO: 969641 - RNA, 20 nt, Mycobacterium avium subsp. paratuberculosis
guggaacaucuccagcgcgg

SEQ ID NO: 969642 - RNA, 20 nt, Mycobacterium avium subsp. paratuberculosis
guggaaggcgccggcgcggg

SEQ ID NO: 969643 - RNA, 16 nt, Mycobacterium avium subsp. paratuberculosis
guggaagguguuggug

SEQ ID NO: 969644 - RNA, 18 nt, Mycobacterium avium subsp. paratuberculosis
gugcuuucgcgucugcuc

SEQ ID NO: 969645 - RNA, 16 nt, Mycobacterium avium subsp. paratuberculosis
gugcgcagccgcugca

SEQ ID NO: 969646 - RNA, 17 nt, Mycobacterium avium subsp. paratuberculosis
guggagauggccagcac

SEQ ID NO: 969647 - RNA, 21 nt, Mycobacterium avium subsp. paratuberculosis
guggacuccagcaccagcacg

SEQ ID NO: 969648 - RNA, 15 nt, Mycobacterium avium subsp. paratuberculosis
guggacgcgaccagg

SEQ ID NO: 969649 - RNA, 22 nt, Mycobacterium avium subsp. paratuberculosis
guggacgcgaccaggcccagcg

SEQ ID NO: 969650 - RNA, 16 nt, Mycobacterium avium subsp. paratuberculosis
guggacaccgcaccca

SEQ ID NO: 969651 - RNA, 19 nt, Mycobacterium avium subsp. paratuberculosis
guggacaugcagccgccgc

SEQ ID NO: 969652 - RNA, 23 nt, Mycobacterium avium subsp. paratuberculosis
guggacccgccccgacagcaacg

SEQ ID NO: 969653 - RNA, 16 nt, Mycobacterium avium subsp. paratuberculosis
guggacgagcagccgc

SEQ ID NO: 969654 - RNA, 20 nt, Mycobacterium avium subsp. paratuberculosis
guggacgagucccaugggcu

SEQ ID NO: 969655 - RNA, 12 nt, Mycobacterium avium subsp. paratuberculosis
guggcagggcca

SEQ ID NO: 969656 - RNA, 18 nt, Mycobacterium avium subsp. paratuberculosis
guggcagggccagcagcc

SEQ ID NO: 969657 - RNA, 20 nt, Mycobacterium avium subsp. paratuberculosis
guggcaggccaucagcccgg

SEQ ID NO: 969658 - RNA, 16 nt, Mycobacterium avium subsp. paratuberculosis
guggcaggcgauggug

SEQ ID NO: 969659 - RNA, 20 nt, Mycobacterium avium subsp. paratuberculosis
guggcaccccgcgccgggcg

SEQ ID NO: 969660 - RNA, 15 nt, Mycobacterium avium subsp. paratuberculosis
guggcguugcgggcg

SEQ ID NO: 969661 - RNA, 16 nt, Mycobacterium avium subsp. paratuberculosis
gugggacggcgggugg

SEQ ID NO: 969662 - RNA, 16 nt, Mycobacterium avium subsp. paratuberculosis
gugggaaugcggcugg

SEQ ID NO: 969663 - RNA, 17 nt, Mycobacterium avium subsp. paratuberculosis
gugggaaugcggcuggg

SEQ ID NO: 969664 - RNA, 20 nt, Mycobacterium avium subsp. paratuberculosis
guggcguucgaugcccugcc

SEQ ID NO: 969665 - RNA, 14 nt, Mycobacterium avium subsp. paratuberculosis
guggcgugccgggc

SEQ ID NO: 969666 - RNA, 16 nt, Mycobacterium avium subsp. paratuberculosis
guggcgugcagcgcgg

SEQ ID NO: 969667 - RNA, 16 nt, Mycobacterium avium subsp. paratuberculosis
guggcgucgccgccgg

SEQ ID NO: 969668 - RNA, 15 nt, Mycobacterium avium subsp. paratuberculosis
guggcgucggccggg

SEQ ID NO: 969669 - RNA, 20 nt, Mycobacterium avium subsp. paratuberculosis
guggcgucggcggccugcuc

SEQ ID NO: 969670 - RNA, 14 nt, Mycobacterium avium subsp. paratuberculosis
guggcggugccgcg

SEQ ID NO: 969671 - RNA, 15 nt, Mycobacterium avium subsp. paratuberculosis
guggcgggccgccgg

SEQ ID NO: 969672 - RNA, 15 nt, Mycobacterium avium subsp. paratuberculosis
guggccucggcgcug

SEQ ID NO: 969673 - RNA, 21 nt, Mycobacterium avium subsp. paratuberculosis
guggccucgggggugaaggcg

SEQ ID NO: 969674 - RNA, 13 nt, Mycobacterium avium subsp. paratuberculosis
guggccggugggc

SEQ ID NO: 969675 - RNA, 18 nt, Mycobacterium avium subsp. paratuberculosis
guggccgugaugcgcaag

SEQ ID NO: 969676 - RNA, 14 nt, Mycobacterium avium subsp. paratuberculosis
guggccgggaugcc

SEQ ID NO: 969677 - RNA, 21 nt, Mycobacterium avium subsp. paratuberculosis
guggccgguaucgggucaccg

SEQ ID NO: 969678 - RNA, 16 nt, Mycobacterium avium subsp. paratuberculosis
guggccggccagcaca

SEQ ID NO: 969679 - RNA, 14 nt, Mycobacterium avium subsp. paratuberculosis
guggcaucaccgcc

SEQ ID NO: 969680 - RNA, 22 nt, Mycobacterium avium subsp. paratuberculosis
guggcccggauggccgggcagg

SEQ ID NO: 969681 - RNA, 22 nt, Mycobacterium avium subsp. paratuberculosis
guggcccgguacagcgccgcgg

SEQ ID NO: 969682 - RNA, 14 nt, Mycobacterium avium subsp. paratuberculosis
guggccgcgcuggu

SEQ ID NO: 969683 - RNA, 15 nt, Mycobacterium avium subsp. paratuberculosis
guggccgcgcugguc

SEQ ID NO: 969684 - RNA, 19 nt, Mycobacterium avium subsp. paratuberculosis
guggccgaucagcggcggg

SEQ ID NO: 969685 - RNA, 13 nt, Mycobacterium avium subsp. paratuberculosis
gugggcagcgcga

SEQ ID NO: 969686 - RNA, 23 nt, Mycobacterium avium subsp. paratuberculosis
gugggccaccacguacuccugcg

SEQ ID NO: 969687 - RNA, 16 nt, Mycobacterium avium subsp. paratuberculosis
gugggccagcgcggug

SEQ ID NO: 969688 - RNA, 22 nt, Mycobacterium avium subsp. paratuberculosis
gugggccaucgccaggaaccac

SEQ ID NO: 969689 - RNA, 14 nt, Mycobacterium avium subsp. paratuberculosis
gugggccgccgcgg

SEQ ID NO: 969690 - RNA, 22 nt, Mycobacterium avium subsp. paratuberculosis
gugggcgauccgcaggccgucg

SEQ ID NO: 969691 - RNA, 15 nt, Mycobacterium avium subsp. paratuberculosis
gugggcgcagggccg

SEQ ID NO: 969692 - RNA, 19 nt, Mycobacterium avium subsp. paratuberculosis
gugggcgcauaaaccuggu

SEQ ID NO: 969693 - RNA, 16 nt, Mycobacterium avium subsp. paratuberculosis
gugggcgccggcguca

SEQ ID NO: 969694 - RNA, 15 nt, Mycobacterium avium subsp. paratuberculosis
gugggcgcugguccu

SEQ ID NO: 969695 - RNA, 11 nt, Mycobacterium avium subsp. paratuberculosis
gugggcggcgc

SEQ ID NO: 969696 - RNA, 14 nt, Mycobacterium avium subsp. paratuberculosis
gugggcgggcaccc

SEQ ID NO: 969697 - RNA, 11 nt, Mycobacterium avium subsp. paratuberculosis
gugguccaggc

SEQ ID NO: 969698 - RNA, 15 nt, Mycobacterium avium subsp. paratuberculosis
gugguccuggcggug

SEQ ID NO: 969699 - RNA, 16 nt, Mycobacterium avium subsp. paratuberculosis
gugggcgugcaggccg

SEQ ID NO: 969700 - RNA, 22 nt, Mycobacterium avium subsp. paratuberculosis
guggucuccuggccgccgugca

SEQ ID NO: 969701 - RNA, 18 nt, Mycobacterium avium subsp. paratuberculosis
guggucgcugaccuucuu

SEQ ID NO: 969702 - RNA, 17 nt, Mycobacterium avium subsp. paratuberculosis
guggucggcagcaccgg

SEQ ID NO: 969703 - RNA, 23 nt, Mycobacterium avium subsp. paratuberculosis
guggucggcgaugcgcaccauca

SEQ ID NO: 969704 - RNA, 15 nt, Mycobacterium avium subsp. paratuberculosis
guggucugccagaac

SEQ ID NO: 969705 - RNA, 18 nt, Mycobacterium avium subsp. paratuberculosis
gugcaccugagucugggu

SEQ ID NO: 969706 - RNA, 23 nt, Mycobacterium avium subsp. paratuberculosis
gugcacgaacgcggccagcgggc

SEQ ID NO: 969707 - RNA, 20 nt, Mycobacterium avium subsp. paratuberculosis
gugcaccuuggucagcuccc

SEQ ID NO: 969708 - RNA, 15 nt, Mycobacterium avium subsp. paratuberculosis
gugcacgccgagcag

SEQ ID NO: 969709 - RNA, 20 nt, Mycobacterium avium subsp. paratuberculosis
gugcacgccguggcggcggg

SEQ ID NO: 969710 - RNA, 19 nt, Mycobacterium avium subsp. paratuberculosis
gugcacgagcgucgugcgg

SEQ ID NO: 969711 - RNA, 20 nt, Mycobacterium avium subsp. paratuberculosis
gugcacgagcgucgugcggg

SEQ ID NO: 969712 - RNA, 12 nt, Mycobacterium avium subsp. paratuberculosis
gugcagcgccag

SEQ ID NO: 969713 - RNA, 14 nt, Mycobacterium avium subsp. paratuberculosis
gugcagcgccagca

SEQ ID NO: 969714 - RNA, 15 nt, Mycobacterium avium subsp. paratuberculosis
gugcagcgccagcac

SEQ ID NO: 969715 - RNA, 14 nt, Mycobacterium avium subsp. paratuberculosis
gugcagcgcccagc

SEQ ID NO: 969716 - RNA, 23 nt, Mycobacterium avium subsp. paratuberculosis
gugcagcgcccagccgagccggg

SEQ ID NO: 969717 - RNA, 17 nt, Mycobacterium avium subsp. paratuberculosis
gugcagccgggcggcgc

SEQ ID NO: 969718 - RNA, 22 nt, Mycobacterium avium subsp. paratuberculosis
gugcagccgaagaacuggcuga

SEQ ID NO: 969719 - RNA, 14 nt, Mycobacterium avium subsp. paratuberculosis
gugcagaacagcac

SEQ ID NO: 969720 - RNA, 16 nt, Mycobacterium avium subsp. paratuberculosis
gugcacucagggcgau

SEQ ID NO: 969721 - RNA, 17 nt, Mycobacterium avium subsp. paratuberculosis
gugaucucgccgcggug

SEQ ID NO: 969722 - RNA, 21 nt, Mycobacterium avium subsp. paratuberculosis
gugaucugcaccagcguggug

SEQ ID NO: 969723 - RNA, 15 nt, Mycobacterium avium subsp. paratuberculosis
gugcaccgccagcgc

SEQ ID NO: 969724 - RNA, 20 nt, Mycobacterium avium subsp. paratuberculosis
gugcauccagccguccagcc

SEQ ID NO: 969725 - RNA, 18 nt, Mycobacterium avium subsp. paratuberculosis
gugcaucgucgcggcggu

SEQ ID NO: 969726 - RNA, 16 nt, Mycobacterium avium subsp. paratuberculosis
gugcaucggcgccugc

SEQ ID NO: 969727 - RNA, 18 nt, Mycobacterium avium subsp. paratuberculosis
gugcauagcuggcgccga

SEQ ID NO: 969728 - RNA, 19 nt, Mycobacterium avium subsp. paratuberculosis
gugcaggcccgggcggcga

SEQ ID NO: 969729 - RNA, 22 nt, Mycobacterium avium subsp. paratuberculosis
gugcaggccgcggguggcgcca

SEQ ID NO: 969730 - RNA, 19 nt, Mycobacterium avium subsp. paratuberculosis
gugcaggauccgcucgacg

SEQ ID NO: 969731 - RNA, 16 nt, Mycobacterium avium subsp. paratuberculosis
gugcagggucagcagc

SEQ ID NO: 969732 - RNA, 20 nt, Mycobacterium avium subsp. paratuberculosis
gugcccaccgggcagccgca

SEQ ID NO: 969733 - RNA, 22 nt, Mycobacterium avium subsp. paratuberculosis
gugcccaccgggcagccgcaca

SEQ ID NO: 969734 - RNA, 15 nt, Mycobacterium avium subsp. paratuberculosis
gugccgacggugcgu

SEQ ID NO: 969735 - RNA, 17 nt, Mycobacterium avium subsp. paratuberculosis
gugccaguaccagcggc

SEQ ID NO: 969736 - RNA, 19 nt, Mycobacterium avium subsp. paratuberculosis
gugccaguaccagcggccg

SEQ ID NO: 969737 - RNA, 22 nt, Mycobacterium avium subsp. paratuberculosis
gugcccagcaccgccggcgccg

SEQ ID NO: 969738 - RNA, 15 nt, Mycobacterium avium subsp. paratuberculosis
gugcccagccgcagg

SEQ ID NO: 969739 - RNA, 19 nt, Mycobacterium avium subsp. paratuberculosis
gugccgagcacgcggccgc

SEQ ID NO: 969740 - RNA, 16 nt, Mycobacterium avium subsp. paratuberculosis
gugccgagcccgccgg

SEQ ID NO: 969741 - RNA, 17 nt, Mycobacterium avium subsp. paratuberculosis
gugccgagcccgccggc

SEQ ID NO: 969742 - RNA, 13 nt, Mycobacterium avium subsp. paratuberculosis
gugccgagcgcgc

SEQ ID NO: 969743 - RNA, 14 nt, Mycobacterium avium subsp. paratuberculosis
gugccgcagguggu

SEQ ID NO: 969744 - RNA, 17 nt, Mycobacterium avium subsp. paratuberculosis
gugccgcaggugguggg

SEQ ID NO: 969745 - RNA, 16 nt, Mycobacterium avium subsp. paratuberculosis
gugccgauggccaccg

SEQ ID NO: 969746 - RNA, 18 nt, Mycobacterium avium subsp. paratuberculosis
gugccgauguaggacagg

SEQ ID NO: 969747 - RNA, 17 nt, Mycobacterium avium subsp. paratuberculosis
gugccgauuccagcaac

SEQ ID NO: 969748 - RNA, 15 nt, Mycobacterium avium subsp. paratuberculosis
gugccgcaccagcac

SEQ ID NO: 969749 - RNA, 13 nt, Mycobacterium avium subsp. paratuberculosis
gugccggaagcgg

SEQ ID NO: 969750 - RNA, 17 nt, Mycobacterium avium subsp. paratuberculosis
gugccgcugcccgccgc

SEQ ID NO: 969751 - RNA, 14 nt, Mycobacterium avium subsp. paratuberculosis
gugccggcagcccg

SEQ ID NO: 969752 - RNA, 13 nt, Mycobacterium avium subsp. paratuberculosis
gugccggcccagu

SEQ ID NO: 969753 - RNA, 22 nt, Mycobacterium avium subsp. paratuberculosis
gugccggccucgucggcgagca

SEQ ID NO: 969754 - RNA, 19 nt, Mycobacterium avium subsp. paratuberculosis
gugccgccauacccacaau

SEQ ID NO: 969755 - RNA, 17 nt, Mycobacterium avium subsp. paratuberculosis
gugccgggggccgagca

SEQ ID NO: 969756 - RNA, 16 nt, Mycobacterium avium subsp. paratuberculosis
gugccgguccagccgc

SEQ ID NO: 969757 - RNA, 14 nt, Mycobacterium avium subsp. paratuberculosis
gugccggugaugaa

SEQ ID NO: 969758 - RNA, 19 nt, Mycobacterium avium subsp. paratuberculosis
gugccggcgggucagcagc

SEQ ID NO: 969759 - RNA, 15 nt, Mycobacterium avium subsp. paratuberculosis
gugccggcgcaccgc

SEQ ID NO: 969760 - RNA, 18 nt, Mycobacterium avium subsp. paratuberculosis
gugccgggucgcagcggc

SEQ ID NO: 969761 - RNA, 14 nt, Mycobacterium avium subsp. paratuberculosis
gugccguccagcuc

SEQ ID NO: 969762 - RNA, 14 nt, Mycobacterium avium subsp. paratuberculosis
gugccgucgcgcuc

SEQ ID NO: 969763 - RNA, 17 nt, Mycobacterium avium subsp. paratuberculosis
gugccugcgggcccagc

SEQ ID NO: 969764 - RNA, 16 nt, Mycobacterium avium subsp. paratuberculosis
gugagcuggccgcgca

SEQ ID NO: 969765 - RNA, 20 nt, Mycobacterium avium subsp. paratuberculosis
gugagcacgaccgccagcag

SEQ ID NO: 969766 - RNA, 19 nt, Mycobacterium avium subsp. paratuberculosis
gugagccgggugcccgcgu

SEQ ID NO: 969767 - RNA, 22 nt, Mycobacterium avium subsp. paratuberculosis
gugaggcacccgcugcaccagc

SEQ ID NO: 969768 - RNA, 15 nt, Mycobacterium avium subsp. paratuberculosis
gugaggccgaggcga

SEQ ID NO: 969769 - RNA, 21 nt, Mycobacterium avium subsp. paratuberculosis
gugaggccgaggcgagugagg

SEQ ID NO: 969770 - RNA, 22 nt, Mycobacterium avium subsp. paratuberculosis
gugaggccgaggcgagugagga

SEQ ID NO: 969771 - RNA, 11 nt, Mycobacterium avium subsp. paratuberculosis
gugaggccagc

SEQ ID NO: 969772 - RNA, 14 nt, Mycobacterium avium subsp. paratuberculosis
gugaggcccggcgu

SEQ ID NO: 969773 - RNA, 23 nt, Mycobacterium avium subsp. paratuberculosis
gugagguggcguagucgucgauc

SEQ ID NO: 969774 - RNA, 14 nt, Mycobacterium avium subsp. paratuberculosis
gugaggucgcgcag

SEQ ID NO: 969775 - RNA, 17 nt, Mycobacterium avium subsp. paratuberculosis
gugaucagcagcagguc

SEQ ID NO: 969776 - RNA, 13 nt, Mycobacterium avium subsp. paratuberculosis
gugaucacccagc

SEQ ID NO: 969777 - RNA, 19 nt, Mycobacterium avium subsp. paratuberculosis
gugaucucaccggcggcgg

SEQ ID NO: 969778 - RNA, 16 nt, Mycobacterium avium subsp. paratuberculosis
gugaucucccgugcgg

SEQ ID NO: 969779 - RNA, 17 nt, Mycobacterium avium subsp. paratuberculosis
gugaucggucugccugg

SEQ ID NO: 969780 - RNA, 17 nt, Mycobacterium avium subsp. paratuberculosis
gugaucggugcccgcgg

SEQ ID NO: 969781 - RNA, 14 nt, Mycobacterium avium subsp. paratuberculosis
gugaucggccagcc

SEQ ID NO: 969782 - RNA, 15 nt, Mycobacterium avium subsp. paratuberculosis
gugaucggccaggcg

SEQ ID NO: 969783 - RNA, 23 nt, Mycobacterium avium subsp. paratuberculosis
gugaucggccaggcgcccagcac

SEQ ID NO: 969784 - RNA, 16 nt, Mycobacterium avium subsp. paratuberculosis
gugaucggcggccugc

SEQ ID NO: 969785 - RNA, 14 nt, Mycobacterium avium subsp. paratuberculosis
gugaucgccaccac

SEQ ID NO: 969786 - RNA, 22 nt, Mycobacterium avium subsp. paratuberculosis
gugaucgcgaacgcgccgguga

SEQ ID NO: 969787 - RNA, 16 nt, Mycobacterium avium subsp. paratuberculosis
gugauagcccaggccu

SEQ ID NO: 969788 - RNA, 22 nt, Mycobacterium avium subsp. paratuberculosis
gugauaggccucguggaacacc

SEQ ID NO: 969789 - RNA, 22 nt, Mycobacterium avium subsp. paratuberculosis
gugacgaaaugcaacgcacggg

SEQ ID NO: 969790 - RNA, 24 nt, Mycobacterium avium subsp. paratuberculosis
gugacgaaaugcaacgcacgggcg

SEQ ID NO: 969791 - RNA, 22 nt, Mycobacterium avium subsp. paratuberculosis
gugacgaucuggcgcaucagcg

SEQ ID NO: 969792 - RNA, 20 nt, Mycobacterium avium subsp. paratuberculosis
gugacgccgauccgcugcgg

SEQ ID NO: 969793 - RNA, 19 nt, Mycobacterium avium subsp. paratuberculosis
gugacgcggcgucgggcgg

SEQ ID NO: 969794 - RNA, 14 nt, Mycobacterium avium subsp. paratuberculosis
gugacgcgggaccg

SEQ ID NO: 969795 - RNA, 16 nt, Mycobacterium avium subsp. paratuberculosis
gugacgcucgccggcg

SEQ ID NO: 969796 - RNA, 20 nt, Mycobacterium avium subsp. paratuberculosis
gugacgcucggcgccggccg

SEQ ID NO: 969797 - RNA, 17 nt, Mycobacterium avium subsp. paratuberculosis
gugacgcugaccugugc

SEQ ID NO: 969798 - RNA, 22 nt, Mycobacterium avium subsp. paratuberculosis
gugacggccgugaugccgggca

SEQ ID NO: 969799 - RNA, 14 nt, Mycobacterium avium subsp. paratuberculosis
gugacggcggggcg

SEQ ID NO: 969800 - RNA, 16 nt, Mycobacterium avium subsp. paratuberculosis
gugacggauccgggcg

SEQ ID NO: 969801 - RNA, 13 nt, Mycobacterium avium subsp. paratuberculosis
gugacggucaggg

SEQ ID NO: 969802 - RNA, 16 nt, Mycobacterium avium subsp. paratuberculosis
gugacguacgggcuga

SEQ ID NO: 969803 - RNA, 24 nt, Mycobacterium avium subsp. paratuberculosis
gugacgucgcgccgcucggccagc

SEQ ID NO: 969804 - RNA, 12 nt, Mycobacterium avium subsp. paratuberculosis
gugacgugcccc

SEQ ID NO: 969805 - RNA, 21 nt, Mycobacterium avium subsp. paratuberculosis
gugaccacggucacagccgcg

SEQ ID NO: 969806 - RNA, 13 nt, Mycobacterium avium subsp. paratuberculosis
gugacaggggcag

SEQ ID NO: 969807 - RNA, 16 nt, Mycobacterium avium subsp. paratuberculosis
gugacaggggcagcag

SEQ ID NO: 969808 - RNA, 13 nt, Mycobacterium avium subsp. paratuberculosis
gugaccugcagcg

SEQ ID NO: 969809 - RNA, 15 nt, Mycobacterium avium subsp. paratuberculosis
gugaccugcagcgcc

SEQ ID NO: 969810 - RNA, 19 nt, Mycobacterium avium subsp. paratuberculosis
gugaccugcugggcgggca

SEQ ID NO: 969811 - RNA, 20 nt, Mycobacterium avium subsp. paratuberculosis
gugaccgucacccccggcgc

SEQ ID NO: 969812 - RNA, 15 nt, Mycobacterium avium subsp. paratuberculosis
gugaccggcgccggg

SEQ ID NO: 969813 - RNA, 13 nt, Mycobacterium avium subsp. paratuberculosis
gugaccggcgcgc

SEQ ID NO: 969814 - RNA, 15 nt, Mycobacterium avium subsp. paratuberculosis
gugaccggcgcgccc

SEQ ID NO: 969815 - RNA, 14 nt, Mycobacterium avium subsp. paratuberculosis
gugaccggcugcuc

SEQ ID NO: 969816 - RNA, 20 nt, Mycobacterium avium subsp. paratuberculosis
gugaccgccuuggcgcgcuc

SEQ ID NO: 969817 - RNA, 14 nt, Mycobacterium avium subsp. paratuberculosis
gugaccucgagcag

SEQ ID NO: 969818 - RNA, 16 nt, Mycobacterium avium subsp. paratuberculosis
gugaccucgagcagcg

SEQ ID NO: 969819 - RNA, 13 nt, Mycobacterium avium subsp. paratuberculosis
gugaccccggcga

SEQ ID NO: 969820 - RNA, 14 nt, Mycobacterium avium subsp. paratuberculosis
gugacccgggcgau

SEQ ID NO: 969821 - RNA, 14 nt, Mycobacterium avium subsp. paratuberculosis
gugaccgccagcac

SEQ ID NO: 969822 - RNA, 15 nt, Mycobacterium avium subsp. paratuberculosis
gugaccgccagcacc

SEQ ID NO: 969823 - RNA, 16 nt, Mycobacterium avium subsp. paratuberculosis
gugaccgccagcaccg

SEQ ID NO: 969824 - RNA, 17 nt, Mycobacterium avium subsp. paratuberculosis
gugaacucguccaugcu

SEQ ID NO: 969825 - RNA, 13 nt, Mycobacterium avium subsp. paratuberculosis
gugaacgccucgg

SEQ ID NO: 969826 - RNA, 19 nt, Mycobacterium avium subsp. paratuberculosis
gugaacgcgguaccgauga

SEQ ID NO: 969827 - RNA, 14 nt, Mycobacterium avium subsp. paratuberculosis
gugaacgccgguga

SEQ ID NO: 969828 - RNA, 17 nt, Mycobacterium avium subsp. paratuberculosis
gugaacccugggcggcg

SEQ ID NO: 969829 - RNA, 18 nt, Mycobacterium avium subsp. paratuberculosis
gugaauccagccgugcgg

SEQ ID NO: 969830 - RNA, 14 nt, Mycobacterium avium subsp. paratuberculosis
gugaaugcccagcg

SEQ ID NO: 969831 - RNA, 18 nt, Mycobacterium avium subsp. paratuberculosis
gugacaaagaucacagcg

SEQ ID NO: 969832 - RNA, 13 nt, Mycobacterium avium subsp. paratuberculosis
gugaagugccggc

SEQ ID NO: 969833 - RNA, 13 nt, Mycobacterium avium subsp. paratuberculosis
gugaagugccggu

SEQ ID NO: 969834 - RNA, 21 nt, Mycobacterium avium subsp. paratuberculosis
gugaagugccgguccagccgc

SEQ ID NO: 969835 - RNA, 16 nt, Mycobacterium avium subsp. paratuberculosis
gugaaguuaguuucac

SEQ ID NO: 969836 - RNA, 22 nt, Mycobacterium avium subsp. paratuberculosis
gugaaguccaugaacggcagcu

SEQ ID NO: 969837 - RNA, 17 nt, Mycobacterium avium subsp. paratuberculosis
gugaaguuggcggcggu

SEQ ID NO: 969838 - RNA, 19 nt, Mycobacterium avium subsp. paratuberculosis
gugaaggccuggaugccgc

SEQ ID NO: 969839 - RNA, 14 nt, Mycobacterium avium subsp. paratuberculosis
gugaagcggcgcgg

SEQ ID NO: 969840 - RNA, 14 nt, Mycobacterium avium subsp. paratuberculosis
gugaagcuagcuuc

SEQ ID NO: 969841 - RNA, 16 nt, Mycobacterium avium subsp. paratuberculosis
gugaagcuaguuucac

SEQ ID NO: 969842 - RNA, 14 nt, Mycobacterium avium subsp. paratuberculosis
gugaagccgguggg

SEQ ID NO: 969843 - RNA, 22 nt, Mycobacterium avium subsp. paratuberculosis
gugaagccguagacggucaggu

SEQ ID NO: 969844 - RNA, 16 nt, Mycobacterium avium subsp. paratuberculosis
gugaagccgacgccgu

SEQ ID NO: 969845 - RNA, 18 nt, Mycobacterium avium subsp. paratuberculosis
gucuuucgucgcuuggua

SEQ ID NO: 969846 - RNA, 15 nt, Mycobacterium avium subsp. paratuberculosis
gucuuguugaccuuc

SEQ ID NO: 969847 - RNA, 15 nt, Mycobacterium avium subsp. paratuberculosis
gugaaacuagcuuca

SEQ ID NO: 969848 - RNA, 20 nt, Mycobacterium avium subsp. paratuberculosis
gucuucucguccgcgcuggc

SEQ ID NO: 969849 - RNA, 18 nt, Mycobacterium avium subsp. paratuberculosis
gucuugacgaacuccugc

SEQ ID NO: 969850 - RNA, 20 nt, Mycobacterium avium subsp. paratuberculosis
gucuugaggaugacggggug

SEQ ID NO: 969851 - RNA, 13 nt, Mycobacterium avium subsp. paratuberculosis
gucuugcagccgg

SEQ ID NO: 969852 - RNA, 16 nt, Mycobacterium avium subsp. paratuberculosis
gucuuggacagcagca

SEQ ID NO: 969853 - RNA, 14 nt, Mycobacterium avium subsp. paratuberculosis
gucuugcugggugg

SEQ ID NO: 969854 - RNA, 13 nt, Mycobacterium avium subsp. paratuberculosis
gucuuggccaggc

SEQ ID NO: 969855 - RNA, 10 nt, Mycobacterium avium subsp. paratuberculosis
gucuuggccu

SEQ ID NO: 969856 - RNA, 15 nt, Mycobacterium avium subsp. paratuberculosis
gucugcugcgccauc

SEQ ID NO: 969857 - RNA, 15 nt, Mycobacterium avium subsp. paratuberculosis
gucugcucggcggcu

SEQ ID NO: 969858 - RNA, 19 nt, Mycobacterium avium subsp. paratuberculosis
gucuggcagccggccggca

SEQ ID NO: 969859 - RNA, 11 nt, Mycobacterium avium subsp. paratuberculosis
gucuggccccg

SEQ ID NO: 969860 - RNA, 19 nt, Mycobacterium avium subsp. paratuberculosis
gucuggcucggcaccagag

SEQ ID NO: 969861 - RNA, 17 nt, Mycobacterium avium subsp. paratuberculosis
gucugggccgccgagca

SEQ ID NO: 969862 - RNA, 17 nt, Mycobacterium avium subsp. paratuberculosis
gucugucgcgcgaacag

SEQ ID NO: 969863 - RNA, 19 nt, Mycobacterium avium subsp. paratuberculosis
gucuguggaucgugucugg

SEQ ID NO: 969864 - RNA, 14 nt, Mycobacterium avium subsp. paratuberculosis
gucugagcccgggc

SEQ ID NO: 969865 - RNA, 20 nt, Mycobacterium avium subsp. paratuberculosis
gucugaccccccgacgccga

SEQ ID NO: 969866 - RNA, 13 nt, Mycobacterium avium subsp. paratuberculosis
gucugcagcgacg

SEQ ID NO: 969867 - RNA, 20 nt, Mycobacterium avium subsp. paratuberculosis
gucugcauccggaaccgggc

SEQ ID NO: 969868 - RNA, 15 nt, Mycobacterium avium subsp. paratuberculosis
gucugcaccgggaug

SEQ ID NO: 969869 - RNA, 14 nt, Mycobacterium avium subsp. paratuberculosis
gucugaucgcccag

SEQ ID NO: 969870 - RNA, 21 nt, Mycobacterium avium subsp. paratuberculosis
gucugcuccccguugaucuug

SEQ ID NO: 969871 - RNA, 22 nt, Mycobacterium avium subsp. paratuberculosis
gucugcggccgcgacugcaccc

SEQ ID NO: 969872 - RNA, 15 nt, Mycobacterium avium subsp. paratuberculosis
gucugcgccagcucc

SEQ ID NO: 969873 - RNA, 19 nt, Mycobacterium avium subsp. paratuberculosis
gucugccagaacggcggca

SEQ ID NO: 969874 - RNA, 18 nt, Mycobacterium avium subsp. paratuberculosis
gucucgacaccggcgguc

SEQ ID NO: 969875 - RNA, 20 nt, Mycobacterium avium subsp. paratuberculosis
gucucgaccacccggcgggc

SEQ ID NO: 969876 - RNA, 20 nt, Mycobacterium avium subsp. paratuberculosis
gucucgacccgggccagcag

SEQ ID NO: 969877 - RNA, 15 nt, Mycobacterium avium subsp. paratuberculosis
gucucgaaccgggcg

SEQ ID NO: 969878 - RNA, 20 nt, Mycobacterium avium subsp. paratuberculosis
gucucgaaccgucuagcggc

SEQ ID NO: 969879 - RNA, 16 nt, Mycobacterium avium subsp. paratuberculosis
gucuccuggggcagau

SEQ ID NO: 969880 - RNA, 14 nt, Mycobacterium avium subsp. paratuberculosis
gucucgacggcgcc

SEQ ID NO: 969881 - RNA, 15 nt, Mycobacterium avium subsp. paratuberculosis
gucucgcccaccuug

SEQ ID NO: 969882 - RNA, 16 nt, Mycobacterium avium subsp. paratuberculosis
gucucgcccaccuugg

SEQ ID NO: 969883 - RNA, 18 nt, Mycobacterium avium subsp. paratuberculosis
gucucgccggggaacacc

SEQ ID NO: 969884 - RNA, 16 nt, Mycobacterium avium subsp. paratuberculosis
gucucggccagccggu

SEQ ID NO: 969885 - RNA, 18 nt, Mycobacterium avium subsp. paratuberculosis
gucucggccgcggugcgu

SEQ ID NO: 969886 - RNA, 13 nt, Mycobacterium avium subsp. paratuberculosis
gucucggcgaggc

SEQ ID NO: 969887 - RNA, 17 nt, Mycobacterium avium subsp. paratuberculosis
gucucggcgaggcgcuc

SEQ ID NO: 969888 - RNA, 18 nt, Mycobacterium avium subsp. paratuberculosis
gucucgggcagcagcacc

SEQ ID NO: 969889 - RNA, 13 nt, Mycobacterium avium subsp. paratuberculosis
gucuacuccacca

SEQ ID NO: 969890 - RNA, 19 nt, Mycobacterium avium subsp. paratuberculosis
gucuacuuggccagcugcg

SEQ ID NO: 969891 - RNA, 14 nt, Mycobacterium avium subsp. paratuberculosis
gucguuugguggug

SEQ ID NO: 969892 - RNA, 14 nt, Mycobacterium avium subsp. paratuberculosis
gucguuguccagcg

SEQ ID NO: 969893 - RNA, 17 nt, Mycobacterium avium subsp. paratuberculosis
gucguugucgucgccgg

SEQ ID NO: 969894 - RNA, 17 nt, Mycobacterium avium subsp. paratuberculosis
gucguugcgggcggcgc

SEQ ID NO: 969895 - RNA, 13 nt, Mycobacterium avium subsp. paratuberculosis
gucguuggcccgc

SEQ ID NO: 969896 - RNA, 16 nt, Mycobacterium avium subsp. paratuberculosis
gucguucuccagcccu

SEQ ID NO: 969897 - RNA, 22 nt, Mycobacterium avium subsp. paratuberculosis
gucguugaacgcgcgggugcgg

SEQ ID NO: 969898 - RNA, 20 nt, Mycobacterium avium subsp. paratuberculosis
gucguugaaggccugcagaa

SEQ ID NO: 969899 - RNA, 15 nt, Mycobacterium avium subsp. paratuberculosis
gucguugcacacccg

SEQ ID NO: 969900 - RNA, 18 nt, Mycobacterium avium subsp. paratuberculosis
gucguugcacacccggug

SEQ ID NO: 969901 - RNA, 20 nt, Mycobacterium avium subsp. paratuberculosis
gucguugcacacccggugcg

SEQ ID NO: 969902 - RNA, 13 nt, Mycobacterium avium subsp. paratuberculosis
gucuccgcgcagc

SEQ ID NO: 969903 - RNA, 17 nt, Mycobacterium avium subsp. paratuberculosis
gucuccggccccgagcc

SEQ ID NO: 969904 - RNA, 13 nt, Mycobacterium avium subsp. paratuberculosis
gucuccggcggca

SEQ ID NO: 969905 - RNA, 19 nt, Mycobacterium avium subsp. paratuberculosis
gucuccguagcccugcagg

SEQ ID NO: 969906 - RNA, 16 nt, Mycobacterium avium subsp. paratuberculosis
gucucaaucuucuccg

SEQ ID NO: 969907 - RNA, 21 nt, Mycobacterium avium subsp. paratuberculosis
gucucaaucuucuccgcggcc

SEQ ID NO: 969908 - RNA, 15 nt, Mycobacterium avium subsp. paratuberculosis
gucucaucccgccga

SEQ ID NO: 969909 - RNA, 19 nt, Mycobacterium avium subsp. paratuberculosis
gucguagccgaagccgccg

SEQ ID NO: 969910 - RNA, 16 nt, Mycobacterium avium subsp. paratuberculosis
gucguagacgcugccg

SEQ ID NO: 969911 - RNA, 20 nt, Mycobacterium avium subsp. paratuberculosis
gucguaguaggcgccgaacg

SEQ ID NO: 969912 - RNA, 15 nt, Mycobacterium avium subsp. paratuberculosis
gucgguuuggcuggu

SEQ ID NO: 969913 - RNA, 13 nt, Mycobacterium avium subsp. paratuberculosis
gucguacagcagc

SEQ ID NO: 969914 - RNA, 16 nt, Mycobacterium avium subsp. paratuberculosis
gucguacagcagcccc

SEQ ID NO: 969915 - RNA, 14 nt, Mycobacterium avium subsp. paratuberculosis
gucguacucgggug

SEQ ID NO: 969916 - RNA, 16 nt, Mycobacterium avium subsp. paratuberculosis
gucggugguggggccg

SEQ ID NO: 969917 - RNA, 15 nt, Mycobacterium avium subsp. paratuberculosis
gucggugcggccgca

SEQ ID NO: 969918 - RNA, 14 nt, Mycobacterium avium subsp. paratuberculosis
gucggucugcaggu

SEQ ID NO: 969919 - RNA, 17 nt, Mycobacterium avium subsp. paratuberculosis
gucggugccgcggcgca

SEQ ID NO: 969920 - RNA, 16 nt, Mycobacterium avium subsp. paratuberculosis
gucggugccgcguucg

SEQ ID NO: 969921 - RNA, 12 nt, Mycobacterium avium subsp. paratuberculosis
gucggugcagug

SEQ ID NO: 969922 - RNA, 13 nt, Mycobacterium avium subsp. paratuberculosis
gucggugcccuug

SEQ ID NO: 969923 - RNA, 17 nt, Mycobacterium avium subsp. paratuberculosis
gucggugcgcgccgcaa

SEQ ID NO: 969924 - RNA, 16 nt, Mycobacterium avium subsp. paratuberculosis
gucggguuggccaggg

SEQ ID NO: 969925 - RNA, 15 nt, Mycobacterium avium subsp. paratuberculosis
gucggucagcaggcg

SEQ ID NO: 969926 - RNA, 18 nt, Mycobacterium avium subsp. paratuberculosis
gucggucagcgucgccgc

SEQ ID NO: 969927 - RNA, 16 nt, Mycobacterium avium subsp. paratuberculosis
gucguguucgccgagg

SEQ ID NO: 969928 - RNA, 16 nt, Mycobacterium avium subsp. paratuberculosis
gucguggccgacggga

SEQ ID NO: 969929 - RNA, 20 nt, Mycobacterium avium subsp. paratuberculosis
gucgugcagcaccgccagca

SEQ ID NO: 969930 - RNA, 19 nt, Mycobacterium avium subsp. paratuberculosis
gucgugccgggugaugcag

SEQ ID NO: 969931 - RNA, 19 nt, Mycobacterium avium subsp. paratuberculosis
gucgucggugccgaagcgc

SEQ ID NO: 969932 - RNA, 19 nt, Mycobacterium avium subsp. paratuberculosis
gucgucggugggccgccgc

SEQ ID NO: 969933 - RNA, 12 nt, Mycobacterium avium subsp. paratuberculosis
gucgucguccuc

SEQ ID NO: 969934 - RNA, 20 nt, Mycobacterium avium subsp. paratuberculosis
gucgucguugugggccagcg

SEQ ID NO: 969935 - RNA, 15 nt, Mycobacterium avium subsp. paratuberculosis
gucgucgagggccac

SEQ ID NO: 969936 - RNA, 16 nt, Mycobacterium avium subsp. paratuberculosis
gucgucgaugaacagc

SEQ ID NO: 969937 - RNA, 24 nt, Mycobacterium avium subsp. paratuberculosis
gucgucgcccgucucggcgugcuc

SEQ ID NO: 969938 - RNA, 16 nt, Mycobacterium avium subsp. paratuberculosis
gucgucgccgccggug

SEQ ID NO: 969939 - RNA, 19 nt, Mycobacterium avium subsp. paratuberculosis
gucgucggacagcagcacc

SEQ ID NO: 969940 - RNA, 19 nt, Mycobacterium avium subsp. paratuberculosis
gucgucggccucggcggcc

SEQ ID NO: 969941 - RNA, 16 nt, Mycobacterium avium subsp. paratuberculosis
gucgucggccugcacg

SEQ ID NO: 969942 - RNA, 16 nt, Mycobacterium avium subsp. paratuberculosis
gucgucggccuguccg

SEQ ID NO: 969943 - RNA, 14 nt, Mycobacterium avium subsp. paratuberculosis
gucgucgggcagga

SEQ ID NO: 969944 - RNA, 17 nt, Mycobacterium avium subsp. paratuberculosis
gucgucgggccgcagca

SEQ ID NO: 969945 - RNA, 14 nt, Mycobacterium avium subsp. paratuberculosis
gucgucgggcgccg

SEQ ID NO: 969946 - RNA, 18 nt, Mycobacterium avium subsp. paratuberculosis
gucgucggguuggccagg

SEQ ID NO: 969947 - RNA, 18 nt, Mycobacterium avium subsp. paratuberculosis
gucguccagcgucgacug

SEQ ID NO: 969948 - RNA, 20 nt, Mycobacterium avium subsp. paratuberculosis
gucguccacgcccagcgccc

SEQ ID NO: 969949 - RNA, 22 nt, Mycobacterium avium subsp. paratuberculosis
gucguccacgcccagcgccccg

SEQ ID NO: 969950 - RNA, 19 nt, Mycobacterium avium subsp. paratuberculosis
gucgucgaagagcuggucg

SEQ ID NO: 969951 - RNA, 15 nt, Mycobacterium avium subsp. paratuberculosis
gucgucgaaggccug

SEQ ID NO: 969952 - RNA, 18 nt, Mycobacterium avium subsp. paratuberculosis
gucguccggcgcgcagca

SEQ ID NO: 969953 - RNA, 14 nt, Mycobacterium avium subsp. paratuberculosis
gucgcucggcggcg

SEQ ID NO: 969954 - RNA, 15 nt, Mycobacterium avium subsp. paratuberculosis
gucgcucggcggcga

SEQ ID NO: 969955 - RNA, 19 nt, Mycobacterium avium subsp. paratuberculosis
gucgcugaccaccgaggug

SEQ ID NO: 969956 - RNA, 20 nt, Mycobacterium avium subsp. paratuberculosis
gucgcugaccccgcucggcg

SEQ ID NO: 969957 - RNA, 17 nt, Mycobacterium avium subsp. paratuberculosis
gucgcugacccgccgca

SEQ ID NO: 969958 - RNA, 18 nt, Mycobacterium avium subsp. paratuberculosis
gucgcgguccacgccggc

SEQ ID NO: 969959 - RNA, 21 nt, Mycobacterium avium subsp. paratuberculosis
gucgcggucccaggugcuggg

SEQ ID NO: 969960 - RNA, 21 nt, Mycobacterium avium subsp. paratuberculosis
gucgcgguagaucgacagggc

SEQ ID NO: 969961 - RNA, 18 nt, Mycobacterium avium subsp. paratuberculosis
gucgcggugggcucggcg

SEQ ID NO: 969962 - RNA, 18 nt, Mycobacterium avium subsp. paratuberculosis
gucgcggugucggcgucg

SEQ ID NO: 969963 - RNA, 17 nt, Mycobacterium avium subsp. paratuberculosis
gucgcguagggcagggu

SEQ ID NO: 969964 - RNA, 17 nt, Mycobacterium avium subsp. paratuberculosis
gucgcguccagcaugcc

SEQ ID NO: 969965 - RNA, 16 nt, Mycobacterium avium subsp. paratuberculosis
gucggcauagcgccgc

SEQ ID NO: 969966 - RNA, 14 nt, Mycobacterium avium subsp. paratuberculosis
gucggagcgcucca

SEQ ID NO: 969967 - RNA, 17 nt, Mycobacterium avium subsp. paratuberculosis
gucggagcgcuccacca

SEQ ID NO: 969968 - RNA, 14 nt, Mycobacterium avium subsp. paratuberculosis
gucggacaccagca

SEQ ID NO: 969969 - RNA, 18 nt, Mycobacterium avium subsp. paratuberculosis
gucggaguccagcacgcc

SEQ ID NO: 969970 - RNA, 14 nt, Mycobacterium avium subsp. paratuberculosis
gucggaucgagcuc

SEQ ID NO: 969971 - RNA, 13 nt, Mycobacterium avium subsp. paratuberculosis
gucggcaccagcg

SEQ ID NO: 969972 - RNA, 15 nt, Mycobacterium avium subsp. paratuberculosis
gucggcaccagcggc

SEQ ID NO: 969973 - RNA, 18 nt, Mycobacterium avium subsp. paratuberculosis
gucgcgcaccgcggcggg

SEQ ID NO: 969974 - RNA, 12 nt, Mycobacterium avium subsp. paratuberculosis
gucgcgccgcca

SEQ ID NO: 969975 - RNA, 15 nt, Mycobacterium avium subsp. paratuberculosis
gucgcgggcggggcg

SEQ ID NO: 969976 - RNA, 19 nt, Mycobacterium avium subsp. paratuberculosis
gucgcgggcgucgggcagc

SEQ ID NO: 969977 - RNA, 20 nt, Mycobacterium avium subsp. paratuberculosis
gucgcgcaaacugacaggcg

SEQ ID NO: 969978 - RNA, 16 nt, Mycobacterium avium subsp. paratuberculosis
gucgcgcccggcgucg

SEQ ID NO: 969979 - RNA, 16 nt, Mycobacterium avium subsp. paratuberculosis
gucgcgcagccgccgg

SEQ ID NO: 969980 - RNA, 16 nt, Mycobacterium avium subsp. paratuberculosis
gucgcgcagccucaga

SEQ ID NO: 969981 - RNA, 22 nt, Mycobacterium avium subsp. paratuberculosis
gucgcgcaucgccucggcggcc

SEQ ID NO: 969982 - RNA, 16 nt, Mycobacterium avium subsp. paratuberculosis
gucgagccagcgggcc

SEQ ID NO: 969983 - RNA, 16 nt, Mycobacterium avium subsp. paratuberculosis
gucgagccgcucgcgc

SEQ ID NO: 969984 - RNA, 19 nt, Mycobacterium avium subsp. paratuberculosis
gucgagccgggcccgggug

SEQ ID NO: 969985 - RNA, 13 nt, Mycobacterium avium subsp. paratuberculosis
gucgagcagcagc

SEQ ID NO: 969986 - RNA, 18 nt, Mycobacterium avium subsp. paratuberculosis
gucgaugacguccaccag

SEQ ID NO: 969987 - RNA, 21 nt, Mycobacterium avium subsp. paratuberculosis
gucgaugaaguugaagacgcg

SEQ ID NO: 969988 - RNA, 17 nt, Mycobacterium avium subsp. paratuberculosis
gucgagcggcccgcacc

SEQ ID NO: 969989 - RNA, 19 nt, Mycobacterium avium subsp. paratuberculosis
gucgagcggcccgucgccg

SEQ ID NO: 969990 - RNA, 17 nt, Mycobacterium avium subsp. paratuberculosis
gucgaucucggccagcg

SEQ ID NO: 969991 - RNA, 16 nt, Mycobacterium avium subsp. paratuberculosis
gucgauggacagggcg

SEQ ID NO: 969992 - RNA, 14 nt, Mycobacterium avium subsp. paratuberculosis
gucgaugccgagcc

SEQ ID NO: 969993 - RNA, 22 nt, Mycobacterium avium subsp. paratuberculosis
gucgagcagguucuccucccag

SEQ ID NO: 969994 - RNA, 19 nt, Mycobacterium avium subsp. paratuberculosis
gucgaugucgacgccgugc

SEQ ID NO: 969995 - RNA, 23 nt, Mycobacterium avium subsp. paratuberculosis
gucgaugucggcgaaccagggca

SEQ ID NO: 969996 - RNA, 16 nt, Mycobacterium avium subsp. paratuberculosis
gucgaugucggcggcc

SEQ ID NO: 969997 - RNA, 19 nt, Mycobacterium avium subsp. paratuberculosis
gucgaugucgguggcgcgc

SEQ ID NO: 969998 - RNA, 16 nt, Mycobacterium avium subsp. paratuberculosis
gucgaugugcgcgcug

SEQ ID NO: 969999 - RNA, 12 nt, Mycobacterium avium subsp. paratuberculosis
gucggcggccuu

SEQ ID NO: 970000 - RNA, 21 nt, Mycobacterium avium subsp. paratuberculosis
gucggcgguuucggugccggc

SEQ ID NO: 970001 - RNA, 18 nt, Mycobacterium avium subsp. paratuberculosis
gucggcguccagcgcggu

SEQ ID NO: 970002 - RNA, 17 nt, Mycobacterium avium subsp. paratuberculosis
gucggcgucgccgagcc

SEQ ID NO: 970003 - RNA, 17 nt, Mycobacterium avium subsp. paratuberculosis
gucggcgucgggccggg

SEQ ID NO: 970004 - RNA, 13 nt, Mycobacterium avium subsp. paratuberculosis
gucggcggcggcc

SEQ ID NO: 970005 - RNA, 12 nt, Mycobacterium avium subsp. paratuberculosis
gucggcgggcag

SEQ ID NO: 970006 - RNA, 19 nt, Mycobacterium avium subsp. paratuberculosis
gucggcggucgccagcgcc

SEQ ID NO: 970007 - RNA, 23 nt, Mycobacterium avium subsp. paratuberculosis
gucggcggucgccagcgccacgc

SEQ ID NO: 970008 - RNA, 15 nt, Mycobacterium avium subsp. paratuberculosis
gucggcggugccgag

SEQ ID NO: 970009 - RNA, 21 nt, Mycobacterium avium subsp. paratuberculosis
gucggcgcggccggaucgaau

SEQ ID NO: 970010 - RNA, 15 nt, Mycobacterium avium subsp. paratuberculosis
gucggcgccccgccc

SEQ ID NO: 970011 - RNA, 17 nt, Mycobacterium avium subsp. paratuberculosis
gucggcgccgccgagcc

SEQ ID NO: 970012 - RNA, 19 nt, Mycobacterium avium subsp. paratuberculosis
gucggcgcgcucggugcug

SEQ ID NO: 970013 - RNA, 17 nt, Mycobacterium avium subsp. paratuberculosis
gucggcgauggcggcgu

SEQ ID NO: 970014 - RNA, 16 nt, Mycobacterium avium subsp. paratuberculosis
gucggcgauguccuug

SEQ ID NO: 970015 - RNA, 22 nt, Mycobacterium avium subsp. paratuberculosis
gucggccgcgacgaccgccugc

SEQ ID NO: 970016 - RNA, 19 nt, Mycobacterium avium subsp. paratuberculosis
gucggcgaucgccagcacg

SEQ ID NO: 970017 - RNA, 15 nt, Mycobacterium avium subsp. paratuberculosis
gucggcgagcuugcc

SEQ ID NO: 970018 - RNA, 15 nt, Mycobacterium avium subsp. paratuberculosis
gucggcgagcuuggc

SEQ ID NO: 970019 - RNA, 22 nt, Mycobacterium avium subsp. paratuberculosis
gucggcgacggcguccagcugc

SEQ ID NO: 970020 - RNA, 16 nt, Mycobacterium avium subsp. paratuberculosis
gucggcgaccuccugc

SEQ ID NO: 970021 - RNA, 13 nt, Mycobacterium avium subsp. paratuberculosis
gucggcgacccgc

SEQ ID NO: 970022 - RNA, 14 nt, Mycobacterium avium subsp. paratuberculosis
gucggcgacccgca

SEQ ID NO: 970023 - RNA, 18 nt, Mycobacterium avium subsp. paratuberculosis
gucggcgaaccagggcag

SEQ ID NO: 970024 - RNA, 19 nt, Mycobacterium avium subsp. paratuberculosis
gucggcgaaccagggcagc

SEQ ID NO: 970025 - RNA, 23 nt, Mycobacterium avium subsp. paratuberculosis
gucggcgaaccagggcagccagc

SEQ ID NO: 970026 - RNA, 19 nt, Mycobacterium avium subsp. paratuberculosis
gucggccuucagcguccac

SEQ ID NO: 970027 - RNA, 22 nt, Mycobacterium avium subsp. paratuberculosis
gucggccggcggggcgggggcg

SEQ ID NO: 970028 - RNA, 14 nt, Mycobacterium avium subsp. paratuberculosis
gucggccgggggcg

SEQ ID NO: 970029 - RNA, 17 nt, Mycobacterium avium subsp. paratuberculosis
gucggccgucggcgccg

SEQ ID NO: 970030 - RNA, 19 nt, Mycobacterium avium subsp. paratuberculosis
gucggccucggcggccggg

SEQ ID NO: 970031 - RNA, 19 nt, Mycobacterium avium subsp. paratuberculosis
gucggcccgccgggccgga

SEQ ID NO: 970032 - RNA, 13 nt, Mycobacterium avium subsp. paratuberculosis
gucggccgcccgu

SEQ ID NO: 970033 - RNA, 21 nt, Mycobacterium avium subsp. paratuberculosis
gucggccaucagccgccgucg

SEQ ID NO: 970034 - RNA, 16 nt, Mycobacterium avium subsp. paratuberculosis
gucggcccaggccaac

SEQ ID NO: 970035 - RNA, 18 nt, Mycobacterium avium subsp. paratuberculosis
gucggccacguugccggg

SEQ ID NO: 970036 - RNA, 13 nt, Mycobacterium avium subsp. paratuberculosis
gucggccagcgcg

SEQ ID NO: 970037 - RNA, 19 nt, Mycobacterium avium subsp. paratuberculosis
gucggccagcgcgcgggcg

SEQ ID NO: 970038 - RNA, 19 nt, Mycobacterium avium subsp. paratuberculosis
gucgggguccaggccgcgc

SEQ ID NO: 970039 - RNA, 22 nt, Mycobacterium avium subsp. paratuberculosis
gucggggcuggcggcgaaugcc

SEQ ID NO: 970040 - RNA, 13 nt, Mycobacterium avium subsp. paratuberculosis
gucgggcagcagc

SEQ ID NO: 970041 - RNA, 21 nt, Mycobacterium avium subsp. paratuberculosis
gucggggucgucgacggccgc

SEQ ID NO: 970042 - RNA, 22 nt, Mycobacterium avium subsp. paratuberculosis
gucggggucgucgacggccgcg

SEQ ID NO: 970043 - RNA, 21 nt, Mycobacterium avium subsp. paratuberculosis
gucggggugcgccaggcaggc

SEQ ID NO: 970044 - RNA, 22 nt, Mycobacterium avium subsp. paratuberculosis
gucggggugcucgaucggcgcg

SEQ ID NO: 970045 - RNA, 15 nt, Mycobacterium avium subsp. paratuberculosis
gucgggugcggcggu

SEQ ID NO: 970046 - RNA, 16 nt, Mycobacterium avium subsp. paratuberculosis
gucgggugcggcggug

SEQ ID NO: 970047 - RNA, 18 nt, Mycobacterium avium subsp. paratuberculosis
gucggggcaucgcagcgc

SEQ ID NO: 970048 - RNA, 14 nt, Mycobacterium avium subsp. paratuberculosis
gucgggcgccggcg

SEQ ID NO: 970049 - RNA, 13 nt, Mycobacterium avium subsp. paratuberculosis
gucgggcgcggcg

SEQ ID NO: 970050 - RNA, 15 nt, Mycobacterium avium subsp. paratuberculosis
gucgggccgggggcg

SEQ ID NO: 970051 - RNA, 17 nt, Mycobacterium avium subsp. paratuberculosis
gucgggccaacugggug

SEQ ID NO: 970052 - RNA, 14 nt, Mycobacterium avium subsp. paratuberculosis
gucgggccgcagca

SEQ ID NO: 970053 - RNA, 18 nt, Mycobacterium avium subsp. paratuberculosis
gucgggccgcagcacggc

SEQ ID NO: 970054 - RNA, 17 nt, Mycobacterium avium subsp. paratuberculosis
gucggcuuccuccucgg

SEQ ID NO: 970055 - RNA, 23 nt, Mycobacterium avium subsp. paratuberculosis
gucggcgugcccgccgaccagga

SEQ ID NO: 970056 - RNA, 17 nt, Mycobacterium avium subsp. paratuberculosis
gucggcguggccguccg

SEQ ID NO: 970057 - RNA, 16 nt, Mycobacterium avium subsp. paratuberculosis
gucgggaauggggccc

SEQ ID NO: 970058 - RNA, 15 nt, Mycobacterium avium subsp. paratuberculosis
gucgggauggcggcg

SEQ ID NO: 970059 - RNA, 23 nt, Mycobacterium avium subsp. paratuberculosis
gucgggcagugcacgacgaccgc

SEQ ID NO: 970060 - RNA, 20 nt, Mycobacterium avium subsp. paratuberculosis
gucgggcaugccggccggca

SEQ ID NO: 970061 - RNA, 16 nt, Mycobacterium avium subsp. paratuberculosis
gucgggcacaucccgc

SEQ ID NO: 970062 - RNA, 19 nt, Mycobacterium avium subsp. paratuberculosis
gucgggcaccacggcggca

SEQ ID NO: 970063 - RNA, 14 nt, Mycobacterium avium subsp. paratuberculosis
gucgggcaccagca

SEQ ID NO: 970064 - RNA, 17 nt, Mycobacterium avium subsp. paratuberculosis
gucgggcacagccagcg

SEQ ID NO: 970065 - RNA, 16 nt, Mycobacterium avium subsp. paratuberculosis
guccgguucggcggca

SEQ ID NO: 970066 - RNA, 14 nt, Mycobacterium avium subsp. paratuberculosis
guccgugcugccgg

SEQ ID NO: 970067 - RNA, 13 nt, Mycobacterium avium subsp. paratuberculosis
guccuccagcggc

SEQ ID NO: 970068 - RNA, 15 nt, Mycobacterium avium subsp. paratuberculosis
guccgggccggccag

SEQ ID NO: 970069 - RNA, 22 nt, Mycobacterium avium subsp. paratuberculosis
guccggggugagcagggccagc

SEQ ID NO: 970070 - RNA, 16 nt, Mycobacterium avium subsp. paratuberculosis
guccggggugggcacg

SEQ ID NO: 970071 - RNA, 22 nt, Mycobacterium avium subsp. paratuberculosis
guccgggguguaggcgucggcg

SEQ ID NO: 970072 - RNA, 23 nt, Mycobacterium avium subsp. paratuberculosis
guccgggucgcacagccgcagca

SEQ ID NO: 970073 - RNA, 20 nt, Mycobacterium avium subsp. paratuberculosis
guccgaccgccaccacccgg

SEQ ID NO: 970074 - RNA, 13 nt, Mycobacterium avium subsp. paratuberculosis
guccgaccgguug

SEQ ID NO: 970075 - RNA, 17 nt, Mycobacterium avium subsp. paratuberculosis
guccgacuucgcgugcc

SEQ ID NO: 970076 - RNA, 13 nt, Mycobacterium avium subsp. paratuberculosis
guccgagcgggcc

SEQ ID NO: 970077 - RNA, 18 nt, Mycobacterium avium subsp. paratuberculosis
guccgccuccgaccagcc

SEQ ID NO: 970078 - RNA, 13 nt, Mycobacterium avium subsp. paratuberculosis
guccgccggccgg

SEQ ID NO: 970079 - RNA, 15 nt, Mycobacterium avium subsp. paratuberculosis
guccgccggcggugc

SEQ ID NO: 970080 - RNA, 18 nt, Mycobacterium avium subsp. paratuberculosis
guccgccggcggugcggg

SEQ ID NO: 970081 - RNA, 15 nt, Mycobacterium avium subsp. paratuberculosis
guccgcgugaaugcc

SEQ ID NO: 970082 - RNA, 23 nt, Mycobacterium avium subsp. paratuberculosis
guccgcggaggcgagcagccggg

SEQ ID NO: 970083 - RNA, 13 nt, Mycobacterium avium subsp. paratuberculosis
guccgcggcggcg

SEQ ID NO: 970084 - RNA, 14 nt, Mycobacterium avium subsp. paratuberculosis
guccgcggcggcgu

SEQ ID NO: 970085 - RNA, 21 nt, Mycobacterium avium subsp. paratuberculosis
guccgcgaacgggugcggcgc

SEQ ID NO: 970086 - RNA, 21 nt, Mycobacterium avium subsp. paratuberculosis
gucccggcaacaccggcggcg

SEQ ID NO: 970087 - RNA, 20 nt, Mycobacterium avium subsp. paratuberculosis
gucccggugaugacggggcg

SEQ ID NO: 970088 - RNA, 23 nt, Mycobacterium avium subsp. paratuberculosis
gucccggggcucgacaggcagcc

SEQ ID NO: 970089 - RNA, 16 nt, Mycobacterium avium subsp. paratuberculosis
gucccguuggucucga

SEQ ID NO: 970090 - RNA, 17 nt, Mycobacterium avium subsp. paratuberculosis
gucccguccugggccug

SEQ ID NO: 970091 - RNA, 18 nt, Mycobacterium avium subsp. paratuberculosis
gucccgguugaccccggc

SEQ ID NO: 970092 - RNA, 14 nt, Mycobacterium avium subsp. paratuberculosis
gucccgugcgccgc

SEQ ID NO: 970093 - RNA, 23 nt, Mycobacterium avium subsp. paratuberculosis
gucgaaacggcugcugcgcggca

SEQ ID NO: 970094 - RNA, 13 nt, Mycobacterium avium subsp. paratuberculosis
gucgaaaaaugcg

SEQ ID NO: 970095 - RNA, 23 nt, Mycobacterium avium subsp. paratuberculosis
guccucggggaugugcugcaggu

SEQ ID NO: 970096 - RNA, 18 nt, Mycobacterium avium subsp. paratuberculosis
guccuuguaggugaucgu

SEQ ID NO: 970097 - RNA, 22 nt, Mycobacterium avium subsp. paratuberculosis
guccucgaucaccgacagcgcg

SEQ ID NO: 970098 - RNA, 20 nt, Mycobacterium avium subsp. paratuberculosis
guccucgauggcggcggcug

SEQ ID NO: 970099 - RNA, 15 nt, Mycobacterium avium subsp. paratuberculosis
guccucggccgccac

SEQ ID NO: 970100 - RNA, 13 nt, Mycobacterium avium subsp. paratuberculosis
guccucgcuggcg

SEQ ID NO: 970101 - RNA, 22 nt, Mycobacterium avium subsp. paratuberculosis
guccucgcuggcgaucaccuug

SEQ ID NO: 970102 - RNA, 23 nt, Mycobacterium avium subsp. paratuberculosis
guccucgaccacccgcuggucaa

SEQ ID NO: 970103 - RNA, 13 nt, Mycobacterium avium subsp. paratuberculosis
guccucgagcugc

SEQ ID NO: 970104 - RNA, 15 nt, Mycobacterium avium subsp. paratuberculosis
guccucgagcuggcc

SEQ ID NO: 970105 - RNA, 16 nt, Mycobacterium avium subsp. paratuberculosis
guccucgagcuggccg

SEQ ID NO: 970106 - RNA, 13 nt, Mycobacterium avium subsp. paratuberculosis
gucgaacacggcg

SEQ ID NO: 970107 - RNA, 12 nt, Mycobacterium avium subsp. paratuberculosis
gucgaacagcag

SEQ ID NO: 970108 - RNA, 14 nt, Mycobacterium avium subsp. paratuberculosis
gucgaacagccggu

SEQ ID NO: 970109 - RNA, 20 nt, Mycobacterium avium subsp. paratuberculosis
gucgaacagccgguccuggg

SEQ ID NO: 970110 - RNA, 19 nt, Mycobacterium avium subsp. paratuberculosis
gucgaaccgcgagcgcgcg

SEQ ID NO: 970111 - RNA, 18 nt, Mycobacterium avium subsp. paratuberculosis
gucgaacucgggcccgag

SEQ ID NO: 970112 - RNA, 18 nt, Mycobacterium avium subsp. paratuberculosis
gucgaacggcaaccuggg

SEQ ID NO: 970113 - RNA, 16 nt, Mycobacterium avium subsp. paratuberculosis
gucgaacgcguacacg

SEQ ID NO: 970114 - RNA, 23 nt, Mycobacterium avium subsp. paratuberculosis
gucgaagaagucguucagcugca

SEQ ID NO: 970115 - RNA, 23 nt, Mycobacterium avium subsp. paratuberculosis
gucgaaggaggccagcugcaccg

SEQ ID NO: 970116 - RNA, 14 nt, Mycobacterium avium subsp. paratuberculosis
gucgaaggccccgg

SEQ ID NO: 970117 - RNA, 20 nt, Mycobacterium avium subsp. paratuberculosis
gucgaaguagggccgcagcg

SEQ ID NO: 970118 - RNA, 21 nt, Mycobacterium avium subsp. paratuberculosis
gucgaaguagggccgcagcgc

SEQ ID NO: 970119 - RNA, 20 nt, Mycobacterium avium subsp. paratuberculosis
gucgaaguccugcgccgcgg

SEQ ID NO: 970120 - RNA, 19 nt, Mycobacterium avium subsp. paratuberculosis
gucgacggcguggaacacg

SEQ ID NO: 970121 - RNA, 19 nt, Mycobacterium avium subsp. paratuberculosis
gucgacgugggcggccacc

SEQ ID NO: 970122 - RNA, 16 nt, Mycobacterium avium subsp. paratuberculosis
gucgacgcugagccgc

SEQ ID NO: 970123 - RNA, 14 nt, Mycobacterium avium subsp. paratuberculosis
gucgacgcugcagg

SEQ ID NO: 970124 - RNA, 18 nt, Mycobacterium avium subsp. paratuberculosis
gucgacgggccaccagcg

SEQ ID NO: 970125 - RNA, 14 nt, Mycobacterium avium subsp. paratuberculosis
gucgacggugauca

SEQ ID NO: 970126 - RNA, 23 nt, Mycobacterium avium subsp. paratuberculosis
gucgacgucgagaaaggccagca

SEQ ID NO: 970127 - RNA, 17 nt, Mycobacterium avium subsp. paratuberculosis
gucgacgauggcccggg

SEQ ID NO: 970128 - RNA, 14 nt, Mycobacterium avium subsp. paratuberculosis
gucgacgcgccgca

SEQ ID NO: 970129 - RNA, 15 nt, Mycobacterium avium subsp. paratuberculosis
gucgacgcgccgcac

SEQ ID NO: 970130 - RNA, 20 nt, Mycobacterium avium subsp. paratuberculosis
gucgagcacgucgacgccgg

SEQ ID NO: 970131 - RNA, 17 nt, Mycobacterium avium subsp. paratuberculosis
gucgagcaccggcuggu

SEQ ID NO: 970132 - RNA, 19 nt, Mycobacterium avium subsp. paratuberculosis
gucgagcaccacccgggug

SEQ ID NO: 970133 - RNA, 12 nt, Mycobacterium avium subsp. paratuberculosis
gucgagagccgc

SEQ ID NO: 970134 - RNA, 22 nt, Mycobacterium avium subsp. paratuberculosis
gucgagacaccgucgcgcaccc

SEQ ID NO: 970135 - RNA, 18 nt, Mycobacterium avium subsp. paratuberculosis
gucgaaguucggcaucuc

SEQ ID NO: 970136 - RNA, 14 nt, Mycobacterium avium subsp. paratuberculosis
gucgacacccgggc

SEQ ID NO: 970137 - RNA, 14 nt, Mycobacterium avium subsp. paratuberculosis
gucgacgagcaggc

SEQ ID NO: 970138 - RNA, 17 nt, Mycobacterium avium subsp. paratuberculosis
gucgacgagcaggcuga

SEQ ID NO: 970139 - RNA, 18 nt, Mycobacterium avium subsp. paratuberculosis
gucgacgagcccgccggc

SEQ ID NO: 970140 - RNA, 20 nt, Mycobacterium avium subsp. paratuberculosis
gucgacgacgaaucccgccu

SEQ ID NO: 970141 - RNA, 16 nt, Mycobacterium avium subsp. paratuberculosis
gucgaccggggcgccc

SEQ ID NO: 970142 - RNA, 17 nt, Mycobacterium avium subsp. paratuberculosis
gucgaccgucacgcugg

SEQ ID NO: 970143 - RNA, 21 nt, Mycobacterium avium subsp. paratuberculosis
gucgaccucgaugcgcagggc

SEQ ID NO: 970144 - RNA, 23 nt, Mycobacterium avium subsp. paratuberculosis
gucgaccucgcgcgucacgcugg

SEQ ID NO: 970145 - RNA, 12 nt, Mycobacterium avium subsp. paratuberculosis
gucaucaccuug

SEQ ID NO: 970146 - RNA, 23 nt, Mycobacterium avium subsp. paratuberculosis
gucauccccaucucgagcaggaa

SEQ ID NO: 970147 - RNA, 14 nt, Mycobacterium avium subsp. paratuberculosis
guccaaaaugcguu

SEQ ID NO: 970148 - RNA, 16 nt, Mycobacterium avium subsp. paratuberculosis
guccaaagacguugac

SEQ ID NO: 970149 - RNA, 22 nt, Mycobacterium avium subsp. paratuberculosis
guccaacaggugcuuggucagc

SEQ ID NO: 970150 - RNA, 17 nt, Mycobacterium avium subsp. paratuberculosis
gucauguaccaggcgac

SEQ ID NO: 970151 - RNA, 22 nt, Mycobacterium avium subsp. paratuberculosis
gucaucgcguaguggugccgga

SEQ ID NO: 970152 - RNA, 14 nt, Mycobacterium avium subsp. paratuberculosis
gucaugcgcgggca

SEQ ID NO: 970153 - RNA, 14 nt, Mycobacterium avium subsp. paratuberculosis
guccaccagaucgc

SEQ ID NO: 970154 - RNA, 20 nt, Mycobacterium avium subsp. paratuberculosis
guccaccaggguggccgcca

SEQ ID NO: 970155 - RNA, 23 nt, Mycobacterium avium subsp. paratuberculosis
guccaccaggguggccgccacca

SEQ ID NO: 970156 - RNA, 15 nt, Mycobacterium avium subsp. paratuberculosis
guccaccaucaacau

SEQ ID NO: 970157 - RNA, 16 nt, Mycobacterium avium subsp. paratuberculosis
guccaccgcggcggcc

SEQ ID NO: 970158 - RNA, 14 nt, Mycobacterium avium subsp. paratuberculosis
guccaccggauggc

SEQ ID NO: 970159 - RNA, 15 nt, Mycobacterium avium subsp. paratuberculosis
guccacgccgagggc

SEQ ID NO: 970160 - RNA, 21 nt, Mycobacterium avium subsp. paratuberculosis
guccacgccgagggcggcggc

SEQ ID NO: 970161 - RNA, 20 nt, Mycobacterium avium subsp. paratuberculosis
guccacguccugccaguugu

SEQ ID NO: 970162 - RNA, 18 nt, Mycobacterium avium subsp. paratuberculosis
guccacgucgcccagcgu

SEQ ID NO: 970163 - RNA, 24 nt, Mycobacterium avium subsp. paratuberculosis
guccacguugaugccgcccagcag

SEQ ID NO: 970164 - RNA, 13 nt, Mycobacterium avium subsp. paratuberculosis
guccagcacggcg

SEQ ID NO: 970165 - RNA, 11 nt, Mycobacterium avium subsp. paratuberculosis
guccagcagca

SEQ ID NO: 970166 - RNA, 18 nt, Mycobacterium avium subsp. paratuberculosis
guccagcagcagcgcgcg

SEQ ID NO: 970167 - RNA, 17 nt, Mycobacterium avium subsp. paratuberculosis
guccagaacucggcggc

SEQ ID NO: 970168 - RNA, 18 nt, Mycobacterium avium subsp. paratuberculosis
guccagaacucggcggcg

SEQ ID NO: 970169 - RNA, 16 nt, Mycobacterium avium subsp. paratuberculosis
guccagaccggccggg

SEQ ID NO: 970170 - RNA, 17 nt, Mycobacterium avium subsp. paratuberculosis
guccagucggccgugaa

SEQ ID NO: 970171 - RNA, 22 nt, Mycobacterium avium subsp. paratuberculosis
guccaugcucuugcgggcggca

SEQ ID NO: 970172 - RNA, 13 nt, Mycobacterium avium subsp. paratuberculosis
guccagugccggc

SEQ ID NO: 970173 - RNA, 15 nt, Mycobacterium avium subsp. paratuberculosis
guccagguggggugg

SEQ ID NO: 970174 - RNA, 18 nt, Mycobacterium avium subsp. paratuberculosis
guccaggugggguggugg

SEQ ID NO: 970175 - RNA, 14 nt, Mycobacterium avium subsp. paratuberculosis
guccaggccgccgu

SEQ ID NO: 970176 - RNA, 15 nt, Mycobacterium avium subsp. paratuberculosis
guccaggccggcgcc

SEQ ID NO: 970177 - RNA, 17 nt, Mycobacterium avium subsp. paratuberculosis
guccaggccggcgccgc

SEQ ID NO: 970178 - RNA, 19 nt, Mycobacterium avium subsp. paratuberculosis
guccaggcgcaccgccacc

SEQ ID NO: 970179 - RNA, 17 nt, Mycobacterium avium subsp. paratuberculosis
guccaggccgaggcuga

SEQ ID NO: 970180 - RNA, 15 nt, Mycobacterium avium subsp. paratuberculosis
guccaggguggccag

SEQ ID NO: 970181 - RNA, 17 nt, Mycobacterium avium subsp. paratuberculosis
guccaggguggccagca

SEQ ID NO: 970182 - RNA, 18 nt, Mycobacterium avium subsp. paratuberculosis
guccaggguggccagcac

SEQ ID NO: 970183 - RNA, 16 nt, Mycobacterium avium subsp. paratuberculosis
guccagcugcgcgccg

SEQ ID NO: 970184 - RNA, 21 nt, Mycobacterium avium subsp. paratuberculosis
guccagcuugucguagcggcg

SEQ ID NO: 970185 - RNA, 18 nt, Mycobacterium avium subsp. paratuberculosis
guccaggaucacgcggcg

SEQ ID NO: 970186 - RNA, 14 nt, Mycobacterium avium subsp. paratuberculosis
guccaggaugggga

SEQ ID NO: 970187 - RNA, 17 nt, Mycobacterium avium subsp. paratuberculosis
guccagcgugccgcgca

SEQ ID NO: 970188 - RNA, 22 nt, Mycobacterium avium subsp. paratuberculosis
guccagcgugcgcggcuggccg

SEQ ID NO: 970189 - RNA, 18 nt, Mycobacterium avium subsp. paratuberculosis
guccagcggguugccgcu

SEQ ID NO: 970190 - RNA, 22 nt, Mycobacterium avium subsp. paratuberculosis
guccagcggguugccgcuggcg

SEQ ID NO: 970191 - RNA, 21 nt, Mycobacterium avium subsp. paratuberculosis
guccagccgugcggcacgccg

SEQ ID NO: 970192 - RNA, 19 nt, Mycobacterium avium subsp. paratuberculosis
guauucgucaccccaccag

SEQ ID NO: 970193 - RNA, 22 nt, Mycobacterium avium subsp. paratuberculosis
gucaaagccguucgcgccgaga

SEQ ID NO: 970194 - RNA, 13 nt, Mycobacterium avium subsp. paratuberculosis
gucacacccucgg

SEQ ID NO: 970195 - RNA, 18 nt, Mycobacterium avium subsp. paratuberculosis
gucacaccgcggccagcg

SEQ ID NO: 970196 - RNA, 15 nt, Mycobacterium avium subsp. paratuberculosis
gucaauccccgcggu

SEQ ID NO: 970197 - RNA, 13 nt, Mycobacterium avium subsp. paratuberculosis
gucaccagcggcc

SEQ ID NO: 970198 - RNA, 21 nt, Mycobacterium avium subsp. paratuberculosis
gucaccaaugcgccggcggcc

SEQ ID NO: 970199 - RNA, 14 nt, Mycobacterium avium subsp. paratuberculosis
gucaccaccggguc

SEQ ID NO: 970200 - RNA, 23 nt, Mycobacterium avium subsp. paratuberculosis
gucaccggucggugcccagcacc

SEQ ID NO: 970201 - RNA, 19 nt, Mycobacterium avium subsp. paratuberculosis
gucaccggugucacgcugg

SEQ ID NO: 970202 - RNA, 20 nt, Mycobacterium avium subsp. paratuberculosis
gucaccguccuuguagguga

SEQ ID NO: 970203 - RNA, 22 nt, Mycobacterium avium subsp. paratuberculosis
gucaccguggugugcccgcggg

SEQ ID NO: 970204 - RNA, 17 nt, Mycobacterium avium subsp. paratuberculosis
guaucgagcaccagcaa

SEQ ID NO: 970205 - RNA, 17 nt, Mycobacterium avium subsp. paratuberculosis
guaugccuccucgguga

SEQ ID NO: 970206 - RNA, 22 nt, Mycobacterium avium subsp. paratuberculosis
guaugcgguccucgagcuggcc

SEQ ID NO: 970207 - RNA, 17 nt, Mycobacterium avium subsp. paratuberculosis
guauccggccagccggg

SEQ ID NO: 970208 - RNA, 23 nt, Mycobacterium avium subsp. paratuberculosis
guaggagaacgucaggcccagcg

SEQ ID NO: 970209 - RNA, 21 nt, Mycobacterium avium subsp. paratuberculosis
guagcugcccugaagcugggc

SEQ ID NO: 970210 - RNA, 13 nt, Mycobacterium avium subsp. paratuberculosis
guagcggucgggg

SEQ ID NO: 970211 - RNA, 16 nt, Mycobacterium avium subsp. paratuberculosis
guaggacagcaccaca

SEQ ID NO: 970212 - RNA, 20 nt, Mycobacterium avium subsp. paratuberculosis
guaggagcugacggccauga

SEQ ID NO: 970213 - RNA, 14 nt, Mycobacterium avium subsp. paratuberculosis
guagcagcgcggcu

SEQ ID NO: 970214 - RNA, 15 nt, Mycobacterium avium subsp. paratuberculosis
guagcacccggccgg

SEQ ID NO: 970215 - RNA, 22 nt, Mycobacterium avium subsp. paratuberculosis
guagcagacgguaugcccgccg

SEQ ID NO: 970216 - RNA, 18 nt, Mycobacterium avium subsp. paratuberculosis
guagaagaucagcgccag

SEQ ID NO: 970217 - RNA, 20 nt, Mycobacterium avium subsp. paratuberculosis
guagcccuaccggcucggcc

SEQ ID NO: 970218 - RNA, 17 nt, Mycobacterium avium subsp. paratuberculosis
guagcggucgccccaga

SEQ ID NO: 970219 - RNA, 14 nt, Mycobacterium avium subsp. paratuberculosis
guagcgguccagcg

SEQ ID NO: 970220 - RNA, 21 nt, Mycobacterium avium subsp. paratuberculosis
guagcggccgcacgcgaacac

SEQ ID NO: 970221 - RNA, 22 nt, Mycobacterium avium subsp. paratuberculosis
guagcgggcgaacgaccgggug

SEQ ID NO: 970222 - RNA, 21 nt, Mycobacterium avium subsp. paratuberculosis
guagcggcgccaccggcuggc

SEQ ID NO: 970223 - RNA, 12 nt, Mycobacterium avium subsp. paratuberculosis
guagcggcggcu

SEQ ID NO: 970224 - RNA, 16 nt, Mycobacterium avium subsp. paratuberculosis
guagcggcggucggcg

SEQ ID NO: 970225 - RNA, 22 nt, Mycobacterium avium subsp. paratuberculosis
guagccggcccgcagccagcgc

SEQ ID NO: 970226 - RNA, 23 nt, Mycobacterium avium subsp. paratuberculosis
guagccggcccgcagccagcgca

SEQ ID NO: 970227 - RNA, 13 nt, Mycobacterium avium subsp. paratuberculosis
guagccggccagc

SEQ ID NO: 970228 - RNA, 21 nt, Mycobacterium avium subsp. paratuberculosis
guagccguaacgaugccgcuu

SEQ ID NO: 970229 - RNA, 17 nt, Mycobacterium avium subsp. paratuberculosis
guagccgccguagccgg

SEQ ID NO: 970230 - RNA, 21 nt, Mycobacterium avium subsp. paratuberculosis
guagccgaccaacgggcggcg

SEQ ID NO: 970231 - RNA, 21 nt, Mycobacterium avium subsp. paratuberculosis
guagccgaucuccaccgagug

SEQ ID NO: 970232 - RNA, 15 nt, Mycobacterium avium subsp. paratuberculosis
guacugcagcagucc

SEQ ID NO: 970233 - RNA, 20 nt, Mycobacterium avium subsp. paratuberculosis
guacucgaguggcgaacggg

SEQ ID NO: 970234 - RNA, 17 nt, Mycobacterium avium subsp. paratuberculosis
guacucggcggcgggca

SEQ ID NO: 970235 - RNA, 18 nt, Mycobacterium avium subsp. paratuberculosis
guacucggcggcgggcag

SEQ ID NO: 970236 - RNA, 22 nt, Mycobacterium avium subsp. paratuberculosis
guacucggcggcgggcaggcuc

SEQ ID NO: 970237 - RNA, 17 nt, Mycobacterium avium subsp. paratuberculosis
guacucggcgucgccga

SEQ ID NO: 970238 - RNA, 14 nt, Mycobacterium avium subsp. paratuberculosis
guacuccucggugu

SEQ ID NO: 970239 - RNA, 13 nt, Mycobacterium avium subsp. paratuberculosis
guacuccugcgcg

SEQ ID NO: 970240 - RNA, 16 nt, Mycobacterium avium subsp. paratuberculosis
guacgcgccggccagc

SEQ ID NO: 970241 - RNA, 22 nt, Mycobacterium avium subsp. paratuberculosis
guaccagugcaagcucgccagg

SEQ ID NO: 970242 - RNA, 20 nt, Mycobacterium avium subsp. paratuberculosis
guaccagggcagcgccucgg

SEQ ID NO: 970243 - RNA, 12 nt, Mycobacterium avium subsp. paratuberculosis
guaccagcggcc

SEQ ID NO: 970244 - RNA, 22 nt, Mycobacterium avium subsp. paratuberculosis
guaccagcugcccaccagcagg

SEQ ID NO: 970245 - RNA, 23 nt, Mycobacterium avium subsp. paratuberculosis
guaccacuugaaggaggcggucg

SEQ ID NO: 970246 - RNA, 18 nt, Mycobacterium avium subsp. paratuberculosis
guacaggugcagcagcag

SEQ ID NO: 970247 - RNA, 17 nt, Mycobacterium avium subsp. paratuberculosis
guacagcugguccggcc

SEQ ID NO: 970248 - RNA, 21 nt, Mycobacterium avium subsp. paratuberculosis
guacagcugguccggccggcc

SEQ ID NO: 970249 - RNA, 15 nt, Mycobacterium avium subsp. paratuberculosis
guacagcuaggccag

SEQ ID NO: 970250 - RNA, 22 nt, Mycobacterium avium subsp. paratuberculosis
guacagccagcccguggccagc

SEQ ID NO: 970251 - RNA, 11 nt, Mycobacterium avium subsp. paratuberculosis
guacagcagcc

SEQ ID NO: 970252 - RNA, 11 nt, Mycobacterium avium subsp. paratuberculosis
guacagcagcu

SEQ ID NO: 970253 - RNA, 19 nt, Mycobacterium avium subsp. paratuberculosis
guacacgucgcgggugacc

SEQ ID NO: 970254 - RNA, 12 nt, Mycobacterium avium subsp. paratuberculosis
guaauugaucgu

SEQ ID NO: 970255 - RNA, 16 nt, Mycobacterium avium subsp. paratuberculosis
gguuguucagcccggu

SEQ ID NO: 970256 - RNA, 15 nt, Mycobacterium avium subsp. paratuberculosis
gguugggcggcggcc

SEQ ID NO: 970257 - RNA, 21 nt, Mycobacterium avium subsp. paratuberculosis
gguugguuucgguccaggugg

SEQ ID NO: 970258 - RNA, 19 nt, Mycobacterium avium subsp. paratuberculosis
gguugucgucgggcaccac

SEQ ID NO: 970259 - RNA, 15 nt, Mycobacterium avium subsp. paratuberculosis
gguuggucggcgcgg

SEQ ID NO: 970260 - RNA, 18 nt, Mycobacterium avium subsp. paratuberculosis
gguugcggaucggugcag

SEQ ID NO: 970261 - RNA, 15 nt, Mycobacterium avium subsp. paratuberculosis
gguugcggccccgcc

SEQ ID NO: 970262 - RNA, 19 nt, Mycobacterium avium subsp. paratuberculosis
gguugcggccccgccagca

SEQ ID NO: 970263 - RNA, 19 nt, Mycobacterium avium subsp. paratuberculosis
gguuggacaccuccuuggg

SEQ ID NO: 970264 - RNA, 17 nt, Mycobacterium avium subsp. paratuberculosis
gguuggacaugaagccc

SEQ ID NO: 970265 - RNA, 13 nt, Mycobacterium avium subsp. paratuberculosis
gguugcuccucgg

SEQ ID NO: 970266 - RNA, 14 nt, Mycobacterium avium subsp. paratuberculosis
gguugccggcggcc

SEQ ID NO: 970267 - RNA, 15 nt, Mycobacterium avium subsp. paratuberculosis
gguugccgcccucgg

SEQ ID NO: 970268 - RNA, 16 nt, Mycobacterium avium subsp. paratuberculosis
gguugaucaguuccuu

SEQ ID NO: 970269 - RNA, 20 nt, Mycobacterium avium subsp. paratuberculosis
gguugauccggaucgggcgg

SEQ ID NO: 970270 - RNA, 13 nt, Mycobacterium avium subsp. paratuberculosis
gguugaggaucug

SEQ ID NO: 970271 - RNA, 23 nt, Mycobacterium avium subsp. paratuberculosis
gguugacccucagcagggcggca

SEQ ID NO: 970272 - RNA, 15 nt, Mycobacterium avium subsp. paratuberculosis
gguugaccuugacca

SEQ ID NO: 970273 - RNA, 23 nt, Mycobacterium avium subsp. paratuberculosis
gguucgcccuccccggccagcac

SEQ ID NO: 970274 - RNA, 18 nt, Mycobacterium avium subsp. paratuberculosis
gguucggacacggcgccg

SEQ ID NO: 970275 - RNA, 19 nt, Mycobacterium avium subsp. paratuberculosis
gguucgcgcagccaccgcc

SEQ ID NO: 970276 - RNA, 12 nt, Mycobacterium avium subsp. paratuberculosis
gguucgggcccc

SEQ ID NO: 970277 - RNA, 16 nt, Mycobacterium avium subsp. paratuberculosis
gguucgggccccaugg

SEQ ID NO: 970278 - RNA, 17 nt, Mycobacterium avium subsp. paratuberculosis
gguucgucgcggcggcc

SEQ ID NO: 970279 - RNA, 16 nt, Mycobacterium avium subsp. paratuberculosis
gguucgucguggccga

SEQ ID NO: 970280 - RNA, 16 nt, Mycobacterium avium subsp. paratuberculosis
gguucucccgucgcga

SEQ ID NO: 970281 - RNA, 13 nt, Mycobacterium avium subsp. paratuberculosis
gguucuccuccca

SEQ ID NO: 970282 - RNA, 17 nt, Mycobacterium avium subsp. paratuberculosis
gguucuucgaccacgcg

SEQ ID NO: 970283 - RNA, 22 nt, Mycobacterium avium subsp. paratuberculosis
gguuuucccgcgagcugccccu

SEQ ID NO: 970284 - RNA, 19 nt, Mycobacterium avium subsp. paratuberculosis
gguuuguccggccaggucc

SEQ ID NO: 970285 - RNA, 19 nt, Mycobacterium avium subsp. paratuberculosis
gguuuguccggcucugccu

SEQ ID NO: 970286 - RNA, 21 nt, Mycobacterium avium subsp. paratuberculosis
gguuucaccgccgucccgucc

SEQ ID NO: 970287 - RNA, 18 nt, Mycobacterium avium subsp. paratuberculosis
gguuuccaguccggcgcc

SEQ ID NO: 970288 - RNA, 16 nt, Mycobacterium avium subsp. paratuberculosis
gguuucgugugcucag

SEQ ID NO: 970289 - RNA, 13 nt, Mycobacterium avium subsp. paratuberculosis
gguuucguugucc

SEQ ID NO: 970290 - RNA, 20 nt, Mycobacterium avium subsp. paratuberculosis
gguuucgccguacagcuggu

SEQ ID NO: 970291 - RNA, 18 nt, Mycobacterium avium subsp. paratuberculosis
gguuucggugccggccca

SEQ ID NO: 970292 - RNA, 14 nt, Mycobacterium avium subsp. paratuberculosis
gguguugagcgcgu

SEQ ID NO: 970293 - RNA, 23 nt, Mycobacterium avium subsp. paratuberculosis
gguguuguccgguaggccggccg

SEQ ID NO: 970294 - RNA, 18 nt, Mycobacterium avium subsp. paratuberculosis
gguuagguacgcggcugg

SEQ ID NO: 970295 - RNA, 21 nt, Mycobacterium avium subsp. paratuberculosis
gguucaggcguccgcaagcac

SEQ ID NO: 970296 - RNA, 20 nt, Mycobacterium avium subsp. paratuberculosis
gguucaggcugaucuggaug

SEQ ID NO: 970297 - RNA, 18 nt, Mycobacterium avium subsp. paratuberculosis
gguuccggcgugcagcac

SEQ ID NO: 970298 - RNA, 19 nt, Mycobacterium avium subsp. paratuberculosis
gguuccgggcgcucuucgg

SEQ ID NO: 970299 - RNA, 22 nt, Mycobacterium avium subsp. paratuberculosis
gguuccgguggacuccagcacc

SEQ ID NO: 970300 - RNA, 18 nt, Mycobacterium avium subsp. paratuberculosis
gguuccagaccggcggcg

SEQ ID NO: 970301 - RNA, 16 nt, Mycobacterium avium subsp. paratuberculosis
gguucccggcaccacc

SEQ ID NO: 970302 - RNA, 17 nt, Mycobacterium avium subsp. paratuberculosis
gguuccaccgggccgcc

SEQ ID NO: 970303 - RNA, 22 nt, Mycobacterium avium subsp. paratuberculosis
gguuccaccgggccgccaucac

SEQ ID NO: 970304 - RNA, 17 nt, Mycobacterium avium subsp. paratuberculosis
gguucauccccgcggcc

SEQ ID NO: 970305 - RNA, 14 nt, Mycobacterium avium subsp. paratuberculosis
ggugcugggcaccc

SEQ ID NO: 970306 - RNA, 17 nt, Mycobacterium avium subsp. paratuberculosis
gguggccagcaccacgu

SEQ ID NO: 970307 - RNA, 13 nt, Mycobacterium avium subsp. paratuberculosis
gguggccagcacg

SEQ ID NO: 970308 - RNA, 16 nt, Mycobacterium avium subsp. paratuberculosis
gguggccuuggccacc

SEQ ID NO: 970309 - RNA, 22 nt, Mycobacterium avium subsp. paratuberculosis
gguggcgaacugcaccagcacg

SEQ ID NO: 970310 - RNA, 17 nt, Mycobacterium avium subsp. paratuberculosis
gguggccgccaccaaca

SEQ ID NO: 970311 - RNA, 19 nt, Mycobacterium avium subsp. paratuberculosis
gguggccgccaccaacauc

SEQ ID NO: 970312 - RNA, 13 nt, Mycobacterium avium subsp. paratuberculosis
gguggccggggcc

SEQ ID NO: 970313 - RNA, 17 nt, Mycobacterium avium subsp. paratuberculosis
gguggccgcgcugguca

SEQ ID NO: 970314 - RNA, 18 nt, Mycobacterium avium subsp. paratuberculosis
gguggccggugggcggcg

SEQ ID NO: 970315 - RNA, 21 nt, Mycobacterium avium subsp. paratuberculosis
gguggccccagcccgggggug

SEQ ID NO: 970316 - RNA, 23 nt, Mycobacterium avium subsp. paratuberculosis
gguggccccagcccggggguggc

SEQ ID NO: 970317 - RNA, 18 nt, Mycobacterium avium subsp. paratuberculosis
gguggcccccaccacgaa

SEQ ID NO: 970318 - RNA, 12 nt, Mycobacterium avium subsp. paratuberculosis
gguggccagcag

SEQ ID NO: 970319 - RNA, 21 nt, Mycobacterium avium subsp. paratuberculosis
ggugcccagccaggccgccgg

SEQ ID NO: 970320 - RNA, 15 nt, Mycobacterium avium subsp. paratuberculosis
ggugcccagccgcag

SEQ ID NO: 970321 - RNA, 22 nt, Mycobacterium avium subsp. paratuberculosis
ggugcccagccgcaggugcagc

SEQ ID NO: 970322 - RNA, 12 nt, Mycobacterium avium subsp. paratuberculosis
ggugcccgccgc

SEQ ID NO: 970323 - RNA, 13 nt, Mycobacterium avium subsp. paratuberculosis
ggugccccacgcc

SEQ ID NO: 970324 - RNA, 13 nt, Mycobacterium avium subsp. paratuberculosis
ggugcccuccucg

SEQ ID NO: 970325 - RNA, 14 nt, Mycobacterium avium subsp. paratuberculosis
ggugcccuccucgc

SEQ ID NO: 970326 - RNA, 21 nt, Mycobacterium avium subsp. paratuberculosis
ggugcucgcgccgggcggccu

SEQ ID NO: 970327 - RNA, 20 nt, Mycobacterium avium subsp. paratuberculosis
ggugcucuugacggccgcgg

SEQ ID NO: 970328 - RNA, 16 nt, Mycobacterium avium subsp. paratuberculosis
ggugcucuugguggug

SEQ ID NO: 970329 - RNA, 17 nt, Mycobacterium avium subsp. paratuberculosis
ggugcccgggccgcagc

SEQ ID NO: 970330 - RNA, 14 nt, Mycobacterium avium subsp. paratuberculosis
ggugcucuccugcu

SEQ ID NO: 970331 - RNA, 18 nt, Mycobacterium avium subsp. paratuberculosis
ggugcuguccacaucggu

SEQ ID NO: 970332 - RNA, 16 nt, Mycobacterium avium subsp. paratuberculosis
ggugcugcugccccuc

SEQ ID NO: 970333 - RNA, 17 nt, Mycobacterium avium subsp. paratuberculosis
gguggguccgccgggcg

SEQ ID NO: 970334 - RNA, 17 nt, Mycobacterium avium subsp. paratuberculosis
gguggguccggucagca

SEQ ID NO: 970335 - RNA, 18 nt, Mycobacterium avium subsp. paratuberculosis
gguggccucggcgcugcc

SEQ ID NO: 970336 - RNA, 15 nt, Mycobacterium avium subsp. paratuberculosis
ggugggcgcgguggu

SEQ ID NO: 970337 - RNA, 16 nt, Mycobacterium avium subsp. paratuberculosis
ggugggcggcgcccga

SEQ ID NO: 970338 - RNA, 15 nt, Mycobacterium avium subsp. paratuberculosis
ggugggcgugccggg

SEQ ID NO: 970339 - RNA, 14 nt, Mycobacterium avium subsp. paratuberculosis
ggugggcguggcgg

SEQ ID NO: 970340 - RNA, 19 nt, Mycobacterium avium subsp. paratuberculosis
gguggggaucacgucggcg

SEQ ID NO: 970341 - RNA, 12 nt, Mycobacterium avium subsp. paratuberculosis
gguggggcacca

SEQ ID NO: 970342 - RNA, 18 nt, Mycobacterium avium subsp. paratuberculosis
gguggggcaccagaacac

SEQ ID NO: 970343 - RNA, 13 nt, Mycobacterium avium subsp. paratuberculosis
ggugggggucugg

SEQ ID NO: 970344 - RNA, 20 nt, Mycobacterium avium subsp. paratuberculosis
gguggggucgguuuggcugg

SEQ ID NO: 970345 - RNA, 18 nt, Mycobacterium avium subsp. paratuberculosis
gguggggugaggcacccg

SEQ ID NO: 970346 - RNA, 13 nt, Mycobacterium avium subsp. paratuberculosis
ggugggcugggcg

SEQ ID NO: 970347 - RNA, 13 nt, Mycobacterium avium subsp. paratuberculosis
ggugggggccagg

SEQ ID NO: 970348 - RNA, 19 nt, Mycobacterium avium subsp. paratuberculosis
gguguuccccgggcgagcg

SEQ ID NO: 970349 - RNA, 20 nt, Mycobacterium avium subsp. paratuberculosis
gguguucaccgcgccgggca

SEQ ID NO: 970350 - RNA, 23 nt, Mycobacterium avium subsp. paratuberculosis
gguguucaccgcgccgggcacca

SEQ ID NO: 970351 - RNA, 14 nt, Mycobacterium avium subsp. paratuberculosis
gguguggcaggugg

SEQ ID NO: 970352 - RNA, 23 nt, Mycobacterium avium subsp. paratuberculosis
gguguggcgucggccgggggcgc

SEQ ID NO: 970353 - RNA, 13 nt, Mycobacterium avium subsp. paratuberculosis
ggugugggcagcc

SEQ ID NO: 970354 - RNA, 23 nt, Mycobacterium avium subsp. paratuberculosis
gguguagcggauggcgacggcga

SEQ ID NO: 970355 - RNA, 14 nt, Mycobacterium avium subsp. paratuberculosis
gguguagcggcggc

SEQ ID NO: 970356 - RNA, 15 nt, Mycobacterium avium subsp. paratuberculosis
gguguagcggcggcu

SEQ ID NO: 970357 - RNA, 22 nt, Mycobacterium avium subsp. paratuberculosis
gguguaggcgaucgggaacagc

SEQ ID NO: 970358 - RNA, 17 nt, Mycobacterium avium subsp. paratuberculosis
ggugucacguccacgcc

SEQ ID NO: 970359 - RNA, 14 nt, Mycobacterium avium subsp. paratuberculosis
gguccugccccggg

SEQ ID NO: 970360 - RNA, 23 nt, Mycobacterium avium subsp. paratuberculosis
gguccucgucaccgugggcggcg

SEQ ID NO: 970361 - RNA, 14 nt, Mycobacterium avium subsp. paratuberculosis
gguccuccagcggc

SEQ ID NO: 970362 - RNA, 15 nt, Mycobacterium avium subsp. paratuberculosis
gguccucgaucgaca

SEQ ID NO: 970363 - RNA, 17 nt, Mycobacterium avium subsp. paratuberculosis
gguccucgaucgacacc

SEQ ID NO: 970364 - RNA, 21 nt, Mycobacterium avium subsp. paratuberculosis
gguccucgaucgacaccucgg

SEQ ID NO: 970365 - RNA, 12 nt, Mycobacterium avium subsp. paratuberculosis
ggucgcggcgcc

SEQ ID NO: 970366 - RNA, 14 nt, Mycobacterium avium subsp. paratuberculosis
ggucgcgggcgccg

SEQ ID NO: 970367 - RNA, 23 nt, Mycobacterium avium subsp. paratuberculosis
ggucgcggauacgcccggccacc

SEQ ID NO: 970368 - RNA, 18 nt, Mycobacterium avium subsp. paratuberculosis
ggucgcggaucucgucgg

SEQ ID NO: 970369 - RNA, 15 nt, Mycobacterium avium subsp. paratuberculosis
ggucgcggcaucccu

SEQ ID NO: 970370 - RNA, 20 nt, Mycobacterium avium subsp. paratuberculosis
ggucgcggcaucccugguga

SEQ ID NO: 970371 - RNA, 22 nt, Mycobacterium avium subsp. paratuberculosis
ggucgcgcagccgggcggcgcu

SEQ ID NO: 970372 - RNA, 18 nt, Mycobacterium avium subsp. paratuberculosis
gguccgcccggaccaggg

SEQ ID NO: 970373 - RNA, 14 nt, Mycobacterium avium subsp. paratuberculosis
gguccgccgcagcg

SEQ ID NO: 970374 - RNA, 15 nt, Mycobacterium avium subsp. paratuberculosis
gguccgccgcagcgg

SEQ ID NO: 970375 - RNA, 22 nt, Mycobacterium avium subsp. paratuberculosis
gguccgcaacgccggcgugcac

SEQ ID NO: 970376 - RNA, 20 nt, Mycobacterium avium subsp. paratuberculosis
gguccgcaacgcggcgguga

SEQ ID NO: 970377 - RNA, 15 nt, Mycobacterium avium subsp. paratuberculosis
gguccgaccagcacc

SEQ ID NO: 970378 - RNA, 15 nt, Mycobacterium avium subsp. paratuberculosis
gguccgaccagcggc

SEQ ID NO: 970379 - RNA, 16 nt, Mycobacterium avium subsp. paratuberculosis
gguccgaccagcggcc

SEQ ID NO: 970380 - RNA, 21 nt, Mycobacterium avium subsp. paratuberculosis
gguccgaccagcggcccaccg

SEQ ID NO: 970381 - RNA, 19 nt, Mycobacterium avium subsp. paratuberculosis
gguccgaucguccggcgcc

SEQ ID NO: 970382 - RNA, 12 nt, Mycobacterium avium subsp. paratuberculosis
ggucccgugcgc

SEQ ID NO: 970383 - RNA, 21 nt, Mycobacterium avium subsp. paratuberculosis
ggucccgugcgccgcccacac

SEQ ID NO: 970384 - RNA, 16 nt, Mycobacterium avium subsp. paratuberculosis
gguccgccgggcgcga

SEQ ID NO: 970385 - RNA, 14 nt, Mycobacterium avium subsp. paratuberculosis
gguccgccggugcc

SEQ ID NO: 970386 - RNA, 19 nt, Mycobacterium avium subsp. paratuberculosis
gguccgccggugccagcaa

SEQ ID NO: 970387 - RNA, 24 nt, Mycobacterium avium subsp. paratuberculosis
gguccgcgguucgaucuccucggc

SEQ ID NO: 970388 - RNA, 18 nt, Mycobacterium avium subsp. paratuberculosis
gguccgcuccaccagcgc

SEQ ID NO: 970389 - RNA, 14 nt, Mycobacterium avium subsp. paratuberculosis
gguccggcgcccga

SEQ ID NO: 970390 - RNA, 23 nt, Mycobacterium avium subsp. paratuberculosis
gguccggcugaacgccagcagcc

SEQ ID NO: 970391 - RNA, 13 nt, Mycobacterium avium subsp. paratuberculosis
gguccgggcugcg

SEQ ID NO: 970392 - RNA, 15 nt, Mycobacterium avium subsp. paratuberculosis
gguccgggucgcuga

SEQ ID NO: 970393 - RNA, 15 nt, Mycobacterium avium subsp. paratuberculosis
gguccggcagcgcgc

SEQ ID NO: 970394 - RNA, 22 nt, Mycobacterium avium subsp. paratuberculosis
gguccggcggcaccacccgcgg

SEQ ID NO: 970395 - RNA, 21 nt, Mycobacterium avium subsp. paratuberculosis
gguccggcuucaccgucaggg

SEQ ID NO: 970396 - RNA, 14 nt, Mycobacterium avium subsp. paratuberculosis
ggucggugcgcggg

SEQ ID NO: 970397 - RNA, 23 nt, Mycobacterium avium subsp. paratuberculosis
ggucgguggugaucgcggcggcg

SEQ ID NO: 970398 - RNA, 15 nt, Mycobacterium avium subsp. paratuberculosis
ggucguaccaccacc

SEQ ID NO: 970399 - RNA, 18 nt, Mycobacterium avium subsp. paratuberculosis
ggucucaucccgccgacc

SEQ ID NO: 970400 - RNA, 14 nt, Mycobacterium avium subsp. paratuberculosis
ggucugcagcagcc

SEQ ID NO: 970401 - RNA, 23 nt, Mycobacterium avium subsp. paratuberculosis
ggucugcagcagccgcugcuggg

SEQ ID NO: 970402 - RNA, 15 nt, Mycobacterium avium subsp. paratuberculosis
ggucugcagcgacgg

SEQ ID NO: 970403 - RNA, 16 nt, Mycobacterium avium subsp. paratuberculosis
ggucucggcgaggcgc

SEQ ID NO: 970404 - RNA, 17 nt, Mycobacterium avium subsp. paratuberculosis
ggucucgggaucgccga

SEQ ID NO: 970405 - RNA, 18 nt, Mycobacterium avium subsp. paratuberculosis
ggucucgggcaccacgcc

SEQ ID NO: 970406 - RNA, 17 nt, Mycobacterium avium subsp. paratuberculosis
ggucucgggcagcagca

SEQ ID NO: 970407 - RNA, 23 nt, Mycobacterium avium subsp. paratuberculosis
ggucucgcaccugccgucgacga

SEQ ID NO: 970408 - RNA, 20 nt, Mycobacterium avium subsp. paratuberculosis
ggucucgaccgcggcgccga

SEQ ID NO: 970409 - RNA, 16 nt, Mycobacterium avium subsp. paratuberculosis
ggucgcggugcccagc

SEQ ID NO: 970410 - RNA, 17 nt, Mycobacterium avium subsp. paratuberculosis
ggucgcggugcccagcc

SEQ ID NO: 970411 - RNA, 21 nt, Mycobacterium avium subsp. paratuberculosis
ggucgcggugggcucggcgcc

SEQ ID NO: 970412 - RNA, 19 nt, Mycobacterium avium subsp. paratuberculosis
ggucgcgucgucggcgggc

SEQ ID NO: 970413 - RNA, 17 nt, Mycobacterium avium subsp. paratuberculosis
ggucgcgucgugcggcc

SEQ ID NO: 970414 - RNA, 18 nt, Mycobacterium avium subsp. paratuberculosis
ggucgcgugaccggcggu

SEQ ID NO: 970415 - RNA, 15 nt, Mycobacterium avium subsp. paratuberculosis
ggucggcgcggggcc

SEQ ID NO: 970416 - RNA, 17 nt, Mycobacterium avium subsp. paratuberculosis
ggucggcguccagcgcg

SEQ ID NO: 970417 - RNA, 22 nt, Mycobacterium avium subsp. paratuberculosis
ggucggcguccagcgcggugag

SEQ ID NO: 970418 - RNA, 22 nt, Mycobacterium avium subsp. paratuberculosis
ggucggcgucgggccgggggcg

SEQ ID NO: 970419 - RNA, 14 nt, Mycobacterium avium subsp. paratuberculosis
ggucggugagcugg

SEQ ID NO: 970420 - RNA, 14 nt, Mycobacterium avium subsp. paratuberculosis
ggucggugaggcug

SEQ ID NO: 970421 - RNA, 15 nt, Mycobacterium avium subsp. paratuberculosis
ggucggugaggcugg

SEQ ID NO: 970422 - RNA, 15 nt, Mycobacterium avium subsp. paratuberculosis
ggucgggucccggca

SEQ ID NO: 970423 - RNA, 13 nt, Mycobacterium avium subsp. paratuberculosis
ggucggggcggcg

SEQ ID NO: 970424 - RNA, 23 nt, Mycobacterium avium subsp. paratuberculosis
ggucggcggguaugucggcgacc

SEQ ID NO: 970425 - RNA, 17 nt, Mycobacterium avium subsp. paratuberculosis
ggugaugacgucgccca

SEQ ID NO: 970426 - RNA, 22 nt, Mycobacterium avium subsp. paratuberculosis
ggugcaacacucgagcgcgcuc

SEQ ID NO: 970427 - RNA, 14 nt, Mycobacterium avium subsp. paratuberculosis
ggugcagcuccuug

SEQ ID NO: 970428 - RNA, 14 nt, Mycobacterium avium subsp. paratuberculosis
ggugcaggcccagc

SEQ ID NO: 970429 - RNA, 19 nt, Mycobacterium avium subsp. paratuberculosis
ggugcaggcccgggcggcg

SEQ ID NO: 970430 - RNA, 14 nt, Mycobacterium avium subsp. paratuberculosis
ggugaugugcagga

SEQ ID NO: 970431 - RNA, 17 nt, Mycobacterium avium subsp. paratuberculosis
ggugaugucgccggcgg

SEQ ID NO: 970432 - RNA, 14 nt, Mycobacterium avium subsp. paratuberculosis
ggugaugaacgcgc

SEQ ID NO: 970433 - RNA, 16 nt, Mycobacterium avium subsp. paratuberculosis
ggugaugaggucgcga

SEQ ID NO: 970434 - RNA, 20 nt, Mycobacterium avium subsp. paratuberculosis
ggugaugggcagcgccccgg

SEQ ID NO: 970435 - RNA, 16 nt, Mycobacterium avium subsp. paratuberculosis
ggugaugccgagcgcc

SEQ ID NO: 970436 - RNA, 16 nt, Mycobacterium avium subsp. paratuberculosis
ggugaugccggccagc

SEQ ID NO: 970437 - RNA, 20 nt, Mycobacterium avium subsp. paratuberculosis
ggugaugcggaugcccgccg

SEQ ID NO: 970438 - RNA, 18 nt, Mycobacterium avium subsp. paratuberculosis
ggugaugcggcccgaccc

SEQ ID NO: 970439 - RNA, 15 nt, Mycobacterium avium subsp. paratuberculosis
ggugcagggucagca

SEQ ID NO: 970440 - RNA, 19 nt, Mycobacterium avium subsp. paratuberculosis
ggugcagggucagcagcac

SEQ ID NO: 970441 - RNA, 21 nt, Mycobacterium avium subsp. paratuberculosis
ggugcaguacgcaucggcgcc

SEQ ID NO: 970442 - RNA, 22 nt, Mycobacterium avium subsp. paratuberculosis
ggugcaguacgcaucggcgccg

SEQ ID NO: 970443 - RNA, 18 nt, Mycobacterium avium subsp. paratuberculosis
ggugccagccgugcggcg

SEQ ID NO: 970444 - RNA, 20 nt, Mycobacterium avium subsp. paratuberculosis
ggugccagccgugcggcggc

SEQ ID NO: 970445 - RNA, 21 nt, Mycobacterium avium subsp. paratuberculosis
ggugaauaccacugcgcgccc

SEQ ID NO: 970446 - RNA, 20 nt, Mycobacterium avium subsp. paratuberculosis
ggugaagucggugcccagcg

SEQ ID NO: 970447 - RNA, 22 nt, Mycobacterium avium subsp. paratuberculosis
ggugaaggugcccuccucgccg

SEQ ID NO: 970448 - RNA, 14 nt, Mycobacterium avium subsp. paratuberculosis
ggucuggcugguga

SEQ ID NO: 970449 - RNA, 15 nt, Mycobacterium avium subsp. paratuberculosis
ggucugggcgaacgg

SEQ ID NO: 970450 - RNA, 22 nt, Mycobacterium avium subsp. paratuberculosis
ggucuggaugaucgucucggcc

SEQ ID NO: 970451 - RNA, 17 nt, Mycobacterium avium subsp. paratuberculosis
ggucugcgcgagcagau

SEQ ID NO: 970452 - RNA, 18 nt, Mycobacterium avium subsp. paratuberculosis
ggucugccacgcccaccg

SEQ ID NO: 970453 - RNA, 20 nt, Mycobacterium avium subsp. paratuberculosis
ggucugcggccgcgacugca

SEQ ID NO: 970454 - RNA, 20 nt, Mycobacterium avium subsp. paratuberculosis
ggucugcggugcgcccaggu

SEQ ID NO: 970455 - RNA, 17 nt, Mycobacterium avium subsp. paratuberculosis
ggucugcccgccgccga

SEQ ID NO: 970456 - RNA, 23 nt, Mycobacterium avium subsp. paratuberculosis
ggucugcccgccgccgaugcuga

SEQ ID NO: 970457 - RNA, 21 nt, Mycobacterium avium subsp. paratuberculosis
ggugagccaguucgccagcau

SEQ ID NO: 970458 - RNA, 11 nt, Mycobacterium avium subsp. paratuberculosis
ggugagcagaa

SEQ ID NO: 970459 - RNA, 20 nt, Mycobacterium avium subsp. paratuberculosis
ggugagcagcaugccgagca

SEQ ID NO: 970460 - RNA, 17 nt, Mycobacterium avium subsp. paratuberculosis
ggugagcagggccagcg

SEQ ID NO: 970461 - RNA, 18 nt, Mycobacterium avium subsp. paratuberculosis
ggugagcagggccagcgg

SEQ ID NO: 970462 - RNA, 19 nt, Mycobacterium avium subsp. paratuberculosis
ggugagcuaucagcucgcg

SEQ ID NO: 970463 - RNA, 21 nt, Mycobacterium avium subsp. paratuberculosis
ggugagcgcgucgagcaccug

SEQ ID NO: 970464 - RNA, 17 nt, Mycobacterium avium subsp. paratuberculosis
ggugagcuggccgcgca

SEQ ID NO: 970465 - RNA, 14 nt, Mycobacterium avium subsp. paratuberculosis
ggugaggggcgcgc

SEQ ID NO: 970466 - RNA, 14 nt, Mycobacterium avium subsp. paratuberculosis
ggugagacggccag

SEQ ID NO: 970467 - RNA, 15 nt, Mycobacterium avium subsp. paratuberculosis
ggugagacggccagc

SEQ ID NO: 970468 - RNA, 16 nt, Mycobacterium avium subsp. paratuberculosis
ggugagacggccagca

SEQ ID NO: 970469 - RNA, 20 nt, Mycobacterium avium subsp. paratuberculosis
ggugagacggccagcagcac

SEQ ID NO: 970470 - RNA, 15 nt, Mycobacterium avium subsp. paratuberculosis
ggugacaugcccggg

SEQ ID NO: 970471 - RNA, 21 nt, Mycobacterium avium subsp. paratuberculosis
ggucauugaugccccggguga

SEQ ID NO: 970472 - RNA, 12 nt, Mycobacterium avium subsp. paratuberculosis
gguccagcaccg

SEQ ID NO: 970473 - RNA, 12 nt, Mycobacterium avium subsp. paratuberculosis
gguccacgcagu

SEQ ID NO: 970474 - RNA, 13 nt, Mycobacterium avium subsp. paratuberculosis
gguccaccaccac

SEQ ID NO: 970475 - RNA, 19 nt, Mycobacterium avium subsp. paratuberculosis
gguccaccgggcaguagaa

SEQ ID NO: 970476 - RNA, 14 nt, Mycobacterium avium subsp. paratuberculosis
gguccacacguccu

SEQ ID NO: 970477 - RNA, 17 nt, Mycobacterium avium subsp. paratuberculosis
gguccaacgggcucagc

SEQ ID NO: 970478 - RNA, 18 nt, Mycobacterium avium subsp. paratuberculosis
gguccccggagucgucga

SEQ ID NO: 970479 - RNA, 15 nt, Mycobacterium avium subsp. paratuberculosis
ggucccgcggcggcg

SEQ ID NO: 970480 - RNA, 16 nt, Mycobacterium avium subsp. paratuberculosis
ggucccgcggcggcgc

SEQ ID NO: 970481 - RNA, 21 nt, Mycobacterium avium subsp. paratuberculosis
gguccaucccguugcgcauga

SEQ ID NO: 970482 - RNA, 15 nt, Mycobacterium avium subsp. paratuberculosis
gguccaucuccagcu

SEQ ID NO: 970483 - RNA, 16 nt, Mycobacterium avium subsp. paratuberculosis
gguccaucuccagcuc

SEQ ID NO: 970484 - RNA, 17 nt, Mycobacterium avium subsp. paratuberculosis
gguccaucuccagcucc

SEQ ID NO: 970485 - RNA, 21 nt, Mycobacterium avium subsp. paratuberculosis
gguccaucuccagcuccgcgg

SEQ ID NO: 970486 - RNA, 16 nt, Mycobacterium avium subsp. paratuberculosis
ggucccaggugcuggg

SEQ ID NO: 970487 - RNA, 13 nt, Mycobacterium avium subsp. paratuberculosis
ggucccagucccc

SEQ ID NO: 970488 - RNA, 12 nt, Mycobacterium avium subsp. paratuberculosis
gguccagguggg

SEQ ID NO: 970489 - RNA, 15 nt, Mycobacterium avium subsp. paratuberculosis
gguccaggccgcgcc

SEQ ID NO: 970490 - RNA, 17 nt, Mycobacterium avium subsp. paratuberculosis
gguccagaucggcgcgc

SEQ ID NO: 970491 - RNA, 16 nt, Mycobacterium avium subsp. paratuberculosis
gguccaggcgccgggu

SEQ ID NO: 970492 - RNA, 21 nt, Mycobacterium avium subsp. paratuberculosis
gguccaggaucacgcggcggg

SEQ ID NO: 970493 - RNA, 19 nt, Mycobacterium avium subsp. paratuberculosis
gguccagcacgugcccagc

SEQ ID NO: 970494 - RNA, 21 nt, Mycobacterium avium subsp. paratuberculosis
gguccagcacgugcccagccc

SEQ ID NO: 970495 - RNA, 17 nt, Mycobacterium avium subsp. paratuberculosis
gguccagcgugcgcggc

SEQ ID NO: 970496 - RNA, 19 nt, Mycobacterium avium subsp. paratuberculosis
gguccagcgugcgcggcug

SEQ ID NO: 970497 - RNA, 12 nt, Mycobacterium avium subsp. paratuberculosis
gguccagcccgg

SEQ ID NO: 970498 - RNA, 20 nt, Mycobacterium avium subsp. paratuberculosis
ggucauccccgugcggggcc

SEQ ID NO: 970499 - RNA, 20 nt, Mycobacterium avium subsp. paratuberculosis
ggucauccgggccaccacca

SEQ ID NO: 970500 - RNA, 22 nt, Mycobacterium avium subsp. paratuberculosis
ggucauccucgccgcgccagca

SEQ ID NO: 970501 - RNA, 17 nt, Mycobacterium avium subsp. paratuberculosis
ggucaucgagccgagca

SEQ ID NO: 970502 - RNA, 14 nt, Mycobacterium avium subsp. paratuberculosis
ggucaucgagccgg

SEQ ID NO: 970503 - RNA, 14 nt, Mycobacterium avium subsp. paratuberculosis
ggucaugccgagcc

SEQ ID NO: 970504 - RNA, 16 nt, Mycobacterium avium subsp. paratuberculosis
ggucaugccgagccgc

SEQ ID NO: 970505 - RNA, 16 nt, Mycobacterium avium subsp. paratuberculosis
ggucaugguggcggcg

SEQ ID NO: 970506 - RNA, 18 nt, Mycobacterium avium subsp. paratuberculosis
ggucaugguggcggcgcc

SEQ ID NO: 970507 - RNA, 18 nt, Mycobacterium avium subsp. paratuberculosis
ggucaguucgucggucac

SEQ ID NO: 970508 - RNA, 15 nt, Mycobacterium avium subsp. paratuberculosis
ggucauagggcucgu

SEQ ID NO: 970509 - RNA, 16 nt, Mycobacterium avium subsp. paratuberculosis
ggucauaucgacggcc

SEQ ID NO: 970510 - RNA, 21 nt, Mycobacterium avium subsp. paratuberculosis
ggucagaccccguaccagcgc

SEQ ID NO: 970511 - RNA, 17 nt, Mycobacterium avium subsp. paratuberculosis
ggucagaccgcggcggu

SEQ ID NO: 970512 - RNA, 18 nt, Mycobacterium avium subsp. paratuberculosis
ggucagaccgcggcgguc

SEQ ID NO: 970513 - RNA, 19 nt, Mycobacterium avium subsp. paratuberculosis
ggucacguagugcuucuug

SEQ ID NO: 970514 - RNA, 22 nt, Mycobacterium avium subsp. paratuberculosis
ggucacguagugcuucuugaag

SEQ ID NO: 970515 - RNA, 23 nt, Mycobacterium avium subsp. paratuberculosis
ggucagcagcacccggucgccgg

SEQ ID NO: 970516 - RNA, 23 nt, Mycobacterium avium subsp. paratuberculosis
ggucagcagcgucugcgccagcu

SEQ ID NO: 970517 - RNA, 13 nt, Mycobacterium avium subsp. paratuberculosis
ggucaacgugucg

SEQ ID NO: 970518 - RNA, 19 nt, Mycobacterium avium subsp. paratuberculosis
ggucaagcgcuuucgccga

SEQ ID NO: 970519 - RNA, 16 nt, Mycobacterium avium subsp. paratuberculosis
ggucaagcggcagacc

SEQ ID NO: 970520 - RNA, 17 nt, Mycobacterium avium subsp. paratuberculosis
ggucaaguccgcgagga

SEQ ID NO: 970521 - RNA, 13 nt, Mycobacterium avium subsp. paratuberculosis
ggucaaugcccuc

SEQ ID NO: 970522 - RNA, 13 nt, Mycobacterium avium subsp. paratuberculosis
ggucacagccgcg

SEQ ID NO: 970523 - RNA, 21 nt, Mycobacterium avium subsp. paratuberculosis
ggucaaacccauugucgccgu

SEQ ID NO: 970524 - RNA, 15 nt, Mycobacterium avium subsp. paratuberculosis
gguagcgcagcacca

SEQ ID NO: 970525 - RNA, 23 nt, Mycobacterium avium subsp. paratuberculosis
gguagccgcucgcccagcgcggc

SEQ ID NO: 970526 - RNA, 22 nt, Mycobacterium avium subsp. paratuberculosis
gggugugcaggccgaacaccgu

SEQ ID NO: 970527 - RNA, 15 nt, Mycobacterium avium subsp. paratuberculosis
gggugugcggcacgg

SEQ ID NO: 970528 - RNA, 23 nt, Mycobacterium avium subsp. paratuberculosis
ggguguucaccgcgccgggcacc

SEQ ID NO: 970529 - RNA, 21 nt, Mycobacterium avium subsp. paratuberculosis
ggguguuccccgggcgagcgu

SEQ ID NO: 970530 - RNA, 21 nt, Mycobacterium avium subsp. paratuberculosis
ggguguugcggcagggccacc

SEQ ID NO: 970531 - RNA, 16 nt, Mycobacterium avium subsp. paratuberculosis
gguagccagcaccgcc

SEQ ID NO: 970532 - RNA, 13 nt, Mycobacterium avium subsp. paratuberculosis
gggugggcggcac

SEQ ID NO: 970533 - RNA, 12 nt, Mycobacterium avium subsp. paratuberculosis
gggugggcagcg

SEQ ID NO: 970534 - RNA, 13 nt, Mycobacterium avium subsp. paratuberculosis
gggugggggucug

SEQ ID NO: 970535 - RNA, 11 nt, Mycobacterium avium subsp. paratuberculosis
gggugggugcu

SEQ ID NO: 970536 - RNA, 19 nt, Mycobacterium avium subsp. paratuberculosis
ggguggucaccagcgcggu

SEQ ID NO: 970537 - RNA, 16 nt, Mycobacterium avium subsp. paratuberculosis
gggugguccacccaga

SEQ ID NO: 970538 - RNA, 13 nt, Mycobacterium avium subsp. paratuberculosis
gggugguccaggc

SEQ ID NO: 970539 - RNA, 14 nt, Mycobacterium avium subsp. paratuberculosis
ggguggucugcugg

SEQ ID NO: 970540 - RNA, 20 nt, Mycobacterium avium subsp. paratuberculosis
gggugguggacgucaggccg

SEQ ID NO: 970541 - RNA, 16 nt, Mycobacterium avium subsp. paratuberculosis
ggguggugugcaaggc

SEQ ID NO: 970542 - RNA, 20 nt, Mycobacterium avium subsp. paratuberculosis
ggguguaggcccgaucaggg

SEQ ID NO: 970543 - RNA, 13 nt, Mycobacterium avium subsp. paratuberculosis
gggugucgaccca

SEQ ID NO: 970544 - RNA, 20 nt, Mycobacterium avium subsp. paratuberculosis
ggggauuuuuuggggcgggg

SEQ ID NO: 970545 - RNA, 21 nt, Mycobacterium avium subsp. paratuberculosis
ggggauuuuuuggggcggggc

SEQ ID NO: 970546 - RNA, 14 nt, Mycobacterium avium subsp. paratuberculosis
ggggcaagcagcgg

SEQ ID NO: 970547 - RNA, 18 nt, Mycobacterium avium subsp. paratuberculosis
ggggauggugcgccgggu

SEQ ID NO: 970548 - RNA, 17 nt, Mycobacterium avium subsp. paratuberculosis
ggggauguagccgccgg

SEQ ID NO: 970549 - RNA, 22 nt, Mycobacterium avium subsp. paratuberculosis
ggggauguagccgccgguggcg

SEQ ID NO: 970550 - RNA, 19 nt, Mycobacterium avium subsp. paratuberculosis
ggggaugucgaaccccacg

SEQ ID NO: 970551 - RNA, 21 nt, Mycobacterium avium subsp. paratuberculosis
ggggaugucgucgggcgcggu

SEQ ID NO: 970552 - RNA, 21 nt, Mycobacterium avium subsp. paratuberculosis
ggggaugacggucugcaccgg

SEQ ID NO: 970553 - RNA, 19 nt, Mycobacterium avium subsp. paratuberculosis
ggggauccagcggcggccu

SEQ ID NO: 970554 - RNA, 13 nt, Mycobacterium avium subsp. paratuberculosis
ggggaucgccagg

SEQ ID NO: 970555 - RNA, 18 nt, Mycobacterium avium subsp. paratuberculosis
ggggaucgcgcagccgcg

SEQ ID NO: 970556 - RNA, 12 nt, Mycobacterium avium subsp. paratuberculosis
ggggaggcccag

SEQ ID NO: 970557 - RNA, 18 nt, Mycobacterium avium subsp. paratuberculosis
ggggaggcguugcguccc

SEQ ID NO: 970558 - RNA, 13 nt, Mycobacterium avium subsp. paratuberculosis
gggcugaccgcca

SEQ ID NO: 970559 - RNA, 23 nt, Mycobacterium avium subsp. paratuberculosis
gggcucguccucgaaagccgcug

SEQ ID NO: 970560 - RNA, 17 nt, Mycobacterium avium subsp. paratuberculosis
gggcugugccggcgggu

SEQ ID NO: 970561 - RNA, 18 nt, Mycobacterium avium subsp. paratuberculosis
gggcuggugcgcagccgu

SEQ ID NO: 970562 - RNA, 17 nt, Mycobacterium avium subsp. paratuberculosis
gggcugucccggccgcg

SEQ ID NO: 970563 - RNA, 18 nt, Mycobacterium avium subsp. paratuberculosis
gggcuguugaccacggcc

SEQ ID NO: 970564 - RNA, 22 nt, Mycobacterium avium subsp. paratuberculosis
gggcuguugaccacggccuggu

SEQ ID NO: 970565 - RNA, 14 nt, Mycobacterium avium subsp. paratuberculosis
gggcuguccuccca

SEQ ID NO: 970566 - RNA, 20 nt, Mycobacterium avium subsp. paratuberculosis
ggggcgaccuugcgcagccg

SEQ ID NO: 970567 - RNA, 21 nt, Mycobacterium avium subsp. paratuberculosis
ggggcgagcuggccgcccacc

SEQ ID NO: 970568 - RNA, 17 nt, Mycobacterium avium subsp. paratuberculosis
ggggcgagccggcccgg

SEQ ID NO: 970569 - RNA, 13 nt, Mycobacterium avium subsp. paratuberculosis
ggggcgcaccgcc

SEQ ID NO: 970570 - RNA, 18 nt, Mycobacterium avium subsp. paratuberculosis
ggggccuucuuggcggcg

SEQ ID NO: 970571 - RNA, 19 nt, Mycobacterium avium subsp. paratuberculosis
ggggccuucuuggcggcgg

SEQ ID NO: 970572 - RNA, 14 nt, Mycobacterium avium subsp. paratuberculosis
ggggccuccagcca

SEQ ID NO: 970573 - RNA, 19 nt, Mycobacterium avium subsp. paratuberculosis
ggggccucgaugcggccgu

SEQ ID NO: 970574 - RNA, 22 nt, Mycobacterium avium subsp. paratuberculosis
ggggccggcgaaggacagccgg

SEQ ID NO: 970575 - RNA, 14 nt, Mycobacterium avium subsp. paratuberculosis
ggggccggcgcggu

SEQ ID NO: 970576 - RNA, 13 nt, Mycobacterium avium subsp. paratuberculosis
ggggccggccgcc

SEQ ID NO: 970577 - RNA, 20 nt, Mycobacterium avium subsp. paratuberculosis
ggggccggccgcccgcacca

SEQ ID NO: 970578 - RNA, 14 nt, Mycobacterium avium subsp. paratuberculosis
ggggccgcggccgg

SEQ ID NO: 970579 - RNA, 19 nt, Mycobacterium avium subsp. paratuberculosis
ggggccgcggccggcacua

SEQ ID NO: 970580 - RNA, 21 nt, Mycobacterium avium subsp. paratuberculosis
ggggccgaugaccgcggcggg

SEQ ID NO: 970581 - RNA, 22 nt, Mycobacterium avium subsp. paratuberculosis
ggggccgaugaccgcggcgggc

SEQ ID NO: 970582 - RNA, 18 nt, Mycobacterium avium subsp. paratuberculosis
ggggccgauguucacccc

SEQ ID NO: 970583 - RNA, 16 nt, Mycobacterium avium subsp. paratuberculosis
ggggccaccaggcgcc

SEQ ID NO: 970584 - RNA, 15 nt, Mycobacterium avium subsp. paratuberculosis
ggggcccguccccac

SEQ ID NO: 970585 - RNA, 18 nt, Mycobacterium avium subsp. paratuberculosis
ggggcccucgcucaaccc

SEQ ID NO: 970586 - RNA, 22 nt, Mycobacterium avium subsp. paratuberculosis
ggggcagaucgucggcacugcc

SEQ ID NO: 970587 - RNA, 21 nt, Mycobacterium avium subsp. paratuberculosis
ggggcagcacccgcaccgugu

SEQ ID NO: 970588 - RNA, 13 nt, Mycobacterium avium subsp. paratuberculosis
ggggcacgucccc

SEQ ID NO: 970589 - RNA, 23 nt, Mycobacterium avium subsp. paratuberculosis
ggggcacguccccgugcagccgg

SEQ ID NO: 970590 - RNA, 22 nt, Mycobacterium avium subsp. paratuberculosis
ggggcagggaauucagccugcc

SEQ ID NO: 970591 - RNA, 23 nt, Mycobacterium avium subsp. paratuberculosis
ggggcagccgucgaugccggcga

SEQ ID NO: 970592 - RNA, 14 nt, Mycobacterium avium subsp. paratuberculosis
ggggcagcagcgcc

SEQ ID NO: 970593 - RNA, 20 nt, Mycobacterium avium subsp. paratuberculosis
ggggcagcugauagcccgcc

SEQ ID NO: 970594 - RNA, 13 nt, Mycobacterium avium subsp. paratuberculosis
ggggcaucgcagc

SEQ ID NO: 970595 - RNA, 19 nt, Mycobacterium avium subsp. paratuberculosis
ggggcaucgcagcgcgcgg

SEQ ID NO: 970596 - RNA, 22 nt, Mycobacterium avium subsp. paratuberculosis
ggggcaguagugguccaccgcc

SEQ ID NO: 970597 - RNA, 12 nt, Mycobacterium avium subsp. paratuberculosis
gggcucgagcaa

SEQ ID NO: 970598 - RNA, 14 nt, Mycobacterium avium subsp. paratuberculosis
gggcucgagcccca

SEQ ID NO: 970599 - RNA, 17 nt, Mycobacterium avium subsp. paratuberculosis
gggcucgagggcggcga

SEQ ID NO: 970600 - RNA, 21 nt, Mycobacterium avium subsp. paratuberculosis
gggcucacuuuugacaggugg

SEQ ID NO: 970601 - RNA, 12 nt, Mycobacterium avium subsp. paratuberculosis
gggcucagccga

SEQ ID NO: 970602 - RNA, 14 nt, Mycobacterium avium subsp. paratuberculosis
gggcuccgcgcuga

SEQ ID NO: 970603 - RNA, 20 nt, Mycobacterium avium subsp. paratuberculosis
gggcucgauguugaucgcca

SEQ ID NO: 970604 - RNA, 14 nt, Mycobacterium avium subsp. paratuberculosis
gggcucgcccgggc

SEQ ID NO: 970605 - RNA, 13 nt, Mycobacterium avium subsp. paratuberculosis
gggcucgcgcacc

SEQ ID NO: 970606 - RNA, 20 nt, Mycobacterium avium subsp. paratuberculosis
gggcucggaguugcgcagcc

SEQ ID NO: 970607 - RNA, 21 nt, Mycobacterium avium subsp. paratuberculosis
gggcucggaguugcgcagccg

SEQ ID NO: 970608 - RNA, 16 nt, Mycobacterium avium subsp. paratuberculosis
gggcucggcgccgacc

SEQ ID NO: 970609 - RNA, 17 nt, Mycobacterium avium subsp. paratuberculosis
gggcucggcgccgaccu

SEQ ID NO: 970610 - RNA, 21 nt, Mycobacterium avium subsp. paratuberculosis
gggcuagacgcgcaccagggc

SEQ ID NO: 970611 - RNA, 13 nt, Mycobacterium avium subsp. paratuberculosis
gggcgggcagccg

SEQ ID NO: 970612 - RNA, 15 nt, Mycobacterium avium subsp. paratuberculosis
gggcgggcaggcccg

SEQ ID NO: 970613 - RNA, 21 nt, Mycobacterium avium subsp. paratuberculosis
gggcgggccccacgccaguca

SEQ ID NO: 970614 - RNA, 14 nt, Mycobacterium avium subsp. paratuberculosis
gggcgggccgccag

SEQ ID NO: 970615 - RNA, 22 nt, Mycobacterium avium subsp. paratuberculosis
gggcgggaaucacgccccaggc

SEQ ID NO: 970616 - RNA, 21 nt, Mycobacterium avium subsp. paratuberculosis
gggcguuugccacugagcgca

SEQ ID NO: 970617 - RNA, 17 nt, Mycobacterium avium subsp. paratuberculosis
gggcggcgccggcacug

SEQ ID NO: 970618 - RNA, 17 nt, Mycobacterium avium subsp. paratuberculosis
gggcggccugcacccag

SEQ ID NO: 970619 - RNA, 23 nt, Mycobacterium avium subsp. paratuberculosis
gggcggccucggcguccgcggcg

SEQ ID NO: 970620 - RNA, 23 nt, Mycobacterium avium subsp. paratuberculosis
gggcggcgcgaucgucgaccacc

SEQ ID NO: 970621 - RNA, 15 nt, Mycobacterium avium subsp. paratuberculosis
gggcggaagucggug

SEQ ID NO: 970622 - RNA, 14 nt, Mycobacterium avium subsp. paratuberculosis
gggcggacggcacc

SEQ ID NO: 970623 - RNA, 14 nt, Mycobacterium avium subsp. paratuberculosis
gggccugcggcggc

SEQ ID NO: 970624 - RNA, 20 nt, Mycobacterium avium subsp. paratuberculosis
gggcggccagccgcgcggcg

SEQ ID NO: 970625 - RNA, 13 nt, Mycobacterium avium subsp. paratuberculosis
gggcggcccgggu

SEQ ID NO: 970626 - RNA, 18 nt, Mycobacterium avium subsp. paratuberculosis
gggcggccccgggcgcug

SEQ ID NO: 970627 - RNA, 23 nt, Mycobacterium avium subsp. paratuberculosis
gggcggcaucgcgcgcggcggcc

SEQ ID NO: 970628 - RNA, 20 nt, Mycobacterium avium subsp. paratuberculosis
gggcggcagguggggcagca

SEQ ID NO: 970629 - RNA, 15 nt, Mycobacterium avium subsp. paratuberculosis
gggcggaugugccug

SEQ ID NO: 970630 - RNA, 15 nt, Mycobacterium avium subsp. paratuberculosis
gggccucguccaggg

SEQ ID NO: 970631 - RNA, 23 nt, Mycobacterium avium subsp. paratuberculosis
gggccucguccagggacuccggg

SEQ ID NO: 970632 - RNA, 18 nt, Mycobacterium avium subsp. paratuberculosis
gggccugcagcaccaggc

SEQ ID NO: 970633 - RNA, 14 nt, Mycobacterium avium subsp. paratuberculosis
gggccuccaccagc

SEQ ID NO: 970634 - RNA, 16 nt, Mycobacterium avium subsp. paratuberculosis
gggccgccggguggcg

SEQ ID NO: 970635 - RNA, 22 nt, Mycobacterium avium subsp. paratuberculosis
gggccguccgggugcgggcuga

SEQ ID NO: 970636 - RNA, 16 nt, Mycobacterium avium subsp. paratuberculosis
gggccuagugccgggg

SEQ ID NO: 970637 - RNA, 19 nt, Mycobacterium avium subsp. paratuberculosis
gggccuagugccgggggcc

SEQ ID NO: 970638 - RNA, 15 nt, Mycobacterium avium subsp. paratuberculosis
gggccguggcaccgg

SEQ ID NO: 970639 - RNA, 13 nt, Mycobacterium avium subsp. paratuberculosis
ggggugggcgaac

SEQ ID NO: 970640 - RNA, 10 nt, Mycobacterium avium subsp. paratuberculosis
gggguggugg

SEQ ID NO: 970641 - RNA, 13 nt, Mycobacterium avium subsp. paratuberculosis
gggguggcgccgg

SEQ ID NO: 970642 - RNA, 13 nt, Mycobacterium avium subsp. paratuberculosis
gggguggccagcu

SEQ ID NO: 970643 - RNA, 20 nt, Mycobacterium avium subsp. paratuberculosis
ggguaccacuugaaggaggc

SEQ ID NO: 970644 - RNA, 14 nt, Mycobacterium avium subsp. paratuberculosis
gggucaccacgguc

SEQ ID NO: 970645 - RNA, 14 nt, Mycobacterium avium subsp. paratuberculosis
ggguaaccgcagcc

SEQ ID NO: 970646 - RNA, 22 nt, Mycobacterium avium subsp. paratuberculosis
ggguaaccgcagccgggugcgg

SEQ ID NO: 970647 - RNA, 14 nt, Mycobacterium avium subsp. paratuberculosis
ggguacagccgcag

SEQ ID NO: 970648 - RNA, 21 nt, Mycobacterium avium subsp. paratuberculosis
gggucagcacccgcagccgcg

SEQ ID NO: 970649 - RNA, 19 nt, Mycobacterium avium subsp. paratuberculosis
gggucagcaccgcggagga

SEQ ID NO: 970650 - RNA, 13 nt, Mycobacterium avium subsp. paratuberculosis
gggucagcgaggc

SEQ ID NO: 970651 - RNA, 18 nt, Mycobacterium avium subsp. paratuberculosis
ggguccuugcgccccggc

SEQ ID NO: 970652 - RNA, 19 nt, Mycobacterium avium subsp. paratuberculosis
gggucgacccgccgcagcc

SEQ ID NO: 970653 - RNA, 16 nt, Mycobacterium avium subsp. paratuberculosis
gggucgaacggcaacc

SEQ ID NO: 970654 - RNA, 21 nt, Mycobacterium avium subsp. paratuberculosis
gggucgacagccugaccgcgg

SEQ ID NO: 970655 - RNA, 22 nt, Mycobacterium avium subsp. paratuberculosis
gggucaggaacaccgagccggc

SEQ ID NO: 970656 - RNA, 19 nt, Mycobacterium avium subsp. paratuberculosis
gggucgcgcggcuacagca

SEQ ID NO: 970657 - RNA, 15 nt, Mycobacterium avium subsp. paratuberculosis
gggucgcggcccacc

SEQ ID NO: 970658 - RNA, 23 nt, Mycobacterium avium subsp. paratuberculosis
gggucggagcaaauccggcagcg

SEQ ID NO: 970659 - RNA, 13 nt, Mycobacterium avium subsp. paratuberculosis
gggucgcgguggg

SEQ ID NO: 970660 - RNA, 17 nt, Mycobacterium avium subsp. paratuberculosis
gggucgccguggccgaa

SEQ ID NO: 970661 - RNA, 14 nt, Mycobacterium avium subsp. paratuberculosis
gggucacggucagg

SEQ ID NO: 970662 - RNA, 19 nt, Mycobacterium avium subsp. paratuberculosis
gggucgagaucagcaccgg

SEQ ID NO: 970663 - RNA, 20 nt, Mycobacterium avium subsp. paratuberculosis
gggugccagccgugcggcgg

SEQ ID NO: 970664 - RNA, 21 nt, Mycobacterium avium subsp. paratuberculosis
gggugcaggcccgggcggcga

SEQ ID NO: 970665 - RNA, 18 nt, Mycobacterium avium subsp. paratuberculosis
gggugcccaucugcacag

SEQ ID NO: 970666 - RNA, 21 nt, Mycobacterium avium subsp. paratuberculosis
gggugccccgcgaccgcagca

SEQ ID NO: 970667 - RNA, 19 nt, Mycobacterium avium subsp. paratuberculosis
gggugcccgggccgcagcu

SEQ ID NO: 970668 - RNA, 13 nt, Mycobacterium avium subsp. paratuberculosis
gggugccgcagcg

SEQ ID NO: 970669 - RNA, 20 nt, Mycobacterium avium subsp. paratuberculosis
gggugccgcagcggcggcac

SEQ ID NO: 970670 - RNA, 18 nt, Mycobacterium avium subsp. paratuberculosis
gggugccggaggcggcgu

SEQ ID NO: 970671 - RNA, 17 nt, Mycobacterium avium subsp. paratuberculosis
gggugauaccggcccag

SEQ ID NO: 970672 - RNA, 23 nt, Mycobacterium avium subsp. paratuberculosis
gggugauaccggcccagcgcggu

SEQ ID NO: 970673 - RNA, 13 nt, Mycobacterium avium subsp. paratuberculosis
gggucggcgccgg

SEQ ID NO: 970674 - RNA, 13 nt, Mycobacterium avium subsp. paratuberculosis
gggucgccgggca

SEQ ID NO: 970675 - RNA, 17 nt, Mycobacterium avium subsp. paratuberculosis
gggucggcgagcagccg

SEQ ID NO: 970676 - RNA, 17 nt, Mycobacterium avium subsp. paratuberculosis
ggggugaugccggcggu

SEQ ID NO: 970677 - RNA, 13 nt, Mycobacterium avium subsp. paratuberculosis
ggggugcccggcg

SEQ ID NO: 970678 - RNA, 20 nt, Mycobacterium avium subsp. paratuberculosis
ggggugccgcagcggcggca

SEQ ID NO: 970679 - RNA, 20 nt, Mycobacterium avium subsp. paratuberculosis
ggggucggcgucgggccggg

SEQ ID NO: 970680 - RNA, 19 nt, Mycobacterium avium subsp. paratuberculosis
ggggucuggucgguuugcg

SEQ ID NO: 970681 - RNA, 15 nt, Mycobacterium avium subsp. paratuberculosis
ggggucgggccggac

SEQ ID NO: 970682 - RNA, 13 nt, Mycobacterium avium subsp. paratuberculosis
ggggucggccagc

SEQ ID NO: 970683 - RNA, 13 nt, Mycobacterium avium subsp. paratuberculosis
ggggucggccgag

SEQ ID NO: 970684 - RNA, 17 nt, Mycobacterium avium subsp. paratuberculosis
ggggucggcgccgcgcg

SEQ ID NO: 970685 - RNA, 20 nt, Mycobacterium avium subsp. paratuberculosis
gggguccuccagcggcaggu

SEQ ID NO: 970686 - RNA, 21 nt, Mycobacterium avium subsp. paratuberculosis
gggguccucgauggcggcggc

SEQ ID NO: 970687 - RNA, 22 nt, Mycobacterium avium subsp. paratuberculosis
gggguccucgauggcggcggcu

SEQ ID NO: 970688 - RNA, 15 nt, Mycobacterium avium subsp. paratuberculosis
ggggucgcggcccgc

SEQ ID NO: 970689 - RNA, 19 nt, Mycobacterium avium subsp. paratuberculosis
gggguccgcaacgccggcg

SEQ ID NO: 970690 - RNA, 13 nt, Mycobacterium avium subsp. paratuberculosis
gggggugggcucc

SEQ ID NO: 970691 - RNA, 14 nt, Mycobacterium avium subsp. paratuberculosis
gggggugccgaccg

SEQ ID NO: 970692 - RNA, 12 nt, Mycobacterium avium subsp. paratuberculosis
ggggggcggggu

SEQ ID NO: 970693 - RNA, 20 nt, Mycobacterium avium subsp. paratuberculosis
ggggguaaaccgccagcagc

SEQ ID NO: 970694 - RNA, 22 nt, Mycobacterium avium subsp. paratuberculosis
gggggcuguccaccugcaccug

SEQ ID NO: 970695 - RNA, 14 nt, Mycobacterium avium subsp. paratuberculosis
gggggcggcggggu

SEQ ID NO: 970696 - RNA, 22 nt, Mycobacterium avium subsp. paratuberculosis
gggggauuucacgucugcucgg

SEQ ID NO: 970697 - RNA, 13 nt, Mycobacterium avium subsp. paratuberculosis
ggggcuggcggcg

SEQ ID NO: 970698 - RNA, 22 nt, Mycobacterium avium subsp. paratuberculosis
gggggacuuucgcgucugcucg

SEQ ID NO: 970699 - RNA, 20 nt, Mycobacterium avium subsp. paratuberculosis
gggggaagucgaccggggcg

SEQ ID NO: 970700 - RNA, 18 nt, Mycobacterium avium subsp. paratuberculosis
gggggaccagcgcaaccg

SEQ ID NO: 970701 - RNA, 18 nt, Mycobacterium avium subsp. paratuberculosis
ggggcuuuugcgucugcu

SEQ ID NO: 970702 - RNA, 17 nt, Mycobacterium avium subsp. paratuberculosis
ggggcucgacaggcagc

SEQ ID NO: 970703 - RNA, 20 nt, Mycobacterium avium subsp. paratuberculosis
ggggcucgacaggcagcccg

SEQ ID NO: 970704 - RNA, 18 nt, Mycobacterium avium subsp. paratuberculosis
ggggcucauacggcggcu

SEQ ID NO: 970705 - RNA, 23 nt, Mycobacterium avium subsp. paratuberculosis
ggggcguugguugcggccccgcc

SEQ ID NO: 970706 - RNA, 15 nt, Mycobacterium avium subsp. paratuberculosis
ggggcuacaaaacca

SEQ ID NO: 970707 - RNA, 13 nt, Mycobacterium avium subsp. paratuberculosis
ggggcuauccggg

SEQ ID NO: 970708 - RNA, 16 nt, Mycobacterium avium subsp. paratuberculosis
ggggcuauccgggguc

SEQ ID NO: 970709 - RNA, 17 nt, Mycobacterium avium subsp. paratuberculosis
ggggcgucgaugcguga

SEQ ID NO: 970710 - RNA, 15 nt, Mycobacterium avium subsp. paratuberculosis
ggggcgggcggcggc

SEQ ID NO: 970711 - RNA, 13 nt, Mycobacterium avium subsp. paratuberculosis
ggggcggcggcgc

SEQ ID NO: 970712 - RNA, 16 nt, Mycobacterium avium subsp. paratuberculosis
ggggcggcggcgccgg

SEQ ID NO: 970713 - RNA, 14 nt, Mycobacterium avium subsp. paratuberculosis
ggggcggccgccgg

SEQ ID NO: 970714 - RNA, 14 nt, Mycobacterium avium subsp. paratuberculosis
ggggcggccugagc

SEQ ID NO: 970715 - RNA, 18 nt, Mycobacterium avium subsp. paratuberculosis
ggggcggccugagccgcc

SEQ ID NO: 970716 - RNA, 14 nt, Mycobacterium avium subsp. paratuberculosis
ggggcgcgaggcgc

SEQ ID NO: 970717 - RNA, 13 nt, Mycobacterium avium subsp. paratuberculosis
ggggcgcgcaggc

SEQ ID NO: 970718 - RNA, 14 nt, Mycobacterium avium subsp. paratuberculosis
ggggcgcgcgccgg

SEQ ID NO: 970719 - RNA, 15 nt, Mycobacterium avium subsp. paratuberculosis
ggggcgcgcgccggg

SEQ ID NO: 970720 - RNA, 15 nt, Mycobacterium avium subsp. paratuberculosis
ggggcgcggaccgca

SEQ ID NO: 970721 - RNA, 12 nt, Mycobacterium avium subsp. paratuberculosis
ggggcgcagccg

SEQ ID NO: 970722 - RNA, 16 nt, Mycobacterium avium subsp. paratuberculosis
ggggcgcagcugcagc

SEQ ID NO: 970723 - RNA, 18 nt, Mycobacterium avium subsp. paratuberculosis
ggggcgccgacagucgcg

SEQ ID NO: 970724 - RNA, 19 nt, Mycobacterium avium subsp. paratuberculosis
ggggcgccgacagucgcgg

SEQ ID NO: 970725 - RNA, 19 nt, Mycobacterium avium subsp. paratuberculosis
ggggcgccuaccggguggc

SEQ ID NO: 970726 - RNA, 20 nt, Mycobacterium avium subsp. paratuberculosis
gggauuuuuuggggcggggc

SEQ ID NO: 970727 - RNA, 14 nt, Mycobacterium avium subsp. paratuberculosis
gggauuggacagcg

SEQ ID NO: 970728 - RNA, 20 nt, Mycobacterium avium subsp. paratuberculosis
gggaucagguagaggcuguc

SEQ ID NO: 970729 - RNA, 14 nt, Mycobacterium avium subsp. paratuberculosis
gggaucggcagcgc

SEQ ID NO: 970730 - RNA, 23 nt, Mycobacterium avium subsp. paratuberculosis
gggaucggcgcccaccgcggcgc

SEQ ID NO: 970731 - RNA, 14 nt, Mycobacterium avium subsp. paratuberculosis
gggaucggcggcgg

SEQ ID NO: 970732 - RNA, 15 nt, Mycobacterium avium subsp. paratuberculosis
gggaucggcggcggg

SEQ ID NO: 970733 - RNA, 14 nt, Mycobacterium avium subsp. paratuberculosis
gggaucggcggggc

SEQ ID NO: 970734 - RNA, 18 nt, Mycobacterium avium subsp. paratuberculosis
gggaucggcggggcgcgu

SEQ ID NO: 970735 - RNA, 15 nt, Mycobacterium avium subsp. paratuberculosis
gggagagcgggaccg

SEQ ID NO: 970736 - RNA, 20 nt, Mycobacterium avium subsp. paratuberculosis
gggagaggcgcggcgcgagg

SEQ ID NO: 970737 - RNA, 21 nt, Mycobacterium avium subsp. paratuberculosis
gggagcacucgauggcggcga

SEQ ID NO: 970738 - RNA, 14 nt, Mycobacterium avium subsp. paratuberculosis
gggaucaggaugac

SEQ ID NO: 970739 - RNA, 23 nt, Mycobacterium avium subsp. paratuberculosis
gggauccaggaauucgggcaccc

SEQ ID NO: 970740 - RNA, 16 nt, Mycobacterium avium subsp. paratuberculosis
gggauccgccugcgcg

SEQ ID NO: 970741 - RNA, 23 nt, Mycobacterium avium subsp. paratuberculosis
gggauccgccugcgcgggcgcgg

SEQ ID NO: 970742 - RNA, 21 nt, Mycobacterium avium subsp. paratuberculosis
gggcaacagcgcgccggccgg

SEQ ID NO: 970743 - RNA, 13 nt, Mycobacterium avium subsp. paratuberculosis
gggcacggucagg

SEQ ID NO: 970744 - RNA, 15 nt, Mycobacterium avium subsp. paratuberculosis
gggcaaagacgacgg

SEQ ID NO: 970745 - RNA, 22 nt, Mycobacterium avium subsp. paratuberculosis
gggcacucccuuguugccgagu

SEQ ID NO: 970746 - RNA, 15 nt, Mycobacterium avium subsp. paratuberculosis
gggcagccagcccgc

SEQ ID NO: 970747 - RNA, 18 nt, Mycobacterium avium subsp. paratuberculosis
gggcagccccagcgagca

SEQ ID NO: 970748 - RNA, 20 nt, Mycobacterium avium subsp. paratuberculosis
gggcagcccgaacagccggg

SEQ ID NO: 970749 - RNA, 18 nt, Mycobacterium avium subsp. paratuberculosis
gggcagcccgagcaacug

SEQ ID NO: 970750 - RNA, 12 nt, Mycobacterium avium subsp. paratuberculosis
gggcagcccgcc

SEQ ID NO: 970751 - RNA, 16 nt, Mycobacterium avium subsp. paratuberculosis
gggcagcccgccgcgg

SEQ ID NO: 970752 - RNA, 19 nt, Mycobacterium avium subsp. paratuberculosis
gggcagcccgggucuagau

SEQ ID NO: 970753 - RNA, 21 nt, Mycobacterium avium subsp. paratuberculosis
gggcagcagcaucggucccag

SEQ ID NO: 970754 - RNA, 19 nt, Mycobacterium avium subsp. paratuberculosis
gggcagcagcaccagcgcc

SEQ ID NO: 970755 - RNA, 17 nt, Mycobacterium avium subsp. paratuberculosis
gggcagauaggcggcga

SEQ ID NO: 970756 - RNA, 19 nt, Mycobacterium avium subsp. paratuberculosis
gggcagaucgucggcacug

SEQ ID NO: 970757 - RNA, 16 nt, Mycobacterium avium subsp. paratuberculosis
gggcagauggucgccg

SEQ ID NO: 970758 - RNA, 15 nt, Mycobacterium avium subsp. paratuberculosis
gggccauccggccgg

SEQ ID NO: 970759 - RNA, 14 nt, Mycobacterium avium subsp. paratuberculosis
gggcccaccagguc

SEQ ID NO: 970760 - RNA, 14 nt, Mycobacterium avium subsp. paratuberculosis
gggcccacgcucga

SEQ ID NO: 970761 - RNA, 17 nt, Mycobacterium avium subsp. paratuberculosis
gggcccagcaccaccac

SEQ ID NO: 970762 - RNA, 21 nt, Mycobacterium avium subsp. paratuberculosis
gggcccagcagauagcccagc

SEQ ID NO: 970763 - RNA, 17 nt, Mycobacterium avium subsp. paratuberculosis
gggcccacagcagccgc

SEQ ID NO: 970764 - RNA, 13 nt, Mycobacterium avium subsp. paratuberculosis
gggcccagcgcga

SEQ ID NO: 970765 - RNA, 13 nt, Mycobacterium avium subsp. paratuberculosis
gggcccagcucgg

SEQ ID NO: 970766 - RNA, 17 nt, Mycobacterium avium subsp. paratuberculosis
gggccaggucggugaca

SEQ ID NO: 970767 - RNA, 20 nt, Mycobacterium avium subsp. paratuberculosis
gggccaggugugcccgcccu

SEQ ID NO: 970768 - RNA, 18 nt, Mycobacterium avium subsp. paratuberculosis
gggccagguucaggcccg

SEQ ID NO: 970769 - RNA, 15 nt, Mycobacterium avium subsp. paratuberculosis
gggccaucgacucca

SEQ ID NO: 970770 - RNA, 18 nt, Mycobacterium avium subsp. paratuberculosis
gggccaucgacuccagca

SEQ ID NO: 970771 - RNA, 23 nt, Mycobacterium avium subsp. paratuberculosis
gggccaucaccuccuuggccagg

SEQ ID NO: 970772 - RNA, 14 nt, Mycobacterium avium subsp. paratuberculosis
gggccaucgccagg

SEQ ID NO: 970773 - RNA, 12 nt, Mycobacterium avium subsp. paratuberculosis
gggccaggcgcg

SEQ ID NO: 970774 - RNA, 21 nt, Mycobacterium avium subsp. paratuberculosis
gggccaggcgcgcgcuggugc

SEQ ID NO: 970775 - RNA, 19 nt, Mycobacterium avium subsp. paratuberculosis
gggccagcucgaaccugga

SEQ ID NO: 970776 - RNA, 21 nt, Mycobacterium avium subsp. paratuberculosis
gggccagcucgaaccuggagg

SEQ ID NO: 970777 - RNA, 20 nt, Mycobacterium avium subsp. paratuberculosis
gggccagcucgucgagccgg

SEQ ID NO: 970778 - RNA, 20 nt, Mycobacterium avium subsp. paratuberculosis
gggccagcguuuccagcgcc

SEQ ID NO: 970779 - RNA, 16 nt, Mycobacterium avium subsp. paratuberculosis
gggccagcggcgccgg

SEQ ID NO: 970780 - RNA, 17 nt, Mycobacterium avium subsp. paratuberculosis
gggccagccggcccucc

SEQ ID NO: 970781 - RNA, 21 nt, Mycobacterium avium subsp. paratuberculosis
gggccagccggcccuccagga

SEQ ID NO: 970782 - RNA, 12 nt, Mycobacterium avium subsp. paratuberculosis
gggccagcagga

SEQ ID NO: 970783 - RNA, 14 nt, Mycobacterium avium subsp. paratuberculosis
gggccagcagcccg

SEQ ID NO: 970784 - RNA, 15 nt, Mycobacterium avium subsp. paratuberculosis
gggccagcagcccgg

SEQ ID NO: 970785 - RNA, 13 nt, Mycobacterium avium subsp. paratuberculosis
gggccagcagccg

SEQ ID NO: 970786 - RNA, 11 nt, Mycobacterium avium subsp. paratuberculosis
gggcagcgcgu

SEQ ID NO: 970787 - RNA, 17 nt, Mycobacterium avium subsp. paratuberculosis
gggcagcgccucgagca

SEQ ID NO: 970788 - RNA, 20 nt, Mycobacterium avium subsp. paratuberculosis
gggcagcgcgaccagcccgg

SEQ ID NO: 970789 - RNA, 21 nt, Mycobacterium avium subsp. paratuberculosis
gggcagcgcgaccagcccggc

SEQ ID NO: 970790 - RNA, 15 nt, Mycobacterium avium subsp. paratuberculosis
gggcagcgagcacag

SEQ ID NO: 970791 - RNA, 22 nt, Mycobacterium avium subsp. paratuberculosis
gggcagcgagucgaaggcgcgg

SEQ ID NO: 970792 - RNA, 19 nt, Mycobacterium avium subsp. paratuberculosis
gggccgaaggcggcgccgg

SEQ ID NO: 970793 - RNA, 21 nt, Mycobacterium avium subsp. paratuberculosis
gggccgacagcacgccgggca

SEQ ID NO: 970794 - RNA, 15 nt, Mycobacterium avium subsp. paratuberculosis
gggccgaccgucagc

SEQ ID NO: 970795 - RNA, 19 nt, Mycobacterium avium subsp. paratuberculosis
gggccgaccuggcggccgg

SEQ ID NO: 970796 - RNA, 15 nt, Mycobacterium avium subsp. paratuberculosis
gggccgcacccccuc

SEQ ID NO: 970797 - RNA, 16 nt, Mycobacterium avium subsp. paratuberculosis
gggccgcagcgcgcgg

SEQ ID NO: 970798 - RNA, 20 nt, Mycobacterium avium subsp. paratuberculosis
gggccgcagcucgcccagca

SEQ ID NO: 970799 - RNA, 12 nt, Mycobacterium avium subsp. paratuberculosis
gggccgaggaag

SEQ ID NO: 970800 - RNA, 15 nt, Mycobacterium avium subsp. paratuberculosis
gggccgggcaccgcg

SEQ ID NO: 970801 - RNA, 12 nt, Mycobacterium avium subsp. paratuberculosis
gggccgggcacg

SEQ ID NO: 970802 - RNA, 12 nt, Mycobacterium avium subsp. paratuberculosis
gggccggugcgu

SEQ ID NO: 970803 - RNA, 14 nt, Mycobacterium avium subsp. paratuberculosis
gggccggugcguga

SEQ ID NO: 970804 - RNA, 16 nt, Mycobacterium avium subsp. paratuberculosis
gggccgggcgcuggcc

SEQ ID NO: 970805 - RNA, 12 nt, Mycobacterium avium subsp. paratuberculosis
gggccgggcggg

SEQ ID NO: 970806 - RNA, 17 nt, Mycobacterium avium subsp. paratuberculosis
gggccgggcgggcaccc

SEQ ID NO: 970807 - RNA, 13 nt, Mycobacterium avium subsp. paratuberculosis
gggccgggggcgg

SEQ ID NO: 970808 - RNA, 22 nt, Mycobacterium avium subsp. paratuberculosis
gggccgguaaaacuggccagca

SEQ ID NO: 970809 - RNA, 16 nt, Mycobacterium avium subsp. paratuberculosis
gggccggucagcgcga

SEQ ID NO: 970810 - RNA, 14 nt, Mycobacterium avium subsp. paratuberculosis
gggccggcgggggc

SEQ ID NO: 970811 - RNA, 15 nt, Mycobacterium avium subsp. paratuberculosis
gggccggcgggggcg

SEQ ID NO: 970812 - RNA, 22 nt, Mycobacterium avium subsp. paratuberculosis
gggccggcgucgucgagcaccg

SEQ ID NO: 970813 - RNA, 13 nt, Mycobacterium avium subsp. paratuberculosis
gggccggcggcgg

SEQ ID NO: 970814 - RNA, 17 nt, Mycobacterium avium subsp. paratuberculosis
gggccgccgcggccaca

SEQ ID NO: 970815 - RNA, 16 nt, Mycobacterium avium subsp. paratuberculosis
gggccgccggccgcgg

SEQ ID NO: 970816 - RNA, 13 nt, Mycobacterium avium subsp. paratuberculosis
gggccgcccgcgc

SEQ ID NO: 970817 - RNA, 22 nt, Mycobacterium avium subsp. paratuberculosis
gggccgccagguuggcggcggc

SEQ ID NO: 970818 - RNA, 14 nt, Mycobacterium avium subsp. paratuberculosis
gggccgccgagcag

SEQ ID NO: 970819 - RNA, 20 nt, Mycobacterium avium subsp. paratuberculosis
ggcuucauaugacgccggcc

SEQ ID NO: 970820 - RNA, 16 nt, Mycobacterium avium subsp. paratuberculosis
ggcuugaucucgaccu

SEQ ID NO: 970821 - RNA, 14 nt, Mycobacterium avium subsp. paratuberculosis
ggcuugcgcucggc

SEQ ID NO: 970822 - RNA, 23 nt, Mycobacterium avium subsp. paratuberculosis
ggcuugccccggucccggggcuc

SEQ ID NO: 970823 - RNA, 16 nt, Mycobacterium avium subsp. paratuberculosis
ggcuugagcgccagcg

SEQ ID NO: 970824 - RNA, 18 nt, Mycobacterium avium subsp. paratuberculosis
ggcuugaaaguccgccga

SEQ ID NO: 970825 - RNA, 20 nt, Mycobacterium avium subsp. paratuberculosis
ggcuugaccggcucgccggc

SEQ ID NO: 970826 - RNA, 23 nt, Mycobacterium avium subsp. paratuberculosis
ggcuguccaccugcaccugggug

SEQ ID NO: 970827 - RNA, 14 nt, Mycobacterium avium subsp. paratuberculosis
ggcuguccaccugc

SEQ ID NO: 970828 - RNA, 15 nt, Mycobacterium avium subsp. paratuberculosis
ggccgcccgacccgu

SEQ ID NO: 970829 - RNA, 21 nt, Mycobacterium avium subsp. paratuberculosis
ggcuguccgcguggccgagga

SEQ ID NO: 970830 - RNA, 21 nt, Mycobacterium avium subsp. paratuberculosis
ggcugucgggugccgccuugg

SEQ ID NO: 970831 - RNA, 16 nt, Mycobacterium avium subsp. paratuberculosis
ggcugugaucgcugac

SEQ ID NO: 970832 - RNA, 20 nt, Mycobacterium avium subsp. paratuberculosis
ggcugugcacgauggacagg

SEQ ID NO: 970833 - RNA, 19 nt, Mycobacterium avium subsp. paratuberculosis
ggccgcccagcccgcgccg

SEQ ID NO: 970834 - RNA, 22 nt, Mycobacterium avium subsp. paratuberculosis
ggccgccaguuguuggccgggc

SEQ ID NO: 970835 - RNA, 18 nt, Mycobacterium avium subsp. paratuberculosis
ggccgccaucaccgcgcu

SEQ ID NO: 970836 - RNA, 20 nt, Mycobacterium avium subsp. paratuberculosis
ggccgccaucauccgcuggg

SEQ ID NO: 970837 - RNA, 13 nt, Mycobacterium avium subsp. paratuberculosis
ggccgccagcgcc

SEQ ID NO: 970838 - RNA, 14 nt, Mycobacterium avium subsp. paratuberculosis
ggccgccagcucgu

SEQ ID NO: 970839 - RNA, 17 nt, Mycobacterium avium subsp. paratuberculosis
ggccgcagccgcgcggc

SEQ ID NO: 970840 - RNA, 19 nt, Mycobacterium avium subsp. paratuberculosis
ggccgcagcgcaucgccgg

SEQ ID NO: 970841 - RNA, 13 nt, Mycobacterium avium subsp. paratuberculosis
ggccgcagcgcga

SEQ ID NO: 970842 - RNA, 15 nt, Mycobacterium avium subsp. paratuberculosis
ggccgcagcgcgcgg

SEQ ID NO: 970843 - RNA, 23 nt, Mycobacterium avium subsp. paratuberculosis
ggccgcagcggcaggucgucguc

SEQ ID NO: 970844 - RNA, 18 nt, Mycobacterium avium subsp. paratuberculosis
ggccgcaggcggccagca

SEQ ID NO: 970845 - RNA, 13 nt, Mycobacterium avium subsp. paratuberculosis
ggccgccagcgca

SEQ ID NO: 970846 - RNA, 17 nt, Mycobacterium avium subsp. paratuberculosis
ggccgcacggugcagca

SEQ ID NO: 970847 - RNA, 19 nt, Mycobacterium avium subsp. paratuberculosis
ggccgcacggugcagcagc

SEQ ID NO: 970848 - RNA, 22 nt, Mycobacterium avium subsp. paratuberculosis
ggccgcaaucggcgccggcucc

SEQ ID NO: 970849 - RNA, 15 nt, Mycobacterium avium subsp. paratuberculosis
ggccgcacaccacca

SEQ ID NO: 970850 - RNA, 18 nt, Mycobacterium avium subsp. paratuberculosis
ggccgcacccccuccaca

SEQ ID NO: 970851 - RNA, 22 nt, Mycobacterium avium subsp. paratuberculosis
ggccgcacccccuccacacggc

SEQ ID NO: 970852 - RNA, 15 nt, Mycobacterium avium subsp. paratuberculosis
gggaaguuggccucc

SEQ ID NO: 970853 - RNA, 17 nt, Mycobacterium avium subsp. paratuberculosis
gggaaucuuccuucuug

SEQ ID NO: 970854 - RNA, 12 nt, Mycobacterium avium subsp. paratuberculosis
gggaaguccggg

SEQ ID NO: 970855 - RNA, 12 nt, Mycobacterium avium subsp. paratuberculosis
gggaagggcgcg

SEQ ID NO: 970856 - RNA, 19 nt, Mycobacterium avium subsp. paratuberculosis
gggaaggugcgggcggggc

SEQ ID NO: 970857 - RNA, 13 nt, Mycobacterium avium subsp. paratuberculosis
gggaaggcggccg

SEQ ID NO: 970858 - RNA, 14 nt, Mycobacterium avium subsp. paratuberculosis
gggaagggcccggg

SEQ ID NO: 970859 - RNA, 23 nt, Mycobacterium avium subsp. paratuberculosis
gggaaggacucaaucggucaggg

SEQ ID NO: 970860 - RNA, 12 nt, Mycobacterium avium subsp. paratuberculosis
gggaagcugcug

SEQ ID NO: 970861 - RNA, 21 nt, Mycobacterium avium subsp. paratuberculosis
gggaagccgagcuugggccgg

SEQ ID NO: 970862 - RNA, 17 nt, Mycobacterium avium subsp. paratuberculosis
gggagaacucgaucugc

SEQ ID NO: 970863 - RNA, 14 nt, Mycobacterium avium subsp. paratuberculosis
gggacgggucggcg

SEQ ID NO: 970864 - RNA, 23 nt, Mycobacterium avium subsp. paratuberculosis
gggacggugcagccgggggcggu

SEQ ID NO: 970865 - RNA, 19 nt, Mycobacterium avium subsp. paratuberculosis
gggacgucggcgcgcucgg

SEQ ID NO: 970866 - RNA, 20 nt, Mycobacterium avium subsp. paratuberculosis
gggacgucgucgucccaggg

SEQ ID NO: 970867 - RNA, 23 nt, Mycobacterium avium subsp. paratuberculosis
gggacgugucgggguggugggcg

SEQ ID NO: 970868 - RNA, 15 nt, Mycobacterium avium subsp. paratuberculosis
gggacggcggcgagu

SEQ ID NO: 970869 - RNA, 16 nt, Mycobacterium avium subsp. paratuberculosis
gggacgacgccgaacu

SEQ ID NO: 970870 - RNA, 21 nt, Mycobacterium avium subsp. paratuberculosis
gggacgacgccgaacugccgg

SEQ ID NO: 970871 - RNA, 21 nt, Mycobacterium avium subsp. paratuberculosis
gggacgaaugucucgaugaca

SEQ ID NO: 970872 - RNA, 16 nt, Mycobacterium avium subsp. paratuberculosis
gggaccacccgcagcg

SEQ ID NO: 970873 - RNA, 15 nt, Mycobacterium avium subsp. paratuberculosis
gggaccgcacgccgg

SEQ ID NO: 970874 - RNA, 15 nt, Mycobacterium avium subsp. paratuberculosis
gggacaugccgagca

SEQ ID NO: 970875 - RNA, 18 nt, Mycobacterium avium subsp. paratuberculosis
gggacagguagcgcagcc

SEQ ID NO: 970876 - RNA, 16 nt, Mycobacterium avium subsp. paratuberculosis
gggaaugcggcugggu

SEQ ID NO: 970877 - RNA, 20 nt, Mycobacterium avium subsp. paratuberculosis
gggacaccgcuggccgaggc

SEQ ID NO: 970878 - RNA, 17 nt, Mycobacterium avium subsp. paratuberculosis
cuacaggugccggcggc

SEQ ID NO: 970879 - RNA, 19 nt, Mycobacterium avium subsp. paratuberculosis
cuaccggguggccagcacc

SEQ ID NO: 970880 - RNA, 21 nt, Mycobacterium avium subsp. paratuberculosis
cuaccggguggccagcaccag

SEQ ID NO: 970881 - RNA, 14 nt, Mycobacterium avium subsp. paratuberculosis
cuaccgccucgcca

SEQ ID NO: 970882 - RNA, 14 nt, Mycobacterium avium subsp. paratuberculosis
cuacggcgggccgg

SEQ ID NO: 970883 - RNA, 19 nt, Mycobacterium avium subsp. paratuberculosis
cuagucgacgccgauggug

SEQ ID NO: 970884 - RNA, 23 nt, Mycobacterium avium subsp. paratuberculosis
cucaggaauuugcggcccggcuc

SEQ ID NO: 970885 - RNA, 15 nt, Mycobacterium avium subsp. paratuberculosis
cucagcucccgagca

SEQ ID NO: 970886 - RNA, 13 nt, Mycobacterium avium subsp. paratuberculosis
cucagcugcugcg

SEQ ID NO: 970887 - RNA, 18 nt, Mycobacterium avium subsp. paratuberculosis
cucagcugcugcgcggcg

SEQ ID NO: 970888 - RNA, 23 nt, Mycobacterium avium subsp. paratuberculosis
cucagcgggaagccgaggucgcc

SEQ ID NO: 970889 - RNA, 18 nt, Mycobacterium avium subsp. paratuberculosis
cucagcgggcggccagcc

SEQ ID NO: 970890 - RNA, 17 nt, Mycobacterium avium subsp. paratuberculosis
cucagcgcggccacacc

SEQ ID NO: 970891 - RNA, 12 nt, Mycobacterium avium subsp. paratuberculosis
cucagcgcggcg

SEQ ID NO: 970892 - RNA, 21 nt, Mycobacterium avium subsp. paratuberculosis
cucagcggccaucgccgccau

SEQ ID NO: 970893 - RNA, 14 nt, Mycobacterium avium subsp. paratuberculosis
cucagcgcccagga

SEQ ID NO: 970894 - RNA, 20 nt, Mycobacterium avium subsp. paratuberculosis
cucagcgauugcggccgccg

SEQ ID NO: 970895 - RNA, 13 nt, Mycobacterium avium subsp. paratuberculosis
cucagcgcccgcc

SEQ ID NO: 970896 - RNA, 14 nt, Mycobacterium avium subsp. paratuberculosis
cucagcgcccgccc

SEQ ID NO: 970897 - RNA, 14 nt, Mycobacterium avium subsp. paratuberculosis
cucagcccggcgcu

SEQ ID NO: 970898 - RNA, 22 nt, Mycobacterium avium subsp. paratuberculosis
cucagccgaagccggcgcaggu

SEQ ID NO: 970899 - RNA, 12 nt, Mycobacterium avium subsp. paratuberculosis
cucagcccggca

SEQ ID NO: 970900 - RNA, 18 nt, Mycobacterium avium subsp. paratuberculosis
cucagcccggcagcgggg

SEQ ID NO: 970901 - RNA, 15 nt, Mycobacterium avium subsp. paratuberculosis
cucagcccggcccag

SEQ ID NO: 970902 - RNA, 15 nt, Mycobacterium avium subsp. paratuberculosis
cucagcagggcggca

SEQ ID NO: 970903 - RNA, 14 nt, Mycobacterium avium subsp. paratuberculosis
cucagccccagcgg

SEQ ID NO: 970904 - RNA, 24 nt, Mycobacterium avium subsp. paratuberculosis
cucagccacgccggcacaccgagc

SEQ ID NO: 970905 - RNA, 17 nt, Mycobacterium avium subsp. paratuberculosis
cucacggcggcagcgcg

SEQ ID NO: 970906 - RNA, 22 nt, Mycobacterium avium subsp. paratuberculosis
cucacggucggcguccagcgcg

SEQ ID NO: 970907 - RNA, 15 nt, Mycobacterium avium subsp. paratuberculosis
cucagcagcaccgca

SEQ ID NO: 970908 - RNA, 15 nt, Mycobacterium avium subsp. paratuberculosis
cucagcacggccgcg

SEQ ID NO: 970909 - RNA, 18 nt, Mycobacterium avium subsp. paratuberculosis
cucagcacggccgcggcc

SEQ ID NO: 970910 - RNA, 13 nt, Mycobacterium avium subsp. paratuberculosis
cucacgcagggcc

SEQ ID NO: 970911 - RNA, 15 nt, Mycobacterium avium subsp. paratuberculosis
cucaccccggccagg

SEQ ID NO: 970912 - RNA, 18 nt, Mycobacterium avium subsp. paratuberculosis
cucaccacgugccacugg

SEQ ID NO: 970913 - RNA, 14 nt, Mycobacterium avium subsp. paratuberculosis
cuauucgggccagc

SEQ ID NO: 970914 - RNA, 14 nt, Mycobacterium avium subsp. paratuberculosis
cuauugggucagcu

SEQ ID NO: 970915 - RNA, 17 nt, Mycobacterium avium subsp. paratuberculosis
cucgucgucgaugaaca

SEQ ID NO: 970916 - RNA, 14 nt, Mycobacterium avium subsp. paratuberculosis
cucgucgucgguga

SEQ ID NO: 970917 - RNA, 20 nt, Mycobacterium avium subsp. paratuberculosis
cucgucuuggugcgagccac

SEQ ID NO: 970918 - RNA, 22 nt, Mycobacterium avium subsp. paratuberculosis
cucgucuuggugcgagccaccu

SEQ ID NO: 970919 - RNA, 14 nt, Mycobacterium avium subsp. paratuberculosis
cucgucggcgcgcc

SEQ ID NO: 970920 - RNA, 20 nt, Mycobacterium avium subsp. paratuberculosis
cucgucggcgcgccacccga

SEQ ID NO: 970921 - RNA, 19 nt, Mycobacterium avium subsp. paratuberculosis
cucgucggcggcggccugc

SEQ ID NO: 970922 - RNA, 17 nt, Mycobacterium avium subsp. paratuberculosis
cucgucggcgggcaccu

SEQ ID NO: 970923 - RNA, 23 nt, Mycobacterium avium subsp. paratuberculosis
cucgucggcgggcaccucggcca

SEQ ID NO: 970924 - RNA, 23 nt, Mycobacterium avium subsp. paratuberculosis
cucgucggcggugccgagcccgc

SEQ ID NO: 970925 - RNA, 14 nt, Mycobacterium avium subsp. paratuberculosis
cucgucgggcaccg

SEQ ID NO: 970926 - RNA, 14 nt, Mycobacterium avium subsp. paratuberculosis
cucgucgggcgcca

SEQ ID NO: 970927 - RNA, 18 nt, Mycobacterium avium subsp. paratuberculosis
cucgucgggcgccagccc

SEQ ID NO: 970928 - RNA, 24 nt, Mycobacterium avium subsp. paratuberculosis
cucgucggguguggcgccgugcag

SEQ ID NO: 970929 - RNA, 12 nt, Mycobacterium avium subsp. paratuberculosis
cucgugcaaccu

SEQ ID NO: 970930 - RNA, 18 nt, Mycobacterium avium subsp. paratuberculosis
cucgugcagccggcggcg

SEQ ID NO: 970931 - RNA, 13 nt, Mycobacterium avium subsp. paratuberculosis
cucgugcccgggc

SEQ ID NO: 970932 - RNA, 18 nt, Mycobacterium avium subsp. paratuberculosis
cucgugcggcgccgcccg

SEQ ID NO: 970933 - RNA, 19 nt, Mycobacterium avium subsp. paratuberculosis
cucgugcguagcggcccga

SEQ ID NO: 970934 - RNA, 14 nt, Mycobacterium avium subsp. paratuberculosis
cucgugcugcugcu

SEQ ID NO: 970935 - RNA, 14 nt, Mycobacterium avium subsp. paratuberculosis
cucgugggccacca

SEQ ID NO: 970936 - RNA, 17 nt, Mycobacterium avium subsp. paratuberculosis
cucgugggucagcuuca

SEQ ID NO: 970937 - RNA, 20 nt, Mycobacterium avium subsp. paratuberculosis
cucguggucccaggaccacu

SEQ ID NO: 970938 - RNA, 13 nt, Mycobacterium avium subsp. paratuberculosis
cucguugagcaca

SEQ ID NO: 970939 - RNA, 15 nt, Mycobacterium avium subsp. paratuberculosis
cucguucugcgugcg

SEQ ID NO: 970940 - RNA, 16 nt, Mycobacterium avium subsp. paratuberculosis
cucguucuggcccgcc

SEQ ID NO: 970941 - RNA, 13 nt, Mycobacterium avium subsp. paratuberculosis
cucguugauccag

SEQ ID NO: 970942 - RNA, 12 nt, Mycobacterium avium subsp. paratuberculosis
cucguuggccag

SEQ ID NO: 970943 - RNA, 22 nt, Mycobacterium avium subsp. paratuberculosis
cucguuggccagcucggccauc

SEQ ID NO: 970944 - RNA, 17 nt, Mycobacterium avium subsp. paratuberculosis
cucguuggccggcucca

SEQ ID NO: 970945 - RNA, 17 nt, Mycobacterium avium subsp. paratuberculosis
cucguuggggccaccag

SEQ ID NO: 970946 - RNA, 19 nt, Mycobacterium avium subsp. paratuberculosis
cucguugugcaccggcacg

SEQ ID NO: 970947 - RNA, 20 nt, Mycobacterium avium subsp. paratuberculosis
cucuaacuccgcucgggccc

SEQ ID NO: 970948 - RNA, 20 nt, Mycobacterium avium subsp. paratuberculosis
cucggucaagccggccagca

SEQ ID NO: 970949 - RNA, 17 nt, Mycobacterium avium subsp. paratuberculosis
cucggguguaggcccga

SEQ ID NO: 970950 - RNA, 15 nt, Mycobacterium avium subsp. paratuberculosis
cucgggugacgccuc

SEQ ID NO: 970951 - RNA, 19 nt, Mycobacterium avium subsp. paratuberculosis
cucgggguacucggcggcg

SEQ ID NO: 970952 - RNA, 19 nt, Mycobacterium avium subsp. paratuberculosis
cucgggguagccggcccgc

SEQ ID NO: 970953 - RNA, 22 nt, Mycobacterium avium subsp. paratuberculosis
cucggggucggcgucgggccgg

SEQ ID NO: 970954 - RNA, 23 nt, Mycobacterium avium subsp. paratuberculosis
cucggugaugaucgccgggucgc

SEQ ID NO: 970955 - RNA, 18 nt, Mycobacterium avium subsp. paratuberculosis
cucggugcggaacaccgc

SEQ ID NO: 970956 - RNA, 16 nt, Mycobacterium avium subsp. paratuberculosis
cucgguggccaccuug

SEQ ID NO: 970957 - RNA, 19 nt, Mycobacterium avium subsp. paratuberculosis
cucgguggcgucggcggcc

SEQ ID NO: 970958 - RNA, 14 nt, Mycobacterium avium subsp. paratuberculosis
cucgguguagagca

SEQ ID NO: 970959 - RNA, 18 nt, Mycobacterium avium subsp. paratuberculosis
cucgguguagagcaccuc

SEQ ID NO: 970960 - RNA, 22 nt, Mycobacterium avium subsp. paratuberculosis
cucgguguagagcaccucgaug

SEQ ID NO: 970961 - RNA, 21 nt, Mycobacterium avium subsp. paratuberculosis
cucggugaugccgagcgccgc

SEQ ID NO: 970962 - RNA, 20 nt, Mycobacterium avium subsp. paratuberculosis
cucggucaccagcggcccgc

SEQ ID NO: 970963 - RNA, 13 nt, Mycobacterium avium subsp. paratuberculosis
cucggucaccccg

SEQ ID NO: 970964 - RNA, 13 nt, Mycobacterium avium subsp. paratuberculosis
cucggucaccgag

SEQ ID NO: 970965 - RNA, 16 nt, Mycobacterium avium subsp. paratuberculosis
cucggggcucaccaca

SEQ ID NO: 970966 - RNA, 15 nt, Mycobacterium avium subsp. paratuberculosis
cucggcgugcccgcc

SEQ ID NO: 970967 - RNA, 17 nt, Mycobacterium avium subsp. paratuberculosis
cucggcgugcccgccga

SEQ ID NO: 970968 - RNA, 16 nt, Mycobacterium avium subsp. paratuberculosis
cucggcguggcaggcg

SEQ ID NO: 970969 - RNA, 16 nt, Mycobacterium avium subsp. paratuberculosis
cucggcguugagccgg

SEQ ID NO: 970970 - RNA, 19 nt, Mycobacterium avium subsp. paratuberculosis
cucggcgucgaagcgcaug

SEQ ID NO: 970971 - RNA, 16 nt, Mycobacterium avium subsp. paratuberculosis
cucggcguacaggccg

SEQ ID NO: 970972 - RNA, 16 nt, Mycobacterium avium subsp. paratuberculosis
cucggcgucccguccu

SEQ ID NO: 970973 - RNA, 17 nt, Mycobacterium avium subsp. paratuberculosis
cucggcggcgacggugu

SEQ ID NO: 970974 - RNA, 14 nt, Mycobacterium avium subsp. paratuberculosis
cucggcggcgcgca

SEQ ID NO: 970975 - RNA, 18 nt, Mycobacterium avium subsp. paratuberculosis
cucggcggcucagcaacc

SEQ ID NO: 970976 - RNA, 23 nt, Mycobacterium avium subsp. paratuberculosis
cucggcgggccgcccggcgcgcc

SEQ ID NO: 970977 - RNA, 15 nt, Mycobacterium avium subsp. paratuberculosis
cucggcggccucgcc

SEQ ID NO: 970978 - RNA, 13 nt, Mycobacterium avium subsp. paratuberculosis
cucggcggcggcg

SEQ ID NO: 970979 - RNA, 17 nt, Mycobacterium avium subsp. paratuberculosis
cucggcggcggcgcgcc

SEQ ID NO: 970980 - RNA, 21 nt, Mycobacterium avium subsp. paratuberculosis
cucggcggcggcgcgccggcc

SEQ ID NO: 970981 - RNA, 15 nt, Mycobacterium avium subsp. paratuberculosis
cucgcgggccacagc

SEQ ID NO: 970982 - RNA, 19 nt, Mycobacterium avium subsp. paratuberculosis
cucgcgggcgaucuccagc

SEQ ID NO: 970983 - RNA, 20 nt, Mycobacterium avium subsp. paratuberculosis
cucgcgggcgaucuccagcg

SEQ ID NO: 970984 - RNA, 20 nt, Mycobacterium avium subsp. paratuberculosis
cucgcgggugcggcgcugcc

SEQ ID NO: 970985 - RNA, 23 nt, Mycobacterium avium subsp. paratuberculosis
cucgcgggugcggcgcugccggc

SEQ ID NO: 970986 - RNA, 19 nt, Mycobacterium avium subsp. paratuberculosis
cucgcgggaguggccggcg

SEQ ID NO: 970987 - RNA, 12 nt, Mycobacterium avium subsp. paratuberculosis
cucgcggcggcc

SEQ ID NO: 970988 - RNA, 20 nt, Mycobacterium avium subsp. paratuberculosis
cucgcugaucucgacggugg

SEQ ID NO: 970989 - RNA, 22 nt, Mycobacterium avium subsp. paratuberculosis
cucgcugacgucgaugccggcc

SEQ ID NO: 970990 - RNA, 13 nt, Mycobacterium avium subsp. paratuberculosis
cucgcugccggcc

SEQ ID NO: 970991 - RNA, 18 nt, Mycobacterium avium subsp. paratuberculosis
cucgcugccggccggggc

SEQ ID NO: 970992 - RNA, 15 nt, Mycobacterium avium subsp. paratuberculosis
cucgcugcucugcgc

SEQ ID NO: 970993 - RNA, 18 nt, Mycobacterium avium subsp. paratuberculosis
cucgcuggcgaucaccuu

SEQ ID NO: 970994 - RNA, 16 nt, Mycobacterium avium subsp. paratuberculosis
cucggcgccccacgcc

SEQ ID NO: 970995 - RNA, 22 nt, Mycobacterium avium subsp. paratuberculosis
cucggcgauguugaccacccgc

SEQ ID NO: 970996 - RNA, 20 nt, Mycobacterium avium subsp. paratuberculosis
cucggcgccgccggucgccc

SEQ ID NO: 970997 - RNA, 14 nt, Mycobacterium avium subsp. paratuberculosis
cucggcggccgccc

SEQ ID NO: 970998 - RNA, 18 nt, Mycobacterium avium subsp. paratuberculosis
cucggcggccgggaugcc

SEQ ID NO: 970999 - RNA, 22 nt, Mycobacterium avium subsp. paratuberculosis
cucggcggccgggaugccgccg

SEQ ID NO: 971000 - RNA, 15 nt, Mycobacterium avium subsp. paratuberculosis
cucggcggccagcgc

SEQ ID NO: 971001 - RNA, 13 nt, Mycobacterium avium subsp. paratuberculosis
cucggcggcccgc

SEQ ID NO: 971002 - RNA, 14 nt, Mycobacterium avium subsp. paratuberculosis
cucggcggcccgca

SEQ ID NO: 971003 - RNA, 15 nt, Mycobacterium avium subsp. paratuberculosis
cucggcgcugaacug

SEQ ID NO: 971004 - RNA, 16 nt, Mycobacterium avium subsp. paratuberculosis
cucggcgcugcccgcc

SEQ ID NO: 971005 - RNA, 16 nt, Mycobacterium avium subsp. paratuberculosis
cucggcgccguccagc

SEQ ID NO: 971006 - RNA, 20 nt, Mycobacterium avium subsp. paratuberculosis
cucggcgccgaccucggcca

SEQ ID NO: 971007 - RNA, 18 nt, Mycobacterium avium subsp. paratuberculosis
cucgauguagagcgggau

SEQ ID NO: 971008 - RNA, 15 nt, Mycobacterium avium subsp. paratuberculosis
cucgaugggggugcc

SEQ ID NO: 971009 - RNA, 20 nt, Mycobacterium avium subsp. paratuberculosis
cucgaugcggcccugguuga

SEQ ID NO: 971010 - RNA, 17 nt, Mycobacterium avium subsp. paratuberculosis
cucgauggacaggcacu

SEQ ID NO: 971011 - RNA, 15 nt, Mycobacterium avium subsp. paratuberculosis
cucgauggcccgcuc

SEQ ID NO: 971012 - RNA, 21 nt, Mycobacterium avium subsp. paratuberculosis
cucgauggcggcgaugaagcc

SEQ ID NO: 971013 - RNA, 14 nt, Mycobacterium avium subsp. paratuberculosis
cucgaugacgccgg

SEQ ID NO: 971014 - RNA, 21 nt, Mycobacterium avium subsp. paratuberculosis
cucgaugacgccggacagcug

SEQ ID NO: 971015 - RNA, 21 nt, Mycobacterium avium subsp. paratuberculosis
cucgaugcacggucggccccg

SEQ ID NO: 971016 - RNA, 22 nt, Mycobacterium avium subsp. paratuberculosis
cucgaugcgcaccgugccgccc

SEQ ID NO: 971017 - RNA, 16 nt, Mycobacterium avium subsp. paratuberculosis
cucgacgaucagcacg

SEQ ID NO: 971018 - RNA, 18 nt, Mycobacterium avium subsp. paratuberculosis
cucgcaaccgucuuggcu

SEQ ID NO: 971019 - RNA, 20 nt, Mycobacterium avium subsp. paratuberculosis
cucgcaaccgucuuggcugg

SEQ ID NO: 971020 - RNA, 18 nt, Mycobacterium avium subsp. paratuberculosis
cucgcacccggucaggua

SEQ ID NO: 971021 - RNA, 23 nt, Mycobacterium avium subsp. paratuberculosis
cucgcacagcuugucccagugcu

SEQ ID NO: 971022 - RNA, 14 nt, Mycobacterium avium subsp. paratuberculosis
cucgcaccugccgu

SEQ ID NO: 971023 - RNA, 14 nt, Mycobacterium avium subsp. paratuberculosis
cucgcagcgacaau

SEQ ID NO: 971024 - RNA, 19 nt, Mycobacterium avium subsp. paratuberculosis
cucgcaggcgagccgacag

SEQ ID NO: 971025 - RNA, 19 nt, Mycobacterium avium subsp. paratuberculosis
cucgaagcgacaaaggagg

SEQ ID NO: 971026 - RNA, 20 nt, Mycobacterium avium subsp. paratuberculosis
cucgaagcgacaaaggaggg

SEQ ID NO: 971027 - RNA, 15 nt, Mycobacterium avium subsp. paratuberculosis
cucgaagaagagggc

SEQ ID NO: 971028 - RNA, 16 nt, Mycobacterium avium subsp. paratuberculosis
cucgaagaucgccugc

SEQ ID NO: 971029 - RNA, 18 nt, Mycobacterium avium subsp. paratuberculosis
cucgaagcagccuucuug

SEQ ID NO: 971030 - RNA, 21 nt, Mycobacterium avium subsp. paratuberculosis
cucgaaguggcagcgcuccug

SEQ ID NO: 971031 - RNA, 14 nt, Mycobacterium avium subsp. paratuberculosis
cucgacccgcaccu

SEQ ID NO: 971032 - RNA, 16 nt, Mycobacterium avium subsp. paratuberculosis
cucgaccgcggcgccg

SEQ ID NO: 971033 - RNA, 23 nt, Mycobacterium avium subsp. paratuberculosis
cucgaccucggcgaccagcgacg

SEQ ID NO: 971034 - RNA, 21 nt, Mycobacterium avium subsp. paratuberculosis
cucgaccucggcggccagcgc

SEQ ID NO: 971035 - RNA, 19 nt, Mycobacterium avium subsp. paratuberculosis
cucgaccucuucggcgccg

SEQ ID NO: 971036 - RNA, 21 nt, Mycobacterium avium subsp. paratuberculosis
cucgaccugggucaucaccuu

SEQ ID NO: 971037 - RNA, 15 nt, Mycobacterium avium subsp. paratuberculosis
cucgaccucaccccg

SEQ ID NO: 971038 - RNA, 17 nt, Mycobacterium avium subsp. paratuberculosis
cucgaccuucgagccgc

SEQ ID NO: 971039 - RNA, 16 nt, Mycobacterium avium subsp. paratuberculosis
cucgaacaacccggcc

SEQ ID NO: 971040 - RNA, 16 nt, Mycobacterium avium subsp. paratuberculosis
cucgaacacccggcuu

SEQ ID NO: 971041 - RNA, 20 nt, Mycobacterium avium subsp. paratuberculosis
cuccuccucgcgccgccacg

SEQ ID NO: 971042 - RNA, 15 nt, Mycobacterium avium subsp. paratuberculosis
cuccuccucgcugcc

SEQ ID NO: 971043 - RNA, 16 nt, Mycobacterium avium subsp. paratuberculosis
cuccuccucggccagc

SEQ ID NO: 971044 - RNA, 14 nt, Mycobacterium avium subsp. paratuberculosis
cucgaaccggggca

SEQ ID NO: 971045 - RNA, 19 nt, Mycobacterium avium subsp. paratuberculosis
cucgaaccggggcaccacg

SEQ ID NO: 971046 - RNA, 19 nt, Mycobacterium avium subsp. paratuberculosis
cuccucccagcccucgucg

SEQ ID NO: 971047 - RNA, 16 nt, Mycobacterium avium subsp. paratuberculosis
cucgcccaccuuggcg

SEQ ID NO: 971048 - RNA, 15 nt, Mycobacterium avium subsp. paratuberculosis
cucgccccgcccgau

SEQ ID NO: 971049 - RNA, 23 nt, Mycobacterium avium subsp. paratuberculosis
cucgccccgcccgaucccgucgu

SEQ ID NO: 971050 - RNA, 14 nt, Mycobacterium avium subsp. paratuberculosis
cucgccacugggcg

SEQ ID NO: 971051 - RNA, 23 nt, Mycobacterium avium subsp. paratuberculosis
cucgccacugggcgucggcgccc

SEQ ID NO: 971052 - RNA, 20 nt, Mycobacterium avium subsp. paratuberculosis
cucgccagaccgguugcggc

SEQ ID NO: 971053 - RNA, 23 nt, Mycobacterium avium subsp. paratuberculosis
cucgccagaccgguugcggcgaa

SEQ ID NO: 971054 - RNA, 23 nt, Mycobacterium avium subsp. paratuberculosis
cucgccagacucacggcggcagc

SEQ ID NO: 971055 - RNA, 15 nt, Mycobacterium avium subsp. paratuberculosis
cucgccagccccacc

SEQ ID NO: 971056 - RNA, 22 nt, Mycobacterium avium subsp. paratuberculosis
cucgccaauaaagcgggcccgc

SEQ ID NO: 971057 - RNA, 20 nt, Mycobacterium avium subsp. paratuberculosis
cucgccaccccgcgccacgc

SEQ ID NO: 971058 - RNA, 14 nt, Mycobacterium avium subsp. paratuberculosis
cucgcccggcucca

SEQ ID NO: 971059 - RNA, 23 nt, Mycobacterium avium subsp. paratuberculosis
cucgcccgggcuaucgcccggcg

SEQ ID NO: 971060 - RNA, 18 nt, Mycobacterium avium subsp. paratuberculosis
cucgccgcaggcguccuu

SEQ ID NO: 971061 - RNA, 15 nt, Mycobacterium avium subsp. paratuberculosis
cucgccggccgccgu

SEQ ID NO: 971062 - RNA, 13 nt, Mycobacterium avium subsp. paratuberculosis
cucgccgcgggcc

SEQ ID NO: 971063 - RNA, 21 nt, Mycobacterium avium subsp. paratuberculosis
cucgccgcgggugucgcccuc

SEQ ID NO: 971064 - RNA, 12 nt, Mycobacterium avium subsp. paratuberculosis
cucgccuuugau

SEQ ID NO: 971065 - RNA, 16 nt, Mycobacterium avium subsp. paratuberculosis
cucgccguugccggcc

SEQ ID NO: 971066 - RNA, 19 nt, Mycobacterium avium subsp. paratuberculosis
cucgccguugccggcccgc

SEQ ID NO: 971067 - RNA, 14 nt, Mycobacterium avium subsp. paratuberculosis
cucgccguugcggg

SEQ ID NO: 971068 - RNA, 19 nt, Mycobacterium avium subsp. paratuberculosis
cucgccguacgcgccggcc

SEQ ID NO: 971069 - RNA, 21 nt, Mycobacterium avium subsp. paratuberculosis
cucgccguacgcgccggccag

SEQ ID NO: 971070 - RNA, 19 nt, Mycobacterium avium subsp. paratuberculosis
cucgccguacuugacgugc

SEQ ID NO: 971071 - RNA, 14 nt, Mycobacterium avium subsp. paratuberculosis
cucgccgggcccgc

SEQ ID NO: 971072 - RNA, 16 nt, Mycobacterium avium subsp. paratuberculosis
cucgccggcgcgcagc

SEQ ID NO: 971073 - RNA, 13 nt, Mycobacterium avium subsp. paratuberculosis
cucgccggcggcc

SEQ ID NO: 971074 - RNA, 15 nt, Mycobacterium avium subsp. paratuberculosis
cucgccggcggccgc

SEQ ID NO: 971075 - RNA, 18 nt, Mycobacterium avium subsp. paratuberculosis
cucgccggcggccgccac

SEQ ID NO: 971076 - RNA, 20 nt, Mycobacterium avium subsp. paratuberculosis
cucgccggcggccgccacgc

SEQ ID NO: 971077 - RNA, 14 nt, Mycobacterium avium subsp. paratuberculosis
cucgccggcggcgc

SEQ ID NO: 971078 - RNA, 18 nt, Mycobacterium avium subsp. paratuberculosis
cucgccggcgucuugauc

SEQ ID NO: 971079 - RNA, 15 nt, Mycobacterium avium subsp. paratuberculosis
cucgccggcgccggg

SEQ ID NO: 971080 - RNA, 15 nt, Mycobacterium avium subsp. paratuberculosis
cucgccggcgcgcac

SEQ ID NO: 971081 - RNA, 15 nt, Mycobacterium avium subsp. paratuberculosis
cucgccggccgggcg

SEQ ID NO: 971082 - RNA, 22 nt, Mycobacterium avium subsp. paratuberculosis
cucgcgagggcgggccagcucg

SEQ ID NO: 971083 - RNA, 20 nt, Mycobacterium avium subsp. paratuberculosis
cucgcgcaccggcugcccca

SEQ ID NO: 971084 - RNA, 22 nt, Mycobacterium avium subsp. paratuberculosis
cucgcgcaccgggaccagcgcg

SEQ ID NO: 971085 - RNA, 12 nt, Mycobacterium avium subsp. paratuberculosis
cucgcgcagcac

SEQ ID NO: 971086 - RNA, 15 nt, Mycobacterium avium subsp. paratuberculosis
cucgcgcagcaccga

SEQ ID NO: 971087 - RNA, 12 nt, Mycobacterium avium subsp. paratuberculosis
cucgcgcccggc

SEQ ID NO: 971088 - RNA, 22 nt, Mycobacterium avium subsp. paratuberculosis
cucgcgcccggcgccggcccgc

SEQ ID NO: 971089 - RNA, 14 nt, Mycobacterium avium subsp. paratuberculosis
cucgcgccgcgcau

SEQ ID NO: 971090 - RNA, 23 nt, Mycobacterium avium subsp. paratuberculosis
cucgcgccgccacgcggcgcgca

SEQ ID NO: 971091 - RNA, 20 nt, Mycobacterium avium subsp. paratuberculosis
cuccgucagcgccgcccgca

SEQ ID NO: 971092 - RNA, 20 nt, Mycobacterium avium subsp. paratuberculosis
cuccgucgagucggccaccg

SEQ ID NO: 971093 - RNA, 20 nt, Mycobacterium avium subsp. paratuberculosis
cuccgugccgauggccaccg

SEQ ID NO: 971094 - RNA, 12 nt, Mycobacterium avium subsp. paratuberculosis
cuccgggcugcc

SEQ ID NO: 971095 - RNA, 13 nt, Mycobacterium avium subsp. paratuberculosis
cuccgggcugugg

SEQ ID NO: 971096 - RNA, 18 nt, Mycobacterium avium subsp. paratuberculosis
cuccgggggcaccgccag

SEQ ID NO: 971097 - RNA, 16 nt, Mycobacterium avium subsp. paratuberculosis
cuccgguccgggcugc

SEQ ID NO: 971098 - RNA, 20 nt, Mycobacterium avium subsp. paratuberculosis
cuccggucgcgucgugcggc

SEQ ID NO: 971099 - RNA, 18 nt, Mycobacterium avium subsp. paratuberculosis
cuccuaugucggugcggc

SEQ ID NO: 971100 - RNA, 12 nt, Mycobacterium avium subsp. paratuberculosis
cuccucacaccu

SEQ ID NO: 971101 - RNA, 21 nt, Mycobacterium avium subsp. paratuberculosis
cuccguugucgaggucgguga

SEQ ID NO: 971102 - RNA, 18 nt, Mycobacterium avium subsp. paratuberculosis
cuccggcggacccagcuc

SEQ ID NO: 971103 - RNA, 20 nt, Mycobacterium avium subsp. paratuberculosis
cuccggcggacccagcuccu

SEQ ID NO: 971104 - RNA, 21 nt, Mycobacterium avium subsp. paratuberculosis
cuccggcggacccagcuccuc

SEQ ID NO: 971105 - RNA, 15 nt, Mycobacterium avium subsp. paratuberculosis
cuccggcguaucucc

SEQ ID NO: 971106 - RNA, 21 nt, Mycobacterium avium subsp. paratuberculosis
cuccggcgggcuggugcgcag

SEQ ID NO: 971107 - RNA, 18 nt, Mycobacterium avium subsp. paratuberculosis
cuccgggaaggcggccgc

SEQ ID NO: 971108 - RNA, 17 nt, Mycobacterium avium subsp. paratuberculosis
cuccgcgggcagcgagc

SEQ ID NO: 971109 - RNA, 14 nt, Mycobacterium avium subsp. paratuberculosis
cuccgacuccagca

SEQ ID NO: 971110 - RNA, 19 nt, Mycobacterium avium subsp. paratuberculosis
cuccgaauccagcgcgccg

SEQ ID NO: 971111 - RNA, 20 nt, Mycobacterium avium subsp. paratuberculosis
cuccgaauccagcgcgccgc

SEQ ID NO: 971112 - RNA, 21 nt, Mycobacterium avium subsp. paratuberculosis
cuccgaauccagcgcgccgcu

SEQ ID NO: 971113 - RNA, 16 nt, Mycobacterium avium subsp. paratuberculosis
cuccgaggcguccucc

SEQ ID NO: 971114 - RNA, 12 nt, Mycobacterium avium subsp. paratuberculosis
cuccgacagccc

SEQ ID NO: 971115 - RNA, 21 nt, Mycobacterium avium subsp. paratuberculosis
cuccgacagcccccgcagccc

SEQ ID NO: 971116 - RNA, 22 nt, Mycobacterium avium subsp. paratuberculosis
cuccgacagcccccgcagcccg

SEQ ID NO: 971117 - RNA, 16 nt, Mycobacterium avium subsp. paratuberculosis
cucccggguggccucc

SEQ ID NO: 971118 - RNA, 20 nt, Mycobacterium avium subsp. paratuberculosis
cucccgguagagcggcacca

SEQ ID NO: 971119 - RNA, 20 nt, Mycobacterium avium subsp. paratuberculosis
cucccggucguagucggccc

SEQ ID NO: 971120 - RNA, 14 nt, Mycobacterium avium subsp. paratuberculosis
cuccccguugaucu

SEQ ID NO: 971121 - RNA, 16 nt, Mycobacterium avium subsp. paratuberculosis
cuccccggccagcacg

SEQ ID NO: 971122 - RNA, 20 nt, Mycobacterium avium subsp. paratuberculosis
cucccggcagaucgcggccc

SEQ ID NO: 971123 - RNA, 22 nt, Mycobacterium avium subsp. paratuberculosis
cucccggcagaucgcggcccgc

SEQ ID NO: 971124 - RNA, 15 nt, Mycobacterium avium subsp. paratuberculosis
cucccggcgcagcaa

SEQ ID NO: 971125 - RNA, 17 nt, Mycobacterium avium subsp. paratuberculosis
cucccggcgccacgccg

SEQ ID NO: 971126 - RNA, 14 nt, Mycobacterium avium subsp. paratuberculosis
cucccggcgccgcc

SEQ ID NO: 971127 - RNA, 14 nt, Mycobacterium avium subsp. paratuberculosis
cucccgggacagcc

SEQ ID NO: 971128 - RNA, 14 nt, Mycobacterium avium subsp. paratuberculosis
cuccccauccgcgg

SEQ ID NO: 971129 - RNA, 15 nt, Mycobacterium avium subsp. paratuberculosis
cucccccggaccugc

SEQ ID NO: 971130 - RNA, 19 nt, Mycobacterium avium subsp. paratuberculosis
cucccccgacgccgacacc

SEQ ID NO: 971131 - RNA, 20 nt, Mycobacterium avium subsp. paratuberculosis
cuccccggacagccacucca

SEQ ID NO: 971132 - RNA, 16 nt, Mycobacterium avium subsp. paratuberculosis
cuccagccacuccacc

SEQ ID NO: 971133 - RNA, 19 nt, Mycobacterium avium subsp. paratuberculosis
cuccagcagcuguugcggc

SEQ ID NO: 971134 - RNA, 13 nt, Mycobacterium avium subsp. paratuberculosis
cuccagccagcgc

SEQ ID NO: 971135 - RNA, 17 nt, Mycobacterium avium subsp. paratuberculosis
cuccagccagcgcgcga

SEQ ID NO: 971136 - RNA, 23 nt, Mycobacterium avium subsp. paratuberculosis
cuccagccgccgguccagugccg

SEQ ID NO: 971137 - RNA, 18 nt, Mycobacterium avium subsp. paratuberculosis
cuccagccgcgcggccgc

SEQ ID NO: 971138 - RNA, 18 nt, Mycobacterium avium subsp. paratuberculosis
cuccagccgcuccgcggc

SEQ ID NO: 971139 - RNA, 23 nt, Mycobacterium avium subsp. paratuberculosis
cuccagccgcuccucguugaucc

SEQ ID NO: 971140 - RNA, 18 nt, Mycobacterium avium subsp. paratuberculosis
cuccaacggcaccaccac

SEQ ID NO: 971141 - RNA, 21 nt, Mycobacterium avium subsp. paratuberculosis
cuccaacggcaccaccacggu

SEQ ID NO: 971142 - RNA, 15 nt, Mycobacterium avium subsp. paratuberculosis
cuccaacggccgcac

SEQ ID NO: 971143 - RNA, 18 nt, Mycobacterium avium subsp. paratuberculosis
cucauugggaccggugcg

SEQ ID NO: 971144 - RNA, 20 nt, Mycobacterium avium subsp. paratuberculosis
cucaggagugguagggcucc

SEQ ID NO: 971145 - RNA, 11 nt, Mycobacterium avium subsp. paratuberculosis
cucaggaugau

SEQ ID NO: 971146 - RNA, 15 nt, Mycobacterium avium subsp. paratuberculosis
cuccagaucgccgcc

SEQ ID NO: 971147 - RNA, 22 nt, Mycobacterium avium subsp. paratuberculosis
cuccagauugcggaucuuggug

SEQ ID NO: 971148 - RNA, 22 nt, Mycobacterium avium subsp. paratuberculosis
cuccagcaggcuggcguugggc

SEQ ID NO: 971149 - RNA, 14 nt, Mycobacterium avium subsp. paratuberculosis
cuccagcagggaca

SEQ ID NO: 971150 - RNA, 16 nt, Mycobacterium avium subsp. paratuberculosis
cuccagcagggacauc

SEQ ID NO: 971151 - RNA, 18 nt, Mycobacterium avium subsp. paratuberculosis
cuccagcacgaaggccgc

SEQ ID NO: 971152 - RNA, 22 nt, Mycobacterium avium subsp. paratuberculosis
cuccacgacuucacaggccgcc

SEQ ID NO: 971153 - RNA, 21 nt, Mycobacterium avium subsp. paratuberculosis
cuccaccucgggcauuggcag

SEQ ID NO: 971154 - RNA, 23 nt, Mycobacterium avium subsp. paratuberculosis
cuccacgccgccgggaacagcga

SEQ ID NO: 971155 - RNA, 14 nt, Mycobacterium avium subsp. paratuberculosis
cuccaccgcgcgcg

SEQ ID NO: 971156 - RNA, 19 nt, Mycobacterium avium subsp. paratuberculosis
cuccaccgcguccugcagg

SEQ ID NO: 971157 - RNA, 20 nt, Mycobacterium avium subsp. paratuberculosis
cuccacacggcaggcggccc

SEQ ID NO: 971158 - RNA, 22 nt, Mycobacterium avium subsp. paratuberculosis
cuccacacggcaggcggcccgc

SEQ ID NO: 971159 - RNA, 13 nt, Mycobacterium avium subsp. paratuberculosis
cuccaccagcgcg

SEQ ID NO: 971160 - RNA, 14 nt, Mycobacterium avium subsp. paratuberculosis
cuccaccagcggcg

SEQ ID NO: 971161 - RNA, 16 nt, Mycobacterium avium subsp. paratuberculosis
cguuuggccugcggca

SEQ ID NO: 971162 - RNA, 20 nt, Mycobacterium avium subsp. paratuberculosis
cguuucggccggccccgccc

SEQ ID NO: 971163 - RNA, 21 nt, Mycobacterium avium subsp. paratuberculosis
cguuguucaggucgauggucu

SEQ ID NO: 971164 - RNA, 14 nt, Mycobacterium avium subsp. paratuberculosis
cguuguccagcagc

SEQ ID NO: 971165 - RNA, 19 nt, Mycobacterium avium subsp. paratuberculosis
cguugucgcggcccagcac

SEQ ID NO: 971166 - RNA, 13 nt, Mycobacterium avium subsp. paratuberculosis
cguuguggccacc

SEQ ID NO: 971167 - RNA, 14 nt, Mycobacterium avium subsp. paratuberculosis
cguugugggccagc

SEQ ID NO: 971168 - RNA, 15 nt, Mycobacterium avium subsp. paratuberculosis
cguugugggccagcg

SEQ ID NO: 971169 - RNA, 19 nt, Mycobacterium avium subsp. paratuberculosis
cguugucgucgccggccgc

SEQ ID NO: 971170 - RNA, 18 nt, Mycobacterium avium subsp. paratuberculosis
cguugucguucuccccgc

SEQ ID NO: 971171 - RNA, 18 nt, Mycobacterium avium subsp. paratuberculosis
cguugccaggccgcgagc

SEQ ID NO: 971172 - RNA, 13 nt, Mycobacterium avium subsp. paratuberculosis
cguugccagccgg

SEQ ID NO: 971173 - RNA, 18 nt, Mycobacterium avium subsp. paratuberculosis
cguugcacaccaccagcg

SEQ ID NO: 971174 - RNA, 17 nt, Mycobacterium avium subsp. paratuberculosis
cguugaugcgcaccgcg

SEQ ID NO: 971175 - RNA, 14 nt, Mycobacterium avium subsp. paratuberculosis
cguggccagcaccg

SEQ ID NO: 971176 - RNA, 22 nt, Mycobacterium avium subsp. paratuberculosis
cguggccagcaccgucagccag

SEQ ID NO: 971177 - RNA, 18 nt, Mycobacterium avium subsp. paratuberculosis
cgugcuugaacgccgccc

SEQ ID NO: 971178 - RNA, 20 nt, Mycobacterium avium subsp. paratuberculosis
cgugcuugaacgccgccccc

SEQ ID NO: 971179 - RNA, 22 nt, Mycobacterium avium subsp. paratuberculosis
cgugcuugaacgccgcccccgc

SEQ ID NO: 971180 - RNA, 19 nt, Mycobacterium avium subsp. paratuberculosis
cgugcuguggaacacgucg

SEQ ID NO: 971181 - RNA, 18 nt, Mycobacterium avium subsp. paratuberculosis
cgugcugccggccggcag

SEQ ID NO: 971182 - RNA, 19 nt, Mycobacterium avium subsp. paratuberculosis
cgugcugccggccggcagc

SEQ ID NO: 971183 - RNA, 20 nt, Mycobacterium avium subsp. paratuberculosis
cguggcaggcacgagcgaac

SEQ ID NO: 971184 - RNA, 20 nt, Mycobacterium avium subsp. paratuberculosis
cguggcaggccaucagcccg

SEQ ID NO: 971185 - RNA, 14 nt, Mycobacterium avium subsp. paratuberculosis
cguggcagggccag

SEQ ID NO: 971186 - RNA, 18 nt, Mycobacterium avium subsp. paratuberculosis
cguggcagggccagcagc

SEQ ID NO: 971187 - RNA, 19 nt, Mycobacterium avium subsp. paratuberculosis
cguggcagggccagcagcc

SEQ ID NO: 971188 - RNA, 11 nt, Mycobacterium avium subsp. paratuberculosis
cguucaucacc

SEQ ID NO: 971189 - RNA, 20 nt, Mycobacterium avium subsp. paratuberculosis
cguucagugaccagugcaga

SEQ ID NO: 971190 - RNA, 20 nt, Mycobacterium avium subsp. paratuberculosis
cguucagcugcagccggccg

SEQ ID NO: 971191 - RNA, 19 nt, Mycobacterium avium subsp. paratuberculosis
cguucagccggagccggcc

SEQ ID NO: 971192 - RNA, 15 nt, Mycobacterium avium subsp. paratuberculosis
cguucagcgcggcca

SEQ ID NO: 971193 - RNA, 22 nt, Mycobacterium avium subsp. paratuberculosis
cguucaccugacgcaucaccac

SEQ ID NO: 971194 - RNA, 21 nt, Mycobacterium avium subsp. paratuberculosis
cguucgugagcgguggccacg

SEQ ID NO: 971195 - RNA, 13 nt, Mycobacterium avium subsp. paratuberculosis
cguugagcccgga

SEQ ID NO: 971196 - RNA, 14 nt, Mycobacterium avium subsp. paratuberculosis
cguucuccacccgc

SEQ ID NO: 971197 - RNA, 15 nt, Mycobacterium avium subsp. paratuberculosis
cguugagccggcgca

SEQ ID NO: 971198 - RNA, 19 nt, Mycobacterium avium subsp. paratuberculosis
cguugagcgucgccaccac

SEQ ID NO: 971199 - RNA, 22 nt, Mycobacterium avium subsp. paratuberculosis
cguugagggcggggcagcagug

SEQ ID NO: 971200 - RNA, 22 nt, Mycobacterium avium subsp. paratuberculosis
cguugaugaaacuuccgcccgg

SEQ ID NO: 971201 - RNA, 21 nt, Mycobacterium avium subsp. paratuberculosis
cguuccgaugaagaacacccc

SEQ ID NO: 971202 - RNA, 17 nt, Mycobacterium avium subsp. paratuberculosis
cguucccugcgcggcga

SEQ ID NO: 971203 - RNA, 22 nt, Mycobacterium avium subsp. paratuberculosis
cguucguagaaccggcccagca

SEQ ID NO: 971204 - RNA, 15 nt, Mycobacterium avium subsp. paratuberculosis
cguucgguggccacc

SEQ ID NO: 971205 - RNA, 18 nt, Mycobacterium avium subsp. paratuberculosis
cguuccggcgagaucuuc

SEQ ID NO: 971206 - RNA, 12 nt, Mycobacterium avium subsp. paratuberculosis
cguucggcgcca

SEQ ID NO: 971207 - RNA, 22 nt, Mycobacterium avium subsp. paratuberculosis
cguucggcggcgcgcugcaggc

SEQ ID NO: 971208 - RNA, 15 nt, Mycobacterium avium subsp. paratuberculosis
cguucggcgggcagg

SEQ ID NO: 971209 - RNA, 16 nt, Mycobacterium avium subsp. paratuberculosis
cguucgggcagcgccu

SEQ ID NO: 971210 - RNA, 17 nt, Mycobacterium avium subsp. paratuberculosis
cguucgggcccggccgc

SEQ ID NO: 971211 - RNA, 19 nt, Mycobacterium avium subsp. paratuberculosis
cuaaaccccacggccgcaa

SEQ ID NO: 971212 - RNA, 15 nt, Mycobacterium avium subsp. paratuberculosis
cuaacgccagcuggg

SEQ ID NO: 971213 - RNA, 21 nt, Mycobacterium avium subsp. paratuberculosis
cuaacgccagcugggcagcca

SEQ ID NO: 971214 - RNA, 15 nt, Mycobacterium avium subsp. paratuberculosis
cuaacggcgcggcag

SEQ ID NO: 971215 - RNA, 19 nt, Mycobacterium avium subsp. paratuberculosis
cuaacuguugucagccacu

SEQ ID NO: 971216 - RNA, 22 nt, Mycobacterium avium subsp. paratuberculosis
cuaacuguugucagccacucgc

SEQ ID NO: 971217 - RNA, 18 nt, Mycobacterium avium subsp. paratuberculosis
cuaacuccgcucgggccc

SEQ ID NO: 971218 - RNA, 22 nt, Mycobacterium avium subsp. paratuberculosis
cuaagcgcugaaccgguagucg

SEQ ID NO: 971219 - RNA, 15 nt, Mycobacterium avium subsp. paratuberculosis
cuaaugcaucgaugc

SEQ ID NO: 971220 - RNA, 22 nt, Mycobacterium avium subsp. paratuberculosis
cuaaucgccgcgcguuccagca

SEQ ID NO: 971221 - RNA, 14 nt, Mycobacterium avium subsp. paratuberculosis
cgucgccaauccgg

SEQ ID NO: 971222 - RNA, 17 nt, Mycobacterium avium subsp. paratuberculosis
cgucgccaauccggcgg

SEQ ID NO: 971223 - RNA, 20 nt, Mycobacterium avium subsp. paratuberculosis
cgucgccaccaccgcgccgu

SEQ ID NO: 971224 - RNA, 14 nt, Mycobacterium avium subsp. paratuberculosis
cgucgccaccaccu

SEQ ID NO: 971225 - RNA, 19 nt, Mycobacterium avium subsp. paratuberculosis
cgucgccaccgagucgcgc

SEQ ID NO: 971226 - RNA, 14 nt, Mycobacterium avium subsp. paratuberculosis
cgucgcagugcccg

SEQ ID NO: 971227 - RNA, 22 nt, Mycobacterium avium subsp. paratuberculosis
cguccgcgacgcugagcgccag

SEQ ID NO: 971228 - RNA, 23 nt, Mycobacterium avium subsp. paratuberculosis
cgucgcagaucccgccggcggcc

SEQ ID NO: 971229 - RNA, 17 nt, Mycobacterium avium subsp. paratuberculosis
cgucgccagccgccggc

SEQ ID NO: 971230 - RNA, 17 nt, Mycobacterium avium subsp. paratuberculosis
cgucgcccacccgccag

SEQ ID NO: 971231 - RNA, 18 nt, Mycobacterium avium subsp. paratuberculosis
cgucgcccacccgccagc

SEQ ID NO: 971232 - RNA, 12 nt, Mycobacterium avium subsp. paratuberculosis
cgucgcccaccg

SEQ ID NO: 971233 - RNA, 20 nt, Mycobacterium avium subsp. paratuberculosis
cgucgccgaucagcaccagg

SEQ ID NO: 971234 - RNA, 13 nt, Mycobacterium avium subsp. paratuberculosis
cgucgccgccccc

SEQ ID NO: 971235 - RNA, 11 nt, Mycobacterium avium subsp. paratuberculosis
cgucgccgccc

SEQ ID NO: 971236 - RNA, 21 nt, Mycobacterium avium subsp. paratuberculosis
cgucgccgcuggugaacucgc

SEQ ID NO: 971237 - RNA, 13 nt, Mycobacterium avium subsp. paratuberculosis
cgucgccgcgcgc

SEQ ID NO: 971238 - RNA, 20 nt, Mycobacterium avium subsp. paratuberculosis
cgucgcggaacagccggcuc

SEQ ID NO: 971239 - RNA, 16 nt, Mycobacterium avium subsp. paratuberculosis
cgucgcgcugccggcc

SEQ ID NO: 971240 - RNA, 22 nt, Mycobacterium avium subsp. paratuberculosis
cgucgcggaggaugccggccag

SEQ ID NO: 971241 - RNA, 16 nt, Mycobacterium avium subsp. paratuberculosis
cgucgccggccgcggu

SEQ ID NO: 971242 - RNA, 21 nt, Mycobacterium avium subsp. paratuberculosis
cgucggagaucaccggcaccc

SEQ ID NO: 971243 - RNA, 20 nt, Mycobacterium avium subsp. paratuberculosis
cgucggaggcgucgacgcgc

SEQ ID NO: 971244 - RNA, 22 nt, Mycobacterium avium subsp. paratuberculosis
cgucgcugcccagauacgccgc

SEQ ID NO: 971245 - RNA, 15 nt, Mycobacterium avium subsp. paratuberculosis
cgucgcugacgccga

SEQ ID NO: 971246 - RNA, 20 nt, Mycobacterium avium subsp. paratuberculosis
cgucgcugacgccgagcagc

SEQ ID NO: 971247 - RNA, 21 nt, Mycobacterium avium subsp. paratuberculosis
cgucgcuguuggcgacggcgc

SEQ ID NO: 971248 - RNA, 19 nt, Mycobacterium avium subsp. paratuberculosis
cgucgcguccagcaugccc

SEQ ID NO: 971249 - RNA, 14 nt, Mycobacterium avium subsp. paratuberculosis
cgucgcggcggccc

SEQ ID NO: 971250 - RNA, 13 nt, Mycobacterium avium subsp. paratuberculosis
cgucgcggcggcg

SEQ ID NO: 971251 - RNA, 20 nt, Mycobacterium avium subsp. paratuberculosis
cgucgcggcggugcgcagcc

SEQ ID NO: 971252 - RNA, 20 nt, Mycobacterium avium subsp. paratuberculosis
cgucgcgggagagcgcgggc

SEQ ID NO: 971253 - RNA, 15 nt, Mycobacterium avium subsp. paratuberculosis
cgucgcgggcgccga

SEQ ID NO: 971254 - RNA, 22 nt, Mycobacterium avium subsp. paratuberculosis
cgucgcgguggagcacagcacg

SEQ ID NO: 971255 - RNA, 15 nt, Mycobacterium avium subsp. paratuberculosis
cgucggcgccgccga

SEQ ID NO: 971256 - RNA, 13 nt, Mycobacterium avium subsp. paratuberculosis
cgucggcgccgcg

SEQ ID NO: 971257 - RNA, 21 nt, Mycobacterium avium subsp. paratuberculosis
cgucggcgccggaucggcccc

SEQ ID NO: 971258 - RNA, 17 nt, Mycobacterium avium subsp. paratuberculosis
cgucggcgccggcgcgc

SEQ ID NO: 971259 - RNA, 18 nt, Mycobacterium avium subsp. paratuberculosis
cgucggcgaucgccagca

SEQ ID NO: 971260 - RNA, 20 nt, Mycobacterium avium subsp. paratuberculosis
cgucggcgaucgccagcacg

SEQ ID NO: 971261 - RNA, 21 nt, Mycobacterium avium subsp. paratuberculosis
cgucggcgccccccugcucgc

SEQ ID NO: 971262 - RNA, 18 nt, Mycobacterium avium subsp. paratuberculosis
cgucggccuugcgccacu

SEQ ID NO: 971263 - RNA, 24 nt, Mycobacterium avium subsp. paratuberculosis
cgucggcgaacuccagaucgccgc

SEQ ID NO: 971264 - RNA, 13 nt, Mycobacterium avium subsp. paratuberculosis
cgucggcgacgac

SEQ ID NO: 971265 - RNA, 15 nt, Mycobacterium avium subsp. paratuberculosis
cgucggcgagcagca

SEQ ID NO: 971266 - RNA, 12 nt, Mycobacterium avium subsp. paratuberculosis
cgucggcgagcg

SEQ ID NO: 971267 - RNA, 12 nt, Mycobacterium avium subsp. paratuberculosis
cgucggccggcu

SEQ ID NO: 971268 - RNA, 15 nt, Mycobacterium avium subsp. paratuberculosis
cgucggccggcugca

SEQ ID NO: 971269 - RNA, 13 nt, Mycobacterium avium subsp. paratuberculosis
cgucggccggggg

SEQ ID NO: 971270 - RNA, 11 nt, Mycobacterium avium subsp. paratuberculosis
cgucggccugc

SEQ ID NO: 971271 - RNA, 19 nt, Mycobacterium avium subsp. paratuberculosis
cgucggccaucagccgccg

SEQ ID NO: 971272 - RNA, 23 nt, Mycobacterium avium subsp. paratuberculosis
cgucggcccagacgaugucgucg

SEQ ID NO: 971273 - RNA, 15 nt, Mycobacterium avium subsp. paratuberculosis
cgucggccagcggca

SEQ ID NO: 971274 - RNA, 18 nt, Mycobacterium avium subsp. paratuberculosis
cgucggccagcggcagcg

SEQ ID NO: 971275 - RNA, 17 nt, Mycobacterium avium subsp. paratuberculosis
cgucggccaccgcgccu

SEQ ID NO: 971276 - RNA, 19 nt, Mycobacterium avium subsp. paratuberculosis
cgucggccacgcucgccag

SEQ ID NO: 971277 - RNA, 16 nt, Mycobacterium avium subsp. paratuberculosis
cgucggcaccagcggc

SEQ ID NO: 971278 - RNA, 12 nt, Mycobacterium avium subsp. paratuberculosis
cgucgggccggg

SEQ ID NO: 971279 - RNA, 15 nt, Mycobacterium avium subsp. paratuberculosis
cgucgggccgcagca

SEQ ID NO: 971280 - RNA, 14 nt, Mycobacterium avium subsp. paratuberculosis
cgucgggcgccggu

SEQ ID NO: 971281 - RNA, 15 nt, Mycobacterium avium subsp. paratuberculosis
cgucgggcgcggcgg

SEQ ID NO: 971282 - RNA, 15 nt, Mycobacterium avium subsp. paratuberculosis
cgucgggcggcagga

SEQ ID NO: 971283 - RNA, 19 nt, Mycobacterium avium subsp. paratuberculosis
cgucgggcuugcgcaacag

SEQ ID NO: 971284 - RNA, 22 nt, Mycobacterium avium subsp. paratuberculosis
cgucggggaugucgucgggcgc

SEQ ID NO: 971285 - RNA, 13 nt, Mycobacterium avium subsp. paratuberculosis
cgucggggcccgg

SEQ ID NO: 971286 - RNA, 17 nt, Mycobacterium avium subsp. paratuberculosis
cgucgggguggccggcc

SEQ ID NO: 971287 - RNA, 18 nt, Mycobacterium avium subsp. paratuberculosis
cgucgggguggccggcca

SEQ ID NO: 971288 - RNA, 19 nt, Mycobacterium avium subsp. paratuberculosis
cgucggggcgucggcggcc

SEQ ID NO: 971289 - RNA, 19 nt, Mycobacterium avium subsp. paratuberculosis
cgucgggggcguuugaggu

SEQ ID NO: 971290 - RNA, 17 nt, Mycobacterium avium subsp. paratuberculosis
cgucgggucggcgagca

SEQ ID NO: 971291 - RNA, 13 nt, Mycobacterium avium subsp. paratuberculosis
cgucggucacccg

SEQ ID NO: 971292 - RNA, 18 nt, Mycobacterium avium subsp. paratuberculosis
cgucggucagcggcguca

SEQ ID NO: 971293 - RNA, 13 nt, Mycobacterium avium subsp. paratuberculosis
cgucggugcgcgc

SEQ ID NO: 971294 - RNA, 15 nt, Mycobacterium avium subsp. paratuberculosis
cgucggugcgcgccg

SEQ ID NO: 971295 - RNA, 17 nt, Mycobacterium avium subsp. paratuberculosis
cgucggugcgcgccgca

SEQ ID NO: 971296 - RNA, 22 nt, Mycobacterium avium subsp. paratuberculosis
cgucggugaaauagcgcagcau

SEQ ID NO: 971297 - RNA, 22 nt, Mycobacterium avium subsp. paratuberculosis
cgucggcuagcggcugacccgc

SEQ ID NO: 971298 - RNA, 17 nt, Mycobacterium avium subsp. paratuberculosis
cgucggcuuccuccucg

SEQ ID NO: 971299 - RNA, 19 nt, Mycobacterium avium subsp. paratuberculosis
cgucgggaccgucgcgcag

SEQ ID NO: 971300 - RNA, 15 nt, Mycobacterium avium subsp. paratuberculosis
cgucgggacgcggca

SEQ ID NO: 971301 - RNA, 18 nt, Mycobacterium avium subsp. paratuberculosis
cgucgggacggccagcag

SEQ ID NO: 971302 - RNA, 20 nt, Mycobacterium avium subsp. paratuberculosis
cgucgggcaccacggcggca

SEQ ID NO: 971303 - RNA, 17 nt, Mycobacterium avium subsp. paratuberculosis
cgucgggcaccgccagg

SEQ ID NO: 971304 - RNA, 11 nt, Mycobacterium avium subsp. paratuberculosis
cgucgggcagc

SEQ ID NO: 971305 - RNA, 22 nt, Mycobacterium avium subsp. paratuberculosis
cgucggcgugcccgccgaccag

SEQ ID NO: 971306 - RNA, 18 nt, Mycobacterium avium subsp. paratuberculosis
cgucggcguucagcggca

SEQ ID NO: 971307 - RNA, 18 nt, Mycobacterium avium subsp. paratuberculosis
cgucggcgggcugcagcg

SEQ ID NO: 971308 - RNA, 21 nt, Mycobacterium avium subsp. paratuberculosis
cgucggcgggggauccgccug

SEQ ID NO: 971309 - RNA, 16 nt, Mycobacterium avium subsp. paratuberculosis
cgucggcggucgccag

SEQ ID NO: 971310 - RNA, 14 nt, Mycobacterium avium subsp. paratuberculosis
cgucggcggccgcg

SEQ ID NO: 971311 - RNA, 14 nt, Mycobacterium avium subsp. paratuberculosis
cgucggcggccugc

SEQ ID NO: 971312 - RNA, 19 nt, Mycobacterium avium subsp. paratuberculosis
cgucggcggccugcuccag

SEQ ID NO: 971313 - RNA, 12 nt, Mycobacterium avium subsp. paratuberculosis
cgucggcgcgcu

SEQ ID NO: 971314 - RNA, 19 nt, Mycobacterium avium subsp. paratuberculosis
cgucggccgcgacgaccgc

SEQ ID NO: 971315 - RNA, 12 nt, Mycobacterium avium subsp. paratuberculosis
cgucggcgccgu

SEQ ID NO: 971316 - RNA, 15 nt, Mycobacterium avium subsp. paratuberculosis
cgucggcgcgggcca

SEQ ID NO: 971317 - RNA, 13 nt, Mycobacterium avium subsp. paratuberculosis
cgucgucgcgcag

SEQ ID NO: 971318 - RNA, 14 nt, Mycobacterium avium subsp. paratuberculosis
cgucgucgcgcagg

SEQ ID NO: 971319 - RNA, 15 nt, Mycobacterium avium subsp. paratuberculosis
cgucgucgcggcgcu

SEQ ID NO: 971320 - RNA, 24 nt, Mycobacterium avium subsp. paratuberculosis
cgucgucgcuccacaucugccggc

SEQ ID NO: 971321 - RNA, 21 nt, Mycobacterium avium subsp. paratuberculosis
cgucgucggacaccagcaugg

SEQ ID NO: 971322 - RNA, 15 nt, Mycobacterium avium subsp. paratuberculosis
cgucgucggacagca

SEQ ID NO: 971323 - RNA, 18 nt, Mycobacterium avium subsp. paratuberculosis
cgucgucggacagcagca

SEQ ID NO: 971324 - RNA, 14 nt, Mycobacterium avium subsp. paratuberculosis
cgucgucggccucg

SEQ ID NO: 971325 - RNA, 14 nt, Mycobacterium avium subsp. paratuberculosis
cgucgucggcggcg

SEQ ID NO: 971326 - RNA, 15 nt, Mycobacterium avium subsp. paratuberculosis
cgucgucgccgccgg

SEQ ID NO: 971327 - RNA, 18 nt, Mycobacterium avium subsp. paratuberculosis
cgucgucgccgccgguga

SEQ ID NO: 971328 - RNA, 16 nt, Mycobacterium avium subsp. paratuberculosis
cgucgucgaugcgcag

SEQ ID NO: 971329 - RNA, 17 nt, Mycobacterium avium subsp. paratuberculosis
cgucgucgaugcgcagc

SEQ ID NO: 971330 - RNA, 14 nt, Mycobacterium avium subsp. paratuberculosis
cgucgucgacccgc

SEQ ID NO: 971331 - RNA, 15 nt, Mycobacterium avium subsp. paratuberculosis
cgucgucgagcaccg

SEQ ID NO: 971332 - RNA, 14 nt, Mycobacterium avium subsp. paratuberculosis
cgucgucgagcacg

SEQ ID NO: 971333 - RNA, 21 nt, Mycobacterium avium subsp. paratuberculosis
cgucguccuugagcccccacc

SEQ ID NO: 971334 - RNA, 18 nt, Mycobacterium avium subsp. paratuberculosis
cgucgucaucgucuccgc

SEQ ID NO: 971335 - RNA, 21 nt, Mycobacterium avium subsp. paratuberculosis
cgucguagucgcucggcggcg

SEQ ID NO: 971336 - RNA, 14 nt, Mycobacterium avium subsp. paratuberculosis
cgucguacagcagc

SEQ ID NO: 971337 - RNA, 19 nt, Mycobacterium avium subsp. paratuberculosis
cgucguagacgcugccgcu

SEQ ID NO: 971338 - RNA, 22 nt, Mycobacterium avium subsp. paratuberculosis
cgucguagagcaggaccgagcc

SEQ ID NO: 971339 - RNA, 17 nt, Mycobacterium avium subsp. paratuberculosis
cgucgugcucggcgagc

SEQ ID NO: 971340 - RNA, 16 nt, Mycobacterium avium subsp. paratuberculosis
cgucgugcggccggcg

SEQ ID NO: 971341 - RNA, 22 nt, Mycobacterium avium subsp. paratuberculosis
cgucguggguauccgccgccag

SEQ ID NO: 971342 - RNA, 20 nt, Mycobacterium avium subsp. paratuberculosis
cgucgugguagcggucgggg

SEQ ID NO: 971343 - RNA, 19 nt, Mycobacterium avium subsp. paratuberculosis
cgucguccggcgcgcagca

SEQ ID NO: 971344 - RNA, 22 nt, Mycobacterium avium subsp. paratuberculosis
cgucgugauggcgaaccagcgc

SEQ ID NO: 971345 - RNA, 13 nt, Mycobacterium avium subsp. paratuberculosis
cgucguucucggg

SEQ ID NO: 971346 - RNA, 17 nt, Mycobacterium avium subsp. paratuberculosis
cgucguucucgggggcg

SEQ ID NO: 971347 - RNA, 21 nt, Mycobacterium avium subsp. paratuberculosis
cgucguucucgggggcgggca

SEQ ID NO: 971348 - RNA, 14 nt, Mycobacterium avium subsp. paratuberculosis
cgucguugacgccc

SEQ ID NO: 971349 - RNA, 15 nt, Mycobacterium avium subsp. paratuberculosis
cgucguugugggcca

SEQ ID NO: 971350 - RNA, 21 nt, Mycobacterium avium subsp. paratuberculosis
cgucguuuuccagccggcgca

SEQ ID NO: 971351 - RNA, 22 nt, Mycobacterium avium subsp. paratuberculosis
cgucuaagucgaugccgccccu

SEQ ID NO: 971352 - RNA, 15 nt, Mycobacterium avium subsp. paratuberculosis
cgucguugcgcagcg

SEQ ID NO: 971353 - RNA, 23 nt, Mycobacterium avium subsp. paratuberculosis
cgucguugcgggcggcgcggcgc

SEQ ID NO: 971354 - RNA, 20 nt, Mycobacterium avium subsp. paratuberculosis
cgucuccucgaccagcgcgc

SEQ ID NO: 971355 - RNA, 23 nt, Mycobacterium avium subsp. paratuberculosis
cgucuccucgaccagcgcgccgc

SEQ ID NO: 971356 - RNA, 20 nt, Mycobacterium avium subsp. paratuberculosis
cgucuccuggggcagaucgu

SEQ ID NO: 971357 - RNA, 14 nt, Mycobacterium avium subsp. paratuberculosis
cgucuccggcggca

SEQ ID NO: 971358 - RNA, 18 nt, Mycobacterium avium subsp. paratuberculosis
cgucucgagccggcgcac

SEQ ID NO: 971359 - RNA, 22 nt, Mycobacterium avium subsp. paratuberculosis
cgucucgaucgacgacgccagc

SEQ ID NO: 971360 - RNA, 14 nt, Mycobacterium avium subsp. paratuberculosis
cgucucggccagcc

SEQ ID NO: 971361 - RNA, 13 nt, Mycobacterium avium subsp. paratuberculosis
cgucucggccgcg

SEQ ID NO: 971362 - RNA, 21 nt, Mycobacterium avium subsp. paratuberculosis
cgucugcgggaagcccaccgc

SEQ ID NO: 971363 - RNA, 14 nt, Mycobacterium avium subsp. paratuberculosis
cgucugcucgccag

SEQ ID NO: 971364 - RNA, 16 nt, Mycobacterium avium subsp. paratuberculosis
cgucucgucggccgcg

SEQ ID NO: 971365 - RNA, 13 nt, Mycobacterium avium subsp. paratuberculosis
cgucucggcggcc

SEQ ID NO: 971366 - RNA, 17 nt, Mycobacterium avium subsp. paratuberculosis
cgucucggcgucucggc

SEQ ID NO: 971367 - RNA, 17 nt, Mycobacterium avium subsp. paratuberculosis
cgucuggcagccggccg

SEQ ID NO: 971368 - RNA, 16 nt, Mycobacterium avium subsp. paratuberculosis
cgucugguuggccggc

SEQ ID NO: 971369 - RNA, 17 nt, Mycobacterium avium subsp. paratuberculosis
cgucugguuggccggcg

SEQ ID NO: 971370 - RNA, 19 nt, Mycobacterium avium subsp. paratuberculosis
cgugacuugucgggccgca

SEQ ID NO: 971371 - RNA, 15 nt, Mycobacterium avium subsp. paratuberculosis
cgugacuggguggga

SEQ ID NO: 971372 - RNA, 17 nt, Mycobacterium avium subsp. paratuberculosis
cgugagauccagcagcc

SEQ ID NO: 971373 - RNA, 17 nt, Mycobacterium avium subsp. paratuberculosis
cgugaaguuaguuucac

SEQ ID NO: 971374 - RNA, 16 nt, Mycobacterium avium subsp. paratuberculosis
cgugaauccucagcac

SEQ ID NO: 971375 - RNA, 17 nt, Mycobacterium avium subsp. paratuberculosis
cgugaauccucagcacg

SEQ ID NO: 971376 - RNA, 13 nt, Mycobacterium avium subsp. paratuberculosis
cgugaaugcccag

SEQ ID NO: 971377 - RNA, 20 nt, Mycobacterium avium subsp. paratuberculosis
cgucuucuuggccgcggccu

SEQ ID NO: 971378 - RNA, 13 nt, Mycobacterium avium subsp. paratuberculosis
cgucuugcccagc

SEQ ID NO: 971379 - RNA, 17 nt, Mycobacterium avium subsp. paratuberculosis
cgucuucggggccgccg

SEQ ID NO: 971380 - RNA, 21 nt, Mycobacterium avium subsp. paratuberculosis
cgucuuggugcgagccaccuc

SEQ ID NO: 971381 - RNA, 15 nt, Mycobacterium avium subsp. paratuberculosis
cgucuugccguugac

SEQ ID NO: 971382 - RNA, 22 nt, Mycobacterium avium subsp. paratuberculosis
cgugaucuggucggccagcgcg

SEQ ID NO: 971383 - RNA, 14 nt, Mycobacterium avium subsp. paratuberculosis
cgugaugagcgcgu

SEQ ID NO: 971384 - RNA, 14 nt, Mycobacterium avium subsp. paratuberculosis
cgugaucggccagc

SEQ ID NO: 971385 - RNA, 17 nt, Mycobacterium avium subsp. paratuberculosis
cgugagggaccuccagc

SEQ ID NO: 971386 - RNA, 13 nt, Mycobacterium avium subsp. paratuberculosis
cgugcagcacgcc

SEQ ID NO: 971387 - RNA, 11 nt, Mycobacterium avium subsp. paratuberculosis
cgugcagcacc

SEQ ID NO: 971388 - RNA, 18 nt, Mycobacterium avium subsp. paratuberculosis
cgugcaaaccggaccgcc

SEQ ID NO: 971389 - RNA, 14 nt, Mycobacterium avium subsp. paratuberculosis
cgugcagcgccagc

SEQ ID NO: 971390 - RNA, 15 nt, Mycobacterium avium subsp. paratuberculosis
cgugcagccggcggc

SEQ ID NO: 971391 - RNA, 16 nt, Mycobacterium avium subsp. paratuberculosis
cgugcccaccagccgg

SEQ ID NO: 971392 - RNA, 15 nt, Mycobacterium avium subsp. paratuberculosis
cgugcccagcccgcg

SEQ ID NO: 971393 - RNA, 19 nt, Mycobacterium avium subsp. paratuberculosis
cgugcagggggcgcagccg

SEQ ID NO: 971394 - RNA, 21 nt, Mycobacterium avium subsp. paratuberculosis
cgugcaggaucggcuugggga

SEQ ID NO: 971395 - RNA, 15 nt, Mycobacterium avium subsp. paratuberculosis
cgugcaggccgcggg

SEQ ID NO: 971396 - RNA, 13 nt, Mycobacterium avium subsp. paratuberculosis
cgugcuccagcag

SEQ ID NO: 971397 - RNA, 14 nt, Mycobacterium avium subsp. paratuberculosis
cgugcuccagcagg

SEQ ID NO: 971398 - RNA, 17 nt, Mycobacterium avium subsp. paratuberculosis
cgugcuccagcaggcgc

SEQ ID NO: 971399 - RNA, 15 nt, Mycobacterium avium subsp. paratuberculosis
cgugcugcgcagcag

SEQ ID NO: 971400 - RNA, 17 nt, Mycobacterium avium subsp. paratuberculosis
cgugcugcgcagcagcg

SEQ ID NO: 971401 - RNA, 21 nt, Mycobacterium avium subsp. paratuberculosis
cgugcugcgcagcagcgccag

SEQ ID NO: 971402 - RNA, 18 nt, Mycobacterium avium subsp. paratuberculosis
cgugcucggcgagcaccg

SEQ ID NO: 971403 - RNA, 14 nt, Mycobacterium avium subsp. paratuberculosis
cgugcucggcggcg

SEQ ID NO: 971404 - RNA, 17 nt, Mycobacterium avium subsp. paratuberculosis
cgugcgacaccggcgug

SEQ ID NO: 971405 - RNA, 15 nt, Mycobacterium avium subsp. paratuberculosis
cgugcgacuccuggg

SEQ ID NO: 971406 - RNA, 15 nt, Mycobacterium avium subsp. paratuberculosis
cgugccuuacgccgg

SEQ ID NO: 971407 - RNA, 15 nt, Mycobacterium avium subsp. paratuberculosis
cgugcccuuccccgg

SEQ ID NO: 971408 - RNA, 12 nt, Mycobacterium avium subsp. paratuberculosis
cgugccgaugcc

SEQ ID NO: 971409 - RNA, 17 nt, Mycobacterium avium subsp. paratuberculosis
cgugccgaugccggccu

SEQ ID NO: 971410 - RNA, 23 nt, Mycobacterium avium subsp. paratuberculosis
cgugccgauuccagcaacugcuc

SEQ ID NO: 971411 - RNA, 16 nt, Mycobacterium avium subsp. paratuberculosis
cgugccgcgcaccacc

SEQ ID NO: 971412 - RNA, 18 nt, Mycobacterium avium subsp. paratuberculosis
cgugccggaccgcgcggg

SEQ ID NO: 971413 - RNA, 16 nt, Mycobacterium avium subsp. paratuberculosis
cgugccggacuccuuc

SEQ ID NO: 971414 - RNA, 12 nt, Mycobacterium avium subsp. paratuberculosis
cgugccggcccg

SEQ ID NO: 971415 - RNA, 14 nt, Mycobacterium avium subsp. paratuberculosis
cgugccgaacggcg

SEQ ID NO: 971416 - RNA, 14 nt, Mycobacterium avium subsp. paratuberculosis
cgugcccggcgccg

SEQ ID NO: 971417 - RNA, 15 nt, Mycobacterium avium subsp. paratuberculosis
cgugcccgcgcccac

SEQ ID NO: 971418 - RNA, 21 nt, Mycobacterium avium subsp. paratuberculosis
cgugcccgcgcccaccuggag

SEQ ID NO: 971419 - RNA, 13 nt, Mycobacterium avium subsp. paratuberculosis
cguauucgacggc

SEQ ID NO: 971420 - RNA, 21 nt, Mycobacterium avium subsp. paratuberculosis
cgucaccucgaccagauccuc

SEQ ID NO: 971421 - RNA, 16 nt, Mycobacterium avium subsp. paratuberculosis
cgucaccuucaccccc

SEQ ID NO: 971422 - RNA, 22 nt, Mycobacterium avium subsp. paratuberculosis
cgucaccggcugcccgacccgc

SEQ ID NO: 971423 - RNA, 17 nt, Mycobacterium avium subsp. paratuberculosis
cgucacugcccagccau

SEQ ID NO: 971424 - RNA, 18 nt, Mycobacterium avium subsp. paratuberculosis
cgucacugcccagccauc

SEQ ID NO: 971425 - RNA, 15 nt, Mycobacterium avium subsp. paratuberculosis
cgucacgacggucac

SEQ ID NO: 971426 - RNA, 18 nt, Mycobacterium avium subsp. paratuberculosis
cgucaccgcugaugccgc

SEQ ID NO: 971427 - RNA, 20 nt, Mycobacterium avium subsp. paratuberculosis
cgucaccgcugaugccgccg

SEQ ID NO: 971428 - RNA, 22 nt, Mycobacterium avium subsp. paratuberculosis
cgucaccgcugaugccgccgaa

SEQ ID NO: 971429 - RNA, 14 nt, Mycobacterium avium subsp. paratuberculosis
cgucaucgcggcga

SEQ ID NO: 971430 - RNA, 15 nt, Mycobacterium avium subsp. paratuberculosis
cgucaggucaccgag

SEQ ID NO: 971431 - RNA, 17 nt, Mycobacterium avium subsp. paratuberculosis
cgucaggucaccgagcg

SEQ ID NO: 971432 - RNA, 15 nt, Mycobacterium avium subsp. paratuberculosis
cgucaggucgaccgg

SEQ ID NO: 971433 - RNA, 20 nt, Mycobacterium avium subsp. paratuberculosis
cgucagggguuggcgcgcag

SEQ ID NO: 971434 - RNA, 23 nt, Mycobacterium avium subsp. paratuberculosis
cgucaggguggccucgucggcgc

SEQ ID NO: 971435 - RNA, 22 nt, Mycobacterium avium subsp. paratuberculosis
cgucaggguggugcccccgccc

SEQ ID NO: 971436 - RNA, 19 nt, Mycobacterium avium subsp. paratuberculosis
cgucaggagugcucggcgu

SEQ ID NO: 971437 - RNA, 22 nt, Mycobacterium avium subsp. paratuberculosis
cgucagaaccggggccagcacg

SEQ ID NO: 971438 - RNA, 16 nt, Mycobacterium avium subsp. paratuberculosis
cgucacuucgccgggc

SEQ ID NO: 971439 - RNA, 21 nt, Mycobacterium avium subsp. paratuberculosis
cgucauuccgccgcgcccguc

SEQ ID NO: 971440 - RNA, 23 nt, Mycobacterium avium subsp. paratuberculosis
cgucaugccguaaguggcgccgc

SEQ ID NO: 971441 - RNA, 13 nt, Mycobacterium avium subsp. paratuberculosis
cgucaugccuugg

SEQ ID NO: 971442 - RNA, 19 nt, Mycobacterium avium subsp. paratuberculosis
cguccacaccgggaaggug

SEQ ID NO: 971443 - RNA, 18 nt, Mycobacterium avium subsp. paratuberculosis
cguccacguugaugccgc

SEQ ID NO: 971444 - RNA, 23 nt, Mycobacterium avium subsp. paratuberculosis
cguccacguugaugccgcccagc

SEQ ID NO: 971445 - RNA, 23 nt, Mycobacterium avium subsp. paratuberculosis
cguccacuccaauacggcccggc

SEQ ID NO: 971446 - RNA, 14 nt, Mycobacterium avium subsp. paratuberculosis
cguccaccuccucc

SEQ ID NO: 971447 - RNA, 22 nt, Mycobacterium avium subsp. paratuberculosis
cguccacgggucgccguggccg

SEQ ID NO: 971448 - RNA, 23 nt, Mycobacterium avium subsp. paratuberculosis
cguccacgcccagcgccccgaag

SEQ ID NO: 971449 - RNA, 17 nt, Mycobacterium avium subsp. paratuberculosis
cguccacgaaacccauc

SEQ ID NO: 971450 - RNA, 20 nt, Mycobacterium avium subsp. paratuberculosis
cguccacgaccccggcggca

SEQ ID NO: 971451 - RNA, 13 nt, Mycobacterium avium subsp. paratuberculosis
cguccaccagggu

SEQ ID NO: 971452 - RNA, 15 nt, Mycobacterium avium subsp. paratuberculosis
cguccacccggccca

SEQ ID NO: 971453 - RNA, 13 nt, Mycobacterium avium subsp. paratuberculosis
cguccaccagauc

SEQ ID NO: 971454 - RNA, 18 nt, Mycobacterium avium subsp. paratuberculosis
cguccaccagcaccaggc

SEQ ID NO: 971455 - RNA, 14 nt, Mycobacterium avium subsp. paratuberculosis
cguccaccagcacg

SEQ ID NO: 971456 - RNA, 18 nt, Mycobacterium avium subsp. paratuberculosis
cguccacagccggcggcu

SEQ ID NO: 971457 - RNA, 16 nt, Mycobacterium avium subsp. paratuberculosis
cguccagaccggccgg

SEQ ID NO: 971458 - RNA, 11 nt, Mycobacterium avium subsp. paratuberculosis
cguccagcagc

SEQ ID NO: 971459 - RNA, 15 nt, Mycobacterium avium subsp. paratuberculosis
cguccagcaacgccg

SEQ ID NO: 971460 - RNA, 15 nt, Mycobacterium avium subsp. paratuberculosis
cguccagcaccugcu

SEQ ID NO: 971461 - RNA, 20 nt, Mycobacterium avium subsp. paratuberculosis
cgucccgcucgaucuggcgg

SEQ ID NO: 971462 - RNA, 19 nt, Mycobacterium avium subsp. paratuberculosis
cgucccgguugaccccggc

SEQ ID NO: 971463 - RNA, 21 nt, Mycobacterium avium subsp. paratuberculosis
cgucccgguugaccccggccc

SEQ ID NO: 971464 - RNA, 22 nt, Mycobacterium avium subsp. paratuberculosis
cgucccgguugaccccggcccc

SEQ ID NO: 971465 - RNA, 23 nt, Mycobacterium avium subsp. paratuberculosis
cgucccgguugaccccggccccg

SEQ ID NO: 971466 - RNA, 20 nt, Mycobacterium avium subsp. paratuberculosis
cguccccgugcagccgggcc

SEQ ID NO: 971467 - RNA, 20 nt, Mycobacterium avium subsp. paratuberculosis
cguccagaucggccagcgcg

SEQ ID NO: 971468 - RNA, 13 nt, Mycobacterium avium subsp. paratuberculosis
cgucccgcccggc

SEQ ID NO: 971469 - RNA, 17 nt, Mycobacterium avium subsp. paratuberculosis
cgucccgcccggcgccg

SEQ ID NO: 971470 - RNA, 22 nt, Mycobacterium avium subsp. paratuberculosis
cgucccgcgcgggggccgccgc

SEQ ID NO: 971471 - RNA, 16 nt, Mycobacterium avium subsp. paratuberculosis
cguccgcaaccgccgg

SEQ ID NO: 971472 - RNA, 17 nt, Mycobacterium avium subsp. paratuberculosis
cguccgcaaccgccggc

SEQ ID NO: 971473 - RNA, 15 nt, Mycobacterium avium subsp. paratuberculosis
cguccgccggcuggc

SEQ ID NO: 971474 - RNA, 21 nt, Mycobacterium avium subsp. paratuberculosis
cguccgccuccgaccagccgg

SEQ ID NO: 971475 - RNA, 16 nt, Mycobacterium avium subsp. paratuberculosis
cgucccgucacggcug

SEQ ID NO: 971476 - RNA, 24 nt, Mycobacterium avium subsp. paratuberculosis
cgucccgucacggcugccgaccuc

SEQ ID NO: 971477 - RNA, 16 nt, Mycobacterium avium subsp. paratuberculosis
cgucccguccugggcc

SEQ ID NO: 971478 - RNA, 19 nt, Mycobacterium avium subsp. paratuberculosis
cgucccgucgaccaaugcg

SEQ ID NO: 971479 - RNA, 21 nt, Mycobacterium avium subsp. paratuberculosis
cguccgagcagcagccgcagc

SEQ ID NO: 971480 - RNA, 15 nt, Mycobacterium avium subsp. paratuberculosis
cguccgacaccaccu

SEQ ID NO: 971481 - RNA, 17 nt, Mycobacterium avium subsp. paratuberculosis
cguccgacaccaccugc

SEQ ID NO: 971482 - RNA, 16 nt, Mycobacterium avium subsp. paratuberculosis
cguagggcagcccgag

SEQ ID NO: 971483 - RNA, 15 nt, Mycobacterium avium subsp. paratuberculosis
cguaggugcacagcc

SEQ ID NO: 971484 - RNA, 15 nt, Mycobacterium avium subsp. paratuberculosis
cguaggccaggaccg

SEQ ID NO: 971485 - RNA, 15 nt, Mycobacterium avium subsp. paratuberculosis
cguaggcggccagca

SEQ ID NO: 971486 - RNA, 17 nt, Mycobacterium avium subsp. paratuberculosis
cguaggcgaucagcgcg

SEQ ID NO: 971487 - RNA, 15 nt, Mycobacterium avium subsp. paratuberculosis
cguagcuggugcgca

SEQ ID NO: 971488 - RNA, 19 nt, Mycobacterium avium subsp. paratuberculosis
cguagcuggugcgcagccc

SEQ ID NO: 971489 - RNA, 15 nt, Mycobacterium avium subsp. paratuberculosis
cguaggacagcagcc

SEQ ID NO: 971490 - RNA, 16 nt, Mycobacterium avium subsp. paratuberculosis
cguaggacagcagccg

SEQ ID NO: 971491 - RNA, 14 nt, Mycobacterium avium subsp. paratuberculosis
cguagcagcagacc

SEQ ID NO: 971492 - RNA, 16 nt, Mycobacterium avium subsp. paratuberculosis
cguagaacauccacgg

SEQ ID NO: 971493 - RNA, 19 nt, Mycobacterium avium subsp. paratuberculosis
cguagaaccggcccagcag

SEQ ID NO: 971494 - RNA, 21 nt, Mycobacterium avium subsp. paratuberculosis
cguagaaccggcccagcagcg

SEQ ID NO: 971495 - RNA, 15 nt, Mycobacterium avium subsp. paratuberculosis
cguagaggugcagcg

SEQ ID NO: 971496 - RNA, 21 nt, Mycobacterium avium subsp. paratuberculosis
cguagacgacgucgaccgcgc

SEQ ID NO: 971497 - RNA, 15 nt, Mycobacterium avium subsp. paratuberculosis
cguagagcaggaccg

SEQ ID NO: 971498 - RNA, 21 nt, Mycobacterium avium subsp. paratuberculosis
cguagagcaggaccgagccgc

SEQ ID NO: 971499 - RNA, 21 nt, Mycobacterium avium subsp. paratuberculosis
cguagagccguuuggcgccgc

SEQ ID NO: 971500 - RNA, 22 nt, Mycobacterium avium subsp. paratuberculosis
cguagagccguuuggcgccgcc

SEQ ID NO: 971501 - RNA, 22 nt, Mycobacterium avium subsp. paratuberculosis
cguagaucacgccggugagcac

SEQ ID NO: 971502 - RNA, 20 nt, Mycobacterium avium subsp. paratuberculosis
cguagaucucgcgccgcgca

SEQ ID NO: 971503 - RNA, 15 nt, Mycobacterium avium subsp. paratuberculosis
cguacgggcgcagcg

SEQ ID NO: 971504 - RNA, 22 nt, Mycobacterium avium subsp. paratuberculosis
cguacucgugggccaccacgua

SEQ ID NO: 971505 - RNA, 19 nt, Mycobacterium avium subsp. paratuberculosis
cguacugcucggcgcggcu

SEQ ID NO: 971506 - RNA, 18 nt, Mycobacterium avium subsp. paratuberculosis
cguaccgguacagcgacu

SEQ ID NO: 971507 - RNA, 19 nt, Mycobacterium avium subsp. paratuberculosis
cguacgcgguucgugcgca

SEQ ID NO: 971508 - RNA, 20 nt, Mycobacterium avium subsp. paratuberculosis
cguacgcgccggccagccgg

SEQ ID NO: 971509 - RNA, 12 nt, Mycobacterium avium subsp. paratuberculosis
cguacccgccca

SEQ ID NO: 971510 - RNA, 15 nt, Mycobacterium avium subsp. paratuberculosis
cguaccgcggcggcg

SEQ ID NO: 971511 - RNA, 17 nt, Mycobacterium avium subsp. paratuberculosis
cggcguacugcgcgacc

SEQ ID NO: 971512 - RNA, 22 nt, Mycobacterium avium subsp. paratuberculosis
cguacaucagcucgucagcgcg

SEQ ID NO: 971513 - RNA, 16 nt, Mycobacterium avium subsp. paratuberculosis
cuucgaugucgccggc

SEQ ID NO: 971514 - RNA, 16 nt, Mycobacterium avium subsp. paratuberculosis
cuucgaugccgguggc

SEQ ID NO: 971515 - RNA, 21 nt, Mycobacterium avium subsp. paratuberculosis
cuucgaacgcgacgaagcggu

SEQ ID NO: 971516 - RNA, 18 nt, Mycobacterium avium subsp. paratuberculosis
cuucgcccggcugcgccg

SEQ ID NO: 971517 - RNA, 23 nt, Mycobacterium avium subsp. paratuberculosis
cuucgccagcgggccgaccuggc

SEQ ID NO: 971518 - RNA, 14 nt, Mycobacterium avium subsp. paratuberculosis
cuucgccgcagccu

SEQ ID NO: 971519 - RNA, 17 nt, Mycobacterium avium subsp. paratuberculosis
cuuccgcaacaucguca

SEQ ID NO: 971520 - RNA, 18 nt, Mycobacterium avium subsp. paratuberculosis
cuuccgagacguggucgg

SEQ ID NO: 971521 - RNA, 21 nt, Mycobacterium avium subsp. paratuberculosis
cuuccgccacgcccagggcgc

SEQ ID NO: 971522 - RNA, 14 nt, Mycobacterium avium subsp. paratuberculosis
cuuccgcccggcga

SEQ ID NO: 971523 - RNA, 22 nt, Mycobacterium avium subsp. paratuberculosis
cuuccucgcuguccugccgggc

SEQ ID NO: 971524 - RNA, 13 nt, Mycobacterium avium subsp. paratuberculosis
cuuccuccucuuc

SEQ ID NO: 971525 - RNA, 14 nt, Mycobacterium avium subsp. paratuberculosis
cuuccuccucuucg

SEQ ID NO: 971526 - RNA, 16 nt, Mycobacterium avium subsp. paratuberculosis
cuuccaccaccgcggc

SEQ ID NO: 971527 - RNA, 20 nt, Mycobacterium avium subsp. paratuberculosis
cuuccaccaccgcggcgccg

SEQ ID NO: 971528 - RNA, 13 nt, Mycobacterium avium subsp. paratuberculosis
cuuccacagcccg

SEQ ID NO: 971529 - RNA, 15 nt, Mycobacterium avium subsp. paratuberculosis
cuucccacgccuugc

SEQ ID NO: 971530 - RNA, 19 nt, Mycobacterium avium subsp. paratuberculosis
cuucccacgccuugcgguu

SEQ ID NO: 971531 - RNA, 20 nt, Mycobacterium avium subsp. paratuberculosis
cuucauaugacgccggccuc

SEQ ID NO: 971532 - RNA, 14 nt, Mycobacterium avium subsp. paratuberculosis
cuucauguaccggu

SEQ ID NO: 971533 - RNA, 14 nt, Mycobacterium avium subsp. paratuberculosis
cuucaugugguugg

SEQ ID NO: 971534 - RNA, 14 nt, Mycobacterium avium subsp. paratuberculosis
cuucaugcccuugg

SEQ ID NO: 971535 - RNA, 15 nt, Mycobacterium avium subsp. paratuberculosis
cuucaccgcgccggu

SEQ ID NO: 971536 - RNA, 20 nt, Mycobacterium avium subsp. paratuberculosis
cuucacgaccggcagcaccg

SEQ ID NO: 971537 - RNA, 17 nt, Mycobacterium avium subsp. paratuberculosis
cuucaccucggccuugc

SEQ ID NO: 971538 - RNA, 14 nt, Mycobacterium avium subsp. paratuberculosis
cuuacgcaucgccg

SEQ ID NO: 971539 - RNA, 17 nt, Mycobacterium avium subsp. paratuberculosis
cuguuggaaccggccac

SEQ ID NO: 971540 - RNA, 18 nt, Mycobacterium avium subsp. paratuberculosis
cuguuggaaccggccacc

SEQ ID NO: 971541 - RNA, 19 nt, Mycobacterium avium subsp. paratuberculosis
cuguggugacggccccaga

SEQ ID NO: 971542 - RNA, 22 nt, Mycobacterium avium subsp. paratuberculosis
cuguggucgguagggucgggug

SEQ ID NO: 971543 - RNA, 15 nt, Mycobacterium avium subsp. paratuberculosis
cuguugacgggccgc

SEQ ID NO: 971544 - RNA, 19 nt, Mycobacterium avium subsp. paratuberculosis
cugucguagcggcccaggu

SEQ ID NO: 971545 - RNA, 17 nt, Mycobacterium avium subsp. paratuberculosis
cugucgucguccuccuc

SEQ ID NO: 971546 - RNA, 15 nt, Mycobacterium avium subsp. paratuberculosis
cugucgcgcgaacag

SEQ ID NO: 971547 - RNA, 15 nt, Mycobacterium avium subsp. paratuberculosis
cugucggaggccucc

SEQ ID NO: 971548 - RNA, 17 nt, Mycobacterium avium subsp. paratuberculosis
cugucggaggccuccag

SEQ ID NO: 971549 - RNA, 19 nt, Mycobacterium avium subsp. paratuberculosis
cugucggaggccuccaggc

SEQ ID NO: 971550 - RNA, 20 nt, Mycobacterium avium subsp. paratuberculosis
cugucggggucgcggcccgc

SEQ ID NO: 971551 - RNA, 17 nt, Mycobacterium avium subsp. paratuberculosis
cugucggcgccccgccc

SEQ ID NO: 971552 - RNA, 19 nt, Mycobacterium avium subsp. paratuberculosis
cugucggcgcggacgugau

SEQ ID NO: 971553 - RNA, 19 nt, Mycobacterium avium subsp. paratuberculosis
cugucgccgagguccucga

SEQ ID NO: 971554 - RNA, 13 nt, Mycobacterium avium subsp. paratuberculosis
cuguccucccagc

SEQ ID NO: 971555 - RNA, 22 nt, Mycobacterium avium subsp. paratuberculosis
cuguccucccagcgcccgggcg

SEQ ID NO: 971556 - RNA, 20 nt, Mycobacterium avium subsp. paratuberculosis
cuguccugcgguucgggccc

SEQ ID NO: 971557 - RNA, 21 nt, Mycobacterium avium subsp. paratuberculosis
cuguccugcgguucgggcccc

SEQ ID NO: 971558 - RNA, 18 nt, Mycobacterium avium subsp. paratuberculosis
cugucgaacaccgugccg

SEQ ID NO: 971559 - RNA, 16 nt, Mycobacterium avium subsp. paratuberculosis
cugugggcgcagggcc

SEQ ID NO: 971560 - RNA, 17 nt, Mycobacterium avium subsp. paratuberculosis
cugugggcgcagggccg

SEQ ID NO: 971561 - RNA, 19 nt, Mycobacterium avium subsp. paratuberculosis
cugugccggcgggucagca

SEQ ID NO: 971562 - RNA, 22 nt, Mycobacterium avium subsp. paratuberculosis
cugugcgccuugccgucgagca

SEQ ID NO: 971563 - RNA, 13 nt, Mycobacterium avium subsp. paratuberculosis
cugugcggcccgg

SEQ ID NO: 971564 - RNA, 18 nt, Mycobacterium avium subsp. paratuberculosis
aaacucguugccagccgg

SEQ ID NO: 971565 - RNA, 15 nt, Mycobacterium avium subsp. paratuberculosis
cuguauuaagcuggc

SEQ ID NO: 971566 - RNA, 21 nt, Mycobacterium avium subsp. paratuberculosis
cuguauuaagcuggcaggguu

SEQ ID NO: 971567 - RNA, 22 nt, Mycobacterium avium subsp. paratuberculosis
cuguagcucacggugucggcgg

SEQ ID NO: 971568 - RNA, 18 nt, Mycobacterium avium subsp. paratuberculosis
cuguagggcgagcucguu

SEQ ID NO: 971569 - RNA, 17 nt, Mycobacterium avium subsp. paratuberculosis
cuguaggcggcgugcca

SEQ ID NO: 971570 - RNA, 22 nt, Mycobacterium avium subsp. paratuberculosis
cuguaggccagcccggcgugca

SEQ ID NO: 971571 - RNA, 15 nt, Mycobacterium avium subsp. paratuberculosis
cuguaggccagccgg

SEQ ID NO: 971572 - RNA, 17 nt, Mycobacterium avium subsp. paratuberculosis
cuguccacguccugcca

SEQ ID NO: 971573 - RNA, 16 nt, Mycobacterium avium subsp. paratuberculosis
cuguccaggccgaggc

SEQ ID NO: 971574 - RNA, 17 nt, Mycobacterium avium subsp. paratuberculosis
cuguccaggccgaggcu

SEQ ID NO: 971575 - RNA, 13 nt, Mycobacterium avium subsp. paratuberculosis
cuguccaccugca

SEQ ID NO: 971576 - RNA, 19 nt, Mycobacterium avium subsp. paratuberculosis
cuguccaccugcaccuggg

SEQ ID NO: 971577 - RNA, 22 nt, Mycobacterium avium subsp. paratuberculosis
cuguccagcagcgagaaccggc

SEQ ID NO: 971578 - RNA, 22 nt, Mycobacterium avium subsp. paratuberculosis
cuguccggucuucucggccagg

SEQ ID NO: 971579 - RNA, 17 nt, Mycobacterium avium subsp. paratuberculosis
cuguaccgcgagaucag

SEQ ID NO: 971580 - RNA, 21 nt, Mycobacterium avium subsp. paratuberculosis
cugguucaccgccaccagcag

SEQ ID NO: 971581 - RNA, 21 nt, Mycobacterium avium subsp. paratuberculosis
cugguuccacagcugcaggcu

SEQ ID NO: 971582 - RNA, 19 nt, Mycobacterium avium subsp. paratuberculosis
cugguuggcccgcaccacc

SEQ ID NO: 971583 - RNA, 22 nt, Mycobacterium avium subsp. paratuberculosis
cugguuggcccgcaccacccag

SEQ ID NO: 971584 - RNA, 21 nt, Mycobacterium avium subsp. paratuberculosis
cuggugucccgcguggccgcc

SEQ ID NO: 971585 - RNA, 18 nt, Mycobacterium avium subsp. paratuberculosis
cugguggugaucacccag

SEQ ID NO: 971586 - RNA, 16 nt, Mycobacterium avium subsp. paratuberculosis
cuggugcugcugcccc

SEQ ID NO: 971587 - RNA, 15 nt, Mycobacterium avium subsp. paratuberculosis
cuggugcgggccagc

SEQ ID NO: 971588 - RNA, 16 nt, Mycobacterium avium subsp. paratuberculosis
cuggugcgcgccggcg

SEQ ID NO: 971589 - RNA, 19 nt, Mycobacterium avium subsp. paratuberculosis
cuggugcgcgcgcaucacc

SEQ ID NO: 971590 - RNA, 17 nt, Mycobacterium avium subsp. paratuberculosis
cuggugcacccgaugcu

SEQ ID NO: 971591 - RNA, 20 nt, Mycobacterium avium subsp. paratuberculosis
cuggugcagcagggcgcgca

SEQ ID NO: 971592 - RNA, 15 nt, Mycobacterium avium subsp. paratuberculosis
cuggugccgccggcg

SEQ ID NO: 971593 - RNA, 12 nt, Mycobacterium avium subsp. paratuberculosis
cuggggcccagc

SEQ ID NO: 971594 - RNA, 17 nt, Mycobacterium avium subsp. paratuberculosis
cugggguaguucugcuc

SEQ ID NO: 971595 - RNA, 14 nt, Mycobacterium avium subsp. paratuberculosis
cuggguacgaaccu

SEQ ID NO: 971596 - RNA, 15 nt, Mycobacterium avium subsp. paratuberculosis
cugggucaccacggu

SEQ ID NO: 971597 - RNA, 20 nt, Mycobacterium avium subsp. paratuberculosis
cuggguguuccccgggcgag

SEQ ID NO: 971598 - RNA, 21 nt, Mycobacterium avium subsp. paratuberculosis
cuggguggcgaaaccaacacc

SEQ ID NO: 971599 - RNA, 20 nt, Mycobacterium avium subsp. paratuberculosis
cugggugagcgacaccaggu

SEQ ID NO: 971600 - RNA, 19 nt, Mycobacterium avium subsp. paratuberculosis
cugggugcgggcugcacca

SEQ ID NO: 971601 - RNA, 20 nt, Mycobacterium avium subsp. paratuberculosis
cugggcuaccagccccagga

SEQ ID NO: 971602 - RNA, 19 nt, Mycobacterium avium subsp. paratuberculosis
cuggggcagaucgucggca

SEQ ID NO: 971603 - RNA, 24 nt, Mycobacterium avium subsp. paratuberculosis
cuggggcagaucgucggcacugcc

SEQ ID NO: 971604 - RNA, 23 nt, Mycobacterium avium subsp. paratuberculosis
cugggcgcccacccguuggcagg

SEQ ID NO: 971605 - RNA, 22 nt, Mycobacterium avium subsp. paratuberculosis
cugggcgcuagcugcgccggcu

SEQ ID NO: 971606 - RNA, 15 nt, Mycobacterium avium subsp. paratuberculosis
cugggcggcaccacc

SEQ ID NO: 971607 - RNA, 15 nt, Mycobacterium avium subsp. paratuberculosis
cugggcggccugcac

SEQ ID NO: 971608 - RNA, 20 nt, Mycobacterium avium subsp. paratuberculosis
cugggcguacagcggcgcca

SEQ ID NO: 971609 - RNA, 19 nt, Mycobacterium avium subsp. paratuberculosis
cugggcguacugcucggcg

SEQ ID NO: 971610 - RNA, 13 nt, Mycobacterium avium subsp. paratuberculosis
cugggcgggcagc

SEQ ID NO: 971611 - RNA, 22 nt, Mycobacterium avium subsp. paratuberculosis
cugguaguggcgugcggccucg

SEQ ID NO: 971612 - RNA, 17 nt, Mycobacterium avium subsp. paratuberculosis
cuggucaaggugcugaa

SEQ ID NO: 971613 - RNA, 17 nt, Mycobacterium avium subsp. paratuberculosis
cugguagaugccgaagc

SEQ ID NO: 971614 - RNA, 21 nt, Mycobacterium avium subsp. paratuberculosis
cugguagaugguggccgucgg

SEQ ID NO: 971615 - RNA, 17 nt, Mycobacterium avium subsp. paratuberculosis
cugguacgcgccgucgu

SEQ ID NO: 971616 - RNA, 19 nt, Mycobacterium avium subsp. paratuberculosis
cuggucgacgucauccggc

SEQ ID NO: 971617 - RNA, 19 nt, Mycobacterium avium subsp. paratuberculosis
cuggucgaagauggccagg

SEQ ID NO: 971618 - RNA, 14 nt, Mycobacterium avium subsp. paratuberculosis
cugguccucccggg

SEQ ID NO: 971619 - RNA, 18 nt, Mycobacterium avium subsp. paratuberculosis
cugguccucccggguggg

SEQ ID NO: 971620 - RNA, 12 nt, Mycobacterium avium subsp. paratuberculosis
cugguccugccc

SEQ ID NO: 971621 - RNA, 13 nt, Mycobacterium avium subsp. paratuberculosis
cugguccugcccc

SEQ ID NO: 971622 - RNA, 20 nt, Mycobacterium avium subsp. paratuberculosis
cugguccuuaaucgggacgu

SEQ ID NO: 971623 - RNA, 19 nt, Mycobacterium avium subsp. paratuberculosis
cuggucuugccgugcagca

SEQ ID NO: 971624 - RNA, 20 nt, Mycobacterium avium subsp. paratuberculosis
cuggucuugccgugcagcag

SEQ ID NO: 971625 - RNA, 21 nt, Mycobacterium avium subsp. paratuberculosis
cuggugauccucgucuccggc

SEQ ID NO: 971626 - RNA, 18 nt, Mycobacterium avium subsp. paratuberculosis
cuggugaaguucuccagc

SEQ ID NO: 971627 - RNA, 19 nt, Mycobacterium avium subsp. paratuberculosis
cuggugaaguucuccagca

SEQ ID NO: 971628 - RNA, 15 nt, Mycobacterium avium subsp. paratuberculosis
cuggugaccgacgac

SEQ ID NO: 971629 - RNA, 16 nt, Mycobacterium avium subsp. paratuberculosis
cuggucgugcagcacc

SEQ ID NO: 971630 - RNA, 17 nt, Mycobacterium avium subsp. paratuberculosis
cuggucggccuggccca

SEQ ID NO: 971631 - RNA, 14 nt, Mycobacterium avium subsp. paratuberculosis
cuggucggccagcg

SEQ ID NO: 971632 - RNA, 14 nt, Mycobacterium avium subsp. paratuberculosis
cuggucggccaggg

SEQ ID NO: 971633 - RNA, 15 nt, Mycobacterium avium subsp. paratuberculosis
cuggucggccagggc

SEQ ID NO: 971634 - RNA, 16 nt, Mycobacterium avium subsp. paratuberculosis
cuggucggccagggcg

SEQ ID NO: 971635 - RNA, 23 nt, Mycobacterium avium subsp. paratuberculosis
cuggcgaauucggaacccugccc

SEQ ID NO: 971636 - RNA, 14 nt, Mycobacterium avium subsp. paratuberculosis
cuggcgaucaccuu

SEQ ID NO: 971637 - RNA, 14 nt, Mycobacterium avium subsp. paratuberculosis
cuggccuggucggc

SEQ ID NO: 971638 - RNA, 20 nt, Mycobacterium avium subsp. paratuberculosis
cuggcgaacaugguggucga

SEQ ID NO: 971639 - RNA, 17 nt, Mycobacterium avium subsp. paratuberculosis
cuggcgaacucgcgcag

SEQ ID NO: 971640 - RNA, 17 nt, Mycobacterium avium subsp. paratuberculosis
cuggccuugaucgggua

SEQ ID NO: 971641 - RNA, 14 nt, Mycobacterium avium subsp. paratuberculosis
cuggccggccacca

SEQ ID NO: 971642 - RNA, 16 nt, Mycobacterium avium subsp. paratuberculosis
cuggccggccaccagc

SEQ ID NO: 971643 - RNA, 14 nt, Mycobacterium avium subsp. paratuberculosis
cuggccggccaucu

SEQ ID NO: 971644 - RNA, 22 nt, Mycobacterium avium subsp. paratuberculosis
cuggccggugcggaugaagugc

SEQ ID NO: 971645 - RNA, 18 nt, Mycobacterium avium subsp. paratuberculosis
cuggccgugcaccgucgc

SEQ ID NO: 971646 - RNA, 15 nt, Mycobacterium avium subsp. paratuberculosis
cuggccgaggccucc

SEQ ID NO: 971647 - RNA, 21 nt, Mycobacterium avium subsp. paratuberculosis
cuggccgaucccggccacguc

SEQ ID NO: 971648 - RNA, 21 nt, Mycobacterium avium subsp. paratuberculosis
cuggccgauggucagcugccg

SEQ ID NO: 971649 - RNA, 13 nt, Mycobacterium avium subsp. paratuberculosis
cuggccgcccacc

SEQ ID NO: 971650 - RNA, 15 nt, Mycobacterium avium subsp. paratuberculosis
cuggccgcggccagc

SEQ ID NO: 971651 - RNA, 22 nt, Mycobacterium avium subsp. paratuberculosis
cuggccgcggccagcugcccgc

SEQ ID NO: 971652 - RNA, 20 nt, Mycobacterium avium subsp. paratuberculosis
cuggccgcguuccaggaccu

SEQ ID NO: 971653 - RNA, 19 nt, Mycobacterium avium subsp. paratuberculosis
cuggccgcgaacggcccgc

SEQ ID NO: 971654 - RNA, 16 nt, Mycobacterium avium subsp. paratuberculosis
cuggccgcgccacagc

SEQ ID NO: 971655 - RNA, 16 nt, Mycobacterium avium subsp. paratuberculosis
cuggcagcugccgaac

SEQ ID NO: 971656 - RNA, 14 nt, Mycobacterium avium subsp. paratuberculosis
cuggcaggucgcgc

SEQ ID NO: 971657 - RNA, 13 nt, Mycobacterium avium subsp. paratuberculosis
cuggcggccuucu

SEQ ID NO: 971658 - RNA, 14 nt, Mycobacterium avium subsp. paratuberculosis
cuggcggccuucuu

SEQ ID NO: 971659 - RNA, 15 nt, Mycobacterium avium subsp. paratuberculosis
cuggcggccuucuug

SEQ ID NO: 971660 - RNA, 15 nt, Mycobacterium avium subsp. paratuberculosis
cuggcggccggccgc

SEQ ID NO: 971661 - RNA, 14 nt, Mycobacterium avium subsp. paratuberculosis
cuggcgcuggaucu

SEQ ID NO: 971662 - RNA, 20 nt, Mycobacterium avium subsp. paratuberculosis
cuggcgcuggaucugcccga

SEQ ID NO: 971663 - RNA, 14 nt, Mycobacterium avium subsp. paratuberculosis
cuggcgcuggugca

SEQ ID NO: 971664 - RNA, 19 nt, Mycobacterium avium subsp. paratuberculosis
cuggcgcuccagccacucc

SEQ ID NO: 971665 - RNA, 23 nt, Mycobacterium avium subsp. paratuberculosis
cuggcgcuccagccacuccacca

SEQ ID NO: 971666 - RNA, 14 nt, Mycobacterium avium subsp. paratuberculosis
cuggcgcugccagu

SEQ ID NO: 971667 - RNA, 15 nt, Mycobacterium avium subsp. paratuberculosis
cuggcgcaccgggac

SEQ ID NO: 971668 - RNA, 17 nt, Mycobacterium avium subsp. paratuberculosis
cuggcgcagcaccgacu

SEQ ID NO: 971669 - RNA, 22 nt, Mycobacterium avium subsp. paratuberculosis
cuggcgauggugccgaagcgcc

SEQ ID NO: 971670 - RNA, 13 nt, Mycobacterium avium subsp. paratuberculosis
cuggcgcagggcg

SEQ ID NO: 971671 - RNA, 18 nt, Mycobacterium avium subsp. paratuberculosis
cuggcgccggcguccagc

SEQ ID NO: 971672 - RNA, 19 nt, Mycobacterium avium subsp. paratuberculosis
cuggcuggugauggccauc

SEQ ID NO: 971673 - RNA, 16 nt, Mycobacterium avium subsp. paratuberculosis
cugggaggcggcggua

SEQ ID NO: 971674 - RNA, 16 nt, Mycobacterium avium subsp. paratuberculosis
cugggaguugacuccu

SEQ ID NO: 971675 - RNA, 21 nt, Mycobacterium avium subsp. paratuberculosis
cugggaguugacuccucugcc

SEQ ID NO: 971676 - RNA, 20 nt, Mycobacterium avium subsp. paratuberculosis
cugggaggaagugcacgccg

SEQ ID NO: 971677 - RNA, 15 nt, Mycobacterium avium subsp. paratuberculosis
cugggaggcgcacaa

SEQ ID NO: 971678 - RNA, 19 nt, Mycobacterium avium subsp. paratuberculosis
cugggaucggugcgcggcg

SEQ ID NO: 971679 - RNA, 23 nt, Mycobacterium avium subsp. paratuberculosis
cugggcaauggccgcgacucugc

SEQ ID NO: 971680 - RNA, 21 nt, Mycobacterium avium subsp. paratuberculosis
cugggauugccgggcaccagc

SEQ ID NO: 971681 - RNA, 15 nt, Mycobacterium avium subsp. paratuberculosis
cugggcagccgcgcg

SEQ ID NO: 971682 - RNA, 19 nt, Mycobacterium avium subsp. paratuberculosis
cugggcaucaucggcacgc

SEQ ID NO: 971683 - RNA, 12 nt, Mycobacterium avium subsp. paratuberculosis
cugggccagcgc

SEQ ID NO: 971684 - RNA, 13 nt, Mycobacterium avium subsp. paratuberculosis
cugggccccucca

SEQ ID NO: 971685 - RNA, 16 nt, Mycobacterium avium subsp. paratuberculosis
cugggccccuccagcc

SEQ ID NO: 971686 - RNA, 22 nt, Mycobacterium avium subsp. paratuberculosis
cugggcgaccacguccagcugg

SEQ ID NO: 971687 - RNA, 14 nt, Mycobacterium avium subsp. paratuberculosis
cugggccuggcgcu

SEQ ID NO: 971688 - RNA, 17 nt, Mycobacterium avium subsp. paratuberculosis
cugggccucguccaggg

SEQ ID NO: 971689 - RNA, 14 nt, Mycobacterium avium subsp. paratuberculosis
cugggccgggcggu

SEQ ID NO: 971690 - RNA, 17 nt, Mycobacterium avium subsp. paratuberculosis
cugggccuccggcggca

SEQ ID NO: 971691 - RNA, 19 nt, Mycobacterium avium subsp. paratuberculosis
cuggcgggcgaagcgaaag

SEQ ID NO: 971692 - RNA, 20 nt, Mycobacterium avium subsp. paratuberculosis
cuggcggguguucagccccu

SEQ ID NO: 971693 - RNA, 17 nt, Mycobacterium avium subsp. paratuberculosis
cuggcguagagccgcuc

SEQ ID NO: 971694 - RNA, 13 nt, Mycobacterium avium subsp. paratuberculosis
cuggcggugucga

SEQ ID NO: 971695 - RNA, 22 nt, Mycobacterium avium subsp. paratuberculosis
cuggcgugacacucggucaccg

SEQ ID NO: 971696 - RNA, 21 nt, Mycobacterium avium subsp. paratuberculosis
cuggcgugacgcucgccggcg

SEQ ID NO: 971697 - RNA, 22 nt, Mycobacterium avium subsp. paratuberculosis
cuggcgugacgcucgccggcgg

SEQ ID NO: 971698 - RNA, 22 nt, Mycobacterium avium subsp. paratuberculosis
cuggcgugacgcucggccgugg

SEQ ID NO: 971699 - RNA, 18 nt, Mycobacterium avium subsp. paratuberculosis
cuggcgugacgcucggcg

SEQ ID NO: 971700 - RNA, 22 nt, Mycobacterium avium subsp. paratuberculosis
cuggcgugacggucgaccucga

SEQ ID NO: 971701 - RNA, 16 nt, Mycobacterium avium subsp. paratuberculosis
cuggcgguuggacagg

SEQ ID NO: 971702 - RNA, 18 nt, Mycobacterium avium subsp. paratuberculosis
cuggcucggcaccagagc

SEQ ID NO: 971703 - RNA, 20 nt, Mycobacterium avium subsp. paratuberculosis
cuggcucggcaccagagcgc

SEQ ID NO: 971704 - RNA, 17 nt, Mycobacterium avium subsp. paratuberculosis
cuggcugagcagcaccc

SEQ ID NO: 971705 - RNA, 19 nt, Mycobacterium avium subsp. paratuberculosis
cuggcguggcucggcccgc

SEQ ID NO: 971706 - RNA, 23 nt, Mycobacterium avium subsp. paratuberculosis
cuggcgugcuugaacgccgcccc

SEQ ID NO: 971707 - RNA, 17 nt, Mycobacterium avium subsp. paratuberculosis
cuggcguugagcacgcg

SEQ ID NO: 971708 - RNA, 20 nt, Mycobacterium avium subsp. paratuberculosis
cuggcucaacacguccuggc

SEQ ID NO: 971709 - RNA, 17 nt, Mycobacterium avium subsp. paratuberculosis
cuggagugcugcagacc

SEQ ID NO: 971710 - RNA, 14 nt, Mycobacterium avium subsp. paratuberculosis
cuggaugcccaggg

SEQ ID NO: 971711 - RNA, 17 nt, Mycobacterium avium subsp. paratuberculosis
cuggauggcgcccagcc

SEQ ID NO: 971712 - RNA, 21 nt, Mycobacterium avium subsp. paratuberculosis
cuggaugcggucgucgcccac

SEQ ID NO: 971713 - RNA, 23 nt, Mycobacterium avium subsp. paratuberculosis
cuggaugcggucgucgcccaccg

SEQ ID NO: 971714 - RNA, 21 nt, Mycobacterium avium subsp. paratuberculosis
cuggauucgucgcuggccagg

SEQ ID NO: 971715 - RNA, 20 nt, Mycobacterium avium subsp. paratuberculosis
cuggaagaagucggugucga

SEQ ID NO: 971716 - RNA, 16 nt, Mycobacterium avium subsp. paratuberculosis
cuggaagaugacccgc

SEQ ID NO: 971717 - RNA, 18 nt, Mycobacterium avium subsp. paratuberculosis
cuggaagaugacccgccu

SEQ ID NO: 971718 - RNA, 16 nt, Mycobacterium avium subsp. paratuberculosis
cuggaaguucgcuggc

SEQ ID NO: 971719 - RNA, 14 nt, Mycobacterium avium subsp. paratuberculosis
cuggaguggucagg

SEQ ID NO: 971720 - RNA, 19 nt, Mycobacterium avium subsp. paratuberculosis
cuggaguggucaggcccag

SEQ ID NO: 971721 - RNA, 22 nt, Mycobacterium avium subsp. paratuberculosis
cuggagugaggggauccagcgg

SEQ ID NO: 971722 - RNA, 20 nt, Mycobacterium avium subsp. paratuberculosis
cugcuugugaaugggcugcg

SEQ ID NO: 971723 - RNA, 16 nt, Mycobacterium avium subsp. paratuberculosis
cugcuugaugaugccg

SEQ ID NO: 971724 - RNA, 14 nt, Mycobacterium avium subsp. paratuberculosis
cugcuugagccgcc

SEQ ID NO: 971725 - RNA, 13 nt, Mycobacterium avium subsp. paratuberculosis
cugcuugaacagc

SEQ ID NO: 971726 - RNA, 16 nt, Mycobacterium avium subsp. paratuberculosis
cugcuugaacagcacc

SEQ ID NO: 971727 - RNA, 23 nt, Mycobacterium avium subsp. paratuberculosis
cugcuugacccgcuccagcggcc

SEQ ID NO: 971728 - RNA, 20 nt, Mycobacterium avium subsp. paratuberculosis
cugcuguuccucgaacaggc

SEQ ID NO: 971729 - RNA, 14 nt, Mycobacterium avium subsp. paratuberculosis
cugcugggcgggca

SEQ ID NO: 971730 - RNA, 16 nt, Mycobacterium avium subsp. paratuberculosis
cugcugggcgggcagc

SEQ ID NO: 971731 - RNA, 20 nt, Mycobacterium avium subsp. paratuberculosis
cugcugggcgggcagccgcu

SEQ ID NO: 971732 - RNA, 16 nt, Mycobacterium avium subsp. paratuberculosis
cugcugguagacccgg

SEQ ID NO: 971733 - RNA, 21 nt, Mycobacterium avium subsp. paratuberculosis
cugcucggcgacgcugugcuc

SEQ ID NO: 971734 - RNA, 20 nt, Mycobacterium avium subsp. paratuberculosis
cugcucuucgcgcgcggcgu

SEQ ID NO: 971735 - RNA, 16 nt, Mycobacterium avium subsp. paratuberculosis
cugcucugcgcgcggu

SEQ ID NO: 971736 - RNA, 15 nt, Mycobacterium avium subsp. paratuberculosis
cugcucggcgcggcu

SEQ ID NO: 971737 - RNA, 17 nt, Mycobacterium avium subsp. paratuberculosis
cugcucggcgggcucgc

SEQ ID NO: 971738 - RNA, 21 nt, Mycobacterium avium subsp. paratuberculosis
cugcucgcgcugccgcgcgcc

SEQ ID NO: 971739 - RNA, 12 nt, Mycobacterium avium subsp. paratuberculosis
cugcucgcugug

SEQ ID NO: 971740 - RNA, 17 nt, Mycobacterium avium subsp. paratuberculosis
cugcucgcuguggcgga

SEQ ID NO: 971741 - RNA, 20 nt, Mycobacterium avium subsp. paratuberculosis
cugcucggaggaaccgugcg

SEQ ID NO: 971742 - RNA, 17 nt, Mycobacterium avium subsp. paratuberculosis
cugcucgccggcuaccg

SEQ ID NO: 971743 - RNA, 22 nt, Mycobacterium avium subsp. paratuberculosis
cugcucgccggcuaccggcgcu

SEQ ID NO: 971744 - RNA, 13 nt, Mycobacterium avium subsp. paratuberculosis
cugcucgcgcccu

SEQ ID NO: 971745 - RNA, 17 nt, Mycobacterium avium subsp. paratuberculosis
cugcgugcugggcaccg

SEQ ID NO: 971746 - RNA, 21 nt, Mycobacterium avium subsp. paratuberculosis
cugcucaugagcccuccagcu

SEQ ID NO: 971747 - RNA, 13 nt, Mycobacterium avium subsp. paratuberculosis
cugcucccaggcg

SEQ ID NO: 971748 - RNA, 15 nt, Mycobacterium avium subsp. paratuberculosis
cugcgagaucggcag

SEQ ID NO: 971749 - RNA, 16 nt, Mycobacterium avium subsp. paratuberculosis
cugcgagaucggcaga

SEQ ID NO: 971750 - RNA, 18 nt, Mycobacterium avium subsp. paratuberculosis
cugcgagcacacccucac

SEQ ID NO: 971751 - RNA, 15 nt, Mycobacterium avium subsp. paratuberculosis
cugcgaccacccgga

SEQ ID NO: 971752 - RNA, 17 nt, Mycobacterium avium subsp. paratuberculosis
cugcgaauacccgccca

SEQ ID NO: 971753 - RNA, 15 nt, Mycobacterium avium subsp. paratuberculosis
cugcgcuugcggcgc

SEQ ID NO: 971754 - RNA, 21 nt, Mycobacterium avium subsp. paratuberculosis
cugcgcuugcggcgcagccag

SEQ ID NO: 971755 - RNA, 20 nt, Mycobacterium avium subsp. paratuberculosis
cugcggaaaugcccgcgccc

SEQ ID NO: 971756 - RNA, 24 nt, Mycobacterium avium subsp. paratuberculosis
cugcggaacccacgugcggcgccc

SEQ ID NO: 971757 - RNA, 23 nt, Mycobacterium avium subsp. paratuberculosis
cugcggaugucggugugcagcag

SEQ ID NO: 971758 - RNA, 21 nt, Mycobacterium avium subsp. paratuberculosis
cugcggcaacagcaccagcac

SEQ ID NO: 971759 - RNA, 21 nt, Mycobacterium avium subsp. paratuberculosis
cugcggauaaccguccacacc

SEQ ID NO: 971760 - RNA, 16 nt, Mycobacterium avium subsp. paratuberculosis
cugcggcacaccagcg

SEQ ID NO: 971761 - RNA, 15 nt, Mycobacterium avium subsp. paratuberculosis
cugcgggcgggccgc

SEQ ID NO: 971762 - RNA, 16 nt, Mycobacterium avium subsp. paratuberculosis
cugcgggcgggccgcc

SEQ ID NO: 971763 - RNA, 19 nt, Mycobacterium avium subsp. paratuberculosis
cugcgggucagcagcuugg

SEQ ID NO: 971764 - RNA, 18 nt, Mycobacterium avium subsp. paratuberculosis
cugcgggugcggccagcg

SEQ ID NO: 971765 - RNA, 18 nt, Mycobacterium avium subsp. paratuberculosis
cugcggccagugccgggc

SEQ ID NO: 971766 - RNA, 20 nt, Mycobacterium avium subsp. paratuberculosis
cugcggccagugccgggcca

SEQ ID NO: 971767 - RNA, 22 nt, Mycobacterium avium subsp. paratuberculosis
cugcggccagugccgggccagc

SEQ ID NO: 971768 - RNA, 20 nt, Mycobacterium avium subsp. paratuberculosis
cugcggcccagcguagaaca

SEQ ID NO: 971769 - RNA, 16 nt, Mycobacterium avium subsp. paratuberculosis
cugcggcaccucggcc

SEQ ID NO: 971770 - RNA, 17 nt, Mycobacterium avium subsp. paratuberculosis
cugcgguagaggcgggc

SEQ ID NO: 971771 - RNA, 15 nt, Mycobacterium avium subsp. paratuberculosis
cugcggguugcgggc

SEQ ID NO: 971772 - RNA, 12 nt, Mycobacterium avium subsp. paratuberculosis
cugccacgccca

SEQ ID NO: 971773 - RNA, 14 nt, Mycobacterium avium subsp. paratuberculosis
cugccacgcccacc

SEQ ID NO: 971774 - RNA, 12 nt, Mycobacterium avium subsp. paratuberculosis
cugccagggccg

SEQ ID NO: 971775 - RNA, 15 nt, Mycobacterium avium subsp. paratuberculosis
cugccagcggcgcaa

SEQ ID NO: 971776 - RNA, 23 nt, Mycobacterium avium subsp. paratuberculosis
cugccagggggaguagucggcga

SEQ ID NO: 971777 - RNA, 21 nt, Mycobacterium avium subsp. paratuberculosis
cugccagcgaauuguucugcu

SEQ ID NO: 971778 - RNA, 16 nt, Mycobacterium avium subsp. paratuberculosis
cugccagaacggcggc

SEQ ID NO: 971779 - RNA, 21 nt, Mycobacterium avium subsp. paratuberculosis
cugccagaacggcggcagcga

SEQ ID NO: 971780 - RNA, 21 nt, Mycobacterium avium subsp. paratuberculosis
cugcccaaugaucugggccgc

SEQ ID NO: 971781 - RNA, 14 nt, Mycobacterium avium subsp. paratuberculosis
cugcccaccaccag

SEQ ID NO: 971782 - RNA, 16 nt, Mycobacterium avium subsp. paratuberculosis
cugcccaccaccaggg

SEQ ID NO: 971783 - RNA, 14 nt, Mycobacterium avium subsp. paratuberculosis
cugcccaccagcag

SEQ ID NO: 971784 - RNA, 16 nt, Mycobacterium avium subsp. paratuberculosis
cugcccaccagcaggu

SEQ ID NO: 971785 - RNA, 12 nt, Mycobacterium avium subsp. paratuberculosis
cugcccggcgcu

SEQ ID NO: 971786 - RNA, 20 nt, Mycobacterium avium subsp. paratuberculosis
cugcccgacccgcaccaccg

SEQ ID NO: 971787 - RNA, 15 nt, Mycobacterium avium subsp. paratuberculosis
cugcccgacccgccu

SEQ ID NO: 971788 - RNA, 14 nt, Mycobacterium avium subsp. paratuberculosis
cugcccggccagca

SEQ ID NO: 971789 - RNA, 17 nt, Mycobacterium avium subsp. paratuberculosis
cugcccggccagcaggu

SEQ ID NO: 971790 - RNA, 17 nt, Mycobacterium avium subsp. paratuberculosis
cugcccggcccgccgcu

SEQ ID NO: 971791 - RNA, 20 nt, Mycobacterium avium subsp. paratuberculosis
cugcccgugccgcaccuggu

SEQ ID NO: 971792 - RNA, 23 nt, Mycobacterium avium subsp. paratuberculosis
cugcccgucgaccuccucgaccc

SEQ ID NO: 971793 - RNA, 19 nt, Mycobacterium avium subsp. paratuberculosis
cugcccggucugcggccgc

SEQ ID NO: 971794 - RNA, 20 nt, Mycobacterium avium subsp. paratuberculosis
cugccccggcgaggccaggc

SEQ ID NO: 971795 - RNA, 14 nt, Mycobacterium avium subsp. paratuberculosis
cugccccgcuccuc

SEQ ID NO: 971796 - RNA, 14 nt, Mycobacterium avium subsp. paratuberculosis
cugccgaccaggaa

SEQ ID NO: 971797 - RNA, 14 nt, Mycobacterium avium subsp. paratuberculosis
cugccgacgauguc

SEQ ID NO: 971798 - RNA, 16 nt, Mycobacterium avium subsp. paratuberculosis
cugccgacggucccac

SEQ ID NO: 971799 - RNA, 19 nt, Mycobacterium avium subsp. paratuberculosis
cugccgagcaucagcugcc

SEQ ID NO: 971800 - RNA, 21 nt, Mycobacterium avium subsp. paratuberculosis
cugccgagcaucagcugccgu

SEQ ID NO: 971801 - RNA, 14 nt, Mycobacterium avium subsp. paratuberculosis
cugcccucuuccuc

SEQ ID NO: 971802 - RNA, 23 nt, Mycobacterium avium subsp. paratuberculosis
cugcccucuuccucgcuguccug

SEQ ID NO: 971803 - RNA, 16 nt, Mycobacterium avium subsp. paratuberculosis
cugcccugaagcuggg

SEQ ID NO: 971804 - RNA, 16 nt, Mycobacterium avium subsp. paratuberculosis
cugccgcgccccgagc

SEQ ID NO: 971805 - RNA, 18 nt, Mycobacterium avium subsp. paratuberculosis
cugccgcgccccgagcag

SEQ ID NO: 971806 - RNA, 16 nt, Mycobacterium avium subsp. paratuberculosis
cugccgcgacucggug

SEQ ID NO: 971807 - RNA, 22 nt, Mycobacterium avium subsp. paratuberculosis
cugccgcgacucggugucgcuc

SEQ ID NO: 971808 - RNA, 17 nt, Mycobacterium avium subsp. paratuberculosis
cugccgccgcagcagcc

SEQ ID NO: 971809 - RNA, 17 nt, Mycobacterium avium subsp. paratuberculosis
cugccgccgcccaggcc

SEQ ID NO: 971810 - RNA, 20 nt, Mycobacterium avium subsp. paratuberculosis
cugccguagcgcugggugaa

SEQ ID NO: 971811 - RNA, 16 nt, Mycobacterium avium subsp. paratuberculosis
cugccguccacccggc

SEQ ID NO: 971812 - RNA, 20 nt, Mycobacterium avium subsp. paratuberculosis
cugccgucaccggccauccg

SEQ ID NO: 971813 - RNA, 14 nt, Mycobacterium avium subsp. paratuberculosis
cugccguccggcgg

SEQ ID NO: 971814 - RNA, 14 nt, Mycobacterium avium subsp. paratuberculosis
cugccguccggguc

SEQ ID NO: 971815 - RNA, 22 nt, Mycobacterium avium subsp. paratuberculosis
cugccggaccucgaccagccgg

SEQ ID NO: 971816 - RNA, 18 nt, Mycobacterium avium subsp. paratuberculosis
cugccggacaccccggcc

SEQ ID NO: 971817 - RNA, 18 nt, Mycobacterium avium subsp. paratuberculosis
cugccggcauaggccagc

SEQ ID NO: 971818 - RNA, 21 nt, Mycobacterium avium subsp. paratuberculosis
cugccggcauaggccagcacc

SEQ ID NO: 971819 - RNA, 14 nt, Mycobacterium avium subsp. paratuberculosis
cugccggccaaggc

SEQ ID NO: 971820 - RNA, 18 nt, Mycobacterium avium subsp. paratuberculosis
cugccggccaaggcaagu

SEQ ID NO: 971821 - RNA, 20 nt, Mycobacterium avium subsp. paratuberculosis
cugccggcggccgccggcac

SEQ ID NO: 971822 - RNA, 13 nt, Mycobacterium avium subsp. paratuberculosis
cugccggccgccg

SEQ ID NO: 971823 - RNA, 14 nt, Mycobacterium avium subsp. paratuberculosis
cugccggccggcag

SEQ ID NO: 971824 - RNA, 17 nt, Mycobacterium avium subsp. paratuberculosis
cugccggccguugcggg

SEQ ID NO: 971825 - RNA, 17 nt, Mycobacterium avium subsp. paratuberculosis
cugccggcgcacccgca

SEQ ID NO: 971826 - RNA, 13 nt, Mycobacterium avium subsp. paratuberculosis
cugcaccagcccg

SEQ ID NO: 971827 - RNA, 14 nt, Mycobacterium avium subsp. paratuberculosis
cugcaccagcgcgg

SEQ ID NO: 971828 - RNA, 14 nt, Mycobacterium avium subsp. paratuberculosis
cugcaccagcggcg

SEQ ID NO: 971829 - RNA, 15 nt, Mycobacterium avium subsp. paratuberculosis
cugcaccagcggcgc

SEQ ID NO: 971830 - RNA, 17 nt, Mycobacterium avium subsp. paratuberculosis
cugcaccagcggcgccc

SEQ ID NO: 971831 - RNA, 16 nt, Mycobacterium avium subsp. paratuberculosis
cugcaccagcguggug

SEQ ID NO: 971832 - RNA, 20 nt, Mycobacterium avium subsp. paratuberculosis
cugcaccagcguggugcgcc

SEQ ID NO: 971833 - RNA, 16 nt, Mycobacterium avium subsp. paratuberculosis
cugcaccggggccggc

SEQ ID NO: 971834 - RNA, 13 nt, Mycobacterium avium subsp. paratuberculosis
cugcaccuugccc

SEQ ID NO: 971835 - RNA, 13 nt, Mycobacterium avium subsp. paratuberculosis
cugcaccugggug

SEQ ID NO: 971836 - RNA, 14 nt, Mycobacterium avium subsp. paratuberculosis
cugcaccuggguga

SEQ ID NO: 971837 - RNA, 16 nt, Mycobacterium avium subsp. paratuberculosis
cugcaccugggugauc

SEQ ID NO: 971838 - RNA, 18 nt, Mycobacterium avium subsp. paratuberculosis
cugcaccgacugcggcgc

SEQ ID NO: 971839 - RNA, 22 nt, Mycobacterium avium subsp. paratuberculosis
cugcacccaccggcccagccgg

SEQ ID NO: 971840 - RNA, 21 nt, Mycobacterium avium subsp. paratuberculosis
cugcacgaugccgaccaacac

SEQ ID NO: 971841 - RNA, 23 nt, Mycobacterium avium subsp. paratuberculosis
cugcacgaugccgaccaacaccc

SEQ ID NO: 971842 - RNA, 15 nt, Mycobacterium avium subsp. paratuberculosis
cugcacgcaggccuc

SEQ ID NO: 971843 - RNA, 16 nt, Mycobacterium avium subsp. paratuberculosis
cugcacgcaggccucu

SEQ ID NO: 971844 - RNA, 19 nt, Mycobacterium avium subsp. paratuberculosis
cugcacgcguugcagcgcc

SEQ ID NO: 971845 - RNA, 20 nt, Mycobacterium avium subsp. paratuberculosis
cugcacgcguugcagcgccg

SEQ ID NO: 971846 - RNA, 14 nt, Mycobacterium avium subsp. paratuberculosis
cugcacgggcgugu

SEQ ID NO: 971847 - RNA, 17 nt, Mycobacterium avium subsp. paratuberculosis
cugcacggugcgccggc

SEQ ID NO: 971848 - RNA, 14 nt, Mycobacterium avium subsp. paratuberculosis
cugcacgucggcgg

SEQ ID NO: 971849 - RNA, 17 nt, Mycobacterium avium subsp. paratuberculosis
cugcagcaacucgcgcu

SEQ ID NO: 971850 - RNA, 18 nt, Mycobacterium avium subsp. paratuberculosis
cugcagcaacucgcgcuc

SEQ ID NO: 971851 - RNA, 20 nt, Mycobacterium avium subsp. paratuberculosis
cugcagcaacucgcgcuccc

SEQ ID NO: 971852 - RNA, 13 nt, Mycobacterium avium subsp. paratuberculosis
cugcacugcgguu

SEQ ID NO: 971853 - RNA, 22 nt, Mycobacterium avium subsp. paratuberculosis
cugcacucagagcagcgccugc

SEQ ID NO: 971854 - RNA, 20 nt, Mycobacterium avium subsp. paratuberculosis
cugcagcauccagguggcgc

SEQ ID NO: 971855 - RNA, 18 nt, Mycobacterium avium subsp. paratuberculosis
cugcagcaccaggcccuc

SEQ ID NO: 971856 - RNA, 19 nt, Mycobacterium avium subsp. paratuberculosis
cugcagcaccgaaccggcg

SEQ ID NO: 971857 - RNA, 13 nt, Mycobacterium avium subsp. paratuberculosis
cugcagcagaugc

SEQ ID NO: 971858 - RNA, 16 nt, Mycobacterium avium subsp. paratuberculosis
cugcagcagccgcugc

SEQ ID NO: 971859 - RNA, 18 nt, Mycobacterium avium subsp. paratuberculosis
cugcagcagccggaccca

SEQ ID NO: 971860 - RNA, 17 nt, Mycobacterium avium subsp. paratuberculosis
cugcagccggcgcggca

SEQ ID NO: 971861 - RNA, 14 nt, Mycobacterium avium subsp. paratuberculosis
cugcagccgggcgg

SEQ ID NO: 971862 - RNA, 15 nt, Mycobacterium avium subsp. paratuberculosis
cugcagccgggcggc

SEQ ID NO: 971863 - RNA, 23 nt, Mycobacterium avium subsp. paratuberculosis
cugcagccgggcggcggccuccg

SEQ ID NO: 971864 - RNA, 14 nt, Mycobacterium avium subsp. paratuberculosis
cugcagcgacugga

SEQ ID NO: 971865 - RNA, 20 nt, Mycobacterium avium subsp. paratuberculosis
cugcagcgagaccucccggc

SEQ ID NO: 971866 - RNA, 20 nt, Mycobacterium avium subsp. paratuberculosis
cugcagcucggugcgcaccc

SEQ ID NO: 971867 - RNA, 20 nt, Mycobacterium avium subsp. paratuberculosis
cugcagcucgccggcgcgca

SEQ ID NO: 971868 - RNA, 15 nt, Mycobacterium avium subsp. paratuberculosis
cugcagcgcccgggc

SEQ ID NO: 971869 - RNA, 20 nt, Mycobacterium avium subsp. paratuberculosis
cugcagcgcccgggccagga

SEQ ID NO: 971870 - RNA, 15 nt, Mycobacterium avium subsp. paratuberculosis
cugcagcgccgaggc

SEQ ID NO: 971871 - RNA, 16 nt, Mycobacterium avium subsp. paratuberculosis
cugcagcgccgaggcc

SEQ ID NO: 971872 - RNA, 16 nt, Mycobacterium avium subsp. paratuberculosis
cugcaggcaggccggc

SEQ ID NO: 971873 - RNA, 17 nt, Mycobacterium avium subsp. paratuberculosis
cugcaggcaggccggca

SEQ ID NO: 971874 - RNA, 14 nt, Mycobacterium avium subsp. paratuberculosis
cugcaggcccucga

SEQ ID NO: 971875 - RNA, 14 nt, Mycobacterium avium subsp. paratuberculosis
cugcaggccccagu

SEQ ID NO: 971876 - RNA, 16 nt, Mycobacterium avium subsp. paratuberculosis
cugcaggaacaaccgc

SEQ ID NO: 971877 - RNA, 22 nt, Mycobacterium avium subsp. paratuberculosis
cugcaggaacgccuugaccgcc

SEQ ID NO: 971878 - RNA, 14 nt, Mycobacterium avium subsp. paratuberculosis
cugcaggcgacgaa

SEQ ID NO: 971879 - RNA, 23 nt, Mycobacterium avium subsp. paratuberculosis
cugcaggcgacgaaaaugcccag

SEQ ID NO: 971880 - RNA, 15 nt, Mycobacterium avium subsp. paratuberculosis
cugaugguggcgcgc

SEQ ID NO: 971881 - RNA, 21 nt, Mycobacterium avium subsp. paratuberculosis
cugagguagucccgcgccugg

SEQ ID NO: 971882 - RNA, 23 nt, Mycobacterium avium subsp. paratuberculosis
cugauagcccgccgcggcgaccg

SEQ ID NO: 971883 - RNA, 17 nt, Mycobacterium avium subsp. paratuberculosis
cugaggaugguggugca

SEQ ID NO: 971884 - RNA, 22 nt, Mycobacterium avium subsp. paratuberculosis
cugaggaugguggugcaggcga

SEQ ID NO: 971885 - RNA, 19 nt, Mycobacterium avium subsp. paratuberculosis
cugaggccgccccggccgc

SEQ ID NO: 971886 - RNA, 17 nt, Mycobacterium avium subsp. paratuberculosis
cugagcuucugcccggc

SEQ ID NO: 971887 - RNA, 17 nt, Mycobacterium avium subsp. paratuberculosis
cugagcguggugaagca

SEQ ID NO: 971888 - RNA, 14 nt, Mycobacterium avium subsp. paratuberculosis
cugagcgcccgguc

SEQ ID NO: 971889 - RNA, 14 nt, Mycobacterium avium subsp. paratuberculosis
cugagcgccaggcc

SEQ ID NO: 971890 - RNA, 16 nt, Mycobacterium avium subsp. paratuberculosis
cugagcgccaggccau

SEQ ID NO: 971891 - RNA, 14 nt, Mycobacterium avium subsp. paratuberculosis
cugaccgagcagcg

SEQ ID NO: 971892 - RNA, 14 nt, Mycobacterium avium subsp. paratuberculosis
cugaccggccaccu

SEQ ID NO: 971893 - RNA, 14 nt, Mycobacterium avium subsp. paratuberculosis
cugaccgcgggccc

SEQ ID NO: 971894 - RNA, 14 nt, Mycobacterium avium subsp. paratuberculosis
cugacgcaucacca

SEQ ID NO: 971895 - RNA, 17 nt, Mycobacterium avium subsp. paratuberculosis
cugacgcaucaccacgc

SEQ ID NO: 971896 - RNA, 20 nt, Mycobacterium avium subsp. paratuberculosis
cugacgcaccucgcucagcc

SEQ ID NO: 971897 - RNA, 21 nt, Mycobacterium avium subsp. paratuberculosis
cugacgauggcgaccgcgcag

SEQ ID NO: 971898 - RNA, 19 nt, Mycobacterium avium subsp. paratuberculosis
cugacgaugauccuggccu

SEQ ID NO: 971899 - RNA, 15 nt, Mycobacterium avium subsp. paratuberculosis
cugaagugcagcgca

SEQ ID NO: 971900 - RNA, 18 nt, Mycobacterium avium subsp. paratuberculosis
cugaaugaacgaccuggu

SEQ ID NO: 971901 - RNA, 21 nt, Mycobacterium avium subsp. paratuberculosis
cugaaugaacgaccugguuga

SEQ ID NO: 971902 - RNA, 15 nt, Mycobacterium avium subsp. paratuberculosis
cugaauuccuggccg

SEQ ID NO: 971903 - RNA, 16 nt, Mycobacterium avium subsp. paratuberculosis
cugaauucggccaccg

SEQ ID NO: 971904 - RNA, 20 nt, Mycobacterium avium subsp. paratuberculosis
gaauugccuugcuccacacu

SEQ ID NO: 971905 - RNA, 14 nt, Mycobacterium avium subsp. paratuberculosis
gaauuguggcggcc

SEQ ID NO: 971906 - RNA, 17 nt, Mycobacterium avium subsp. paratuberculosis
gaauuguccagcaguuu

SEQ ID NO: 971907 - RNA, 13 nt, Mycobacterium avium subsp. paratuberculosis
gacaccaccggcc

SEQ ID NO: 971908 - RNA, 21 nt, Mycobacterium avium subsp. paratuberculosis
gacaccaccgugcuggccacc

SEQ ID NO: 971909 - RNA, 17 nt, Mycobacterium avium subsp. paratuberculosis
gacaccacggucgccgc

SEQ ID NO: 971910 - RNA, 21 nt, Mycobacterium avium subsp. paratuberculosis
gacaccacgucgucggccugc

SEQ ID NO: 971911 - RNA, 22 nt, Mycobacterium avium subsp. paratuberculosis
gacaccacgucgucggccugca

SEQ ID NO: 971912 - RNA, 16 nt, Mycobacterium avium subsp. paratuberculosis
gacaccccgcucggcc

SEQ ID NO: 971913 - RNA, 17 nt, Mycobacterium avium subsp. paratuberculosis
gacaccccgcucggcca

SEQ ID NO: 971914 - RNA, 17 nt, Mycobacterium avium subsp. paratuberculosis
gacaccccggcgaugac

SEQ ID NO: 971915 - RNA, 22 nt, Mycobacterium avium subsp. paratuberculosis
gacaccccguaggugcacagcc

SEQ ID NO: 971916 - RNA, 17 nt, Mycobacterium avium subsp. paratuberculosis
gacaacgcagguuucuc

SEQ ID NO: 971917 - RNA, 15 nt, Mycobacterium avium subsp. paratuberculosis
gaaucuuggccagca

SEQ ID NO: 971918 - RNA, 22 nt, Mycobacterium avium subsp. paratuberculosis
gaaucuuggccagcagcguggg

SEQ ID NO: 971919 - RNA, 19 nt, Mycobacterium avium subsp. paratuberculosis
gaaucgacaccgcacggcc

SEQ ID NO: 971920 - RNA, 15 nt, Mycobacterium avium subsp. paratuberculosis
gaaucgagggcgcgc

SEQ ID NO: 971921 - RNA, 22 nt, Mycobacterium avium subsp. paratuberculosis
gaauccuguugguagcccagga

SEQ ID NO: 971922 - RNA, 12 nt, Mycobacterium avium subsp. paratuberculosis
gaaucgcccggg

SEQ ID NO: 971923 - RNA, 19 nt, Mycobacterium avium subsp. paratuberculosis
gaauccaaggagaaggccg

SEQ ID NO: 971924 - RNA, 21 nt, Mycobacterium avium subsp. paratuberculosis
gaauccagccgugcggcuugc

SEQ ID NO: 971925 - RNA, 20 nt, Mycobacterium avium subsp. paratuberculosis
gaauaaggggguagauguca

SEQ ID NO: 971926 - RNA, 16 nt, Mycobacterium avium subsp. paratuberculosis
gaauacccgcccagca

SEQ ID NO: 971927 - RNA, 20 nt, Mycobacterium avium subsp. paratuberculosis
gaauacccgcccagcaccag

SEQ ID NO: 971928 - RNA, 21 nt, Mycobacterium avium subsp. paratuberculosis
gaauacccgcccagcaccagu

SEQ ID NO: 971929 - RNA, 19 nt, Mycobacterium avium subsp. paratuberculosis
gaauacccuccgggcggca

SEQ ID NO: 971930 - RNA, 19 nt, Mycobacterium avium subsp. paratuberculosis
gaauacccuucggccggca

SEQ ID NO: 971931 - RNA, 20 nt, Mycobacterium avium subsp. paratuberculosis
gaauacccuucggccggcag

SEQ ID NO: 971932 - RNA, 15 nt, Mycobacterium avium subsp. paratuberculosis
gaauaccacugcgcg

SEQ ID NO: 971933 - RNA, 12 nt, Mycobacterium avium subsp. paratuberculosis
gaaguucgcugg

SEQ ID NO: 971934 - RNA, 20 nt, Mycobacterium avium subsp. paratuberculosis
gaaguucuccagcacgaagg

SEQ ID NO: 971935 - RNA, 18 nt, Mycobacterium avium subsp. paratuberculosis
gaaguuuccccaccaggc

SEQ ID NO: 971936 - RNA, 22 nt, Mycobacterium avium subsp. paratuberculosis
aaagaucgucuugaccgcccgg

SEQ ID NO: 971937 - RNA, 18 nt, Mycobacterium avium subsp. paratuberculosis
aaagaucaaggaaccggc

SEQ ID NO: 971938 - RNA, 17 nt, Mycobacterium avium subsp. paratuberculosis
gaagucguucagcugca

SEQ ID NO: 971939 - RNA, 22 nt, Mycobacterium avium subsp. paratuberculosis
gaagucguucagcugcagccgg

SEQ ID NO: 971940 - RNA, 21 nt, Mycobacterium avium subsp. paratuberculosis
gaaguccuuguggcccaggcc

SEQ ID NO: 971941 - RNA, 18 nt, Mycobacterium avium subsp. paratuberculosis
gaaggacgucaggccggu

SEQ ID NO: 971942 - RNA, 17 nt, Mycobacterium avium subsp. paratuberculosis
gaaggccaaggccagca

SEQ ID NO: 971943 - RNA, 19 nt, Mycobacterium avium subsp. paratuberculosis
gaaggccuggaacacccag

SEQ ID NO: 971944 - RNA, 15 nt, Mycobacterium avium subsp. paratuberculosis
gaaggcgaacaccag

SEQ ID NO: 971945 - RNA, 15 nt, Mycobacterium avium subsp. paratuberculosis
gaaggucagaucguu

SEQ ID NO: 971946 - RNA, 14 nt, Mycobacterium avium subsp. paratuberculosis
gaaggcgccgaugg

SEQ ID NO: 971947 - RNA, 13 nt, Mycobacterium avium subsp. paratuberculosis
gaaggcgccgucg

SEQ ID NO: 971948 - RNA, 22 nt, Mycobacterium avium subsp. paratuberculosis
gaaggcgcgggcagggggacga

SEQ ID NO: 971949 - RNA, 15 nt, Mycobacterium avium subsp. paratuberculosis
gaaggcgcgggcguc

SEQ ID NO: 971950 - RNA, 16 nt, Mycobacterium avium subsp. paratuberculosis
gaagggcgccagcacc

SEQ ID NO: 971951 - RNA, 16 nt, Mycobacterium avium subsp. paratuberculosis
gaaggcggcgccggcc

SEQ ID NO: 971952 - RNA, 17 nt, Mycobacterium avium subsp. paratuberculosis
gaaggcggccaccgcgg

SEQ ID NO: 971953 - RNA, 23 nt, Mycobacterium avium subsp. paratuberculosis
gaaggcggccgcgagcccggcga

SEQ ID NO: 971954 - RNA, 23 nt, Mycobacterium avium subsp. paratuberculosis
gaagggcuuuagaaggccgccuc

SEQ ID NO: 971955 - RNA, 17 nt, Mycobacterium avium subsp. paratuberculosis
gaagggguccggaagcc

SEQ ID NO: 971956 - RNA, 10 nt, Mycobacterium avium subsp. paratuberculosis
gaaggggucg

SEQ ID NO: 971957 - RNA, 14 nt, Mycobacterium avium subsp. paratuberculosis
gaagcgggcggcga

SEQ ID NO: 971958 - RNA, 19 nt, Mycobacterium avium subsp. paratuberculosis
gaagcgcuaacaaaagccc

SEQ ID NO: 971959 - RNA, 17 nt, Mycobacterium avium subsp. paratuberculosis
gaagcccagcacccgcu

SEQ ID NO: 971960 - RNA, 13 nt, Mycobacterium avium subsp. paratuberculosis
gaagccccaggcc

SEQ ID NO: 971961 - RNA, 22 nt, Mycobacterium avium subsp. paratuberculosis
gaagcccgugccgaugccggcc

SEQ ID NO: 971962 - RNA, 21 nt, Mycobacterium avium subsp. paratuberculosis
gaagcgccacggggcgccgcu

SEQ ID NO: 971963 - RNA, 14 nt, Mycobacterium avium subsp. paratuberculosis
gaagcgcccgcgcg

SEQ ID NO: 971964 - RNA, 13 nt, Mycobacterium avium subsp. paratuberculosis
gaagcgcagcagc

SEQ ID NO: 971965 - RNA, 22 nt, Mycobacterium avium subsp. paratuberculosis
gaagagggcgugacgccgcugc

SEQ ID NO: 971966 - RNA, 22 nt, Mycobacterium avium subsp. paratuberculosis
gaagaguuuucacgaagaacac

SEQ ID NO: 971967 - RNA, 16 nt, Mycobacterium avium subsp. paratuberculosis
gaagcacgaccacacc

SEQ ID NO: 971968 - RNA, 14 nt, Mycobacterium avium subsp. paratuberculosis
gaagcccaccgccg

SEQ ID NO: 971969 - RNA, 12 nt, Mycobacterium avium subsp. paratuberculosis
gaagccaggugu

SEQ ID NO: 971970 - RNA, 22 nt, Mycobacterium avium subsp. paratuberculosis
gaagcagcucgcguagcgaggu

SEQ ID NO: 971971 - RNA, 21 nt, Mycobacterium avium subsp. paratuberculosis
gaagacguacggaugccccuu

SEQ ID NO: 971972 - RNA, 16 nt, Mycobacterium avium subsp. paratuberculosis
gaagacguaggcggcc

SEQ ID NO: 971973 - RNA, 20 nt, Mycobacterium avium subsp. paratuberculosis
gaagaaccgcaacaccagca

SEQ ID NO: 971974 - RNA, 12 nt, Mycobacterium avium subsp. paratuberculosis
gaacuguuuuuc

SEQ ID NO: 971975 - RNA, 17 nt, Mycobacterium avium subsp. paratuberculosis
gaacugggugccccgcc

SEQ ID NO: 971976 - RNA, 17 nt, Mycobacterium avium subsp. paratuberculosis
gaacuucuccgccggca

SEQ ID NO: 971977 - RNA, 11 nt, Mycobacterium avium subsp. paratuberculosis
gaacuuggccg

SEQ ID NO: 971978 - RNA, 21 nt, Mycobacterium avium subsp. paratuberculosis
gaacuugaccgggcuccagcg

SEQ ID NO: 971979 - RNA, 22 nt, Mycobacterium avium subsp. paratuberculosis
gacgccguugacaccgggugcg

SEQ ID NO: 971980 - RNA, 14 nt, Mycobacterium avium subsp. paratuberculosis
gacgccggccacca

SEQ ID NO: 971981 - RNA, 16 nt, Mycobacterium avium subsp. paratuberculosis
gacgccgugcugccgg

SEQ ID NO: 971982 - RNA, 22 nt, Mycobacterium avium subsp. paratuberculosis
gacgccgugguccagccggucg

SEQ ID NO: 971983 - RNA, 16 nt, Mycobacterium avium subsp. paratuberculosis
gacgccgucaucccca

SEQ ID NO: 971984 - RNA, 18 nt, Mycobacterium avium subsp. paratuberculosis
gacgccgggcagcgcgcg

SEQ ID NO: 971985 - RNA, 15 nt, Mycobacterium avium subsp. paratuberculosis
gacgccgggccgccg

SEQ ID NO: 971986 - RNA, 14 nt, Mycobacterium avium subsp. paratuberculosis
gacggagccgagca

SEQ ID NO: 971987 - RNA, 13 nt, Mycobacterium avium subsp. paratuberculosis
gacggccccccgg

SEQ ID NO: 971988 - RNA, 17 nt, Mycobacterium avium subsp. paratuberculosis
gacggccagcagggcgc

SEQ ID NO: 971989 - RNA, 19 nt, Mycobacterium avium subsp. paratuberculosis
gacggccagcagggcgccg

SEQ ID NO: 971990 - RNA, 21 nt, Mycobacterium avium subsp. paratuberculosis
gacggccagcugauagccgcc

SEQ ID NO: 971991 - RNA, 17 nt, Mycobacterium avium subsp. paratuberculosis
gacggugccgccgugcg

SEQ ID NO: 971992 - RNA, 20 nt, Mycobacterium avium subsp. paratuberculosis
gacguacgggcugaagauca

SEQ ID NO: 971993 - RNA, 23 nt, Mycobacterium avium subsp. paratuberculosis
gacguaccagcugcccaccagca

SEQ ID NO: 971994 - RNA, 22 nt, Mycobacterium avium subsp. paratuberculosis
gacguagaagucgauugccgcg

SEQ ID NO: 971995 - RNA, 21 nt, Mycobacterium avium subsp. paratuberculosis
gacggugaugucgccggcggc

SEQ ID NO: 971996 - RNA, 19 nt, Mycobacterium avium subsp. paratuberculosis
gacggugaggucgggcucg

SEQ ID NO: 971997 - RNA, 18 nt, Mycobacterium avium subsp. paratuberculosis
gacggugcaugcgcuggc

SEQ ID NO: 971998 - RNA, 21 nt, Mycobacterium avium subsp. paratuberculosis
gacggucugggaggcggcggu

SEQ ID NO: 971999 - RNA, 21 nt, Mycobacterium avium subsp. paratuberculosis
gacggugaccggcgcgcccga

SEQ ID NO: 972000 - RNA, 21 nt, Mycobacterium avium subsp. paratuberculosis
gacggucgugcugggccgggc

SEQ ID NO: 972001 - RNA, 11 nt, Mycobacterium avium subsp. paratuberculosis
gacggucagcg

SEQ ID NO: 972002 - RNA, 17 nt, Mycobacterium avium subsp. paratuberculosis
gacggucaugccgagcc

SEQ ID NO: 972003 - RNA, 17 nt, Mycobacterium avium subsp. paratuberculosis
gacggucaccggcaggc

SEQ ID NO: 972004 - RNA, 21 nt, Mycobacterium avium subsp. paratuberculosis
gacggucacggccgccagcag

SEQ ID NO: 972005 - RNA, 14 nt, Mycobacterium avium subsp. paratuberculosis
gacggcguugcugg

SEQ ID NO: 972006 - RNA, 22 nt, Mycobacterium avium subsp. paratuberculosis
gacggcgucggcgagcgguucg

SEQ ID NO: 972007 - RNA, 16 nt, Mycobacterium avium subsp. paratuberculosis
gacggcgucggcggcc

SEQ ID NO: 972008 - RNA, 23 nt, Mycobacterium avium subsp. paratuberculosis
gacggcggggcggaugcgcuggu

SEQ ID NO: 972009 - RNA, 17 nt, Mycobacterium avium subsp. paratuberculosis
gacggcgacggccagac

SEQ ID NO: 972010 - RNA, 15 nt, Mycobacterium avium subsp. paratuberculosis
gacggcgcccgcccc

SEQ ID NO: 972011 - RNA, 20 nt, Mycobacterium avium subsp. paratuberculosis
gacggcgccggacaccuugg

SEQ ID NO: 972012 - RNA, 14 nt, Mycobacterium avium subsp. paratuberculosis
gacggcgcgcccga

SEQ ID NO: 972013 - RNA, 16 nt, Mycobacterium avium subsp. paratuberculosis
gacggccggggccagc

SEQ ID NO: 972014 - RNA, 17 nt, Mycobacterium avium subsp. paratuberculosis
gacggccgcaccccacc

SEQ ID NO: 972015 - RNA, 13 nt, Mycobacterium avium subsp. paratuberculosis
gacuaagucacca

SEQ ID NO: 972016 - RNA, 18 nt, Mycobacterium avium subsp. paratuberculosis
gacguucgccgccagcac

SEQ ID NO: 972017 - RNA, 22 nt, Mycobacterium avium subsp. paratuberculosis
gacgugggugguggugccgucg

SEQ ID NO: 972018 - RNA, 20 nt, Mycobacterium avium subsp. paratuberculosis
gacgucaacaccguggugga

SEQ ID NO: 972019 - RNA, 24 nt, Mycobacterium avium subsp. paratuberculosis
gacguaggugagcaacgccagcgc

SEQ ID NO: 972020 - RNA, 13 nt, Mycobacterium avium subsp. paratuberculosis
gacgucaccaccg

SEQ ID NO: 972021 - RNA, 21 nt, Mycobacterium avium subsp. paratuberculosis
gacgucacgacggucacggcc

SEQ ID NO: 972022 - RNA, 20 nt, Mycobacterium avium subsp. paratuberculosis
gacgaacuccgcgcgcggca

SEQ ID NO: 972023 - RNA, 20 nt, Mycobacterium avium subsp. paratuberculosis
gacgaagaaggacgccucgc

SEQ ID NO: 972024 - RNA, 15 nt, Mycobacterium avium subsp. paratuberculosis
gacgaagcagcucgc

SEQ ID NO: 972025 - RNA, 16 nt, Mycobacterium avium subsp. paratuberculosis
gacgaagcagcucgcg

SEQ ID NO: 972026 - RNA, 22 nt, Mycobacterium avium subsp. paratuberculosis
gaccugggucugcggccggggc

SEQ ID NO: 972027 - RNA, 14 nt, Mycobacterium avium subsp. paratuberculosis
gaccuggucgccga

SEQ ID NO: 972028 - RNA, 14 nt, Mycobacterium avium subsp. paratuberculosis
gaccuggucgccgc

SEQ ID NO: 972029 - RNA, 22 nt, Mycobacterium avium subsp. paratuberculosis
gaccuugucgcgcacccgcacg

SEQ ID NO: 972030 - RNA, 19 nt, Mycobacterium avium subsp. paratuberculosis
gaccuugcgcagccggcag

SEQ ID NO: 972031 - RNA, 21 nt, Mycobacterium avium subsp. paratuberculosis
gaccuugcgcagccggcagca

SEQ ID NO: 972032 - RNA, 15 nt, Mycobacterium avium subsp. paratuberculosis
gaccugcgcgacggc

SEQ ID NO: 972033 - RNA, 18 nt, Mycobacterium avium subsp. paratuberculosis
gaccugcuuggcggccug

SEQ ID NO: 972034 - RNA, 14 nt, Mycobacterium avium subsp. paratuberculosis
gaccuggccggccu

SEQ ID NO: 972035 - RNA, 22 nt, Mycobacterium avium subsp. paratuberculosis
gaccugcgagauggggugaugc

SEQ ID NO: 972036 - RNA, 17 nt, Mycobacterium avium subsp. paratuberculosis
gaccggacagcugggcg

SEQ ID NO: 972037 - RNA, 16 nt, Mycobacterium avium subsp. paratuberculosis
gaccggagccgucucg

SEQ ID NO: 972038 - RNA, 14 nt, Mycobacterium avium subsp. paratuberculosis
gaccggcggccgcc

SEQ ID NO: 972039 - RNA, 22 nt, Mycobacterium avium subsp. paratuberculosis
gaccggcggcgaucggcgcggc

SEQ ID NO: 972040 - RNA, 23 nt, Mycobacterium avium subsp. paratuberculosis
gaccggcggaaguagcccggagu

SEQ ID NO: 972041 - RNA, 12 nt, Mycobacterium avium subsp. paratuberculosis
gaccggccaccu

SEQ ID NO: 972042 - RNA, 20 nt, Mycobacterium avium subsp. paratuberculosis
gaccggccaccucgucggcg

SEQ ID NO: 972043 - RNA, 14 nt, Mycobacterium avium subsp. paratuberculosis
gaccggccagcagc

SEQ ID NO: 972044 - RNA, 20 nt, Mycobacterium avium subsp. paratuberculosis
gaccggccagcauggucucg

SEQ ID NO: 972045 - RNA, 15 nt, Mycobacterium avium subsp. paratuberculosis
gaccggcccggcggc

SEQ ID NO: 972046 - RNA, 16 nt, Mycobacterium avium subsp. paratuberculosis
gaccggcccggcggcc

SEQ ID NO: 972047 - RNA, 13 nt, Mycobacterium avium subsp. paratuberculosis
gaccggccggggc

SEQ ID NO: 972048 - RNA, 14 nt, Mycobacterium avium subsp. paratuberculosis
gaccggccggggcg

SEQ ID NO: 972049 - RNA, 19 nt, Mycobacterium avium subsp. paratuberculosis
gaccggccggggcgggcac

SEQ ID NO: 972050 - RNA, 21 nt, Mycobacterium avium subsp. paratuberculosis
gacgacgugcccuuccccggc

SEQ ID NO: 972051 - RNA, 21 nt, Mycobacterium avium subsp. paratuberculosis
gacgacggucuucccgccgcc

SEQ ID NO: 972052 - RNA, 23 nt, Mycobacterium avium subsp. paratuberculosis
gacgacggucuucccgccgccgu

SEQ ID NO: 972053 - RNA, 16 nt, Mycobacterium avium subsp. paratuberculosis
gacgacggcgccgccc

SEQ ID NO: 972054 - RNA, 15 nt, Mycobacterium avium subsp. paratuberculosis
gacgacgggcagggu

SEQ ID NO: 972055 - RNA, 15 nt, Mycobacterium avium subsp. paratuberculosis
gacgacgccaccauc

SEQ ID NO: 972056 - RNA, 20 nt, Mycobacterium avium subsp. paratuberculosis
gacgacgccgauccgcagcc

SEQ ID NO: 972057 - RNA, 13 nt, Mycobacterium avium subsp. paratuberculosis
gacgacucuucca

SEQ ID NO: 972058 - RNA, 18 nt, Mycobacterium avium subsp. paratuberculosis
gacgagucccaugggcug

SEQ ID NO: 972059 - RNA, 21 nt, Mycobacterium avium subsp. paratuberculosis
gacgagucgccguuggucugc

SEQ ID NO: 972060 - RNA, 22 nt, Mycobacterium avium subsp. paratuberculosis
gacgaggugaugccguccagca

SEQ ID NO: 972061 - RNA, 18 nt, Mycobacterium avium subsp. paratuberculosis
gacgauccgggccggucg

SEQ ID NO: 972062 - RNA, 15 nt, Mycobacterium avium subsp. paratuberculosis
gacgauccgggcgcc

SEQ ID NO: 972063 - RNA, 16 nt, Mycobacterium avium subsp. paratuberculosis
gacgauacgugcuccc

SEQ ID NO: 972064 - RNA, 14 nt, Mycobacterium avium subsp. paratuberculosis
gacgcccaacuacc

SEQ ID NO: 972065 - RNA, 20 nt, Mycobacterium avium subsp. paratuberculosis
gacgcccacagcgccagcac

SEQ ID NO: 972066 - RNA, 20 nt, Mycobacterium avium subsp. paratuberculosis
gacgcccagaacgacgcgcu

SEQ ID NO: 972067 - RNA, 17 nt, Mycobacterium avium subsp. paratuberculosis
gacgcccagaacugggc

SEQ ID NO: 972068 - RNA, 22 nt, Mycobacterium avium subsp. paratuberculosis
gacgccaguucgucggccgucg

SEQ ID NO: 972069 - RNA, 15 nt, Mycobacterium avium subsp. paratuberculosis
gacgcauccacggcc

SEQ ID NO: 972070 - RNA, 11 nt, Mycobacterium avium subsp. paratuberculosis
gacgccagcac

SEQ ID NO: 972071 - RNA, 21 nt, Mycobacterium avium subsp. paratuberculosis
gacgccagcaugaucaccgcc

SEQ ID NO: 972072 - RNA, 23 nt, Mycobacterium avium subsp. paratuberculosis
gacgccagcaugaucaccgccag

SEQ ID NO: 972073 - RNA, 13 nt, Mycobacterium avium subsp. paratuberculosis
gacgcccuccugg

SEQ ID NO: 972074 - RNA, 11 nt, Mycobacterium avium subsp. paratuberculosis
gacgccccagu

SEQ ID NO: 972075 - RNA, 20 nt, Mycobacterium avium subsp. paratuberculosis
gacgcccuuggcgcccagcg

SEQ ID NO: 972076 - RNA, 16 nt, Mycobacterium avium subsp. paratuberculosis
gacgccgcgcuggccg

SEQ ID NO: 972077 - RNA, 19 nt, Mycobacterium avium subsp. paratuberculosis
gacgccgcgcagcggggcg

SEQ ID NO: 972078 - RNA, 15 nt, Mycobacterium avium subsp. paratuberculosis
gacgccgcgccgccc

SEQ ID NO: 972079 - RNA, 20 nt, Mycobacterium avium subsp. paratuberculosis
gacgccgcgguuggucacca

SEQ ID NO: 972080 - RNA, 14 nt, Mycobacterium avium subsp. paratuberculosis
gacgccgcucggcc

SEQ ID NO: 972081 - RNA, 16 nt, Mycobacterium avium subsp. paratuberculosis
gacgccggacagcugg

SEQ ID NO: 972082 - RNA, 18 nt, Mycobacterium avium subsp. paratuberculosis
gacgccggacagcuggcg

SEQ ID NO: 972083 - RNA, 18 nt, Mycobacterium avium subsp. paratuberculosis
gacgccgacaccagcgcg

SEQ ID NO: 972084 - RNA, 18 nt, Mycobacterium avium subsp. paratuberculosis
gacgccgacaucgcggcg

SEQ ID NO: 972085 - RNA, 11 nt, Mycobacterium avium subsp. paratuberculosis
gacgccgagca

SEQ ID NO: 972086 - RNA, 19 nt, Mycobacterium avium subsp. paratuberculosis
gacgccgaguaacucggcc

SEQ ID NO: 972087 - RNA, 19 nt, Mycobacterium avium subsp. paratuberculosis
gacgccgauccgcagccgc

SEQ ID NO: 972088 - RNA, 20 nt, Mycobacterium avium subsp. paratuberculosis
gacacccucgcgcaggaaca

SEQ ID NO: 972089 - RNA, 23 nt, Mycobacterium avium subsp. paratuberculosis
gacacccucgggguagccggccc

SEQ ID NO: 972090 - RNA, 17 nt, Mycobacterium avium subsp. paratuberculosis
gacacccuucaucagca

SEQ ID NO: 972091 - RNA, 15 nt, Mycobacterium avium subsp. paratuberculosis
gacaccgccagcagc

SEQ ID NO: 972092 - RNA, 20 nt, Mycobacterium avium subsp. paratuberculosis
gacaccgccagcagcgccgc

SEQ ID NO: 972093 - RNA, 23 nt, Mycobacterium avium subsp. paratuberculosis
gacaccgccuucgacggccggcc

SEQ ID NO: 972094 - RNA, 22 nt, Mycobacterium avium subsp. paratuberculosis
gacaccgcggcgacgucgugca

SEQ ID NO: 972095 - RNA, 22 nt, Mycobacterium avium subsp. paratuberculosis
gacagaugcggcaccagcccgc

SEQ ID NO: 972096 - RNA, 18 nt, Mycobacterium avium subsp. paratuberculosis
gacagccacagcucgggc

SEQ ID NO: 972097 - RNA, 14 nt, Mycobacterium avium subsp. paratuberculosis
gacagccacuccau

SEQ ID NO: 972098 - RNA, 18 nt, Mycobacterium avium subsp. paratuberculosis
gacagguucuuggcggcc

SEQ ID NO: 972099 - RNA, 21 nt, Mycobacterium avium subsp. paratuberculosis
gacagguggccgaucagcggc

SEQ ID NO: 972100 - RNA, 14 nt, Mycobacterium avium subsp. paratuberculosis
gacagguggggcac

SEQ ID NO: 972101 - RNA, 15 nt, Mycobacterium avium subsp. paratuberculosis
gacagguggggcacc

SEQ ID NO: 972102 - RNA, 21 nt, Mycobacterium avium subsp. paratuberculosis
gacagguagcgcagcccgguu

SEQ ID NO: 972103 - RNA, 14 nt, Mycobacterium avium subsp. paratuberculosis
gacaggggcagcag

SEQ ID NO: 972104 - RNA, 15 nt, Mycobacterium avium subsp. paratuberculosis
gacaggggcagcagc

SEQ ID NO: 972105 - RNA, 16 nt, Mycobacterium avium subsp. paratuberculosis
gacaggggcagcagca

SEQ ID NO: 972106 - RNA, 13 nt, Mycobacterium avium subsp. paratuberculosis
gacagggcggcga

SEQ ID NO: 972107 - RNA, 15 nt, Mycobacterium avium subsp. paratuberculosis
gacaggcccagcggc

SEQ ID NO: 972108 - RNA, 20 nt, Mycobacterium avium subsp. paratuberculosis
gacagccgcgccgacagaug

SEQ ID NO: 972109 - RNA, 19 nt, Mycobacterium avium subsp. paratuberculosis
gacaggcggucgugucagg

SEQ ID NO: 972110 - RNA, 16 nt, Mycobacterium avium subsp. paratuberculosis
gacagccgagauggca

SEQ ID NO: 972111 - RNA, 23 nt, Mycobacterium avium subsp. paratuberculosis
gacaggccggccgcuacccggcg

SEQ ID NO: 972112 - RNA, 20 nt, Mycobacterium avium subsp. paratuberculosis
gacaugcccggcgacggcgc

SEQ ID NO: 972113 - RNA, 23 nt, Mycobacterium avium subsp. paratuberculosis
gacauguccgggauggacgacgu

SEQ ID NO: 972114 - RNA, 20 nt, Mycobacterium avium subsp. paratuberculosis
gacaucgaaugcagcggcuc

SEQ ID NO: 972115 - RNA, 16 nt, Mycobacterium avium subsp. paratuberculosis
gacaucgccaccugga

SEQ ID NO: 972116 - RNA, 19 nt, Mycobacterium avium subsp. paratuberculosis
gacaucgccaucagcagcg

SEQ ID NO: 972117 - RNA, 15 nt, Mycobacterium avium subsp. paratuberculosis
gacaucgccgcggcc

SEQ ID NO: 972118 - RNA, 16 nt, Mycobacterium avium subsp. paratuberculosis
gacauccauugggccg

SEQ ID NO: 972119 - RNA, 15 nt, Mycobacterium avium subsp. paratuberculosis
gacaguuaggucuug

SEQ ID NO: 972120 - RNA, 17 nt, Mycobacterium avium subsp. paratuberculosis
gacauuggccgcgcgca

SEQ ID NO: 972121 - RNA, 19 nt, Mycobacterium avium subsp. paratuberculosis
gacauuggccgcgcgcagg

SEQ ID NO: 972122 - RNA, 14 nt, Mycobacterium avium subsp. paratuberculosis
gacauugggggcuu

SEQ ID NO: 972123 - RNA, 18 nt, Mycobacterium avium subsp. paratuberculosis
gacaugugagguggcugg

SEQ ID NO: 972124 - RNA, 19 nt, Mycobacterium avium subsp. paratuberculosis
gaccaauugcgagcaggcc

SEQ ID NO: 972125 - RNA, 16 nt, Mycobacterium avium subsp. paratuberculosis
gaccaccacgaccagu

SEQ ID NO: 972126 - RNA, 16 nt, Mycobacterium avium subsp. paratuberculosis
gaccaccacggccgca

SEQ ID NO: 972127 - RNA, 12 nt, Mycobacterium avium subsp. paratuberculosis
gaccaccaggua

SEQ ID NO: 972128 - RNA, 20 nt, Mycobacterium avium subsp. paratuberculosis
gaccaccaggagcaccugcg

SEQ ID NO: 972129 - RNA, 22 nt, Mycobacterium avium subsp. paratuberculosis
gaccacaugccguugccaggcc

SEQ ID NO: 972130 - RNA, 15 nt, Mycobacterium avium subsp. paratuberculosis
gaccacacccgcacg

SEQ ID NO: 972131 - RNA, 19 nt, Mycobacterium avium subsp. paratuberculosis
gaccauaaucggcucgugg

SEQ ID NO: 972132 - RNA, 19 nt, Mycobacterium avium subsp. paratuberculosis
gaccaucauggccucccca

SEQ ID NO: 972133 - RNA, 19 nt, Mycobacterium avium subsp. paratuberculosis
gaccaugucggcgacccgc

SEQ ID NO: 972134 - RNA, 14 nt, Mycobacterium avium subsp. paratuberculosis
gaccaugccgccga

SEQ ID NO: 972135 - RNA, 19 nt, Mycobacterium avium subsp. paratuberculosis
gaccaugccgcgggccagc

SEQ ID NO: 972136 - RNA, 23 nt, Mycobacterium avium subsp. paratuberculosis
gaccaugccgcgggccagcagcc

SEQ ID NO: 972137 - RNA, 14 nt, Mycobacterium avium subsp. paratuberculosis
gacccaggccgccg

SEQ ID NO: 972138 - RNA, 15 nt, Mycobacterium avium subsp. paratuberculosis
gacccaggccgccgc

SEQ ID NO: 972139 - RNA, 13 nt, Mycobacterium avium subsp. paratuberculosis
gacccagcuccuc

SEQ ID NO: 972140 - RNA, 23 nt, Mycobacterium avium subsp. paratuberculosis
gacccagcuccucggccagcacc

SEQ ID NO: 972141 - RNA, 22 nt, Mycobacterium avium subsp. paratuberculosis
gaccacgaucugcuuggucacc

SEQ ID NO: 972142 - RNA, 20 nt, Mycobacterium avium subsp. paratuberculosis
gaccaccuugcgcagcagca

SEQ ID NO: 972143 - RNA, 23 nt, Mycobacterium avium subsp. paratuberculosis
gaccacgaagggcgccagcaccu

SEQ ID NO: 972144 - RNA, 20 nt, Mycobacterium avium subsp. paratuberculosis
gaccaccgcuguggacaggu

SEQ ID NO: 972145 - RNA, 20 nt, Mycobacterium avium subsp. paratuberculosis
gaccacccucagggagcugc

SEQ ID NO: 972146 - RNA, 22 nt, Mycobacterium avium subsp. paratuberculosis
gaccacccucagggagcugccc

SEQ ID NO: 972147 - RNA, 20 nt, Mycobacterium avium subsp. paratuberculosis
gaccaccgccggcccggcgu

SEQ ID NO: 972148 - RNA, 16 nt, Mycobacterium avium subsp. paratuberculosis
gaccacccacucccag

SEQ ID NO: 972149 - RNA, 17 nt, Mycobacterium avium subsp. paratuberculosis
gaccacccgcagcgcgg

SEQ ID NO: 972150 - RNA, 18 nt, Mycobacterium avium subsp. paratuberculosis
gaccacccgcagcgcggc

SEQ ID NO: 972151 - RNA, 14 nt, Mycobacterium avium subsp. paratuberculosis
gaccacccgcagcu

SEQ ID NO: 972152 - RNA, 21 nt, Mycobacterium avium subsp. paratuberculosis
gaccaccaugauguagcggcg

SEQ ID NO: 972153 - RNA, 15 nt, Mycobacterium avium subsp. paratuberculosis
gaccacgccgugccc

SEQ ID NO: 972154 - RNA, 15 nt, Mycobacterium avium subsp. paratuberculosis
gaccagcggcgcgcc

SEQ ID NO: 972155 - RNA, 16 nt, Mycobacterium avium subsp. paratuberculosis
gaccagcggcgcgccg

SEQ ID NO: 972156 - RNA, 14 nt, Mycobacterium avium subsp. paratuberculosis
gaccagcggcagca

SEQ ID NO: 972157 - RNA, 21 nt, Mycobacterium avium subsp. paratuberculosis
gaccagcgggaugaaggcacc

SEQ ID NO: 972158 - RNA, 19 nt, Mycobacterium avium subsp. paratuberculosis
gaccagcgggccgacagca

SEQ ID NO: 972159 - RNA, 23 nt, Mycobacterium avium subsp. paratuberculosis
gaccagcgggccgacagcacgcc

SEQ ID NO: 972160 - RNA, 21 nt, Mycobacterium avium subsp. paratuberculosis
gaccagcgccucggccugcgc

SEQ ID NO: 972161 - RNA, 16 nt, Mycobacterium avium subsp. paratuberculosis
gaccagcgcgccgccc

SEQ ID NO: 972162 - RNA, 23 nt, Mycobacterium avium subsp. paratuberculosis
gaccagcgcgccgcccagcggcc

SEQ ID NO: 972163 - RNA, 23 nt, Mycobacterium avium subsp. paratuberculosis
gaccagcgcgccggccagcagca

SEQ ID NO: 972164 - RNA, 16 nt, Mycobacterium avium subsp. paratuberculosis
gaccagcggcagcacg

SEQ ID NO: 972165 - RNA, 17 nt, Mycobacterium avium subsp. paratuberculosis
gaccagcggcagcacgu

SEQ ID NO: 972166 - RNA, 15 nt, Mycobacterium avium subsp. paratuberculosis
gaccagcggcagcag

SEQ ID NO: 972167 - RNA, 18 nt, Mycobacterium avium subsp. paratuberculosis
gaccagcggcagcagcac

SEQ ID NO: 972168 - RNA, 14 nt, Mycobacterium avium subsp. paratuberculosis
gaccacgcuccaga

SEQ ID NO: 972169 - RNA, 20 nt, Mycobacterium avium subsp. paratuberculosis
gaccacgcugagcaaccgcc

SEQ ID NO: 972170 - RNA, 17 nt, Mycobacterium avium subsp. paratuberculosis
gaccacgcacaccaccg

SEQ ID NO: 972171 - RNA, 15 nt, Mycobacterium avium subsp. paratuberculosis
gaccgacauggccag

SEQ ID NO: 972172 - RNA, 20 nt, Mycobacterium avium subsp. paratuberculosis
gaccgacauggccagcacca

SEQ ID NO: 972173 - RNA, 15 nt, Mycobacterium avium subsp. paratuberculosis
gaccgagcagcgggg

SEQ ID NO: 972174 - RNA, 15 nt, Mycobacterium avium subsp. paratuberculosis
gaccgagggcgcggg

SEQ ID NO: 972175 - RNA, 17 nt, Mycobacterium avium subsp. paratuberculosis
gaccgccaccacccggc

SEQ ID NO: 972176 - RNA, 23 nt, Mycobacterium avium subsp. paratuberculosis
gaccgagaugaagacccggccgu

SEQ ID NO: 972177 - RNA, 17 nt, Mycobacterium avium subsp. paratuberculosis
gaccccccgacgccgac

SEQ ID NO: 972178 - RNA, 16 nt, Mycobacterium avium subsp. paratuberculosis
gaccccagugcaggcu

SEQ ID NO: 972179 - RNA, 19 nt, Mycobacterium avium subsp. paratuberculosis
gacccccucggggcucacc

SEQ ID NO: 972180 - RNA, 15 nt, Mycobacterium avium subsp. paratuberculosis
gaccccgccagcacc

SEQ ID NO: 972181 - RNA, 16 nt, Mycobacterium avium subsp. paratuberculosis
gaccccgccagcaccg

SEQ ID NO: 972182 - RNA, 20 nt, Mycobacterium avium subsp. paratuberculosis
gaccccggccccggccggcg

SEQ ID NO: 972183 - RNA, 23 nt, Mycobacterium avium subsp. paratuberculosis
gaccccgguuucguuguccacca

SEQ ID NO: 972184 - RNA, 16 nt, Mycobacterium avium subsp. paratuberculosis
gaccccguaccagcgc

SEQ ID NO: 972185 - RNA, 20 nt, Mycobacterium avium subsp. paratuberculosis
gaccccguucgccgacagca

SEQ ID NO: 972186 - RNA, 19 nt, Mycobacterium avium subsp. paratuberculosis
gaccccuccaacggccgca

SEQ ID NO: 972187 - RNA, 16 nt, Mycobacterium avium subsp. paratuberculosis
gacccgaaccggauca

SEQ ID NO: 972188 - RNA, 17 nt, Mycobacterium avium subsp. paratuberculosis
gaccgccgacaccaccg

SEQ ID NO: 972189 - RNA, 20 nt, Mycobacterium avium subsp. paratuberculosis
gaccgccagacugaugcccu

SEQ ID NO: 972190 - RNA, 23 nt, Mycobacterium avium subsp. paratuberculosis
gaccgccucgucgaaggucugca

SEQ ID NO: 972191 - RNA, 14 nt, Mycobacterium avium subsp. paratuberculosis
gaccgccgcggccg

SEQ ID NO: 972192 - RNA, 22 nt, Mycobacterium avium subsp. paratuberculosis
gaccgccgcggccgccuucacg

SEQ ID NO: 972193 - RNA, 16 nt, Mycobacterium avium subsp. paratuberculosis
gaccgccgcggcggcc

SEQ ID NO: 972194 - RNA, 16 nt, Mycobacterium avium subsp. paratuberculosis
gaccgccgagcgggcg

SEQ ID NO: 972195 - RNA, 15 nt, Mycobacterium avium subsp. paratuberculosis
gaccgcguccgaggc

SEQ ID NO: 972196 - RNA, 20 nt, Mycobacterium avium subsp. paratuberculosis
gaccgcguccgaggcgguuc

SEQ ID NO: 972197 - RNA, 19 nt, Mycobacterium avium subsp. paratuberculosis
gaccgcgaucagccccagg

SEQ ID NO: 972198 - RNA, 14 nt, Mycobacterium avium subsp. paratuberculosis
gaccgcgcgcggcg

SEQ ID NO: 972199 - RNA, 18 nt, Mycobacterium avium subsp. paratuberculosis
gaccgcgcgcggcgccgc

SEQ ID NO: 972200 - RNA, 14 nt, Mycobacterium avium subsp. paratuberculosis
gaccgcggcgggca

SEQ ID NO: 972201 - RNA, 17 nt, Mycobacterium avium subsp. paratuberculosis
gaccgcggcuccggccg

SEQ ID NO: 972202 - RNA, 12 nt, Mycobacterium avium subsp. paratuberculosis
gaccgcggccug

SEQ ID NO: 972203 - RNA, 19 nt, Mycobacterium avium subsp. paratuberculosis
gaccgcggcgauggugggc

SEQ ID NO: 972204 - RNA, 17 nt, Mycobacterium avium subsp. paratuberculosis
gaaccugcugggcggca

SEQ ID NO: 972205 - RNA, 21 nt, Mycobacterium avium subsp. paratuberculosis
gaaccuggccaccagcagcag

SEQ ID NO: 972206 - RNA, 15 nt, Mycobacterium avium subsp. paratuberculosis
gaacgaccgggugaa

SEQ ID NO: 972207 - RNA, 14 nt, Mycobacterium avium subsp. paratuberculosis
gaacgacagcagga

SEQ ID NO: 972208 - RNA, 17 nt, Mycobacterium avium subsp. paratuberculosis
gaacgacuggcggcggc

SEQ ID NO: 972209 - RNA, 12 nt, Mycobacterium avium subsp. paratuberculosis
gaacgacgccac

SEQ ID NO: 972210 - RNA, 15 nt, Mycobacterium avium subsp. paratuberculosis
gaaccguuugucccu

SEQ ID NO: 972211 - RNA, 22 nt, Mycobacterium avium subsp. paratuberculosis
gaaccguucgucgucgcgcagg

SEQ ID NO: 972212 - RNA, 15 nt, Mycobacterium avium subsp. paratuberculosis
gaaccgucccacacg

SEQ ID NO: 972213 - RNA, 19 nt, Mycobacterium avium subsp. paratuberculosis
gaaccggucguuggccucc

SEQ ID NO: 972214 - RNA, 17 nt, Mycobacterium avium subsp. paratuberculosis
gaaccucgcggcggcgu

SEQ ID NO: 972215 - RNA, 19 nt, Mycobacterium avium subsp. paratuberculosis
gaaccgaucaccggcagca

SEQ ID NO: 972216 - RNA, 22 nt, Mycobacterium avium subsp. paratuberculosis
gaaccgacaccucgccguccuu

SEQ ID NO: 972217 - RNA, 13 nt, Mycobacterium avium subsp. paratuberculosis
gaacccugcccca

SEQ ID NO: 972218 - RNA, 20 nt, Mycobacterium avium subsp. paratuberculosis
gaacccguggauggacgccc

SEQ ID NO: 972219 - RNA, 19 nt, Mycobacterium avium subsp. paratuberculosis
gaacccggguggcccgcac

SEQ ID NO: 972220 - RNA, 17 nt, Mycobacterium avium subsp. paratuberculosis
gaaccgccgcacccagc

SEQ ID NO: 972221 - RNA, 19 nt, Mycobacterium avium subsp. paratuberculosis
gaaccgccgcacccagcgg

SEQ ID NO: 972222 - RNA, 14 nt, Mycobacterium avium subsp. paratuberculosis
gaaccggcagccgg

SEQ ID NO: 972223 - RNA, 22 nt, Mycobacterium avium subsp. paratuberculosis
gaaccggcaggacgggggccgg

SEQ ID NO: 972224 - RNA, 20 nt, Mycobacterium avium subsp. paratuberculosis
gaaccggaagaucagcaggc

SEQ ID NO: 972225 - RNA, 17 nt, Mycobacterium avium subsp. paratuberculosis
gaaccgcucggcggcgc

SEQ ID NO: 972226 - RNA, 16 nt, Mycobacterium avium subsp. paratuberculosis
gaaccgcugcuccggg

SEQ ID NO: 972227 - RNA, 22 nt, Mycobacterium avium subsp. paratuberculosis
gaaccgcugcugcucggccgca

SEQ ID NO: 972228 - RNA, 11 nt, Mycobacterium avium subsp. paratuberculosis
gaaccggggcc

SEQ ID NO: 972229 - RNA, 14 nt, Mycobacterium avium subsp. paratuberculosis
gaaccggggccagc

SEQ ID NO: 972230 - RNA, 15 nt, Mycobacterium avium subsp. paratuberculosis
gaaccggggccgcac

SEQ ID NO: 972231 - RNA, 17 nt, Mycobacterium avium subsp. paratuberculosis
gaaccgggccgcuggcc

SEQ ID NO: 972232 - RNA, 21 nt, Mycobacterium avium subsp. paratuberculosis
gaaccgggcacccggcgcggc

SEQ ID NO: 972233 - RNA, 17 nt, Mycobacterium avium subsp. paratuberculosis
gaaccgggccaggauga

SEQ ID NO: 972234 - RNA, 16 nt, Mycobacterium avium subsp. paratuberculosis
gaaccgggucagcacc

SEQ ID NO: 972235 - RNA, 17 nt, Mycobacterium avium subsp. paratuberculosis
gaaccgggucagcacca

SEQ ID NO: 972236 - RNA, 14 nt, Mycobacterium avium subsp. paratuberculosis
gaacccaccagcgc

SEQ ID NO: 972237 - RNA, 17 nt, Mycobacterium avium subsp. paratuberculosis
gaacccacgugcggcgc

SEQ ID NO: 972238 - RNA, 12 nt, Mycobacterium avium subsp. paratuberculosis
gaacccagcacc

SEQ ID NO: 972239 - RNA, 21 nt, Mycobacterium avium subsp. paratuberculosis
gaaccauuugcccagcagggc

SEQ ID NO: 972240 - RNA, 22 nt, Mycobacterium avium subsp. paratuberculosis
gaaccauuugcccagcagggcg

SEQ ID NO: 972241 - RNA, 19 nt, Mycobacterium avium subsp. paratuberculosis
gaaccagcaccgccgcggc

SEQ ID NO: 972242 - RNA, 15 nt, Mycobacterium avium subsp. paratuberculosis
gaaccaguucgccac

SEQ ID NO: 972243 - RNA, 17 nt, Mycobacterium avium subsp. paratuberculosis
gaaccaguucgccacca

SEQ ID NO: 972244 - RNA, 20 nt, Mycobacterium avium subsp. paratuberculosis
gaaccagcaugcgccagagc

SEQ ID NO: 972245 - RNA, 16 nt, Mycobacterium avium subsp. paratuberculosis
gaaccagggcagccag

SEQ ID NO: 972246 - RNA, 17 nt, Mycobacterium avium subsp. paratuberculosis
gaaccagggcagccagc

SEQ ID NO: 972247 - RNA, 18 nt, Mycobacterium avium subsp. paratuberculosis
gaaccagggcagccagcc

SEQ ID NO: 972248 - RNA, 22 nt, Mycobacterium avium subsp. paratuberculosis
gaaccaggccgcgcuggcgcag

SEQ ID NO: 972249 - RNA, 20 nt, Mycobacterium avium subsp. paratuberculosis
gaaccaggcgccggccagca

SEQ ID NO: 972250 - RNA, 18 nt, Mycobacterium avium subsp. paratuberculosis
gaaccagcucgugcagcu

SEQ ID NO: 972251 - RNA, 20 nt, Mycobacterium avium subsp. paratuberculosis
gaaccacaccccggccacca

SEQ ID NO: 972252 - RNA, 15 nt, Mycobacterium avium subsp. paratuberculosis
gaaccaccggaaggc

SEQ ID NO: 972253 - RNA, 20 nt, Mycobacterium avium subsp. paratuberculosis
gaaccaccggaaggccaggu

SEQ ID NO: 972254 - RNA, 19 nt, Mycobacterium avium subsp. paratuberculosis
gaaccaacugagcgcggcg

SEQ ID NO: 972255 - RNA, 20 nt, Mycobacterium avium subsp. paratuberculosis
gaacugaagcuucaagauag

SEQ ID NO: 972256 - RNA, 15 nt, Mycobacterium avium subsp. paratuberculosis
gaacucgucgccacc

SEQ ID NO: 972257 - RNA, 14 nt, Mycobacterium avium subsp. paratuberculosis
gaacucggccagcu

SEQ ID NO: 972258 - RNA, 15 nt, Mycobacterium avium subsp. paratuberculosis
gaacucgcgggcgag

SEQ ID NO: 972259 - RNA, 14 nt, Mycobacterium avium subsp. paratuberculosis
gaacugcucgacca

SEQ ID NO: 972260 - RNA, 15 nt, Mycobacterium avium subsp. paratuberculosis
gaacugauugcccuu

SEQ ID NO: 972261 - RNA, 12 nt, Mycobacterium avium subsp. paratuberculosis
gaacugcagccc

SEQ ID NO: 972262 - RNA, 11 nt, Mycobacterium avium subsp. paratuberculosis
gaacugccgcg

SEQ ID NO: 972263 - RNA, 14 nt, Mycobacterium avium subsp. paratuberculosis
gaacugccgcggca

SEQ ID NO: 972264 - RNA, 23 nt, Mycobacterium avium subsp. paratuberculosis
gaacugccggcauaggccagcac

SEQ ID NO: 972265 - RNA, 20 nt, Mycobacterium avium subsp. paratuberculosis
gaacuacuucgucagcagcg

SEQ ID NO: 972266 - RNA, 17 nt, Mycobacterium avium subsp. paratuberculosis
gaacuccagaucgccgc

SEQ ID NO: 972267 - RNA, 14 nt, Mycobacterium avium subsp. paratuberculosis
gaacuccagcagcu

SEQ ID NO: 972268 - RNA, 19 nt, Mycobacterium avium subsp. paratuberculosis
gaacuccugcucgcgggcc

SEQ ID NO: 972269 - RNA, 17 nt, Mycobacterium avium subsp. paratuberculosis
gaacucgaucugcagcc

SEQ ID NO: 972270 - RNA, 19 nt, Mycobacterium avium subsp. paratuberculosis
gaacgggugaccggcggcc

SEQ ID NO: 972271 - RNA, 17 nt, Mycobacterium avium subsp. paratuberculosis
gaacgggugcggcgcuc

SEQ ID NO: 972272 - RNA, 13 nt, Mycobacterium avium subsp. paratuberculosis
gaacgggccggcg

SEQ ID NO: 972273 - RNA, 21 nt, Mycobacterium avium subsp. paratuberculosis
gaacgggccgggcaccgcgcc

SEQ ID NO: 972274 - RNA, 24 nt, Mycobacterium avium subsp. paratuberculosis
gaacggcccgccgccggcggcguc

SEQ ID NO: 972275 - RNA, 21 nt, Mycobacterium avium subsp. paratuberculosis
gaacggcaaccugggcggcgg

SEQ ID NO: 972276 - RNA, 18 nt, Mycobacterium avium subsp. paratuberculosis
gaacggcaacggcggcgg

SEQ ID NO: 972277 - RNA, 12 nt, Mycobacterium avium subsp. paratuberculosis
gaacggucagcc

SEQ ID NO: 972278 - RNA, 19 nt, Mycobacterium avium subsp. paratuberculosis
gaacggucggggcggcggg

SEQ ID NO: 972279 - RNA, 16 nt, Mycobacterium avium subsp. paratuberculosis
gaacgucaccaacaug

SEQ ID NO: 972280 - RNA, 21 nt, Mycobacterium avium subsp. paratuberculosis
gaacgucaggauccaguucca

SEQ ID NO: 972281 - RNA, 22 nt, Mycobacterium avium subsp. paratuberculosis
gaacgucaggcccagcgaggcg

SEQ ID NO: 972282 - RNA, 18 nt, Mycobacterium avium subsp. paratuberculosis
gaacgucccguuggucuc

SEQ ID NO: 972283 - RNA, 19 nt, Mycobacterium avium subsp. paratuberculosis
gaacgucccguuggucucg

SEQ ID NO: 972284 - RNA, 13 nt, Mycobacterium avium subsp. paratuberculosis
gaacgucgauccc

SEQ ID NO: 972285 - RNA, 15 nt, Mycobacterium avium subsp. paratuberculosis
gaacgaggccgacgu

SEQ ID NO: 972286 - RNA, 18 nt, Mycobacterium avium subsp. paratuberculosis
gaacgauggugugcagca

SEQ ID NO: 972287 - RNA, 14 nt, Mycobacterium avium subsp. paratuberculosis
gaacgcaacagggc

SEQ ID NO: 972288 - RNA, 18 nt, Mycobacterium avium subsp. paratuberculosis
gaacgcaagaagucggug

SEQ ID NO: 972289 - RNA, 15 nt, Mycobacterium avium subsp. paratuberculosis
gaacgcacucggugu

SEQ ID NO: 972290 - RNA, 19 nt, Mycobacterium avium subsp. paratuberculosis
gaacgccaucaccagcgcg

SEQ ID NO: 972291 - RNA, 13 nt, Mycobacterium avium subsp. paratuberculosis
gaacgccagcagc

SEQ ID NO: 972292 - RNA, 14 nt, Mycobacterium avium subsp. paratuberculosis
gaacgccagcagcc

SEQ ID NO: 972293 - RNA, 20 nt, Mycobacterium avium subsp. paratuberculosis
gaacgccagcagccgcagca

SEQ ID NO: 972294 - RNA, 23 nt, Mycobacterium avium subsp. paratuberculosis
gaacgccucgaucagagcgggcc

SEQ ID NO: 972295 - RNA, 18 nt, Mycobacterium avium subsp. paratuberculosis
gaacgccucgggccggca

SEQ ID NO: 972296 - RNA, 15 nt, Mycobacterium avium subsp. paratuberculosis
gaacgcgccccgccg

SEQ ID NO: 972297 - RNA, 15 nt, Mycobacterium avium subsp. paratuberculosis
gaacgcgcccggcgg

SEQ ID NO: 972298 - RNA, 23 nt, Mycobacterium avium subsp. paratuberculosis
gaacgcgccgccgagcaacagcc

SEQ ID NO: 972299 - RNA, 14 nt, Mycobacterium avium subsp. paratuberculosis
gaacgcggacagcu

SEQ ID NO: 972300 - RNA, 21 nt, Mycobacterium avium subsp. paratuberculosis
gaacgcggacagcucgccggc

SEQ ID NO: 972301 - RNA, 17 nt, Mycobacterium avium subsp. paratuberculosis
gaacgcgucgaccgccg

SEQ ID NO: 972302 - RNA, 12 nt, Mycobacterium avium subsp. paratuberculosis
gaacgcggcgga

SEQ ID NO: 972303 - RNA, 22 nt, Mycobacterium avium subsp. paratuberculosis
gaacacggcucgggggccgcuc

SEQ ID NO: 972304 - RNA, 19 nt, Mycobacterium avium subsp. paratuberculosis
gaacacguacagcggcggc

SEQ ID NO: 972305 - RNA, 15 nt, Mycobacterium avium subsp. paratuberculosis
gaacacgaacccggc

SEQ ID NO: 972306 - RNA, 13 nt, Mycobacterium avium subsp. paratuberculosis
gaacagcaccgcc

SEQ ID NO: 972307 - RNA, 14 nt, Mycobacterium avium subsp. paratuberculosis
gaacagcaccgcca

SEQ ID NO: 972308 - RNA, 14 nt, Mycobacterium avium subsp. paratuberculosis
gaacagcagcaccc

SEQ ID NO: 972309 - RNA, 16 nt, Mycobacterium avium subsp. paratuberculosis
gaacagcagcagcagc

SEQ ID NO: 972310 - RNA, 11 nt, Mycobacterium avium subsp. paratuberculosis
gaacagcagcg

SEQ ID NO: 972311 - RNA, 23 nt, Mycobacterium avium subsp. paratuberculosis
gaacagcagaaaauagcccagcc

SEQ ID NO: 972312 - RNA, 11 nt, Mycobacterium avium subsp. paratuberculosis
gaacagcagca

SEQ ID NO: 972313 - RNA, 14 nt, Mycobacterium avium subsp. paratuberculosis
gaacagccaggcga

SEQ ID NO: 972314 - RNA, 16 nt, Mycobacterium avium subsp. paratuberculosis
gaacagcgggccggcg

SEQ ID NO: 972315 - RNA, 22 nt, Mycobacterium avium subsp. paratuberculosis
gaacagcggggugcccaccacc

SEQ ID NO: 972316 - RNA, 18 nt, Mycobacterium avium subsp. paratuberculosis
gaacagcggguucuucag

SEQ ID NO: 972317 - RNA, 17 nt, Mycobacterium avium subsp. paratuberculosis
gaacagcgucaggucac

SEQ ID NO: 972318 - RNA, 20 nt, Mycobacterium avium subsp. paratuberculosis
gaacagcagcgcgccgacca

SEQ ID NO: 972319 - RNA, 18 nt, Mycobacterium avium subsp. paratuberculosis
gaacagcaggcccaggcc

SEQ ID NO: 972320 - RNA, 23 nt, Mycobacterium avium subsp. paratuberculosis
gaacagcaggcccaggccgaugg

SEQ ID NO: 972321 - RNA, 18 nt, Mycobacterium avium subsp. paratuberculosis
gaacaggccgagcgcgcu

SEQ ID NO: 972322 - RNA, 15 nt, Mycobacterium avium subsp. paratuberculosis
gaacaggaugcagcc

SEQ ID NO: 972323 - RNA, 17 nt, Mycobacterium avium subsp. paratuberculosis
gaacaggaugcggguga

SEQ ID NO: 972324 - RNA, 18 nt, Mycobacterium avium subsp. paratuberculosis
gaacagcuuggcgcagcc

SEQ ID NO: 972325 - RNA, 23 nt, Mycobacterium avium subsp. paratuberculosis
gaaaugcaacgcacgggcggcgg

SEQ ID NO: 972326 - RNA, 13 nt, Mycobacterium avium subsp. paratuberculosis
gaaaucgcagacg

SEQ ID NO: 972327 - RNA, 16 nt, Mycobacterium avium subsp. paratuberculosis
gaaaucggacccagcc

SEQ ID NO: 972328 - RNA, 16 nt, Mycobacterium avium subsp. paratuberculosis
gaaauucaggccacgc

SEQ ID NO: 972329 - RNA, 21 nt, Mycobacterium avium subsp. paratuberculosis
gaaacucaccgcgucagcagc

SEQ ID NO: 972330 - RNA, 18 nt, Mycobacterium avium subsp. paratuberculosis
gaaagcgcuuucgcuggu

SEQ ID NO: 972331 - RNA, 18 nt, Mycobacterium avium subsp. paratuberculosis
gaaaguacggcauggaca

SEQ ID NO: 972332 - RNA, 22 nt, Mycobacterium avium subsp. paratuberculosis
gaaauccggggucagggcgcuc

SEQ ID NO: 972333 - RNA, 12 nt, Mycobacterium avium subsp. paratuberculosis
gaaaaccagcac

SEQ ID NO: 972334 - RNA, 13 nt, Mycobacterium avium subsp. paratuberculosis
gaaaaccccaccc

SEQ ID NO: 972335 - RNA, 21 nt, Mycobacterium avium subsp. paratuberculosis
gaaaaccccaccccgagcagg

SEQ ID NO: 972336 - RNA, 14 nt, Mycobacterium avium subsp. paratuberculosis
gaaaaaacggcggc

SEQ ID NO: 972337 - RNA, 17 nt, Mycobacterium avium subsp. paratuberculosis
cuuuugugucugcucgc

SEQ ID NO: 972338 - RNA, 20 nt, Mycobacterium avium subsp. paratuberculosis
cuuuuugaccaccggcacca

SEQ ID NO: 972339 - RNA, 19 nt, Mycobacterium avium subsp. paratuberculosis
cuuuuccaucugggcgcgc

SEQ ID NO: 972340 - RNA, 20 nt, Mycobacterium avium subsp. paratuberculosis
cuuuugcgucugcucgccag

SEQ ID NO: 972341 - RNA, 17 nt, Mycobacterium avium subsp. paratuberculosis
cuucggagacguggcgg

SEQ ID NO: 972342 - RNA, 17 nt, Mycobacterium avium subsp. paratuberculosis
cuucgcgguccaucucc

SEQ ID NO: 972343 - RNA, 21 nt, Mycobacterium avium subsp. paratuberculosis
cuucgcgggugccuucuuggc

SEQ ID NO: 972344 - RNA, 13 nt, Mycobacterium avium subsp. paratuberculosis
cuucgcugccgcc

SEQ ID NO: 972345 - RNA, 14 nt, Mycobacterium avium subsp. paratuberculosis
cuucggcgccggca

SEQ ID NO: 972346 - RNA, 13 nt, Mycobacterium avium subsp. paratuberculosis
cuucggcgcgccg

SEQ ID NO: 972347 - RNA, 21 nt, Mycobacterium avium subsp. paratuberculosis
cuucggccagcgcgucggcca

SEQ ID NO: 972348 - RNA, 21 nt, Mycobacterium avium subsp. paratuberculosis
cuuuccgcgcggcgggcccgc

SEQ ID NO: 972349 - RNA, 15 nt, Mycobacterium avium subsp. paratuberculosis
cuuuccaaccaggcg

SEQ ID NO: 972350 - RNA, 16 nt, Mycobacterium avium subsp. paratuberculosis
cuuuccaaccaggcgc

SEQ ID NO: 972351 - RNA, 14 nt, Mycobacterium avium subsp. paratuberculosis
gagcaacuggguga

SEQ ID NO: 972352 - RNA, 14 nt, Mycobacterium avium subsp. paratuberculosis
gagcaaauccggca

SEQ ID NO: 972353 - RNA, 17 nt, Mycobacterium avium subsp. paratuberculosis
gagcagcaagagcaggc

SEQ ID NO: 972354 - RNA, 23 nt, Mycobacterium avium subsp. paratuberculosis
gagcagaucgcggaucucgguga

SEQ ID NO: 972355 - RNA, 17 nt, Mycobacterium avium subsp. paratuberculosis
gagcagcaugccgagca

SEQ ID NO: 972356 - RNA, 13 nt, Mycobacterium avium subsp. paratuberculosis
gagcagcaccgcg

SEQ ID NO: 972357 - RNA, 20 nt, Mycobacterium avium subsp. paratuberculosis
gagcagcagccgcagcggcg

SEQ ID NO: 972358 - RNA, 15 nt, Mycobacterium avium subsp. paratuberculosis
gagcagcagccgccg

SEQ ID NO: 972359 - RNA, 15 nt, Mycobacterium avium subsp. paratuberculosis
gagcagcagcgcggu

SEQ ID NO: 972360 - RNA, 23 nt, Mycobacterium avium subsp. paratuberculosis
gagcagcagcgcggugccgaccu

SEQ ID NO: 972361 - RNA, 22 nt, Mycobacterium avium subsp. paratuberculosis
gagcauuucgcgcacgucgagg

SEQ ID NO: 972362 - RNA, 14 nt, Mycobacterium avium subsp. paratuberculosis
gagcaggaccgagc

SEQ ID NO: 972363 - RNA, 23 nt, Mycobacterium avium subsp. paratuberculosis
gagcaggaccgagccgcgcgccg

SEQ ID NO: 972364 - RNA, 16 nt, Mycobacterium avium subsp. paratuberculosis
gagcagcugggacagc

SEQ ID NO: 972365 - RNA, 20 nt, Mycobacterium avium subsp. paratuberculosis
gagcagccgaucuggcgggc

SEQ ID NO: 972366 - RNA, 21 nt, Mycobacterium avium subsp. paratuberculosis
gagcagccgaucuggcgggcg

SEQ ID NO: 972367 - RNA, 15 nt, Mycobacterium avium subsp. paratuberculosis
gagcagcgcccgggu

SEQ ID NO: 972368 - RNA, 21 nt, Mycobacterium avium subsp. paratuberculosis
gagcagcgcgaugccggccag

SEQ ID NO: 972369 - RNA, 23 nt, Mycobacterium avium subsp. paratuberculosis
gagcagcgcgaugccggccaggc

SEQ ID NO: 972370 - RNA, 19 nt, Mycobacterium avium subsp. paratuberculosis
gagcagccgcaacacggcc

SEQ ID NO: 972371 - RNA, 20 nt, Mycobacterium avium subsp. paratuberculosis
gagcagcucgcggauccgca

SEQ ID NO: 972372 - RNA, 16 nt, Mycobacterium avium subsp. paratuberculosis
gagcagcucggcggcc

SEQ ID NO: 972373 - RNA, 22 nt, Mycobacterium avium subsp. paratuberculosis
gagcagcggggugagcaccgcg

SEQ ID NO: 972374 - RNA, 13 nt, Mycobacterium avium subsp. paratuberculosis
gacucacggcggc

SEQ ID NO: 972375 - RNA, 16 nt, Mycobacterium avium subsp. paratuberculosis
gacuccaccaccuggc

SEQ ID NO: 972376 - RNA, 17 nt, Mycobacterium avium subsp. paratuberculosis
gacuccaccaccuggcc

SEQ ID NO: 972377 - RNA, 20 nt, Mycobacterium avium subsp. paratuberculosis
gacuccagcaccagcacggc

SEQ ID NO: 972378 - RNA, 18 nt, Mycobacterium avium subsp. paratuberculosis
gacuccagcaccggcgcc

SEQ ID NO: 972379 - RNA, 14 nt, Mycobacterium avium subsp. paratuberculosis
gacuccaccgccac

SEQ ID NO: 972380 - RNA, 15 nt, Mycobacterium avium subsp. paratuberculosis
gacuccaccgccacc

SEQ ID NO: 972381 - RNA, 13 nt, Mycobacterium avium subsp. paratuberculosis
gagaguaucgcca

SEQ ID NO: 972382 - RNA, 22 nt, Mycobacterium avium subsp. paratuberculosis
gagaguaucgccacgccgacca

SEQ ID NO: 972383 - RNA, 13 nt, Mycobacterium avium subsp. paratuberculosis
gagaggcgcggcg

SEQ ID NO: 972384 - RNA, 14 nt, Mycobacterium avium subsp. paratuberculosis
gagaucgcgguggc

SEQ ID NO: 972385 - RNA, 15 nt, Mycobacterium avium subsp. paratuberculosis
gagaucggcagaccg

SEQ ID NO: 972386 - RNA, 22 nt, Mycobacterium avium subsp. paratuberculosis
gagauuggacgacaccacgguc

SEQ ID NO: 972387 - RNA, 23 nt, Mycobacterium avium subsp. paratuberculosis
gagcgucacgccgcgcccgucga

SEQ ID NO: 972388 - RNA, 22 nt, Mycobacterium avium subsp. paratuberculosis
gagcgucggucucgacguugga

SEQ ID NO: 972389 - RNA, 17 nt, Mycobacterium avium subsp. paratuberculosis
gagcgugggcccuaggu

SEQ ID NO: 972390 - RNA, 12 nt, Mycobacterium avium subsp. paratuberculosis
gagcguguggga

SEQ ID NO: 972391 - RNA, 19 nt, Mycobacterium avium subsp. paratuberculosis
gagcguggacaccgcaccc

SEQ ID NO: 972392 - RNA, 22 nt, Mycobacterium avium subsp. paratuberculosis
gagcgugaaguuaguuucacgc

SEQ ID NO: 972393 - RNA, 13 nt, Mycobacterium avium subsp. paratuberculosis
gagcgugaaacua

SEQ ID NO: 972394 - RNA, 14 nt, Mycobacterium avium subsp. paratuberculosis
gagcucaggccggc

SEQ ID NO: 972395 - RNA, 17 nt, Mycobacterium avium subsp. paratuberculosis
gagcucaggccggccuu

SEQ ID NO: 972396 - RNA, 20 nt, Mycobacterium avium subsp. paratuberculosis
gagcuccagcuaggagccug

SEQ ID NO: 972397 - RNA, 18 nt, Mycobacterium avium subsp. paratuberculosis
gagcguucuccacccgcc

SEQ ID NO: 972398 - RNA, 16 nt, Mycobacterium avium subsp. paratuberculosis
gagcgggccuucacgc

SEQ ID NO: 972399 - RNA, 21 nt, Mycobacterium avium subsp. paratuberculosis
gagcgggcacgccgccgcgaa

SEQ ID NO: 972400 - RNA, 17 nt, Mycobacterium avium subsp. paratuberculosis
gagcggguaaccgcagc

SEQ ID NO: 972401 - RNA, 18 nt, Mycobacterium avium subsp. paratuberculosis
gagcggguaaccgcagcc

SEQ ID NO: 972402 - RNA, 16 nt, Mycobacterium avium subsp. paratuberculosis
gagcggcgcugcagca

SEQ ID NO: 972403 - RNA, 19 nt, Mycobacterium avium subsp. paratuberculosis
gagcggcgcugcagcagcc

SEQ ID NO: 972404 - RNA, 16 nt, Mycobacterium avium subsp. paratuberculosis
gagcggcgcaggccgg

SEQ ID NO: 972405 - RNA, 13 nt, Mycobacterium avium subsp. paratuberculosis
gagcggcccugcg

SEQ ID NO: 972406 - RNA, 11 nt, Mycobacterium avium subsp. paratuberculosis
gagcgcgcuua

SEQ ID NO: 972407 - RNA, 21 nt, Mycobacterium avium subsp. paratuberculosis
gagcggauggcgccgucgagg

SEQ ID NO: 972408 - RNA, 22 nt, Mycobacterium avium subsp. paratuberculosis
gagcggcacgaucggcagcgcc

SEQ ID NO: 972409 - RNA, 16 nt, Mycobacterium avium subsp. paratuberculosis
gagcggaucggcggcg

SEQ ID NO: 972410 - RNA, 21 nt, Mycobacterium avium subsp. paratuberculosis
gagcgaggacgucgagcggcg

SEQ ID NO: 972411 - RNA, 18 nt, Mycobacterium avium subsp. paratuberculosis
gagcgcagcgccaggcag

SEQ ID NO: 972412 - RNA, 13 nt, Mycobacterium avium subsp. paratuberculosis
gagcgcagcaggu

SEQ ID NO: 972413 - RNA, 21 nt, Mycobacterium avium subsp. paratuberculosis
gagcgcagcagguaaaccagc

SEQ ID NO: 972414 - RNA, 13 nt, Mycobacterium avium subsp. paratuberculosis
gagcgcaggccgu

SEQ ID NO: 972415 - RNA, 15 nt, Mycobacterium avium subsp. paratuberculosis
gagcgccccagggcc

SEQ ID NO: 972416 - RNA, 19 nt, Mycobacterium avium subsp. paratuberculosis
gagcgcccggccagccggc

SEQ ID NO: 972417 - RNA, 18 nt, Mycobacterium avium subsp. paratuberculosis
gagcgccagcgcggugcc

SEQ ID NO: 972418 - RNA, 14 nt, Mycobacterium avium subsp. paratuberculosis
gagcgccaggccau

SEQ ID NO: 972419 - RNA, 14 nt, Mycobacterium avium subsp. paratuberculosis
gagcgcgaaaacca

SEQ ID NO: 972420 - RNA, 19 nt, Mycobacterium avium subsp. paratuberculosis
gagcgcgaaaaccagcacc

SEQ ID NO: 972421 - RNA, 18 nt, Mycobacterium avium subsp. paratuberculosis
gagcgccgcguucacccg

SEQ ID NO: 972422 - RNA, 13 nt, Mycobacterium avium subsp. paratuberculosis
gagccaccacugc

SEQ ID NO: 972423 - RNA, 22 nt, Mycobacterium avium subsp. paratuberculosis
gagccaccucgaucagcggcau

SEQ ID NO: 972424 - RNA, 13 nt, Mycobacterium avium subsp. paratuberculosis
gagccgccacagc

SEQ ID NO: 972425 - RNA, 16 nt, Mycobacterium avium subsp. paratuberculosis
gagccgccacagcgcc

SEQ ID NO: 972426 - RNA, 15 nt, Mycobacterium avium subsp. paratuberculosis
gagccgaugcccagc

SEQ ID NO: 972427 - RNA, 13 nt, Mycobacterium avium subsp. paratuberculosis
gagccgcaccgcc

SEQ ID NO: 972428 - RNA, 14 nt, Mycobacterium avium subsp. paratuberculosis
gagccgagcaccgg

SEQ ID NO: 972429 - RNA, 18 nt, Mycobacterium avium subsp. paratuberculosis
gagccgagcaccgggcug

SEQ ID NO: 972430 - RNA, 15 nt, Mycobacterium avium subsp. paratuberculosis
gagccgagccgaccc

SEQ ID NO: 972431 - RNA, 17 nt, Mycobacterium avium subsp. paratuberculosis
gagccgcagccgggugg

SEQ ID NO: 972432 - RNA, 14 nt, Mycobacterium avium subsp. paratuberculosis
gagccgccgcggca

SEQ ID NO: 972433 - RNA, 19 nt, Mycobacterium avium subsp. paratuberculosis
gagccgccgcgggucggcg

SEQ ID NO: 972434 - RNA, 20 nt, Mycobacterium avium subsp. paratuberculosis
gagccgucggcuuccuccuc

SEQ ID NO: 972435 - RNA, 19 nt, Mycobacterium avium subsp. paratuberculosis
gagccgucgucgcugcagu

SEQ ID NO: 972436 - RNA, 15 nt, Mycobacterium avium subsp. paratuberculosis
gagccgugcccgagg

SEQ ID NO: 972437 - RNA, 23 nt, Mycobacterium avium subsp. paratuberculosis
gagccguccggguucgacgccuc

SEQ ID NO: 972438 - RNA, 23 nt, Mycobacterium avium subsp. paratuberculosis
gagccguuuggcgccgcccacca

SEQ ID NO: 972439 - RNA, 15 nt, Mycobacterium avium subsp. paratuberculosis
gagccucagggcgcg

SEQ ID NO: 972440 - RNA, 23 nt, Mycobacterium avium subsp. paratuberculosis
gagccugggauugccgggcacca

SEQ ID NO: 972441 - RNA, 15 nt, Mycobacterium avium subsp. paratuberculosis
gaguuuggccagcuc

SEQ ID NO: 972442 - RNA, 17 nt, Mycobacterium avium subsp. paratuberculosis
gaguucgcggcgcagca

SEQ ID NO: 972443 - RNA, 18 nt, Mycobacterium avium subsp. paratuberculosis
gaguucgcggcgcagcac

SEQ ID NO: 972444 - RNA, 24 nt, Mycobacterium avium subsp. paratuberculosis
gaguucgucggcgaucgccagcac

SEQ ID NO: 972445 - RNA, 19 nt, Mycobacterium avium subsp. paratuberculosis
gaguuggccggcacucgcc

SEQ ID NO: 972446 - RNA, 24 nt, Mycobacterium avium subsp. paratuberculosis
gaguggcgaacgggugaguaacac

SEQ ID NO: 972447 - RNA, 15 nt, Mycobacterium avium subsp. paratuberculosis
gagugguagggcucc

SEQ ID NO: 972448 - RNA, 16 nt, Mycobacterium avium subsp. paratuberculosis
gagugguagggcuccg

SEQ ID NO: 972449 - RNA, 22 nt, Mycobacterium avium subsp. paratuberculosis
gaguuccgcgucggcccccagc

SEQ ID NO: 972450 - RNA, 15 nt, Mycobacterium avium subsp. paratuberculosis
gaguguugaagccgc

SEQ ID NO: 972451 - RNA, 13 nt, Mycobacterium avium subsp. paratuberculosis
gagugaggacgag

SEQ ID NO: 972452 - RNA, 22 nt, Mycobacterium avium subsp. paratuberculosis
gagugaggccgaggcgagugag

SEQ ID NO: 972453 - RNA, 16 nt, Mycobacterium avium subsp. paratuberculosis
gagugcaccuugaucu

SEQ ID NO: 972454 - RNA, 20 nt, Mycobacterium avium subsp. paratuberculosis
gagucgguuucgaccugcgg

SEQ ID NO: 972455 - RNA, 16 nt, Mycobacterium avium subsp. paratuberculosis
gagucggggugcucga

SEQ ID NO: 972456 - RNA, 21 nt, Mycobacterium avium subsp. paratuberculosis
gaguagaccuuguccggcguc

SEQ ID NO: 972457 - RNA, 14 nt, Mycobacterium avium subsp. paratuberculosis
gaguacccgccgca

SEQ ID NO: 972458 - RNA, 15 nt, Mycobacterium avium subsp. paratuberculosis
gaguacccgccgcac

SEQ ID NO: 972459 - RNA, 21 nt, Mycobacterium avium subsp. paratuberculosis
gaguaccgacgagaucagcac

SEQ ID NO: 972460 - RNA, 15 nt, Mycobacterium avium subsp. paratuberculosis
gagucgaucgccagc

SEQ ID NO: 972461 - RNA, 17 nt, Mycobacterium avium subsp. paratuberculosis
gagucgaucgccagcgc

SEQ ID NO: 972462 - RNA, 21 nt, Mycobacterium avium subsp. paratuberculosis
gagucgggcaaucggacccag

SEQ ID NO: 972463 - RNA, 16 nt, Mycobacterium avium subsp. paratuberculosis
gaguccggcucggugc

SEQ ID NO: 972464 - RNA, 20 nt, Mycobacterium avium subsp. paratuberculosis
gagcugaucgcgucgacggc

SEQ ID NO: 972465 - RNA, 19 nt, Mycobacterium avium subsp. paratuberculosis
gagcugccggcgaccagcc

SEQ ID NO: 972466 - RNA, 17 nt, Mycobacterium avium subsp. paratuberculosis
gagcugcccgcacuggu

SEQ ID NO: 972467 - RNA, 13 nt, Mycobacterium avium subsp. paratuberculosis
gagcugcgcccac

SEQ ID NO: 972468 - RNA, 18 nt, Mycobacterium avium subsp. paratuberculosis
gagcugcgcccacgugcc

SEQ ID NO: 972469 - RNA, 17 nt, Mycobacterium avium subsp. paratuberculosis
gagcugcgcgccccggc

SEQ ID NO: 972470 - RNA, 22 nt, Mycobacterium avium subsp. paratuberculosis
gagcucggccuuacgcugcgcg

SEQ ID NO: 972471 - RNA, 20 nt, Mycobacterium avium subsp. paratuberculosis
gagcucggccuugagccggu

SEQ ID NO: 972472 - RNA, 16 nt, Mycobacterium avium subsp. paratuberculosis
gagcuccucggccagc

SEQ ID NO: 972473 - RNA, 17 nt, Mycobacterium avium subsp. paratuberculosis
gagcucgaagcccaggg

SEQ ID NO: 972474 - RNA, 18 nt, Mycobacterium avium subsp. paratuberculosis
gagcugaaguucaccacc

SEQ ID NO: 972475 - RNA, 21 nt, Mycobacterium avium subsp. paratuberculosis
gaggacggcuuggguguggcg

SEQ ID NO: 972476 - RNA, 15 nt, Mycobacterium avium subsp. paratuberculosis
gaggaacucagcgcc

SEQ ID NO: 972477 - RNA, 19 nt, Mycobacterium avium subsp. paratuberculosis
gaggaacucagcgcccagg

SEQ ID NO: 972478 - RNA, 21 nt, Mycobacterium avium subsp. paratuberculosis
gaggaacucagcgcccaggau

SEQ ID NO: 972479 - RNA, 16 nt, Mycobacterium avium subsp. paratuberculosis
gaggaaccgugcgucc

SEQ ID NO: 972480 - RNA, 22 nt, Mycobacterium avium subsp. paratuberculosis
gaggaacagacucagcccggcc

SEQ ID NO: 972481 - RNA, 16 nt, Mycobacterium avium subsp. paratuberculosis
gaggccagcacgccgg

SEQ ID NO: 972482 - RNA, 16 nt, Mycobacterium avium subsp. paratuberculosis
gaggccaccgcgccgu

SEQ ID NO: 972483 - RNA, 21 nt, Mycobacterium avium subsp. paratuberculosis
gaggccagggcccgcagccgc

SEQ ID NO: 972484 - RNA, 16 nt, Mycobacterium avium subsp. paratuberculosis
gaggccagcugcaccg

SEQ ID NO: 972485 - RNA, 17 nt, Mycobacterium avium subsp. paratuberculosis
gaggccagcugcaccgg

SEQ ID NO: 972486 - RNA, 19 nt, Mycobacterium avium subsp. paratuberculosis
gaggcccggcagccggggu

SEQ ID NO: 972487 - RNA, 19 nt, Mycobacterium avium subsp. paratuberculosis
gaggccgacguggagcuga

SEQ ID NO: 972488 - RNA, 13 nt, Mycobacterium avium subsp. paratuberculosis
gaggccgaggcga

SEQ ID NO: 972489 - RNA, 14 nt, Mycobacterium avium subsp. paratuberculosis
gaggccgaggcgag

SEQ ID NO: 972490 - RNA, 16 nt, Mycobacterium avium subsp. paratuberculosis
gaggccgaggucgguc

SEQ ID NO: 972491 - RNA, 17 nt, Mycobacterium avium subsp. paratuberculosis
gaggccgaaccgcagcc

SEQ ID NO: 972492 - RNA, 19 nt, Mycobacterium avium subsp. paratuberculosis
gaggccgaaccgcagccgg

SEQ ID NO: 972493 - RNA, 15 nt, Mycobacterium avium subsp. paratuberculosis
gaggccgccccggcc

SEQ ID NO: 972494 - RNA, 16 nt, Mycobacterium avium subsp. paratuberculosis
gaggccgcgccgugcg

SEQ ID NO: 972495 - RNA, 21 nt, Mycobacterium avium subsp. paratuberculosis
gaggccgcgccgugcgccagc

SEQ ID NO: 972496 - RNA, 21 nt, Mycobacterium avium subsp. paratuberculosis
gaggccgcgggcguucaucac

SEQ ID NO: 972497 - RNA, 15 nt, Mycobacterium avium subsp. paratuberculosis
gaggccaacucgcga

SEQ ID NO: 972498 - RNA, 19 nt, Mycobacterium avium subsp. paratuberculosis
gaggaguuuuucggggugg

SEQ ID NO: 972499 - RNA, 21 nt, Mycobacterium avium subsp. paratuberculosis
gaggagguuuugcguggucua

SEQ ID NO: 972500 - RNA, 22 nt, Mycobacterium avium subsp. paratuberculosis
gaggaggccgcggcgacaccca

SEQ ID NO: 972501 - RNA, 18 nt, Mycobacterium avium subsp. paratuberculosis
gaggguuuucggggcgug

SEQ ID NO: 972502 - RNA, 15 nt, Mycobacterium avium subsp. paratuberculosis
gagggugucggcggg

SEQ ID NO: 972503 - RNA, 13 nt, Mycobacterium avium subsp. paratuberculosis
gaggggcagcagc

SEQ ID NO: 972504 - RNA, 19 nt, Mycobacterium avium subsp. paratuberculosis
gaggggcagcagcgcccac

SEQ ID NO: 972505 - RNA, 13 nt, Mycobacterium avium subsp. paratuberculosis
gaggggcgcggca

SEQ ID NO: 972506 - RNA, 18 nt, Mycobacterium avium subsp. paratuberculosis
gaggcggguaggcgucgc

SEQ ID NO: 972507 - RNA, 13 nt, Mycobacterium avium subsp. paratuberculosis
gaggcggcggcgg

SEQ ID NO: 972508 - RNA, 20 nt, Mycobacterium avium subsp. paratuberculosis
gaggcggcguagucgccggu

SEQ ID NO: 972509 - RNA, 13 nt, Mycobacterium avium subsp. paratuberculosis
gaggcggucggcg

SEQ ID NO: 972510 - RNA, 20 nt, Mycobacterium avium subsp. paratuberculosis
gaggcggucggcggaggcga

SEQ ID NO: 972511 - RNA, 19 nt, Mycobacterium avium subsp. paratuberculosis
gagggcguucgcggugggc

SEQ ID NO: 972512 - RNA, 22 nt, Mycobacterium avium subsp. paratuberculosis
gagggucgccaggccaccgcac

SEQ ID NO: 972513 - RNA, 22 nt, Mycobacterium avium subsp. paratuberculosis
gaggggguggguccggucagca

SEQ ID NO: 972514 - RNA, 15 nt, Mycobacterium avium subsp. paratuberculosis
gaggccugcgcggcc

SEQ ID NO: 972515 - RNA, 19 nt, Mycobacterium avium subsp. paratuberculosis
gaggccguaucccaccacg

SEQ ID NO: 972516 - RNA, 23 nt, Mycobacterium avium subsp. paratuberculosis
gaggccguucagguaaucgauga

SEQ ID NO: 972517 - RNA, 20 nt, Mycobacterium avium subsp. paratuberculosis
gaggcgagugaggacgaggc

SEQ ID NO: 972518 - RNA, 17 nt, Mycobacterium avium subsp. paratuberculosis
gaggcgcacaacgaggc

SEQ ID NO: 972519 - RNA, 17 nt, Mycobacterium avium subsp. paratuberculosis
gaucuacgucggcuggc

SEQ ID NO: 972520 - RNA, 23 nt, Mycobacterium avium subsp. paratuberculosis
gaucucgacgguggccucggcgc

SEQ ID NO: 972521 - RNA, 19 nt, Mycobacterium avium subsp. paratuberculosis
gaucucgagcauccggugc

SEQ ID NO: 972522 - RNA, 16 nt, Mycobacterium avium subsp. paratuberculosis
gaucucgaccagcgcc

SEQ ID NO: 972523 - RNA, 13 nt, Mycobacterium avium subsp. paratuberculosis
gaucucggccacc

SEQ ID NO: 972524 - RNA, 22 nt, Mycobacterium avium subsp. paratuberculosis
gaucucgccgaaggccgggucg

SEQ ID NO: 972525 - RNA, 15 nt, Mycobacterium avium subsp. paratuberculosis
gaucucgccgagcac

SEQ ID NO: 972526 - RNA, 11 nt, Mycobacterium avium subsp. paratuberculosis
gaucuccagca

SEQ ID NO: 972527 - RNA, 14 nt, Mycobacterium avium subsp. paratuberculosis
gaucuccagcagcu

SEQ ID NO: 972528 - RNA, 20 nt, Mycobacterium avium subsp. paratuberculosis
gaucucccaacgcagcgcau

SEQ ID NO: 972529 - RNA, 15 nt, Mycobacterium avium subsp. paratuberculosis
gaucugcagccggcg

SEQ ID NO: 972530 - RNA, 17 nt, Mycobacterium avium subsp. paratuberculosis
gaucugaccgagcagcg

SEQ ID NO: 972531 - RNA, 19 nt, Mycobacterium avium subsp. paratuberculosis
gaucucuucgccggacagc

SEQ ID NO: 972532 - RNA, 18 nt, Mycobacterium avium subsp. paratuberculosis
gaucucggccagcgggcg

SEQ ID NO: 972533 - RNA, 22 nt, Mycobacterium avium subsp. paratuberculosis
gaucucguagguggccagcacg

SEQ ID NO: 972534 - RNA, 20 nt, Mycobacterium avium subsp. paratuberculosis
gaucucgcggucgaagggug

SEQ ID NO: 972535 - RNA, 17 nt, Mycobacterium avium subsp. paratuberculosis
gaucucggcggccgcgu

SEQ ID NO: 972536 - RNA, 14 nt, Mycobacterium avium subsp. paratuberculosis
gaucucggcggcga

SEQ ID NO: 972537 - RNA, 16 nt, Mycobacterium avium subsp. paratuberculosis
gaucucggggaucagc

SEQ ID NO: 972538 - RNA, 17 nt, Mycobacterium avium subsp. paratuberculosis
gaucucggugagcagaa

SEQ ID NO: 972539 - RNA, 20 nt, Mycobacterium avium subsp. paratuberculosis
gaucugcuuggucaccugac

SEQ ID NO: 972540 - RNA, 14 nt, Mycobacterium avium subsp. paratuberculosis
gaucugcucggcug

SEQ ID NO: 972541 - RNA, 14 nt, Mycobacterium avium subsp. paratuberculosis
gaucugcuccucgg

SEQ ID NO: 972542 - RNA, 15 nt, Mycobacterium avium subsp. paratuberculosis
gaucugcuccucggu

SEQ ID NO: 972543 - RNA, 22 nt, Mycobacterium avium subsp. paratuberculosis
gaucugcucgaugcggcccugg

SEQ ID NO: 972544 - RNA, 17 nt, Mycobacterium avium subsp. paratuberculosis
gaucugcggcacggugc

SEQ ID NO: 972545 - RNA, 15 nt, Mycobacterium avium subsp. paratuberculosis
gaucugcgcaagaag

SEQ ID NO: 972546 - RNA, 13 nt, Mycobacterium avium subsp. paratuberculosis
gaucugccggugc

SEQ ID NO: 972547 - RNA, 20 nt, Mycobacterium avium subsp. paratuberculosis
gaucuggaugcggcccuggc

SEQ ID NO: 972548 - RNA, 21 nt, Mycobacterium avium subsp. paratuberculosis
gaucuggcgcaucagcggggc

SEQ ID NO: 972549 - RNA, 19 nt, Mycobacterium avium subsp. paratuberculosis
gaucuggugggcgggcacc

SEQ ID NO: 972550 - RNA, 15 nt, Mycobacterium avium subsp. paratuberculosis
gaucugggcggcggg

SEQ ID NO: 972551 - RNA, 23 nt, Mycobacterium avium subsp. paratuberculosis
gaucuggguuugggucaucgacu

SEQ ID NO: 972552 - RNA, 16 nt, Mycobacterium avium subsp. paratuberculosis
gaucugguccagcgug

SEQ ID NO: 972553 - RNA, 15 nt, Mycobacterium avium subsp. paratuberculosis
gaucggccauggugc

SEQ ID NO: 972554 - RNA, 13 nt, Mycobacterium avium subsp. paratuberculosis
gaucggccagcag

SEQ ID NO: 972555 - RNA, 19 nt, Mycobacterium avium subsp. paratuberculosis
gaucggcccccgggcccga

SEQ ID NO: 972556 - RNA, 20 nt, Mycobacterium avium subsp. paratuberculosis
gaucggcgccacgaccagcg

SEQ ID NO: 972557 - RNA, 18 nt, Mycobacterium avium subsp. paratuberculosis
gaucggcgggacccgcga

SEQ ID NO: 972558 - RNA, 16 nt, Mycobacterium avium subsp. paratuberculosis
gaucggcgucacugcc

SEQ ID NO: 972559 - RNA, 14 nt, Mycobacterium avium subsp. paratuberculosis
gaucggccagcgcg

SEQ ID NO: 972560 - RNA, 17 nt, Mycobacterium avium subsp. paratuberculosis
gaucgggaacagcccgc

SEQ ID NO: 972561 - RNA, 20 nt, Mycobacterium avium subsp. paratuberculosis
gaucgggaacggguagugca

SEQ ID NO: 972562 - RNA, 13 nt, Mycobacterium avium subsp. paratuberculosis
gaucgggaccggg

SEQ ID NO: 972563 - RNA, 15 nt, Mycobacterium avium subsp. paratuberculosis
gaucggucucggugg

SEQ ID NO: 972564 - RNA, 16 nt, Mycobacterium avium subsp. paratuberculosis
gaucgguagcaggacc

SEQ ID NO: 972565 - RNA, 21 nt, Mycobacterium avium subsp. paratuberculosis
gaucggugccgacggugcgug

SEQ ID NO: 972566 - RNA, 16 nt, Mycobacterium avium subsp. paratuberculosis
gaucgugcgcccaucc

SEQ ID NO: 972567 - RNA, 15 nt, Mycobacterium avium subsp. paratuberculosis
gaucgucggcacugc

SEQ ID NO: 972568 - RNA, 17 nt, Mycobacterium avium subsp. paratuberculosis
gaucgucucggccagcc

SEQ ID NO: 972569 - RNA, 12 nt, Mycobacterium avium subsp. paratuberculosis
gaucgcggcggu

SEQ ID NO: 972570 - RNA, 21 nt, Mycobacterium avium subsp. paratuberculosis
gaucgcgguggcuuccagccc

SEQ ID NO: 972571 - RNA, 17 nt, Mycobacterium avium subsp. paratuberculosis
gaucgcggcccacccgc

SEQ ID NO: 972572 - RNA, 20 nt, Mycobacterium avium subsp. paratuberculosis
gaucggauccgccugcccuu

SEQ ID NO: 972573 - RNA, 18 nt, Mycobacterium avium subsp. paratuberculosis
gaucgccuggcagcugcc

SEQ ID NO: 972574 - RNA, 14 nt, Mycobacterium avium subsp. paratuberculosis
gaucgccgcuugca

SEQ ID NO: 972575 - RNA, 23 nt, Mycobacterium avium subsp. paratuberculosis
gaucgccgugagauccagcagcc

SEQ ID NO: 972576 - RNA, 17 nt, Mycobacterium avium subsp. paratuberculosis
gaucgccgcgcccagca

SEQ ID NO: 972577 - RNA, 18 nt, Mycobacterium avium subsp. paratuberculosis
gaucgccgacgccagcac

SEQ ID NO: 972578 - RNA, 12 nt, Mycobacterium avium subsp. paratuberculosis
gaucgccaggcg

SEQ ID NO: 972579 - RNA, 13 nt, Mycobacterium avium subsp. paratuberculosis
gaucgccagcccg

SEQ ID NO: 972580 - RNA, 17 nt, Mycobacterium avium subsp. paratuberculosis
gaucgccagcccggcgu

SEQ ID NO: 972581 - RNA, 13 nt, Mycobacterium avium subsp. paratuberculosis
gaucgccagcgcc

SEQ ID NO: 972582 - RNA, 18 nt, Mycobacterium avium subsp. paratuberculosis
gaucgccagcgcccccag

SEQ ID NO: 972583 - RNA, 19 nt, Mycobacterium avium subsp. paratuberculosis
gaucgccagcgcccccagc

SEQ ID NO: 972584 - RNA, 12 nt, Mycobacterium avium subsp. paratuberculosis
gaucgccagcac

SEQ ID NO: 972585 - RNA, 14 nt, Mycobacterium avium subsp. paratuberculosis
gaucgcccagcacc

SEQ ID NO: 972586 - RNA, 17 nt, Mycobacterium avium subsp. paratuberculosis
gaucgcccagcaccgcg

SEQ ID NO: 972587 - RNA, 20 nt, Mycobacterium avium subsp. paratuberculosis
gaucgcccagugcgcgccgu

SEQ ID NO: 972588 - RNA, 13 nt, Mycobacterium avium subsp. paratuberculosis
gaucgccccgccg

SEQ ID NO: 972589 - RNA, 10 nt, Mycobacterium avium subsp. paratuberculosis
aaagccgacu

SEQ ID NO: 972590 - RNA, 22 nt, Mycobacterium avium subsp. paratuberculosis
gauccgggcggcagguggggca

SEQ ID NO: 972591 - RNA, 16 nt, Mycobacterium avium subsp. paratuberculosis
gauccggggcagcagc

SEQ ID NO: 972592 - RNA, 13 nt, Mycobacterium avium subsp. paratuberculosis
gauccggggggcg

SEQ ID NO: 972593 - RNA, 22 nt, Mycobacterium avium subsp. paratuberculosis
gauccucagcagcuagcccaga

SEQ ID NO: 972594 - RNA, 17 nt, Mycobacterium avium subsp. paratuberculosis
gauccucgccgcgggcc

SEQ ID NO: 972595 - RNA, 19 nt, Mycobacterium avium subsp. paratuberculosis
gauccucgccgcgggccag

SEQ ID NO: 972596 - RNA, 21 nt, Mycobacterium avium subsp. paratuberculosis
gauccucgccgcgggccagcc

SEQ ID NO: 972597 - RNA, 20 nt, Mycobacterium avium subsp. paratuberculosis
gauccucgucuccggcggca

SEQ ID NO: 972598 - RNA, 21 nt, Mycobacterium avium subsp. paratuberculosis
gaucgaucccuuggcggcggc

SEQ ID NO: 972599 - RNA, 22 nt, Mycobacterium avium subsp. paratuberculosis
gaucgaucccuuggcggcggcc

SEQ ID NO: 972600 - RNA, 19 nt, Mycobacterium avium subsp. paratuberculosis
gaucgaugcccagcgcgcg

SEQ ID NO: 972601 - RNA, 18 nt, Mycobacterium avium subsp. paratuberculosis
gaucgcaaaccgcgucuu

SEQ ID NO: 972602 - RNA, 16 nt, Mycobacterium avium subsp. paratuberculosis
gaucgaggaucucccg

SEQ ID NO: 972603 - RNA, 13 nt, Mycobacterium avium subsp. paratuberculosis
gaucgagcugggc

SEQ ID NO: 972604 - RNA, 16 nt, Mycobacterium avium subsp. paratuberculosis
gaucgagaucagggcg

SEQ ID NO: 972605 - RNA, 19 nt, Mycobacterium avium subsp. paratuberculosis
gauccugguuucagguggc

SEQ ID NO: 972606 - RNA, 14 nt, Mycobacterium avium subsp. paratuberculosis
gauccuggccuggu

SEQ ID NO: 972607 - RNA, 16 nt, Mycobacterium avium subsp. paratuberculosis
gaucgaaggcgugcuc

SEQ ID NO: 972608 - RNA, 14 nt, Mycobacterium avium subsp. paratuberculosis
gaucgaacagggcg

SEQ ID NO: 972609 - RNA, 13 nt, Mycobacterium avium subsp. paratuberculosis
gaucgaaaugacc

SEQ ID NO: 972610 - RNA, 14 nt, Mycobacterium avium subsp. paratuberculosis
gauccacuccagca

SEQ ID NO: 972611 - RNA, 14 nt, Mycobacterium avium subsp. paratuberculosis
gauccagcaccgcc

SEQ ID NO: 972612 - RNA, 14 nt, Mycobacterium avium subsp. paratuberculosis
gauccagcagcgcc

SEQ ID NO: 972613 - RNA, 16 nt, Mycobacterium avium subsp. paratuberculosis
gauccaccaucuucca

SEQ ID NO: 972614 - RNA, 23 nt, Mycobacterium avium subsp. paratuberculosis
gauccaggaacggcacccgcagc

SEQ ID NO: 972615 - RNA, 15 nt, Mycobacterium avium subsp. paratuberculosis
gaucccagacccagc

SEQ ID NO: 972616 - RNA, 13 nt, Mycobacterium avium subsp. paratuberculosis
gauccccagcggc

SEQ ID NO: 972617 - RNA, 12 nt, Mycobacterium avium subsp. paratuberculosis
gaucccgcagcu

SEQ ID NO: 972618 - RNA, 21 nt, Mycobacterium avium subsp. paratuberculosis
gauccccucacuccagcggcg

SEQ ID NO: 972619 - RNA, 22 nt, Mycobacterium avium subsp. paratuberculosis
gauccccguccagcccagcgcc

SEQ ID NO: 972620 - RNA, 23 nt, Mycobacterium avium subsp. paratuberculosis
gaucccgggccguucagcgggcg

SEQ ID NO: 972621 - RNA, 19 nt, Mycobacterium avium subsp. paratuberculosis
gaucccgaacugccgcgca

SEQ ID NO: 972622 - RNA, 20 nt, Mycobacterium avium subsp. paratuberculosis
gaucccgucgucggcgccgc

SEQ ID NO: 972623 - RNA, 14 nt, Mycobacterium avium subsp. paratuberculosis
gauccgaugcaggg

SEQ ID NO: 972624 - RNA, 14 nt, Mycobacterium avium subsp. paratuberculosis
gauccgccugcccu

SEQ ID NO: 972625 - RNA, 17 nt, Mycobacterium avium subsp. paratuberculosis
gauccgaggcgucaggg

SEQ ID NO: 972626 - RNA, 19 nt, Mycobacterium avium subsp. paratuberculosis
gauccggauugccgggcag

SEQ ID NO: 972627 - RNA, 17 nt, Mycobacterium avium subsp. paratuberculosis
gauccggccgcggauga

SEQ ID NO: 972628 - RNA, 13 nt, Mycobacterium avium subsp. paratuberculosis
gauccggccggcg

SEQ ID NO: 972629 - RNA, 15 nt, Mycobacterium avium subsp. paratuberculosis
gauccggaucgggcg

SEQ ID NO: 972630 - RNA, 23 nt, Mycobacterium avium subsp. paratuberculosis
gauccggcgcgccgcgauuuccg

SEQ ID NO: 972631 - RNA, 17 nt, Mycobacterium avium subsp. paratuberculosis
gauccgcgcggccacca

SEQ ID NO: 972632 - RNA, 22 nt, Mycobacterium avium subsp. paratuberculosis
gauccgaugacgcugccgcgcc

SEQ ID NO: 972633 - RNA, 22 nt, Mycobacterium avium subsp. paratuberculosis
gauccgcggcgccgggcggccc

SEQ ID NO: 972634 - RNA, 13 nt, Mycobacterium avium subsp. paratuberculosis
gauccgcgggccg

SEQ ID NO: 972635 - RNA, 13 nt, Mycobacterium avium subsp. paratuberculosis
gaucaucagggca

SEQ ID NO: 972636 - RNA, 19 nt, Mycobacterium avium subsp. paratuberculosis
gaucaucgagggcguccuu

SEQ ID NO: 972637 - RNA, 23 nt, Mycobacterium avium subsp. paratuberculosis
gaucaugucgguaaggcaggcac

SEQ ID NO: 972638 - RNA, 20 nt, Mycobacterium avium subsp. paratuberculosis
gaucaugucguugaugccgu

SEQ ID NO: 972639 - RNA, 15 nt, Mycobacterium avium subsp. paratuberculosis
gaucauggucggcga

SEQ ID NO: 972640 - RNA, 23 nt, Mycobacterium avium subsp. paratuberculosis
gaucauccaggugaacagcagcc

SEQ ID NO: 972641 - RNA, 15 nt, Mycobacterium avium subsp. paratuberculosis
gaucagggcggcgcc

SEQ ID NO: 972642 - RNA, 16 nt, Mycobacterium avium subsp. paratuberculosis
gaucagggccgcggcc

SEQ ID NO: 972643 - RNA, 23 nt, Mycobacterium avium subsp. paratuberculosis
gaucagguagaggcuguccagca

SEQ ID NO: 972644 - RNA, 24 nt, Mycobacterium avium subsp. paratuberculosis
gaucagguccggaaucaccuugcc

SEQ ID NO: 972645 - RNA, 14 nt, Mycobacterium avium subsp. paratuberculosis
gaucagguccuugc

SEQ ID NO: 972646 - RNA, 14 nt, Mycobacterium avium subsp. paratuberculosis
gaucagguggggca

SEQ ID NO: 972647 - RNA, 22 nt, Mycobacterium avium subsp. paratuberculosis
gaucagcggauagaggcggcgc

SEQ ID NO: 972648 - RNA, 13 nt, Mycobacterium avium subsp. paratuberculosis
gaucagcggcggg

SEQ ID NO: 972649 - RNA, 22 nt, Mycobacterium avium subsp. paratuberculosis
gaucagcggcgggcccagcaga

SEQ ID NO: 972650 - RNA, 16 nt, Mycobacterium avium subsp. paratuberculosis
gaucagccacaccgcc

SEQ ID NO: 972651 - RNA, 18 nt, Mycobacterium avium subsp. paratuberculosis
gaucagcgcgcccaggcc

SEQ ID NO: 972652 - RNA, 17 nt, Mycobacterium avium subsp. paratuberculosis
gaucagcgcguccaacc

SEQ ID NO: 972653 - RNA, 15 nt, Mycobacterium avium subsp. paratuberculosis
gaucagcucuucgau

SEQ ID NO: 972654 - RNA, 17 nt, Mycobacterium avium subsp. paratuberculosis
gaucacguucaccugac

SEQ ID NO: 972655 - RNA, 14 nt, Mycobacterium avium subsp. paratuberculosis
gaucacgcggcggg

SEQ ID NO: 972656 - RNA, 21 nt, Mycobacterium avium subsp. paratuberculosis
gaucacgaaguugaucgcggc

SEQ ID NO: 972657 - RNA, 22 nt, Mycobacterium avium subsp. paratuberculosis
gaucaccucgaccgugaggccc

SEQ ID NO: 972658 - RNA, 20 nt, Mycobacterium avium subsp. paratuberculosis
gaucaccucgauggccggga

SEQ ID NO: 972659 - RNA, 15 nt, Mycobacterium avium subsp. paratuberculosis
gaucaccugcgggcg

SEQ ID NO: 972660 - RNA, 22 nt, Mycobacterium avium subsp. paratuberculosis
gaucaccuugcggccggcggcg

SEQ ID NO: 972661 - RNA, 21 nt, Mycobacterium avium subsp. paratuberculosis
gaucaccgugaucgccaccac

SEQ ID NO: 972662 - RNA, 15 nt, Mycobacterium avium subsp. paratuberculosis
gaucaccgggcggcc

SEQ ID NO: 972663 - RNA, 13 nt, Mycobacterium avium subsp. paratuberculosis
gaucaccgcgcuc

SEQ ID NO: 972664 - RNA, 15 nt, Mycobacterium avium subsp. paratuberculosis
gaucaccgcgcucgg

SEQ ID NO: 972665 - RNA, 18 nt, Mycobacterium avium subsp. paratuberculosis
gaucaccgcggccaccac

SEQ ID NO: 972666 - RNA, 22 nt, Mycobacterium avium subsp. paratuberculosis
gaucaccgcggccaccaccgcc

SEQ ID NO: 972667 - RNA, 17 nt, Mycobacterium avium subsp. paratuberculosis
gaucaccgcggccaccu

SEQ ID NO: 972668 - RNA, 16 nt, Mycobacterium avium subsp. paratuberculosis
gaucagcaccaggugg

SEQ ID NO: 972669 - RNA, 14 nt, Mycobacterium avium subsp. paratuberculosis
gaucagcagcaccc

SEQ ID NO: 972670 - RNA, 14 nt, Mycobacterium avium subsp. paratuberculosis
gaucagcagcaccu

SEQ ID NO: 972671 - RNA, 16 nt, Mycobacterium avium subsp. paratuberculosis
gaucagcagccgggcc

SEQ ID NO: 972672 - RNA, 16 nt, Mycobacterium avium subsp. paratuberculosis
gaucagcagccguucc

SEQ ID NO: 972673 - RNA, 11 nt, Mycobacterium avium subsp. paratuberculosis
gaucagcagcc

SEQ ID NO: 972674 - RNA, 14 nt, Mycobacterium avium subsp. paratuberculosis
gaucagccgcccga

SEQ ID NO: 972675 - RNA, 20 nt, Mycobacterium avium subsp. paratuberculosis
gaucagccgcgacagccgcc

SEQ ID NO: 972676 - RNA, 16 nt, Mycobacterium avium subsp. paratuberculosis
gaucaccaccaccgcc

SEQ ID NO: 972677 - RNA, 23 nt, Mycobacterium avium subsp. paratuberculosis
gaucacccagccguugggcagcu

SEQ ID NO: 972678 - RNA, 23 nt, Mycobacterium avium subsp. paratuberculosis
gaucacccgccggguggccgcca

SEQ ID NO: 972679 - RNA, 17 nt, Mycobacterium avium subsp. paratuberculosis
gaucaaccacaccagca

SEQ ID NO: 972680 - RNA, 18 nt, Mycobacterium avium subsp. paratuberculosis
gaucaacaccgccagcac

SEQ ID NO: 972681 - RNA, 18 nt, Mycobacterium avium subsp. paratuberculosis
gauagugaacgccucggg

SEQ ID NO: 972682 - RNA, 15 nt, Mycobacterium avium subsp. paratuberculosis
gauaggcggccagcu

SEQ ID NO: 972683 - RNA, 20 nt, Mycobacterium avium subsp. paratuberculosis
gauaggccucguggaacacc

SEQ ID NO: 972684 - RNA, 13 nt, Mycobacterium avium subsp. paratuberculosis
gauaggggcaggg

SEQ ID NO: 972685 - RNA, 18 nt, Mycobacterium avium subsp. paratuberculosis
gauagguggucucccaga

SEQ ID NO: 972686 - RNA, 19 nt, Mycobacterium avium subsp. paratuberculosis
gauaagcggauugaccagc

SEQ ID NO: 972687 - RNA, 14 nt, Mycobacterium avium subsp. paratuberculosis
gauagagcaccgcg

SEQ ID NO: 972688 - RNA, 21 nt, Mycobacterium avium subsp. paratuberculosis
gaugaugucgcccggcggcac

SEQ ID NO: 972689 - RNA, 17 nt, Mycobacterium avium subsp. paratuberculosis
gaugaugucggcggccg

SEQ ID NO: 972690 - RNA, 15 nt, Mycobacterium avium subsp. paratuberculosis
gaugccaguuuuugg

SEQ ID NO: 972691 - RNA, 23 nt, Mycobacterium avium subsp. paratuberculosis
gaugccagacgaacgcggccgcc

SEQ ID NO: 972692 - RNA, 19 nt, Mycobacterium avium subsp. paratuberculosis
gaugcccgcguccugcagc

SEQ ID NO: 972693 - RNA, 16 nt, Mycobacterium avium subsp. paratuberculosis
gaugcccuccagcacc

SEQ ID NO: 972694 - RNA, 21 nt, Mycobacterium avium subsp. paratuberculosis
gaugccgagccggccgaagcg

SEQ ID NO: 972695 - RNA, 21 nt, Mycobacterium avium subsp. paratuberculosis
gaugccgaccgacagccgcac

SEQ ID NO: 972696 - RNA, 16 nt, Mycobacterium avium subsp. paratuberculosis
gaugcccuuggccagc

SEQ ID NO: 972697 - RNA, 17 nt, Mycobacterium avium subsp. paratuberculosis
gaugccgaaccgcugcg

SEQ ID NO: 972698 - RNA, 18 nt, Mycobacterium avium subsp. paratuberculosis
gaugcccaucacgcccca

SEQ ID NO: 972699 - RNA, 19 nt, Mycobacterium avium subsp. paratuberculosis
gaugcccaucacgccccag

SEQ ID NO: 972700 - RNA, 23 nt, Mycobacterium avium subsp. paratuberculosis
gaugcccgacaccgccccgccgc

SEQ ID NO: 972701 - RNA, 21 nt, Mycobacterium avium subsp. paratuberculosis
gaugcccgccccgcccggcgg

SEQ ID NO: 972702 - RNA, 21 nt, Mycobacterium avium subsp. paratuberculosis
gaugcccaagccggccaggcc

SEQ ID NO: 972703 - RNA, 14 nt, Mycobacterium avium subsp. paratuberculosis
gaugcccagcagga

SEQ ID NO: 972704 - RNA, 19 nt, Mycobacterium avium subsp. paratuberculosis
gaugcccagcgcgcggugc

SEQ ID NO: 972705 - RNA, 21 nt, Mycobacterium avium subsp. paratuberculosis
gaugcccagcgcgcggugcgc

SEQ ID NO: 972706 - RNA, 17 nt, Mycobacterium avium subsp. paratuberculosis
gaugcccaggcccacca

SEQ ID NO: 972707 - RNA, 16 nt, Mycobacterium avium subsp. paratuberculosis
gaugcccaggccggcg

SEQ ID NO: 972708 - RNA, 18 nt, Mycobacterium avium subsp. paratuberculosis
gaugcgcagcagcggcuu

SEQ ID NO: 972709 - RNA, 21 nt, Mycobacterium avium subsp. paratuberculosis
gaugcgccaccgacaccaccg

SEQ ID NO: 972710 - RNA, 19 nt, Mycobacterium avium subsp. paratuberculosis
gaugcgcaccaucaccugu

SEQ ID NO: 972711 - RNA, 15 nt, Mycobacterium avium subsp. paratuberculosis
gaugcgccgucucag

SEQ ID NO: 972712 - RNA, 12 nt, Mycobacterium avium subsp. paratuberculosis
gaugcgccgcac

SEQ ID NO: 972713 - RNA, 20 nt, Mycobacterium avium subsp. paratuberculosis
gaugccgccgagggccagca

SEQ ID NO: 972714 - RNA, 23 nt, Mycobacterium avium subsp. paratuberculosis
gaugccgccgagggccagcagcc

SEQ ID NO: 972715 - RNA, 15 nt, Mycobacterium avium subsp. paratuberculosis
gaugccgcccaccac

SEQ ID NO: 972716 - RNA, 18 nt, Mycobacterium avium subsp. paratuberculosis
gaugccgcccagcagcgg

SEQ ID NO: 972717 - RNA, 18 nt, Mycobacterium avium subsp. paratuberculosis
gaugccgcccaucagcag

SEQ ID NO: 972718 - RNA, 16 nt, Mycobacterium avium subsp. paratuberculosis
gaugccgccccugcug

SEQ ID NO: 972719 - RNA, 22 nt, Mycobacterium avium subsp. paratuberculosis
gaugccgguguucaagccggcg

SEQ ID NO: 972720 - RNA, 16 nt, Mycobacterium avium subsp. paratuberculosis
gaugccgggcauggcu

SEQ ID NO: 972721 - RNA, 13 nt, Mycobacterium avium subsp. paratuberculosis
gaugccggggcag

SEQ ID NO: 972722 - RNA, 16 nt, Mycobacterium avium subsp. paratuberculosis
gaugccggggcagcac

SEQ ID NO: 972723 - RNA, 19 nt, Mycobacterium avium subsp. paratuberculosis
gaugccggccagcggccag

SEQ ID NO: 972724 - RNA, 21 nt, Mycobacterium avium subsp. paratuberculosis
gaugccggccagcggccagcc

SEQ ID NO: 972725 - RNA, 14 nt, Mycobacterium avium subsp. paratuberculosis
gaugccggccaggc

SEQ ID NO: 972726 - RNA, 14 nt, Mycobacterium avium subsp. paratuberculosis
gaugccggccggga

SEQ ID NO: 972727 - RNA, 22 nt, Mycobacterium avium subsp. paratuberculosis
gaugccggcgacgaacgcuucc

SEQ ID NO: 972728 - RNA, 15 nt, Mycobacterium avium subsp. paratuberculosis
gaugccggcggacag

SEQ ID NO: 972729 - RNA, 18 nt, Mycobacterium avium subsp. paratuberculosis
gaugccggcggacagccc

SEQ ID NO: 972730 - RNA, 20 nt, Mycobacterium avium subsp. paratuberculosis
gaugccggcguagcagucgg

SEQ ID NO: 972731 - RNA, 19 nt, Mycobacterium avium subsp. paratuberculosis
gaugccggcgauccgcgcg

SEQ ID NO: 972732 - RNA, 23 nt, Mycobacterium avium subsp. paratuberculosis
gaugcguuggccgagcagccggg

SEQ ID NO: 972733 - RNA, 15 nt, Mycobacterium avium subsp. paratuberculosis
gaugcgugcgguggu

SEQ ID NO: 972734 - RNA, 23 nt, Mycobacterium avium subsp. paratuberculosis
gaugcggggccggcggcggccag

SEQ ID NO: 972735 - RNA, 14 nt, Mycobacterium avium subsp. paratuberculosis
gaugcggggcggcg

SEQ ID NO: 972736 - RNA, 17 nt, Mycobacterium avium subsp. paratuberculosis
gaugcggggcggcggga

SEQ ID NO: 972737 - RNA, 17 nt, Mycobacterium avium subsp. paratuberculosis
gaugcgcgccagcagcg

SEQ ID NO: 972738 - RNA, 18 nt, Mycobacterium avium subsp. paratuberculosis
gaugcggcaccagcccgc

SEQ ID NO: 972739 - RNA, 23 nt, Mycobacterium avium subsp. paratuberculosis
gaugcggcagcuugaugcuggca

SEQ ID NO: 972740 - RNA, 14 nt, Mycobacterium avium subsp. paratuberculosis
gaugcggcccggcc

SEQ ID NO: 972741 - RNA, 18 nt, Mycobacterium avium subsp. paratuberculosis
gaugcggcgcccacagca

SEQ ID NO: 972742 - RNA, 16 nt, Mycobacterium avium subsp. paratuberculosis
gaugcgcugugcgggu

SEQ ID NO: 972743 - RNA, 17 nt, Mycobacterium avium subsp. paratuberculosis
gaugcggaucucggugc

SEQ ID NO: 972744 - RNA, 13 nt, Mycobacterium avium subsp. paratuberculosis
gaucuugaucgcc

SEQ ID NO: 972745 - RNA, 16 nt, Mycobacterium avium subsp. paratuberculosis
gaucuguucggcggcg

SEQ ID NO: 972746 - RNA, 16 nt, Mycobacterium avium subsp. paratuberculosis
gaucugggaucggugc

SEQ ID NO: 972747 - RNA, 20 nt, Mycobacterium avium subsp. paratuberculosis
gaucuuccaucacgccccgg

SEQ ID NO: 972748 - RNA, 16 nt, Mycobacterium avium subsp. paratuberculosis
gaucuuggugaagccg

SEQ ID NO: 972749 - RNA, 18 nt, Mycobacterium avium subsp. paratuberculosis
gaugaagaauuccauguc

SEQ ID NO: 972750 - RNA, 20 nt, Mycobacterium avium subsp. paratuberculosis
gaugaagugcgccagcgacg

SEQ ID NO: 972751 - RNA, 23 nt, Mycobacterium avium subsp. paratuberculosis
gaugaagaugaucucgccgagcg

SEQ ID NO: 972752 - RNA, 12 nt, Mycobacterium avium subsp. paratuberculosis
gaugaacagcac

SEQ ID NO: 972753 - RNA, 23 nt, Mycobacterium avium subsp. paratuberculosis
gaugaacagcacgugcccgccgu

SEQ ID NO: 972754 - RNA, 20 nt, Mycobacterium avium subsp. paratuberculosis
gaugaaaccggccagcagca

SEQ ID NO: 972755 - RNA, 21 nt, Mycobacterium avium subsp. paratuberculosis
gaugaaacuuccgcccggcga

SEQ ID NO: 972756 - RNA, 23 nt, Mycobacterium avium subsp. paratuberculosis
gaugaacucgcgggcgagcagcg

SEQ ID NO: 972757 - RNA, 23 nt, Mycobacterium avium subsp. paratuberculosis
gaugaacgucccguuggucucga

SEQ ID NO: 972758 - RNA, 21 nt, Mycobacterium avium subsp. paratuberculosis
gaugagcgagaugaucagccg

SEQ ID NO: 972759 - RNA, 17 nt, Mycobacterium avium subsp. paratuberculosis
gaugacguccaccaggg

SEQ ID NO: 972760 - RNA, 16 nt, Mycobacterium avium subsp. paratuberculosis
gaugacgucgcccacc

SEQ ID NO: 972761 - RNA, 15 nt, Mycobacterium avium subsp. paratuberculosis
gaugacggcggcgcc

SEQ ID NO: 972762 - RNA, 21 nt, Mycobacterium avium subsp. paratuberculosis
gaugaccgacauggccagcac

SEQ ID NO: 972763 - RNA, 16 nt, Mycobacterium avium subsp. paratuberculosis
gaugaugguggcggcc

SEQ ID NO: 972764 - RNA, 20 nt, Mycobacterium avium subsp. paratuberculosis
aaagccguaccgcaacaccg

SEQ ID NO: 972765 - RNA, 21 nt, Mycobacterium avium subsp. paratuberculosis
aaagccguaccgcaacaccga

SEQ ID NO: 972766 - RNA, 21 nt, Mycobacterium avium subsp. paratuberculosis
aaagccguagcgcaacaccga

SEQ ID NO: 972767 - RNA, 21 nt, Mycobacterium avium subsp. paratuberculosis
gaugaugccgcccaucagcag

SEQ ID NO: 972768 - RNA, 23 nt, Mycobacterium avium subsp. paratuberculosis
gaugaugccgcccaucagcagga

SEQ ID NO: 972769 - RNA, 16 nt, Mycobacterium avium subsp. paratuberculosis
gaugaucgucggcagc

SEQ ID NO: 972770 - RNA, 14 nt, Mycobacterium avium subsp. paratuberculosis
gaugagcuggugca

SEQ ID NO: 972771 - RNA, 18 nt, Mycobacterium avium subsp. paratuberculosis
gaugaucgagccgcggcc

SEQ ID NO: 972772 - RNA, 23 nt, Mycobacterium avium subsp. paratuberculosis
gaugaucugguuccacagcugca

SEQ ID NO: 972773 - RNA, 15 nt, Mycobacterium avium subsp. paratuberculosis
gaugaucuucuccag

SEQ ID NO: 972774 - RNA, 17 nt, Mycobacterium avium subsp. paratuberculosis
gaugaucaccucgguga

SEQ ID NO: 972775 - RNA, 23 nt, Mycobacterium avium subsp. paratuberculosis
gauguucaccccguugagcagcg

SEQ ID NO: 972776 - RNA, 20 nt, Mycobacterium avium subsp. paratuberculosis
gaugucggacuucugguuga

SEQ ID NO: 972777 - RNA, 20 nt, Mycobacterium avium subsp. paratuberculosis
gaugucgcccggcggcaccg

SEQ ID NO: 972778 - RNA, 22 nt, Mycobacterium avium subsp. paratuberculosis
gaugucgccgcagaucagggcg

SEQ ID NO: 972779 - RNA, 15 nt, Mycobacterium avium subsp. paratuberculosis
gaugucggccagcgc

SEQ ID NO: 972780 - RNA, 23 nt, Mycobacterium avium subsp. paratuberculosis
gaugucggccgguccgugcacgg

SEQ ID NO: 972781 - RNA, 21 nt, Mycobacterium avium subsp. paratuberculosis
gaugucggcgaaccagggcag

SEQ ID NO: 972782 - RNA, 23 nt, Mycobacterium avium subsp. paratuberculosis
gaugucggcgaaccagggcagcc

SEQ ID NO: 972783 - RNA, 17 nt, Mycobacterium avium subsp. paratuberculosis
gaugucggugugcagca

SEQ ID NO: 972784 - RNA, 13 nt, Mycobacterium avium subsp. paratuberculosis
gaugucgaugacg

SEQ ID NO: 972785 - RNA, 20 nt, Mycobacterium avium subsp. paratuberculosis
gaugucgaugacggcggcgc

SEQ ID NO: 972786 - RNA, 19 nt, Mycobacterium avium subsp. paratuberculosis
gaugucgaaacccaggaac

SEQ ID NO: 972787 - RNA, 18 nt, Mycobacterium avium subsp. paratuberculosis
gauguggcgggcguccug

SEQ ID NO: 972788 - RNA, 13 nt, Mycobacterium avium subsp. paratuberculosis
gaugugcucgguc

SEQ ID NO: 972789 - RNA, 17 nt, Mycobacterium avium subsp. paratuberculosis
gauguggucggccacga

SEQ ID NO: 972790 - RNA, 23 nt, Mycobacterium avium subsp. paratuberculosis
gauggucaccgugucggcgggcg

SEQ ID NO: 972791 - RNA, 19 nt, Mycobacterium avium subsp. paratuberculosis
gauggucagccgcaccagg

SEQ ID NO: 972792 - RNA, 17 nt, Mycobacterium avium subsp. paratuberculosis
gaugguacgcgagaagc

SEQ ID NO: 972793 - RNA, 16 nt, Mycobacterium avium subsp. paratuberculosis
gauggugaccucgguc

SEQ ID NO: 972794 - RNA, 21 nt, Mycobacterium avium subsp. paratuberculosis
gaugguccccgggcccagcac

SEQ ID NO: 972795 - RNA, 16 nt, Mycobacterium avium subsp. paratuberculosis
gauggucgucguggug

SEQ ID NO: 972796 - RNA, 18 nt, Mycobacterium avium subsp. paratuberculosis
gaugggccgcccgcuggg

SEQ ID NO: 972797 - RNA, 12 nt, Mycobacterium avium subsp. paratuberculosis
gauggguuggcc

SEQ ID NO: 972798 - RNA, 18 nt, Mycobacterium avium subsp. paratuberculosis
gaugggggugccgcagcg

SEQ ID NO: 972799 - RNA, 16 nt, Mycobacterium avium subsp. paratuberculosis
gauguccccgcgggug

SEQ ID NO: 972800 - RNA, 22 nt, Mycobacterium avium subsp. paratuberculosis
gauguccccgcgggugacgcug

SEQ ID NO: 972801 - RNA, 19 nt, Mycobacterium avium subsp. paratuberculosis
gauguccgacagcccgccc

SEQ ID NO: 972802 - RNA, 14 nt, Mycobacterium avium subsp. paratuberculosis
gauguagcggcggu

SEQ ID NO: 972803 - RNA, 21 nt, Mycobacterium avium subsp. paratuberculosis
gauguagagcgggauccccac

SEQ ID NO: 972804 - RNA, 17 nt, Mycobacterium avium subsp. paratuberculosis
gaugguuuccacugcca

SEQ ID NO: 972805 - RNA, 22 nt, Mycobacterium avium subsp. paratuberculosis
gauggugccgaagcgccgcaug

SEQ ID NO: 972806 - RNA, 21 nt, Mycobacterium avium subsp. paratuberculosis
gaugguggcgcugccgagcac

SEQ ID NO: 972807 - RNA, 14 nt, Mycobacterium avium subsp. paratuberculosis
gauggugggcaccg

SEQ ID NO: 972808 - RNA, 18 nt, Mycobacterium avium subsp. paratuberculosis
gaugguggugcaggcgaa

SEQ ID NO: 972809 - RNA, 22 nt, Mycobacterium avium subsp. paratuberculosis
gaugguguacacgucgcgggug

SEQ ID NO: 972810 - RNA, 18 nt, Mycobacterium avium subsp. paratuberculosis
gaugguguaguccugcuu

SEQ ID NO: 972811 - RNA, 14 nt, Mycobacterium avium subsp. paratuberculosis
gauggaaggugcug

SEQ ID NO: 972812 - RNA, 21 nt, Mycobacterium avium subsp. paratuberculosis
gauggaagcgcccgcgcgcuc

SEQ ID NO: 972813 - RNA, 16 nt, Mycobacterium avium subsp. paratuberculosis
gauggacgcccaacua

SEQ ID NO: 972814 - RNA, 14 nt, Mycobacterium avium subsp. paratuberculosis
gauggacagcagcc

SEQ ID NO: 972815 - RNA, 23 nt, Mycobacterium avium subsp. paratuberculosis
gauggacagcagccagguccggg

SEQ ID NO: 972816 - RNA, 20 nt, Mycobacterium avium subsp. paratuberculosis
gauggaggugccgcgcagca

SEQ ID NO: 972817 - RNA, 19 nt, Mycobacterium avium subsp. paratuberculosis
gauggagcgcgacgggcug

SEQ ID NO: 972818 - RNA, 12 nt, Mycobacterium avium subsp. paratuberculosis
gauggagcugac

SEQ ID NO: 972819 - RNA, 18 nt, Mycobacterium avium subsp. paratuberculosis
gaugcuggugacgccgcu

SEQ ID NO: 972820 - RNA, 16 nt, Mycobacterium avium subsp. paratuberculosis
gaugcugagcgggucg

SEQ ID NO: 972821 - RNA, 15 nt, Mycobacterium avium subsp. paratuberculosis
gaugcugcccggcgc

SEQ ID NO: 972822 - RNA, 15 nt, Mycobacterium avium subsp. paratuberculosis
gauggcgggcgcgcc

SEQ ID NO: 972823 - RNA, 17 nt, Mycobacterium avium subsp. paratuberculosis
gauggcgguccaccacc

SEQ ID NO: 972824 - RNA, 22 nt, Mycobacterium avium subsp. paratuberculosis
gauggcgguccaccaccacacc

SEQ ID NO: 972825 - RNA, 19 nt, Mycobacterium avium subsp. paratuberculosis
gauggcggucgcgccagac

SEQ ID NO: 972826 - RNA, 15 nt, Mycobacterium avium subsp. paratuberculosis
gauggcgauggccug

SEQ ID NO: 972827 - RNA, 17 nt, Mycobacterium avium subsp. paratuberculosis
gauggcgcuggccgcga

SEQ ID NO: 972828 - RNA, 22 nt, Mycobacterium avium subsp. paratuberculosis
gauggcggcgugcagucccaga

SEQ ID NO: 972829 - RNA, 23 nt, Mycobacterium avium subsp. paratuberculosis
gauggcgcggcccaguucgcacc

SEQ ID NO: 972830 - RNA, 19 nt, Mycobacterium avium subsp. paratuberculosis
gauggcgcggcgcaccgcc

SEQ ID NO: 972831 - RNA, 17 nt, Mycobacterium avium subsp. paratuberculosis
gauggcgacggucugcc

SEQ ID NO: 972832 - RNA, 12 nt, Mycobacterium avium subsp. paratuberculosis
gauggccagcag

SEQ ID NO: 972833 - RNA, 13 nt, Mycobacterium avium subsp. paratuberculosis
gauggccagcgcg

SEQ ID NO: 972834 - RNA, 17 nt, Mycobacterium avium subsp. paratuberculosis
gauggccagguaguggu

SEQ ID NO: 972835 - RNA, 20 nt, Mycobacterium avium subsp. paratuberculosis
gauggccagguagugguggg

SEQ ID NO: 972836 - RNA, 17 nt, Mycobacterium avium subsp. paratuberculosis
gauggcgaaccagcgcc

SEQ ID NO: 972837 - RNA, 23 nt, Mycobacterium avium subsp. paratuberculosis
gauggcgaccgcgcaggcggcga

SEQ ID NO: 972838 - RNA, 18 nt, Mycobacterium avium subsp. paratuberculosis
gauggcccgggccacacc

SEQ ID NO: 972839 - RNA, 17 nt, Mycobacterium avium subsp. paratuberculosis
gauggccauggccagga

SEQ ID NO: 972840 - RNA, 12 nt, Mycobacterium avium subsp. paratuberculosis
gauggccaggcc

SEQ ID NO: 972841 - RNA, 16 nt, Mycobacterium avium subsp. paratuberculosis
gauggccaccaggucc

SEQ ID NO: 972842 - RNA, 14 nt, Mycobacterium avium subsp. paratuberculosis
gauggccccggcga

SEQ ID NO: 972843 - RNA, 12 nt, Mycobacterium avium subsp. paratuberculosis
gauuucgccugc

SEQ ID NO: 972844 - RNA, 18 nt, Mycobacterium avium subsp. paratuberculosis
gauuuggccgucaucucc

SEQ ID NO: 972845 - RNA, 17 nt, Mycobacterium avium subsp. paratuberculosis
gauuggucgggcacagc

SEQ ID NO: 972846 - RNA, 18 nt, Mycobacterium avium subsp. paratuberculosis
gauuucaaggggccgggc

SEQ ID NO: 972847 - RNA, 16 nt, Mycobacterium avium subsp. paratuberculosis
gauuucacgucugcuc

SEQ ID NO: 972848 - RNA, 22 nt, Mycobacterium avium subsp. paratuberculosis
gauuuccgguugcggcagcaca

SEQ ID NO: 972849 - RNA, 18 nt, Mycobacterium avium subsp. paratuberculosis
gauuccagaucugucuuc

SEQ ID NO: 972850 - RNA, 17 nt, Mycobacterium avium subsp. paratuberculosis
gauucagccggcgggcg

SEQ ID NO: 972851 - RNA, 20 nt, Mycobacterium avium subsp. paratuberculosis
gauucacccagcgagcucag

SEQ ID NO: 972852 - RNA, 22 nt, Mycobacterium avium subsp. paratuberculosis
gauucgaucaaaucccgcagcu

SEQ ID NO: 972853 - RNA, 16 nt, Mycobacterium avium subsp. paratuberculosis
gauuccggcacccgcc

SEQ ID NO: 972854 - RNA, 17 nt, Mycobacterium avium subsp. paratuberculosis
gauuccggcacccgcca

SEQ ID NO: 972855 - RNA, 20 nt, Mycobacterium avium subsp. paratuberculosis
gauuccggcacccgccagcc

SEQ ID NO: 972856 - RNA, 14 nt, Mycobacterium avium subsp. paratuberculosis
gauuccggccggcc

SEQ ID NO: 972857 - RNA, 15 nt, Mycobacterium avium subsp. paratuberculosis
gauuccgucggcggc

SEQ ID NO: 972858 - RNA, 16 nt, Mycobacterium avium subsp. paratuberculosis
gauuccgucggcggcc

SEQ ID NO: 972859 - RNA, 21 nt, Mycobacterium avium subsp. paratuberculosis
gauucccgaccccgccagcac

SEQ ID NO: 972860 - RNA, 17 nt, Mycobacterium avium subsp. paratuberculosis
gauucgcggccaccacc

SEQ ID NO: 972861 - RNA, 15 nt, Mycobacterium avium subsp. paratuberculosis
gauucgcggcggcgc

SEQ ID NO: 972862 - RNA, 20 nt, Mycobacterium avium subsp. paratuberculosis
gauuggcgucgguggcggcg

SEQ ID NO: 972863 - RNA, 21 nt, Mycobacterium avium subsp. paratuberculosis
gauuggcgucgguggcggcgg

SEQ ID NO: 972864 - RNA, 19 nt, Mycobacterium avium subsp. paratuberculosis
gauuggccucgagugccug

SEQ ID NO: 972865 - RNA, 16 nt, Mycobacterium avium subsp. paratuberculosis
gauugcccgacuccuc

SEQ ID NO: 972866 - RNA, 21 nt, Mycobacterium avium subsp. paratuberculosis
gauugcccuuggacaccugca

SEQ ID NO: 972867 - RNA, 19 nt, Mycobacterium avium subsp. paratuberculosis
gauugaccauccgguccag

SEQ ID NO: 972868 - RNA, 16 nt, Mycobacterium avium subsp. paratuberculosis
gcaaaucagccgagcc

SEQ ID NO: 972869 - RNA, 15 nt, Mycobacterium avium subsp. paratuberculosis
gcaaaguuugggagu

SEQ ID NO: 972870 - RNA, 13 nt, Mycobacterium avium subsp. paratuberculosis
gcaaagggcuagg

SEQ ID NO: 972871 - RNA, 22 nt, Mycobacterium avium subsp. paratuberculosis
gcaaccaaaaagcuagcgggag

SEQ ID NO: 972872 - RNA, 16 nt, Mycobacterium avium subsp. paratuberculosis
gcaaccacagcggcgc

SEQ ID NO: 972873 - RNA, 18 nt, Mycobacterium avium subsp. paratuberculosis
gcaacaugauuccgccgg

SEQ ID NO: 972874 - RNA, 21 nt, Mycobacterium avium subsp. paratuberculosis
gcaacaugauuccgccgggcg

SEQ ID NO: 972875 - RNA, 22 nt, Mycobacterium avium subsp. paratuberculosis
gcaacccgccgagcgugaaacu

SEQ ID NO: 972876 - RNA, 16 nt, Mycobacterium avium subsp. paratuberculosis
gcaacccgaaagcccc

SEQ ID NO: 972877 - RNA, 19 nt, Mycobacterium avium subsp. paratuberculosis
gcaacacagccaaucgccg

SEQ ID NO: 972878 - RNA, 23 nt, Mycobacterium avium subsp. paratuberculosis
gcaacacagccaaucgccgauga

SEQ ID NO: 972879 - RNA, 14 nt, Mycobacterium avium subsp. paratuberculosis
gcaacaccggcggc

SEQ ID NO: 972880 - RNA, 16 nt, Mycobacterium avium subsp. paratuberculosis
gcaacaccgaaagccg

SEQ ID NO: 972881 - RNA, 17 nt, Mycobacterium avium subsp. paratuberculosis
gcaacacguugaguccc

SEQ ID NO: 972882 - RNA, 21 nt, Mycobacterium avium subsp. paratuberculosis
gcaacagcaccagcaccaccg

SEQ ID NO: 972883 - RNA, 23 nt, Mycobacterium avium subsp. paratuberculosis
gcaacagcgugcacacccgcagc

SEQ ID NO: 972884 - RNA, 20 nt, Mycobacterium avium subsp. paratuberculosis
gcaacagcauuucgcgcggc

SEQ ID NO: 972885 - RNA, 16 nt, Mycobacterium avium subsp. paratuberculosis
gcaacagcgcgccggc

SEQ ID NO: 972886 - RNA, 13 nt, Mycobacterium avium subsp. paratuberculosis
gcaaacccagcac

SEQ ID NO: 972887 - RNA, 13 nt, Mycobacterium avium subsp. paratuberculosis
gcaaaccgaccgc

SEQ ID NO: 972888 - RNA, 19 nt, Mycobacterium avium subsp. paratuberculosis
gcaaaccgaccgccgcggc

SEQ ID NO: 972889 - RNA, 20 nt, Mycobacterium avium subsp. paratuberculosis
gcaaaccggaccgccgcggc

SEQ ID NO: 972890 - RNA, 19 nt, Mycobacterium avium subsp. paratuberculosis
gcaaaacggugcggccucg

SEQ ID NO: 972891 - RNA, 18 nt, Mycobacterium avium subsp. paratuberculosis
gccaggaaccacaccccg

SEQ ID NO: 972892 - RNA, 12 nt, Mycobacterium avium subsp. paratuberculosis
gccaggaccagc

SEQ ID NO: 972893 - RNA, 18 nt, Mycobacterium avium subsp. paratuberculosis
gccaggaauaacgccggc

SEQ ID NO: 972894 - RNA, 16 nt, Mycobacterium avium subsp. paratuberculosis
gccaggaccagcgggu

SEQ ID NO: 972895 - RNA, 21 nt, Mycobacterium avium subsp. paratuberculosis
gccaggacgaaaaccaggaac

SEQ ID NO: 972896 - RNA, 14 nt, Mycobacterium avium subsp. paratuberculosis
gccagcugggcagc

SEQ ID NO: 972897 - RNA, 15 nt, Mycobacterium avium subsp. paratuberculosis
gccagcugggcagcc

SEQ ID NO: 972898 - RNA, 20 nt, Mycobacterium avium subsp. paratuberculosis
gccagcuggugaagcugccg

SEQ ID NO: 972899 - RNA, 14 nt, Mycobacterium avium subsp. paratuberculosis
gccagcugcgugaa

SEQ ID NO: 972900 - RNA, 22 nt, Mycobacterium avium subsp. paratuberculosis
gccagcuucaccggucgggcca

SEQ ID NO: 972901 - RNA, 19 nt, Mycobacterium avium subsp. paratuberculosis
gccagcuucgggcgcgcgc

SEQ ID NO: 972902 - RNA, 15 nt, Mycobacterium avium subsp. paratuberculosis
gccagcuugcagcug

SEQ ID NO: 972903 - RNA, 19 nt, Mycobacterium avium subsp. paratuberculosis
gccagcugcaccggggccg

SEQ ID NO: 972904 - RNA, 16 nt, Mycobacterium avium subsp. paratuberculosis
gccagcugcccgccga

SEQ ID NO: 972905 - RNA, 21 nt, Mycobacterium avium subsp. paratuberculosis
gccagcucggucagccgggcg

SEQ ID NO: 972906 - RNA, 16 nt, Mycobacterium avium subsp. paratuberculosis
gccagcucguccagcg

SEQ ID NO: 972907 - RNA, 16 nt, Mycobacterium avium subsp. paratuberculosis
gccagcucggccaucc

SEQ ID NO: 972908 - RNA, 23 nt, Mycobacterium avium subsp. paratuberculosis
gccaggccauggcgcaccgcggc

SEQ ID NO: 972909 - RNA, 15 nt, Mycobacterium avium subsp. paratuberculosis
gccaggcccugccag

SEQ ID NO: 972910 - RNA, 22 nt, Mycobacterium avium subsp. paratuberculosis
gccaggcccugccagcgcccgc

SEQ ID NO: 972911 - RNA, 15 nt, Mycobacterium avium subsp. paratuberculosis
gccaggcccagcccg

SEQ ID NO: 972912 - RNA, 15 nt, Mycobacterium avium subsp. paratuberculosis
gccaggcccagccca

SEQ ID NO: 972913 - RNA, 20 nt, Mycobacterium avium subsp. paratuberculosis
gccaggccgucggcgcggcc

SEQ ID NO: 972914 - RNA, 15 nt, Mycobacterium avium subsp. paratuberculosis
gccaggccgccgggc

SEQ ID NO: 972915 - RNA, 12 nt, Mycobacterium avium subsp. paratuberculosis
gccaggccgccg

SEQ ID NO: 972916 - RNA, 11 nt, Mycobacterium avium subsp. paratuberculosis
gccaggaugac

SEQ ID NO: 972917 - RNA, 19 nt, Mycobacterium avium subsp. paratuberculosis
gccaggaucucgcgggccc

SEQ ID NO: 972918 - RNA, 21 nt, Mycobacterium avium subsp. paratuberculosis
gccaggaucucgcgggcccgc

SEQ ID NO: 972919 - RNA, 14 nt, Mycobacterium avium subsp. paratuberculosis
gccaggaugaaccg

SEQ ID NO: 972920 - RNA, 18 nt, Mycobacterium avium subsp. paratuberculosis
gccaggauccgcccgccg

SEQ ID NO: 972921 - RNA, 20 nt, Mycobacterium avium subsp. paratuberculosis
gccaggauguacccgcaggc

SEQ ID NO: 972922 - RNA, 20 nt, Mycobacterium avium subsp. paratuberculosis
gccaggaugucguccucggu

SEQ ID NO: 972923 - RNA, 20 nt, Mycobacterium avium subsp. paratuberculosis
gccaggauguucaccccggc

SEQ ID NO: 972924 - RNA, 16 nt, Mycobacterium avium subsp. paratuberculosis
gccaggcacagcaggg

SEQ ID NO: 972925 - RNA, 17 nt, Mycobacterium avium subsp. paratuberculosis
gccaggcacagcagggc

SEQ ID NO: 972926 - RNA, 20 nt, Mycobacterium avium subsp. paratuberculosis
gccaggcacagcagggcacc

SEQ ID NO: 972927 - RNA, 21 nt, Mycobacterium avium subsp. paratuberculosis
gccagcguuuccagcgccggc

SEQ ID NO: 972928 - RNA, 16 nt, Mycobacterium avium subsp. paratuberculosis
gccagcucaccggcca

SEQ ID NO: 972929 - RNA, 22 nt, Mycobacterium avium subsp. paratuberculosis
gccagcucaccggccagggccg

SEQ ID NO: 972930 - RNA, 23 nt, Mycobacterium avium subsp. paratuberculosis
gccagcucaccggccagggccgc

SEQ ID NO: 972931 - RNA, 14 nt, Mycobacterium avium subsp. paratuberculosis
gccagcucccgggc

SEQ ID NO: 972932 - RNA, 20 nt, Mycobacterium avium subsp. paratuberculosis
gccagcuccucggggaugac

SEQ ID NO: 972933 - RNA, 16 nt, Mycobacterium avium subsp. paratuberculosis
gccagcuccagcagcc

SEQ ID NO: 972934 - RNA, 18 nt, Mycobacterium avium subsp. paratuberculosis
gccagcucgaaccuggag

SEQ ID NO: 972935 - RNA, 18 nt, Mycobacterium avium subsp. paratuberculosis
gccagcucgaccgcggcg

SEQ ID NO: 972936 - RNA, 16 nt, Mycobacterium avium subsp. paratuberculosis
gccagcucgccgccga

SEQ ID NO: 972937 - RNA, 19 nt, Mycobacterium avium subsp. paratuberculosis
gccagcgucccguccuggg

SEQ ID NO: 972938 - RNA, 15 nt, Mycobacterium avium subsp. paratuberculosis
gccagcgucgcgccg

SEQ ID NO: 972939 - RNA, 16 nt, Mycobacterium avium subsp. paratuberculosis
gccagcgucgcgccgc

SEQ ID NO: 972940 - RNA, 18 nt, Mycobacterium avium subsp. paratuberculosis
gccagcgugacgccgggc

SEQ ID NO: 972941 - RNA, 19 nt, Mycobacterium avium subsp. paratuberculosis
gccagcgugacgccgggcc

SEQ ID NO: 972942 - RNA, 15 nt, Mycobacterium avium subsp. paratuberculosis
gccagcguggccagc

SEQ ID NO: 972943 - RNA, 16 nt, Mycobacterium avium subsp. paratuberculosis
gccagcguggccagca

SEQ ID NO: 972944 - RNA, 18 nt, Mycobacterium avium subsp. paratuberculosis
gccagcgugaacagcgcc

SEQ ID NO: 972945 - RNA, 15 nt, Mycobacterium avium subsp. paratuberculosis
gccagcgcgcgggcg

SEQ ID NO: 972946 - RNA, 13 nt, Mycobacterium avium subsp. paratuberculosis
gccagcgcgcgca

SEQ ID NO: 972947 - RNA, 22 nt, Mycobacterium avium subsp. paratuberculosis
gccagcgcgccgaucgcccagu

SEQ ID NO: 972948 - RNA, 15 nt, Mycobacterium avium subsp. paratuberculosis
gccagcgcgccgcac

SEQ ID NO: 972949 - RNA, 16 nt, Mycobacterium avium subsp. paratuberculosis
gccagcgcgccgcaca

SEQ ID NO: 972950 - RNA, 18 nt, Mycobacterium avium subsp. paratuberculosis
gccagcgcgccgcacagc

SEQ ID NO: 972951 - RNA, 21 nt, Mycobacterium avium subsp. paratuberculosis
gccagcgccuucggcgccagc

SEQ ID NO: 972952 - RNA, 22 nt, Mycobacterium avium subsp. paratuberculosis
gccagcgccuucggcgccagcc

SEQ ID NO: 972953 - RNA, 18 nt, Mycobacterium avium subsp. paratuberculosis
gccagcgccuucuccagc

SEQ ID NO: 972954 - RNA, 23 nt, Mycobacterium avium subsp. paratuberculosis
gccagcgccuucuccagcuccuc

SEQ ID NO: 972955 - RNA, 14 nt, Mycobacterium avium subsp. paratuberculosis
gccagcgcggcggc

SEQ ID NO: 972956 - RNA, 18 nt, Mycobacterium avium subsp. paratuberculosis
gccagcgcggcggccagc

SEQ ID NO: 972957 - RNA, 16 nt, Mycobacterium avium subsp. paratuberculosis
gccagcgcggcggcgc

SEQ ID NO: 972958 - RNA, 14 nt, Mycobacterium avium subsp. paratuberculosis
gccagcgcggcggu

SEQ ID NO: 972959 - RNA, 23 nt, Mycobacterium avium subsp. paratuberculosis
gccagcgcggcggucgcgcgccg

SEQ ID NO: 972960 - RNA, 21 nt, Mycobacterium avium subsp. paratuberculosis
gccagcgcggcgucacccugg

SEQ ID NO: 972961 - RNA, 12 nt, Mycobacterium avium subsp. paratuberculosis
gccagcgcggcg

SEQ ID NO: 972962 - RNA, 14 nt, Mycobacterium avium subsp. paratuberculosis
gccagcgcgcggcc

SEQ ID NO: 972963 - RNA, 17 nt, Mycobacterium avium subsp. paratuberculosis
gccagcgcggugcccag

SEQ ID NO: 972964 - RNA, 18 nt, Mycobacterium avium subsp. paratuberculosis
gccagcgcggugcccagc

SEQ ID NO: 972965 - RNA, 19 nt, Mycobacterium avium subsp. paratuberculosis
gccagcgcggugcccagcc

SEQ ID NO: 972966 - RNA, 23 nt, Mycobacterium avium subsp. paratuberculosis
gccagcgcggugcccagccaggc

SEQ ID NO: 972967 - RNA, 22 nt, Mycobacterium avium subsp. paratuberculosis
gccagcgcgucggccagcacca

SEQ ID NO: 972968 - RNA, 12 nt, Mycobacterium avium subsp. paratuberculosis
gccagcgcguga

SEQ ID NO: 972969 - RNA, 15 nt, Mycobacterium avium subsp. paratuberculosis
gccagcgcgugcggg

SEQ ID NO: 972970 - RNA, 15 nt, Mycobacterium avium subsp. paratuberculosis
gccagcgcggugugc

SEQ ID NO: 972971 - RNA, 15 nt, Mycobacterium avium subsp. paratuberculosis
gccagcggcuugccg

SEQ ID NO: 972972 - RNA, 15 nt, Mycobacterium avium subsp. paratuberculosis
gccagcggcgccggg

SEQ ID NO: 972973 - RNA, 20 nt, Mycobacterium avium subsp. paratuberculosis
gccagcggcgccgggucacc

SEQ ID NO: 972974 - RNA, 13 nt, Mycobacterium avium subsp. paratuberculosis
gccagcggccagc

SEQ ID NO: 972975 - RNA, 14 nt, Mycobacterium avium subsp. paratuberculosis
gccagcggccagcc

SEQ ID NO: 972976 - RNA, 20 nt, Mycobacterium avium subsp. paratuberculosis
gccagcggccagcccgcggc

SEQ ID NO: 972977 - RNA, 10 nt, Mycobacterium avium subsp. paratuberculosis
gccagcggca

SEQ ID NO: 972978 - RNA, 18 nt, Mycobacterium avium subsp. paratuberculosis
gccagcggcagcgccagc

SEQ ID NO: 972979 - RNA, 22 nt, Mycobacterium avium subsp. paratuberculosis
gccagcaucgagaugcugugga

SEQ ID NO: 972980 - RNA, 23 nt, Mycobacterium avium subsp. paratuberculosis
gccagcaugaucaccgccagcgc

SEQ ID NO: 972981 - RNA, 15 nt, Mycobacterium avium subsp. paratuberculosis
gccagccagccgccc

SEQ ID NO: 972982 - RNA, 14 nt, Mycobacterium avium subsp. paratuberculosis
gccagccaggcgau

SEQ ID NO: 972983 - RNA, 21 nt, Mycobacterium avium subsp. paratuberculosis
gccagccaguugggggccagc

SEQ ID NO: 972984 - RNA, 17 nt, Mycobacterium avium subsp. paratuberculosis
gccagcagguccgccgg

SEQ ID NO: 972985 - RNA, 22 nt, Mycobacterium avium subsp. paratuberculosis
gccagcaggucgaaggcggccg

SEQ ID NO: 972986 - RNA, 21 nt, Mycobacterium avium subsp. paratuberculosis
gccagcagucgugacgcggcg

SEQ ID NO: 972987 - RNA, 14 nt, Mycobacterium avium subsp. paratuberculosis
gccagcagcggcuu

SEQ ID NO: 972988 - RNA, 13 nt, Mycobacterium avium subsp. paratuberculosis
gccagcaggaucu

SEQ ID NO: 972989 - RNA, 17 nt, Mycobacterium avium subsp. paratuberculosis
gccagcaggaugaugac

SEQ ID NO: 972990 - RNA, 11 nt, Mycobacterium avium subsp. paratuberculosis
gccagcagcac

SEQ ID NO: 972991 - RNA, 16 nt, Mycobacterium avium subsp. paratuberculosis
gccagcagaucggaga

SEQ ID NO: 972992 - RNA, 17 nt, Mycobacterium avium subsp. paratuberculosis
gccagcagaugccgccc

SEQ ID NO: 972993 - RNA, 22 nt, Mycobacterium avium subsp. paratuberculosis
gccagcagaugccgcccaggug

SEQ ID NO: 972994 - RNA, 13 nt, Mycobacterium avium subsp. paratuberculosis
gccagcagcaggu

SEQ ID NO: 972995 - RNA, 13 nt, Mycobacterium avium subsp. paratuberculosis
gccagcagcacca

SEQ ID NO: 972996 - RNA, 13 nt, Mycobacterium avium subsp. paratuberculosis
gccagcagcagcc

SEQ ID NO: 972997 - RNA, 19 nt, Mycobacterium avium subsp. paratuberculosis
gccagcagcagccgcgccg

SEQ ID NO: 972998 - RNA, 22 nt, Mycobacterium avium subsp. paratuberculosis
gccagcagcagccgcgccgccg

SEQ ID NO: 972999 - RNA, 16 nt, Mycobacterium avium subsp. paratuberculosis
gccagcagccagcugg

SEQ ID NO: 973000 - RNA, 18 nt, Mycobacterium avium subsp. paratuberculosis
gccagcagcagcgcggca

SEQ ID NO: 973001 - RNA, 12 nt, Mycobacterium avium subsp. paratuberculosis
gccagcagcagg

SEQ ID NO: 973002 - RNA, 14 nt, Mycobacterium avium subsp. paratuberculosis
gccagcagccgcgc

SEQ ID NO: 973003 - RNA, 19 nt, Mycobacterium avium subsp. paratuberculosis
gccagcagccgcgcgagca

SEQ ID NO: 973004 - RNA, 15 nt, Mycobacterium avium subsp. paratuberculosis
gccagcagccgcagc

SEQ ID NO: 973005 - RNA, 15 nt, Mycobacterium avium subsp. paratuberculosis
gccagcagcgcaagc

SEQ ID NO: 973006 - RNA, 15 nt, Mycobacterium avium subsp. paratuberculosis
gccagcagcgcgccg

SEQ ID NO: 973007 - RNA, 17 nt, Mycobacterium avium subsp. paratuberculosis
gccagccgggguagggc

SEQ ID NO: 973008 - RNA, 21 nt, Mycobacterium avium subsp. paratuberculosis
gccagccgguacggaucgccg

SEQ ID NO: 973009 - RNA, 17 nt, Mycobacterium avium subsp. paratuberculosis
gccagccggcccuccag

SEQ ID NO: 973010 - RNA, 13 nt, Mycobacterium avium subsp. paratuberculosis
gccagccggccgc

SEQ ID NO: 973011 - RNA, 14 nt, Mycobacterium avium subsp. paratuberculosis
gccagccggccgcu

SEQ ID NO: 973012 - RNA, 15 nt, Mycobacterium avium subsp. paratuberculosis
gccagccggccgcug

SEQ ID NO: 973013 - RNA, 15 nt, Mycobacterium avium subsp. paratuberculosis
gccagccccaccggc

SEQ ID NO: 973014 - RNA, 17 nt, Mycobacterium avium subsp. paratuberculosis
gccagccccaccggcca

SEQ ID NO: 973015 - RNA, 12 nt, Mycobacterium avium subsp. paratuberculosis
gccagcccgcgg

SEQ ID NO: 973016 - RNA, 12 nt, Mycobacterium avium subsp. paratuberculosis
gccagcccgcgu

SEQ ID NO: 973017 - RNA, 22 nt, Mycobacterium avium subsp. paratuberculosis
gccagcccgcgucguguccggg

SEQ ID NO: 973018 - RNA, 18 nt, Mycobacterium avium subsp. paratuberculosis
gccagccgccggcucagc

SEQ ID NO: 973019 - RNA, 21 nt, Mycobacterium avium subsp. paratuberculosis
gccagccgcccagcaucgccg

SEQ ID NO: 973020 - RNA, 13 nt, Mycobacterium avium subsp. paratuberculosis
gccagccgcgccg

SEQ ID NO: 973021 - RNA, 20 nt, Mycobacterium avium subsp. paratuberculosis
gccagccgaugcgcccgcgc

SEQ ID NO: 973022 - RNA, 12 nt, Mycobacterium avium subsp. paratuberculosis
gccagcccggcg

SEQ ID NO: 973023 - RNA, 18 nt, Mycobacterium avium subsp. paratuberculosis
gccagcccgggaaagcgg

SEQ ID NO: 973024 - RNA, 22 nt, Mycobacterium avium subsp. paratuberculosis
gccagcccggugaucgccgccc

SEQ ID NO: 973025 - RNA, 13 nt, Mycobacterium avium subsp. paratuberculosis
gccagcccgucgg

SEQ ID NO: 973026 - RNA, 13 nt, Mycobacterium avium subsp. paratuberculosis
gccagcccguggc

SEQ ID NO: 973027 - RNA, 12 nt, Mycobacterium avium subsp. paratuberculosis
gccagcgcccgc

SEQ ID NO: 973028 - RNA, 13 nt, Mycobacterium avium subsp. paratuberculosis
gccagcgccgaga

SEQ ID NO: 973029 - RNA, 13 nt, Mycobacterium avium subsp. paratuberculosis
gccagcgccgcaa

SEQ ID NO: 973030 - RNA, 12 nt, Mycobacterium avium subsp. paratuberculosis
gccagcgccgcc

SEQ ID NO: 973031 - RNA, 17 nt, Mycobacterium avium subsp. paratuberculosis
gccagcgccgcgcgcgc

SEQ ID NO: 973032 - RNA, 18 nt, Mycobacterium avium subsp. paratuberculosis
gccagcgccgccagccgc

SEQ ID NO: 973033 - RNA, 13 nt, Mycobacterium avium subsp. paratuberculosis
gccagcgccgccc

SEQ ID NO: 973034 - RNA, 17 nt, Mycobacterium avium subsp. paratuberculosis
gccagcgccgcccgggc

SEQ ID NO: 973035 - RNA, 20 nt, Mycobacterium avium subsp. paratuberculosis
gccagcgccuccagccgcuc

SEQ ID NO: 973036 - RNA, 14 nt, Mycobacterium avium subsp. paratuberculosis
gccagcgccagcgc

SEQ ID NO: 973037 - RNA, 17 nt, Mycobacterium avium subsp. paratuberculosis
gccagcgccacccccca

SEQ ID NO: 973038 - RNA, 14 nt, Mycobacterium avium subsp. paratuberculosis
gccagcgcccgcgc

SEQ ID NO: 973039 - RNA, 16 nt, Mycobacterium avium subsp. paratuberculosis
gccagcgcccgcgcgu

SEQ ID NO: 973040 - RNA, 13 nt, Mycobacterium avium subsp. paratuberculosis
gccagcgcccgcu

SEQ ID NO: 973041 - RNA, 15 nt, Mycobacterium avium subsp. paratuberculosis
gccagcgcccggcga

SEQ ID NO: 973042 - RNA, 15 nt, Mycobacterium avium subsp. paratuberculosis
gccagcgcaccgagc

SEQ ID NO: 973043 - RNA, 17 nt, Mycobacterium avium subsp. paratuberculosis
gccagcgcaucggucac

SEQ ID NO: 973044 - RNA, 20 nt, Mycobacterium avium subsp. paratuberculosis
gccagcgccacgcucaugcc

SEQ ID NO: 973045 - RNA, 20 nt, Mycobacterium avium subsp. paratuberculosis
gccagcgcagguacgcggcg

SEQ ID NO: 973046 - RNA, 22 nt, Mycobacterium avium subsp. paratuberculosis
gccagcgaguccagccagccgc

SEQ ID NO: 973047 - RNA, 13 nt, Mycobacterium avium subsp. paratuberculosis
gccagcgacggcc

SEQ ID NO: 973048 - RNA, 20 nt, Mycobacterium avium subsp. paratuberculosis
gccacaauggauccgaucag

SEQ ID NO: 973049 - RNA, 14 nt, Mycobacterium avium subsp. paratuberculosis
gccacaccgaucag

SEQ ID NO: 973050 - RNA, 15 nt, Mycobacterium avium subsp. paratuberculosis
gccacauguucuccu

SEQ ID NO: 973051 - RNA, 15 nt, Mycobacterium avium subsp. paratuberculosis
gccaccaccuucauc

SEQ ID NO: 973052 - RNA, 21 nt, Mycobacterium avium subsp. paratuberculosis
gccaccacaucgcuggggugc

SEQ ID NO: 973053 - RNA, 12 nt, Mycobacterium avium subsp. paratuberculosis
gccaccaccacg

SEQ ID NO: 973054 - RNA, 18 nt, Mycobacterium avium subsp. paratuberculosis
gccaccaccacggccgcc

SEQ ID NO: 973055 - RNA, 16 nt, Mycobacterium avium subsp. paratuberculosis
gccaccaccagcgggc

SEQ ID NO: 973056 - RNA, 23 nt, Mycobacterium avium subsp. paratuberculosis
gccaccaccgagguggcccagcc

SEQ ID NO: 973057 - RNA, 14 nt, Mycobacterium avium subsp. paratuberculosis
gccaccaccgccac

SEQ ID NO: 973058 - RNA, 15 nt, Mycobacterium avium subsp. paratuberculosis
gccaccacggcgccc

SEQ ID NO: 973059 - RNA, 16 nt, Mycobacterium avium subsp. paratuberculosis
gccaccaccuccucgc

SEQ ID NO: 973060 - RNA, 14 nt, Mycobacterium avium subsp. paratuberculosis
gccaccacgccagc

SEQ ID NO: 973061 - RNA, 15 nt, Mycobacterium avium subsp. paratuberculosis
gccaccacgccagcc

SEQ ID NO: 973062 - RNA, 16 nt, Mycobacterium avium subsp. paratuberculosis
gccaccacgccagccu

SEQ ID NO: 973063 - RNA, 16 nt, Mycobacterium avium subsp. paratuberculosis
gccaccagaaccauuu

SEQ ID NO: 973064 - RNA, 14 nt, Mycobacterium avium subsp. paratuberculosis
gccaccucgccgca

SEQ ID NO: 973065 - RNA, 22 nt, Mycobacterium avium subsp. paratuberculosis
gccaccuccuccgguccgggcu

SEQ ID NO: 973066 - RNA, 17 nt, Mycobacterium avium subsp. paratuberculosis
gccaccucgucccagcg

SEQ ID NO: 973067 - RNA, 19 nt, Mycobacterium avium subsp. paratuberculosis
gccaccucgucggcgguca

SEQ ID NO: 973068 - RNA, 22 nt, Mycobacterium avium subsp. paratuberculosis
gccacgaugcugauacccgcgc

SEQ ID NO: 973069 - RNA, 19 nt, Mycobacterium avium subsp. paratuberculosis
gccacgccaacugguccug

SEQ ID NO: 973070 - RNA, 12 nt, Mycobacterium avium subsp. paratuberculosis
gccacgccgccc

SEQ ID NO: 973071 - RNA, 13 nt, Mycobacterium avium subsp. paratuberculosis
gccacgccgcccc

SEQ ID NO: 973072 - RNA, 17 nt, Mycobacterium avium subsp. paratuberculosis
gccacgccgggcauccg

SEQ ID NO: 973073 - RNA, 13 nt, Mycobacterium avium subsp. paratuberculosis
gccacgccggguu

SEQ ID NO: 973074 - RNA, 22 nt, Mycobacterium avium subsp. paratuberculosis
gccacgccggguuuguccggcc

SEQ ID NO: 973075 - RNA, 14 nt, Mycobacterium avium subsp. paratuberculosis
gccacgccguggcc

SEQ ID NO: 973076 - RNA, 22 nt, Mycobacterium avium subsp. paratuberculosis
gccacgccgacaccgucgccgu

SEQ ID NO: 973077 - RNA, 13 nt, Mycobacterium avium subsp. paratuberculosis
gccacgccccggc

SEQ ID NO: 973078 - RNA, 21 nt, Mycobacterium avium subsp. paratuberculosis
gccacgccgacuagcgcggcg

SEQ ID NO: 973079 - RNA, 23 nt, Mycobacterium avium subsp. paratuberculosis
gccacgcccagggcgccagauuc

SEQ ID NO: 973080 - RNA, 14 nt, Mycobacterium avium subsp. paratuberculosis
gccacgcccaccgg

SEQ ID NO: 973081 - RNA, 19 nt, Mycobacterium avium subsp. paratuberculosis
gccacgcccaccgguggcc

SEQ ID NO: 973082 - RNA, 18 nt, Mycobacterium avium subsp. paratuberculosis
gccaccgcgucgcugccc

SEQ ID NO: 973083 - RNA, 21 nt, Mycobacterium avium subsp. paratuberculosis
gccaccgcugggcggcgcggc

SEQ ID NO: 973084 - RNA, 18 nt, Mycobacterium avium subsp. paratuberculosis
gccaccgcggccagcugc

SEQ ID NO: 973085 - RNA, 18 nt, Mycobacterium avium subsp. paratuberculosis
gccaccgcggggcugggc

SEQ ID NO: 973086 - RNA, 16 nt, Mycobacterium avium subsp. paratuberculosis
gccaccgcgcggcggu

SEQ ID NO: 973087 - RNA, 23 nt, Mycobacterium avium subsp. paratuberculosis
gccaccgcgcggugcaccaggac

SEQ ID NO: 973088 - RNA, 16 nt, Mycobacterium avium subsp. paratuberculosis
gccaccgcgccccggc

SEQ ID NO: 973089 - RNA, 14 nt, Mycobacterium avium subsp. paratuberculosis
gccaccgccugcgc

SEQ ID NO: 973090 - RNA, 22 nt, Mycobacterium avium subsp. paratuberculosis
gccaccgccugcgcgaucgccg

SEQ ID NO: 973091 - RNA, 18 nt, Mycobacterium avium subsp. paratuberculosis
gccaccgcgaaagcgucg

SEQ ID NO: 973092 - RNA, 15 nt, Mycobacterium avium subsp. paratuberculosis
gccaccgcgacgccc

SEQ ID NO: 973093 - RNA, 17 nt, Mycobacterium avium subsp. paratuberculosis
gccaccgcgacgcugcc

SEQ ID NO: 973094 - RNA, 15 nt, Mycobacterium avium subsp. paratuberculosis
gccaccgccgccagc

SEQ ID NO: 973095 - RNA, 18 nt, Mycobacterium avium subsp. paratuberculosis
gccaccgccgccagcagc

SEQ ID NO: 973096 - RNA, 19 nt, Mycobacterium avium subsp. paratuberculosis
gccaccgccgccagcagca

SEQ ID NO: 973097 - RNA, 21 nt, Mycobacterium avium subsp. paratuberculosis
gccaccagaugccgggcuccg

SEQ ID NO: 973098 - RNA, 13 nt, Mycobacterium avium subsp. paratuberculosis
gccaccagcaggc

SEQ ID NO: 973099 - RNA, 12 nt, Mycobacterium avium subsp. paratuberculosis
gccaccagcagc

SEQ ID NO: 973100 - RNA, 13 nt, Mycobacterium avium subsp. paratuberculosis
gccaccagcagcg

SEQ ID NO: 973101 - RNA, 17 nt, Mycobacterium avium subsp. paratuberculosis
gccaccagcgcccgccc

SEQ ID NO: 973102 - RNA, 20 nt, Mycobacterium avium subsp. paratuberculosis
gccaccagccacaccgccgc

SEQ ID NO: 973103 - RNA, 20 nt, Mycobacterium avium subsp. paratuberculosis
gccaccagggcgaccgccgc

SEQ ID NO: 973104 - RNA, 21 nt, Mycobacterium avium subsp. paratuberculosis
gccagcaccagcagccggucg

SEQ ID NO: 973105 - RNA, 13 nt, Mycobacterium avium subsp. paratuberculosis
gccagcaccaccg

SEQ ID NO: 973106 - RNA, 18 nt, Mycobacterium avium subsp. paratuberculosis
gccagcaccaccgcgagc

SEQ ID NO: 973107 - RNA, 18 nt, Mycobacterium avium subsp. paratuberculosis
gccagcacauagcgcagc

SEQ ID NO: 973108 - RNA, 13 nt, Mycobacterium avium subsp. paratuberculosis
gccagcaccacca

SEQ ID NO: 973109 - RNA, 17 nt, Mycobacterium avium subsp. paratuberculosis
gccagcaacgacccggc

SEQ ID NO: 973110 - RNA, 20 nt, Mycobacterium avium subsp. paratuberculosis
gccagcaccaugaucaggcc

SEQ ID NO: 973111 - RNA, 22 nt, Mycobacterium avium subsp. paratuberculosis
gccagcacccgcucgcgggccc

SEQ ID NO: 973112 - RNA, 16 nt, Mycobacterium avium subsp. paratuberculosis
gccagcaccggcgcgc

SEQ ID NO: 973113 - RNA, 17 nt, Mycobacterium avium subsp. paratuberculosis
gccagcaccggcgcgcc

SEQ ID NO: 973114 - RNA, 18 nt, Mycobacterium avium subsp. paratuberculosis
gccagcaccggcgcgccg

SEQ ID NO: 973115 - RNA, 20 nt, Mycobacterium avium subsp. paratuberculosis
gccagcaccgggcccagcuc

SEQ ID NO: 973116 - RNA, 18 nt, Mycobacterium avium subsp. paratuberculosis
gccagcaccgacgcgccg

SEQ ID NO: 973117 - RNA, 17 nt, Mycobacterium avium subsp. paratuberculosis
gccagcaccgccagcgc

SEQ ID NO: 973118 - RNA, 17 nt, Mycobacterium avium subsp. paratuberculosis
gccagcaccgccccggu

SEQ ID NO: 973119 - RNA, 20 nt, Mycobacterium avium subsp. paratuberculosis
gccagcaccgccccggucac

SEQ ID NO: 973120 - RNA, 16 nt, Mycobacterium avium subsp. paratuberculosis
gccagcaccgcggccg

SEQ ID NO: 973121 - RNA, 16 nt, Mycobacterium avium subsp. paratuberculosis
gccagcaccucgcggc

SEQ ID NO: 973122 - RNA, 17 nt, Mycobacterium avium subsp. paratuberculosis
gccagcaccucgcggca

SEQ ID NO: 973123 - RNA, 20 nt, Mycobacterium avium subsp. paratuberculosis
gccagcaccucgcggcagcc

SEQ ID NO: 973124 - RNA, 19 nt, Mycobacterium avium subsp. paratuberculosis
gccagcaccuucagcgggc

SEQ ID NO: 973125 - RNA, 20 nt, Mycobacterium avium subsp. paratuberculosis
gccagcaccuucagcgggcg

SEQ ID NO: 973126 - RNA, 18 nt, Mycobacterium avium subsp. paratuberculosis
gccagcacgaacaccacg

SEQ ID NO: 973127 - RNA, 22 nt, Mycobacterium avium subsp. paratuberculosis
gccagcacgguguugcgcaccc

SEQ ID NO: 973128 - RNA, 18 nt, Mycobacterium avium subsp. paratuberculosis
gccagcacggucagcggc

SEQ ID NO: 973129 - RNA, 21 nt, Mycobacterium avium subsp. paratuberculosis
gccagcacggccaccagcagc

SEQ ID NO: 973130 - RNA, 19 nt, Mycobacterium avium subsp. paratuberculosis
gccagcacgcccccgcugg

SEQ ID NO: 973131 - RNA, 17 nt, Mycobacterium avium subsp. paratuberculosis
gccagauacuccucggu

SEQ ID NO: 973132 - RNA, 14 nt, Mycobacterium avium subsp. paratuberculosis
gccagaucgacccc

SEQ ID NO: 973133 - RNA, 18 nt, Mycobacterium avium subsp. paratuberculosis
gccagaucgacgccgcgg

SEQ ID NO: 973134 - RNA, 18 nt, Mycobacterium avium subsp. paratuberculosis
gccagaucgaggccagcg

SEQ ID NO: 973135 - RNA, 15 nt, Mycobacterium avium subsp. paratuberculosis
gccagcaacacccag

SEQ ID NO: 973136 - RNA, 16 nt, Mycobacterium avium subsp. paratuberculosis
gccagcaacacccagc

SEQ ID NO: 973137 - RNA, 18 nt, Mycobacterium avium subsp. paratuberculosis
gccagaccguucuccgag

SEQ ID NO: 973138 - RNA, 20 nt, Mycobacterium avium subsp. paratuberculosis
gccagacgcgcaccgccacc

SEQ ID NO: 973139 - RNA, 17 nt, Mycobacterium avium subsp. paratuberculosis
gccagacguccagcgcc

SEQ ID NO: 973140 - RNA, 20 nt, Mycobacterium avium subsp. paratuberculosis
gccagacguccagcgccgcc

SEQ ID NO: 973141 - RNA, 21 nt, Mycobacterium avium subsp. paratuberculosis
gccagacgguggggcuggccg

SEQ ID NO: 973142 - RNA, 21 nt, Mycobacterium avium subsp. paratuberculosis
gccagacugaugcccucgccg

SEQ ID NO: 973143 - RNA, 14 nt, Mycobacterium avium subsp. paratuberculosis
gccacuuguccacc

SEQ ID NO: 973144 - RNA, 22 nt, Mycobacterium avium subsp. paratuberculosis
gccagaacgaacagauggugaa

SEQ ID NO: 973145 - RNA, 16 nt, Mycobacterium avium subsp. paratuberculosis
gccagaacacgccccg

SEQ ID NO: 973146 - RNA, 20 nt, Mycobacterium avium subsp. paratuberculosis
gccagaacacgccccggcgg

SEQ ID NO: 973147 - RNA, 20 nt, Mycobacterium avium subsp. paratuberculosis
gccagaacgcuacucgcgca

SEQ ID NO: 973148 - RNA, 15 nt, Mycobacterium avium subsp. paratuberculosis
gccagaacggcggca

SEQ ID NO: 973149 - RNA, 17 nt, Mycobacterium avium subsp. paratuberculosis
gccacgcucggcggcgc

SEQ ID NO: 973150 - RNA, 14 nt, Mycobacterium avium subsp. paratuberculosis
gccacgcggcgcgc

SEQ ID NO: 973151 - RNA, 15 nt, Mycobacterium avium subsp. paratuberculosis
gccacgcgcagggcg

SEQ ID NO: 973152 - RNA, 18 nt, Mycobacterium avium subsp. paratuberculosis
gcauccagguggcgccuc

SEQ ID NO: 973153 - RNA, 21 nt, Mycobacterium avium subsp. paratuberculosis
gcaucgaggaccggcgccggc

SEQ ID NO: 973154 - RNA, 11 nt, Mycobacterium avium subsp. paratuberculosis
gcaucaucgcc

SEQ ID NO: 973155 - RNA, 22 nt, Mycobacterium avium subsp. paratuberculosis
gcauccagcacggccgccagga

SEQ ID NO: 973156 - RNA, 18 nt, Mycobacterium avium subsp. paratuberculosis
gcaucgucggcgccggcg

SEQ ID NO: 973157 - RNA, 22 nt, Mycobacterium avium subsp. paratuberculosis
gcaucguggcuuuggucgccag

SEQ ID NO: 973158 - RNA, 22 nt, Mycobacterium avium subsp. paratuberculosis
gcaucgcacagauacgcgacga

SEQ ID NO: 973159 - RNA, 23 nt, Mycobacterium avium subsp. paratuberculosis
gcaucgccgaaccgggcgcgcag

SEQ ID NO: 973160 - RNA, 12 nt, Mycobacterium avium subsp. paratuberculosis
gcaucgccgaga

SEQ ID NO: 973161 - RNA, 14 nt, Mycobacterium avium subsp. paratuberculosis
gcaucgcagcgcgc

SEQ ID NO: 973162 - RNA, 19 nt, Mycobacterium avium subsp. paratuberculosis
gcaucaaaaacgaucccag

SEQ ID NO: 973163 - RNA, 15 nt, Mycobacterium avium subsp. paratuberculosis
gcaucaaauucagga

SEQ ID NO: 973164 - RNA, 20 nt, Mycobacterium avium subsp. paratuberculosis
gcaucagggccagccgaugc

SEQ ID NO: 973165 - RNA, 15 nt, Mycobacterium avium subsp. paratuberculosis
gcaucaggucggugc

SEQ ID NO: 973166 - RNA, 16 nt, Mycobacterium avium subsp. paratuberculosis
gcauaggccagcacca

SEQ ID NO: 973167 - RNA, 18 nt, Mycobacterium avium subsp. paratuberculosis
gcauagcgggagccggcc

SEQ ID NO: 973168 - RNA, 15 nt, Mycobacterium avium subsp. paratuberculosis
gcaugcccacgccgu

SEQ ID NO: 973169 - RNA, 20 nt, Mycobacterium avium subsp. paratuberculosis
gcaugucgguggacagcgcg

SEQ ID NO: 973170 - RNA, 22 nt, Mycobacterium avium subsp. paratuberculosis
gcaugucgccgaacgccaccac

SEQ ID NO: 973171 - RNA, 17 nt, Mycobacterium avium subsp. paratuberculosis
gcauguagguggcgacc

SEQ ID NO: 973172 - RNA, 17 nt, Mycobacterium avium subsp. paratuberculosis
gcauguccucggggugg

SEQ ID NO: 973173 - RNA, 23 nt, Mycobacterium avium subsp. paratuberculosis
gcauggcgaacacgucggccagc

SEQ ID NO: 973174 - RNA, 20 nt, Mycobacterium avium subsp. paratuberculosis
gcauuucggcuuccaccugc

SEQ ID NO: 973175 - RNA, 21 nt, Mycobacterium avium subsp. paratuberculosis
gccaaagagcuuggcauuucc

SEQ ID NO: 973176 - RNA, 22 nt, Mycobacterium avium subsp. paratuberculosis
gccaaacugcgcaaccacugau

SEQ ID NO: 973177 - RNA, 14 nt, Mycobacterium avium subsp. paratuberculosis
gcauucggccgcca

SEQ ID NO: 973178 - RNA, 20 nt, Mycobacterium avium subsp. paratuberculosis
gcauuccgucuuggccaggc

SEQ ID NO: 973179 - RNA, 15 nt, Mycobacterium avium subsp. paratuberculosis
gcauuccaccgcgcg

SEQ ID NO: 973180 - RNA, 21 nt, Mycobacterium avium subsp. paratuberculosis
gcauuccaccgcgcggcgcag

SEQ ID NO: 973181 - RNA, 18 nt, Mycobacterium avium subsp. paratuberculosis
gcagggccaagacacgcu

SEQ ID NO: 973182 - RNA, 20 nt, Mycobacterium avium subsp. paratuberculosis
gcaggcuggcggcgaucacc

SEQ ID NO: 973183 - RNA, 20 nt, Mycobacterium avium subsp. paratuberculosis
gcaggcucucguugaugcug

SEQ ID NO: 973184 - RNA, 23 nt, Mycobacterium avium subsp. paratuberculosis
gcaggcucucguugaugcugugc

SEQ ID NO: 973185 - RNA, 15 nt, Mycobacterium avium subsp. paratuberculosis
gcagggccucgccgu

SEQ ID NO: 973186 - RNA, 18 nt, Mycobacterium avium subsp. paratuberculosis
gcagggccagcgccucgg

SEQ ID NO: 973187 - RNA, 14 nt, Mycobacterium avium subsp. paratuberculosis
gcagggccagcggc

SEQ ID NO: 973188 - RNA, 12 nt, Mycobacterium avium subsp. paratuberculosis
gcagggccaccg

SEQ ID NO: 973189 - RNA, 19 nt, Mycobacterium avium subsp. paratuberculosis
gcagggccaccgucagggu

SEQ ID NO: 973190 - RNA, 20 nt, Mycobacterium avium subsp. paratuberculosis
gcagggccaccgucagggug

SEQ ID NO: 973191 - RNA, 14 nt, Mycobacterium avium subsp. paratuberculosis
gcagggccagcacc

SEQ ID NO: 973192 - RNA, 15 nt, Mycobacterium avium subsp. paratuberculosis
gcagggccagcggca

SEQ ID NO: 973193 - RNA, 19 nt, Mycobacterium avium subsp. paratuberculosis
gcagggccagcggcaacug

SEQ ID NO: 973194 - RNA, 15 nt, Mycobacterium avium subsp. paratuberculosis
gcaggcucagcagca

SEQ ID NO: 973195 - RNA, 16 nt, Mycobacterium avium subsp. paratuberculosis
gcaggcucagcagcac

SEQ ID NO: 973196 - RNA, 23 nt, Mycobacterium avium subsp. paratuberculosis
gcaggcgauguggguggucagcg

SEQ ID NO: 973197 - RNA, 15 nt, Mycobacterium avium subsp. paratuberculosis
gcaggcgcgccgagc

SEQ ID NO: 973198 - RNA, 16 nt, Mycobacterium avium subsp. paratuberculosis
gcaggcgcgccgagcg

SEQ ID NO: 973199 - RNA, 21 nt, Mycobacterium avium subsp. paratuberculosis
gcaggagaucggcgcggagcg

SEQ ID NO: 973200 - RNA, 16 nt, Mycobacterium avium subsp. paratuberculosis
gcaggacgggggccgg

SEQ ID NO: 973201 - RNA, 17 nt, Mycobacterium avium subsp. paratuberculosis
gcaggaccgagccgcgc

SEQ ID NO: 973202 - RNA, 15 nt, Mycobacterium avium subsp. paratuberculosis
gcaggacgcgcccgg

SEQ ID NO: 973203 - RNA, 19 nt, Mycobacterium avium subsp. paratuberculosis
gcaggaggcggccaacaac

SEQ ID NO: 973204 - RNA, 22 nt, Mycobacterium avium subsp. paratuberculosis
gcaggaucagcacuucaugguc

SEQ ID NO: 973205 - RNA, 23 nt, Mycobacterium avium subsp. paratuberculosis
gcaggaucagcacuucauggucg

SEQ ID NO: 973206 - RNA, 12 nt, Mycobacterium avium subsp. paratuberculosis
gcaggccgagcc

SEQ ID NO: 973207 - RNA, 18 nt, Mycobacterium avium subsp. paratuberculosis
gcaggccgagccgccgga

SEQ ID NO: 973208 - RNA, 16 nt, Mycobacterium avium subsp. paratuberculosis
gcaggccgaggccaac

SEQ ID NO: 973209 - RNA, 18 nt, Mycobacterium avium subsp. paratuberculosis
gcaggccggcagccggcg

SEQ ID NO: 973210 - RNA, 13 nt, Mycobacterium avium subsp. paratuberculosis
gcaggccgcccgg

SEQ ID NO: 973211 - RNA, 18 nt, Mycobacterium avium subsp. paratuberculosis
gcaggccgcccggcccaa

SEQ ID NO: 973212 - RNA, 23 nt, Mycobacterium avium subsp. paratuberculosis
gcaggccgggauagagcaccgcg

SEQ ID NO: 973213 - RNA, 17 nt, Mycobacterium avium subsp. paratuberculosis
gcaggcgagccgacagu

SEQ ID NO: 973214 - RNA, 19 nt, Mycobacterium avium subsp. paratuberculosis
gcagcugcagcgucgggua

SEQ ID NO: 973215 - RNA, 22 nt, Mycobacterium avium subsp. paratuberculosis
gcagcuggaaauaggccgggca

SEQ ID NO: 973216 - RNA, 19 nt, Mycobacterium avium subsp. paratuberculosis
gcagcuggaacaccacggc

SEQ ID NO: 973217 - RNA, 12 nt, Mycobacterium avium subsp. paratuberculosis
gcagcuggccaa

SEQ ID NO: 973218 - RNA, 12 nt, Mycobacterium avium subsp. paratuberculosis
gcagcugcucgu

SEQ ID NO: 973219 - RNA, 23 nt, Mycobacterium avium subsp. paratuberculosis
gcagcugcgucggcaccagcggc

SEQ ID NO: 973220 - RNA, 14 nt, Mycobacterium avium subsp. paratuberculosis
gcagcuagcccaga

SEQ ID NO: 973221 - RNA, 18 nt, Mycobacterium avium subsp. paratuberculosis
gcagcucagccgccuggc

SEQ ID NO: 973222 - RNA, 19 nt, Mycobacterium avium subsp. paratuberculosis
gcagcucagccgccuggcg

SEQ ID NO: 973223 - RNA, 13 nt, Mycobacterium avium subsp. paratuberculosis
gcagcgguuggcc

SEQ ID NO: 973224 - RNA, 14 nt, Mycobacterium avium subsp. paratuberculosis
gcagcggggugugc

SEQ ID NO: 973225 - RNA, 22 nt, Mycobacterium avium subsp. paratuberculosis
gcagcgggucgucgggccgggg

SEQ ID NO: 973226 - RNA, 22 nt, Mycobacterium avium subsp. paratuberculosis
gcagcggguuuggccgcgggcg

SEQ ID NO: 973227 - RNA, 21 nt, Mycobacterium avium subsp. paratuberculosis
gcaggaacagacacagcacgc

SEQ ID NO: 973228 - RNA, 22 nt, Mycobacterium avium subsp. paratuberculosis
gcaggaacuccagcagcuguug

SEQ ID NO: 973229 - RNA, 16 nt, Mycobacterium avium subsp. paratuberculosis
gcaggaaguucuucgc

SEQ ID NO: 973230 - RNA, 15 nt, Mycobacterium avium subsp. paratuberculosis
gcagcuucuggucau

SEQ ID NO: 973231 - RNA, 16 nt, Mycobacterium avium subsp. paratuberculosis
gcagcuucuggucaug

SEQ ID NO: 973232 - RNA, 17 nt, Mycobacterium avium subsp. paratuberculosis
gcagcugggagauguug

SEQ ID NO: 973233 - RNA, 15 nt, Mycobacterium avium subsp. paratuberculosis
gcaguuuggucaucc

SEQ ID NO: 973234 - RNA, 20 nt, Mycobacterium avium subsp. paratuberculosis
gcaguuccuugcgcagcacc

SEQ ID NO: 973235 - RNA, 20 nt, Mycobacterium avium subsp. paratuberculosis
gcagugccggugcagcaccu

SEQ ID NO: 973236 - RNA, 19 nt, Mycobacterium avium subsp. paratuberculosis
gcagugccgcaccagcacc

SEQ ID NO: 973237 - RNA, 12 nt, Mycobacterium avium subsp. paratuberculosis
gcaguggugcuc

SEQ ID NO: 973238 - RNA, 12 nt, Mycobacterium avium subsp. paratuberculosis
gcagggucagcg

SEQ ID NO: 973239 - RNA, 16 nt, Mycobacterium avium subsp. paratuberculosis
gcagggucagcgacaa

SEQ ID NO: 973240 - RNA, 11 nt, Mycobacterium avium subsp. paratuberculosis
gcagggcggca

SEQ ID NO: 973241 - RNA, 14 nt, Mycobacterium avium subsp. paratuberculosis
gcaguccagggugg

SEQ ID NO: 973242 - RNA, 15 nt, Mycobacterium avium subsp. paratuberculosis
gcaguccgcgccggu

SEQ ID NO: 973243 - RNA, 23 nt, Mycobacterium avium subsp. paratuberculosis
gcaguccgcgccggucccgcggc

SEQ ID NO: 973244 - RNA, 23 nt, Mycobacterium avium subsp. paratuberculosis
gcaguccggcgaguacccgccgc

SEQ ID NO: 973245 - RNA, 14 nt, Mycobacterium avium subsp. paratuberculosis
gcagucgcagcagc

SEQ ID NO: 973246 - RNA, 13 nt, Mycobacterium avium subsp. paratuberculosis
gcagucggccgga

SEQ ID NO: 973247 - RNA, 16 nt, Mycobacterium avium subsp. paratuberculosis
gcagucggccugcagc

SEQ ID NO: 973248 - RNA, 15 nt, Mycobacterium avium subsp. paratuberculosis
gcagugccaccacca

SEQ ID NO: 973249 - RNA, 14 nt, Mycobacterium avium subsp. paratuberculosis
gccgccgugcgcgg

SEQ ID NO: 973250 - RNA, 16 nt, Mycobacterium avium subsp. paratuberculosis
gccgccgugcgcggcg

SEQ ID NO: 973251 - RNA, 16 nt, Mycobacterium avium subsp. paratuberculosis
gccgccgggccugucc

SEQ ID NO: 973252 - RNA, 19 nt, Mycobacterium avium subsp. paratuberculosis
gccgccgucguagccgcgg

SEQ ID NO: 973253 - RNA, 17 nt, Mycobacterium avium subsp. paratuberculosis
gccgccggcucagcggc

SEQ ID NO: 973254 - RNA, 13 nt, Mycobacterium avium subsp. paratuberculosis
gccgccgggaaca

SEQ ID NO: 973255 - RNA, 22 nt, Mycobacterium avium subsp. paratuberculosis
gccgccgggaacagcgacgccc

SEQ ID NO: 973256 - RNA, 20 nt, Mycobacterium avium subsp. paratuberculosis
gccgccgggacgggcauccg

SEQ ID NO: 973257 - RNA, 14 nt, Mycobacterium avium subsp. paratuberculosis
gccgccgggcaccu

SEQ ID NO: 973258 - RNA, 12 nt, Mycobacterium avium subsp. paratuberculosis
gccgccgggccg

SEQ ID NO: 973259 - RNA, 14 nt, Mycobacterium avium subsp. paratuberculosis
gccgccgggccggc

SEQ ID NO: 973260 - RNA, 17 nt, Mycobacterium avium subsp. paratuberculosis
gccgccgggccggcggc

SEQ ID NO: 973261 - RNA, 16 nt, Mycobacterium avium subsp. paratuberculosis
gccgccguucgccggc

SEQ ID NO: 973262 - RNA, 20 nt, Mycobacterium avium subsp. paratuberculosis
gccgcgaaaauaccgccggc

SEQ ID NO: 973263 - RNA, 11 nt, Mycobacterium avium subsp. paratuberculosis
gccgccuuggu

SEQ ID NO: 973264 - RNA, 16 nt, Mycobacterium avium subsp. paratuberculosis
gccgcgacagccgccc

SEQ ID NO: 973265 - RNA, 21 nt, Mycobacterium avium subsp. paratuberculosis
gccgcgaacgacgaccucccc

SEQ ID NO: 973266 - RNA, 18 nt, Mycobacterium avium subsp. paratuberculosis
gccgcgaacgggucgggg

SEQ ID NO: 973267 - RNA, 16 nt, Mycobacterium avium subsp. paratuberculosis
gccgcgaugcccgccg

SEQ ID NO: 973268 - RNA, 19 nt, Mycobacterium avium subsp. paratuberculosis
gccgcgcaccacgguggcg

SEQ ID NO: 973269 - RNA, 13 nt, Mycobacterium avium subsp. paratuberculosis
gccgcgcaccccg

SEQ ID NO: 973270 - RNA, 15 nt, Mycobacterium avium subsp. paratuberculosis
gccgcgcagaucgau

SEQ ID NO: 973271 - RNA, 17 nt, Mycobacterium avium subsp. paratuberculosis
gccgcgcccuucuucgc

SEQ ID NO: 973272 - RNA, 22 nt, Mycobacterium avium subsp. paratuberculosis
gccgcgccgaacaccacgccga

SEQ ID NO: 973273 - RNA, 13 nt, Mycobacterium avium subsp. paratuberculosis
gccgcgcccggcu

SEQ ID NO: 973274 - RNA, 11 nt, Mycobacterium avium subsp. paratuberculosis
gccgcgcccgu

SEQ ID NO: 973275 - RNA, 17 nt, Mycobacterium avium subsp. paratuberculosis
gccgcgcagccagaccu

SEQ ID NO: 973276 - RNA, 14 nt, Mycobacterium avium subsp. paratuberculosis
gccgcgcggcgcca

SEQ ID NO: 973277 - RNA, 16 nt, Mycobacterium avium subsp. paratuberculosis
gccgcgcggcgccagc

SEQ ID NO: 973278 - RNA, 19 nt, Mycobacterium avium subsp. paratuberculosis
gccgcgcggcgccagcggc

SEQ ID NO: 973279 - RNA, 13 nt, Mycobacterium avium subsp. paratuberculosis
gccgcgcggcggu

SEQ ID NO: 973280 - RNA, 16 nt, Mycobacterium avium subsp. paratuberculosis
gccgcgcgugcagccg

SEQ ID NO: 973281 - RNA, 22 nt, Mycobacterium avium subsp. paratuberculosis
gccgcgcguagaucaucuggcu

SEQ ID NO: 973282 - RNA, 20 nt, Mycobacterium avium subsp. paratuberculosis
gccgcgcucaacccgggccg

SEQ ID NO: 973283 - RNA, 13 nt, Mycobacterium avium subsp. paratuberculosis
gccgcgcucggcc

SEQ ID NO: 973284 - RNA, 17 nt, Mycobacterium avium subsp. paratuberculosis
gccgcgcucgcaccagc

SEQ ID NO: 973285 - RNA, 15 nt, Mycobacterium avium subsp. paratuberculosis
gccgcgcuggccagc

SEQ ID NO: 973286 - RNA, 21 nt, Mycobacterium avium subsp. paratuberculosis
gccgcgcuggccagcgucagg

SEQ ID NO: 973287 - RNA, 18 nt, Mycobacterium avium subsp. paratuberculosis
gccgcgcaccgccccgcc

SEQ ID NO: 973288 - RNA, 15 nt, Mycobacterium avium subsp. paratuberculosis
gccgcgccgcccggc

SEQ ID NO: 973289 - RNA, 16 nt, Mycobacterium avium subsp. paratuberculosis
gccgcgccgcccggcg

SEQ ID NO: 973290 - RNA, 22 nt, Mycobacterium avium subsp. paratuberculosis
gccgcccggcgagcagcccggc

SEQ ID NO: 973291 - RNA, 20 nt, Mycobacterium avium subsp. paratuberculosis
gccgccagcacgugaugcag

SEQ ID NO: 973292 - RNA, 22 nt, Mycobacterium avium subsp. paratuberculosis
gccgcccgcaccugcgcgccgu

SEQ ID NO: 973293 - RNA, 12 nt, Mycobacterium avium subsp. paratuberculosis
gccgccagcagc

SEQ ID NO: 973294 - RNA, 13 nt, Mycobacterium avium subsp. paratuberculosis
gccgccagcagca

SEQ ID NO: 973295 - RNA, 17 nt, Mycobacterium avium subsp. paratuberculosis
gccgccagcagcacggc

SEQ ID NO: 973296 - RNA, 22 nt, Mycobacterium avium subsp. paratuberculosis
gccgccagcagcagcgccgcca

SEQ ID NO: 973297 - RNA, 13 nt, Mycobacterium avium subsp. paratuberculosis
gccgccacgcugg

SEQ ID NO: 973298 - RNA, 20 nt, Mycobacterium avium subsp. paratuberculosis
gccgccagcaaccccgcggu

SEQ ID NO: 973299 - RNA, 22 nt, Mycobacterium avium subsp. paratuberculosis
gccgcccgcaguucggccgccg

SEQ ID NO: 973300 - RNA, 13 nt, Mycobacterium avium subsp. paratuberculosis
gccgcccggaggu

SEQ ID NO: 973301 - RNA, 21 nt, Mycobacterium avium subsp. paratuberculosis
gccgcccggagguucgccgga

SEQ ID NO: 973302 - RNA, 16 nt, Mycobacterium avium subsp. paratuberculosis
gccgcccgcuccugca

SEQ ID NO: 973303 - RNA, 20 nt, Mycobacterium avium subsp. paratuberculosis
gccgcccgcuggggcgcacc

SEQ ID NO: 973304 - RNA, 16 nt, Mycobacterium avium subsp. paratuberculosis
gccgccggcgucgccg

SEQ ID NO: 973305 - RNA, 15 nt, Mycobacterium avium subsp. paratuberculosis
gccgccggcgcuggc

SEQ ID NO: 973306 - RNA, 17 nt, Mycobacterium avium subsp. paratuberculosis
gccgccggcgcccugcg

SEQ ID NO: 973307 - RNA, 18 nt, Mycobacterium avium subsp. paratuberculosis
gccgccggcgcccugcgc

SEQ ID NO: 973308 - RNA, 15 nt, Mycobacterium avium subsp. paratuberculosis
gccgccgcggccgcg

SEQ ID NO: 973309 - RNA, 16 nt, Mycobacterium avium subsp. paratuberculosis
gccgccgcgggucggc

SEQ ID NO: 973310 - RNA, 19 nt, Mycobacterium avium subsp. paratuberculosis
gccgccgcguaggccagga

SEQ ID NO: 973311 - RNA, 13 nt, Mycobacterium avium subsp. paratuberculosis
gccgccgcggcca

SEQ ID NO: 973312 - RNA, 14 nt, Mycobacterium avium subsp. paratuberculosis
gccgccgcggcacc

SEQ ID NO: 973313 - RNA, 15 nt, Mycobacterium avium subsp. paratuberculosis
gccgccgcgcgcggc

SEQ ID NO: 973314 - RNA, 16 nt, Mycobacterium avium subsp. paratuberculosis
gccgccgcgcgcggcc

SEQ ID NO: 973315 - RNA, 14 nt, Mycobacterium avium subsp. paratuberculosis
gccgccgcgcaccg

SEQ ID NO: 973316 - RNA, 18 nt, Mycobacterium avium subsp. paratuberculosis
gccgccgcgaacucaggc

SEQ ID NO: 973317 - RNA, 13 nt, Mycobacterium avium subsp. paratuberculosis
gccgccgcgaccg

SEQ ID NO: 973318 - RNA, 17 nt, Mycobacterium avium subsp. paratuberculosis
gccgccgccgcggccgc

SEQ ID NO: 973319 - RNA, 18 nt, Mycobacterium avium subsp. paratuberculosis
gccgccgcccgcgcggcg

SEQ ID NO: 973320 - RNA, 19 nt, Mycobacterium avium subsp. paratuberculosis
gccgccgcauaccgcccgc

SEQ ID NO: 973321 - RNA, 23 nt, Mycobacterium avium subsp. paratuberculosis
gccgccgcauuccucggccagcu

SEQ ID NO: 973322 - RNA, 14 nt, Mycobacterium avium subsp. paratuberculosis
gccgccgcagcagc

SEQ ID NO: 973323 - RNA, 19 nt, Mycobacterium avium subsp. paratuberculosis
gccgccgcccacgccgccc

SEQ ID NO: 973324 - RNA, 14 nt, Mycobacterium avium subsp. paratuberculosis
gccgccgcccaggc

SEQ ID NO: 973325 - RNA, 15 nt, Mycobacterium avium subsp. paratuberculosis
gccgccgcccaggcc

SEQ ID NO: 973326 - RNA, 13 nt, Mycobacterium avium subsp. paratuberculosis
gccgccgccagcc

SEQ ID NO: 973327 - RNA, 19 nt, Mycobacterium avium subsp. paratuberculosis
gccgccgccagccagccgg

SEQ ID NO: 973328 - RNA, 18 nt, Mycobacterium avium subsp. paratuberculosis
gccgcucgucggccagcg

SEQ ID NO: 973329 - RNA, 16 nt, Mycobacterium avium subsp. paratuberculosis
gccgcucgucgggcac

SEQ ID NO: 973330 - RNA, 22 nt, Mycobacterium avium subsp. paratuberculosis
gccgcucgcgggccacagcggc

SEQ ID NO: 973331 - RNA, 16 nt, Mycobacterium avium subsp. paratuberculosis
gccgcucggccagcag

SEQ ID NO: 973332 - RNA, 20 nt, Mycobacterium avium subsp. paratuberculosis
gccgcucggccagcagcacc

SEQ ID NO: 973333 - RNA, 15 nt, Mycobacterium avium subsp. paratuberculosis
gccgcucggccagcg

SEQ ID NO: 973334 - RNA, 13 nt, Mycobacterium avium subsp. paratuberculosis
gccgcucggcgcu

SEQ ID NO: 973335 - RNA, 12 nt, Mycobacterium avium subsp. paratuberculosis
gccgcucgccgg

SEQ ID NO: 973336 - RNA, 12 nt, Mycobacterium avium subsp. paratuberculosis
gccgcuccgcgg

SEQ ID NO: 973337 - RNA, 15 nt, Mycobacterium avium subsp. paratuberculosis
gccgcuccgcggcgg

SEQ ID NO: 973338 - RNA, 22 nt, Mycobacterium avium subsp. paratuberculosis
gccgcugagcuucugcccggcc

SEQ ID NO: 973339 - RNA, 24 nt, Mycobacterium avium subsp. paratuberculosis
gccgcugacugcgaucgccgacgc

SEQ ID NO: 973340 - RNA, 18 nt, Mycobacterium avium subsp. paratuberculosis
gccgcucccggcgcagca

SEQ ID NO: 973341 - RNA, 17 nt, Mycobacterium avium subsp. paratuberculosis
gccgcugacggucgccg

SEQ ID NO: 973342 - RNA, 16 nt, Mycobacterium avium subsp. paratuberculosis
gccgcuaguuggugcu

SEQ ID NO: 973343 - RNA, 20 nt, Mycobacterium avium subsp. paratuberculosis
gccgcuagguuuggccagca

SEQ ID NO: 973344 - RNA, 20 nt, Mycobacterium avium subsp. paratuberculosis
gccgcuagucgcccagcagc

SEQ ID NO: 973345 - RNA, 19 nt, Mycobacterium avium subsp. paratuberculosis
gccgcuccaccgcguccug

SEQ ID NO: 973346 - RNA, 15 nt, Mycobacterium avium subsp. paratuberculosis
gccgcucagcgggcg

SEQ ID NO: 973347 - RNA, 21 nt, Mycobacterium avium subsp. paratuberculosis
gccgcucagcgggcggccagc

SEQ ID NO: 973348 - RNA, 13 nt, Mycobacterium avium subsp. paratuberculosis
gccgcugcagcug

SEQ ID NO: 973349 - RNA, 14 nt, Mycobacterium avium subsp. paratuberculosis
gccgcugcagcugc

SEQ ID NO: 973350 - RNA, 15 nt, Mycobacterium avium subsp. paratuberculosis
gccgcugcagcugcu

SEQ ID NO: 973351 - RNA, 23 nt, Mycobacterium avium subsp. paratuberculosis
gccgcugcagcugcucguccugg

SEQ ID NO: 973352 - RNA, 18 nt, Mycobacterium avium subsp. paratuberculosis
gccgcugcauccgcagca

SEQ ID NO: 973353 - RNA, 14 nt, Mycobacterium avium subsp. paratuberculosis
gccgcugcccgggc

SEQ ID NO: 973354 - RNA, 23 nt, Mycobacterium avium subsp. paratuberculosis
gccgcuggauccccucacuccag

SEQ ID NO: 973355 - RNA, 17 nt, Mycobacterium avium subsp. paratuberculosis
gccgcugcgggcgggcc

SEQ ID NO: 973356 - RNA, 15 nt, Mycobacterium avium subsp. paratuberculosis
gccgcugcgccggcg

SEQ ID NO: 973357 - RNA, 14 nt, Mycobacterium avium subsp. paratuberculosis
gccgcuggccgcgc

SEQ ID NO: 973358 - RNA, 15 nt, Mycobacterium avium subsp. paratuberculosis
gccgcuggucaggcc

SEQ ID NO: 973359 - RNA, 17 nt, Mycobacterium avium subsp. paratuberculosis
gccgcugguaggcggcg

SEQ ID NO: 973360 - RNA, 18 nt, Mycobacterium avium subsp. paratuberculosis
gccgcugguaggcggcgc

SEQ ID NO: 973361 - RNA, 22 nt, Mycobacterium avium subsp. paratuberculosis
gccgcuguccucgucggaggcg

SEQ ID NO: 973362 - RNA, 22 nt, Mycobacterium avium subsp. paratuberculosis
gccgcguuccccggcgugggug

SEQ ID NO: 973363 - RNA, 23 nt, Mycobacterium avium subsp. paratuberculosis
gccgcgucggcggcggcggccgc

SEQ ID NO: 973364 - RNA, 13 nt, Mycobacterium avium subsp. paratuberculosis
gccgcgugcaccu

SEQ ID NO: 973365 - RNA, 17 nt, Mycobacterium avium subsp. paratuberculosis
gccgcgucgcgccgccg

SEQ ID NO: 973366 - RNA, 19 nt, Mycobacterium avium subsp. paratuberculosis
gccgcgucggucagcgcca

SEQ ID NO: 973367 - RNA, 18 nt, Mycobacterium avium subsp. paratuberculosis
gccgcgguagcggaccug

SEQ ID NO: 973368 - RNA, 17 nt, Mycobacterium avium subsp. paratuberculosis
gccgcggucaucgagcc

SEQ ID NO: 973369 - RNA, 21 nt, Mycobacterium avium subsp. paratuberculosis
gccgcggucgccccggccgcg

SEQ ID NO: 973370 - RNA, 22 nt, Mycobacterium avium subsp. paratuberculosis
gccgcggucgcugacccgccgc

SEQ ID NO: 973371 - RNA, 13 nt, Mycobacterium avium subsp. paratuberculosis
gccgcggugguga

SEQ ID NO: 973372 - RNA, 20 nt, Mycobacterium avium subsp. paratuberculosis
gccgcgguggugggcgcggu

SEQ ID NO: 973373 - RNA, 17 nt, Mycobacterium avium subsp. paratuberculosis
gccgcgguucggcgucg

SEQ ID NO: 973374 - RNA, 21 nt, Mycobacterium avium subsp. paratuberculosis
gccgcggggccggcgcuggcg

SEQ ID NO: 973375 - RNA, 15 nt, Mycobacterium avium subsp. paratuberculosis
gccgcggugcggccc

SEQ ID NO: 973376 - RNA, 20 nt, Mycobacterium avium subsp. paratuberculosis
gccgcggugcggcccgcggc

SEQ ID NO: 973377 - RNA, 21 nt, Mycobacterium avium subsp. paratuberculosis
gccgcggugcggcccgcggca

SEQ ID NO: 973378 - RNA, 15 nt, Mycobacterium avium subsp. paratuberculosis
gccgcgguggcgccg

SEQ ID NO: 973379 - RNA, 18 nt, Mycobacterium avium subsp. paratuberculosis
gccgcgguggcgccgcgg

SEQ ID NO: 973380 - RNA, 16 nt, Mycobacterium avium subsp. paratuberculosis
gccgcgucagcggcgg

SEQ ID NO: 973381 - RNA, 15 nt, Mycobacterium avium subsp. paratuberculosis
gccgcguccucgccg

SEQ ID NO: 973382 - RNA, 16 nt, Mycobacterium avium subsp. paratuberculosis
gccgcgucgacgccgc

SEQ ID NO: 973383 - RNA, 21 nt, Mycobacterium avium subsp. paratuberculosis
gccgcgucgacgccgcugccg

SEQ ID NO: 973384 - RNA, 20 nt, Mycobacterium avium subsp. paratuberculosis
gccgcguacuucgcgcccug

SEQ ID NO: 973385 - RNA, 21 nt, Mycobacterium avium subsp. paratuberculosis
gccgcguacuucgcgcccugg

SEQ ID NO: 973386 - RNA, 16 nt, Mycobacterium avium subsp. paratuberculosis
gccgcguagcucgccg

SEQ ID NO: 973387 - RNA, 17 nt, Mycobacterium avium subsp. paratuberculosis
gccgcguagcucgccgc

SEQ ID NO: 973388 - RNA, 19 nt, Mycobacterium avium subsp. paratuberculosis
gccgcguagcucgccgcgg

SEQ ID NO: 973389 - RNA, 20 nt, Mycobacterium avium subsp. paratuberculosis
gccgcguagcucgccgcggc

SEQ ID NO: 973390 - RNA, 21 nt, Mycobacterium avium subsp. paratuberculosis
gccgcguaggucuucggugaa

SEQ ID NO: 973391 - RNA, 15 nt, Mycobacterium avium subsp. paratuberculosis
gccgcguacagccag

SEQ ID NO: 973392 - RNA, 18 nt, Mycobacterium avium subsp. paratuberculosis
gccgcguacagccagccc

SEQ ID NO: 973393 - RNA, 17 nt, Mycobacterium avium subsp. paratuberculosis
gccgcggcuccagcagc

SEQ ID NO: 973394 - RNA, 13 nt, Mycobacterium avium subsp. paratuberculosis
gccgcggcucgcg

SEQ ID NO: 973395 - RNA, 17 nt, Mycobacterium avium subsp. paratuberculosis
gccgcggcgugcaacug

SEQ ID NO: 973396 - RNA, 18 nt, Mycobacterium avium subsp. paratuberculosis
gccgcggcgugcaacugc

SEQ ID NO: 973397 - RNA, 17 nt, Mycobacterium avium subsp. paratuberculosis
gccgcggcgguggccug

SEQ ID NO: 973398 - RNA, 20 nt, Mycobacterium avium subsp. paratuberculosis
gccgcggcgguggccugccc

SEQ ID NO: 973399 - RNA, 13 nt, Mycobacterium avium subsp. paratuberculosis
gccgcgggccagc

SEQ ID NO: 973400 - RNA, 18 nt, Mycobacterium avium subsp. paratuberculosis
gccgcgggccagcagccg

SEQ ID NO: 973401 - RNA, 14 nt, Mycobacterium avium subsp. paratuberculosis
gccgcgggccagcc

SEQ ID NO: 973402 - RNA, 17 nt, Mycobacterium avium subsp. paratuberculosis
gccgcggcggcucggcg

SEQ ID NO: 973403 - RNA, 15 nt, Mycobacterium avium subsp. paratuberculosis
gccgcgggaggccca

SEQ ID NO: 973404 - RNA, 17 nt, Mycobacterium avium subsp. paratuberculosis
gccgcgggaggcccagu

SEQ ID NO: 973405 - RNA, 20 nt, Mycobacterium avium subsp. paratuberculosis
gccgcgggucgauaugcugc

SEQ ID NO: 973406 - RNA, 22 nt, Mycobacterium avium subsp. paratuberculosis
gccgcgggucggcgacggcgcu

SEQ ID NO: 973407 - RNA, 23 nt, Mycobacterium avium subsp. paratuberculosis
gccgcgggugacgaucuggcgca

SEQ ID NO: 973408 - RNA, 16 nt, Mycobacterium avium subsp. paratuberculosis
gccgcgggcgggccga

SEQ ID NO: 973409 - RNA, 11 nt, Mycobacterium avium subsp. paratuberculosis
gccgcggcggg

SEQ ID NO: 973410 - RNA, 13 nt, Mycobacterium avium subsp. paratuberculosis
gccgcggcggccc

SEQ ID NO: 973411 - RNA, 13 nt, Mycobacterium avium subsp. paratuberculosis
gccgcggcggccu

SEQ ID NO: 973412 - RNA, 12 nt, Mycobacterium avium subsp. paratuberculosis
gccgcggcggcg

SEQ ID NO: 973413 - RNA, 15 nt, Mycobacterium avium subsp. paratuberculosis
gccgcggcggcgccg

SEQ ID NO: 973414 - RNA, 15 nt, Mycobacterium avium subsp. paratuberculosis
gccgcggcgcggccc

SEQ ID NO: 973415 - RNA, 16 nt, Mycobacterium avium subsp. paratuberculosis
gccgcggcgcggcccg

SEQ ID NO: 973416 - RNA, 15 nt, Mycobacterium avium subsp. paratuberculosis
gccgcggcgccgcca

SEQ ID NO: 973417 - RNA, 16 nt, Mycobacterium avium subsp. paratuberculosis
gccgcggccggcggca

SEQ ID NO: 973418 - RNA, 16 nt, Mycobacterium avium subsp. paratuberculosis
gccgcggccggugcca

SEQ ID NO: 973419 - RNA, 14 nt, Mycobacterium avium subsp. paratuberculosis
gccgcggcgcaccc

SEQ ID NO: 973420 - RNA, 16 nt, Mycobacterium avium subsp. paratuberculosis
gccgcggcgcaccccg

SEQ ID NO: 973421 - RNA, 14 nt, Mycobacterium avium subsp. paratuberculosis
gccgcggcgcccgg

SEQ ID NO: 973422 - RNA, 17 nt, Mycobacterium avium subsp. paratuberculosis
gccgcggcgacacccag

SEQ ID NO: 973423 - RNA, 15 nt, Mycobacterium avium subsp. paratuberculosis
gccgcggcgaccggg

SEQ ID NO: 973424 - RNA, 13 nt, Mycobacterium avium subsp. paratuberculosis
gccgcggccgccu

SEQ ID NO: 973425 - RNA, 23 nt, Mycobacterium avium subsp. paratuberculosis
gccgcggccgccucccgcagcgc

SEQ ID NO: 973426 - RNA, 15 nt, Mycobacterium avium subsp. paratuberculosis
gccgcggccgccuuc

SEQ ID NO: 973427 - RNA, 15 nt, Mycobacterium avium subsp. paratuberculosis
gccgcggccgcggcg

SEQ ID NO: 973428 - RNA, 14 nt, Mycobacterium avium subsp. paratuberculosis
gccgcggccgcguu

SEQ ID NO: 973429 - RNA, 14 nt, Mycobacterium avium subsp. paratuberculosis
gccgcggccgcugg

SEQ ID NO: 973430 - RNA, 16 nt, Mycobacterium avium subsp. paratuberculosis
gccgcggccgcuggcg

SEQ ID NO: 973431 - RNA, 14 nt, Mycobacterium avium subsp. paratuberculosis
gccgcggccggaga

SEQ ID NO: 973432 - RNA, 13 nt, Mycobacterium avium subsp. paratuberculosis
gccgcggccggca

SEQ ID NO: 973433 - RNA, 14 nt, Mycobacterium avium subsp. paratuberculosis
gccgcggccggcac

SEQ ID NO: 973434 - RNA, 21 nt, Mycobacterium avium subsp. paratuberculosis
gccgcgcuugacggccgggcc

SEQ ID NO: 973435 - RNA, 16 nt, Mycobacterium avium subsp. paratuberculosis
gccgcgcuugcgaccg

SEQ ID NO: 973436 - RNA, 18 nt, Mycobacterium avium subsp. paratuberculosis
gccgcgcugcgccgggug

SEQ ID NO: 973437 - RNA, 23 nt, Mycobacterium avium subsp. paratuberculosis
gccgaauuguucggccaccgcgc

SEQ ID NO: 973438 - RNA, 16 nt, Mycobacterium avium subsp. paratuberculosis
gccgacaccaccgcgc

SEQ ID NO: 973439 - RNA, 13 nt, Mycobacterium avium subsp. paratuberculosis
gccgacaccagcg

SEQ ID NO: 973440 - RNA, 16 nt, Mycobacterium avium subsp. paratuberculosis
gccgacaccagcgcgc

SEQ ID NO: 973441 - RNA, 12 nt, Mycobacterium avium subsp. paratuberculosis
gccgacacccca

SEQ ID NO: 973442 - RNA, 23 nt, Mycobacterium avium subsp. paratuberculosis
gccgacaccgggucccccgccga

SEQ ID NO: 973443 - RNA, 19 nt, Mycobacterium avium subsp. paratuberculosis
gccgaccagcaggacgcgc

SEQ ID NO: 973444 - RNA, 18 nt, Mycobacterium avium subsp. paratuberculosis
gccgaccagccgaggcgc

SEQ ID NO: 973445 - RNA, 19 nt, Mycobacterium avium subsp. paratuberculosis
gccgaccagccgaggcgcu

SEQ ID NO: 973446 - RNA, 18 nt, Mycobacterium avium subsp. paratuberculosis
gccgaccacggccccagc

SEQ ID NO: 973447 - RNA, 23 nt, Mycobacterium avium subsp. paratuberculosis
gccgaccacccccagcccgccgg

SEQ ID NO: 973448 - RNA, 18 nt, Mycobacterium avium subsp. paratuberculosis
gccgaacucggcgccgcc

SEQ ID NO: 973449 - RNA, 14 nt, Mycobacterium avium subsp. paratuberculosis
gccgaaugccacgc

SEQ ID NO: 973450 - RNA, 21 nt, Mycobacterium avium subsp. paratuberculosis
gccgaacgucgagcgcggccc

SEQ ID NO: 973451 - RNA, 18 nt, Mycobacterium avium subsp. paratuberculosis
gccgaacgugcgcggcgc

SEQ ID NO: 973452 - RNA, 20 nt, Mycobacterium avium subsp. paratuberculosis
gccgaacgugcgcggcgcgc

SEQ ID NO: 973453 - RNA, 18 nt, Mycobacterium avium subsp. paratuberculosis
gccgaacggcaugucggu

SEQ ID NO: 973454 - RNA, 23 nt, Mycobacterium avium subsp. paratuberculosis
gccgaacggcgcucccgauggcu

SEQ ID NO: 973455 - RNA, 17 nt, Mycobacterium avium subsp. paratuberculosis
gccgaacgacagcagga

SEQ ID NO: 973456 - RNA, 17 nt, Mycobacterium avium subsp. paratuberculosis
gccgaaccccagcuccg

SEQ ID NO: 973457 - RNA, 22 nt, Mycobacterium avium subsp. paratuberculosis
gccgaaccggaucuggcccugg

SEQ ID NO: 973458 - RNA, 14 nt, Mycobacterium avium subsp. paratuberculosis
gccgaaccguccca

SEQ ID NO: 973459 - RNA, 14 nt, Mycobacterium avium subsp. paratuberculosis
gccgaacagcgacg

SEQ ID NO: 973460 - RNA, 12 nt, Mycobacterium avium subsp. paratuberculosis
gccgaacaggcg

SEQ ID NO: 973461 - RNA, 21 nt, Mycobacterium avium subsp. paratuberculosis
gccgaacaggcgcaacagcac

SEQ ID NO: 973462 - RNA, 17 nt, Mycobacterium avium subsp. paratuberculosis
gccgaccgaucagcgga

SEQ ID NO: 973463 - RNA, 22 nt, Mycobacterium avium subsp. paratuberculosis
gccgaccgacaguucggcgcgc

SEQ ID NO: 973464 - RNA, 19 nt, Mycobacterium avium subsp. paratuberculosis
gccgaccgacccggccagc

SEQ ID NO: 973465 - RNA, 21 nt, Mycobacterium avium subsp. paratuberculosis
gccgacccgggcuagacgcgc

SEQ ID NO: 973466 - RNA, 18 nt, Mycobacterium avium subsp. paratuberculosis
gccgaccgcggucgcggc

SEQ ID NO: 973467 - RNA, 21 nt, Mycobacterium avium subsp. paratuberculosis
gccgaccgcggucgcggcgcc

SEQ ID NO: 973468 - RNA, 22 nt, Mycobacterium avium subsp. paratuberculosis
gccgaccaccuugcgcagcagc

SEQ ID NO: 973469 - RNA, 14 nt, Mycobacterium avium subsp. paratuberculosis
gccgaccgccccgc

SEQ ID NO: 973470 - RNA, 16 nt, Mycobacterium avium subsp. paratuberculosis
gccgaccgcccgcugu

SEQ ID NO: 973471 - RNA, 14 nt, Mycobacterium avium subsp. paratuberculosis
gccgaccgccgagc

SEQ ID NO: 973472 - RNA, 19 nt, Mycobacterium avium subsp. paratuberculosis
gccgaccagguagcgcugc

SEQ ID NO: 973473 - RNA, 13 nt, Mycobacterium avium subsp. paratuberculosis
gccgagaacaggc

SEQ ID NO: 973474 - RNA, 17 nt, Mycobacterium avium subsp. paratuberculosis
gccgacuugaucgcggc

SEQ ID NO: 973475 - RNA, 14 nt, Mycobacterium avium subsp. paratuberculosis
gccgacggucccac

SEQ ID NO: 973476 - RNA, 19 nt, Mycobacterium avium subsp. paratuberculosis
gccgacgguggcccccacc

SEQ ID NO: 973477 - RNA, 20 nt, Mycobacterium avium subsp. paratuberculosis
gccgacguaggacagcacca

SEQ ID NO: 973478 - RNA, 21 nt, Mycobacterium avium subsp. paratuberculosis
gccgacguaggacagcaccac

SEQ ID NO: 973479 - RNA, 22 nt, Mycobacterium avium subsp. paratuberculosis
gccgacguccuggaucgcgcag

SEQ ID NO: 973480 - RNA, 18 nt, Mycobacterium avium subsp. paratuberculosis
gccgaccgguccgccgcc

SEQ ID NO: 973481 - RNA, 19 nt, Mycobacterium avium subsp. paratuberculosis
gccgaccgguccgccgccg

SEQ ID NO: 973482 - RNA, 22 nt, Mycobacterium avium subsp. paratuberculosis
gccgaccggucucgaccgcggc

SEQ ID NO: 973483 - RNA, 16 nt, Mycobacterium avium subsp. paratuberculosis
gcccugcgccagcagc

SEQ ID NO: 973484 - RNA, 19 nt, Mycobacterium avium subsp. paratuberculosis
gcccugcgcgcccugcugg

SEQ ID NO: 973485 - RNA, 15 nt, Mycobacterium avium subsp. paratuberculosis
gcccugcgcggccug

SEQ ID NO: 973486 - RNA, 18 nt, Mycobacterium avium subsp. paratuberculosis
gcccugcgcggccugcag

SEQ ID NO: 973487 - RNA, 19 nt, Mycobacterium avium subsp. paratuberculosis
gcccugcgcggccugcagc

SEQ ID NO: 973488 - RNA, 19 nt, Mycobacterium avium subsp. paratuberculosis
gcccgggcuaucgcccggc

SEQ ID NO: 973489 - RNA, 22 nt, Mycobacterium avium subsp. paratuberculosis
gcccgggccguccgggugcggg

SEQ ID NO: 973490 - RNA, 22 nt, Mycobacterium avium subsp. paratuberculosis
gcccgggcgccgagaacaggcc

SEQ ID NO: 973491 - RNA, 21 nt, Mycobacterium avium subsp. paratuberculosis
gcccgggcggcgaguccggcc

SEQ ID NO: 973492 - RNA, 14 nt, Mycobacterium avium subsp. paratuberculosis
gcccgggcggcggg

SEQ ID NO: 973493 - RNA, 23 nt, Mycobacterium avium subsp. paratuberculosis
gcccuggauauccagccuugcag

SEQ ID NO: 973494 - RNA, 17 nt, Mycobacterium avium subsp. paratuberculosis
gcccugguaggccugga

SEQ ID NO: 973495 - RNA, 16 nt, Mycobacterium avium subsp. paratuberculosis
gcccugcucggccagc

SEQ ID NO: 973496 - RNA, 23 nt, Mycobacterium avium subsp. paratuberculosis
gcccugcucggugaugccgagcg

SEQ ID NO: 973497 - RNA, 16 nt, Mycobacterium avium subsp. paratuberculosis
gcccugcuugaacagc

SEQ ID NO: 973498 - RNA, 17 nt, Mycobacterium avium subsp. paratuberculosis
gcccugcuugaacagca

SEQ ID NO: 973499 - RNA, 19 nt, Mycobacterium avium subsp. paratuberculosis
gcccugcuugaccgcgacg

SEQ ID NO: 973500 - RNA, 15 nt, Mycobacterium avium subsp. paratuberculosis
gccgaaagguuuucc

SEQ ID NO: 973501 - RNA, 15 nt, Mycobacterium avium subsp. paratuberculosis
gccgaacaacagggc

SEQ ID NO: 973502 - RNA, 13 nt, Mycobacterium avium subsp. paratuberculosis
gccgaacagcagc

SEQ ID NO: 973503 - RNA, 17 nt, Mycobacterium avium subsp. paratuberculosis
gccgaacagcagcgcgc

SEQ ID NO: 973504 - RNA, 20 nt, Mycobacterium avium subsp. paratuberculosis
gccgaacaccugcggcggca

SEQ ID NO: 973505 - RNA, 17 nt, Mycobacterium avium subsp. paratuberculosis
gcccuuggcgcccagcg

SEQ ID NO: 973506 - RNA, 16 nt, Mycobacterium avium subsp. paratuberculosis
gccgaaagccuccgcg

SEQ ID NO: 973507 - RNA, 17 nt, Mycobacterium avium subsp. paratuberculosis
gcccuguucgccgucgc

SEQ ID NO: 973508 - RNA, 17 nt, Mycobacterium avium subsp. paratuberculosis
gcccuggucggccaggg

SEQ ID NO: 973509 - RNA, 14 nt, Mycobacterium avium subsp. paratuberculosis
gcccuugccccacc

SEQ ID NO: 973510 - RNA, 16 nt, Mycobacterium avium subsp. paratuberculosis
gcccuugccccaccac

SEQ ID NO: 973511 - RNA, 22 nt, Mycobacterium avium subsp. paratuberculosis
gcccuugccccaccaccgccgg

SEQ ID NO: 973512 - RNA, 15 nt, Mycobacterium avium subsp. paratuberculosis
gcccuugaagcgcag

SEQ ID NO: 973513 - RNA, 17 nt, Mycobacterium avium subsp. paratuberculosis
gcccuugagcacgguga

SEQ ID NO: 973514 - RNA, 21 nt, Mycobacterium avium subsp. paratuberculosis
gcccuugcagcacaccggcau

SEQ ID NO: 973515 - RNA, 22 nt, Mycobacterium avium subsp. paratuberculosis
gccgcauaccgcccgcgcuggu

SEQ ID NO: 973516 - RNA, 23 nt, Mycobacterium avium subsp. paratuberculosis
gccgcauaccgcccgcgcuggug

SEQ ID NO: 973517 - RNA, 15 nt, Mycobacterium avium subsp. paratuberculosis
gccgcauccgcgagc

SEQ ID NO: 973518 - RNA, 15 nt, Mycobacterium avium subsp. paratuberculosis
gccgcagcggcggcu

SEQ ID NO: 973519 - RNA, 11 nt, Mycobacterium avium subsp. paratuberculosis
gccgcagccga

SEQ ID NO: 973520 - RNA, 13 nt, Mycobacterium avium subsp. paratuberculosis
gccgcagcggcgc

SEQ ID NO: 973521 - RNA, 14 nt, Mycobacterium avium subsp. paratuberculosis
gccgcagcggcgcc

SEQ ID NO: 973522 - RNA, 15 nt, Mycobacterium avium subsp. paratuberculosis
gccgcagcggcgccg

SEQ ID NO: 973523 - RNA, 14 nt, Mycobacterium avium subsp. paratuberculosis
gccgcagcggcggc

SEQ ID NO: 973524 - RNA, 17 nt, Mycobacterium avium subsp. paratuberculosis
gccgcagcgcaucgccg

SEQ ID NO: 973525 - RNA, 20 nt, Mycobacterium avium subsp. paratuberculosis
gccgcagcgcaucgccggcg

SEQ ID NO: 973526 - RNA, 17 nt, Mycobacterium avium subsp. paratuberculosis
gccgcagccgggugggc

SEQ ID NO: 973527 - RNA, 19 nt, Mycobacterium avium subsp. paratuberculosis
gccgcagcgcccggcagcg

SEQ ID NO: 973528 - RNA, 22 nt, Mycobacterium avium subsp. paratuberculosis
gccgcagcgcgacgaacagcac

SEQ ID NO: 973529 - RNA, 12 nt, Mycobacterium avium subsp. paratuberculosis
gccgcagcgcgc

SEQ ID NO: 973530 - RNA, 18 nt, Mycobacterium avium subsp. paratuberculosis
gccgcagcgcgcgaccgc

SEQ ID NO: 973531 - RNA, 15 nt, Mycobacterium avium subsp. paratuberculosis
gccgcagcgcgcggg

SEQ ID NO: 973532 - RNA, 13 nt, Mycobacterium avium subsp. paratuberculosis
gccgcagcgcggc

SEQ ID NO: 973533 - RNA, 14 nt, Mycobacterium avium subsp. paratuberculosis
gccgcagcgcggcg

SEQ ID NO: 973534 - RNA, 15 nt, Mycobacterium avium subsp. paratuberculosis
gccgcagcccaggcc

SEQ ID NO: 973535 - RNA, 22 nt, Mycobacterium avium subsp. paratuberculosis
gccgcagcccaggcccagcagc

SEQ ID NO: 973536 - RNA, 23 nt, Mycobacterium avium subsp. paratuberculosis
gccgcaucaccuucugcgcgccg

SEQ ID NO: 973537 - RNA, 20 nt, Mycobacterium avium subsp. paratuberculosis
gccgaucugcucggcugcag

SEQ ID NO: 973538 - RNA, 20 nt, Mycobacterium avium subsp. paratuberculosis
gccgaugagccucagcgcgc

SEQ ID NO: 973539 - RNA, 19 nt, Mycobacterium avium subsp. paratuberculosis
gccgaugaccgcggcgggc

SEQ ID NO: 973540 - RNA, 17 nt, Mycobacterium avium subsp. paratuberculosis
gccgaucugaccgagca

SEQ ID NO: 973541 - RNA, 23 nt, Mycobacterium avium subsp. paratuberculosis
gccgaugaccacccucagggagc

SEQ ID NO: 973542 - RNA, 12 nt, Mycobacterium avium subsp. paratuberculosis
gccgaugaaccg

SEQ ID NO: 973543 - RNA, 12 nt, Mycobacterium avium subsp. paratuberculosis
gccgaucuuguc

SEQ ID NO: 973544 - RNA, 23 nt, Mycobacterium avium subsp. paratuberculosis
gccgcacuuggccucgggcgacg

SEQ ID NO: 973545 - RNA, 19 nt, Mycobacterium avium subsp. paratuberculosis
gccgcacugcacggccucg

SEQ ID NO: 973546 - RNA, 22 nt, Mycobacterium avium subsp. paratuberculosis
gccgcagcaggugcaucgccac

SEQ ID NO: 973547 - RNA, 18 nt, Mycobacterium avium subsp. paratuberculosis
gccgcacggugcagcagc

SEQ ID NO: 973548 - RNA, 15 nt, Mycobacterium avium subsp. paratuberculosis
gccgcagcaggcacu

SEQ ID NO: 973549 - RNA, 14 nt, Mycobacterium avium subsp. paratuberculosis
gccgcagcaccacc

SEQ ID NO: 973550 - RNA, 15 nt, Mycobacterium avium subsp. paratuberculosis
gccgcagcagcgagg

SEQ ID NO: 973551 - RNA, 17 nt, Mycobacterium avium subsp. paratuberculosis
gccgcagcagcgaggcc

SEQ ID NO: 973552 - RNA, 23 nt, Mycobacterium avium subsp. paratuberculosis
gccgcagcagcgaggccucgccg

SEQ ID NO: 973553 - RNA, 18 nt, Mycobacterium avium subsp. paratuberculosis
gccgcacgaauugccggu

SEQ ID NO: 973554 - RNA, 17 nt, Mycobacterium avium subsp. paratuberculosis
gccgcacguauccgcgg

SEQ ID NO: 973555 - RNA, 15 nt, Mycobacterium avium subsp. paratuberculosis
gccgcacgucccgcc

SEQ ID NO: 973556 - RNA, 18 nt, Mycobacterium avium subsp. paratuberculosis
gccgcacgucccgcccgg

SEQ ID NO: 973557 - RNA, 14 nt, Mycobacterium avium subsp. paratuberculosis
gccgcacgcgaccg

SEQ ID NO: 973558 - RNA, 17 nt, Mycobacterium avium subsp. paratuberculosis
gccgagcacgcggccgc

SEQ ID NO: 973559 - RNA, 19 nt, Mycobacterium avium subsp. paratuberculosis
gccgagcacgcggccgcgc

SEQ ID NO: 973560 - RNA, 14 nt, Mycobacterium avium subsp. paratuberculosis
gccgagcagccggg

SEQ ID NO: 973561 - RNA, 17 nt, Mycobacterium avium subsp. paratuberculosis
gccgagcagcucagccg

SEQ ID NO: 973562 - RNA, 11 nt, Mycobacterium avium subsp. paratuberculosis
gccgagcacac

SEQ ID NO: 973563 - RNA, 17 nt, Mycobacterium avium subsp. paratuberculosis
gccgagcaccaggcgca

SEQ ID NO: 973564 - RNA, 23 nt, Mycobacterium avium subsp. paratuberculosis
gccgagcaccccgucgagcagcc

SEQ ID NO: 973565 - RNA, 11 nt, Mycobacterium avium subsp. paratuberculosis
gccgagcaccu

SEQ ID NO: 973566 - RNA, 17 nt, Mycobacterium avium subsp. paratuberculosis
gccgagaaugccguaga

SEQ ID NO: 973567 - RNA, 20 nt, Mycobacterium avium subsp. paratuberculosis
gccgagacauagacguuacg

SEQ ID NO: 973568 - RNA, 17 nt, Mycobacterium avium subsp. paratuberculosis
gccgagacggcguggcu

SEQ ID NO: 973569 - RNA, 16 nt, Mycobacterium avium subsp. paratuberculosis
gccgagacugauggug

SEQ ID NO: 973570 - RNA, 22 nt, Mycobacterium avium subsp. paratuberculosis
gccgagagcucuugcgccccag

SEQ ID NO: 973571 - RNA, 20 nt, Mycobacterium avium subsp. paratuberculosis
gccgagauccaccgcgcggc

SEQ ID NO: 973572 - RNA, 13 nt, Mycobacterium avium subsp. paratuberculosis
gccgagccgggcg

SEQ ID NO: 973573 - RNA, 16 nt, Mycobacterium avium subsp. paratuberculosis
gccgagccgggcggcc

SEQ ID NO: 973574 - RNA, 18 nt, Mycobacterium avium subsp. paratuberculosis
gccgagccguaggccagg

SEQ ID NO: 973575 - RNA, 14 nt, Mycobacterium avium subsp. paratuberculosis
gccgagccggccga

SEQ ID NO: 973576 - RNA, 18 nt, Mycobacterium avium subsp. paratuberculosis
gccgagcaucagcugccg

SEQ ID NO: 973577 - RNA, 22 nt, Mycobacterium avium subsp. paratuberculosis
gccgagcaucagcugccguccg

SEQ ID NO: 973578 - RNA, 19 nt, Mycobacterium avium subsp. paratuberculosis
gccgagcccgccggcggcg

SEQ ID NO: 973579 - RNA, 19 nt, Mycobacterium avium subsp. paratuberculosis
gccgagccgaugcccagca

SEQ ID NO: 973580 - RNA, 22 nt, Mycobacterium avium subsp. paratuberculosis
gccgagccgaugcccagcagcg

SEQ ID NO: 973581 - RNA, 23 nt, Mycobacterium avium subsp. paratuberculosis
gccgagccgcaccgccucaugcc

SEQ ID NO: 973582 - RNA, 16 nt, Mycobacterium avium subsp. paratuberculosis
gccgagcgugugggaa

SEQ ID NO: 973583 - RNA, 16 nt, Mycobacterium avium subsp. paratuberculosis
gccgagcucggccacc

SEQ ID NO: 973584 - RNA, 22 nt, Mycobacterium avium subsp. paratuberculosis
gccgagcgggucgucguucucg

SEQ ID NO: 973585 - RNA, 19 nt, Mycobacterium avium subsp. paratuberculosis
gccgagcgugaagcuagcu

SEQ ID NO: 973586 - RNA, 15 nt, Mycobacterium avium subsp. paratuberculosis
gccgagcggcugcug

SEQ ID NO: 973587 - RNA, 17 nt, Mycobacterium avium subsp. paratuberculosis
gccgagcgcgccgagca

SEQ ID NO: 973588 - RNA, 20 nt, Mycobacterium avium subsp. paratuberculosis
gccgagcgcgccgagcagcu

SEQ ID NO: 973589 - RNA, 13 nt, Mycobacterium avium subsp. paratuberculosis
gccgagcgcgcug

SEQ ID NO: 973590 - RNA, 13 nt, Mycobacterium avium subsp. paratuberculosis
gccgagcgcgcuu

SEQ ID NO: 973591 - RNA, 18 nt, Mycobacterium avium subsp. paratuberculosis
gccgagcgcgcuuggggu

SEQ ID NO: 973592 - RNA, 22 nt, Mycobacterium avium subsp. paratuberculosis
gccgaucggggcgcagcccggc

SEQ ID NO: 973593 - RNA, 16 nt, Mycobacterium avium subsp. paratuberculosis
gccgaucaacaggccc

SEQ ID NO: 973594 - RNA, 18 nt, Mycobacterium avium subsp. paratuberculosis
gccgaucaacaggcccag

SEQ ID NO: 973595 - RNA, 18 nt, Mycobacterium avium subsp. paratuberculosis
gccgauccggcgccgcgg

SEQ ID NO: 973596 - RNA, 12 nt, Mycobacterium avium subsp. paratuberculosis
gccgauccggcu

SEQ ID NO: 973597 - RNA, 21 nt, Mycobacterium avium subsp. paratuberculosis
gccgauccggcuccacagcag

SEQ ID NO: 973598 - RNA, 17 nt, Mycobacterium avium subsp. paratuberculosis
gccgauauaggugagaa

SEQ ID NO: 973599 - RNA, 17 nt, Mycobacterium avium subsp. paratuberculosis
gccgaggcgcucggccc

SEQ ID NO: 973600 - RNA, 19 nt, Mycobacterium avium subsp. paratuberculosis
gccgaggcgcucggcccgc

SEQ ID NO: 973601 - RNA, 16 nt, Mycobacterium avium subsp. paratuberculosis
gccgaggcgagugagg

SEQ ID NO: 973602 - RNA, 22 nt, Mycobacterium avium subsp. paratuberculosis
gccgaggcgaugccgugcuggg

SEQ ID NO: 973603 - RNA, 13 nt, Mycobacterium avium subsp. paratuberculosis
gccgaggcgcagg

SEQ ID NO: 973604 - RNA, 14 nt, Mycobacterium avium subsp. paratuberculosis
gccgaggccaacuc

SEQ ID NO: 973605 - RNA, 22 nt, Mycobacterium avium subsp. paratuberculosis
gccgaggccgauggcgcccagc

SEQ ID NO: 973606 - RNA, 15 nt, Mycobacterium avium subsp. paratuberculosis
gccgaggcacagcag

SEQ ID NO: 973607 - RNA, 16 nt, Mycobacterium avium subsp. paratuberculosis
gccgaggcacagcagc

SEQ ID NO: 973608 - RNA, 15 nt, Mycobacterium avium subsp. paratuberculosis
gccgagcuugggccg

SEQ ID NO: 973609 - RNA, 16 nt, Mycobacterium avium subsp. paratuberculosis
gccgaggaaagcucgc

SEQ ID NO: 973610 - RNA, 17 nt, Mycobacterium avium subsp. paratuberculosis
gccgaggaaccggcagc

SEQ ID NO: 973611 - RNA, 22 nt, Mycobacterium avium subsp. paratuberculosis
gccgaggaaccggcagccggcg

SEQ ID NO: 973612 - RNA, 19 nt, Mycobacterium avium subsp. paratuberculosis
gccgaggacacguuggcca

SEQ ID NO: 973613 - RNA, 22 nt, Mycobacterium avium subsp. paratuberculosis
gccaucgaucgggcgucgcaga

SEQ ID NO: 973614 - RNA, 14 nt, Mycobacterium avium subsp. paratuberculosis
gccaucgacuccag

SEQ ID NO: 973615 - RNA, 18 nt, Mycobacterium avium subsp. paratuberculosis
gccaucgcaccgcgagca

SEQ ID NO: 973616 - RNA, 11 nt, Mycobacterium avium subsp. paratuberculosis
gccaucuggcc

SEQ ID NO: 973617 - RNA, 14 nt, Mycobacterium avium subsp. paratuberculosis
gccauccggccggc

SEQ ID NO: 973618 - RNA, 15 nt, Mycobacterium avium subsp. paratuberculosis
gccaucagccgccgu

SEQ ID NO: 973619 - RNA, 22 nt, Mycobacterium avium subsp. paratuberculosis
gccaucagccgccgucgcgcca

SEQ ID NO: 973620 - RNA, 22 nt, Mycobacterium avium subsp. paratuberculosis
gccaucagcagcgccucgccgg

SEQ ID NO: 973621 - RNA, 19 nt, Mycobacterium avium subsp. paratuberculosis
gccaggcgggccaccacag

SEQ ID NO: 973622 - RNA, 16 nt, Mycobacterium avium subsp. paratuberculosis
gccaggcucacguagu

SEQ ID NO: 973623 - RNA, 19 nt, Mycobacterium avium subsp. paratuberculosis
gccaggcgguggccgaacc

SEQ ID NO: 973624 - RNA, 23 nt, Mycobacterium avium subsp. paratuberculosis
gccaggcguuggucaccaucagc

SEQ ID NO: 973625 - RNA, 17 nt, Mycobacterium avium subsp. paratuberculosis
gccaggcgcccagcacc

SEQ ID NO: 973626 - RNA, 15 nt, Mycobacterium avium subsp. paratuberculosis
gccauuucagcagcg

SEQ ID NO: 973627 - RNA, 23 nt, Mycobacterium avium subsp. paratuberculosis
gcccaacagcucgcgggccugcu

SEQ ID NO: 973628 - RNA, 23 nt, Mycobacterium avium subsp. paratuberculosis
gcccaaccgcauucggccgccac

SEQ ID NO: 973629 - RNA, 20 nt, Mycobacterium avium subsp. paratuberculosis
gcccacaccgacaccggccg

SEQ ID NO: 973630 - RNA, 14 nt, Mycobacterium avium subsp. paratuberculosis
gcccacaccggaug

SEQ ID NO: 973631 - RNA, 22 nt, Mycobacterium avium subsp. paratuberculosis
gccaugcgcgagucgagcaccg

SEQ ID NO: 973632 - RNA, 15 nt, Mycobacterium avium subsp. paratuberculosis
gccaugccggguuuc

SEQ ID NO: 973633 - RNA, 20 nt, Mycobacterium avium subsp. paratuberculosis
gccaugccucuucggcgcgc

SEQ ID NO: 973634 - RNA, 17 nt, Mycobacterium avium subsp. paratuberculosis
gccaugugccggcgcuc

SEQ ID NO: 973635 - RNA, 19 nt, Mycobacterium avium subsp. paratuberculosis
gccaugugccggcgcucgu

SEQ ID NO: 973636 - RNA, 20 nt, Mycobacterium avium subsp. paratuberculosis
gcccagcugggccagcgcgg

SEQ ID NO: 973637 - RNA, 16 nt, Mycobacterium avium subsp. paratuberculosis
gcccagcuccacgcgu

SEQ ID NO: 973638 - RNA, 21 nt, Mycobacterium avium subsp. paratuberculosis
gcccagcucguugccggcggc

SEQ ID NO: 973639 - RNA, 22 nt, Mycobacterium avium subsp. paratuberculosis
gcccaggaaguagccggccagc

SEQ ID NO: 973640 - RNA, 23 nt, Mycobacterium avium subsp. paratuberculosis
gcccaggaaguagccggccagcg

SEQ ID NO: 973641 - RNA, 17 nt, Mycobacterium avium subsp. paratuberculosis
gcccaggaacgcgccgg

SEQ ID NO: 973642 - RNA, 18 nt, Mycobacterium avium subsp. paratuberculosis
gcccaggaacgcgccggc

SEQ ID NO: 973643 - RNA, 21 nt, Mycobacterium avium subsp. paratuberculosis
gcccagcucggugcgcauggc

SEQ ID NO: 973644 - RNA, 16 nt, Mycobacterium avium subsp. paratuberculosis
gcccaggauucucagc

SEQ ID NO: 973645 - RNA, 23 nt, Mycobacterium avium subsp. paratuberculosis
gcccaggcagacccccagcagcg

SEQ ID NO: 973646 - RNA, 13 nt, Mycobacterium avium subsp. paratuberculosis
gcccaggcucagg

SEQ ID NO: 973647 - RNA, 24 nt, Mycobacterium avium subsp. paratuberculosis
gcccaggcucaggaucagcagccg

SEQ ID NO: 973648 - RNA, 17 nt, Mycobacterium avium subsp. paratuberculosis
gcccagguacuccucgg

SEQ ID NO: 973649 - RNA, 18 nt, Mycobacterium avium subsp. paratuberculosis
gcccagguacuccucggu

SEQ ID NO: 973650 - RNA, 21 nt, Mycobacterium avium subsp. paratuberculosis
gcccagguaaucgaaggccag

SEQ ID NO: 973651 - RNA, 22 nt, Mycobacterium avium subsp. paratuberculosis
gcccagguaaucgaaggccagg

SEQ ID NO: 973652 - RNA, 15 nt, Mycobacterium avium subsp. paratuberculosis
gcccagggcgcgucc

SEQ ID NO: 973653 - RNA, 19 nt, Mycobacterium avium subsp. paratuberculosis
gcccagggcgugcgcggcc

SEQ ID NO: 973654 - RNA, 20 nt, Mycobacterium avium subsp. paratuberculosis
gcccagggcgugcgcggccg

SEQ ID NO: 973655 - RNA, 21 nt, Mycobacterium avium subsp. paratuberculosis
gcccagccaguccgccgccgu

SEQ ID NO: 973656 - RNA, 18 nt, Mycobacterium avium subsp. paratuberculosis
gcccagccagccgguggc

SEQ ID NO: 973657 - RNA, 16 nt, Mycobacterium avium subsp. paratuberculosis
gcccagccaucugcug

SEQ ID NO: 973658 - RNA, 16 nt, Mycobacterium avium subsp. paratuberculosis
gcccagccccagcacg

SEQ ID NO: 973659 - RNA, 19 nt, Mycobacterium avium subsp. paratuberculosis
gcccagcccgagcaccagc

SEQ ID NO: 973660 - RNA, 14 nt, Mycobacterium avium subsp. paratuberculosis
gcccagcccgccgc

SEQ ID NO: 973661 - RNA, 13 nt, Mycobacterium avium subsp. paratuberculosis
gcccagcccgcgc

SEQ ID NO: 973662 - RNA, 19 nt, Mycobacterium avium subsp. paratuberculosis
gcccagcccgcgccgagca

SEQ ID NO: 973663 - RNA, 20 nt, Mycobacterium avium subsp. paratuberculosis
gcccagcccgcgcgagcgca

SEQ ID NO: 973664 - RNA, 17 nt, Mycobacterium avium subsp. paratuberculosis
gcccagcccggccagca

SEQ ID NO: 973665 - RNA, 18 nt, Mycobacterium avium subsp. paratuberculosis
gcccagcccggccagcac

SEQ ID NO: 973666 - RNA, 23 nt, Mycobacterium avium subsp. paratuberculosis
gcccagcggcuguagcacccggc

SEQ ID NO: 973667 - RNA, 19 nt, Mycobacterium avium subsp. paratuberculosis
gcccagcgucucggcggcc

SEQ ID NO: 973668 - RNA, 16 nt, Mycobacterium avium subsp. paratuberculosis
gcccagccaggccgcc

SEQ ID NO: 973669 - RNA, 19 nt, Mycobacterium avium subsp. paratuberculosis
gcccagcaguccggcgguc

SEQ ID NO: 973670 - RNA, 15 nt, Mycobacterium avium subsp. paratuberculosis
gcccagcagggcggc

SEQ ID NO: 973671 - RNA, 16 nt, Mycobacterium avium subsp. paratuberculosis
gcccagcagggcggcg

SEQ ID NO: 973672 - RNA, 17 nt, Mycobacterium avium subsp. paratuberculosis
gcccagacaggccggcc

SEQ ID NO: 973673 - RNA, 20 nt, Mycobacterium avium subsp. paratuberculosis
gcccagaacugggccgccgu

SEQ ID NO: 973674 - RNA, 23 nt, Mycobacterium avium subsp. paratuberculosis
gcccagaacugggccgccgucgc

SEQ ID NO: 973675 - RNA, 13 nt, Mycobacterium avium subsp. paratuberculosis
gcccagaagcccc

SEQ ID NO: 973676 - RNA, 16 nt, Mycobacterium avium subsp. paratuberculosis
gcccagaagccccggu

SEQ ID NO: 973677 - RNA, 16 nt, Mycobacterium avium subsp. paratuberculosis
gcccaucaccagcggc

SEQ ID NO: 973678 - RNA, 13 nt, Mycobacterium avium subsp. paratuberculosis
gcccaucaccccg

SEQ ID NO: 973679 - RNA, 16 nt, Mycobacterium avium subsp. paratuberculosis
gcccaucaccgcaccg

SEQ ID NO: 973680 - RNA, 13 nt, Mycobacterium avium subsp. paratuberculosis
gcccaucagcacg

SEQ ID NO: 973681 - RNA, 12 nt, Mycobacterium avium subsp. paratuberculosis
gcccaucagcag

SEQ ID NO: 973682 - RNA, 20 nt, Mycobacterium avium subsp. paratuberculosis
gcccaucagcaggaccaggc

SEQ ID NO: 973683 - RNA, 16 nt, Mycobacterium avium subsp. paratuberculosis
gcccagguccaccagg

SEQ ID NO: 973684 - RNA, 17 nt, Mycobacterium avium subsp. paratuberculosis
gcccagguccaccaggu

SEQ ID NO: 973685 - RNA, 12 nt, Mycobacterium avium subsp. paratuberculosis
gcccauccggcg

SEQ ID NO: 973686 - RNA, 12 nt, Mycobacterium avium subsp. paratuberculosis
gcccaucgccac

SEQ ID NO: 973687 - RNA, 15 nt, Mycobacterium avium subsp. paratuberculosis
gcccauccaggccag

SEQ ID NO: 973688 - RNA, 21 nt, Mycobacterium avium subsp. paratuberculosis
gcccauccaggccagcaccug

SEQ ID NO: 973689 - RNA, 13 nt, Mycobacterium avium subsp. paratuberculosis
gcccacagcaacg

SEQ ID NO: 973690 - RNA, 19 nt, Mycobacterium avium subsp. paratuberculosis
gcccacagcugacgggccg

SEQ ID NO: 973691 - RNA, 22 nt, Mycobacterium avium subsp. paratuberculosis
gcccacaggacguugaggcggc

SEQ ID NO: 973692 - RNA, 13 nt, Mycobacterium avium subsp. paratuberculosis
gcccacagcagcc

SEQ ID NO: 973693 - RNA, 13 nt, Mycobacterium avium subsp. paratuberculosis
gcccacagcgcca

SEQ ID NO: 973694 - RNA, 16 nt, Mycobacterium avium subsp. paratuberculosis
gcccacagcgccagca

SEQ ID NO: 973695 - RNA, 13 nt, Mycobacterium avium subsp. paratuberculosis
gcccaccagcagg

SEQ ID NO: 973696 - RNA, 13 nt, Mycobacterium avium subsp. paratuberculosis
gcccaccagcauc

SEQ ID NO: 973697 - RNA, 14 nt, Mycobacterium avium subsp. paratuberculosis
gcccaccagccggc

SEQ ID NO: 973698 - RNA, 18 nt, Mycobacterium avium subsp. paratuberculosis
gcccaccagccggccggc

SEQ ID NO: 973699 - RNA, 20 nt, Mycobacterium avium subsp. paratuberculosis
gcccaccaccaggggcagcu

SEQ ID NO: 973700 - RNA, 17 nt, Mycobacterium avium subsp. paratuberculosis
gcccaccaccgccucga

SEQ ID NO: 973701 - RNA, 12 nt, Mycobacterium avium subsp. paratuberculosis
gcccaccaccgg

SEQ ID NO: 973702 - RNA, 13 nt, Mycobacterium avium subsp. paratuberculosis
gcccaccaccggc

SEQ ID NO: 973703 - RNA, 18 nt, Mycobacterium avium subsp. paratuberculosis
gcccacccguuggcaggc

SEQ ID NO: 973704 - RNA, 15 nt, Mycobacterium avium subsp. paratuberculosis
gcccaccgaaucacc

SEQ ID NO: 973705 - RNA, 14 nt, Mycobacterium avium subsp. paratuberculosis
gcccaccgccacca

SEQ ID NO: 973706 - RNA, 18 nt, Mycobacterium avium subsp. paratuberculosis
gcccaccgccaccaggcc

SEQ ID NO: 973707 - RNA, 19 nt, Mycobacterium avium subsp. paratuberculosis
gcccaccgaucgcgagggc

SEQ ID NO: 973708 - RNA, 20 nt, Mycobacterium avium subsp. paratuberculosis
gcccaccgaucgcgagggcc

SEQ ID NO: 973709 - RNA, 13 nt, Mycobacterium avium subsp. paratuberculosis
gcccaccgcggcg

SEQ ID NO: 973710 - RNA, 19 nt, Mycobacterium avium subsp. paratuberculosis
gcccaccgcggcgcgcggc

SEQ ID NO: 973711 - RNA, 19 nt, Mycobacterium avium subsp. paratuberculosis
gcccaccgcgacccggccg

SEQ ID NO: 973712 - RNA, 17 nt, Mycobacterium avium subsp. paratuberculosis
gcccaccggcccggcgg

SEQ ID NO: 973713 - RNA, 20 nt, Mycobacterium avium subsp. paratuberculosis
gcccaccaucccgccgccga

SEQ ID NO: 973714 - RNA, 20 nt, Mycobacterium avium subsp. paratuberculosis
gcccacccgcacgcccgggc

SEQ ID NO: 973715 - RNA, 15 nt, Mycobacterium avium subsp. paratuberculosis
gcccacccgccagcc

SEQ ID NO: 973716 - RNA, 17 nt, Mycobacterium avium subsp. paratuberculosis
gcccacccgccagcccg

SEQ ID NO: 973717 - RNA, 18 nt, Mycobacterium avium subsp. paratuberculosis
gcccacccgccagcccgc

SEQ ID NO: 973718 - RNA, 16 nt, Mycobacterium avium subsp. paratuberculosis
gcccacccgcgccggc

SEQ ID NO: 973719 - RNA, 14 nt, Mycobacterium avium subsp. paratuberculosis
gcccacccggggcc

SEQ ID NO: 973720 - RNA, 15 nt, Mycobacterium avium subsp. paratuberculosis
gcccacccggggccg

SEQ ID NO: 973721 - RNA, 23 nt, Mycobacterium avium subsp. paratuberculosis
gcccaccacgaacgcgccgccga

SEQ ID NO: 973722 - RNA, 16 nt, Mycobacterium avium subsp. paratuberculosis
gcccagaacgacgcgc

SEQ ID NO: 973723 - RNA, 15 nt, Mycobacterium avium subsp. paratuberculosis
gcccacgucgcgccg

SEQ ID NO: 973724 - RNA, 16 nt, Mycobacterium avium subsp. paratuberculosis
gcccacguucagcgac

SEQ ID NO: 973725 - RNA, 18 nt, Mycobacterium avium subsp. paratuberculosis
gcccacguugagcacgcc

SEQ ID NO: 973726 - RNA, 19 nt, Mycobacterium avium subsp. paratuberculosis
gcccacguugagcacgccc

SEQ ID NO: 973727 - RNA, 15 nt, Mycobacterium avium subsp. paratuberculosis
gcccacguaggggcc

SEQ ID NO: 973728 - RNA, 13 nt, Mycobacterium avium subsp. paratuberculosis
gcccacggccacc

SEQ ID NO: 973729 - RNA, 14 nt, Mycobacterium avium subsp. paratuberculosis
gcccacggccacca

SEQ ID NO: 973730 - RNA, 18 nt, Mycobacterium avium subsp. paratuberculosis
gcccaccgguggccggga

SEQ ID NO: 973731 - RNA, 14 nt, Mycobacterium avium subsp. paratuberculosis
gcccaccgggcagc

SEQ ID NO: 973732 - RNA, 16 nt, Mycobacterium avium subsp. paratuberculosis
gcccaccgggcagccg

SEQ ID NO: 973733 - RNA, 17 nt, Mycobacterium avium subsp. paratuberculosis
gcccaccgggcagccgc

SEQ ID NO: 973734 - RNA, 14 nt, Mycobacterium avium subsp. paratuberculosis
gcccaccgucgcca

SEQ ID NO: 973735 - RNA, 15 nt, Mycobacterium avium subsp. paratuberculosis
gcccaccgucgccac

SEQ ID NO: 973736 - RNA, 18 nt, Mycobacterium avium subsp. paratuberculosis
gcccaccucgagcacgcc

SEQ ID NO: 973737 - RNA, 19 nt, Mycobacterium avium subsp. paratuberculosis
gcccaccucgagcacgccc

SEQ ID NO: 973738 - RNA, 18 nt, Mycobacterium avium subsp. paratuberculosis
gcccaccuggaggccaac

SEQ ID NO: 973739 - RNA, 23 nt, Mycobacterium avium subsp. paratuberculosis
gcccacgacgucugggccgccga

SEQ ID NO: 973740 - RNA, 19 nt, Mycobacterium avium subsp. paratuberculosis
gcccacgccgguggggucg

SEQ ID NO: 973741 - RNA, 14 nt, Mycobacterium avium subsp. paratuberculosis
gcccacgccgaggg

SEQ ID NO: 973742 - RNA, 21 nt, Mycobacterium avium subsp. paratuberculosis
gcccaugucgaucggcucggc

SEQ ID NO: 973743 - RNA, 16 nt, Mycobacterium avium subsp. paratuberculosis
gcccccgccgcgagca

SEQ ID NO: 973744 - RNA, 12 nt, Mycobacterium avium subsp. paratuberculosis
gcccccgcggcg

SEQ ID NO: 973745 - RNA, 14 nt, Mycobacterium avium subsp. paratuberculosis
gcccccgcggcggc

SEQ ID NO: 973746 - RNA, 15 nt, Mycobacterium avium subsp. paratuberculosis
gccccauugccgcgc

SEQ ID NO: 973747 - RNA, 13 nt, Mycobacterium avium subsp. paratuberculosis
gcccccgggcccg

SEQ ID NO: 973748 - RNA, 19 nt, Mycobacterium avium subsp. paratuberculosis
gccccgcgacacgccgcgc

SEQ ID NO: 973749 - RNA, 18 nt, Mycobacterium avium subsp. paratuberculosis
gccccgcgaccgcagcag

SEQ ID NO: 973750 - RNA, 22 nt, Mycobacterium avium subsp. paratuberculosis
gccccggcaucgacaugcccgg

SEQ ID NO: 973751 - RNA, 14 nt, Mycobacterium avium subsp. paratuberculosis
gccccggccggcgg

SEQ ID NO: 973752 - RNA, 13 nt, Mycobacterium avium subsp. paratuberculosis
gccccggccgcgc

SEQ ID NO: 973753 - RNA, 18 nt, Mycobacterium avium subsp. paratuberculosis
gccccggccgcgcaccgc

SEQ ID NO: 973754 - RNA, 17 nt, Mycobacterium avium subsp. paratuberculosis
gccccggccgagccggc

SEQ ID NO: 973755 - RNA, 15 nt, Mycobacterium avium subsp. paratuberculosis
gccccggccgagcgc

SEQ ID NO: 973756 - RNA, 13 nt, Mycobacterium avium subsp. paratuberculosis
gccccgggccgca

SEQ ID NO: 973757 - RNA, 22 nt, Mycobacterium avium subsp. paratuberculosis
gccccgggcgcuggcgauggug

SEQ ID NO: 973758 - RNA, 18 nt, Mycobacterium avium subsp. paratuberculosis
gccccggcgacggcggcc

SEQ ID NO: 973759 - RNA, 15 nt, Mycobacterium avium subsp. paratuberculosis
gccccggcgcagcgc

SEQ ID NO: 973760 - RNA, 18 nt, Mycobacterium avium subsp. paratuberculosis
gccccggcgcagcgccgc

SEQ ID NO: 973761 - RNA, 22 nt, Mycobacterium avium subsp. paratuberculosis
gccccgccagcagaugccgccc

SEQ ID NO: 973762 - RNA, 18 nt, Mycobacterium avium subsp. paratuberculosis
gcccccugggacagcgag

SEQ ID NO: 973763 - RNA, 13 nt, Mycobacterium avium subsp. paratuberculosis
gcccccucggccg

SEQ ID NO: 973764 - RNA, 19 nt, Mycobacterium avium subsp. paratuberculosis
gcccccugcucagcggcca

SEQ ID NO: 973765 - RNA, 22 nt, Mycobacterium avium subsp. paratuberculosis
gccccgccgcggccaggucgag

SEQ ID NO: 973766 - RNA, 16 nt, Mycobacterium avium subsp. paratuberculosis
gccccgcccggcgcgc

SEQ ID NO: 973767 - RNA, 15 nt, Mycobacterium avium subsp. paratuberculosis
gccccgcccggggcg

SEQ ID NO: 973768 - RNA, 13 nt, Mycobacterium avium subsp. paratuberculosis
gccccgccaggcg

SEQ ID NO: 973769 - RNA, 15 nt, Mycobacterium avium subsp. paratuberculosis
gccccgccaggcggc

SEQ ID NO: 973770 - RNA, 15 nt, Mycobacterium avium subsp. paratuberculosis
gcccgaacagccggg

SEQ ID NO: 973771 - RNA, 17 nt, Mycobacterium avium subsp. paratuberculosis
gcccgaacagccgggcc

SEQ ID NO: 973772 - RNA, 19 nt, Mycobacterium avium subsp. paratuberculosis
gcccgaacagccgggcggc

SEQ ID NO: 973773 - RNA, 23 nt, Mycobacterium avium subsp. paratuberculosis
gcccgaacaucgccucggccgcg

SEQ ID NO: 973774 - RNA, 19 nt, Mycobacterium avium subsp. paratuberculosis
gcccgaacaccuccucggu

SEQ ID NO: 973775 - RNA, 20 nt, Mycobacterium avium subsp. paratuberculosis
gccccuucgaugucgccggc

SEQ ID NO: 973776 - RNA, 17 nt, Mycobacterium avium subsp. paratuberculosis
gcccgaaacgucgcagc

SEQ ID NO: 973777 - RNA, 14 nt, Mycobacterium avium subsp. paratuberculosis
gcccgacggcgcgc

SEQ ID NO: 973778 - RNA, 20 nt, Mycobacterium avium subsp. paratuberculosis
gcccgacggguucgcgcagc

SEQ ID NO: 973779 - RNA, 22 nt, Mycobacterium avium subsp. paratuberculosis
gcccgacggauucccgaacagg

SEQ ID NO: 973780 - RNA, 17 nt, Mycobacterium avium subsp. paratuberculosis
gcccgacggcagcaccg

SEQ ID NO: 973781 - RNA, 13 nt, Mycobacterium avium subsp. paratuberculosis
gccccgggggacc

SEQ ID NO: 973782 - RNA, 15 nt, Mycobacterium avium subsp. paratuberculosis
gccccgguagccagc

SEQ ID NO: 973783 - RNA, 19 nt, Mycobacterium avium subsp. paratuberculosis
gccccgguagccagcaccg

SEQ ID NO: 973784 - RNA, 23 nt, Mycobacterium avium subsp. paratuberculosis
gcccgaucaccaggcccaggccg

SEQ ID NO: 973785 - RNA, 17 nt, Mycobacterium avium subsp. paratuberculosis
gcccgaucgcggcgagc

SEQ ID NO: 973786 - RNA, 16 nt, Mycobacterium avium subsp. paratuberculosis
gcccgaucccgggccg

SEQ ID NO: 973787 - RNA, 20 nt, Mycobacterium avium subsp. paratuberculosis
gcccgaucgccagcgcccga

SEQ ID NO: 973788 - RNA, 21 nt, Mycobacterium avium subsp. paratuberculosis
gcccgaggucauaucgacggc

SEQ ID NO: 973789 - RNA, 18 nt, Mycobacterium avium subsp. paratuberculosis
gcccgagguccucgcgca

SEQ ID NO: 973790 - RNA, 14 nt, Mycobacterium avium subsp. paratuberculosis
gcccgagcggcgac

SEQ ID NO: 973791 - RNA, 21 nt, Mycobacterium avium subsp. paratuberculosis
gcccgagcggcgacuccagca

SEQ ID NO: 973792 - RNA, 20 nt, Mycobacterium avium subsp. paratuberculosis
gcccgagcgucacgccagcg

SEQ ID NO: 973793 - RNA, 18 nt, Mycobacterium avium subsp. paratuberculosis
gcccgagcgucauuccgc

SEQ ID NO: 973794 - RNA, 21 nt, Mycobacterium avium subsp. paratuberculosis
gcccgagcgucauuccgccgc

SEQ ID NO: 973795 - RNA, 13 nt, Mycobacterium avium subsp. paratuberculosis
gcccgacuccuca

SEQ ID NO: 973796 - RNA, 14 nt, Mycobacterium avium subsp. paratuberculosis
gcccgagcaccagc

SEQ ID NO: 973797 - RNA, 23 nt, Mycobacterium avium subsp. paratuberculosis
gcccgagcaccugaacggccgcg

SEQ ID NO: 973798 - RNA, 22 nt, Mycobacterium avium subsp. paratuberculosis
gcccgagcauuucgcgcacguc

SEQ ID NO: 973799 - RNA, 13 nt, Mycobacterium avium subsp. paratuberculosis
gcccgccgacggc

SEQ ID NO: 973800 - RNA, 17 nt, Mycobacterium avium subsp. paratuberculosis
gcccgccgacggcugcc

SEQ ID NO: 973801 - RNA, 17 nt, Mycobacterium avium subsp. paratuberculosis
gcccgccgaacaccggc

SEQ ID NO: 973802 - RNA, 20 nt, Mycobacterium avium subsp. paratuberculosis
gcccgccgaacaccggcagc

SEQ ID NO: 973803 - RNA, 22 nt, Mycobacterium avium subsp. paratuberculosis
gcccgcccggcccggcgcggcc

SEQ ID NO: 973804 - RNA, 23 nt, Mycobacterium avium subsp. paratuberculosis
gcccgcccggcccggcgcggccg

SEQ ID NO: 973805 - RNA, 13 nt, Mycobacterium avium subsp. paratuberculosis
gcccgcccggcgg

SEQ ID NO: 973806 - RNA, 16 nt, Mycobacterium avium subsp. paratuberculosis
gcccgcccgagcguca

SEQ ID NO: 973807 - RNA, 16 nt, Mycobacterium avium subsp. paratuberculosis
gcccgcccgcagcggc

SEQ ID NO: 973808 - RNA, 17 nt, Mycobacterium avium subsp. paratuberculosis
gcccgccccgacgugca

SEQ ID NO: 973809 - RNA, 23 nt, Mycobacterium avium subsp. paratuberculosis
gcccgccccgacgugcagcgcca

SEQ ID NO: 973810 - RNA, 13 nt, Mycobacterium avium subsp. paratuberculosis
gcccgcccagcug

SEQ ID NO: 973811 - RNA, 14 nt, Mycobacterium avium subsp. paratuberculosis
gcccgcccaggccg

SEQ ID NO: 973812 - RNA, 15 nt, Mycobacterium avium subsp. paratuberculosis
gcccgcccaggccgc

SEQ ID NO: 973813 - RNA, 11 nt, Mycobacterium avium subsp. paratuberculosis
gcccgccgcga

SEQ ID NO: 973814 - RNA, 15 nt, Mycobacterium avium subsp. paratuberculosis
gcccgccgcgagccg

SEQ ID NO: 973815 - RNA, 18 nt, Mycobacterium avium subsp. paratuberculosis
gcccgccgcgagccgccc

SEQ ID NO: 973816 - RNA, 14 nt, Mycobacterium avium subsp. paratuberculosis
gcccgccgcgcccg

SEQ ID NO: 973817 - RNA, 13 nt, Mycobacterium avium subsp. paratuberculosis
gcccgccgcggcg

SEQ ID NO: 973818 - RNA, 22 nt, Mycobacterium avium subsp. paratuberculosis
gcccgccgcggcuccagcagcg

SEQ ID NO: 973819 - RNA, 19 nt, Mycobacterium avium subsp. paratuberculosis
gcccgcccuuggccgcgga

SEQ ID NO: 973820 - RNA, 15 nt, Mycobacterium avium subsp. paratuberculosis
gcccgccgccggcgg

SEQ ID NO: 973821 - RNA, 17 nt, Mycobacterium avium subsp. paratuberculosis
gcccgccgccaccacgg

SEQ ID NO: 973822 - RNA, 15 nt, Mycobacterium avium subsp. paratuberculosis
gcccgcgacggcgag

SEQ ID NO: 973823 - RNA, 16 nt, Mycobacterium avium subsp. paratuberculosis
gcccgcgacggcgagc

SEQ ID NO: 973824 - RNA, 15 nt, Mycobacterium avium subsp. paratuberculosis
gcccgcgacugucgg

SEQ ID NO: 973825 - RNA, 18 nt, Mycobacterium avium subsp. paratuberculosis
gcccgcgaacgccucguu

SEQ ID NO: 973826 - RNA, 16 nt, Mycobacterium avium subsp. paratuberculosis
gcccgcguccagcagc

SEQ ID NO: 973827 - RNA, 19 nt, Mycobacterium avium subsp. paratuberculosis
gcccgcguugcggcgcagc

SEQ ID NO: 973828 - RNA, 21 nt, Mycobacterium avium subsp. paratuberculosis
gcccgcgguggaacccagcac

SEQ ID NO: 973829 - RNA, 17 nt, Mycobacterium avium subsp. paratuberculosis
gcccgcguaaccggcgg

SEQ ID NO: 973830 - RNA, 20 nt, Mycobacterium avium subsp. paratuberculosis
gcccgcggggcguacgcgcu

SEQ ID NO: 973831 - RNA, 16 nt, Mycobacterium avium subsp. paratuberculosis
gcccgcgggugcagcc

SEQ ID NO: 973832 - RNA, 17 nt, Mycobacterium avium subsp. paratuberculosis
gcccgcgggugcagccg

SEQ ID NO: 973833 - RNA, 19 nt, Mycobacterium avium subsp. paratuberculosis
gcccgcgggugcagccgga

SEQ ID NO: 973834 - RNA, 21 nt, Mycobacterium avium subsp. paratuberculosis
gcccgcggcggauccagcacc

SEQ ID NO: 973835 - RNA, 22 nt, Mycobacterium avium subsp. paratuberculosis
gcccgcggcggauccagcaccg

SEQ ID NO: 973836 - RNA, 17 nt, Mycobacterium avium subsp. paratuberculosis
gcccgcggcagccagcc

SEQ ID NO: 973837 - RNA, 17 nt, Mycobacterium avium subsp. paratuberculosis
gcccgcggccuccagcc

SEQ ID NO: 973838 - RNA, 19 nt, Mycobacterium avium subsp. paratuberculosis
gcccgcggccuccagccgc

SEQ ID NO: 973839 - RNA, 17 nt, Mycobacterium avium subsp. paratuberculosis
gcccgcgccagcucggc

SEQ ID NO: 973840 - RNA, 22 nt, Mycobacterium avium subsp. paratuberculosis
gcccgcgccagcucggcggccg

SEQ ID NO: 973841 - RNA, 17 nt, Mycobacterium avium subsp. paratuberculosis
gcccgcgccgacggccg

SEQ ID NO: 973842 - RNA, 19 nt, Mycobacterium avium subsp. paratuberculosis
gcccgcgccgacggccgcg

SEQ ID NO: 973843 - RNA, 14 nt, Mycobacterium avium subsp. paratuberculosis
gcccgcgccgagca

SEQ ID NO: 973844 - RNA, 18 nt, Mycobacterium avium subsp. paratuberculosis
gcccgcgccgagcaaccg

SEQ ID NO: 973845 - RNA, 17 nt, Mycobacterium avium subsp. paratuberculosis
gcccgcgaucggcgcca

SEQ ID NO: 973846 - RNA, 20 nt, Mycobacterium avium subsp. paratuberculosis
gcccgcgcgcucgggggugc

SEQ ID NO: 973847 - RNA, 14 nt, Mycobacterium avium subsp. paratuberculosis
gcccgcggcacgcu

SEQ ID NO: 973848 - RNA, 13 nt, Mycobacterium avium subsp. paratuberculosis
gcccgcgcggccg

SEQ ID NO: 973849 - RNA, 15 nt, Mycobacterium avium subsp. paratuberculosis
gcccgcgcggccgcc

SEQ ID NO: 973850 - RNA, 14 nt, Mycobacterium avium subsp. paratuberculosis
gcccgcgcggcggc

SEQ ID NO: 973851 - RNA, 21 nt, Mycobacterium avium subsp. paratuberculosis
gcccgcgcggcucacagcgcg

SEQ ID NO: 973852 - RNA, 16 nt, Mycobacterium avium subsp. paratuberculosis
gcccgcgcgggcugca

SEQ ID NO: 973853 - RNA, 16 nt, Mycobacterium avium subsp. paratuberculosis
gcccgcuggggcgcac

SEQ ID NO: 973854 - RNA, 19 nt, Mycobacterium avium subsp. paratuberculosis
gcccggaaaaccccacccc

SEQ ID NO: 973855 - RNA, 17 nt, Mycobacterium avium subsp. paratuberculosis
gcccgcugcggcgcagg

SEQ ID NO: 973856 - RNA, 20 nt, Mycobacterium avium subsp. paratuberculosis
gcccggaacggcgggcccgu

SEQ ID NO: 973857 - RNA, 16 nt, Mycobacterium avium subsp. paratuberculosis
gcccggaccagggugg

SEQ ID NO: 973858 - RNA, 21 nt, Mycobacterium avium subsp. paratuberculosis
gcccggaccgcggucgggucc

SEQ ID NO: 973859 - RNA, 19 nt, Mycobacterium avium subsp. paratuberculosis
gcccggacgcgcacacggc

SEQ ID NO: 973860 - RNA, 21 nt, Mycobacterium avium subsp. paratuberculosis
gcccggagaaaccgucggccc

SEQ ID NO: 973861 - RNA, 15 nt, Mycobacterium avium subsp. paratuberculosis
gcccgcucagagcug

SEQ ID NO: 973862 - RNA, 17 nt, Mycobacterium avium subsp. paratuberculosis
gcccgcucaccugcggc

SEQ ID NO: 973863 - RNA, 14 nt, Mycobacterium avium subsp. paratuberculosis
gcccgcuccugcag

SEQ ID NO: 973864 - RNA, 16 nt, Mycobacterium avium subsp. paratuberculosis
gcccgcucgacggccg

SEQ ID NO: 973865 - RNA, 15 nt, Mycobacterium avium subsp. paratuberculosis
gcccgcuccgcgggc

SEQ ID NO: 973866 - RNA, 16 nt, Mycobacterium avium subsp. paratuberculosis
gcccgcuccgcgggca

SEQ ID NO: 973867 - RNA, 23 nt, Mycobacterium avium subsp. paratuberculosis
gcccgcuccggcggacccagcuc

SEQ ID NO: 973868 - RNA, 15 nt, Mycobacterium avium subsp. paratuberculosis
gcccgcugcgcggcc

SEQ ID NO: 973869 - RNA, 16 nt, Mycobacterium avium subsp. paratuberculosis
gcccgcuggccgccgc

SEQ ID NO: 973870 - RNA, 17 nt, Mycobacterium avium subsp. paratuberculosis
gcccgcuggccgccgcu

SEQ ID NO: 973871 - RNA, 15 nt, Mycobacterium avium subsp. paratuberculosis
gcccgcugaccaggc

SEQ ID NO: 973872 - RNA, 16 nt, Mycobacterium avium subsp. paratuberculosis
gcccgcugaccaggcc

SEQ ID NO: 973873 - RNA, 18 nt, Mycobacterium avium subsp. paratuberculosis
gcccgcugaccaggccga

SEQ ID NO: 973874 - RNA, 20 nt, Mycobacterium avium subsp. paratuberculosis
gcccgcugaccgccgcgcuc

SEQ ID NO: 973875 - RNA, 22 nt, Mycobacterium avium subsp. paratuberculosis
gcccgcugcagcgccgaggcca

SEQ ID NO: 973876 - RNA, 14 nt, Mycobacterium avium subsp. paratuberculosis
gcccggcggccacc

SEQ ID NO: 973877 - RNA, 15 nt, Mycobacterium avium subsp. paratuberculosis
gcccggcggcgcugc

SEQ ID NO: 973878 - RNA, 19 nt, Mycobacterium avium subsp. paratuberculosis
gcccggcgugggccgcagc

SEQ ID NO: 973879 - RNA, 24 nt, Mycobacterium avium subsp. paratuberculosis
gcccggcgugggccgcagcgcggc

SEQ ID NO: 973880 - RNA, 17 nt, Mycobacterium avium subsp. paratuberculosis
gcccggcgucggugguc

SEQ ID NO: 973881 - RNA, 19 nt, Mycobacterium avium subsp. paratuberculosis
gcccggcggccggccgcgc

SEQ ID NO: 973882 - RNA, 15 nt, Mycobacterium avium subsp. paratuberculosis
gcccggcgcggcggc

SEQ ID NO: 973883 - RNA, 20 nt, Mycobacterium avium subsp. paratuberculosis
gcccggcgcggcggcgccgc

SEQ ID NO: 973884 - RNA, 13 nt, Mycobacterium avium subsp. paratuberculosis
gcccggcgcggcg

SEQ ID NO: 973885 - RNA, 14 nt, Mycobacterium avium subsp. paratuberculosis
gcccggcgcugcgc

SEQ ID NO: 973886 - RNA, 20 nt, Mycobacterium avium subsp. paratuberculosis
gcccggcgcgcagcccagcc

SEQ ID NO: 973887 - RNA, 23 nt, Mycobacterium avium subsp. paratuberculosis
gcccggcgcgcagcccagccagc

SEQ ID NO: 973888 - RNA, 14 nt, Mycobacterium avium subsp. paratuberculosis
gcccggcgccacgc

SEQ ID NO: 973889 - RNA, 22 nt, Mycobacterium avium subsp. paratuberculosis
gcccggcuggcaggucgcgccg

SEQ ID NO: 973890 - RNA, 13 nt, Mycobacterium avium subsp. paratuberculosis
gcccggcugcgca

SEQ ID NO: 973891 - RNA, 15 nt, Mycobacterium avium subsp. paratuberculosis
gcccggcugcgcagc

SEQ ID NO: 973892 - RNA, 17 nt, Mycobacterium avium subsp. paratuberculosis
gcccggcugcgcagcgc

SEQ ID NO: 973893 - RNA, 17 nt, Mycobacterium avium subsp. paratuberculosis
gcccggcugcgccgcgc

SEQ ID NO: 973894 - RNA, 16 nt, Mycobacterium avium subsp. paratuberculosis
gcccggcuucgccgcc

SEQ ID NO: 973895 - RNA, 17 nt, Mycobacterium avium subsp. paratuberculosis
gcccggcuucgccgccg

SEQ ID NO: 973896 - RNA, 21 nt, Mycobacterium avium subsp. paratuberculosis
gcccggcuucgccgccgcacc

SEQ ID NO: 973897 - RNA, 19 nt, Mycobacterium avium subsp. paratuberculosis
gcccggcuucgccgcgcuu

SEQ ID NO: 973898 - RNA, 20 nt, Mycobacterium avium subsp. paratuberculosis
gcccggcuucgccgcgcuug

SEQ ID NO: 973899 - RNA, 16 nt, Mycobacterium avium subsp. paratuberculosis
gcccggcucgccgggc

SEQ ID NO: 973900 - RNA, 18 nt, Mycobacterium avium subsp. paratuberculosis
gcccggcucgccgggcug

SEQ ID NO: 973901 - RNA, 15 nt, Mycobacterium avium subsp. paratuberculosis
gcccgggcaucccgc

SEQ ID NO: 973902 - RNA, 18 nt, Mycobacterium avium subsp. paratuberculosis
gcccgggcaucccgccga

SEQ ID NO: 973903 - RNA, 14 nt, Mycobacterium avium subsp. paratuberculosis
gcccgggccgcagc

SEQ ID NO: 973904 - RNA, 16 nt, Mycobacterium avium subsp. paratuberculosis
gcccgggccgcagcuc

SEQ ID NO: 973905 - RNA, 12 nt, Mycobacterium avium subsp. paratuberculosis
gcccgggccaca

SEQ ID NO: 973906 - RNA, 13 nt, Mycobacterium avium subsp. paratuberculosis
gcccgggcaggca

SEQ ID NO: 973907 - RNA, 16 nt, Mycobacterium avium subsp. paratuberculosis
gcccgggcaggcggcg

SEQ ID NO: 973908 - RNA, 16 nt, Mycobacterium avium subsp. paratuberculosis
gcccggcugggcgcgc

SEQ ID NO: 973909 - RNA, 17 nt, Mycobacterium avium subsp. paratuberculosis
gcccgggaagccgcagc

SEQ ID NO: 973910 - RNA, 18 nt, Mycobacterium avium subsp. paratuberculosis
gcccgggaagccgcagca

SEQ ID NO: 973911 - RNA, 21 nt, Mycobacterium avium subsp. paratuberculosis
gcccgggaagccgcagcaggu

SEQ ID NO: 973912 - RNA, 20 nt, Mycobacterium avium subsp. paratuberculosis
gcccgggaagcuggugguga

SEQ ID NO: 973913 - RNA, 22 nt, Mycobacterium avium subsp. paratuberculosis
gcccggagguucgccggaaugg

SEQ ID NO: 973914 - RNA, 24 nt, Mycobacterium avium subsp. paratuberculosis
gcccggagguucgccggaauggca

SEQ ID NO: 973915 - RNA, 14 nt, Mycobacterium avium subsp. paratuberculosis
gcccggaucagcug

SEQ ID NO: 973916 - RNA, 15 nt, Mycobacterium avium subsp. paratuberculosis
gcccggaucagcuga

SEQ ID NO: 973917 - RNA, 24 nt, Mycobacterium avium subsp. paratuberculosis
gcccggauuucgucccaguccagc

SEQ ID NO: 973918 - RNA, 21 nt, Mycobacterium avium subsp. paratuberculosis
gcccggaucgucuugcggccc

SEQ ID NO: 973919 - RNA, 18 nt, Mycobacterium avium subsp. paratuberculosis
gcccggauggccgggcag

SEQ ID NO: 973920 - RNA, 16 nt, Mycobacterium avium subsp. paratuberculosis
gcccggcaccgcggcg

SEQ ID NO: 973921 - RNA, 14 nt, Mycobacterium avium subsp. paratuberculosis
gcccggcagccggg

SEQ ID NO: 973922 - RNA, 19 nt, Mycobacterium avium subsp. paratuberculosis
gcccggccacucgccgcga

SEQ ID NO: 973923 - RNA, 12 nt, Mycobacterium avium subsp. paratuberculosis
gcccggccagca

SEQ ID NO: 973924 - RNA, 17 nt, Mycobacterium avium subsp. paratuberculosis
gcccggccagcacccgc

SEQ ID NO: 973925 - RNA, 19 nt, Mycobacterium avium subsp. paratuberculosis
gcccggccagcacccgcuc

SEQ ID NO: 973926 - RNA, 14 nt, Mycobacterium avium subsp. paratuberculosis
gcccggccagcagg

SEQ ID NO: 973927 - RNA, 14 nt, Mycobacterium avium subsp. paratuberculosis
gcccggccaacggg

SEQ ID NO: 973928 - RNA, 17 nt, Mycobacterium avium subsp. paratuberculosis
gcccggccagccggccg

SEQ ID NO: 973929 - RNA, 19 nt, Mycobacterium avium subsp. paratuberculosis
gcccggccagccggccgcu

SEQ ID NO: 973930 - RNA, 21 nt, Mycobacterium avium subsp. paratuberculosis
gcccggccagccggccgcuga

SEQ ID NO: 973931 - RNA, 15 nt, Mycobacterium avium subsp. paratuberculosis
gcccggccagccggg

SEQ ID NO: 973932 - RNA, 15 nt, Mycobacterium avium subsp. paratuberculosis
gcccggccagccggu

SEQ ID NO: 973933 - RNA, 19 nt, Mycobacterium avium subsp. paratuberculosis
gcccggcgagcacaggaac

SEQ ID NO: 973934 - RNA, 17 nt, Mycobacterium avium subsp. paratuberculosis
gcccggcgaacaccacg

SEQ ID NO: 973935 - RNA, 16 nt, Mycobacterium avium subsp. paratuberculosis
gcccggcgacgcggcg

SEQ ID NO: 973936 - RNA, 13 nt, Mycobacterium avium subsp. paratuberculosis
gcccggcgccggc

SEQ ID NO: 973937 - RNA, 16 nt, Mycobacterium avium subsp. paratuberculosis
gcccggcgccggcggc

SEQ ID NO: 973938 - RNA, 15 nt, Mycobacterium avium subsp. paratuberculosis
gcccggcgccggucg

SEQ ID NO: 973939 - RNA, 12 nt, Mycobacterium avium subsp. paratuberculosis
gcccggccggcg

SEQ ID NO: 973940 - RNA, 15 nt, Mycobacterium avium subsp. paratuberculosis
gcccggccgugagug

SEQ ID NO: 973941 - RNA, 13 nt, Mycobacterium avium subsp. paratuberculosis
gcccggccgccga

SEQ ID NO: 973942 - RNA, 14 nt, Mycobacterium avium subsp. paratuberculosis
gcccggcccgccgc

SEQ ID NO: 973943 - RNA, 15 nt, Mycobacterium avium subsp. paratuberculosis
gcccggcccggcgcg

SEQ ID NO: 973944 - RNA, 15 nt, Mycobacterium avium subsp. paratuberculosis
gcccggcccgucagg

SEQ ID NO: 973945 - RNA, 21 nt, Mycobacterium avium subsp. paratuberculosis
gcccggcccaagacccgcguc

SEQ ID NO: 973946 - RNA, 18 nt, Mycobacterium avium subsp. paratuberculosis
gcccggcccagccggucg

SEQ ID NO: 973947 - RNA, 21 nt, Mycobacterium avium subsp. paratuberculosis
gcccggccccaccgccgcugc

SEQ ID NO: 973948 - RNA, 15 nt, Mycobacterium avium subsp. paratuberculosis
gcccggccagcaggu

SEQ ID NO: 973949 - RNA, 18 nt, Mycobacterium avium subsp. paratuberculosis
gcccggccaguccggcag

SEQ ID NO: 973950 - RNA, 23 nt, Mycobacterium avium subsp. paratuberculosis
gcgccauuuccguugugccaccg

SEQ ID NO: 973951 - RNA, 18 nt, Mycobacterium avium subsp. paratuberculosis
gcgccauguccggcaggc

SEQ ID NO: 973952 - RNA, 20 nt, Mycobacterium avium subsp. paratuberculosis
gcgcccacgugccaucgcug

SEQ ID NO: 973953 - RNA, 23 nt, Mycobacterium avium subsp. paratuberculosis
gcgcccacccgaugaccggcccg

SEQ ID NO: 973954 - RNA, 18 nt, Mycobacterium avium subsp. paratuberculosis
gcgcccacccgcgccggc

SEQ ID NO: 973955 - RNA, 16 nt, Mycobacterium avium subsp. paratuberculosis
gcgcccaccgcggcgc

SEQ ID NO: 973956 - RNA, 22 nt, Mycobacterium avium subsp. paratuberculosis
gcgcccaccgcggcgcgcggcc

SEQ ID NO: 973957 - RNA, 20 nt, Mycobacterium avium subsp. paratuberculosis
gcgcccaccgcucgucgggc

SEQ ID NO: 973958 - RNA, 13 nt, Mycobacterium avium subsp. paratuberculosis
gcgcccacagcag

SEQ ID NO: 973959 - RNA, 23 nt, Mycobacterium avium subsp. paratuberculosis
gcgccaggucgggguccaggccg

SEQ ID NO: 973960 - RNA, 20 nt, Mycobacterium avium subsp. paratuberculosis
gcgccagggucuggcccggu

SEQ ID NO: 973961 - RNA, 17 nt, Mycobacterium avium subsp. paratuberculosis
gcgccagggugccccgc

SEQ ID NO: 973962 - RNA, 21 nt, Mycobacterium avium subsp. paratuberculosis
gcgccagggugccccgcaccg

SEQ ID NO: 973963 - RNA, 22 nt, Mycobacterium avium subsp. paratuberculosis
gcgccagggugccccgcaccgc

SEQ ID NO: 973964 - RNA, 13 nt, Mycobacterium avium subsp. paratuberculosis
gcgccaggccggc

SEQ ID NO: 973965 - RNA, 21 nt, Mycobacterium avium subsp. paratuberculosis
gcgccaggccauggcgcaccg

SEQ ID NO: 973966 - RNA, 22 nt, Mycobacterium avium subsp. paratuberculosis
gcgccaggccauggcgcaccgc

SEQ ID NO: 973967 - RNA, 19 nt, Mycobacterium avium subsp. paratuberculosis
gcgccaggcagaagcucca

SEQ ID NO: 973968 - RNA, 20 nt, Mycobacterium avium subsp. paratuberculosis
gcgccaggcagaagcuccac

SEQ ID NO: 973969 - RNA, 14 nt, Mycobacterium avium subsp. paratuberculosis
gcgccagcuccagc

SEQ ID NO: 973970 - RNA, 17 nt, Mycobacterium avium subsp. paratuberculosis
gcgccagcguggccagc

SEQ ID NO: 973971 - RNA, 18 nt, Mycobacterium avium subsp. paratuberculosis
gcgccagcucggcggccg

SEQ ID NO: 973972 - RNA, 12 nt, Mycobacterium avium subsp. paratuberculosis
gcgccagcuggg

SEQ ID NO: 973973 - RNA, 19 nt, Mycobacterium avium subsp. paratuberculosis
gcgcccggcaccgcggcgg

SEQ ID NO: 973974 - RNA, 20 nt, Mycobacterium avium subsp. paratuberculosis
gcgcccggcaccgcggcggu

SEQ ID NO: 973975 - RNA, 14 nt, Mycobacterium avium subsp. paratuberculosis
gcgcccggcagccg

SEQ ID NO: 973976 - RNA, 21 nt, Mycobacterium avium subsp. paratuberculosis
gcgcccggcagccgcuccggc

SEQ ID NO: 973977 - RNA, 14 nt, Mycobacterium avium subsp. paratuberculosis
gcgcccggcagcgg

SEQ ID NO: 973978 - RNA, 16 nt, Mycobacterium avium subsp. paratuberculosis
gcgcccggcgcgccac

SEQ ID NO: 973979 - RNA, 13 nt, Mycobacterium avium subsp. paratuberculosis
gcgcccggcgccg

SEQ ID NO: 973980 - RNA, 15 nt, Mycobacterium avium subsp. paratuberculosis
gcgcccggcgccggc

SEQ ID NO: 973981 - RNA, 20 nt, Mycobacterium avium subsp. paratuberculosis
gcgcccggcgacgcggcggg

SEQ ID NO: 973982 - RNA, 17 nt, Mycobacterium avium subsp. paratuberculosis
gcgcccguagcggcgga

SEQ ID NO: 973983 - RNA, 22 nt, Mycobacterium avium subsp. paratuberculosis
gcgcccgucgagcgucacgcug

SEQ ID NO: 973984 - RNA, 14 nt, Mycobacterium avium subsp. paratuberculosis
gcgcccgggcgcgu

SEQ ID NO: 973985 - RNA, 13 nt, Mycobacterium avium subsp. paratuberculosis
gcgcccgggugcg

SEQ ID NO: 973986 - RNA, 14 nt, Mycobacterium avium subsp. paratuberculosis
gcgcccgggugggc

SEQ ID NO: 973987 - RNA, 19 nt, Mycobacterium avium subsp. paratuberculosis
gcgcccggcuucgccgcgc

SEQ ID NO: 973988 - RNA, 16 nt, Mycobacterium avium subsp. paratuberculosis
gcgcccgagccgcaca

SEQ ID NO: 973989 - RNA, 15 nt, Mycobacterium avium subsp. paratuberculosis
gcgcccgauuccccg

SEQ ID NO: 973990 - RNA, 18 nt, Mycobacterium avium subsp. paratuberculosis
gcgcccgagucacccggc

SEQ ID NO: 973991 - RNA, 12 nt, Mycobacterium avium subsp. paratuberculosis
gcgcccgcccgg

SEQ ID NO: 973992 - RNA, 13 nt, Mycobacterium avium subsp. paratuberculosis
gcgcccgcccggc

SEQ ID NO: 973993 - RNA, 19 nt, Mycobacterium avium subsp. paratuberculosis
gcgcccgcccggcccggcg

SEQ ID NO: 973994 - RNA, 14 nt, Mycobacterium avium subsp. paratuberculosis
gcgcccgccgccac

SEQ ID NO: 973995 - RNA, 15 nt, Mycobacterium avium subsp. paratuberculosis
gcgcccgccgccacc

SEQ ID NO: 973996 - RNA, 13 nt, Mycobacterium avium subsp. paratuberculosis
gcgcccgcgccac

SEQ ID NO: 973997 - RNA, 12 nt, Mycobacterium avium subsp. paratuberculosis
gcgcccgcgcgc

SEQ ID NO: 973998 - RNA, 14 nt, Mycobacterium avium subsp. paratuberculosis
gcgcccgcgcgggc

SEQ ID NO: 973999 - RNA, 17 nt, Mycobacterium avium subsp. paratuberculosis
gcgcccgcgcgugggcc

SEQ ID NO: 974000 - RNA, 14 nt, Mycobacterium avium subsp. paratuberculosis
gcgcccgcuccggc

SEQ ID NO: 974001 - RNA, 18 nt, Mycobacterium avium subsp. paratuberculosis
gcgcccgcgggugcagcc

SEQ ID NO: 974002 - RNA, 20 nt, Mycobacterium avium subsp. paratuberculosis
gcgcccgcgggugcagccgg

SEQ ID NO: 974003 - RNA, 21 nt, Mycobacterium avium subsp. paratuberculosis
gcgcccgcggccuccagccgc

SEQ ID NO: 974004 - RNA, 18 nt, Mycobacterium avium subsp. paratuberculosis
gcgcccgccggcccagcu

SEQ ID NO: 974005 - RNA, 17 nt, Mycobacterium avium subsp. paratuberculosis
gcgcccaucgcggccgc

SEQ ID NO: 974006 - RNA, 17 nt, Mycobacterium avium subsp. paratuberculosis
gcgcccaggggagcggc

SEQ ID NO: 974007 - RNA, 20 nt, Mycobacterium avium subsp. paratuberculosis
gcgcccaggggagcggcgga

SEQ ID NO: 974008 - RNA, 18 nt, Mycobacterium avium subsp. paratuberculosis
gcgcccaggcugaacacc

SEQ ID NO: 974009 - RNA, 17 nt, Mycobacterium avium subsp. paratuberculosis
gcgcccagguacuccuc

SEQ ID NO: 974010 - RNA, 18 nt, Mycobacterium avium subsp. paratuberculosis
gcgcccagguacuccucg

SEQ ID NO: 974011 - RNA, 19 nt, Mycobacterium avium subsp. paratuberculosis
gcgcccagguacuccucgg

SEQ ID NO: 974012 - RNA, 13 nt, Mycobacterium avium subsp. paratuberculosis
gcgcccaggucca

SEQ ID NO: 974013 - RNA, 20 nt, Mycobacterium avium subsp. paratuberculosis
gcgcccagcgucucggcggc

SEQ ID NO: 974014 - RNA, 17 nt, Mycobacterium avium subsp. paratuberculosis
gcgcccaggauucucag

SEQ ID NO: 974015 - RNA, 17 nt, Mycobacterium avium subsp. paratuberculosis
gcgcccagcgagcugcc

SEQ ID NO: 974016 - RNA, 20 nt, Mycobacterium avium subsp. paratuberculosis
gcgcccagcgagcugccggc

SEQ ID NO: 974017 - RNA, 23 nt, Mycobacterium avium subsp. paratuberculosis
gcgcccagcgagcugccggcggc

SEQ ID NO: 974018 - RNA, 13 nt, Mycobacterium avium subsp. paratuberculosis
gcgcccagcgagc

SEQ ID NO: 974019 - RNA, 13 nt, Mycobacterium avium subsp. paratuberculosis
gcgcccagcccca

SEQ ID NO: 974020 - RNA, 12 nt, Mycobacterium avium subsp. paratuberculosis
gcgcccagcccg

SEQ ID NO: 974021 - RNA, 16 nt, Mycobacterium avium subsp. paratuberculosis
gcgcccagccgagccg

SEQ ID NO: 974022 - RNA, 20 nt, Mycobacterium avium subsp. paratuberculosis
gcgcccagccgagccgggcc

SEQ ID NO: 974023 - RNA, 21 nt, Mycobacterium avium subsp. paratuberculosis
gcgcccagcaaacccagcacc

SEQ ID NO: 974024 - RNA, 13 nt, Mycobacterium avium subsp. paratuberculosis
gcgccccagcucc

SEQ ID NO: 974025 - RNA, 15 nt, Mycobacterium avium subsp. paratuberculosis
gcgcccgacauccag

SEQ ID NO: 974026 - RNA, 19 nt, Mycobacterium avium subsp. paratuberculosis
gcgcccgacgaugcggggc

SEQ ID NO: 974027 - RNA, 20 nt, Mycobacterium avium subsp. paratuberculosis
gcgcccgacgaugcggggcg

SEQ ID NO: 974028 - RNA, 21 nt, Mycobacterium avium subsp. paratuberculosis
gcgcccccgacaggcccaccc

SEQ ID NO: 974029 - RNA, 15 nt, Mycobacterium avium subsp. paratuberculosis
gcgccccgaaguucg

SEQ ID NO: 974030 - RNA, 14 nt, Mycobacterium avium subsp. paratuberculosis
gcgccccgagcagc

SEQ ID NO: 974031 - RNA, 24 nt, Mycobacterium avium subsp. paratuberculosis
gcgccccgcccugcuugaacagca

SEQ ID NO: 974032 - RNA, 20 nt, Mycobacterium avium subsp. paratuberculosis
gcgccccgccgggaucggcg

SEQ ID NO: 974033 - RNA, 14 nt, Mycobacterium avium subsp. paratuberculosis
gcgccccgcuggua

SEQ ID NO: 974034 - RNA, 13 nt, Mycobacterium avium subsp. paratuberculosis
gcgccccggcccg

SEQ ID NO: 974035 - RNA, 14 nt, Mycobacterium avium subsp. paratuberculosis
gcgccccggcgggc

SEQ ID NO: 974036 - RNA, 13 nt, Mycobacterium avium subsp. paratuberculosis
gcgccccgggcag

SEQ ID NO: 974037 - RNA, 18 nt, Mycobacterium avium subsp. paratuberculosis
gcgccccggucccgccgg

SEQ ID NO: 974038 - RNA, 13 nt, Mycobacterium avium subsp. paratuberculosis
gcgccccgguccg

SEQ ID NO: 974039 - RNA, 23 nt, Mycobacterium avium subsp. paratuberculosis
gcgccgaucacgaacagguccgc

SEQ ID NO: 974040 - RNA, 17 nt, Mycobacterium avium subsp. paratuberculosis
gcgccgaggcgcucggc

SEQ ID NO: 974041 - RNA, 19 nt, Mycobacterium avium subsp. paratuberculosis
gcgccgaggaacugcagcg

SEQ ID NO: 974042 - RNA, 14 nt, Mycobacterium avium subsp. paratuberculosis
gcgccgaggccagc

SEQ ID NO: 974043 - RNA, 15 nt, Mycobacterium avium subsp. paratuberculosis
gcgccgaggccagca

SEQ ID NO: 974044 - RNA, 16 nt, Mycobacterium avium subsp. paratuberculosis
gcgccgaggccagcac

SEQ ID NO: 974045 - RNA, 22 nt, Mycobacterium avium subsp. paratuberculosis
gcgccgaggucaccgcgggaau

SEQ ID NO: 974046 - RNA, 14 nt, Mycobacterium avium subsp. paratuberculosis
gcgccgaggugcug

SEQ ID NO: 974047 - RNA, 17 nt, Mycobacterium avium subsp. paratuberculosis
gcgccgaguccgggccg

SEQ ID NO: 974048 - RNA, 21 nt, Mycobacterium avium subsp. paratuberculosis
gcgccgaguccgggccgccgg

SEQ ID NO: 974049 - RNA, 18 nt, Mycobacterium avium subsp. paratuberculosis
gcgccgauguggccggcg

SEQ ID NO: 974050 - RNA, 21 nt, Mycobacterium avium subsp. paratuberculosis
gcgccgcaacggcucccaggc

SEQ ID NO: 974051 - RNA, 18 nt, Mycobacterium avium subsp. paratuberculosis
gcgccgauuccgucggug

SEQ ID NO: 974052 - RNA, 15 nt, Mycobacterium avium subsp. paratuberculosis
gcgccgcacagccgg

SEQ ID NO: 974053 - RNA, 17 nt, Mycobacterium avium subsp. paratuberculosis
gcgccgcacagccggcg

SEQ ID NO: 974054 - RNA, 20 nt, Mycobacterium avium subsp. paratuberculosis
gcgccgcacagccggcggcg

SEQ ID NO: 974055 - RNA, 21 nt, Mycobacterium avium subsp. paratuberculosis
gcgccgcacagccggcggcgg

SEQ ID NO: 974056 - RNA, 19 nt, Mycobacterium avium subsp. paratuberculosis
gcgccgaucugcucggcug

SEQ ID NO: 974057 - RNA, 19 nt, Mycobacterium avium subsp. paratuberculosis
gcgccgauggcgaagccca

SEQ ID NO: 974058 - RNA, 22 nt, Mycobacterium avium subsp. paratuberculosis
gcgccgauggcgaagcccaugc

SEQ ID NO: 974059 - RNA, 14 nt, Mycobacterium avium subsp. paratuberculosis
gcgccgccagcaac

SEQ ID NO: 974060 - RNA, 14 nt, Mycobacterium avium subsp. paratuberculosis
gcgccgccagccgc

SEQ ID NO: 974061 - RNA, 12 nt, Mycobacterium avium subsp. paratuberculosis
gcgccgccaccc

SEQ ID NO: 974062 - RNA, 15 nt, Mycobacterium avium subsp. paratuberculosis
gcgccgccaccccag

SEQ ID NO: 974063 - RNA, 17 nt, Mycobacterium avium subsp. paratuberculosis
gcgccgccaccccaggc

SEQ ID NO: 974064 - RNA, 15 nt, Mycobacterium avium subsp. paratuberculosis
gcgccgccacaccuc

SEQ ID NO: 974065 - RNA, 17 nt, Mycobacterium avium subsp. paratuberculosis
gcgccgcauuggcaccg

SEQ ID NO: 974066 - RNA, 19 nt, Mycobacterium avium subsp. paratuberculosis
gcgccgcaugaugcggcca

SEQ ID NO: 974067 - RNA, 20 nt, Mycobacterium avium subsp. paratuberculosis
gcgccgcaccaguuccugca

SEQ ID NO: 974068 - RNA, 20 nt, Mycobacterium avium subsp. paratuberculosis
gcgccgacuugaucgcggcg

SEQ ID NO: 974069 - RNA, 17 nt, Mycobacterium avium subsp. paratuberculosis
gcgccgacuuggugcca

SEQ ID NO: 974070 - RNA, 13 nt, Mycobacterium avium subsp. paratuberculosis
gcgccgagagcgc

SEQ ID NO: 974071 - RNA, 21 nt, Mycobacterium avium subsp. paratuberculosis
gcgccgacgggcccgcgccuu

SEQ ID NO: 974072 - RNA, 17 nt, Mycobacterium avium subsp. paratuberculosis
gcgccgagcagcuggga

SEQ ID NO: 974073 - RNA, 19 nt, Mycobacterium avium subsp. paratuberculosis
gcgccgagaucgcgguggc

SEQ ID NO: 974074 - RNA, 20 nt, Mycobacterium avium subsp. paratuberculosis
gcgccgagaucgcgguggcg

SEQ ID NO: 974075 - RNA, 15 nt, Mycobacterium avium subsp. paratuberculosis
gcgccgagcaaccgg

SEQ ID NO: 974076 - RNA, 22 nt, Mycobacterium avium subsp. paratuberculosis
gcgccgaccucgucggcggugc

SEQ ID NO: 974077 - RNA, 18 nt, Mycobacterium avium subsp. paratuberculosis
gcgccgaccuggucgccg

SEQ ID NO: 974078 - RNA, 21 nt, Mycobacterium avium subsp. paratuberculosis
gcgccgacgaucccggcgagc

SEQ ID NO: 974079 - RNA, 13 nt, Mycobacterium avium subsp. paratuberculosis
gcgccgacccgcc

SEQ ID NO: 974080 - RNA, 16 nt, Mycobacterium avium subsp. paratuberculosis
gcgccgacccccgccg

SEQ ID NO: 974081 - RNA, 22 nt, Mycobacterium avium subsp. paratuberculosis
gcgccgacagaugcggcaccag

SEQ ID NO: 974082 - RNA, 23 nt, Mycobacterium avium subsp. paratuberculosis
gcgccgaccacggccccagccgc

SEQ ID NO: 974083 - RNA, 14 nt, Mycobacterium avium subsp. paratuberculosis
gcgccgaccagcgc

SEQ ID NO: 974084 - RNA, 20 nt, Mycobacterium avium subsp. paratuberculosis
gcgccgaacgucgagcgcgg

SEQ ID NO: 974085 - RNA, 21 nt, Mycobacterium avium subsp. paratuberculosis
gcgccgaacgucgagcgcggc

SEQ ID NO: 974086 - RNA, 19 nt, Mycobacterium avium subsp. paratuberculosis
gcgccgaacucggcgccgc

SEQ ID NO: 974087 - RNA, 17 nt, Mycobacterium avium subsp. paratuberculosis
gcgccgaagauggccag

SEQ ID NO: 974088 - RNA, 18 nt, Mycobacterium avium subsp. paratuberculosis
gcgccgaagauggccagc

SEQ ID NO: 974089 - RNA, 20 nt, Mycobacterium avium subsp. paratuberculosis
gcgccgaagauggccagcgc

SEQ ID NO: 974090 - RNA, 19 nt, Mycobacterium avium subsp. paratuberculosis
gcgccgaagccgucgaccc

SEQ ID NO: 974091 - RNA, 22 nt, Mycobacterium avium subsp. paratuberculosis
gcgccgaacaccacgccgagca

SEQ ID NO: 974092 - RNA, 19 nt, Mycobacterium avium subsp. paratuberculosis
gcgccgaacaccugcggcg

SEQ ID NO: 974093 - RNA, 20 nt, Mycobacterium avium subsp. paratuberculosis
gcgccgaacaccugcggcgg

SEQ ID NO: 974094 - RNA, 20 nt, Mycobacterium avium subsp. paratuberculosis
gcgccgaacagaugccugcc

SEQ ID NO: 974095 - RNA, 20 nt, Mycobacterium avium subsp. paratuberculosis
gcgccgaaaaacgcgacggc

SEQ ID NO: 974096 - RNA, 16 nt, Mycobacterium avium subsp. paratuberculosis
gcgcccuucggcgccc

SEQ ID NO: 974097 - RNA, 19 nt, Mycobacterium avium subsp. paratuberculosis
gcgcccuucuucgcgggug

SEQ ID NO: 974098 - RNA, 20 nt, Mycobacterium avium subsp. paratuberculosis
gcgcccuugagcuucccggc

SEQ ID NO: 974099 - RNA, 22 nt, Mycobacterium avium subsp. paratuberculosis
gcgcccucgauaauggcggccg

SEQ ID NO: 974100 - RNA, 14 nt, Mycobacterium avium subsp. paratuberculosis
gcgcccugaggccc

SEQ ID NO: 974101 - RNA, 13 nt, Mycobacterium avium subsp. paratuberculosis
gcgcccugcaccc

SEQ ID NO: 974102 - RNA, 15 nt, Mycobacterium avium subsp. paratuberculosis
gcgcccugcgagccc

SEQ ID NO: 974103 - RNA, 21 nt, Mycobacterium avium subsp. paratuberculosis
gcgcccugcugggagcggccc

SEQ ID NO: 974104 - RNA, 19 nt, Mycobacterium avium subsp. paratuberculosis
gcgcccuggaucgcgccuu

SEQ ID NO: 974105 - RNA, 13 nt, Mycobacterium avium subsp. paratuberculosis
gcgccgccgagca

SEQ ID NO: 974106 - RNA, 16 nt, Mycobacterium avium subsp. paratuberculosis
gcgccgccgcccuggc

SEQ ID NO: 974107 - RNA, 19 nt, Mycobacterium avium subsp. paratuberculosis
gcgccgccgccgcccacgc

SEQ ID NO: 974108 - RNA, 18 nt, Mycobacterium avium subsp. paratuberculosis
gcgccgccgccagccagc

SEQ ID NO: 974109 - RNA, 12 nt, Mycobacterium avium subsp. paratuberculosis
gcgccgccgccc

SEQ ID NO: 974110 - RNA, 13 nt, Mycobacterium avium subsp. paratuberculosis
gcgccgccgcgca

SEQ ID NO: 974111 - RNA, 21 nt, Mycobacterium avium subsp. paratuberculosis
gcgccgccgcgucgccgccgg

SEQ ID NO: 974112 - RNA, 23 nt, Mycobacterium avium subsp. paratuberculosis
gcgccgccgcgucgugccgagcg

SEQ ID NO: 974113 - RNA, 14 nt, Mycobacterium avium subsp. paratuberculosis
gcgccgcccgggcg

SEQ ID NO: 974114 - RNA, 18 nt, Mycobacterium avium subsp. paratuberculosis
gcgccgcccguccagcgc

SEQ ID NO: 974115 - RNA, 15 nt, Mycobacterium avium subsp. paratuberculosis
gcgccgcccgggccc

SEQ ID NO: 974116 - RNA, 17 nt, Mycobacterium avium subsp. paratuberculosis
gcgccgcccaccagcac

SEQ ID NO: 974117 - RNA, 14 nt, Mycobacterium avium subsp. paratuberculosis
gcgccgcccgcagu

SEQ ID NO: 974118 - RNA, 13 nt, Mycobacterium avium subsp. paratuberculosis
gcgccgcccagcg

SEQ ID NO: 974119 - RNA, 19 nt, Mycobacterium avium subsp. paratuberculosis
gcgccgcccagcggccccg

SEQ ID NO: 974120 - RNA, 20 nt, Mycobacterium avium subsp. paratuberculosis
gcgccgccggucgcccccuc

SEQ ID NO: 974121 - RNA, 22 nt, Mycobacterium avium subsp. paratuberculosis
gcgccgccggucgcccccucgg

SEQ ID NO: 974122 - RNA, 14 nt, Mycobacterium avium subsp. paratuberculosis
gcgccgcgccgccu

SEQ ID NO: 974123 - RNA, 13 nt, Mycobacterium avium subsp. paratuberculosis
gcgccgcgccggc

SEQ ID NO: 974124 - RNA, 14 nt, Mycobacterium avium subsp. paratuberculosis
gcgccgcgcgcccu

SEQ ID NO: 974125 - RNA, 12 nt, Mycobacterium avium subsp. paratuberculosis
gcgccgcgcgcc

SEQ ID NO: 974126 - RNA, 18 nt, Mycobacterium avium subsp. paratuberculosis
gcgccgcgcagccagacc

SEQ ID NO: 974127 - RNA, 19 nt, Mycobacterium avium subsp. paratuberculosis
gcgccgcgaccccggaccg

SEQ ID NO: 974128 - RNA, 19 nt, Mycobacterium avium subsp. paratuberculosis
gcgccgcgagcgcagcagg

SEQ ID NO: 974129 - RNA, 21 nt, Mycobacterium avium subsp. paratuberculosis
gcgccgccuucuugcgcggcg

SEQ ID NO: 974130 - RNA, 19 nt, Mycobacterium avium subsp. paratuberculosis
gcgccgcucgucggccagc

SEQ ID NO: 974131 - RNA, 16 nt, Mycobacterium avium subsp. paratuberculosis
gcgccgcugcgggcca

SEQ ID NO: 974132 - RNA, 15 nt, Mycobacterium avium subsp. paratuberculosis
gcgccggaggccagc

SEQ ID NO: 974133 - RNA, 18 nt, Mycobacterium avium subsp. paratuberculosis
gcgccggaggccagcucg

SEQ ID NO: 974134 - RNA, 15 nt, Mycobacterium avium subsp. paratuberculosis
gcgccggaugccagc

SEQ ID NO: 974135 - RNA, 18 nt, Mycobacterium avium subsp. paratuberculosis
gcgccggaugccagcagg

SEQ ID NO: 974136 - RNA, 22 nt, Mycobacterium avium subsp. paratuberculosis
gcgccggaccgauccggcgccc

SEQ ID NO: 974137 - RNA, 17 nt, Mycobacterium avium subsp. paratuberculosis
gcgccggcauccagcac

SEQ ID NO: 974138 - RNA, 20 nt, Mycobacterium avium subsp. paratuberculosis
gcgccggauucggcgcggcu

SEQ ID NO: 974139 - RNA, 20 nt, Mycobacterium avium subsp. paratuberculosis
gcgccggcaacuggccgccc

SEQ ID NO: 974140 - RNA, 15 nt, Mycobacterium avium subsp. paratuberculosis
gcgccggcaccagca

SEQ ID NO: 974141 - RNA, 23 nt, Mycobacterium avium subsp. paratuberculosis
gcgccggcaccagcagccgcagc

SEQ ID NO: 974142 - RNA, 21 nt, Mycobacterium avium subsp. paratuberculosis
gcgccgcguucacccgcgccc

SEQ ID NO: 974143 - RNA, 14 nt, Mycobacterium avium subsp. paratuberculosis
gcgccgcucgaccc

SEQ ID NO: 974144 - RNA, 19 nt, Mycobacterium avium subsp. paratuberculosis
gcgccgcucgaccccucgg

SEQ ID NO: 974145 - RNA, 15 nt, Mycobacterium avium subsp. paratuberculosis
gcgccgcgggcgccg

SEQ ID NO: 974146 - RNA, 16 nt, Mycobacterium avium subsp. paratuberculosis
gcgccgcucggccagc

SEQ ID NO: 974147 - RNA, 19 nt, Mycobacterium avium subsp. paratuberculosis
gcgccgcucggccagcagc

SEQ ID NO: 974148 - RNA, 17 nt, Mycobacterium avium subsp. paratuberculosis
gcgccgcguaccagcgc

SEQ ID NO: 974149 - RNA, 18 nt, Mycobacterium avium subsp. paratuberculosis
gcgccgcguaccagcgcc

SEQ ID NO: 974150 - RNA, 12 nt, Mycobacterium avium subsp. paratuberculosis
gcgccgcggggc

SEQ ID NO: 974151 - RNA, 21 nt, Mycobacterium avium subsp. paratuberculosis
gcgccgcggcgccgccacggc

SEQ ID NO: 974152 - RNA, 13 nt, Mycobacterium avium subsp. paratuberculosis
gcgccgcggcggc

SEQ ID NO: 974153 - RNA, 19 nt, Mycobacterium avium subsp. paratuberculosis
gcgccgcggcggcacccag

SEQ ID NO: 974154 - RNA, 17 nt, Mycobacterium avium subsp. paratuberculosis
gcgccgcggcccugcag

SEQ ID NO: 974155 - RNA, 15 nt, Mycobacterium avium subsp. paratuberculosis
gcgccgcggccaccg

SEQ ID NO: 974156 - RNA, 20 nt, Mycobacterium avium subsp. paratuberculosis
gcgccgcggccaccgggucg

SEQ ID NO: 974157 - RNA, 14 nt, Mycobacterium avium subsp. paratuberculosis
gcgccgcggccagc

SEQ ID NO: 974158 - RNA, 12 nt, Mycobacterium avium subsp. paratuberculosis
gcgccgcggccc

SEQ ID NO: 974159 - RNA, 20 nt, Mycobacterium avium subsp. paratuberculosis
gcgccgcgcgcgcggccucc

SEQ ID NO: 974160 - RNA, 22 nt, Mycobacterium avium subsp. paratuberculosis
gcgccgcgcgcgcggccuccag

SEQ ID NO: 974161 - RNA, 16 nt, Mycobacterium avium subsp. paratuberculosis
gcgccgggaucggcag

SEQ ID NO: 974162 - RNA, 19 nt, Mycobacterium avium subsp. paratuberculosis
gcgccgggaucggcagcgc

SEQ ID NO: 974163 - RNA, 21 nt, Mycobacterium avium subsp. paratuberculosis
gcgccgggaucggcagcgcgc

SEQ ID NO: 974164 - RNA, 15 nt, Mycobacterium avium subsp. paratuberculosis
gcgccgggcagcccg

SEQ ID NO: 974165 - RNA, 23 nt, Mycobacterium avium subsp. paratuberculosis
gcgccgggcaacagcgcgccggc

SEQ ID NO: 974166 - RNA, 21 nt, Mycobacterium avium subsp. paratuberculosis
gcgccgggcgaagucgccggc

SEQ ID NO: 974167 - RNA, 13 nt, Mycobacterium avium subsp. paratuberculosis
gcgccgggcgccc

SEQ ID NO: 974168 - RNA, 14 nt, Mycobacterium avium subsp. paratuberculosis
gcgccgggcggccc

SEQ ID NO: 974169 - RNA, 21 nt, Mycobacterium avium subsp. paratuberculosis
gcgccgggcggcccgccucgg

SEQ ID NO: 974170 - RNA, 14 nt, Mycobacterium avium subsp. paratuberculosis
gcgccgggcggccu

SEQ ID NO: 974171 - RNA, 15 nt, Mycobacterium avium subsp. paratuberculosis
gcgccgggcggccuc

SEQ ID NO: 974172 - RNA, 16 nt, Mycobacterium avium subsp. paratuberculosis
gcgccgggcggccucg

SEQ ID NO: 974173 - RNA, 18 nt, Mycobacterium avium subsp. paratuberculosis
gcgccgggcggccucggc

SEQ ID NO: 974174 - RNA, 21 nt, Mycobacterium avium subsp. paratuberculosis
gcgccggcuccaccgcgccgg

SEQ ID NO: 974175 - RNA, 21 nt, Mycobacterium avium subsp. paratuberculosis
gcgccggcgguaugcccgggc

SEQ ID NO: 974176 - RNA, 22 nt, Mycobacterium avium subsp. paratuberculosis
gcgccggcgugucggcgccacc

SEQ ID NO: 974177 - RNA, 13 nt, Mycobacterium avium subsp. paratuberculosis
gcgccggcggcgg

SEQ ID NO: 974178 - RNA, 13 nt, Mycobacterium avium subsp. paratuberculosis
gcgccggcggccg

SEQ ID NO: 974179 - RNA, 12 nt, Mycobacterium avium subsp. paratuberculosis
gcgccggcggcc

SEQ ID NO: 974180 - RNA, 14 nt, Mycobacterium avium subsp. paratuberculosis
gcgccggcggccgc

SEQ ID NO: 974181 - RNA, 16 nt, Mycobacterium avium subsp. paratuberculosis
gcgccggcgcgggcau

SEQ ID NO: 974182 - RNA, 14 nt, Mycobacterium avium subsp. paratuberculosis
gcgccggcgcgucc

SEQ ID NO: 974183 - RNA, 18 nt, Mycobacterium avium subsp. paratuberculosis
gcgccggcgcguccggag

SEQ ID NO: 974184 - RNA, 17 nt, Mycobacterium avium subsp. paratuberculosis
gcgccggccagccggcu

SEQ ID NO: 974185 - RNA, 17 nt, Mycobacterium avium subsp. paratuberculosis
gcgccggccuuggcccg

SEQ ID NO: 974186 - RNA, 22 nt, Mycobacterium avium subsp. paratuberculosis
gcgccggcgauaggcggccagc

SEQ ID NO: 974187 - RNA, 13 nt, Mycobacterium avium subsp. paratuberculosis
gcgccggcgauga

SEQ ID NO: 974188 - RNA, 13 nt, Mycobacterium avium subsp. paratuberculosis
gcgccggcgcagc

SEQ ID NO: 974189 - RNA, 19 nt, Mycobacterium avium subsp. paratuberculosis
gcgccggcgcagcggcccg

SEQ ID NO: 974190 - RNA, 20 nt, Mycobacterium avium subsp. paratuberculosis
gcgccggcgcagcggcccga

SEQ ID NO: 974191 - RNA, 17 nt, Mycobacterium avium subsp. paratuberculosis
gcgccggccggagcgga

SEQ ID NO: 974192 - RNA, 13 nt, Mycobacterium avium subsp. paratuberculosis
gcgccggccgccg

SEQ ID NO: 974193 - RNA, 14 nt, Mycobacterium avium subsp. paratuberculosis
gcgccggccgccgg

SEQ ID NO: 974194 - RNA, 17 nt, Mycobacterium avium subsp. paratuberculosis
gcgccggcccgcggcgg

SEQ ID NO: 974195 - RNA, 22 nt, Mycobacterium avium subsp. paratuberculosis
gcgccggcccgauaggccgacu

SEQ ID NO: 974196 - RNA, 15 nt, Mycobacterium avium subsp. paratuberculosis
gcgccggccagcggc

SEQ ID NO: 974197 - RNA, 15 nt, Mycobacterium avium subsp. paratuberculosis
gcgccggccagcacc

SEQ ID NO: 974198 - RNA, 23 nt, Mycobacterium avium subsp. paratuberculosis
gcgccggccagcacggcggcgug

SEQ ID NO: 974199 - RNA, 16 nt, Mycobacterium avium subsp. paratuberculosis
gcgccggccagcagca

SEQ ID NO: 974200 - RNA, 18 nt, Mycobacterium avium subsp. paratuberculosis
gcgccggccagcagcagg

SEQ ID NO: 974201 - RNA, 13 nt, Mycobacterium avium subsp. paratuberculosis
gcgccggccagcc

SEQ ID NO: 974202 - RNA, 17 nt, Mycobacterium avium subsp. paratuberculosis
gcgccggcacugcugcc

SEQ ID NO: 974203 - RNA, 21 nt, Mycobacterium avium subsp. paratuberculosis
gcgccggcagcgccucccgga

SEQ ID NO: 974204 - RNA, 16 nt, Mycobacterium avium subsp. paratuberculosis
gcgccgucaucgacac

SEQ ID NO: 974205 - RNA, 16 nt, Mycobacterium avium subsp. paratuberculosis
gcgccguaggccgcgc

SEQ ID NO: 974206 - RNA, 17 nt, Mycobacterium avium subsp. paratuberculosis
gcgccgguuuccaggac

SEQ ID NO: 974207 - RNA, 16 nt, Mycobacterium avium subsp. paratuberculosis
gcgccgucgccgccgu

SEQ ID NO: 974208 - RNA, 16 nt, Mycobacterium avium subsp. paratuberculosis
gcgccgucccagccgg

SEQ ID NO: 974209 - RNA, 14 nt, Mycobacterium avium subsp. paratuberculosis
gcgccgucgaacac

SEQ ID NO: 974210 - RNA, 22 nt, Mycobacterium avium subsp. paratuberculosis
gcgccgucuccucgaccagcgc

SEQ ID NO: 974211 - RNA, 21 nt, Mycobacterium avium subsp. paratuberculosis
gcgccgucucgacccgggcca

SEQ ID NO: 974212 - RNA, 23 nt, Mycobacterium avium subsp. paratuberculosis
gcgccgucggugggggccaggcg

SEQ ID NO: 974213 - RNA, 19 nt, Mycobacterium avium subsp. paratuberculosis
gcgccgucgauggcgcggc

SEQ ID NO: 974214 - RNA, 20 nt, Mycobacterium avium subsp. paratuberculosis
gcgccgucgauggcgcggcc

SEQ ID NO: 974215 - RNA, 16 nt, Mycobacterium avium subsp. paratuberculosis
gcgccguccgcggcgg

SEQ ID NO: 974216 - RNA, 19 nt, Mycobacterium avium subsp. paratuberculosis
gcgccguccgcggcggcca

SEQ ID NO: 974217 - RNA, 20 nt, Mycobacterium avium subsp. paratuberculosis
gcgccguccgcggcggccag

SEQ ID NO: 974218 - RNA, 13 nt, Mycobacterium avium subsp. paratuberculosis
gcgccguccagcu

SEQ ID NO: 974219 - RNA, 15 nt, Mycobacterium avium subsp. paratuberculosis
gcgccggucccgcgg

SEQ ID NO: 974220 - RNA, 19 nt, Mycobacterium avium subsp. paratuberculosis
gcgccggugccgcagccgu

SEQ ID NO: 974221 - RNA, 21 nt, Mycobacterium avium subsp. paratuberculosis
gcgccgguguucggcgccagc

SEQ ID NO: 974222 - RNA, 17 nt, Mycobacterium avium subsp. paratuberculosis
gcgccggguccagccgc

SEQ ID NO: 974223 - RNA, 19 nt, Mycobacterium avium subsp. paratuberculosis
gcgccggguggccggggcc

SEQ ID NO: 974224 - RNA, 19 nt, Mycobacterium avium subsp. paratuberculosis
gcgccgggguccucucggc

SEQ ID NO: 974225 - RNA, 21 nt, Mycobacterium avium subsp. paratuberculosis
gcgccgguaaugggcgaucga

SEQ ID NO: 974226 - RNA, 15 nt, Mycobacterium avium subsp. paratuberculosis
gcgccgguaggccgc

SEQ ID NO: 974227 - RNA, 19 nt, Mycobacterium avium subsp. paratuberculosis
gcgccgguaggccgcgccg

SEQ ID NO: 974228 - RNA, 19 nt, Mycobacterium avium subsp. paratuberculosis
gcgccgguaggcggccagc

SEQ ID NO: 974229 - RNA, 21 nt, Mycobacterium avium subsp. paratuberculosis
gcgccgguaggcggccagcgc

SEQ ID NO: 974230 - RNA, 14 nt, Mycobacterium avium subsp. paratuberculosis
gcgccggggcgggc

SEQ ID NO: 974231 - RNA, 17 nt, Mycobacterium avium subsp. paratuberculosis
gcgccggggcgggcggc

SEQ ID NO: 974232 - RNA, 22 nt, Mycobacterium avium subsp. paratuberculosis
gcgccggggcgggcggcggcug

SEQ ID NO: 974233 - RNA, 12 nt, Mycobacterium avium subsp. paratuberculosis
gcgccggggccg

SEQ ID NO: 974234 - RNA, 16 nt, Mycobacterium avium subsp. paratuberculosis
gcgccggggccgcggc

SEQ ID NO: 974235 - RNA, 19 nt, Mycobacterium avium subsp. paratuberculosis
gcgccugcaccggcgacgg

SEQ ID NO: 974236 - RNA, 20 nt, Mycobacterium avium subsp. paratuberculosis
gcgccugcaccggcgacggc

SEQ ID NO: 974237 - RNA, 16 nt, Mycobacterium avium subsp. paratuberculosis
gcgccugcacgcaggc

SEQ ID NO: 974238 - RNA, 13 nt, Mycobacterium avium subsp. paratuberculosis
gcgccugccuggc

SEQ ID NO: 974239 - RNA, 18 nt, Mycobacterium avium subsp. paratuberculosis
gcgccugcgcggcggcgu

SEQ ID NO: 974240 - RNA, 16 nt, Mycobacterium avium subsp. paratuberculosis
gcgccuggcgcagggc

SEQ ID NO: 974241 - RNA, 16 nt, Mycobacterium avium subsp. paratuberculosis
gcgccugcugccagga

SEQ ID NO: 974242 - RNA, 14 nt, Mycobacterium avium subsp. paratuberculosis
gcgccguugguggu

SEQ ID NO: 974243 - RNA, 17 nt, Mycobacterium avium subsp. paratuberculosis
gcgccguuguaggccgc

SEQ ID NO: 974244 - RNA, 17 nt, Mycobacterium avium subsp. paratuberculosis
gcgccguugaccggccg

SEQ ID NO: 974245 - RNA, 21 nt, Mycobacterium avium subsp. paratuberculosis
gcgccguugaccggccggucg

SEQ ID NO: 974246 - RNA, 22 nt, Mycobacterium avium subsp. paratuberculosis
gcgccuaccggguggccagcac

SEQ ID NO: 974247 - RNA, 23 nt, Mycobacterium avium subsp. paratuberculosis
gcgccuaccggguggccagcacc

SEQ ID NO: 974248 - RNA, 15 nt, Mycobacterium avium subsp. paratuberculosis
gcgccguggcccaug

SEQ ID NO: 974249 - RNA, 14 nt, Mycobacterium avium subsp. paratuberculosis
gcgccgugaagggc

SEQ ID NO: 974250 - RNA, 14 nt, Mycobacterium avium subsp. paratuberculosis
gcgccgugccgcgc

SEQ ID NO: 974251 - RNA, 15 nt, Mycobacterium avium subsp. paratuberculosis
gcgccgugccgcgcg

SEQ ID NO: 974252 - RNA, 17 nt, Mycobacterium avium subsp. paratuberculosis
gcgccgugccgcgcggc

SEQ ID NO: 974253 - RNA, 18 nt, Mycobacterium avium subsp. paratuberculosis
gcgccgugcagcacgccg

SEQ ID NO: 974254 - RNA, 19 nt, Mycobacterium avium subsp. paratuberculosis
gcgccgugcagcacgccgc

SEQ ID NO: 974255 - RNA, 19 nt, Mycobacterium avium subsp. paratuberculosis
gcgccgugcccaacacgcc

SEQ ID NO: 974256 - RNA, 13 nt, Mycobacterium avium subsp. paratuberculosis
gcgccuccgcccg

SEQ ID NO: 974257 - RNA, 19 nt, Mycobacterium avium subsp. paratuberculosis
gcgccucgugcaugugcuc

SEQ ID NO: 974258 - RNA, 22 nt, Mycobacterium avium subsp. paratuberculosis
gcgccucggcgggccgcccggc

SEQ ID NO: 974259 - RNA, 12 nt, Mycobacterium avium subsp. paratuberculosis
gcgccucggccu

SEQ ID NO: 974260 - RNA, 16 nt, Mycobacterium avium subsp. paratuberculosis
gcgccucgccgggccc

SEQ ID NO: 974261 - RNA, 19 nt, Mycobacterium avium subsp. paratuberculosis
gcgccucgccgggcccgcu

SEQ ID NO: 974262 - RNA, 19 nt, Mycobacterium avium subsp. paratuberculosis
gcgccucgaacaucggcac

SEQ ID NO: 974263 - RNA, 19 nt, Mycobacterium avium subsp. paratuberculosis
gcgccucgagcaccacggc

SEQ ID NO: 974264 - RNA, 20 nt, Mycobacterium avium subsp. paratuberculosis
gcgccucgagcaccacggcc

SEQ ID NO: 974265 - RNA, 14 nt, Mycobacterium avium subsp. paratuberculosis
gcgccucgccgacc

SEQ ID NO: 974266 - RNA, 16 nt, Mycobacterium avium subsp. paratuberculosis
gcgccucgccgaccuu

SEQ ID NO: 974267 - RNA, 12 nt, Mycobacterium avium subsp. paratuberculosis
gcgccucgccgg

SEQ ID NO: 974268 - RNA, 16 nt, Mycobacterium avium subsp. paratuberculosis
gcgcggcauggcuggc

SEQ ID NO: 974269 - RNA, 20 nt, Mycobacterium avium subsp. paratuberculosis
gcgcggcaugccgcccgggc

SEQ ID NO: 974270 - RNA, 21 nt, Mycobacterium avium subsp. paratuberculosis
gcgcggcaugccgcccgggcc

SEQ ID NO: 974271 - RNA, 18 nt, Mycobacterium avium subsp. paratuberculosis
gcgcggcagggccaggcc

SEQ ID NO: 974272 - RNA, 14 nt, Mycobacterium avium subsp. paratuberculosis
gcgcggccaccagc

SEQ ID NO: 974273 - RNA, 15 nt, Mycobacterium avium subsp. paratuberculosis
gcgcggccaccagcg

SEQ ID NO: 974274 - RNA, 21 nt, Mycobacterium avium subsp. paratuberculosis
gcgcggccaccgcgcgcugcc

SEQ ID NO: 974275 - RNA, 20 nt, Mycobacterium avium subsp. paratuberculosis
gcgcggccaccuccagcccg

SEQ ID NO: 974276 - RNA, 23 nt, Mycobacterium avium subsp. paratuberculosis
gcgcggccaccuccagcccggaa

SEQ ID NO: 974277 - RNA, 14 nt, Mycobacterium avium subsp. paratuberculosis
gcgcggccugcagc

SEQ ID NO: 974278 - RNA, 14 nt, Mycobacterium avium subsp. paratuberculosis
gcgcggcgacggcg

SEQ ID NO: 974279 - RNA, 18 nt, Mycobacterium avium subsp. paratuberculosis
gcgcggcgacgguggcgg

SEQ ID NO: 974280 - RNA, 14 nt, Mycobacterium avium subsp. paratuberculosis
gcgcggcgacguga

SEQ ID NO: 974281 - RNA, 12 nt, Mycobacterium avium subsp. paratuberculosis
gcgcggcgcccc

SEQ ID NO: 974282 - RNA, 13 nt, Mycobacterium avium subsp. paratuberculosis
gcgcggcgcgcga

SEQ ID NO: 974283 - RNA, 21 nt, Mycobacterium avium subsp. paratuberculosis
gcgcggcgcgaggcgcggggc

SEQ ID NO: 974284 - RNA, 20 nt, Mycobacterium avium subsp. paratuberculosis
gcgcggcgaucucggcggcc

SEQ ID NO: 974285 - RNA, 14 nt, Mycobacterium avium subsp. paratuberculosis
gcgcggcgcaccgc

SEQ ID NO: 974286 - RNA, 15 nt, Mycobacterium avium subsp. paratuberculosis
gcgcggcgcaccgcc

SEQ ID NO: 974287 - RNA, 21 nt, Mycobacterium avium subsp. paratuberculosis
gcgcggcgaucagcagcaccc

SEQ ID NO: 974288 - RNA, 17 nt, Mycobacterium avium subsp. paratuberculosis
gcgcggaaacuccuggc

SEQ ID NO: 974289 - RNA, 14 nt, Mycobacterium avium subsp. paratuberculosis
gcgcggcacgggcc

SEQ ID NO: 974290 - RNA, 17 nt, Mycobacterium avium subsp. paratuberculosis
gcgcggcaccaccagcg

SEQ ID NO: 974291 - RNA, 23 nt, Mycobacterium avium subsp. paratuberculosis
gcgcgcuggugcgggccagcacg

SEQ ID NO: 974292 - RNA, 18 nt, Mycobacterium avium subsp. paratuberculosis
gcgcgcuggugcugccga

SEQ ID NO: 974293 - RNA, 22 nt, Mycobacterium avium subsp. paratuberculosis
gcgcgcgccgcccccgcggcgu

SEQ ID NO: 974294 - RNA, 14 nt, Mycobacterium avium subsp. paratuberculosis
gcgcgcgccccagc

SEQ ID NO: 974295 - RNA, 15 nt, Mycobacterium avium subsp. paratuberculosis
gcgcgcgccgcagcg

SEQ ID NO: 974296 - RNA, 14 nt, Mycobacterium avium subsp. paratuberculosis
gcgcgcgagcguca

SEQ ID NO: 974297 - RNA, 19 nt, Mycobacterium avium subsp. paratuberculosis
gcgcgcgaucgccggugcg

SEQ ID NO: 974298 - RNA, 23 nt, Mycobacterium avium subsp. paratuberculosis
gcgcgcgaucgccggugcggccg

SEQ ID NO: 974299 - RNA, 23 nt, Mycobacterium avium subsp. paratuberculosis
gcgcgcugccgcgccccgagcag

SEQ ID NO: 974300 - RNA, 15 nt, Mycobacterium avium subsp. paratuberculosis
gcgcgcugcggcguc

SEQ ID NO: 974301 - RNA, 13 nt, Mycobacterium avium subsp. paratuberculosis
gcgcgcucggugc

SEQ ID NO: 974302 - RNA, 20 nt, Mycobacterium avium subsp. paratuberculosis
gcgcgcgaacagguccuugc

SEQ ID NO: 974303 - RNA, 23 nt, Mycobacterium avium subsp. paratuberculosis
gcgcgccgggaucacacgcgcgc

SEQ ID NO: 974304 - RNA, 18 nt, Mycobacterium avium subsp. paratuberculosis
gcgcgccgggcagcccgc

SEQ ID NO: 974305 - RNA, 18 nt, Mycobacterium avium subsp. paratuberculosis
gcgcgccggcgcagcggc

SEQ ID NO: 974306 - RNA, 20 nt, Mycobacterium avium subsp. paratuberculosis
gcgcgccggcgcagcggccc

SEQ ID NO: 974307 - RNA, 13 nt, Mycobacterium avium subsp. paratuberculosis
gcgcgccggccgg

SEQ ID NO: 974308 - RNA, 14 nt, Mycobacterium avium subsp. paratuberculosis
gcgcgccggccagc

SEQ ID NO: 974309 - RNA, 19 nt, Mycobacterium avium subsp. paratuberculosis
gcgcgccggccagcacggc

SEQ ID NO: 974310 - RNA, 14 nt, Mycobacterium avium subsp. paratuberculosis
gcgcgccgcccagc

SEQ ID NO: 974311 - RNA, 15 nt, Mycobacterium avium subsp. paratuberculosis
gcgcgccgcccccgc

SEQ ID NO: 974312 - RNA, 13 nt, Mycobacterium avium subsp. paratuberculosis
gcgcgccgcagga

SEQ ID NO: 974313 - RNA, 13 nt, Mycobacterium avium subsp. paratuberculosis
gcgcgccagcagc

SEQ ID NO: 974314 - RNA, 14 nt, Mycobacterium avium subsp. paratuberculosis
gcgcgccagcagcg

SEQ ID NO: 974315 - RNA, 19 nt, Mycobacterium avium subsp. paratuberculosis
gcgcgacaucaccgcgggc

SEQ ID NO: 974316 - RNA, 19 nt, Mycobacterium avium subsp. paratuberculosis
gcgcgaccaguaccgggcc

SEQ ID NO: 974317 - RNA, 15 nt, Mycobacterium avium subsp. paratuberculosis
gcgcgaaacccccgg

SEQ ID NO: 974318 - RNA, 22 nt, Mycobacterium avium subsp. paratuberculosis
gcgcgaaagcagcaacggcggc

SEQ ID NO: 974319 - RNA, 16 nt, Mycobacterium avium subsp. paratuberculosis
gcgcgaaaaccagcac

SEQ ID NO: 974320 - RNA, 17 nt, Mycobacterium avium subsp. paratuberculosis
gcgcgaaaaccagcacc

SEQ ID NO: 974321 - RNA, 18 nt, Mycobacterium avium subsp. paratuberculosis
gcgcgaacagcgcggcca

SEQ ID NO: 974322 - RNA, 21 nt, Mycobacterium avium subsp. paratuberculosis
gcgccuucuugcugcccgcgg

SEQ ID NO: 974323 - RNA, 24 nt, Mycobacterium avium subsp. paratuberculosis
gcgccuucuugcugcccgcggccg

SEQ ID NO: 974324 - RNA, 19 nt, Mycobacterium avium subsp. paratuberculosis
gcgccuucuuggcggcggu

SEQ ID NO: 974325 - RNA, 19 nt, Mycobacterium avium subsp. paratuberculosis
gcgccuugccgucgagcag

SEQ ID NO: 974326 - RNA, 18 nt, Mycobacterium avium subsp. paratuberculosis
gcgcgaugcgggcgccga

SEQ ID NO: 974327 - RNA, 17 nt, Mycobacterium avium subsp. paratuberculosis
gcgcgauggacagcagc

SEQ ID NO: 974328 - RNA, 15 nt, Mycobacterium avium subsp. paratuberculosis
gcgcgaucggccgcu

SEQ ID NO: 974329 - RNA, 22 nt, Mycobacterium avium subsp. paratuberculosis
gcgcgaucggccgcugcccggg

SEQ ID NO: 974330 - RNA, 21 nt, Mycobacterium avium subsp. paratuberculosis
gcgcgaucgguguccagccgc

SEQ ID NO: 974331 - RNA, 22 nt, Mycobacterium avium subsp. paratuberculosis
gcgcgaucgguguccagccgca

SEQ ID NO: 974332 - RNA, 14 nt, Mycobacterium avium subsp. paratuberculosis
gcgcgaucuccuug

SEQ ID NO: 974333 - RNA, 23 nt, Mycobacterium avium subsp. paratuberculosis
gcgcgacgaacagcaccgccacg

SEQ ID NO: 974334 - RNA, 13 nt, Mycobacterium avium subsp. paratuberculosis
gcgcgacgcacgc

SEQ ID NO: 974335 - RNA, 18 nt, Mycobacterium avium subsp. paratuberculosis
gcgcgacgcacgccggcg

SEQ ID NO: 974336 - RNA, 15 nt, Mycobacterium avium subsp. paratuberculosis
gcgcgacgggcaccc

SEQ ID NO: 974337 - RNA, 15 nt, Mycobacterium avium subsp. paratuberculosis
gcgcgacgggcugcu

SEQ ID NO: 974338 - RNA, 21 nt, Mycobacterium avium subsp. paratuberculosis
gcgcgcaguugcgcggcgggc

SEQ ID NO: 974339 - RNA, 20 nt, Mycobacterium avium subsp. paratuberculosis
gcgcgcaucgucgcggcgcu

SEQ ID NO: 974340 - RNA, 23 nt, Mycobacterium avium subsp. paratuberculosis
gcgcgcaucucgaaugcggcugc

SEQ ID NO: 974341 - RNA, 23 nt, Mycobacterium avium subsp. paratuberculosis
gcggcucagcaacccgccgagcg

SEQ ID NO: 974342 - RNA, 19 nt, Mycobacterium avium subsp. paratuberculosis
gcggcucacagcgcggcgg

SEQ ID NO: 974343 - RNA, 15 nt, Mycobacterium avium subsp. paratuberculosis
gcggcuccagcagcg

SEQ ID NO: 974344 - RNA, 15 nt, Mycobacterium avium subsp. paratuberculosis
gcggcguugcgggug

SEQ ID NO: 974345 - RNA, 17 nt, Mycobacterium avium subsp. paratuberculosis
gcggcguuggccgccgc

SEQ ID NO: 974346 - RNA, 20 nt, Mycobacterium avium subsp. paratuberculosis
gcggcuaauucagcugcgga

SEQ ID NO: 974347 - RNA, 15 nt, Mycobacterium avium subsp. paratuberculosis
gcggcuaagccggcg

SEQ ID NO: 974348 - RNA, 17 nt, Mycobacterium avium subsp. paratuberculosis
gcggcguucagccggag

SEQ ID NO: 974349 - RNA, 20 nt, Mycobacterium avium subsp. paratuberculosis
gcggcguucagccggagccg

SEQ ID NO: 974350 - RNA, 17 nt, Mycobacterium avium subsp. paratuberculosis
gcggcguucuccagcac

SEQ ID NO: 974351 - RNA, 18 nt, Mycobacterium avium subsp. paratuberculosis
gcggcguucuccagcacc

SEQ ID NO: 974352 - RNA, 22 nt, Mycobacterium avium subsp. paratuberculosis
gcggcguaggugggcagcgcgg

SEQ ID NO: 974353 - RNA, 19 nt, Mycobacterium avium subsp. paratuberculosis
gcggcguacugcgcgagcu

SEQ ID NO: 974354 - RNA, 20 nt, Mycobacterium avium subsp. paratuberculosis
gcggcguacugcgcgagcuc

SEQ ID NO: 974355 - RNA, 23 nt, Mycobacterium avium subsp. paratuberculosis
gcggcgucgggauggucgaucca

SEQ ID NO: 974356 - RNA, 13 nt, Mycobacterium avium subsp. paratuberculosis
gcggcgucgggcg

SEQ ID NO: 974357 - RNA, 16 nt, Mycobacterium avium subsp. paratuberculosis
gcggcguccgcggccg

SEQ ID NO: 974358 - RNA, 19 nt, Mycobacterium avium subsp. paratuberculosis
gcggcgugggguucccggc

SEQ ID NO: 974359 - RNA, 22 nt, Mycobacterium avium subsp. paratuberculosis
gcggcgugguagccgccguucu

SEQ ID NO: 974360 - RNA, 15 nt, Mycobacterium avium subsp. paratuberculosis
gcggcgugccagggc

SEQ ID NO: 974361 - RNA, 19 nt, Mycobacterium avium subsp. paratuberculosis
gcggcgugccagggcagcg

SEQ ID NO: 974362 - RNA, 18 nt, Mycobacterium avium subsp. paratuberculosis
gcggcgugcccgcucgcu

SEQ ID NO: 974363 - RNA, 17 nt, Mycobacterium avium subsp. paratuberculosis
gcggcgucgggcgggug

SEQ ID NO: 974364 - RNA, 17 nt, Mycobacterium avium subsp. paratuberculosis
gcggcgucggguagggc

SEQ ID NO: 974365 - RNA, 22 nt, Mycobacterium avium subsp. paratuberculosis
gcggcgucguaguugcggccgg

SEQ ID NO: 974366 - RNA, 20 nt, Mycobacterium avium subsp. paratuberculosis
gcggcgucgucgccguggcg

SEQ ID NO: 974367 - RNA, 19 nt, Mycobacterium avium subsp. paratuberculosis
gcggcggucacgcccgggu

SEQ ID NO: 974368 - RNA, 15 nt, Mycobacterium avium subsp. paratuberculosis
gcggcggucgcgcgc

SEQ ID NO: 974369 - RNA, 16 nt, Mycobacterium avium subsp. paratuberculosis
gcggcggucgcgcgcc

SEQ ID NO: 974370 - RNA, 12 nt, Mycobacterium avium subsp. paratuberculosis
gcggcggucggc

SEQ ID NO: 974371 - RNA, 22 nt, Mycobacterium avium subsp. paratuberculosis
gcggcggucggcauagcgccgc

SEQ ID NO: 974372 - RNA, 23 nt, Mycobacterium avium subsp. paratuberculosis
gcggcggucggcauagcgccgcu

SEQ ID NO: 974373 - RNA, 16 nt, Mycobacterium avium subsp. paratuberculosis
gcggcggugccgcagg

SEQ ID NO: 974374 - RNA, 17 nt, Mycobacterium avium subsp. paratuberculosis
gcggcggugcgcagccg

SEQ ID NO: 974375 - RNA, 15 nt, Mycobacterium avium subsp. paratuberculosis
gcggcggucuucuug

SEQ ID NO: 974376 - RNA, 22 nt, Mycobacterium avium subsp. paratuberculosis
gcggcggucuucuuggccgcgc

SEQ ID NO: 974377 - RNA, 16 nt, Mycobacterium avium subsp. paratuberculosis
gcggcggugagcgcgu

SEQ ID NO: 974378 - RNA, 17 nt, Mycobacterium avium subsp. paratuberculosis
gcggcgguccagcgagc

SEQ ID NO: 974379 - RNA, 15 nt, Mycobacterium avium subsp. paratuberculosis
gcggcgguccguucg

SEQ ID NO: 974380 - RNA, 23 nt, Mycobacterium avium subsp. paratuberculosis
gcggcgguuucuuugaucucauc

SEQ ID NO: 974381 - RNA, 18 nt, Mycobacterium avium subsp. paratuberculosis
gcggcggugcgucgggcg

SEQ ID NO: 974382 - RNA, 19 nt, Mycobacterium avium subsp. paratuberculosis
gcggcggugcucgcgccgg

SEQ ID NO: 974383 - RNA, 14 nt, Mycobacterium avium subsp. paratuberculosis
gcggcgguggccug

SEQ ID NO: 974384 - RNA, 17 nt, Mycobacterium avium subsp. paratuberculosis
gcggcggugggcugggc

SEQ ID NO: 974385 - RNA, 22 nt, Mycobacterium avium subsp. paratuberculosis
gcggcggugggcugggcgaagc

SEQ ID NO: 974386 - RNA, 21 nt, Mycobacterium avium subsp. paratuberculosis
gcggcggcguuggccgccgcc

SEQ ID NO: 974387 - RNA, 22 nt, Mycobacterium avium subsp. paratuberculosis
gcggcggcgucgaccgccccgc

SEQ ID NO: 974388 - RNA, 13 nt, Mycobacterium avium subsp. paratuberculosis
gcggcggcugccu

SEQ ID NO: 974389 - RNA, 13 nt, Mycobacterium avium subsp. paratuberculosis
gcggcggcggccg

SEQ ID NO: 974390 - RNA, 16 nt, Mycobacterium avium subsp. paratuberculosis
gcggcggcgcgccggc

SEQ ID NO: 974391 - RNA, 21 nt, Mycobacterium avium subsp. paratuberculosis
gcggcggcgcgugcgccgcgg

SEQ ID NO: 974392 - RNA, 16 nt, Mycobacterium avium subsp. paratuberculosis
gcggcggcgccgcagc

SEQ ID NO: 974393 - RNA, 15 nt, Mycobacterium avium subsp. paratuberculosis
gcggcggcgccgcgg

SEQ ID NO: 974394 - RNA, 17 nt, Mycobacterium avium subsp. paratuberculosis
gcggcgggggcgggccc

SEQ ID NO: 974395 - RNA, 15 nt, Mycobacterium avium subsp. paratuberculosis
gcggcgggcccggcg

SEQ ID NO: 974396 - RNA, 14 nt, Mycobacterium avium subsp. paratuberculosis
gcggcgggccgcaa

SEQ ID NO: 974397 - RNA, 14 nt, Mycobacterium avium subsp. paratuberculosis
gcggcgggaaacca

SEQ ID NO: 974398 - RNA, 23 nt, Mycobacterium avium subsp. paratuberculosis
gcggcgggaaaccaccugccgca

SEQ ID NO: 974399 - RNA, 22 nt, Mycobacterium avium subsp. paratuberculosis
gcggcgggagcuaggcggccgg

SEQ ID NO: 974400 - RNA, 14 nt, Mycobacterium avium subsp. paratuberculosis
gcggcggccaccuc

SEQ ID NO: 974401 - RNA, 15 nt, Mycobacterium avium subsp. paratuberculosis
gcggcggccaccucg

SEQ ID NO: 974402 - RNA, 17 nt, Mycobacterium avium subsp. paratuberculosis
gcggcggccaccucgcc

SEQ ID NO: 974403 - RNA, 22 nt, Mycobacterium avium subsp. paratuberculosis
gcggcggacgauguccgccggc

SEQ ID NO: 974404 - RNA, 13 nt, Mycobacterium avium subsp. paratuberculosis
gcggcggaggccu

SEQ ID NO: 974405 - RNA, 14 nt, Mycobacterium avium subsp. paratuberculosis
gcggcggaggccug

SEQ ID NO: 974406 - RNA, 16 nt, Mycobacterium avium subsp. paratuberculosis
gcggcggauccagcac

SEQ ID NO: 974407 - RNA, 21 nt, Mycobacterium avium subsp. paratuberculosis
gcggcggcaaccagcuccggc

SEQ ID NO: 974408 - RNA, 22 nt, Mycobacterium avium subsp. paratuberculosis
gcggcggccugcuugaccgcca

SEQ ID NO: 974409 - RNA, 15 nt, Mycobacterium avium subsp. paratuberculosis
gcggcggccgcagcg

SEQ ID NO: 974410 - RNA, 13 nt, Mycobacterium avium subsp. paratuberculosis
gcggcggccggcc

SEQ ID NO: 974411 - RNA, 16 nt, Mycobacterium avium subsp. paratuberculosis
gcggcggccggcgccg

SEQ ID NO: 974412 - RNA, 12 nt, Mycobacterium avium subsp. paratuberculosis
gcggcggccagg

SEQ ID NO: 974413 - RNA, 21 nt, Mycobacterium avium subsp. paratuberculosis
gcggcggcccgccgcgcccgg

SEQ ID NO: 974414 - RNA, 23 nt, Mycobacterium avium subsp. paratuberculosis
gcggcggcccgccgcgcccggcu

SEQ ID NO: 974415 - RNA, 20 nt, Mycobacterium avium subsp. paratuberculosis
gcggcggccgacagcgcguc

SEQ ID NO: 974416 - RNA, 16 nt, Mycobacterium avium subsp. paratuberculosis
gcggcggccgacgcgc

SEQ ID NO: 974417 - RNA, 16 nt, Mycobacterium avium subsp. paratuberculosis
gcggcgcggcccggcc

SEQ ID NO: 974418 - RNA, 15 nt, Mycobacterium avium subsp. paratuberculosis
gcggcgcgggcggcg

SEQ ID NO: 974419 - RNA, 16 nt, Mycobacterium avium subsp. paratuberculosis
gcggcgcgggcggcgu

SEQ ID NO: 974420 - RNA, 16 nt, Mycobacterium avium subsp. paratuberculosis
gcggcgcgggcgcccu

SEQ ID NO: 974421 - RNA, 18 nt, Mycobacterium avium subsp. paratuberculosis
gcggcgcgugcgccgcgg

SEQ ID NO: 974422 - RNA, 22 nt, Mycobacterium avium subsp. paratuberculosis
gcggcgcgucgcugggcagccg

SEQ ID NO: 974423 - RNA, 19 nt, Mycobacterium avium subsp. paratuberculosis
gcggcgcgggucgcuggcc

SEQ ID NO: 974424 - RNA, 15 nt, Mycobacterium avium subsp. paratuberculosis
gcggcgcuggucggc

SEQ ID NO: 974425 - RNA, 16 nt, Mycobacterium avium subsp. paratuberculosis
gcggcgcugccgccgg

SEQ ID NO: 974426 - RNA, 14 nt, Mycobacterium avium subsp. paratuberculosis
gcggcgcugccggc

SEQ ID NO: 974427 - RNA, 16 nt, Mycobacterium avium subsp. paratuberculosis
gcggcgcucggugugc

SEQ ID NO: 974428 - RNA, 18 nt, Mycobacterium avium subsp. paratuberculosis
gcggcgcucagcgcggcg

SEQ ID NO: 974429 - RNA, 20 nt, Mycobacterium avium subsp. paratuberculosis
gcggcgcuaaagccaccagc

SEQ ID NO: 974430 - RNA, 21 nt, Mycobacterium avium subsp. paratuberculosis
gcggcgcaugaucgcccgcuc

SEQ ID NO: 974431 - RNA, 13 nt, Mycobacterium avium subsp. paratuberculosis
gcggcgcagggcg

SEQ ID NO: 974432 - RNA, 16 nt, Mycobacterium avium subsp. paratuberculosis
gcggcgcagguccggc

SEQ ID NO: 974433 - RNA, 13 nt, Mycobacterium avium subsp. paratuberculosis
gcggcgcaguucg

SEQ ID NO: 974434 - RNA, 14 nt, Mycobacterium avium subsp. paratuberculosis
gcggcgcccacggc

SEQ ID NO: 974435 - RNA, 20 nt, Mycobacterium avium subsp. paratuberculosis
gcggcgcccacggccaccac

SEQ ID NO: 974436 - RNA, 14 nt, Mycobacterium avium subsp. paratuberculosis
gcggcgccaccggc

SEQ ID NO: 974437 - RNA, 12 nt, Mycobacterium avium subsp. paratuberculosis
gcggcgccacgu

SEQ ID NO: 974438 - RNA, 15 nt, Mycobacterium avium subsp. paratuberculosis
gcggcgcgccgggca

SEQ ID NO: 974439 - RNA, 14 nt, Mycobacterium avium subsp. paratuberculosis
gcggcgcgcagccg

SEQ ID NO: 974440 - RNA, 12 nt, Mycobacterium avium subsp. paratuberculosis
gcggcgcagcuc

SEQ ID NO: 974441 - RNA, 16 nt, Mycobacterium avium subsp. paratuberculosis
gcggcgcccgcggccu

SEQ ID NO: 974442 - RNA, 21 nt, Mycobacterium avium subsp. paratuberculosis
gcggcgcgaugaucgccggcg

SEQ ID NO: 974443 - RNA, 16 nt, Mycobacterium avium subsp. paratuberculosis
gcggcgcccaggaacu

SEQ ID NO: 974444 - RNA, 14 nt, Mycobacterium avium subsp. paratuberculosis
gcggcgcagcgcga

SEQ ID NO: 974445 - RNA, 14 nt, Mycobacterium avium subsp. paratuberculosis
gcggcgcacuccau

SEQ ID NO: 974446 - RNA, 17 nt, Mycobacterium avium subsp. paratuberculosis
gcggcgcacuccaucac

SEQ ID NO: 974447 - RNA, 13 nt, Mycobacterium avium subsp. paratuberculosis
gcggccgccaggu

SEQ ID NO: 974448 - RNA, 16 nt, Mycobacterium avium subsp. paratuberculosis
gcggccgccggccagc

SEQ ID NO: 974449 - RNA, 14 nt, Mycobacterium avium subsp. paratuberculosis
gcggccgccgggcc

SEQ ID NO: 974450 - RNA, 15 nt, Mycobacterium avium subsp. paratuberculosis
gcggccgccggggcc

SEQ ID NO: 974451 - RNA, 18 nt, Mycobacterium avium subsp. paratuberculosis
gcggccgccacgcuggug

SEQ ID NO: 974452 - RNA, 15 nt, Mycobacterium avium subsp. paratuberculosis
gcggccgcccgggcg

SEQ ID NO: 974453 - RNA, 20 nt, Mycobacterium avium subsp. paratuberculosis
gcggccgcccgggcggcccg

SEQ ID NO: 974454 - RNA, 23 nt, Mycobacterium avium subsp. paratuberculosis
gcggccgcccgucggggcccggc

SEQ ID NO: 974455 - RNA, 11 nt, Mycobacterium avium subsp. paratuberculosis
gcggccgccga

SEQ ID NO: 974456 - RNA, 22 nt, Mycobacterium avium subsp. paratuberculosis
gcggccgccgcccgcgcggcgg

SEQ ID NO: 974457 - RNA, 23 nt, Mycobacterium avium subsp. paratuberculosis
gcggccgccgcccgcgcggcggc

SEQ ID NO: 974458 - RNA, 13 nt, Mycobacterium avium subsp. paratuberculosis
gcggccgccgcga

SEQ ID NO: 974459 - RNA, 16 nt, Mycobacterium avium subsp. paratuberculosis
gcggccgccgcgacgg

SEQ ID NO: 974460 - RNA, 21 nt, Mycobacterium avium subsp. paratuberculosis
gcggccgccgcgaucagggcc

SEQ ID NO: 974461 - RNA, 21 nt, Mycobacterium avium subsp. paratuberculosis
gcggccgcagcgugggcaccg

SEQ ID NO: 974462 - RNA, 20 nt, Mycobacterium avium subsp. paratuberculosis
gcggccgacgaacaagggcg

SEQ ID NO: 974463 - RNA, 15 nt, Mycobacterium avium subsp. paratuberculosis
gcggccgagccgagg

SEQ ID NO: 974464 - RNA, 20 nt, Mycobacterium avium subsp. paratuberculosis
gcggcccugguugagcaccg

SEQ ID NO: 974465 - RNA, 14 nt, Mycobacterium avium subsp. paratuberculosis
gcggccgaagucca

SEQ ID NO: 974466 - RNA, 13 nt, Mycobacterium avium subsp. paratuberculosis
gcgggugcgacgg

SEQ ID NO: 974467 - RNA, 13 nt, Mycobacterium avium subsp. paratuberculosis
gcgggugcggccg

SEQ ID NO: 974468 - RNA, 14 nt, Mycobacterium avium subsp. paratuberculosis
gcgggugcggccgg

SEQ ID NO: 974469 - RNA, 21 nt, Mycobacterium avium subsp. paratuberculosis
gcggguggaucuugacggcga

SEQ ID NO: 974470 - RNA, 19 nt, Mycobacterium avium subsp. paratuberculosis
gcgggucacacccucggcc

SEQ ID NO: 974471 - RNA, 13 nt, Mycobacterium avium subsp. paratuberculosis
gcgggucagcacc

SEQ ID NO: 974472 - RNA, 13 nt, Mycobacterium avium subsp. paratuberculosis
gcgggucagcagc

SEQ ID NO: 974473 - RNA, 16 nt, Mycobacterium avium subsp. paratuberculosis
gcgggucggcgccggc

SEQ ID NO: 974474 - RNA, 16 nt, Mycobacterium avium subsp. paratuberculosis
gcgggucgauggcgac

SEQ ID NO: 974475 - RNA, 15 nt, Mycobacterium avium subsp. paratuberculosis
gcgggucgcgcggcu

SEQ ID NO: 974476 - RNA, 16 nt, Mycobacterium avium subsp. paratuberculosis
gcgggucgcggcccac

SEQ ID NO: 974477 - RNA, 21 nt, Mycobacterium avium subsp. paratuberculosis
gcggguaugucggcgacccgc

SEQ ID NO: 974478 - RNA, 23 nt, Mycobacterium avium subsp. paratuberculosis
gcgggucgugcaucggcgccugc

SEQ ID NO: 974479 - RNA, 17 nt, Mycobacterium avium subsp. paratuberculosis
gcgggucguuggcggcg

SEQ ID NO: 974480 - RNA, 17 nt, Mycobacterium avium subsp. paratuberculosis
gcgggucguagccgucg

SEQ ID NO: 974481 - RNA, 23 nt, Mycobacterium avium subsp. paratuberculosis
gcgggucgucguucucgggggcg

SEQ ID NO: 974482 - RNA, 15 nt, Mycobacterium avium subsp. paratuberculosis
gcgggucggugguga

SEQ ID NO: 974483 - RNA, 15 nt, Mycobacterium avium subsp. paratuberculosis
gcgggucucgcccac

SEQ ID NO: 974484 - RNA, 14 nt, Mycobacterium avium subsp. paratuberculosis
gcgggugagccggu

SEQ ID NO: 974485 - RNA, 19 nt, Mycobacterium avium subsp. paratuberculosis
gcgggugaggacgcccggc

SEQ ID NO: 974486 - RNA, 22 nt, Mycobacterium avium subsp. paratuberculosis
gcgggugaggggcgcgcgccgg

SEQ ID NO: 974487 - RNA, 22 nt, Mycobacterium avium subsp. paratuberculosis
gcgggugaucuuggccuccacc

SEQ ID NO: 974488 - RNA, 16 nt, Mycobacterium avium subsp. paratuberculosis
gcggguacgcguacgg

SEQ ID NO: 974489 - RNA, 17 nt, Mycobacterium avium subsp. paratuberculosis
gcggggaaggugcgggc

SEQ ID NO: 974490 - RNA, 19 nt, Mycobacterium avium subsp. paratuberculosis
gcggggaaggugcgggcgg

SEQ ID NO: 974491 - RNA, 17 nt, Mycobacterium avium subsp. paratuberculosis
gcgggcugucggcgccc

SEQ ID NO: 974492 - RNA, 16 nt, Mycobacterium avium subsp. paratuberculosis
gcgggcugugccggcg

SEQ ID NO: 974493 - RNA, 20 nt, Mycobacterium avium subsp. paratuberculosis
gcgggcuggaguggucaggc

SEQ ID NO: 974494 - RNA, 23 nt, Mycobacterium avium subsp. paratuberculosis
gcgggcucacuuuugacaggugg

SEQ ID NO: 974495 - RNA, 16 nt, Mycobacterium avium subsp. paratuberculosis
gcgggcgcauaccagc

SEQ ID NO: 974496 - RNA, 14 nt, Mycobacterium avium subsp. paratuberculosis
gcgggcgcccagca

SEQ ID NO: 974497 - RNA, 14 nt, Mycobacterium avium subsp. paratuberculosis
gcgggcgccgaacg

SEQ ID NO: 974498 - RNA, 23 nt, Mycobacterium avium subsp. paratuberculosis
gcgggcgccgaagauggccagga

SEQ ID NO: 974499 - RNA, 22 nt, Mycobacterium avium subsp. paratuberculosis
gcgggcgccuucuuggccgcgc

SEQ ID NO: 974500 - RNA, 23 nt, Mycobacterium avium subsp. paratuberculosis
gcgggcgccuucuuggcggcggu

SEQ ID NO: 974501 - RNA, 20 nt, Mycobacterium avium subsp. paratuberculosis
gcgggcuaggcucggcagcc

SEQ ID NO: 974502 - RNA, 21 nt, Mycobacterium avium subsp. paratuberculosis
gcgggcgugcgguuggcccgc

SEQ ID NO: 974503 - RNA, 18 nt, Mycobacterium avium subsp. paratuberculosis
gcgggcguggcggucggu

SEQ ID NO: 974504 - RNA, 21 nt, Mycobacterium avium subsp. paratuberculosis
gcgggcguccuugaccagcug

SEQ ID NO: 974505 - RNA, 22 nt, Mycobacterium avium subsp. paratuberculosis
gcggcuccggccgcgccggccu

SEQ ID NO: 974506 - RNA, 13 nt, Mycobacterium avium subsp. paratuberculosis
gcggcucgccggc

SEQ ID NO: 974507 - RNA, 16 nt, Mycobacterium avium subsp. paratuberculosis
gcggcucgcgggugcg

SEQ ID NO: 974508 - RNA, 19 nt, Mycobacterium avium subsp. paratuberculosis
gcggcucgauggacgccag

SEQ ID NO: 974509 - RNA, 14 nt, Mycobacterium avium subsp. paratuberculosis
gcggcucggcgcug

SEQ ID NO: 974510 - RNA, 15 nt, Mycobacterium avium subsp. paratuberculosis
gcggcucggcggcgu

SEQ ID NO: 974511 - RNA, 19 nt, Mycobacterium avium subsp. paratuberculosis
gcggcucggcggcgucgua

SEQ ID NO: 974512 - RNA, 16 nt, Mycobacterium avium subsp. paratuberculosis
gcggcugaucagccgg

SEQ ID NO: 974513 - RNA, 20 nt, Mycobacterium avium subsp. paratuberculosis
gcggcugaaccaccgcgccc

SEQ ID NO: 974514 - RNA, 14 nt, Mycobacterium avium subsp. paratuberculosis
gcggcuggcgggug

SEQ ID NO: 974515 - RNA, 16 nt, Mycobacterium avium subsp. paratuberculosis
gcggcuugcccguucg

SEQ ID NO: 974516 - RNA, 14 nt, Mycobacterium avium subsp. paratuberculosis
gcggcuugccguug

SEQ ID NO: 974517 - RNA, 23 nt, Mycobacterium avium subsp. paratuberculosis
gcggcugcugcagcgcccgggcc

SEQ ID NO: 974518 - RNA, 15 nt, Mycobacterium avium subsp. paratuberculosis
gcggcuggcccggcg

SEQ ID NO: 974519 - RNA, 20 nt, Mycobacterium avium subsp. paratuberculosis
gcggcuggcccggcgcggcg

SEQ ID NO: 974520 - RNA, 21 nt, Mycobacterium avium subsp. paratuberculosis
gcggcuggcccggcgcggcgg

SEQ ID NO: 974521 - RNA, 16 nt, Mycobacterium avium subsp. paratuberculosis
gcggcuggccgcggcg

SEQ ID NO: 974522 - RNA, 15 nt, Mycobacterium avium subsp. paratuberculosis
gcggcuugagccgga

SEQ ID NO: 974523 - RNA, 13 nt, Mycobacterium avium subsp. paratuberculosis
gcggcuuggccac

SEQ ID NO: 974524 - RNA, 15 nt, Mycobacterium avium subsp. paratuberculosis
gcgggaacgcgucga

SEQ ID NO: 974525 - RNA, 22 nt, Mycobacterium avium subsp. paratuberculosis
gcgggaacgguugacgcucugu

SEQ ID NO: 974526 - RNA, 19 nt, Mycobacterium avium subsp. paratuberculosis
gcgggcgaccuggugcucg

SEQ ID NO: 974527 - RNA, 15 nt, Mycobacterium avium subsp. paratuberculosis
gcgggcgaucuccag

SEQ ID NO: 974528 - RNA, 19 nt, Mycobacterium avium subsp. paratuberculosis
gcgggcgaucuccagcggc

SEQ ID NO: 974529 - RNA, 20 nt, Mycobacterium avium subsp. paratuberculosis
gcgggcgaucuccagcggcc

SEQ ID NO: 974530 - RNA, 16 nt, Mycobacterium avium subsp. paratuberculosis
gcgggcgaugcggccc

SEQ ID NO: 974531 - RNA, 20 nt, Mycobacterium avium subsp. paratuberculosis
gcgggcgauucccggaugcu

SEQ ID NO: 974532 - RNA, 16 nt, Mycobacterium avium subsp. paratuberculosis
gcgggcccgcgcggcg

SEQ ID NO: 974533 - RNA, 19 nt, Mycobacterium avium subsp. paratuberculosis
gcgggcgaaaucgcgggcc

SEQ ID NO: 974534 - RNA, 13 nt, Mycobacterium avium subsp. paratuberculosis
gcgggcccgccgu

SEQ ID NO: 974535 - RNA, 12 nt, Mycobacterium avium subsp. paratuberculosis
gcgggcccgcgc

SEQ ID NO: 974536 - RNA, 16 nt, Mycobacterium avium subsp. paratuberculosis
gcgggccacagcggcg

SEQ ID NO: 974537 - RNA, 16 nt, Mycobacterium avium subsp. paratuberculosis
gcgggccaccgcggcg

SEQ ID NO: 974538 - RNA, 13 nt, Mycobacterium avium subsp. paratuberculosis
gcgggccagcgca

SEQ ID NO: 974539 - RNA, 23 nt, Mycobacterium avium subsp. paratuberculosis
gcgggccagcgccuucggcgcca

SEQ ID NO: 974540 - RNA, 22 nt, Mycobacterium avium subsp. paratuberculosis
gcgggccagcguuuccagcgcc

SEQ ID NO: 974541 - RNA, 21 nt, Mycobacterium avium subsp. paratuberculosis
gcgggccagcucgaaccugga

SEQ ID NO: 974542 - RNA, 13 nt, Mycobacterium avium subsp. paratuberculosis
gcgggcccagcag

SEQ ID NO: 974543 - RNA, 23 nt, Mycobacterium avium subsp. paratuberculosis
gcgggcccagcagauagcccagc

SEQ ID NO: 974544 - RNA, 16 nt, Mycobacterium avium subsp. paratuberculosis
gcgggccaggucgagc

SEQ ID NO: 974545 - RNA, 21 nt, Mycobacterium avium subsp. paratuberculosis
gcgggccagucgccgcgcaga

SEQ ID NO: 974546 - RNA, 19 nt, Mycobacterium avium subsp. paratuberculosis
gcgggccaucgacuccagc

SEQ ID NO: 974547 - RNA, 22 nt, Mycobacterium avium subsp. paratuberculosis
gcgggccaucgacuccagcacc

SEQ ID NO: 974548 - RNA, 17 nt, Mycobacterium avium subsp. paratuberculosis
gcgggccaggcggauca

SEQ ID NO: 974549 - RNA, 17 nt, Mycobacterium avium subsp. paratuberculosis
gcgggccagggcgagga

SEQ ID NO: 974550 - RNA, 19 nt, Mycobacterium avium subsp. paratuberculosis
gcgggccaggcccaccguc

SEQ ID NO: 974551 - RNA, 14 nt, Mycobacterium avium subsp. paratuberculosis
gcgggaccagcgcc

SEQ ID NO: 974552 - RNA, 16 nt, Mycobacterium avium subsp. paratuberculosis
gcgggaccagcgccuc

SEQ ID NO: 974553 - RNA, 23 nt, Mycobacterium avium subsp. paratuberculosis
gcgggaccgaggugccgcggguc

SEQ ID NO: 974554 - RNA, 20 nt, Mycobacterium avium subsp. paratuberculosis
gcgggacguggcucagcggc

SEQ ID NO: 974555 - RNA, 14 nt, Mycobacterium avium subsp. paratuberculosis
gcgggacgccguug

SEQ ID NO: 974556 - RNA, 20 nt, Mycobacterium avium subsp. paratuberculosis
gcgggagcuaggcggccggg

SEQ ID NO: 974557 - RNA, 22 nt, Mycobacterium avium subsp. paratuberculosis
gcgggacggaaucacgcaccgu

SEQ ID NO: 974558 - RNA, 14 nt, Mycobacterium avium subsp. paratuberculosis
gcgggaggcccagu

SEQ ID NO: 974559 - RNA, 16 nt, Mycobacterium avium subsp. paratuberculosis
gcgggaagggcccggg

SEQ ID NO: 974560 - RNA, 23 nt, Mycobacterium avium subsp. paratuberculosis
gcgggaauggccgcgccguagcg

SEQ ID NO: 974561 - RNA, 22 nt, Mycobacterium avium subsp. paratuberculosis
gcgggacacggcggcgcgggcg

SEQ ID NO: 974562 - RNA, 16 nt, Mycobacterium avium subsp. paratuberculosis
gcggccaacgcgacga

SEQ ID NO: 974563 - RNA, 22 nt, Mycobacterium avium subsp. paratuberculosis
gcggccaacgcgacgaagccgg

SEQ ID NO: 974564 - RNA, 16 nt, Mycobacterium avium subsp. paratuberculosis
gcggccaaucgcugug

SEQ ID NO: 974565 - RNA, 15 nt, Mycobacterium avium subsp. paratuberculosis
gcggccaccaccgca

SEQ ID NO: 974566 - RNA, 18 nt, Mycobacterium avium subsp. paratuberculosis
gcggccaccaccgcauca

SEQ ID NO: 974567 - RNA, 19 nt, Mycobacterium avium subsp. paratuberculosis
gcggccaccaacggcagca

SEQ ID NO: 974568 - RNA, 15 nt, Mycobacterium avium subsp. paratuberculosis
gcggccaccagccgg

SEQ ID NO: 974569 - RNA, 16 nt, Mycobacterium avium subsp. paratuberculosis
gcggccaccagccggc

SEQ ID NO: 974570 - RNA, 22 nt, Mycobacterium avium subsp. paratuberculosis
gcggccaccacgacgccgggcg

SEQ ID NO: 974571 - RNA, 18 nt, Mycobacterium avium subsp. paratuberculosis
gcggccaccagcgcggcc

SEQ ID NO: 974572 - RNA, 17 nt, Mycobacterium avium subsp. paratuberculosis
gcggcaugaccggccag

SEQ ID NO: 974573 - RNA, 19 nt, Mycobacterium avium subsp. paratuberculosis
gcggcauggcuggcggcaa

SEQ ID NO: 974574 - RNA, 14 nt, Mycobacterium avium subsp. paratuberculosis
gcggcagggccagg

SEQ ID NO: 974575 - RNA, 19 nt, Mycobacterium avium subsp. paratuberculosis
gcggcaucgcgcgcggcgg

SEQ ID NO: 974576 - RNA, 12 nt, Mycobacterium avium subsp. paratuberculosis
gcggccagccca

SEQ ID NO: 974577 - RNA, 21 nt, Mycobacterium avium subsp. paratuberculosis
gcggccaugucggagcugcgc

SEQ ID NO: 974578 - RNA, 18 nt, Mycobacterium avium subsp. paratuberculosis
gcggccauggucgcggcc

SEQ ID NO: 974579 - RNA, 18 nt, Mycobacterium avium subsp. paratuberculosis
gcggcccacccggauguc

SEQ ID NO: 974580 - RNA, 22 nt, Mycobacterium avium subsp. paratuberculosis
gcggcccagguauucguugccc

SEQ ID NO: 974581 - RNA, 22 nt, Mycobacterium avium subsp. paratuberculosis
gcggccagcacggucagcggcc

SEQ ID NO: 974582 - RNA, 18 nt, Mycobacterium avium subsp. paratuberculosis
gcggccagcagcaccaga

SEQ ID NO: 974583 - RNA, 18 nt, Mycobacterium avium subsp. paratuberculosis
gcggccaccaugccggcg

SEQ ID NO: 974584 - RNA, 19 nt, Mycobacterium avium subsp. paratuberculosis
gcggccaccaugggcggga

SEQ ID NO: 974585 - RNA, 16 nt, Mycobacterium avium subsp. paratuberculosis
gcggccaccgcgccgu

SEQ ID NO: 974586 - RNA, 16 nt, Mycobacterium avium subsp. paratuberculosis
gcggccaccgggaccg

SEQ ID NO: 974587 - RNA, 15 nt, Mycobacterium avium subsp. paratuberculosis
gcggccaccuccagc

SEQ ID NO: 974588 - RNA, 18 nt, Mycobacterium avium subsp. paratuberculosis
gcggccacgacggcgcug

SEQ ID NO: 974589 - RNA, 20 nt, Mycobacterium avium subsp. paratuberculosis
gcggccacgacggcgcuggc

SEQ ID NO: 974590 - RNA, 21 nt, Mycobacterium avium subsp. paratuberculosis
gcggccacgaucgcggccagc

SEQ ID NO: 974591 - RNA, 18 nt, Mycobacterium avium subsp. paratuberculosis
gcggccacgauggggacg

SEQ ID NO: 974592 - RNA, 16 nt, Mycobacterium avium subsp. paratuberculosis
gcggccacgcccuggc

SEQ ID NO: 974593 - RNA, 22 nt, Mycobacterium avium subsp. paratuberculosis
gcggccacgcccuggccgccgg

SEQ ID NO: 974594 - RNA, 16 nt, Mycobacterium avium subsp. paratuberculosis
gcggccacgcucgggc

SEQ ID NO: 974595 - RNA, 17 nt, Mycobacterium avium subsp. paratuberculosis
gcggccacgcucgggcc

SEQ ID NO: 974596 - RNA, 14 nt, Mycobacterium avium subsp. paratuberculosis
gcggcccugcagcg

SEQ ID NO: 974597 - RNA, 16 nt, Mycobacterium avium subsp. paratuberculosis
gcggcccugcgcggcc

SEQ ID NO: 974598 - RNA, 13 nt, Mycobacterium avium subsp. paratuberculosis
gcggcccgcagga

SEQ ID NO: 974599 - RNA, 19 nt, Mycobacterium avium subsp. paratuberculosis
gcggcccggcccgcuggcc

SEQ ID NO: 974600 - RNA, 22 nt, Mycobacterium avium subsp. paratuberculosis
gcggcccgucgccgaucagcac

SEQ ID NO: 974601 - RNA, 15 nt, Mycobacterium avium subsp. paratuberculosis
gcggcccgcggggcg

SEQ ID NO: 974602 - RNA, 14 nt, Mycobacterium avium subsp. paratuberculosis
gcggcccgcgccgg

SEQ ID NO: 974603 - RNA, 16 nt, Mycobacterium avium subsp. paratuberculosis
gcggcccgcgccggcg

SEQ ID NO: 974604 - RNA, 16 nt, Mycobacterium avium subsp. paratuberculosis
gcggcccgccggaacu

SEQ ID NO: 974605 - RNA, 21 nt, Mycobacterium avium subsp. paratuberculosis
gcggcccgcacggccgccagg

SEQ ID NO: 974606 - RNA, 22 nt, Mycobacterium avium subsp. paratuberculosis
gcggcccgcacggccgccaggg

SEQ ID NO: 974607 - RNA, 12 nt, Mycobacterium avium subsp. paratuberculosis
gcggcccgccgg

SEQ ID NO: 974608 - RNA, 15 nt, Mycobacterium avium subsp. paratuberculosis
gcggcccgccgggcg

SEQ ID NO: 974609 - RNA, 15 nt, Mycobacterium avium subsp. paratuberculosis
gcggccccgccagca

SEQ ID NO: 974610 - RNA, 18 nt, Mycobacterium avium subsp. paratuberculosis
gcggcccgaccagcgggc

SEQ ID NO: 974611 - RNA, 19 nt, Mycobacterium avium subsp. paratuberculosis
gcggcccgaccagcgggcc

SEQ ID NO: 974612 - RNA, 16 nt, Mycobacterium avium subsp. paratuberculosis
gcggcccgaucaccag

SEQ ID NO: 974613 - RNA, 15 nt, Mycobacterium avium subsp. paratuberculosis
gcggaucggcggcga

SEQ ID NO: 974614 - RNA, 13 nt, Mycobacterium avium subsp. paratuberculosis
gcggaucgggcgu

SEQ ID NO: 974615 - RNA, 19 nt, Mycobacterium avium subsp. paratuberculosis
gcggaucgguuucuccacc

SEQ ID NO: 974616 - RNA, 14 nt, Mycobacterium avium subsp. paratuberculosis
gcggaucgcgggcg

SEQ ID NO: 974617 - RNA, 23 nt, Mycobacterium avium subsp. paratuberculosis
gcggaucgcgggcgacccgcugg

SEQ ID NO: 974618 - RNA, 17 nt, Mycobacterium avium subsp. paratuberculosis
gcggauccagguggggc

SEQ ID NO: 974619 - RNA, 14 nt, Mycobacterium avium subsp. paratuberculosis
gcggauccgcagcu

SEQ ID NO: 974620 - RNA, 13 nt, Mycobacterium avium subsp. paratuberculosis
gcggauccgggcc

SEQ ID NO: 974621 - RNA, 17 nt, Mycobacterium avium subsp. paratuberculosis
gcggauccgggccggcg

SEQ ID NO: 974622 - RNA, 21 nt, Mycobacterium avium subsp. paratuberculosis
gcggauccgggccggcgucgc

SEQ ID NO: 974623 - RNA, 15 nt, Mycobacterium avium subsp. paratuberculosis
gcggaucggccuggg

SEQ ID NO: 974624 - RNA, 21 nt, Mycobacterium avium subsp. paratuberculosis
gcggaucggccuggggggcgc

SEQ ID NO: 974625 - RNA, 20 nt, Mycobacterium avium subsp. paratuberculosis
gcggaucgaacagggcggcg

SEQ ID NO: 974626 - RNA, 20 nt, Mycobacterium avium subsp. paratuberculosis
gcggaucgcaucgggcgaca

SEQ ID NO: 974627 - RNA, 24 nt, Mycobacterium avium subsp. paratuberculosis
gcggacggaucgagucccgcgcgg

SEQ ID NO: 974628 - RNA, 15 nt, Mycobacterium avium subsp. paratuberculosis
gcggaccggcggccg

SEQ ID NO: 974629 - RNA, 19 nt, Mycobacterium avium subsp. paratuberculosis
gcggacccgacggucgggc

SEQ ID NO: 974630 - RNA, 19 nt, Mycobacterium avium subsp. paratuberculosis
gcggacccggaggcggcgg

SEQ ID NO: 974631 - RNA, 15 nt, Mycobacterium avium subsp. paratuberculosis
gcggacccggucggc

SEQ ID NO: 974632 - RNA, 20 nt, Mycobacterium avium subsp. paratuberculosis
gcggcagcgucgccagccgc

SEQ ID NO: 974633 - RNA, 21 nt, Mycobacterium avium subsp. paratuberculosis
gcggcagcgucgccagccgcc

SEQ ID NO: 974634 - RNA, 22 nt, Mycobacterium avium subsp. paratuberculosis
gcggcagcgucgccagccgccg

SEQ ID NO: 974635 - RNA, 23 nt, Mycobacterium avium subsp. paratuberculosis
gcggcagcgucgccagccgccgg

SEQ ID NO: 974636 - RNA, 18 nt, Mycobacterium avium subsp. paratuberculosis
gcggcagcucggcggccc

SEQ ID NO: 974637 - RNA, 21 nt, Mycobacterium avium subsp. paratuberculosis
gcggcagcucggcggcccgcc

SEQ ID NO: 974638 - RNA, 18 nt, Mycobacterium avium subsp. paratuberculosis
gcggcaggaauuccagcg

SEQ ID NO: 974639 - RNA, 16 nt, Mycobacterium avium subsp. paratuberculosis
gcggcacgaucggcag

SEQ ID NO: 974640 - RNA, 14 nt, Mycobacterium avium subsp. paratuberculosis
gcggcacggcgagg

SEQ ID NO: 974641 - RNA, 20 nt, Mycobacterium avium subsp. paratuberculosis
gcggcacggcgaggucggga

SEQ ID NO: 974642 - RNA, 15 nt, Mycobacterium avium subsp. paratuberculosis
gcggcacgggcaccg

SEQ ID NO: 974643 - RNA, 12 nt, Mycobacterium avium subsp. paratuberculosis
gcggcacgccga

SEQ ID NO: 974644 - RNA, 19 nt, Mycobacterium avium subsp. paratuberculosis
gcggcacgcugcgccagcc

SEQ ID NO: 974645 - RNA, 20 nt, Mycobacterium avium subsp. paratuberculosis
gcggcacggugcgggugccg

SEQ ID NO: 974646 - RNA, 14 nt, Mycobacterium avium subsp. paratuberculosis
gcggcagcgcggcg

SEQ ID NO: 974647 - RNA, 18 nt, Mycobacterium avium subsp. paratuberculosis
gcggcacccaggucaccg

SEQ ID NO: 974648 - RNA, 17 nt, Mycobacterium avium subsp. paratuberculosis
gcggcaccuucaccgac

SEQ ID NO: 974649 - RNA, 21 nt, Mycobacterium avium subsp. paratuberculosis
gcggcaccuuggugagcaccg

SEQ ID NO: 974650 - RNA, 15 nt, Mycobacterium avium subsp. paratuberculosis
gcggcaccgccgcgg

SEQ ID NO: 974651 - RNA, 17 nt, Mycobacterium avium subsp. paratuberculosis
gcggcaccgccgcggug

SEQ ID NO: 974652 - RNA, 22 nt, Mycobacterium avium subsp. paratuberculosis
gcggcaccagguaccggcgggc

SEQ ID NO: 974653 - RNA, 23 nt, Mycobacterium avium subsp. paratuberculosis
gcggcaccagguaccggcgggcg

SEQ ID NO: 974654 - RNA, 15 nt, Mycobacterium avium subsp. paratuberculosis
gcggcaccagucgcg

SEQ ID NO: 974655 - RNA, 18 nt, Mycobacterium avium subsp. paratuberculosis
gcggcaccagucgcgcag

SEQ ID NO: 974656 - RNA, 14 nt, Mycobacterium avium subsp. paratuberculosis
gcggcaacacgccg

SEQ ID NO: 974657 - RNA, 17 nt, Mycobacterium avium subsp. paratuberculosis
gcggcaacacgccggcg

SEQ ID NO: 974658 - RNA, 19 nt, Mycobacterium avium subsp. paratuberculosis
gcggcaacacgccggcggc

SEQ ID NO: 974659 - RNA, 23 nt, Mycobacterium avium subsp. paratuberculosis
gcggcaacagcaccagcaccacc

SEQ ID NO: 974660 - RNA, 15 nt, Mycobacterium avium subsp. paratuberculosis
gcggcaacgccagcc

SEQ ID NO: 974661 - RNA, 19 nt, Mycobacterium avium subsp. paratuberculosis
gcggauuucucagcggcgc

SEQ ID NO: 974662 - RNA, 15 nt, Mycobacterium avium subsp. paratuberculosis
gcggauuggucgggc

SEQ ID NO: 974663 - RNA, 16 nt, Mycobacterium avium subsp. paratuberculosis
gcgcugucggcgggga

SEQ ID NO: 974664 - RNA, 19 nt, Mycobacterium avium subsp. paratuberculosis
gcggaacagccggcucagg

SEQ ID NO: 974665 - RNA, 21 nt, Mycobacterium avium subsp. paratuberculosis
gcggaacagccggcucagggu

SEQ ID NO: 974666 - RNA, 21 nt, Mycobacterium avium subsp. paratuberculosis
gcggaacccacgugcggcgcc

SEQ ID NO: 974667 - RNA, 16 nt, Mycobacterium avium subsp. paratuberculosis
gcggaaacgacgucgc

SEQ ID NO: 974668 - RNA, 23 nt, Mycobacterium avium subsp. paratuberculosis
gcggaaacgacgucgccaccaga

SEQ ID NO: 974669 - RNA, 21 nt, Mycobacterium avium subsp. paratuberculosis
gcggaaccggccggggcgcca

SEQ ID NO: 974670 - RNA, 20 nt, Mycobacterium avium subsp. paratuberculosis
gcggaaccguugcagcacag

SEQ ID NO: 974671 - RNA, 20 nt, Mycobacterium avium subsp. paratuberculosis
gcggaacccguugcgcccuu

SEQ ID NO: 974672 - RNA, 23 nt, Mycobacterium avium subsp. paratuberculosis
gcggaagaaguucucgcacccgg

SEQ ID NO: 974673 - RNA, 20 nt, Mycobacterium avium subsp. paratuberculosis
gcggaacggucggggcggcg

SEQ ID NO: 974674 - RNA, 21 nt, Mycobacterium avium subsp. paratuberculosis
gcggaagccccaggcccgguu

SEQ ID NO: 974675 - RNA, 22 nt, Mycobacterium avium subsp. paratuberculosis
gcggaagcgcguucagggugca

SEQ ID NO: 974676 - RNA, 23 nt, Mycobacterium avium subsp. paratuberculosis
gcggaaggccgcgcgggcggcgu

SEQ ID NO: 974677 - RNA, 14 nt, Mycobacterium avium subsp. paratuberculosis
gcgcuggcgcaggc

SEQ ID NO: 974678 - RNA, 15 nt, Mycobacterium avium subsp. paratuberculosis
gcgcuggcgcaggcg

SEQ ID NO: 974679 - RNA, 13 nt, Mycobacterium avium subsp. paratuberculosis
gcgcuggccgggu

SEQ ID NO: 974680 - RNA, 16 nt, Mycobacterium avium subsp. paratuberculosis
gcgcuggcgaacaugg

SEQ ID NO: 974681 - RNA, 17 nt, Mycobacterium avium subsp. paratuberculosis
gcgcuggccgcgaacgg

SEQ ID NO: 974682 - RNA, 18 nt, Mycobacterium avium subsp. paratuberculosis
gcgcuggccgcggccagc

SEQ ID NO: 974683 - RNA, 16 nt, Mycobacterium avium subsp. paratuberculosis
gcgcugggagcgggcc

SEQ ID NO: 974684 - RNA, 19 nt, Mycobacterium avium subsp. paratuberculosis
gcgcugggagcgggccacg

SEQ ID NO: 974685 - RNA, 21 nt, Mycobacterium avium subsp. paratuberculosis
gcgcugggagcgggccacgca

SEQ ID NO: 974686 - RNA, 23 nt, Mycobacterium avium subsp. paratuberculosis
gcgcuggucggcgggcagcgagu

SEQ ID NO: 974687 - RNA, 15 nt, Mycobacterium avium subsp. paratuberculosis
gcgcuggugcugccg

SEQ ID NO: 974688 - RNA, 19 nt, Mycobacterium avium subsp. paratuberculosis
gcgcuguccacguccugcc

SEQ ID NO: 974689 - RNA, 21 nt, Mycobacterium avium subsp. paratuberculosis
gcgcuguccacguccugccag

SEQ ID NO: 974690 - RNA, 17 nt, Mycobacterium avium subsp. paratuberculosis
gcgcuguaggcggcgug

SEQ ID NO: 974691 - RNA, 19 nt, Mycobacterium avium subsp. paratuberculosis
gcgcugggugaacaccccg

SEQ ID NO: 974692 - RNA, 22 nt, Mycobacterium avium subsp. paratuberculosis
gcgcugggugaacaccccgcgg

SEQ ID NO: 974693 - RNA, 17 nt, Mycobacterium avium subsp. paratuberculosis
gcgcugggugcgggcug

SEQ ID NO: 974694 - RNA, 22 nt, Mycobacterium avium subsp. paratuberculosis
gcgcugggugcgggcugcacca

SEQ ID NO: 974695 - RNA, 15 nt, Mycobacterium avium subsp. paratuberculosis
gcgcugggcuggccg

SEQ ID NO: 974696 - RNA, 14 nt, Mycobacterium avium subsp. paratuberculosis
gcgcugcagcagcc

SEQ ID NO: 974697 - RNA, 16 nt, Mycobacterium avium subsp. paratuberculosis
gcgcugcagcagcccg

SEQ ID NO: 974698 - RNA, 23 nt, Mycobacterium avium subsp. paratuberculosis
gcgcugcagcauccagguggcgc

SEQ ID NO: 974699 - RNA, 23 nt, Mycobacterium avium subsp. paratuberculosis
gcgcugcagcgagaccucccggc

SEQ ID NO: 974700 - RNA, 12 nt, Mycobacterium avium subsp. paratuberculosis
gcgcugccggcg

SEQ ID NO: 974701 - RNA, 17 nt, Mycobacterium avium subsp. paratuberculosis
gcgcugccggcgcaccc

SEQ ID NO: 974702 - RNA, 13 nt, Mycobacterium avium subsp. paratuberculosis
gcgcugcccagcg

SEQ ID NO: 974703 - RNA, 12 nt, Mycobacterium avium subsp. paratuberculosis
gcgcugcccgcc

SEQ ID NO: 974704 - RNA, 22 nt, Mycobacterium avium subsp. paratuberculosis
gcgcugcccgcgaucgccagcg

SEQ ID NO: 974705 - RNA, 13 nt, Mycobacterium avium subsp. paratuberculosis
gcgcugccagggc

SEQ ID NO: 974706 - RNA, 13 nt, Mycobacterium avium subsp. paratuberculosis
gcgcugccagucg

SEQ ID NO: 974707 - RNA, 13 nt, Mycobacterium avium subsp. paratuberculosis
gcgcugccgccgg

SEQ ID NO: 974708 - RNA, 15 nt, Mycobacterium avium subsp. paratuberculosis
gcgcugccgcgcgcc

SEQ ID NO: 974709 - RNA, 14 nt, Mycobacterium avium subsp. paratuberculosis
gcgcugccggcccg

SEQ ID NO: 974710 - RNA, 15 nt, Mycobacterium avium subsp. paratuberculosis
gcgcugcgccgggug

SEQ ID NO: 974711 - RNA, 14 nt, Mycobacterium avium subsp. paratuberculosis
gcgcugcgcgacac

SEQ ID NO: 974712 - RNA, 21 nt, Mycobacterium avium subsp. paratuberculosis
gcgcugcgcgccgcccucgcc

SEQ ID NO: 974713 - RNA, 14 nt, Mycobacterium avium subsp. paratuberculosis
gcgcuggccagcgc

SEQ ID NO: 974714 - RNA, 18 nt, Mycobacterium avium subsp. paratuberculosis
gcgcucgaccucggcggc

SEQ ID NO: 974715 - RNA, 14 nt, Mycobacterium avium subsp. paratuberculosis
gcgcggcgccgcgu

SEQ ID NO: 974716 - RNA, 19 nt, Mycobacterium avium subsp. paratuberculosis
gcgcucgccgucggccagc

SEQ ID NO: 974717 - RNA, 22 nt, Mycobacterium avium subsp. paratuberculosis
gcgcucgcggauguccgaccgg

SEQ ID NO: 974718 - RNA, 14 nt, Mycobacterium avium subsp. paratuberculosis
gcgcucggacucag

SEQ ID NO: 974719 - RNA, 14 nt, Mycobacterium avium subsp. paratuberculosis
gcgcucuggaagau

SEQ ID NO: 974720 - RNA, 22 nt, Mycobacterium avium subsp. paratuberculosis
gcgcucggucagcaccggggcc

SEQ ID NO: 974721 - RNA, 23 nt, Mycobacterium avium subsp. paratuberculosis
gcgcucgucgaugcgcggaaacu

SEQ ID NO: 974722 - RNA, 23 nt, Mycobacterium avium subsp. paratuberculosis
gcgcucggccggguuguccuggc

SEQ ID NO: 974723 - RNA, 19 nt, Mycobacterium avium subsp. paratuberculosis
gcgcucggccauccgggcg

SEQ ID NO: 974724 - RNA, 20 nt, Mycobacterium avium subsp. paratuberculosis
gcgcucggccauccgggcgg

SEQ ID NO: 974725 - RNA, 14 nt, Mycobacterium avium subsp. paratuberculosis
gcgcucggcccgcu

SEQ ID NO: 974726 - RNA, 19 nt, Mycobacterium avium subsp. paratuberculosis
gcgcaguugcgcggcgggc

SEQ ID NO: 974727 - RNA, 18 nt, Mycobacterium avium subsp. paratuberculosis
gcgcaucaucgcccagcg

SEQ ID NO: 974728 - RNA, 21 nt, Mycobacterium avium subsp. paratuberculosis
gcgcaucgacugcgacacccg

SEQ ID NO: 974729 - RNA, 20 nt, Mycobacterium avium subsp. paratuberculosis
gcgcaugaccgauccgccgg

SEQ ID NO: 974730 - RNA, 17 nt, Mycobacterium avium subsp. paratuberculosis
gcgcaugaugcccaggc

SEQ ID NO: 974731 - RNA, 19 nt, Mycobacterium avium subsp. paratuberculosis
gcgcaucggucagcaacag

SEQ ID NO: 974732 - RNA, 19 nt, Mycobacterium avium subsp. paratuberculosis
gcgcaucugcucggcgucc

SEQ ID NO: 974733 - RNA, 19 nt, Mycobacterium avium subsp. paratuberculosis
gcgcauguaggacaccccg

SEQ ID NO: 974734 - RNA, 18 nt, Mycobacterium avium subsp. paratuberculosis
gcgccaacgaggcacggc

SEQ ID NO: 974735 - RNA, 19 nt, Mycobacterium avium subsp. paratuberculosis
gcgccacaacuggucgugc

SEQ ID NO: 974736 - RNA, 13 nt, Mycobacterium avium subsp. paratuberculosis
gcgccaaugguuu

SEQ ID NO: 974737 - RNA, 14 nt, Mycobacterium avium subsp. paratuberculosis
gcgccagcgccagc

SEQ ID NO: 974738 - RNA, 20 nt, Mycobacterium avium subsp. paratuberculosis
gcgccagcgcggugcccagc

SEQ ID NO: 974739 - RNA, 21 nt, Mycobacterium avium subsp. paratuberculosis
gcgccagcgcggugcccagcc

SEQ ID NO: 974740 - RNA, 15 nt, Mycobacterium avium subsp. paratuberculosis
gcgccagccgcaccg

SEQ ID NO: 974741 - RNA, 12 nt, Mycobacterium avium subsp. paratuberculosis
gcgccagcgagu

SEQ ID NO: 974742 - RNA, 14 nt, Mycobacterium avium subsp. paratuberculosis
gcgccagcgacggc

SEQ ID NO: 974743 - RNA, 19 nt, Mycobacterium avium subsp. paratuberculosis
gcgccagcgacggccgggu

SEQ ID NO: 974744 - RNA, 22 nt, Mycobacterium avium subsp. paratuberculosis
gcgccagcagggcaucucccgc

SEQ ID NO: 974745 - RNA, 14 nt, Mycobacterium avium subsp. paratuberculosis
gcgccagcagcggc

SEQ ID NO: 974746 - RNA, 19 nt, Mycobacterium avium subsp. paratuberculosis
gcgccagcaccgccugggu

SEQ ID NO: 974747 - RNA, 18 nt, Mycobacterium avium subsp. paratuberculosis
gcgccagcaccgggccca

SEQ ID NO: 974748 - RNA, 20 nt, Mycobacterium avium subsp. paratuberculosis
gcgccagcaccgggcccagc

SEQ ID NO: 974749 - RNA, 13 nt, Mycobacterium avium subsp. paratuberculosis
gcgccagcaccuc

SEQ ID NO: 974750 - RNA, 15 nt, Mycobacterium avium subsp. paratuberculosis
gcgccagcagcaccu

SEQ ID NO: 974751 - RNA, 19 nt, Mycobacterium avium subsp. paratuberculosis
gcgccagcagcagcgcggc

SEQ ID NO: 974752 - RNA, 17 nt, Mycobacterium avium subsp. paratuberculosis
gcgccagcagcgcgccg

SEQ ID NO: 974753 - RNA, 17 nt, Mycobacterium avium subsp. paratuberculosis
gcgccaccgaggccagc

SEQ ID NO: 974754 - RNA, 21 nt, Mycobacterium avium subsp. paratuberculosis
gcgccacgacugcgcggccgg

SEQ ID NO: 974755 - RNA, 22 nt, Mycobacterium avium subsp. paratuberculosis
gcgccacgacugcgcggccggc

SEQ ID NO: 974756 - RNA, 15 nt, Mycobacterium avium subsp. paratuberculosis
gcgccacgcacaccg

SEQ ID NO: 974757 - RNA, 15 nt, Mycobacterium avium subsp. paratuberculosis
gcgccaccgcggggc

SEQ ID NO: 974758 - RNA, 24 nt, Mycobacterium avium subsp. paratuberculosis
gcgccaccgcggggcugggcgcca

SEQ ID NO: 974759 - RNA, 15 nt, Mycobacterium avium subsp. paratuberculosis
gcgccaccccgagcu

SEQ ID NO: 974760 - RNA, 14 nt, Mycobacterium avium subsp. paratuberculosis
gcgccaccagccac

SEQ ID NO: 974761 - RNA, 14 nt, Mycobacterium avium subsp. paratuberculosis
gcgccaccagcucc

SEQ ID NO: 974762 - RNA, 17 nt, Mycobacterium avium subsp. paratuberculosis
gcgccaccagcuccucg

SEQ ID NO: 974763 - RNA, 18 nt, Mycobacterium avium subsp. paratuberculosis
gcgccaccagcuccucga

SEQ ID NO: 974764 - RNA, 13 nt, Mycobacterium avium subsp. paratuberculosis
gcgccaccagcac

SEQ ID NO: 974765 - RNA, 21 nt, Mycobacterium avium subsp. paratuberculosis
gcgccacaucagcucggcggc

SEQ ID NO: 974766 - RNA, 23 nt, Mycobacterium avium subsp. paratuberculosis
gcgccacaucagcucggcggccu

SEQ ID NO: 974767 - RNA, 14 nt, Mycobacterium avium subsp. paratuberculosis
gcgccacagccggg

SEQ ID NO: 974768 - RNA, 14 nt, Mycobacterium avium subsp. paratuberculosis
gcgccacagcagca

SEQ ID NO: 974769 - RNA, 16 nt, Mycobacterium avium subsp. paratuberculosis
gcgccacagcagcacc

SEQ ID NO: 974770 - RNA, 17 nt, Mycobacterium avium subsp. paratuberculosis
gcgccacagcagcacca

SEQ ID NO: 974771 - RNA, 15 nt, Mycobacterium avium subsp. paratuberculosis
gcgccacuggcuggu

SEQ ID NO: 974772 - RNA, 21 nt, Mycobacterium avium subsp. paratuberculosis
gcgccacugccgccgcccagg

SEQ ID NO: 974773 - RNA, 23 nt, Mycobacterium avium subsp. paratuberculosis
gcgccagagcgcgaaaaccagca

SEQ ID NO: 974774 - RNA, 17 nt, Mycobacterium avium subsp. paratuberculosis
gcgccagaucccgcagc

SEQ ID NO: 974775 - RNA, 21 nt, Mycobacterium avium subsp. paratuberculosis
gcgccagacguccagcgccgc

SEQ ID NO: 974776 - RNA, 13 nt, Mycobacterium avium subsp. paratuberculosis
gcgccacggggcg

SEQ ID NO: 974777 - RNA, 16 nt, Mycobacterium avium subsp. paratuberculosis
gcgccacggggcgccg

SEQ ID NO: 974778 - RNA, 20 nt, Mycobacterium avium subsp. paratuberculosis
gcgccacgguggcggucagg

SEQ ID NO: 974779 - RNA, 13 nt, Mycobacterium avium subsp. paratuberculosis
gcgccaccuccga

SEQ ID NO: 974780 - RNA, 19 nt, Mycobacterium avium subsp. paratuberculosis
gcgccacgccccggcgccg

SEQ ID NO: 974781 - RNA, 16 nt, Mycobacterium avium subsp. paratuberculosis
gcgccacgcccgcagc

SEQ ID NO: 974782 - RNA, 14 nt, Mycobacterium avium subsp. paratuberculosis
gcgccacgcuggcg

SEQ ID NO: 974783 - RNA, 23 nt, Mycobacterium avium subsp. paratuberculosis
gcgcagaucgucgaccugcucgu

SEQ ID NO: 974784 - RNA, 22 nt, Mycobacterium avium subsp. paratuberculosis
gcgcagaugaccggccugcagc

SEQ ID NO: 974785 - RNA, 17 nt, Mycobacterium avium subsp. paratuberculosis
gcgcagaucgccagcac

SEQ ID NO: 974786 - RNA, 23 nt, Mycobacterium avium subsp. paratuberculosis
gcgcagaucgcgcaucacccggc

SEQ ID NO: 974787 - RNA, 18 nt, Mycobacterium avium subsp. paratuberculosis
gcgcagcaccgcgucggc

SEQ ID NO: 974788 - RNA, 19 nt, Mycobacterium avium subsp. paratuberculosis
gcgcagcaccgcgucggcg

SEQ ID NO: 974789 - RNA, 13 nt, Mycobacterium avium subsp. paratuberculosis
gcgcagcaccgcg

SEQ ID NO: 974790 - RNA, 16 nt, Mycobacterium avium subsp. paratuberculosis
gcgcagcaccaggccc

SEQ ID NO: 974791 - RNA, 17 nt, Mycobacterium avium subsp. paratuberculosis
gcgcagcaccaggcccu

SEQ ID NO: 974792 - RNA, 17 nt, Mycobacterium avium subsp. paratuberculosis
gcgcagccgcgguggcg

SEQ ID NO: 974793 - RNA, 16 nt, Mycobacterium avium subsp. paratuberculosis
gcgcagcccagccagc

SEQ ID NO: 974794 - RNA, 16 nt, Mycobacterium avium subsp. paratuberculosis
gcgcagcccgagcggc

SEQ ID NO: 974795 - RNA, 17 nt, Mycobacterium avium subsp. paratuberculosis
gcgcagcccgagcggca

SEQ ID NO: 974796 - RNA, 13 nt, Mycobacterium avium subsp. paratuberculosis
gcgcagcccgccg

SEQ ID NO: 974797 - RNA, 14 nt, Mycobacterium avium subsp. paratuberculosis
gcgcagcccgccgg

SEQ ID NO: 974798 - RNA, 21 nt, Mycobacterium avium subsp. paratuberculosis
gcgcagcauggcccacaggac

SEQ ID NO: 974799 - RNA, 14 nt, Mycobacterium avium subsp. paratuberculosis
gcgcagccacgagc

SEQ ID NO: 974800 - RNA, 20 nt, Mycobacterium avium subsp. paratuberculosis
gcgcagccacgagcccagcc

SEQ ID NO: 974801 - RNA, 19 nt, Mycobacterium avium subsp. paratuberculosis
gcgcagccagaccucgccg

SEQ ID NO: 974802 - RNA, 22 nt, Mycobacterium avium subsp. paratuberculosis
gcgcagccagaccucgccgacg

SEQ ID NO: 974803 - RNA, 22 nt, Mycobacterium avium subsp. paratuberculosis
gcgcagcagcguuccgucggcg

SEQ ID NO: 974804 - RNA, 14 nt, Mycobacterium avium subsp. paratuberculosis
gcgcagcauccgca

SEQ ID NO: 974805 - RNA, 15 nt, Mycobacterium avium subsp. paratuberculosis
gcgcagcauccgcac

SEQ ID NO: 974806 - RNA, 16 nt, Mycobacterium avium subsp. paratuberculosis
gcgcagcauccgcacc

SEQ ID NO: 974807 - RNA, 16 nt, Mycobacterium avium subsp. paratuberculosis
gcgcagcagcucgucg

SEQ ID NO: 974808 - RNA, 23 nt, Mycobacterium avium subsp. paratuberculosis
gcgcagcagcggcuugagcgcca

SEQ ID NO: 974809 - RNA, 19 nt, Mycobacterium avium subsp. paratuberculosis
gcgcagcagccaggacagc

SEQ ID NO: 974810 - RNA, 12 nt, Mycobacterium avium subsp. paratuberculosis
gcgcagcaccuc

SEQ ID NO: 974811 - RNA, 17 nt, Mycobacterium avium subsp. paratuberculosis
gcgcaccgcgcguucga

SEQ ID NO: 974812 - RNA, 23 nt, Mycobacterium avium subsp. paratuberculosis
gcgcaccugaaccgcgcacucga

SEQ ID NO: 974813 - RNA, 15 nt, Mycobacterium avium subsp. paratuberculosis
gcgcacgaucugcag

SEQ ID NO: 974814 - RNA, 13 nt, Mycobacterium avium subsp. paratuberculosis
gcgcacgcucgcg

SEQ ID NO: 974815 - RNA, 19 nt, Mycobacterium avium subsp. paratuberculosis
gcgcacgcucgcggugcgc

SEQ ID NO: 974816 - RNA, 13 nt, Mycobacterium avium subsp. paratuberculosis
gcgcaccgcggcc

SEQ ID NO: 974817 - RNA, 14 nt, Mycobacterium avium subsp. paratuberculosis
gcgcaccgcggccu

SEQ ID NO: 974818 - RNA, 15 nt, Mycobacterium avium subsp. paratuberculosis
gcgcaccgcggccuc

SEQ ID NO: 974819 - RNA, 15 nt, Mycobacterium avium subsp. paratuberculosis
gcgcaccgcggcggg

SEQ ID NO: 974820 - RNA, 14 nt, Mycobacterium avium subsp. paratuberculosis
gcgcaccgcgggcu

SEQ ID NO: 974821 - RNA, 23 nt, Mycobacterium avium subsp. paratuberculosis
gcgcaccgcgucgaugcgggccc

SEQ ID NO: 974822 - RNA, 15 nt, Mycobacterium avium subsp. paratuberculosis
gcgcaccggagccuu

SEQ ID NO: 974823 - RNA, 16 nt, Mycobacterium avium subsp. paratuberculosis
gcgcaccgggaccagc

SEQ ID NO: 974824 - RNA, 24 nt, Mycobacterium avium subsp. paratuberculosis
gcgcaccgggaccagcgcggugcc

SEQ ID NO: 974825 - RNA, 15 nt, Mycobacterium avium subsp. paratuberculosis
gcgcaccgggcccgc

SEQ ID NO: 974826 - RNA, 17 nt, Mycobacterium avium subsp. paratuberculosis
gcgcaccgggcccgccc

SEQ ID NO: 974827 - RNA, 18 nt, Mycobacterium avium subsp. paratuberculosis
gcgcaccgggcccgcccg

SEQ ID NO: 974828 - RNA, 15 nt, Mycobacterium avium subsp. paratuberculosis
gcgcaccugcggccc

SEQ ID NO: 974829 - RNA, 17 nt, Mycobacterium avium subsp. paratuberculosis
gcgcagaaccgcacccc

SEQ ID NO: 974830 - RNA, 16 nt, Mycobacterium avium subsp. paratuberculosis
gcgcagaaaugggcca

SEQ ID NO: 974831 - RNA, 15 nt, Mycobacterium avium subsp. paratuberculosis
gcgcacuuccuccuc

SEQ ID NO: 974832 - RNA, 17 nt, Mycobacterium avium subsp. paratuberculosis
gcgcacuuccuccucuu

SEQ ID NO: 974833 - RNA, 18 nt, Mycobacterium avium subsp. paratuberculosis
gcgcacuucgcgggcggc

SEQ ID NO: 974834 - RNA, 15 nt, Mycobacterium avium subsp. paratuberculosis
gcgcacucgaacggc

SEQ ID NO: 974835 - RNA, 18 nt, Mycobacterium avium subsp. paratuberculosis
gcgcacguagcccagcgc

SEQ ID NO: 974836 - RNA, 20 nt, Mycobacterium avium subsp. paratuberculosis
gcgcacgucggccgccaggg

SEQ ID NO: 974837 - RNA, 21 nt, Mycobacterium avium subsp. paratuberculosis
gcgcacguuggcggccagcgc

SEQ ID NO: 974838 - RNA, 15 nt, Mycobacterium avium subsp. paratuberculosis
gcgcacgcugcuggu

SEQ ID NO: 974839 - RNA, 14 nt, Mycobacterium avium subsp. paratuberculosis
gcgcacgcuggccg

SEQ ID NO: 974840 - RNA, 19 nt, Mycobacterium avium subsp. paratuberculosis
gcgcacgcuggccggcagc

SEQ ID NO: 974841 - RNA, 18 nt, Mycobacterium avium subsp. paratuberculosis
gcgcaggaugcccagcac

SEQ ID NO: 974842 - RNA, 19 nt, Mycobacterium avium subsp. paratuberculosis
gcgcaggaacuccagcagc

SEQ ID NO: 974843 - RNA, 17 nt, Mycobacterium avium subsp. paratuberculosis
gcgcagcucgcgcagcu

SEQ ID NO: 974844 - RNA, 16 nt, Mycobacterium avium subsp. paratuberculosis
gcgcagcucggggucg

SEQ ID NO: 974845 - RNA, 13 nt, Mycobacterium avium subsp. paratuberculosis
gcgcagcucgacg

SEQ ID NO: 974846 - RNA, 21 nt, Mycobacterium avium subsp. paratuberculosis
gcgcagcgugucggggucggc

SEQ ID NO: 974847 - RNA, 23 nt, Mycobacterium avium subsp. paratuberculosis
gcgcagcgucggcgugcccgccg

SEQ ID NO: 974848 - RNA, 19 nt, Mycobacterium avium subsp. paratuberculosis
gcgcagcgucuugcccagc

SEQ ID NO: 974849 - RNA, 20 nt, Mycobacterium avium subsp. paratuberculosis
gcgcagcgaccugguccacc

SEQ ID NO: 974850 - RNA, 15 nt, Mycobacterium avium subsp. paratuberculosis
gcgcagccgggcggu

SEQ ID NO: 974851 - RNA, 16 nt, Mycobacterium avium subsp. paratuberculosis
gcgcagcgccgcgccg

SEQ ID NO: 974852 - RNA, 14 nt, Mycobacterium avium subsp. paratuberculosis
gcgcagccggcagc

SEQ ID NO: 974853 - RNA, 13 nt, Mycobacterium avium subsp. paratuberculosis
gcgcagccggccg

SEQ ID NO: 974854 - RNA, 23 nt, Mycobacterium avium subsp. paratuberculosis
gcgcagccgcugcagcgccgccc

SEQ ID NO: 974855 - RNA, 20 nt, Mycobacterium avium subsp. paratuberculosis
gcgcagcgaacgucaggauc

SEQ ID NO: 974856 - RNA, 23 nt, Mycobacterium avium subsp. paratuberculosis
gcgcagcgcgucgucggucaggc

SEQ ID NO: 974857 - RNA, 18 nt, Mycobacterium avium subsp. paratuberculosis
gcgcagcgcgucgcgccc

SEQ ID NO: 974858 - RNA, 13 nt, Mycobacterium avium subsp. paratuberculosis
gcgcagcggggcg

SEQ ID NO: 974859 - RNA, 18 nt, Mycobacterium avium subsp. paratuberculosis
gcgcaggcggcgacggcc

SEQ ID NO: 974860 - RNA, 15 nt, Mycobacterium avium subsp. paratuberculosis
gcgcaggcggcgcgc

SEQ ID NO: 974861 - RNA, 16 nt, Mycobacterium avium subsp. paratuberculosis
gcgcaggcgcgcggcc

SEQ ID NO: 974862 - RNA, 18 nt, Mycobacterium avium subsp. paratuberculosis
gcgcaggcgcgcggccag

SEQ ID NO: 974863 - RNA, 14 nt, Mycobacterium avium subsp. paratuberculosis
gcgcaggcgcgcac

SEQ ID NO: 974864 - RNA, 17 nt, Mycobacterium avium subsp. paratuberculosis
gcgcaggcgcgcaccau

SEQ ID NO: 974865 - RNA, 18 nt, Mycobacterium avium subsp. paratuberculosis
gcgcaggccccggcgcgc

SEQ ID NO: 974866 - RNA, 23 nt, Mycobacterium avium subsp. paratuberculosis
gcgcaguucaccgaaguccgcca

SEQ ID NO: 974867 - RNA, 22 nt, Mycobacterium avium subsp. paratuberculosis
gcgcaguucgggaucgucgccg

SEQ ID NO: 974868 - RNA, 24 nt, Mycobacterium avium subsp. paratuberculosis
gcgcaguucgggaucgucgccggg

SEQ ID NO: 974869 - RNA, 24 nt, Mycobacterium avium subsp. paratuberculosis
gcgcaguagcgcauaggccgcgag

SEQ ID NO: 974870 - RNA, 17 nt, Mycobacterium avium subsp. paratuberculosis
gcgcagguuguccagcc

SEQ ID NO: 974871 - RNA, 19 nt, Mycobacterium avium subsp. paratuberculosis
gcgcagguuguccagccgg

SEQ ID NO: 974872 - RNA, 22 nt, Mycobacterium avium subsp. paratuberculosis
gcgcagguccggcagcgcgccc

SEQ ID NO: 974873 - RNA, 13 nt, Mycobacterium avium subsp. paratuberculosis
gcgcagguccacc

SEQ ID NO: 974874 - RNA, 17 nt, Mycobacterium avium subsp. paratuberculosis
gcgcagguccacccgcc

SEQ ID NO: 974875 - RNA, 19 nt, Mycobacterium avium subsp. paratuberculosis
gcgcagguccacccgcccc

SEQ ID NO: 974876 - RNA, 22 nt, Mycobacterium avium subsp. paratuberculosis
gcgcacaacccggacagcgcga

SEQ ID NO: 974877 - RNA, 16 nt, Mycobacterium avium subsp. paratuberculosis
gcgcacacggccucgc

SEQ ID NO: 974878 - RNA, 16 nt, Mycobacterium avium subsp. paratuberculosis
gcgcacagcgccacac

SEQ ID NO: 974879 - RNA, 17 nt, Mycobacterium avium subsp. paratuberculosis
gcgcacagcgccacacc

SEQ ID NO: 974880 - RNA, 23 nt, Mycobacterium avium subsp. paratuberculosis
gcgcacagaucgucucggccagc

SEQ ID NO: 974881 - RNA, 17 nt, Mycobacterium avium subsp. paratuberculosis
gcgcaccagcaggucuc

SEQ ID NO: 974882 - RNA, 22 nt, Mycobacterium avium subsp. paratuberculosis
gcgcaccaggcgccacagcagc

SEQ ID NO: 974883 - RNA, 12 nt, Mycobacterium avium subsp. paratuberculosis
gcgcaccagggc

SEQ ID NO: 974884 - RNA, 22 nt, Mycobacterium avium subsp. paratuberculosis
gcgcaccacgucggguucgccg

SEQ ID NO: 974885 - RNA, 13 nt, Mycobacterium avium subsp. paratuberculosis
gcgcacccagacg

SEQ ID NO: 974886 - RNA, 14 nt, Mycobacterium avium subsp. paratuberculosis
gcgcacccagccgc

SEQ ID NO: 974887 - RNA, 20 nt, Mycobacterium avium subsp. paratuberculosis
gcgcaccagggccugcagca

SEQ ID NO: 974888 - RNA, 16 nt, Mycobacterium avium subsp. paratuberculosis
gcgcaccagggugucg

SEQ ID NO: 974889 - RNA, 16 nt, Mycobacterium avium subsp. paratuberculosis
gcgcacccccggggcc

SEQ ID NO: 974890 - RNA, 17 nt, Mycobacterium avium subsp. paratuberculosis
gcgcacccccggggccu

SEQ ID NO: 974891 - RNA, 23 nt, Mycobacterium avium subsp. paratuberculosis
gcgcacccccggggccuccagcc

SEQ ID NO: 974892 - RNA, 21 nt, Mycobacterium avium subsp. paratuberculosis
gcgcaccccgaaccgcccgcc

SEQ ID NO: 974893 - RNA, 23 nt, Mycobacterium avium subsp. paratuberculosis
gcgcaccccgaaccgcccgcccg

SEQ ID NO: 974894 - RNA, 13 nt, Mycobacterium avium subsp. paratuberculosis
gcgcaccgccacc

SEQ ID NO: 974895 - RNA, 14 nt, Mycobacterium avium subsp. paratuberculosis
gcgcaccgccagca

SEQ ID NO: 974896 - RNA, 12 nt, Mycobacterium avium subsp. paratuberculosis
gcgcaccgcccc

SEQ ID NO: 974897 - RNA, 16 nt, Mycobacterium avium subsp. paratuberculosis
gcgcaccgagcccguu

SEQ ID NO: 974898 - RNA, 17 nt, Mycobacterium avium subsp. paratuberculosis
gcgcacccgggaccggu

SEQ ID NO: 974899 - RNA, 20 nt, Mycobacterium avium subsp. paratuberculosis
gcgcaacucguccaccagcu

SEQ ID NO: 974900 - RNA, 22 nt, Mycobacterium avium subsp. paratuberculosis
gcgcaacagcauuucgcgcggc

SEQ ID NO: 974901 - RNA, 19 nt, Mycobacterium avium subsp. paratuberculosis
gcgcaacgauucacccagc

SEQ ID NO: 974902 - RNA, 21 nt, Mycobacterium avium subsp. paratuberculosis
gcgcaaccgcggcggcggccc

SEQ ID NO: 974903 - RNA, 17 nt, Mycobacterium avium subsp. paratuberculosis
gcgcaauccugcccggu

SEQ ID NO: 974904 - RNA, 20 nt, Mycobacterium avium subsp. paratuberculosis
gcgcaauacccgaccagcac

SEQ ID NO: 974905 - RNA, 20 nt, Mycobacterium avium subsp. paratuberculosis
gcgcaagcaccggcuggccg

SEQ ID NO: 974906 - RNA, 18 nt, Mycobacterium avium subsp. paratuberculosis
gcgauugcggccgccggc

SEQ ID NO: 974907 - RNA, 14 nt, Mycobacterium avium subsp. paratuberculosis
gcgauucccgccgg

SEQ ID NO: 974908 - RNA, 17 nt, Mycobacterium avium subsp. paratuberculosis
gcgaugucgacggacgg

SEQ ID NO: 974909 - RNA, 21 nt, Mycobacterium avium subsp. paratuberculosis
gcgauguggcguucgaugccc

SEQ ID NO: 974910 - RNA, 19 nt, Mycobacterium avium subsp. paratuberculosis
gcgaugcagaacagccggu

SEQ ID NO: 974911 - RNA, 22 nt, Mycobacterium avium subsp. paratuberculosis
gcgaugcccaagccggccaggc

SEQ ID NO: 974912 - RNA, 14 nt, Mycobacterium avium subsp. paratuberculosis
gcgaugcccgccgg

SEQ ID NO: 974913 - RNA, 15 nt, Mycobacterium avium subsp. paratuberculosis
gcgaugcccgccggc

SEQ ID NO: 974914 - RNA, 16 nt, Mycobacterium avium subsp. paratuberculosis
gcgaugcccgccggcc

SEQ ID NO: 974915 - RNA, 16 nt, Mycobacterium avium subsp. paratuberculosis
gcgaugccguugauca

SEQ ID NO: 974916 - RNA, 15 nt, Mycobacterium avium subsp. paratuberculosis
gcgaugcgcggcccg

SEQ ID NO: 974917 - RNA, 18 nt, Mycobacterium avium subsp. paratuberculosis
gcgaugcgcgccuccgac

SEQ ID NO: 974918 - RNA, 19 nt, Mycobacterium avium subsp. paratuberculosis
gcgaugcgcuccagcaggc

SEQ ID NO: 974919 - RNA, 19 nt, Mycobacterium avium subsp. paratuberculosis
gcgaugcggcccggccacu

SEQ ID NO: 974920 - RNA, 22 nt, Mycobacterium avium subsp. paratuberculosis
gcgaugcggcucaccagguccu

SEQ ID NO: 974921 - RNA, 20 nt, Mycobacterium avium subsp. paratuberculosis
gcgaugccuuccucggcgcu

SEQ ID NO: 974922 - RNA, 15 nt, Mycobacterium avium subsp. paratuberculosis
gcgaugcgcaccauc

SEQ ID NO: 974923 - RNA, 13 nt, Mycobacterium avium subsp. paratuberculosis
gcgauggacagca

SEQ ID NO: 974924 - RNA, 13 nt, Mycobacterium avium subsp. paratuberculosis
gcgauggcggcgc

SEQ ID NO: 974925 - RNA, 15 nt, Mycobacterium avium subsp. paratuberculosis
gcgauggcggcgcgc

SEQ ID NO: 974926 - RNA, 15 nt, Mycobacterium avium subsp. paratuberculosis
gcgauggcgcuggcc

SEQ ID NO: 974927 - RNA, 15 nt, Mycobacterium avium subsp. paratuberculosis
gcgauggcgcggccg

SEQ ID NO: 974928 - RNA, 14 nt, Mycobacterium avium subsp. paratuberculosis
gcgauggcccgcgc

SEQ ID NO: 974929 - RNA, 20 nt, Mycobacterium avium subsp. paratuberculosis
gcgaugggcaauaccggcag

SEQ ID NO: 974930 - RNA, 18 nt, Mycobacterium avium subsp. paratuberculosis
gcgaugggugaucgcggc

SEQ ID NO: 974931 - RNA, 19 nt, Mycobacterium avium subsp. paratuberculosis
gcgauggugcugcccggcg

SEQ ID NO: 974932 - RNA, 16 nt, Mycobacterium avium subsp. paratuberculosis
gcgaucuccagcggcc

SEQ ID NO: 974933 - RNA, 23 nt, Mycobacterium avium subsp. paratuberculosis
gcgaucucggcggccgcguccuc

SEQ ID NO: 974934 - RNA, 20 nt, Mycobacterium avium subsp. paratuberculosis
gcgaucuggcgguuggacag

SEQ ID NO: 974935 - RNA, 11 nt, Mycobacterium avium subsp. paratuberculosis
gcgaucggcag

SEQ ID NO: 974936 - RNA, 14 nt, Mycobacterium avium subsp. paratuberculosis
gcgaucggcggcuc

SEQ ID NO: 974937 - RNA, 20 nt, Mycobacterium avium subsp. paratuberculosis
gcgaucggcggcucgccggc

SEQ ID NO: 974938 - RNA, 21 nt, Mycobacterium avium subsp. paratuberculosis
gcgaucggcggcucgccggcg

SEQ ID NO: 974939 - RNA, 23 nt, Mycobacterium avium subsp. paratuberculosis
gcgaucggcgguccgccgcagcg

SEQ ID NO: 974940 - RNA, 13 nt, Mycobacterium avium subsp. paratuberculosis
gcgaucgggaaca

SEQ ID NO: 974941 - RNA, 15 nt, Mycobacterium avium subsp. paratuberculosis
gcgaucgggaacagc

SEQ ID NO: 974942 - RNA, 20 nt, Mycobacterium avium subsp. paratuberculosis
gcgaucggugaacccgccgg

SEQ ID NO: 974943 - RNA, 22 nt, Mycobacterium avium subsp. paratuberculosis
gcgaucggugaacccgccggcg

SEQ ID NO: 974944 - RNA, 14 nt, Mycobacterium avium subsp. paratuberculosis
gcgaucaacaccgg

SEQ ID NO: 974945 - RNA, 17 nt, Mycobacterium avium subsp. paratuberculosis
gcgaucacgaagaacuu

SEQ ID NO: 974946 - RNA, 15 nt, Mycobacterium avium subsp. paratuberculosis
gcgaucaccgcggcc

SEQ ID NO: 974947 - RNA, 18 nt, Mycobacterium avium subsp. paratuberculosis
gcgaucaccgcggccacc

SEQ ID NO: 974948 - RNA, 16 nt, Mycobacterium avium subsp. paratuberculosis
gcgaggacgucgagcg

SEQ ID NO: 974949 - RNA, 19 nt, Mycobacterium avium subsp. paratuberculosis
gcgaggacgucgagcggcg

SEQ ID NO: 974950 - RNA, 16 nt, Mycobacterium avium subsp. paratuberculosis
gcgagcuuggcgggcg

SEQ ID NO: 974951 - RNA, 20 nt, Mycobacterium avium subsp. paratuberculosis
gcgaggaaguccggcgcgcc

SEQ ID NO: 974952 - RNA, 21 nt, Mycobacterium avium subsp. paratuberculosis
gcgaggaaguccggcgcgccc

SEQ ID NO: 974953 - RNA, 23 nt, Mycobacterium avium subsp. paratuberculosis
gcgaggaaguccggcgcgcccgg

SEQ ID NO: 974954 - RNA, 20 nt, Mycobacterium avium subsp. paratuberculosis
gcgaggaaucgcggcaggcg

SEQ ID NO: 974955 - RNA, 15 nt, Mycobacterium avium subsp. paratuberculosis
gcgagcuggccgccc

SEQ ID NO: 974956 - RNA, 15 nt, Mycobacterium avium subsp. paratuberculosis
gcgagcugccccuuc

SEQ ID NO: 974957 - RNA, 21 nt, Mycobacterium avium subsp. paratuberculosis
gcgagcugcgggugcucagcc

SEQ ID NO: 974958 - RNA, 22 nt, Mycobacterium avium subsp. paratuberculosis
gcgagcugcgggugcucagccu

SEQ ID NO: 974959 - RNA, 22 nt, Mycobacterium avium subsp. paratuberculosis
gcgagcugcuucgucgccgggc

SEQ ID NO: 974960 - RNA, 19 nt, Mycobacterium avium subsp. paratuberculosis
gcgagccggcacgcgcgcc

SEQ ID NO: 974961 - RNA, 21 nt, Mycobacterium avium subsp. paratuberculosis
gcgagccggcccggggugugc

SEQ ID NO: 974962 - RNA, 15 nt, Mycobacterium avium subsp. paratuberculosis
gcgagcucaggccgg

SEQ ID NO: 974963 - RNA, 16 nt, Mycobacterium avium subsp. paratuberculosis
gcgaguucggcggccc

SEQ ID NO: 974964 - RNA, 20 nt, Mycobacterium avium subsp. paratuberculosis
gcgaguucggcggcccgcuu

SEQ ID NO: 974965 - RNA, 21 nt, Mycobacterium avium subsp. paratuberculosis
gcgaguucgaugacgucgcgc

SEQ ID NO: 974966 - RNA, 22 nt, Mycobacterium avium subsp. paratuberculosis
gcgauaaccucggcggcggcgc

SEQ ID NO: 974967 - RNA, 14 nt, Mycobacterium avium subsp. paratuberculosis
gcgauaggcggcca

SEQ ID NO: 974968 - RNA, 16 nt, Mycobacterium avium subsp. paratuberculosis
gcgauagggccggccg

SEQ ID NO: 974969 - RNA, 17 nt, Mycobacterium avium subsp. paratuberculosis
gcgauagggccggccgg

SEQ ID NO: 974970 - RNA, 14 nt, Mycobacterium avium subsp. paratuberculosis
gcgacggccagcgc

SEQ ID NO: 974971 - RNA, 18 nt, Mycobacterium avium subsp. paratuberculosis
gcgacggcaccgccggcg

SEQ ID NO: 974972 - RNA, 13 nt, Mycobacterium avium subsp. paratuberculosis
gcgacggcagcac

SEQ ID NO: 974973 - RNA, 23 nt, Mycobacterium avium subsp. paratuberculosis
gcgacggcagcaccucgcgcagc

SEQ ID NO: 974974 - RNA, 19 nt, Mycobacterium avium subsp. paratuberculosis
gcgacggccucgccgucgc

SEQ ID NO: 974975 - RNA, 15 nt, Mycobacterium avium subsp. paratuberculosis
gcgacggcccgccgg

SEQ ID NO: 974976 - RNA, 13 nt, Mycobacterium avium subsp. paratuberculosis
gcgacggccgggu

SEQ ID NO: 974977 - RNA, 17 nt, Mycobacterium avium subsp. paratuberculosis
gcgacgggcacccgcgc

SEQ ID NO: 974978 - RNA, 14 nt, Mycobacterium avium subsp. paratuberculosis
gcgacgggccgggc

SEQ ID NO: 974979 - RNA, 17 nt, Mycobacterium avium subsp. paratuberculosis
gcgacgggccgggcacg

SEQ ID NO: 974980 - RNA, 14 nt, Mycobacterium avium subsp. paratuberculosis
gcgacggcgcccgc

SEQ ID NO: 974981 - RNA, 14 nt, Mycobacterium avium subsp. paratuberculosis
gcgacggcgacggc

SEQ ID NO: 974982 - RNA, 12 nt, Mycobacterium avium subsp. paratuberculosis
gcgacggcgccc

SEQ ID NO: 974983 - RNA, 14 nt, Mycobacterium avium subsp. paratuberculosis
gcgacggcgcguga

SEQ ID NO: 974984 - RNA, 18 nt, Mycobacterium avium subsp. paratuberculosis
gcgacggcguccagcugc

SEQ ID NO: 974985 - RNA, 18 nt, Mycobacterium avium subsp. paratuberculosis
gcgacggcgucggcgagc

SEQ ID NO: 974986 - RNA, 22 nt, Mycobacterium avium subsp. paratuberculosis
gcgacggcgucggcggccugcu

SEQ ID NO: 974987 - RNA, 19 nt, Mycobacterium avium subsp. paratuberculosis
gcgacggcucuucgcggcg

SEQ ID NO: 974988 - RNA, 18 nt, Mycobacterium avium subsp. paratuberculosis
gcgaaggugccccgcugg

SEQ ID NO: 974989 - RNA, 17 nt, Mycobacterium avium subsp. paratuberculosis
gcgaaggcucgccacgc

SEQ ID NO: 974990 - RNA, 15 nt, Mycobacterium avium subsp. paratuberculosis
gcgaaguagcgggcg

SEQ ID NO: 974991 - RNA, 21 nt, Mycobacterium avium subsp. paratuberculosis
gcgaagucaucaccggggauc

SEQ ID NO: 974992 - RNA, 15 nt, Mycobacterium avium subsp. paratuberculosis
gcgaagucccacugc

SEQ ID NO: 974993 - RNA, 17 nt, Mycobacterium avium subsp. paratuberculosis
gcgaagcucgacgauga

SEQ ID NO: 974994 - RNA, 17 nt, Mycobacterium avium subsp. paratuberculosis
gcgaagcguaugccggu

SEQ ID NO: 974995 - RNA, 20 nt, Mycobacterium avium subsp. paratuberculosis
gcgaagcguuucagcaaccc

SEQ ID NO: 974996 - RNA, 17 nt, Mycobacterium avium subsp. paratuberculosis
gcgaaggcaucccgcuu

SEQ ID NO: 974997 - RNA, 16 nt, Mycobacterium avium subsp. paratuberculosis
gcgagacgagccgccg

SEQ ID NO: 974998 - RNA, 18 nt, Mycobacterium avium subsp. paratuberculosis
gcgagaguaucgccacgc

SEQ ID NO: 974999 - RNA, 12 nt, Mycobacterium avium subsp. paratuberculosis
gcgagccgagcc

SEQ ID NO: 975000 - RNA, 20 nt, Mycobacterium avium subsp. paratuberculosis
gcgagccgacagucgcgggc

SEQ ID NO: 975001 - RNA, 21 nt, Mycobacterium avium subsp. paratuberculosis
gcgagccgacagucgcgggcg

SEQ ID NO: 975002 - RNA, 17 nt, Mycobacterium avium subsp. paratuberculosis
gcgagaaaaucgcccgc

SEQ ID NO: 975003 - RNA, 17 nt, Mycobacterium avium subsp. paratuberculosis
gcgagaagucgccgacg

SEQ ID NO: 975004 - RNA, 18 nt, Mycobacterium avium subsp. paratuberculosis
gcgagaagucgccgacgc

SEQ ID NO: 975005 - RNA, 17 nt, Mycobacterium avium subsp. paratuberculosis
gcgagaagucgcucagc

SEQ ID NO: 975006 - RNA, 15 nt, Mycobacterium avium subsp. paratuberculosis
gcgacuccagcagcg

SEQ ID NO: 975007 - RNA, 17 nt, Mycobacterium avium subsp. paratuberculosis
gcgacucgaccccgccc

SEQ ID NO: 975008 - RNA, 21 nt, Mycobacterium avium subsp. paratuberculosis
gcgacucgaccccgcccagcg

SEQ ID NO: 975009 - RNA, 13 nt, Mycobacterium avium subsp. paratuberculosis
gccuguccagccg

SEQ ID NO: 975010 - RNA, 14 nt, Mycobacterium avium subsp. paratuberculosis
gccuguccagccgg

SEQ ID NO: 975011 - RNA, 21 nt, Mycobacterium avium subsp. paratuberculosis
gccugguagggguccuccagc

SEQ ID NO: 975012 - RNA, 16 nt, Mycobacterium avium subsp. paratuberculosis
gccugguccucccggg

SEQ ID NO: 975013 - RNA, 17 nt, Mycobacterium avium subsp. paratuberculosis
gccuggucgaacagcac

SEQ ID NO: 975014 - RNA, 15 nt, Mycobacterium avium subsp. paratuberculosis
gccuggcggaaggcc

SEQ ID NO: 975015 - RNA, 19 nt, Mycobacterium avium subsp. paratuberculosis
gccuggcggaaggccgcgc

SEQ ID NO: 975016 - RNA, 15 nt, Mycobacterium avium subsp. paratuberculosis
gccuggcgcuccagc

SEQ ID NO: 975017 - RNA, 16 nt, Mycobacterium avium subsp. paratuberculosis
gccuggcgcuccagcc

SEQ ID NO: 975018 - RNA, 19 nt, Mycobacterium avium subsp. paratuberculosis
gccuggcgcuccagccacu

SEQ ID NO: 975019 - RNA, 19 nt, Mycobacterium avium subsp. paratuberculosis
gccucuucggcgcgccggc

SEQ ID NO: 975020 - RNA, 20 nt, Mycobacterium avium subsp. paratuberculosis
gccugcccuugaagcgcaga

SEQ ID NO: 975021 - RNA, 16 nt, Mycobacterium avium subsp. paratuberculosis
gccugcccgggcgccg

SEQ ID NO: 975022 - RNA, 24 nt, Mycobacterium avium subsp. paratuberculosis
gccugccggaugccgcgcggcgcc

SEQ ID NO: 975023 - RNA, 13 nt, Mycobacterium avium subsp. paratuberculosis
gccugccggccgc

SEQ ID NO: 975024 - RNA, 16 nt, Mycobacterium avium subsp. paratuberculosis
gccugccggccgccgc

SEQ ID NO: 975025 - RNA, 15 nt, Mycobacterium avium subsp. paratuberculosis
gccugcgcggccgcg

SEQ ID NO: 975026 - RNA, 14 nt, Mycobacterium avium subsp. paratuberculosis
gccugcgcggcggc

SEQ ID NO: 975027 - RNA, 15 nt, Mycobacterium avium subsp. paratuberculosis
gccugcgcgggcgcg

SEQ ID NO: 975028 - RNA, 22 nt, Mycobacterium avium subsp. paratuberculosis
gccugccguuggggaucguguc

SEQ ID NO: 975029 - RNA, 15 nt, Mycobacterium avium subsp. paratuberculosis
gccugcggccugcac

SEQ ID NO: 975030 - RNA, 15 nt, Mycobacterium avium subsp. paratuberculosis
gccugcggcgcggcc

SEQ ID NO: 975031 - RNA, 12 nt, Mycobacterium avium subsp. paratuberculosis
gccugcggcggc

SEQ ID NO: 975032 - RNA, 22 nt, Mycobacterium avium subsp. paratuberculosis
gccugcggcggcaacggguugc

SEQ ID NO: 975033 - RNA, 18 nt, Mycobacterium avium subsp. paratuberculosis
gccugcggcggccgcagc

SEQ ID NO: 975034 - RNA, 16 nt, Mycobacterium avium subsp. paratuberculosis
gccugcggcaacagca

SEQ ID NO: 975035 - RNA, 21 nt, Mycobacterium avium subsp. paratuberculosis
gccugcucgucggggcagccg

SEQ ID NO: 975036 - RNA, 17 nt, Mycobacterium avium subsp. paratuberculosis
gccugcgggcccagcuc

SEQ ID NO: 975037 - RNA, 16 nt, Mycobacterium avium subsp. paratuberculosis
gccugcgggcgccggc

SEQ ID NO: 975038 - RNA, 23 nt, Mycobacterium avium subsp. paratuberculosis
gccugcuguuccucgaacaggcu

SEQ ID NO: 975039 - RNA, 12 nt, Mycobacterium avium subsp. paratuberculosis
gccugcuucugg

SEQ ID NO: 975040 - RNA, 23 nt, Mycobacterium avium subsp. paratuberculosis
gccugcuugaugaugccggccgc

SEQ ID NO: 975041 - RNA, 18 nt, Mycobacterium avium subsp. paratuberculosis
gccuggccgucgcggcgc

SEQ ID NO: 975042 - RNA, 14 nt, Mycobacterium avium subsp. paratuberculosis
gccuggcccagaca

SEQ ID NO: 975043 - RNA, 21 nt, Mycobacterium avium subsp. paratuberculosis
gccuggcccagacaggccggc

SEQ ID NO: 975044 - RNA, 13 nt, Mycobacterium avium subsp. paratuberculosis
gccuggcccagcc

SEQ ID NO: 975045 - RNA, 18 nt, Mycobacterium avium subsp. paratuberculosis
gccuuuccgcgcggcggg

SEQ ID NO: 975046 - RNA, 15 nt, Mycobacterium avium subsp. paratuberculosis
gccuuggccguaggu

SEQ ID NO: 975047 - RNA, 14 nt, Mycobacterium avium subsp. paratuberculosis
gccuuggcccgcgc

SEQ ID NO: 975048 - RNA, 18 nt, Mycobacterium avium subsp. paratuberculosis
gccuuggcccgcgcccgc

SEQ ID NO: 975049 - RNA, 16 nt, Mycobacterium avium subsp. paratuberculosis
gccuuggcccgcgcgg

SEQ ID NO: 975050 - RNA, 20 nt, Mycobacterium avium subsp. paratuberculosis
gccuuggcccgcgcggccgc

SEQ ID NO: 975051 - RNA, 16 nt, Mycobacterium avium subsp. paratuberculosis
gccuugguccgcaacg

SEQ ID NO: 975052 - RNA, 14 nt, Mycobacterium avium subsp. paratuberculosis
gccuucaccagggu

SEQ ID NO: 975053 - RNA, 18 nt, Mycobacterium avium subsp. paratuberculosis
gccuucacgaccggcagc

SEQ ID NO: 975054 - RNA, 16 nt, Mycobacterium avium subsp. paratuberculosis
gccuucggcgccagcc

SEQ ID NO: 975055 - RNA, 18 nt, Mycobacterium avium subsp. paratuberculosis
gccuucggcgccagcccg

SEQ ID NO: 975056 - RNA, 22 nt, Mycobacterium avium subsp. paratuberculosis
gccuugaaccggcuggacaccc

SEQ ID NO: 975057 - RNA, 22 nt, Mycobacterium avium subsp. paratuberculosis
gccuugaccacggugcgcucgu

SEQ ID NO: 975058 - RNA, 23 nt, Mycobacterium avium subsp. paratuberculosis
gccuugaucggguaacccuccgg

SEQ ID NO: 975059 - RNA, 17 nt, Mycobacterium avium subsp. paratuberculosis
gccuugaucuuggccug

SEQ ID NO: 975060 - RNA, 20 nt, Mycobacterium avium subsp. paratuberculosis
gccuugaucuuggccugggc

SEQ ID NO: 975061 - RNA, 16 nt, Mycobacterium avium subsp. paratuberculosis
gccuugacgccgggca

SEQ ID NO: 975062 - RNA, 19 nt, Mycobacterium avium subsp. paratuberculosis
gcgaacuugcuggccgagu

SEQ ID NO: 975063 - RNA, 19 nt, Mycobacterium avium subsp. paratuberculosis
gcgaagacgucggcgcggu

SEQ ID NO: 975064 - RNA, 21 nt, Mycobacterium avium subsp. paratuberculosis
gcgaacuacuucgucagcagc

SEQ ID NO: 975065 - RNA, 21 nt, Mycobacterium avium subsp. paratuberculosis
gcgaacuccagaucgccgccc

SEQ ID NO: 975066 - RNA, 23 nt, Mycobacterium avium subsp. paratuberculosis
gcgaacuccagaucgccgcccau

SEQ ID NO: 975067 - RNA, 16 nt, Mycobacterium avium subsp. paratuberculosis
gcgaacucgcggcggg

SEQ ID NO: 975068 - RNA, 23 nt, Mycobacterium avium subsp. paratuberculosis
gcgaacucgucgacgcccaccug

SEQ ID NO: 975069 - RNA, 13 nt, Mycobacterium avium subsp. paratuberculosis
gcgaacugcacca

SEQ ID NO: 975070 - RNA, 19 nt, Mycobacterium avium subsp. paratuberculosis
gcgaacgccucguuggcca

SEQ ID NO: 975071 - RNA, 19 nt, Mycobacterium avium subsp. paratuberculosis
gcgaacugcuugaucaggu

SEQ ID NO: 975072 - RNA, 22 nt, Mycobacterium avium subsp. paratuberculosis
gcgaagccgugacccgccguga

SEQ ID NO: 975073 - RNA, 19 nt, Mycobacterium avium subsp. paratuberculosis
gcgaagcgcgaugcggcuc

SEQ ID NO: 975074 - RNA, 21 nt, Mycobacterium avium subsp. paratuberculosis
gcgaagccggccccgcccggg

SEQ ID NO: 975075 - RNA, 19 nt, Mycobacterium avium subsp. paratuberculosis
gcgaagcccaugccgaugc

SEQ ID NO: 975076 - RNA, 15 nt, Mycobacterium avium subsp. paratuberculosis
gcgaagaugucgccg

SEQ ID NO: 975077 - RNA, 16 nt, Mycobacterium avium subsp. paratuberculosis
gcgaacgcgucccggg

SEQ ID NO: 975078 - RNA, 20 nt, Mycobacterium avium subsp. paratuberculosis
gcgaacgggugaccggcggc

SEQ ID NO: 975079 - RNA, 18 nt, Mycobacterium avium subsp. paratuberculosis
gcgaaccgccgcacccag

SEQ ID NO: 975080 - RNA, 15 nt, Mycobacterium avium subsp. paratuberculosis
gcgaacccggcgccc

SEQ ID NO: 975081 - RNA, 20 nt, Mycobacterium avium subsp. paratuberculosis
gcgaacccgagcaccccggc

SEQ ID NO: 975082 - RNA, 14 nt, Mycobacterium avium subsp. paratuberculosis
gcgaacaucgccag

SEQ ID NO: 975083 - RNA, 18 nt, Mycobacterium avium subsp. paratuberculosis
gcgaacaucgccagcaac

SEQ ID NO: 975084 - RNA, 19 nt, Mycobacterium avium subsp. paratuberculosis
gcgaaccagcaugcgccag

SEQ ID NO: 975085 - RNA, 19 nt, Mycobacterium avium subsp. paratuberculosis
gcgaaauaacccaccccga

SEQ ID NO: 975086 - RNA, 15 nt, Mycobacterium avium subsp. paratuberculosis
gcgaacaccagcacc

SEQ ID NO: 975087 - RNA, 13 nt, Mycobacterium avium subsp. paratuberculosis
gcgaacaggaugc

SEQ ID NO: 975088 - RNA, 19 nt, Mycobacterium avium subsp. paratuberculosis
gcgaacaggaugcggguga

SEQ ID NO: 975089 - RNA, 14 nt, Mycobacterium avium subsp. paratuberculosis
gcgaacagcgcggc

SEQ ID NO: 975090 - RNA, 15 nt, Mycobacterium avium subsp. paratuberculosis
gcgaacagcgcggcc

SEQ ID NO: 975091 - RNA, 19 nt, Mycobacterium avium subsp. paratuberculosis
gcgaaagcccaggcccggc

SEQ ID NO: 975092 - RNA, 14 nt, Mycobacterium avium subsp. paratuberculosis
gcgaaagcgcgagg

SEQ ID NO: 975093 - RNA, 23 nt, Mycobacterium avium subsp. paratuberculosis
gcgaaagcgcgagggcucaacag

SEQ ID NO: 975094 - RNA, 17 nt, Mycobacterium avium subsp. paratuberculosis
gccuuuugcacccgcca

SEQ ID NO: 975095 - RNA, 16 nt, Mycobacterium avium subsp. paratuberculosis
gccucaccccagcgcg

SEQ ID NO: 975096 - RNA, 20 nt, Mycobacterium avium subsp. paratuberculosis
gccucaggcugacgccacgc

SEQ ID NO: 975097 - RNA, 14 nt, Mycobacterium avium subsp. paratuberculosis
gccucagggcgcgc

SEQ ID NO: 975098 - RNA, 15 nt, Mycobacterium avium subsp. paratuberculosis
gccucagggcgcgcu

SEQ ID NO: 975099 - RNA, 21 nt, Mycobacterium avium subsp. paratuberculosis
gccuccacauacgcggcggcc

SEQ ID NO: 975100 - RNA, 13 nt, Mycobacterium avium subsp. paratuberculosis
gccuccaccacca

SEQ ID NO: 975101 - RNA, 12 nt, Mycobacterium avium subsp. paratuberculosis
gccuccaccagc

SEQ ID NO: 975102 - RNA, 14 nt, Mycobacterium avium subsp. paratuberculosis
gccuccaccagcgg

SEQ ID NO: 975103 - RNA, 18 nt, Mycobacterium avium subsp. paratuberculosis
gccuccccauccgcggcc

SEQ ID NO: 975104 - RNA, 19 nt, Mycobacterium avium subsp. paratuberculosis
gccuccccauccgcggcca

SEQ ID NO: 975105 - RNA, 13 nt, Mycobacterium avium subsp. paratuberculosis
gccucccgcagcg

SEQ ID NO: 975106 - RNA, 20 nt, Mycobacterium avium subsp. paratuberculosis
gccucccgguaggcggcgag

SEQ ID NO: 975107 - RNA, 18 nt, Mycobacterium avium subsp. paratuberculosis
gccuccgaauccagcgcg

SEQ ID NO: 975108 - RNA, 19 nt, Mycobacterium avium subsp. paratuberculosis
gccuccgaauccagcgcgc

SEQ ID NO: 975109 - RNA, 15 nt, Mycobacterium avium subsp. paratuberculosis
gccuccgagcggcgc

SEQ ID NO: 975110 - RNA, 16 nt, Mycobacterium avium subsp. paratuberculosis
gccuccgagcggcgca

SEQ ID NO: 975111 - RNA, 17 nt, Mycobacterium avium subsp. paratuberculosis
gccuccgagcggcgcag

SEQ ID NO: 975112 - RNA, 20 nt, Mycobacterium avium subsp. paratuberculosis
gccuccgagcggcgcaggcc

SEQ ID NO: 975113 - RNA, 18 nt, Mycobacterium avium subsp. paratuberculosis
gccuccauucgggccagc

SEQ ID NO: 975114 - RNA, 20 nt, Mycobacterium avium subsp. paratuberculosis
gccuccagguucgccgccca

SEQ ID NO: 975115 - RNA, 17 nt, Mycobacterium avium subsp. paratuberculosis
gccuccagccagcgcgc

SEQ ID NO: 975116 - RNA, 12 nt, Mycobacterium avium subsp. paratuberculosis
gccuccagccgc

SEQ ID NO: 975117 - RNA, 14 nt, Mycobacterium avium subsp. paratuberculosis
gccuccagccgcgc

SEQ ID NO: 975118 - RNA, 13 nt, Mycobacterium avium subsp. paratuberculosis
gccuccagccgcu

SEQ ID NO: 975119 - RNA, 14 nt, Mycobacterium avium subsp. paratuberculosis
gccuccagccgcuc

SEQ ID NO: 975120 - RNA, 18 nt, Mycobacterium avium subsp. paratuberculosis
gccuccagccgcuccucg

SEQ ID NO: 975121 - RNA, 22 nt, Mycobacterium avium subsp. paratuberculosis
gccuccagccgcuccucguuga

SEQ ID NO: 975122 - RNA, 14 nt, Mycobacterium avium subsp. paratuberculosis
gccuccggcggcag

SEQ ID NO: 975123 - RNA, 17 nt, Mycobacterium avium subsp. paratuberculosis
gccuccgucagcgccgc

SEQ ID NO: 975124 - RNA, 15 nt, Mycobacterium avium subsp. paratuberculosis
gccuccgugcuggcc

SEQ ID NO: 975125 - RNA, 20 nt, Mycobacterium avium subsp. paratuberculosis
gccuccuccucgcugccggc

SEQ ID NO: 975126 - RNA, 17 nt, Mycobacterium avium subsp. paratuberculosis
gccuccuguuggcccug

SEQ ID NO: 975127 - RNA, 17 nt, Mycobacterium avium subsp. paratuberculosis
gccucgaagucgccggc

SEQ ID NO: 975128 - RNA, 19 nt, Mycobacterium avium subsp. paratuberculosis
gccuccugcuggcgcugcc

SEQ ID NO: 975129 - RNA, 21 nt, Mycobacterium avium subsp. paratuberculosis
gccucggcgucccggcgucuc

SEQ ID NO: 975130 - RNA, 21 nt, Mycobacterium avium subsp. paratuberculosis
gccucggcgaucggccgcugc

SEQ ID NO: 975131 - RNA, 20 nt, Mycobacterium avium subsp. paratuberculosis
gccucggcgcugcccgccgc

SEQ ID NO: 975132 - RNA, 19 nt, Mycobacterium avium subsp. paratuberculosis
gccucggcgaccgcccggg

SEQ ID NO: 975133 - RNA, 12 nt, Mycobacterium avium subsp. paratuberculosis
gccucggccugc

SEQ ID NO: 975134 - RNA, 14 nt, Mycobacterium avium subsp. paratuberculosis
gccucggccuuggc

SEQ ID NO: 975135 - RNA, 20 nt, Mycobacterium avium subsp. paratuberculosis
gccucggccuuggccaccgc

SEQ ID NO: 975136 - RNA, 18 nt, Mycobacterium avium subsp. paratuberculosis
gccucggcccucaggugg

SEQ ID NO: 975137 - RNA, 13 nt, Mycobacterium avium subsp. paratuberculosis
gccucggccgcgg

SEQ ID NO: 975138 - RNA, 13 nt, Mycobacterium avium subsp. paratuberculosis
gccucggccagca

SEQ ID NO: 975139 - RNA, 19 nt, Mycobacterium avium subsp. paratuberculosis
gccucggccaccagaugcc

SEQ ID NO: 975140 - RNA, 20 nt, Mycobacterium avium subsp. paratuberculosis
gccucguuggccagcucggc

SEQ ID NO: 975141 - RNA, 21 nt, Mycobacterium avium subsp. paratuberculosis
gccucgucgagguacugcagc

SEQ ID NO: 975142 - RNA, 15 nt, Mycobacterium avium subsp. paratuberculosis
gccucgucggcgagc

SEQ ID NO: 975143 - RNA, 14 nt, Mycobacterium avium subsp. paratuberculosis
gccucgucggcgcc

SEQ ID NO: 975144 - RNA, 19 nt, Mycobacterium avium subsp. paratuberculosis
gccucgucggcgccgucgc

SEQ ID NO: 975145 - RNA, 18 nt, Mycobacterium avium subsp. paratuberculosis
gccucgucgagccgggcc

SEQ ID NO: 975146 - RNA, 20 nt, Mycobacterium avium subsp. paratuberculosis
gccucgucgaugucggcggc

SEQ ID NO: 975147 - RNA, 22 nt, Mycobacterium avium subsp. paratuberculosis
gccucgucgaugucggcggccc

SEQ ID NO: 975148 - RNA, 15 nt, Mycobacterium avium subsp. paratuberculosis
gccucggucgcguga

SEQ ID NO: 975149 - RNA, 24 nt, Mycobacterium avium subsp. paratuberculosis
gccucggugaagccgcggacggcg

SEQ ID NO: 975150 - RNA, 21 nt, Mycobacterium avium subsp. paratuberculosis
gccucgggggugaaggcggcc

SEQ ID NO: 975151 - RNA, 17 nt, Mycobacterium avium subsp. paratuberculosis
gccucggcgggccgccc

SEQ ID NO: 975152 - RNA, 21 nt, Mycobacterium avium subsp. paratuberculosis
gccucggcgggccgcccggcg

SEQ ID NO: 975153 - RNA, 16 nt, Mycobacterium avium subsp. paratuberculosis
gccucgggccggcagc

SEQ ID NO: 975154 - RNA, 18 nt, Mycobacterium avium subsp. paratuberculosis
gccucgggccggcagccg

SEQ ID NO: 975155 - RNA, 20 nt, Mycobacterium avium subsp. paratuberculosis
gccucgggccggcagccggc

SEQ ID NO: 975156 - RNA, 16 nt, Mycobacterium avium subsp. paratuberculosis
gccucgcccucggugu

SEQ ID NO: 975157 - RNA, 12 nt, Mycobacterium avium subsp. paratuberculosis
gccucgccagcc

SEQ ID NO: 975158 - RNA, 14 nt, Mycobacterium avium subsp. paratuberculosis
gccucgccagcccc

SEQ ID NO: 975159 - RNA, 15 nt, Mycobacterium avium subsp. paratuberculosis
gccucgcccagcgcc

SEQ ID NO: 975160 - RNA, 17 nt, Mycobacterium avium subsp. paratuberculosis
gccucgcccagcgccgc

SEQ ID NO: 975161 - RNA, 19 nt, Mycobacterium avium subsp. paratuberculosis
gccucgagcaacggccgca

SEQ ID NO: 975162 - RNA, 21 nt, Mycobacterium avium subsp. paratuberculosis
gccucgacgauugucggggcc

SEQ ID NO: 975163 - RNA, 20 nt, Mycobacterium avium subsp. paratuberculosis
gccucgaccaggcuuggccc

SEQ ID NO: 975164 - RNA, 19 nt, Mycobacterium avium subsp. paratuberculosis
gccucgaucugguucaccg

SEQ ID NO: 975165 - RNA, 19 nt, Mycobacterium avium subsp. paratuberculosis
gccucgaugcggguguugc

SEQ ID NO: 975166 - RNA, 16 nt, Mycobacterium avium subsp. paratuberculosis
gccucgaucagagcgg

SEQ ID NO: 975167 - RNA, 18 nt, Mycobacterium avium subsp. paratuberculosis
gccucgaggaucgcggcc

SEQ ID NO: 975168 - RNA, 16 nt, Mycobacterium avium subsp. paratuberculosis
gccgugaagggcccgc

SEQ ID NO: 975169 - RNA, 20 nt, Mycobacterium avium subsp. paratuberculosis
gccgugcggcacgccgcagc

SEQ ID NO: 975170 - RNA, 17 nt, Mycobacterium avium subsp. paratuberculosis
gccgugcgccccgcccu

SEQ ID NO: 975171 - RNA, 22 nt, Mycobacterium avium subsp. paratuberculosis
gccgugcgcgcuggugcugccg

SEQ ID NO: 975172 - RNA, 16 nt, Mycobacterium avium subsp. paratuberculosis
gccgugcggcguucgg

SEQ ID NO: 975173 - RNA, 14 nt, Mycobacterium avium subsp. paratuberculosis
gccgugcggcggcg

SEQ ID NO: 975174 - RNA, 16 nt, Mycobacterium avium subsp. paratuberculosis
gccgugcucggcggcg

SEQ ID NO: 975175 - RNA, 21 nt, Mycobacterium avium subsp. paratuberculosis
gccguggcccauguggccuga

SEQ ID NO: 975176 - RNA, 13 nt, Mycobacterium avium subsp. paratuberculosis
gccguggcccgcc

SEQ ID NO: 975177 - RNA, 14 nt, Mycobacterium avium subsp. paratuberculosis
gccguggcaccggg

SEQ ID NO: 975178 - RNA, 16 nt, Mycobacterium avium subsp. paratuberculosis
gccguggcaccgggug

SEQ ID NO: 975179 - RNA, 13 nt, Mycobacterium avium subsp. paratuberculosis
gccguggcagggc

SEQ ID NO: 975180 - RNA, 17 nt, Mycobacterium avium subsp. paratuberculosis
gccguggcagggccagc

SEQ ID NO: 975181 - RNA, 22 nt, Mycobacterium avium subsp. paratuberculosis
gccguuccaucgggcccagcag

SEQ ID NO: 975182 - RNA, 23 nt, Mycobacterium avium subsp. paratuberculosis
gccguuccaucgggcccagcagc

SEQ ID NO: 975183 - RNA, 23 nt, Mycobacterium avium subsp. paratuberculosis
gccuacuugcguugcgcggcggc

SEQ ID NO: 975184 - RNA, 19 nt, Mycobacterium avium subsp. paratuberculosis
gccuagccuuggccgcagg

SEQ ID NO: 975185 - RNA, 17 nt, Mycobacterium avium subsp. paratuberculosis
gccguuguaggccgcgc

SEQ ID NO: 975186 - RNA, 20 nt, Mycobacterium avium subsp. paratuberculosis
gccguugcggcccacgguga

SEQ ID NO: 975187 - RNA, 16 nt, Mycobacterium avium subsp. paratuberculosis
gccgcuuuccaccccg

SEQ ID NO: 975188 - RNA, 18 nt, Mycobacterium avium subsp. paratuberculosis
gccgcuuuccaccccggc

SEQ ID NO: 975189 - RNA, 17 nt, Mycobacterium avium subsp. paratuberculosis
gccgcuugguggcgccg

SEQ ID NO: 975190 - RNA, 12 nt, Mycobacterium avium subsp. paratuberculosis
gccggaacagcu

SEQ ID NO: 975191 - RNA, 13 nt, Mycobacterium avium subsp. paratuberculosis
gccgucggcggcc

SEQ ID NO: 975192 - RNA, 14 nt, Mycobacterium avium subsp. paratuberculosis
gccgucggcggccu

SEQ ID NO: 975193 - RNA, 15 nt, Mycobacterium avium subsp. paratuberculosis
gccgucggcggccuu

SEQ ID NO: 975194 - RNA, 19 nt, Mycobacterium avium subsp. paratuberculosis
gccgucggcguucagcggc

SEQ ID NO: 975195 - RNA, 18 nt, Mycobacterium avium subsp. paratuberculosis
gccgucggcgccgccgag

SEQ ID NO: 975196 - RNA, 19 nt, Mycobacterium avium subsp. paratuberculosis
gccgucggcgccgccgagc

SEQ ID NO: 975197 - RNA, 21 nt, Mycobacterium avium subsp. paratuberculosis
gccgucggcgccgccgagccg

SEQ ID NO: 975198 - RNA, 15 nt, Mycobacterium avium subsp. paratuberculosis
gccgucggcgcggcc

SEQ ID NO: 975199 - RNA, 16 nt, Mycobacterium avium subsp. paratuberculosis
gccgucggcgcggccg

SEQ ID NO: 975200 - RNA, 19 nt, Mycobacterium avium subsp. paratuberculosis
gccgucgcgaucgcggucc

SEQ ID NO: 975201 - RNA, 17 nt, Mycobacterium avium subsp. paratuberculosis
gccgucgcgcaccaccu

SEQ ID NO: 975202 - RNA, 15 nt, Mycobacterium avium subsp. paratuberculosis
gccgucgcgcagccu

SEQ ID NO: 975203 - RNA, 18 nt, Mycobacterium avium subsp. paratuberculosis
gccgucgcggcgcggguc

SEQ ID NO: 975204 - RNA, 16 nt, Mycobacterium avium subsp. paratuberculosis
gccgucgcgggcgucg

SEQ ID NO: 975205 - RNA, 15 nt, Mycobacterium avium subsp. paratuberculosis
gccgucggcauccac

SEQ ID NO: 975206 - RNA, 18 nt, Mycobacterium avium subsp. paratuberculosis
gccgucggcccacgguga

SEQ ID NO: 975207 - RNA, 13 nt, Mycobacterium avium subsp. paratuberculosis
gccgucggccgcc

SEQ ID NO: 975208 - RNA, 15 nt, Mycobacterium avium subsp. paratuberculosis
gccgucggccgccga

SEQ ID NO: 975209 - RNA, 13 nt, Mycobacterium avium subsp. paratuberculosis
gccgucgccgccg

SEQ ID NO: 975210 - RNA, 20 nt, Mycobacterium avium subsp. paratuberculosis
gccguccuuggccgccagca

SEQ ID NO: 975211 - RNA, 21 nt, Mycobacterium avium subsp. paratuberculosis
gccguccuuggccgccagcac

SEQ ID NO: 975212 - RNA, 23 nt, Mycobacterium avium subsp. paratuberculosis
gccgucgccgcacgcccacagcu

SEQ ID NO: 975213 - RNA, 16 nt, Mycobacterium avium subsp. paratuberculosis
gccguccggguccggc

SEQ ID NO: 975214 - RNA, 22 nt, Mycobacterium avium subsp. paratuberculosis
gccguccgggucgcacagccgc

SEQ ID NO: 975215 - RNA, 19 nt, Mycobacterium avium subsp. paratuberculosis
gccguccgggugcgggcug

SEQ ID NO: 975216 - RNA, 14 nt, Mycobacterium avium subsp. paratuberculosis
gccgucacccagau

SEQ ID NO: 975217 - RNA, 16 nt, Mycobacterium avium subsp. paratuberculosis
gccgucaccgccagga

SEQ ID NO: 975218 - RNA, 15 nt, Mycobacterium avium subsp. paratuberculosis
gccgucacgcuggcg

SEQ ID NO: 975219 - RNA, 16 nt, Mycobacterium avium subsp. paratuberculosis
gccgucacgcuggcgu

SEQ ID NO: 975220 - RNA, 16 nt, Mycobacterium avium subsp. paratuberculosis
gccguccaggccgcug

SEQ ID NO: 975221 - RNA, 20 nt, Mycobacterium avium subsp. paratuberculosis
gccgucccgucacggcugcc

SEQ ID NO: 975222 - RNA, 17 nt, Mycobacterium avium subsp. paratuberculosis
gccgucccguccgacgg

SEQ ID NO: 975223 - RNA, 19 nt, Mycobacterium avium subsp. paratuberculosis
ggucuuggcggccagcgcc

SEQ ID NO: 975224 - RNA, 15 nt, Mycobacterium avium subsp. paratuberculosis
ggucuuggacagcag

SEQ ID NO: 975225 - RNA, 19 nt, Mycobacterium avium subsp. paratuberculosis
ggucuuucaucgccccggc

SEQ ID NO: 975226 - RNA, 15 nt, Mycobacterium avium subsp. paratuberculosis
ggucuucggucgcga

SEQ ID NO: 975227 - RNA, 13 nt, Mycobacterium avium subsp. paratuberculosis
ggucuucucggcc

SEQ ID NO: 975228 - RNA, 13 nt, Mycobacterium avium subsp. paratuberculosis
ggucugcgccggc

SEQ ID NO: 975229 - RNA, 16 nt, Mycobacterium avium subsp. paratuberculosis
ggucugcagcagccgc

SEQ ID NO: 975230 - RNA, 21 nt, Mycobacterium avium subsp. paratuberculosis
ggucugcgccagcuccagcag

SEQ ID NO: 975231 - RNA, 19 nt, Mycobacterium avium subsp. paratuberculosis
ggucuccguagcccugcag

SEQ ID NO: 975232 - RNA, 20 nt, Mycobacterium avium subsp. paratuberculosis
ggucuccguagcccugcagg

SEQ ID NO: 975233 - RNA, 21 nt, Mycobacterium avium subsp. paratuberculosis
ggucuccgggcugugggcgca

SEQ ID NO: 975234 - RNA, 14 nt, Mycobacterium avium subsp. paratuberculosis
ggucucgggcacca

SEQ ID NO: 975235 - RNA, 16 nt, Mycobacterium avium subsp. paratuberculosis
ggucgggugcggcggu

SEQ ID NO: 975236 - RNA, 21 nt, Mycobacterium avium subsp. paratuberculosis
ggucggugacaaagaucacag

SEQ ID NO: 975237 - RNA, 16 nt, Mycobacterium avium subsp. paratuberculosis
ggucggggcggcgggc

SEQ ID NO: 975238 - RNA, 19 nt, Mycobacterium avium subsp. paratuberculosis
ggucgggcaugccggccgg

SEQ ID NO: 975239 - RNA, 16 nt, Mycobacterium avium subsp. paratuberculosis
ggucgggcccagguag

SEQ ID NO: 975240 - RNA, 16 nt, Mycobacterium avium subsp. paratuberculosis
ggucgggcgcaccacg

SEQ ID NO: 975241 - RNA, 22 nt, Mycobacterium avium subsp. paratuberculosis
ggucgggauacucguccucccg

SEQ ID NO: 975242 - RNA, 16 nt, Mycobacterium avium subsp. paratuberculosis
ggucgggaucgauccc

SEQ ID NO: 975243 - RNA, 18 nt, Mycobacterium avium subsp. paratuberculosis
ggucgggaucugcgguga

SEQ ID NO: 975244 - RNA, 20 nt, Mycobacterium avium subsp. paratuberculosis
ggucggcgggagccggcggc

SEQ ID NO: 975245 - RNA, 14 nt, Mycobacterium avium subsp. paratuberculosis
ggucggcgccggcc

SEQ ID NO: 975246 - RNA, 14 nt, Mycobacterium avium subsp. paratuberculosis
ggucggcgcccggc

SEQ ID NO: 975247 - RNA, 20 nt, Mycobacterium avium subsp. paratuberculosis
ggucggcgagcuuguccugc

SEQ ID NO: 975248 - RNA, 17 nt, Mycobacterium avium subsp. paratuberculosis
ggucgugcaucggcgcc

SEQ ID NO: 975249 - RNA, 15 nt, Mycobacterium avium subsp. paratuberculosis
ggucgucggugccga

SEQ ID NO: 975250 - RNA, 23 nt, Mycobacterium avium subsp. paratuberculosis
ggucgucuucuuggccgcggccu

SEQ ID NO: 975251 - RNA, 12 nt, Mycobacterium avium subsp. paratuberculosis
ggucgucgccgg

SEQ ID NO: 975252 - RNA, 13 nt, Mycobacterium avium subsp. paratuberculosis
ggucgucgcggcc

SEQ ID NO: 975253 - RNA, 19 nt, Mycobacterium avium subsp. paratuberculosis
ggucgucgcguccagcaug

SEQ ID NO: 975254 - RNA, 16 nt, Mycobacterium avium subsp. paratuberculosis
ggucgucgggccgggg

SEQ ID NO: 975255 - RNA, 15 nt, Mycobacterium avium subsp. paratuberculosis
ggucguugcacaccc

SEQ ID NO: 975256 - RNA, 14 nt, Mycobacterium avium subsp. paratuberculosis
ggucguuggccucc

SEQ ID NO: 975257 - RNA, 18 nt, Mycobacterium avium subsp. paratuberculosis
ggucuagaucuccaggcu

SEQ ID NO: 975258 - RNA, 16 nt, Mycobacterium avium subsp. paratuberculosis
ggucggccggcaggcc

SEQ ID NO: 975259 - RNA, 21 nt, Mycobacterium avium subsp. paratuberculosis
ggucggcauagcgccgcucgg

SEQ ID NO: 975260 - RNA, 14 nt, Mycobacterium avium subsp. paratuberculosis
ggucggccagcagg

SEQ ID NO: 975261 - RNA, 12 nt, Mycobacterium avium subsp. paratuberculosis
ggucggccagcg

SEQ ID NO: 975262 - RNA, 14 nt, Mycobacterium avium subsp. paratuberculosis
ggucggccagcgcc

SEQ ID NO: 975263 - RNA, 17 nt, Mycobacterium avium subsp. paratuberculosis
ggucggaucgagcucgc

SEQ ID NO: 975264 - RNA, 22 nt, Mycobacterium avium subsp. paratuberculosis
ggucgcugcagcggcggccagu

SEQ ID NO: 975265 - RNA, 23 nt, Mycobacterium avium subsp. paratuberculosis
ggucgcgucgugcggccggcgcc

SEQ ID NO: 975266 - RNA, 15 nt, Mycobacterium avium subsp. paratuberculosis
ggucgcgggcgccga

SEQ ID NO: 975267 - RNA, 18 nt, Mycobacterium avium subsp. paratuberculosis
ggucgcguagggcagggu

SEQ ID NO: 975268 - RNA, 20 nt, Mycobacterium avium subsp. paratuberculosis
ggucgcguugaaagccgcga

SEQ ID NO: 975269 - RNA, 13 nt, Mycobacterium avium subsp. paratuberculosis
ggucgccacggcc

SEQ ID NO: 975270 - RNA, 13 nt, Mycobacterium avium subsp. paratuberculosis
ggucgccggcggc

SEQ ID NO: 975271 - RNA, 17 nt, Mycobacterium avium subsp. paratuberculosis
ggucgccgggcaggugg

SEQ ID NO: 975272 - RNA, 14 nt, Mycobacterium avium subsp. paratuberculosis
ggucgcccccucgg

SEQ ID NO: 975273 - RNA, 16 nt, Mycobacterium avium subsp. paratuberculosis
ggucgccgcccacgcc

SEQ ID NO: 975274 - RNA, 22 nt, Mycobacterium avium subsp. paratuberculosis
ggucgcgccagacguccagcgc

SEQ ID NO: 975275 - RNA, 23 nt, Mycobacterium avium subsp. paratuberculosis
ggucgcgcaucgccucggcggcc

SEQ ID NO: 975276 - RNA, 20 nt, Mycobacterium avium subsp. paratuberculosis
ggucgcgaagacgcuggcca

SEQ ID NO: 975277 - RNA, 18 nt, Mycobacterium avium subsp. paratuberculosis
ggucgaugcccgcgccga

SEQ ID NO: 975278 - RNA, 20 nt, Mycobacterium avium subsp. paratuberculosis
ggucgauggcguagcggguc

SEQ ID NO: 975279 - RNA, 15 nt, Mycobacterium avium subsp. paratuberculosis
ggucgaugucggcga

SEQ ID NO: 975280 - RNA, 14 nt, Mycobacterium avium subsp. paratuberculosis
ggucgaugagcugg

SEQ ID NO: 975281 - RNA, 22 nt, Mycobacterium avium subsp. paratuberculosis
ggucgcacaccagcacggcggc

SEQ ID NO: 975282 - RNA, 22 nt, Mycobacterium avium subsp. paratuberculosis
ggucgcacgccgguagccgcuc

SEQ ID NO: 975283 - RNA, 18 nt, Mycobacterium avium subsp. paratuberculosis
ggucgcaggccgcccggc

SEQ ID NO: 975284 - RNA, 17 nt, Mycobacterium avium subsp. paratuberculosis
ggucgagggucgccagg

SEQ ID NO: 975285 - RNA, 18 nt, Mycobacterium avium subsp. paratuberculosis
ggucgaggucgccgacag

SEQ ID NO: 975286 - RNA, 16 nt, Mycobacterium avium subsp. paratuberculosis
ggucgacuugggcggg

SEQ ID NO: 975287 - RNA, 20 nt, Mycobacterium avium subsp. paratuberculosis
gguccuggcgguggcccggu

SEQ ID NO: 975288 - RNA, 12 nt, Mycobacterium avium subsp. paratuberculosis
gguccugggccu

SEQ ID NO: 975289 - RNA, 14 nt, Mycobacterium avium subsp. paratuberculosis
gguccugggccucc

SEQ ID NO: 975290 - RNA, 19 nt, Mycobacterium avium subsp. paratuberculosis
gguccgggaacagcgacuc

SEQ ID NO: 975291 - RNA, 19 nt, Mycobacterium avium subsp. paratuberculosis
gguccuucucgcacagcac

SEQ ID NO: 975292 - RNA, 23 nt, Mycobacterium avium subsp. paratuberculosis
gguccuugagguagucgcgcagc

SEQ ID NO: 975293 - RNA, 14 nt, Mycobacterium avium subsp. paratuberculosis
gguccuugcccagc

SEQ ID NO: 975294 - RNA, 17 nt, Mycobacterium avium subsp. paratuberculosis
gguccuugccggcggcg

SEQ ID NO: 975295 - RNA, 14 nt, Mycobacterium avium subsp. paratuberculosis
ggucgaagcgcagc

SEQ ID NO: 975296 - RNA, 20 nt, Mycobacterium avium subsp. paratuberculosis
ggucgaaccacgcggcggcg

SEQ ID NO: 975297 - RNA, 21 nt, Mycobacterium avium subsp. paratuberculosis
ggucgaaccgcgagcgcgcgg

SEQ ID NO: 975298 - RNA, 15 nt, Mycobacterium avium subsp. paratuberculosis
ggucgaaggccccgg

SEQ ID NO: 975299 - RNA, 21 nt, Mycobacterium avium subsp. paratuberculosis
ggucgaaguccugcgccgcgg

SEQ ID NO: 975300 - RNA, 18 nt, Mycobacterium avium subsp. paratuberculosis
ggucgaccagcuccugga

SEQ ID NO: 975301 - RNA, 15 nt, Mycobacterium avium subsp. paratuberculosis
ggucgacgagcccgc

SEQ ID NO: 975302 - RNA, 17 nt, Mycobacterium avium subsp. paratuberculosis
ggucgacgagcccgcgc

SEQ ID NO: 975303 - RNA, 13 nt, Mycobacterium avium subsp. paratuberculosis
ggucgaccggcuc

SEQ ID NO: 975304 - RNA, 23 nt, Mycobacterium avium subsp. paratuberculosis
ggucgacgcgccgcacugcacgg

SEQ ID NO: 975305 - RNA, 21 nt, Mycobacterium avium subsp. paratuberculosis
ggucgacgcggggcggcggcg

SEQ ID NO: 975306 - RNA, 21 nt, Mycobacterium avium subsp. paratuberculosis
ggucgacgucauccggcugcc

SEQ ID NO: 975307 - RNA, 18 nt, Mycobacterium avium subsp. paratuberculosis
ggucccaauccucgccga

SEQ ID NO: 975308 - RNA, 16 nt, Mycobacterium avium subsp. paratuberculosis
ggucccacucgggaaa

SEQ ID NO: 975309 - RNA, 20 nt, Mycobacterium avium subsp. paratuberculosis
ggucccaggcguggucggcg

SEQ ID NO: 975310 - RNA, 23 nt, Mycobacterium avium subsp. paratuberculosis
ggucccaggcguggucggcgcgg

SEQ ID NO: 975311 - RNA, 21 nt, Mycobacterium avium subsp. paratuberculosis
ggucccaggugggcgcgcagc

SEQ ID NO: 975312 - RNA, 20 nt, Mycobacterium avium subsp. paratuberculosis
gguccccggcgaccacccuc

SEQ ID NO: 975313 - RNA, 16 nt, Mycobacterium avium subsp. paratuberculosis
gguccccgggcccagc

SEQ ID NO: 975314 - RNA, 19 nt, Mycobacterium avium subsp. paratuberculosis
ggucccggcgggggcggcg

SEQ ID NO: 975315 - RNA, 16 nt, Mycobacterium avium subsp. paratuberculosis
ggucccguccaucgcc

SEQ ID NO: 975316 - RNA, 23 nt, Mycobacterium avium subsp. paratuberculosis
gguccaucgccucgaccagcacc

SEQ ID NO: 975317 - RNA, 19 nt, Mycobacterium avium subsp. paratuberculosis
gguccagaucggcgcgcgg

SEQ ID NO: 975318 - RNA, 13 nt, Mycobacterium avium subsp. paratuberculosis
gguccagcgccga

SEQ ID NO: 975319 - RNA, 23 nt, Mycobacterium avium subsp. paratuberculosis
gguccggucagcaccgcgcggcg

SEQ ID NO: 975320 - RNA, 12 nt, Mycobacterium avium subsp. paratuberculosis
gguccggccggc

SEQ ID NO: 975321 - RNA, 13 nt, Mycobacterium avium subsp. paratuberculosis
gguccgugcacgg

SEQ ID NO: 975322 - RNA, 16 nt, Mycobacterium avium subsp. paratuberculosis
gguccgugccacggcc

SEQ ID NO: 975323 - RNA, 22 nt, Mycobacterium avium subsp. paratuberculosis
gguccgugccacggccgcggcc

SEQ ID NO: 975324 - RNA, 22 nt, Mycobacterium avium subsp. paratuberculosis
gguccguuggaggugaucgcca

SEQ ID NO: 975325 - RNA, 23 nt, Mycobacterium avium subsp. paratuberculosis
gguccguuggaggugaucgccag

SEQ ID NO: 975326 - RNA, 13 nt, Mycobacterium avium subsp. paratuberculosis
gguccucccgggu

SEQ ID NO: 975327 - RNA, 18 nt, Mycobacterium avium subsp. paratuberculosis
gguccucgaccucuucgg

SEQ ID NO: 975328 - RNA, 19 nt, Mycobacterium avium subsp. paratuberculosis
gguccucgauggcggcggc

SEQ ID NO: 975329 - RNA, 21 nt, Mycobacterium avium subsp. paratuberculosis
gguccucggacucgucgcuga

SEQ ID NO: 975330 - RNA, 20 nt, Mycobacterium avium subsp. paratuberculosis
gguccggaagcccuugcagc

SEQ ID NO: 975331 - RNA, 23 nt, Mycobacterium avium subsp. paratuberculosis
gguccgcgguucgaucuccucgg

SEQ ID NO: 975332 - RNA, 22 nt, Mycobacterium avium subsp. paratuberculosis
gguccgcgguuuggucagcgcc

SEQ ID NO: 975333 - RNA, 20 nt, Mycobacterium avium subsp. paratuberculosis
gguccgaucguccggcgcca

SEQ ID NO: 975334 - RNA, 18 nt, Mycobacterium avium subsp. paratuberculosis
gguccgcaacgcggcggu

SEQ ID NO: 975335 - RNA, 21 nt, Mycobacterium avium subsp. paratuberculosis
gguccgcccggaccagggugg

SEQ ID NO: 975336 - RNA, 18 nt, Mycobacterium avium subsp. paratuberculosis
gguccgccgcagcggcgc

SEQ ID NO: 975337 - RNA, 14 nt, Mycobacterium avium subsp. paratuberculosis
ggucaugguggcgg

SEQ ID NO: 975338 - RNA, 21 nt, Mycobacterium avium subsp. paratuberculosis
gguccaccaccacacccgcgg

SEQ ID NO: 975339 - RNA, 17 nt, Mycobacterium avium subsp. paratuberculosis
gguccacccgccccgcc

SEQ ID NO: 975340 - RNA, 16 nt, Mycobacterium avium subsp. paratuberculosis
gguccaccgccgcgcc

SEQ ID NO: 975341 - RNA, 16 nt, Mycobacterium avium subsp. paratuberculosis
gguccaccgcggcggc

SEQ ID NO: 975342 - RNA, 19 nt, Mycobacterium avium subsp. paratuberculosis
gguccaccgcggcggccag

SEQ ID NO: 975343 - RNA, 22 nt, Mycobacterium avium subsp. paratuberculosis
gguccacggucagcgcgucggc

SEQ ID NO: 975344 - RNA, 20 nt, Mycobacterium avium subsp. paratuberculosis
ggucaucaccuugucgcuga

SEQ ID NO: 975345 - RNA, 10 nt, Mycobacterium avium subsp. paratuberculosis
ggucaucgug

SEQ ID NO: 975346 - RNA, 23 nt, Mycobacterium avium subsp. paratuberculosis
ggucaucgacucgaagaaccgca

SEQ ID NO: 975347 - RNA, 16 nt, Mycobacterium avium subsp. paratuberculosis
ggucacggucuggcug

SEQ ID NO: 975348 - RNA, 20 nt, Mycobacterium avium subsp. paratuberculosis
ggucacggauacccgcggcc

SEQ ID NO: 975349 - RNA, 13 nt, Mycobacterium avium subsp. paratuberculosis
ggucacggccgcc

SEQ ID NO: 975350 - RNA, 16 nt, Mycobacterium avium subsp. paratuberculosis
ggucaagccggccagc

SEQ ID NO: 975351 - RNA, 18 nt, Mycobacterium avium subsp. paratuberculosis
ggucaagccggccagcag

SEQ ID NO: 975352 - RNA, 14 nt, Mycobacterium avium subsp. paratuberculosis
ggucaccaccacca

SEQ ID NO: 975353 - RNA, 13 nt, Mycobacterium avium subsp. paratuberculosis
ggucaccagcgcg

SEQ ID NO: 975354 - RNA, 14 nt, Mycobacterium avium subsp. paratuberculosis
ggucaccagcggcc

SEQ ID NO: 975355 - RNA, 16 nt, Mycobacterium avium subsp. paratuberculosis
ggucaccagcucgccg

SEQ ID NO: 975356 - RNA, 14 nt, Mycobacterium avium subsp. paratuberculosis
ggucacagccgcga

SEQ ID NO: 975357 - RNA, 17 nt, Mycobacterium avium subsp. paratuberculosis
ggucacacccucggccc

SEQ ID NO: 975358 - RNA, 15 nt, Mycobacterium avium subsp. paratuberculosis
ggucaccgagcggcc

SEQ ID NO: 975359 - RNA, 22 nt, Mycobacterium avium subsp. paratuberculosis
ggucacccgguugagcaccgca

SEQ ID NO: 975360 - RNA, 13 nt, Mycobacterium avium subsp. paratuberculosis
ggucacccuccuc

SEQ ID NO: 975361 - RNA, 18 nt, Mycobacterium avium subsp. paratuberculosis
ggucacccacuggcggcc

SEQ ID NO: 975362 - RNA, 20 nt, Mycobacterium avium subsp. paratuberculosis
ggucacccacuggcggccgg

SEQ ID NO: 975363 - RNA, 13 nt, Mycobacterium avium subsp. paratuberculosis
ggucacccaggcc

SEQ ID NO: 975364 - RNA, 23 nt, Mycobacterium avium subsp. paratuberculosis
ggucaccccgaguucggccagau

SEQ ID NO: 975365 - RNA, 13 nt, Mycobacterium avium subsp. paratuberculosis
ggucagcaccacc

SEQ ID NO: 975366 - RNA, 19 nt, Mycobacterium avium subsp. paratuberculosis
ggucagcaggcgccgcagc

SEQ ID NO: 975367 - RNA, 14 nt, Mycobacterium avium subsp. paratuberculosis
ggucagcaggguga

SEQ ID NO: 975368 - RNA, 16 nt, Mycobacterium avium subsp. paratuberculosis
ggucagcacccgcagc

SEQ ID NO: 975369 - RNA, 16 nt, Mycobacterium avium subsp. paratuberculosis
ggucagcaccggggcc

SEQ ID NO: 975370 - RNA, 18 nt, Mycobacterium avium subsp. paratuberculosis
ggucagcagcagcgccuc

SEQ ID NO: 975371 - RNA, 16 nt, Mycobacterium avium subsp. paratuberculosis
ggucagccgcaccagg

SEQ ID NO: 975372 - RNA, 18 nt, Mycobacterium avium subsp. paratuberculosis
ggucagccgcaccagguu

SEQ ID NO: 975373 - RNA, 13 nt, Mycobacterium avium subsp. paratuberculosis
ggucagcgccccc

SEQ ID NO: 975374 - RNA, 16 nt, Mycobacterium avium subsp. paratuberculosis
ggucagcgcuacugcc

SEQ ID NO: 975375 - RNA, 18 nt, Mycobacterium avium subsp. paratuberculosis
ggucagcgcuuccagcgc

SEQ ID NO: 975376 - RNA, 13 nt, Mycobacterium avium subsp. paratuberculosis
ggucagcggcagg

SEQ ID NO: 975377 - RNA, 14 nt, Mycobacterium avium subsp. paratuberculosis
ggucagcggcgcca

SEQ ID NO: 975378 - RNA, 16 nt, Mycobacterium avium subsp. paratuberculosis
ggucagccgcggcggc

SEQ ID NO: 975379 - RNA, 16 nt, Mycobacterium avium subsp. paratuberculosis
ggucagccggccugcu

SEQ ID NO: 975380 - RNA, 13 nt, Mycobacterium avium subsp. paratuberculosis
ggucagccgggcg

SEQ ID NO: 975381 - RNA, 18 nt, Mycobacterium avium subsp. paratuberculosis
ggucagcucgcgcccggc

SEQ ID NO: 975382 - RNA, 17 nt, Mycobacterium avium subsp. paratuberculosis
ggucagcucgaucgccg

SEQ ID NO: 975383 - RNA, 14 nt, Mycobacterium avium subsp. paratuberculosis
ggucagcgucgcca

SEQ ID NO: 975384 - RNA, 16 nt, Mycobacterium avium subsp. paratuberculosis
ggucagcgucucgccg

SEQ ID NO: 975385 - RNA, 20 nt, Mycobacterium avium subsp. paratuberculosis
ggucaggucgaagcccgccg

SEQ ID NO: 975386 - RNA, 22 nt, Mycobacterium avium subsp. paratuberculosis
ggucagguagccgaggucgccg

SEQ ID NO: 975387 - RNA, 15 nt, Mycobacterium avium subsp. paratuberculosis
ggucagggccagcaa

SEQ ID NO: 975388 - RNA, 16 nt, Mycobacterium avium subsp. paratuberculosis
ggucagggccagcaac

SEQ ID NO: 975389 - RNA, 22 nt, Mycobacterium avium subsp. paratuberculosis
gguaggccggccgcagcugcug

SEQ ID NO: 975390 - RNA, 12 nt, Mycobacterium avium subsp. paratuberculosis
gguaggccaccg

SEQ ID NO: 975391 - RNA, 15 nt, Mycobacterium avium subsp. paratuberculosis
gguagggccggucac

SEQ ID NO: 975392 - RNA, 22 nt, Mycobacterium avium subsp. paratuberculosis
gguaggugcccgggucgugcgg

SEQ ID NO: 975393 - RNA, 16 nt, Mycobacterium avium subsp. paratuberculosis
gguagggguccuccag

SEQ ID NO: 975394 - RNA, 15 nt, Mycobacterium avium subsp. paratuberculosis
gguaggcgcggguga

SEQ ID NO: 975395 - RNA, 14 nt, Mycobacterium avium subsp. paratuberculosis
gguagucggccucc

SEQ ID NO: 975396 - RNA, 15 nt, Mycobacterium avium subsp. paratuberculosis
gguagucggccuccu

SEQ ID NO: 975397 - RNA, 17 nt, Mycobacterium avium subsp. paratuberculosis
gguaguggcgugcggcc

SEQ ID NO: 975398 - RNA, 13 nt, Mycobacterium avium subsp. paratuberculosis
gguauccgugacc

SEQ ID NO: 975399 - RNA, 14 nt, Mycobacterium avium subsp. paratuberculosis
gguacagcaccgcc

SEQ ID NO: 975400 - RNA, 20 nt, Mycobacterium avium subsp. paratuberculosis
gguacaucguucccugcgcg

SEQ ID NO: 975401 - RNA, 18 nt, Mycobacterium avium subsp. paratuberculosis
gguacaucccgccgggca

SEQ ID NO: 975402 - RNA, 14 nt, Mycobacterium avium subsp. paratuberculosis
gguacaggccccac

SEQ ID NO: 975403 - RNA, 17 nt, Mycobacterium avium subsp. paratuberculosis
gguaccagggcagcgcc

SEQ ID NO: 975404 - RNA, 14 nt, Mycobacterium avium subsp. paratuberculosis
gguaccccagcaaa

SEQ ID NO: 975405 - RNA, 14 nt, Mycobacterium avium subsp. paratuberculosis
gguacccccgccgg

SEQ ID NO: 975406 - RNA, 18 nt, Mycobacterium avium subsp. paratuberculosis
gguacucggcggcgggca

SEQ ID NO: 975407 - RNA, 12 nt, Mycobacterium avium subsp. paratuberculosis
gguacggcggcc

SEQ ID NO: 975408 - RNA, 16 nt, Mycobacterium avium subsp. paratuberculosis
gguaccgccggccagg

SEQ ID NO: 975409 - RNA, 18 nt, Mycobacterium avium subsp. paratuberculosis
gguaccgccggccaggcg

SEQ ID NO: 975410 - RNA, 17 nt, Mycobacterium avium subsp. paratuberculosis
gguaccggcgccaggcc

SEQ ID NO: 975411 - RNA, 21 nt, Mycobacterium avium subsp. paratuberculosis
gguacgaaauucguugauuag

SEQ ID NO: 975412 - RNA, 21 nt, Mycobacterium avium subsp. paratuberculosis
gguagaugguggccgucggcc

SEQ ID NO: 975413 - RNA, 13 nt, Mycobacterium avium subsp. paratuberculosis
gguagagcggcac

SEQ ID NO: 975414 - RNA, 12 nt, Mycobacterium avium subsp. paratuberculosis
gguagcccgcgu

SEQ ID NO: 975415 - RNA, 18 nt, Mycobacterium avium subsp. paratuberculosis
gguagcaggcgcgcagca

SEQ ID NO: 975416 - RNA, 12 nt, Mycobacterium avium subsp. paratuberculosis
gguagccagcac

SEQ ID NO: 975417 - RNA, 15 nt, Mycobacterium avium subsp. paratuberculosis
gguagccgcucgccc

SEQ ID NO: 975418 - RNA, 21 nt, Mycobacterium avium subsp. paratuberculosis
gguagccggcccgcagccagc

SEQ ID NO: 975419 - RNA, 14 nt, Mycobacterium avium subsp. paratuberculosis
gguagcgugcgccc

SEQ ID NO: 975420 - RNA, 18 nt, Mycobacterium avium subsp. paratuberculosis
gguagcgcagcaccaggc

SEQ ID NO: 975421 - RNA, 15 nt, Mycobacterium avium subsp. paratuberculosis
gggugaggccaggcg

SEQ ID NO: 975422 - RNA, 13 nt, Mycobacterium avium subsp. paratuberculosis
gggugaggggcgc

SEQ ID NO: 975423 - RNA, 15 nt, Mycobacterium avium subsp. paratuberculosis
gggugaggggcgcgc

SEQ ID NO: 975424 - RNA, 14 nt, Mycobacterium avium subsp. paratuberculosis
gggugaugcagugg

SEQ ID NO: 975425 - RNA, 14 nt, Mycobacterium avium subsp. paratuberculosis
gggugccaaggucg

SEQ ID NO: 975426 - RNA, 15 nt, Mycobacterium avium subsp. paratuberculosis
gggugcaggcccagc

SEQ ID NO: 975427 - RNA, 21 nt, Mycobacterium avium subsp. paratuberculosis
gggugccgauguaggacaggu

SEQ ID NO: 975428 - RNA, 17 nt, Mycobacterium avium subsp. paratuberculosis
gggugccgcagcggcgg

SEQ ID NO: 975429 - RNA, 16 nt, Mycobacterium avium subsp. paratuberculosis
gggugcccaccagcau

SEQ ID NO: 975430 - RNA, 23 nt, Mycobacterium avium subsp. paratuberculosis
gggugccagccgugcggcggcgg

SEQ ID NO: 975431 - RNA, 17 nt, Mycobacterium avium subsp. paratuberculosis
ggguggcgccggccagc

SEQ ID NO: 975432 - RNA, 18 nt, Mycobacterium avium subsp. paratuberculosis
ggguggcgccggccagca

SEQ ID NO: 975433 - RNA, 12 nt, Mycobacterium avium subsp. paratuberculosis
ggguggccgggu

SEQ ID NO: 975434 - RNA, 11 nt, Mycobacterium avium subsp. paratuberculosis
ggguggcccgc

SEQ ID NO: 975435 - RNA, 15 nt, Mycobacterium avium subsp. paratuberculosis
ggguggccggccagc

SEQ ID NO: 975436 - RNA, 16 nt, Mycobacterium avium subsp. paratuberculosis
ggguggccggccagca

SEQ ID NO: 975437 - RNA, 22 nt, Mycobacterium avium subsp. paratuberculosis
ggguggaucuugacggcgacgg

SEQ ID NO: 975438 - RNA, 17 nt, Mycobacterium avium subsp. paratuberculosis
ggguggccagcaccagc

SEQ ID NO: 975439 - RNA, 22 nt, Mycobacterium avium subsp. paratuberculosis
ggguggccccagcccgggggug

SEQ ID NO: 975440 - RNA, 22 nt, Mycobacterium avium subsp. paratuberculosis
gggugcuuucgcgucugcucgc

SEQ ID NO: 975441 - RNA, 23 nt, Mycobacterium avium subsp. paratuberculosis
gggugcugaacgccugccggcgc

SEQ ID NO: 975442 - RNA, 14 nt, Mycobacterium avium subsp. paratuberculosis
gggugcggugcagc

SEQ ID NO: 975443 - RNA, 20 nt, Mycobacterium avium subsp. paratuberculosis
gggugcggugcagccgcggu

SEQ ID NO: 975444 - RNA, 21 nt, Mycobacterium avium subsp. paratuberculosis
gggugcucagguugcgcagca

SEQ ID NO: 975445 - RNA, 15 nt, Mycobacterium avium subsp. paratuberculosis
gggugcucccgccaa

SEQ ID NO: 975446 - RNA, 15 nt, Mycobacterium avium subsp. paratuberculosis
gggugccggccaccg

SEQ ID NO: 975447 - RNA, 24 nt, Mycobacterium avium subsp. paratuberculosis
gggugccggccaccggcgcgacgg

SEQ ID NO: 975448 - RNA, 14 nt, Mycobacterium avium subsp. paratuberculosis
gggugcgccaggca

SEQ ID NO: 975449 - RNA, 19 nt, Mycobacterium avium subsp. paratuberculosis
gggugcgcgucgcggugga

SEQ ID NO: 975450 - RNA, 13 nt, Mycobacterium avium subsp. paratuberculosis
gggugcggcacgg

SEQ ID NO: 975451 - RNA, 18 nt, Mycobacterium avium subsp. paratuberculosis
ggguguuguccgagccgc

SEQ ID NO: 975452 - RNA, 15 nt, Mycobacterium avium subsp. paratuberculosis
ggguuccgguuggcc

SEQ ID NO: 975453 - RNA, 13 nt, Mycobacterium avium subsp. paratuberculosis
ggguucggcggcg

SEQ ID NO: 975454 - RNA, 19 nt, Mycobacterium avium subsp. paratuberculosis
ggguucggucucggcggcg

SEQ ID NO: 975455 - RNA, 15 nt, Mycobacterium avium subsp. paratuberculosis
ggguugccggcggcc

SEQ ID NO: 975456 - RNA, 14 nt, Mycobacterium avium subsp. paratuberculosis
ggguuggucggcgc

SEQ ID NO: 975457 - RNA, 20 nt, Mycobacterium avium subsp. paratuberculosis
ggguugggcgccugcgguga

SEQ ID NO: 975458 - RNA, 14 nt, Mycobacterium avium subsp. paratuberculosis
ggguugggcggcgg

SEQ ID NO: 975459 - RNA, 16 nt, Mycobacterium avium subsp. paratuberculosis
ggguucucgcggcggc

SEQ ID NO: 975460 - RNA, 21 nt, Mycobacterium avium subsp. paratuberculosis
gggugggcacgucggccagga

SEQ ID NO: 975461 - RNA, 12 nt, Mycobacterium avium subsp. paratuberculosis
gggugggcagcc

SEQ ID NO: 975462 - RNA, 14 nt, Mycobacterium avium subsp. paratuberculosis
gggugggcagcccc

SEQ ID NO: 975463 - RNA, 13 nt, Mycobacterium avium subsp. paratuberculosis
ggguggcggggcg

SEQ ID NO: 975464 - RNA, 20 nt, Mycobacterium avium subsp. paratuberculosis
ggguggacaccuuggcggcc

SEQ ID NO: 975465 - RNA, 12 nt, Mycobacterium avium subsp. paratuberculosis
ggguggucagcg

SEQ ID NO: 975466 - RNA, 15 nt, Mycobacterium avium subsp. paratuberculosis
ggguggugggcgcga

SEQ ID NO: 975467 - RNA, 11 nt, Mycobacterium avium subsp. paratuberculosis
gggugguggug

SEQ ID NO: 975468 - RNA, 15 nt, Mycobacterium avium subsp. paratuberculosis
ggguguagcggaugg

SEQ ID NO: 975469 - RNA, 17 nt, Mycobacterium avium subsp. paratuberculosis
ggguguauucgcccacc

SEQ ID NO: 975470 - RNA, 16 nt, Mycobacterium avium subsp. paratuberculosis
gggugucguagcggcu

SEQ ID NO: 975471 - RNA, 20 nt, Mycobacterium avium subsp. paratuberculosis
gggugucggcggggccggug

SEQ ID NO: 975472 - RNA, 15 nt, Mycobacterium avium subsp. paratuberculosis
gggugucgaaaccgc

SEQ ID NO: 975473 - RNA, 16 nt, Mycobacterium avium subsp. paratuberculosis
gggugucgaacagcag

SEQ ID NO: 975474 - RNA, 23 nt, Mycobacterium avium subsp. paratuberculosis
gggugucgaacagcaggcccagg

SEQ ID NO: 975475 - RNA, 16 nt, Mycobacterium avium subsp. paratuberculosis
gggugugcagcgggau

SEQ ID NO: 975476 - RNA, 21 nt, Mycobacterium avium subsp. paratuberculosis
ggguguucaccgcgccgggca

SEQ ID NO: 975477 - RNA, 20 nt, Mycobacterium avium subsp. paratuberculosis
gguaaucggcgguggugaac

SEQ ID NO: 975478 - RNA, 15 nt, Mycobacterium avium subsp. paratuberculosis
gguaagccaggucac

SEQ ID NO: 975479 - RNA, 20 nt, Mycobacterium avium subsp. paratuberculosis
gguaacagagcgggaucccg

SEQ ID NO: 975480 - RNA, 19 nt, Mycobacterium avium subsp. paratuberculosis
gguaaaccagcagcgccac

SEQ ID NO: 975481 - RNA, 14 nt, Mycobacterium avium subsp. paratuberculosis
gguaaaccgccagc

SEQ ID NO: 975482 - RNA, 18 nt, Mycobacterium avium subsp. paratuberculosis
gguaaaccgccagcagcg

SEQ ID NO: 975483 - RNA, 23 nt, Mycobacterium avium subsp. paratuberculosis
ggguuguucuccagcggccgcag

SEQ ID NO: 975484 - RNA, 16 nt, Mycobacterium avium subsp. paratuberculosis
gggcucgugcagccgg

SEQ ID NO: 975485 - RNA, 14 nt, Mycobacterium avium subsp. paratuberculosis
gggcucgagcaccg

SEQ ID NO: 975486 - RNA, 22 nt, Mycobacterium avium subsp. paratuberculosis
gggcucgagugccggcagcccg

SEQ ID NO: 975487 - RNA, 20 nt, Mycobacterium avium subsp. paratuberculosis
gggcucgaguuuggccagcu

SEQ ID NO: 975488 - RNA, 16 nt, Mycobacterium avium subsp. paratuberculosis
gggcucggcguacagg

SEQ ID NO: 975489 - RNA, 13 nt, Mycobacterium avium subsp. paratuberculosis
gggcucgcgggug

SEQ ID NO: 975490 - RNA, 20 nt, Mycobacterium avium subsp. paratuberculosis
gggcucgacaggcagcccgg

SEQ ID NO: 975491 - RNA, 21 nt, Mycobacterium avium subsp. paratuberculosis
gggcucccagucccagcacag

SEQ ID NO: 975492 - RNA, 23 nt, Mycobacterium avium subsp. paratuberculosis
gggcucccagucccagcacagcc

SEQ ID NO: 975493 - RNA, 11 nt, Mycobacterium avium subsp. paratuberculosis
gggcuccagcg

SEQ ID NO: 975494 - RNA, 17 nt, Mycobacterium avium subsp. paratuberculosis
gggcugcaccagggcgu

SEQ ID NO: 975495 - RNA, 16 nt, Mycobacterium avium subsp. paratuberculosis
gggcugcagcgacugg

SEQ ID NO: 975496 - RNA, 15 nt, Mycobacterium avium subsp. paratuberculosis
gggcugcagggccgg

SEQ ID NO: 975497 - RNA, 22 nt, Mycobacterium avium subsp. paratuberculosis
gggcugaagaucaacagccgcc

SEQ ID NO: 975498 - RNA, 23 nt, Mycobacterium avium subsp. paratuberculosis
gggcguucgcggugggcucgucg

SEQ ID NO: 975499 - RNA, 19 nt, Mycobacterium avium subsp. paratuberculosis
gggcgugcccggcgcacag

SEQ ID NO: 975500 - RNA, 19 nt, Mycobacterium avium subsp. paratuberculosis
gggcguggcgggccaggcg

SEQ ID NO: 975501 - RNA, 22 nt, Mycobacterium avium subsp. paratuberculosis
gggcguugcgccgcgagcgcag

SEQ ID NO: 975502 - RNA, 20 nt, Mycobacterium avium subsp. paratuberculosis
gggcguugguugcggccccg

SEQ ID NO: 975503 - RNA, 22 nt, Mycobacterium avium subsp. paratuberculosis
gggcuaggcucggcagccggcu

SEQ ID NO: 975504 - RNA, 16 nt, Mycobacterium avium subsp. paratuberculosis
gggcuaacgcuggucg

SEQ ID NO: 975505 - RNA, 17 nt, Mycobacterium avium subsp. paratuberculosis
gggcgucacgccagcgu

SEQ ID NO: 975506 - RNA, 13 nt, Mycobacterium avium subsp. paratuberculosis
gggcgggccccac

SEQ ID NO: 975507 - RNA, 16 nt, Mycobacterium avium subsp. paratuberculosis
gggcguccagcgaggg

SEQ ID NO: 975508 - RNA, 21 nt, Mycobacterium avium subsp. paratuberculosis
gggcguacagcggcgccaggu

SEQ ID NO: 975509 - RNA, 13 nt, Mycobacterium avium subsp. paratuberculosis
gggcggggcagca

SEQ ID NO: 975510 - RNA, 16 nt, Mycobacterium avium subsp. paratuberculosis
gggcgggguggccacc

SEQ ID NO: 975511 - RNA, 12 nt, Mycobacterium avium subsp. paratuberculosis
gggcggguggau

SEQ ID NO: 975512 - RNA, 15 nt, Mycobacterium avium subsp. paratuberculosis
gggcgguggcgccgg

SEQ ID NO: 975513 - RNA, 14 nt, Mycobacterium avium subsp. paratuberculosis
gggcgguggcggcg

SEQ ID NO: 975514 - RNA, 14 nt, Mycobacterium avium subsp. paratuberculosis
gggcguggcggaag

SEQ ID NO: 975515 - RNA, 12 nt, Mycobacterium avium subsp. paratuberculosis
gggcguggaacg

SEQ ID NO: 975516 - RNA, 12 nt, Mycobacterium avium subsp. paratuberculosis
gggcgugccgga

SEQ ID NO: 975517 - RNA, 12 nt, Mycobacterium avium subsp. paratuberculosis
gggcgugccggc

SEQ ID NO: 975518 - RNA, 18 nt, Mycobacterium avium subsp. paratuberculosis
gggcgugccggcggcgga

SEQ ID NO: 975519 - RNA, 20 nt, Mycobacterium avium subsp. paratuberculosis
gggcgugcaggccgcgggug

SEQ ID NO: 975520 - RNA, 14 nt, Mycobacterium avium subsp. paratuberculosis
gggcgugacagggu

SEQ ID NO: 975521 - RNA, 19 nt, Mycobacterium avium subsp. paratuberculosis
gggcgucucgaugagcgag

SEQ ID NO: 975522 - RNA, 17 nt, Mycobacterium avium subsp. paratuberculosis
gggcgucggggcccucc

SEQ ID NO: 975523 - RNA, 15 nt, Mycobacterium avium subsp. paratuberculosis
gggcgucgcccgccg

SEQ ID NO: 975524 - RNA, 16 nt, Mycobacterium avium subsp. paratuberculosis
gggcgucgccgccccc

SEQ ID NO: 975525 - RNA, 14 nt, Mycobacterium avium subsp. paratuberculosis
gggcgggcacccgg

SEQ ID NO: 975526 - RNA, 14 nt, Mycobacterium avium subsp. paratuberculosis
gggcggcgggacgg

SEQ ID NO: 975527 - RNA, 16 nt, Mycobacterium avium subsp. paratuberculosis
gggcggcgggcccggc

SEQ ID NO: 975528 - RNA, 14 nt, Mycobacterium avium subsp. paratuberculosis
gggcggcggccacc

SEQ ID NO: 975529 - RNA, 14 nt, Mycobacterium avium subsp. paratuberculosis
gggcggcggccucc

SEQ ID NO: 975530 - RNA, 12 nt, Mycobacterium avium subsp. paratuberculosis
gggcggcggcgg

SEQ ID NO: 975531 - RNA, 16 nt, Mycobacterium avium subsp. paratuberculosis
gggcggcggcgggaag

SEQ ID NO: 975532 - RNA, 12 nt, Mycobacterium avium subsp. paratuberculosis
gggcggcgccgg

SEQ ID NO: 975533 - RNA, 14 nt, Mycobacterium avium subsp. paratuberculosis
gggcggcgccggca

SEQ ID NO: 975534 - RNA, 19 nt, Mycobacterium avium subsp. paratuberculosis
gggcggccugccggccgcc

SEQ ID NO: 975535 - RNA, 17 nt, Mycobacterium avium subsp. paratuberculosis
gggcggccaccaacggc

SEQ ID NO: 975536 - RNA, 18 nt, Mycobacterium avium subsp. paratuberculosis
gggcggcaucgcgcgcgg

SEQ ID NO: 975537 - RNA, 11 nt, Mycobacterium avium subsp. paratuberculosis
gggcggccagc

SEQ ID NO: 975538 - RNA, 21 nt, Mycobacterium avium subsp. paratuberculosis
gggcggcgaacaccagcaccc

SEQ ID NO: 975539 - RNA, 23 nt, Mycobacterium avium subsp. paratuberculosis
gggcggccgccgggccggcggcc

SEQ ID NO: 975540 - RNA, 13 nt, Mycobacterium avium subsp. paratuberculosis
gggcggccgggcc

SEQ ID NO: 975541 - RNA, 21 nt, Mycobacterium avium subsp. paratuberculosis
gggcggcccgccucggcggcc

SEQ ID NO: 975542 - RNA, 20 nt, Mycobacterium avium subsp. paratuberculosis
gggcgauaaccucggcggcg

SEQ ID NO: 975543 - RNA, 15 nt, Mycobacterium avium subsp. paratuberculosis
gggcgaucagcccgc

SEQ ID NO: 975544 - RNA, 15 nt, Mycobacterium avium subsp. paratuberculosis
gggcgaucauccagg

SEQ ID NO: 975545 - RNA, 18 nt, Mycobacterium avium subsp. paratuberculosis
gggcgauccugugcaccg

SEQ ID NO: 975546 - RNA, 21 nt, Mycobacterium avium subsp. paratuberculosis
gggcgaucgacaccagcgugu

SEQ ID NO: 975547 - RNA, 23 nt, Mycobacterium avium subsp. paratuberculosis
gggcgaucgaucccuuggcggcg

SEQ ID NO: 975548 - RNA, 17 nt, Mycobacterium avium subsp. paratuberculosis
gggcgacuccggcgccg

SEQ ID NO: 975549 - RNA, 20 nt, Mycobacterium avium subsp. paratuberculosis
gggcgauuucgucggcggug

SEQ ID NO: 975550 - RNA, 20 nt, Mycobacterium avium subsp. paratuberculosis
gggcgauucccggaugcugc

SEQ ID NO: 975551 - RNA, 18 nt, Mycobacterium avium subsp. paratuberculosis
gggcgauggugccgccgg

SEQ ID NO: 975552 - RNA, 19 nt, Mycobacterium avium subsp. paratuberculosis
gggcgaugccgacacccca

SEQ ID NO: 975553 - RNA, 18 nt, Mycobacterium avium subsp. paratuberculosis
gggcgaccccggccagga

SEQ ID NO: 975554 - RNA, 22 nt, Mycobacterium avium subsp. paratuberculosis
gggcgaccuugcgcagccggca

SEQ ID NO: 975555 - RNA, 21 nt, Mycobacterium avium subsp. paratuberculosis
gggcgacgaugccggccggga

SEQ ID NO: 975556 - RNA, 17 nt, Mycobacterium avium subsp. paratuberculosis
gggcgacgccgcggaag

SEQ ID NO: 975557 - RNA, 14 nt, Mycobacterium avium subsp. paratuberculosis
gggcgacggcggcg

SEQ ID NO: 975558 - RNA, 21 nt, Mycobacterium avium subsp. paratuberculosis
gggccuucuuggcggcggccu

SEQ ID NO: 975559 - RNA, 17 nt, Mycobacterium avium subsp. paratuberculosis
gggccuugacggccugg

SEQ ID NO: 975560 - RNA, 18 nt, Mycobacterium avium subsp. paratuberculosis
gggcgaacagcagcaccc

SEQ ID NO: 975561 - RNA, 20 nt, Mycobacterium avium subsp. paratuberculosis
gggcgaacagcagcacccgg

SEQ ID NO: 975562 - RNA, 21 nt, Mycobacterium avium subsp. paratuberculosis
gggcggaagucggugcccuug

SEQ ID NO: 975563 - RNA, 18 nt, Mycobacterium avium subsp. paratuberculosis
gggcggcaccgcugccgg

SEQ ID NO: 975564 - RNA, 16 nt, Mycobacterium avium subsp. paratuberculosis
gggcggcagccaggua

SEQ ID NO: 975565 - RNA, 21 nt, Mycobacterium avium subsp. paratuberculosis
gggcggaugugccuggcccag

SEQ ID NO: 975566 - RNA, 20 nt, Mycobacterium avium subsp. paratuberculosis
gggcgcgugcacaccggccu

SEQ ID NO: 975567 - RNA, 18 nt, Mycobacterium avium subsp. paratuberculosis
gggcgcugccguccuucu

SEQ ID NO: 975568 - RNA, 14 nt, Mycobacterium avium subsp. paratuberculosis
gggcgcugcgcggu

SEQ ID NO: 975569 - RNA, 23 nt, Mycobacterium avium subsp. paratuberculosis
gggcgcugcgcgguggcgcgggu

SEQ ID NO: 975570 - RNA, 19 nt, Mycobacterium avium subsp. paratuberculosis
gggcgcguccgcgggcggg

SEQ ID NO: 975571 - RNA, 21 nt, Mycobacterium avium subsp. paratuberculosis
gggcgcguccgcgggcggggc

SEQ ID NO: 975572 - RNA, 23 nt, Mycobacterium avium subsp. paratuberculosis
gggcgcguccgcgggcggggccu

SEQ ID NO: 975573 - RNA, 17 nt, Mycobacterium avium subsp. paratuberculosis
gggcgcgcaucugcucg

SEQ ID NO: 975574 - RNA, 15 nt, Mycobacterium avium subsp. paratuberculosis
gggcgcgaggcgcga

SEQ ID NO: 975575 - RNA, 13 nt, Mycobacterium avium subsp. paratuberculosis
gggcgccgcggcg

SEQ ID NO: 975576 - RNA, 20 nt, Mycobacterium avium subsp. paratuberculosis
gggcgccuucuuggcggcgg

SEQ ID NO: 975577 - RNA, 20 nt, Mycobacterium avium subsp. paratuberculosis
gggcgccggccggcgcgugc

SEQ ID NO: 975578 - RNA, 21 nt, Mycobacterium avium subsp. paratuberculosis
gggcgccguaggccgcgcuga

SEQ ID NO: 975579 - RNA, 14 nt, Mycobacterium avium subsp. paratuberculosis
gggcgccgucgggg

SEQ ID NO: 975580 - RNA, 21 nt, Mycobacterium avium subsp. paratuberculosis
gggcgcccagcaaacccagca

SEQ ID NO: 975581 - RNA, 14 nt, Mycobacterium avium subsp. paratuberculosis
gggcgccagcccgc

SEQ ID NO: 975582 - RNA, 17 nt, Mycobacterium avium subsp. paratuberculosis
gggcgcauaccagcgcu

SEQ ID NO: 975583 - RNA, 22 nt, Mycobacterium avium subsp. paratuberculosis
gggcgccacuucuccacgccga

SEQ ID NO: 975584 - RNA, 13 nt, Mycobacterium avium subsp. paratuberculosis
gggcgcagcccgg

SEQ ID NO: 975585 - RNA, 20 nt, Mycobacterium avium subsp. paratuberculosis
gggcgcacgaucgggcgcag

SEQ ID NO: 975586 - RNA, 17 nt, Mycobacterium avium subsp. paratuberculosis
gggcgcaccgcgcgcca

SEQ ID NO: 975587 - RNA, 22 nt, Mycobacterium avium subsp. paratuberculosis
gggcaucggcuggucggcggcc

SEQ ID NO: 975588 - RNA, 14 nt, Mycobacterium avium subsp. paratuberculosis
gggcaucccugaca

SEQ ID NO: 975589 - RNA, 19 nt, Mycobacterium avium subsp. paratuberculosis
gggcauccgcucgccgcgg

SEQ ID NO: 975590 - RNA, 18 nt, Mycobacterium avium subsp. paratuberculosis
gggcauccgggaggccag

SEQ ID NO: 975591 - RNA, 17 nt, Mycobacterium avium subsp. paratuberculosis
gggcauccgggccgccg

SEQ ID NO: 975592 - RNA, 19 nt, Mycobacterium avium subsp. paratuberculosis
gggcaucaucggcacgccg

SEQ ID NO: 975593 - RNA, 17 nt, Mycobacterium avium subsp. paratuberculosis
gggcauacugcuugccg

SEQ ID NO: 975594 - RNA, 17 nt, Mycobacterium avium subsp. paratuberculosis
gggcaucgucucggacc

SEQ ID NO: 975595 - RNA, 20 nt, Mycobacterium avium subsp. paratuberculosis
gggcaugccguucagcgcgg

SEQ ID NO: 975596 - RNA, 12 nt, Mycobacterium avium subsp. paratuberculosis
gggcauggcugg

SEQ ID NO: 975597 - RNA, 17 nt, Mycobacterium avium subsp. paratuberculosis
gggcaugcucaggauga

SEQ ID NO: 975598 - RNA, 22 nt, Mycobacterium avium subsp. paratuberculosis
gggcaugucgccgaacgccacc

SEQ ID NO: 975599 - RNA, 20 nt, Mycobacterium avium subsp. paratuberculosis
gggcauggugaagcccagcg

SEQ ID NO: 975600 - RNA, 19 nt, Mycobacterium avium subsp. paratuberculosis
gggccaaagagcuuggcau

SEQ ID NO: 975601 - RNA, 20 nt, Mycobacterium avium subsp. paratuberculosis
gggccaacuccggcggcagc

SEQ ID NO: 975602 - RNA, 13 nt, Mycobacterium avium subsp. paratuberculosis
gggccaccaccac

SEQ ID NO: 975603 - RNA, 16 nt, Mycobacterium avium subsp. paratuberculosis
gggccaccaccacggc

SEQ ID NO: 975604 - RNA, 19 nt, Mycobacterium avium subsp. paratuberculosis
gggccaauuacgcugcggc

SEQ ID NO: 975605 - RNA, 20 nt, Mycobacterium avium subsp. paratuberculosis
gggccaauuacgcugcggcg

SEQ ID NO: 975606 - RNA, 15 nt, Mycobacterium avium subsp. paratuberculosis
gggccaccacgccag

SEQ ID NO: 975607 - RNA, 17 nt, Mycobacterium avium subsp. paratuberculosis
gggccaccacgccagcc

SEQ ID NO: 975608 - RNA, 13 nt, Mycobacterium avium subsp. paratuberculosis
gggccagcaccca

SEQ ID NO: 975609 - RNA, 14 nt, Mycobacterium avium subsp. paratuberculosis
gggccagcacccag

SEQ ID NO: 975610 - RNA, 20 nt, Mycobacterium avium subsp. paratuberculosis
gggccagaucgacccccacc

SEQ ID NO: 975611 - RNA, 22 nt, Mycobacterium avium subsp. paratuberculosis
gggccagacugcgcaccgccag

SEQ ID NO: 975612 - RNA, 21 nt, Mycobacterium avium subsp. paratuberculosis
gggccacgccgacuagcgcgg

SEQ ID NO: 975613 - RNA, 15 nt, Mycobacterium avium subsp. paratuberculosis
gggccaccggcgcca

SEQ ID NO: 975614 - RNA, 17 nt, Mycobacterium avium subsp. paratuberculosis
gggccaccggcgccagg

SEQ ID NO: 975615 - RNA, 13 nt, Mycobacterium avium subsp. paratuberculosis
gggccaccgggcc

SEQ ID NO: 975616 - RNA, 15 nt, Mycobacterium avium subsp. paratuberculosis
gggccaccgggccga

SEQ ID NO: 975617 - RNA, 22 nt, Mycobacterium avium subsp. paratuberculosis
gggccaucgacuccagcaccgg

SEQ ID NO: 975618 - RNA, 22 nt, Mycobacterium avium subsp. paratuberculosis
gggcccaccgcgcgcugcagca

SEQ ID NO: 975619 - RNA, 15 nt, Mycobacterium avium subsp. paratuberculosis
gggcccagcagccug

SEQ ID NO: 975620 - RNA, 22 nt, Mycobacterium avium subsp. paratuberculosis
gggccauauuucgugaagccgg

SEQ ID NO: 975621 - RNA, 10 nt, Mycobacterium avium subsp. paratuberculosis
gggccccggc

SEQ ID NO: 975622 - RNA, 14 nt, Mycobacterium avium subsp. paratuberculosis
gggccccuccagcc

SEQ ID NO: 975623 - RNA, 19 nt, Mycobacterium avium subsp. paratuberculosis
gggccccuccagccgccgg

SEQ ID NO: 975624 - RNA, 20 nt, Mycobacterium avium subsp. paratuberculosis
gggcccgaagcgcuuucccu

SEQ ID NO: 975625 - RNA, 14 nt, Mycobacterium avium subsp. paratuberculosis
gggcccgcagccgc

SEQ ID NO: 975626 - RNA, 15 nt, Mycobacterium avium subsp. paratuberculosis
gggcccgcagcucgg

SEQ ID NO: 975627 - RNA, 18 nt, Mycobacterium avium subsp. paratuberculosis
gggcccgcagcucggagu

SEQ ID NO: 975628 - RNA, 17 nt, Mycobacterium avium subsp. paratuberculosis
gggcccgcccgcagcgg

SEQ ID NO: 975629 - RNA, 13 nt, Mycobacterium avium subsp. paratuberculosis
gggcccgcgcacc

SEQ ID NO: 975630 - RNA, 14 nt, Mycobacterium avium subsp. paratuberculosis
gggcccgcgcaccg

SEQ ID NO: 975631 - RNA, 13 nt, Mycobacterium avium subsp. paratuberculosis
gggcccgcgcauc

SEQ ID NO: 975632 - RNA, 16 nt, Mycobacterium avium subsp. paratuberculosis
gggccagcgccgagcc

SEQ ID NO: 975633 - RNA, 13 nt, Mycobacterium avium subsp. paratuberculosis
gggccagcgccuc

SEQ ID NO: 975634 - RNA, 23 nt, Mycobacterium avium subsp. paratuberculosis
gggccagcggcaacugggcggcc

SEQ ID NO: 975635 - RNA, 18 nt, Mycobacterium avium subsp. paratuberculosis
gggccagcucgaaccugg

SEQ ID NO: 975636 - RNA, 24 nt, Mycobacterium avium subsp. paratuberculosis
gggccagcgccuucggcgccagcc

SEQ ID NO: 975637 - RNA, 13 nt, Mycobacterium avium subsp. paratuberculosis
gggccagccaggu

SEQ ID NO: 975638 - RNA, 18 nt, Mycobacterium avium subsp. paratuberculosis
gggccagcacgcccccgc

SEQ ID NO: 975639 - RNA, 17 nt, Mycobacterium avium subsp. paratuberculosis
gggccagcagcagcagg

SEQ ID NO: 975640 - RNA, 19 nt, Mycobacterium avium subsp. paratuberculosis
gggccagcagcagcagguc

SEQ ID NO: 975641 - RNA, 14 nt, Mycobacterium avium subsp. paratuberculosis
gggccagcagccag

SEQ ID NO: 975642 - RNA, 15 nt, Mycobacterium avium subsp. paratuberculosis
gggccagcagccgcg

SEQ ID NO: 975643 - RNA, 15 nt, Mycobacterium avium subsp. paratuberculosis
gggccagcagccggg

SEQ ID NO: 975644 - RNA, 16 nt, Mycobacterium avium subsp. paratuberculosis
gggccagcagccgggu

SEQ ID NO: 975645 - RNA, 14 nt, Mycobacterium avium subsp. paratuberculosis
gggccagggcgagg

SEQ ID NO: 975646 - RNA, 17 nt, Mycobacterium avium subsp. paratuberculosis
gggccagggcgaggacg

SEQ ID NO: 975647 - RNA, 13 nt, Mycobacterium avium subsp. paratuberculosis
gggccaggcggau

SEQ ID NO: 975648 - RNA, 16 nt, Mycobacterium avium subsp. paratuberculosis
gggccaggucccaggc

SEQ ID NO: 975649 - RNA, 24 nt, Mycobacterium avium subsp. paratuberculosis
gggccaggucgaagcgcagcaccu

SEQ ID NO: 975650 - RNA, 18 nt, Mycobacterium avium subsp. paratuberculosis
gggccaggugugcccgcc

SEQ ID NO: 975651 - RNA, 14 nt, Mycobacterium avium subsp. paratuberculosis
gggccaggccguga

SEQ ID NO: 975652 - RNA, 13 nt, Mycobacterium avium subsp. paratuberculosis
gggccaggaugac

SEQ ID NO: 975653 - RNA, 21 nt, Mycobacterium avium subsp. paratuberculosis
gggccaggaugaccgcccagg

SEQ ID NO: 975654 - RNA, 22 nt, Mycobacterium avium subsp. paratuberculosis
gggccaggaugaccgcccagga

SEQ ID NO: 975655 - RNA, 20 nt, Mycobacterium avium subsp. paratuberculosis
gggccaggauguucaccccg

SEQ ID NO: 975656 - RNA, 14 nt, Mycobacterium avium subsp. paratuberculosis
gggccaggcacggc

SEQ ID NO: 975657 - RNA, 14 nt, Mycobacterium avium subsp. paratuberculosis
gggccaggcccacc

SEQ ID NO: 975658 - RNA, 22 nt, Mycobacterium avium subsp. paratuberculosis
gggccgaacgauggugugcagc

SEQ ID NO: 975659 - RNA, 19 nt, Mycobacterium avium subsp. paratuberculosis
gggccgaacugccgaugcu

SEQ ID NO: 975660 - RNA, 23 nt, Mycobacterium avium subsp. paratuberculosis
gggccgaacugccgaugcugagc

SEQ ID NO: 975661 - RNA, 15 nt, Mycobacterium avium subsp. paratuberculosis
gggccgaaggcggcg

SEQ ID NO: 975662 - RNA, 16 nt, Mycobacterium avium subsp. paratuberculosis
gggccgaaggcggcgc

SEQ ID NO: 975663 - RNA, 21 nt, Mycobacterium avium subsp. paratuberculosis
gggccgaaggcggcgccggcc

SEQ ID NO: 975664 - RNA, 16 nt, Mycobacterium avium subsp. paratuberculosis
gggcccggucccgcgu

SEQ ID NO: 975665 - RNA, 19 nt, Mycobacterium avium subsp. paratuberculosis
gggcccgccguagcgccgg

SEQ ID NO: 975666 - RNA, 15 nt, Mycobacterium avium subsp. paratuberculosis
gggcccggccgccag

SEQ ID NO: 975667 - RNA, 23 nt, Mycobacterium avium subsp. paratuberculosis
gggcccgcguaaccggcggcggu

SEQ ID NO: 975668 - RNA, 14 nt, Mycobacterium avium subsp. paratuberculosis
gggccgcagcacgg

SEQ ID NO: 975669 - RNA, 12 nt, Mycobacterium avium subsp. paratuberculosis
gggccgcagccg

SEQ ID NO: 975670 - RNA, 14 nt, Mycobacterium avium subsp. paratuberculosis
gggccgcagccgcg

SEQ ID NO: 975671 - RNA, 19 nt, Mycobacterium avium subsp. paratuberculosis
gggccgcagccgcgcggcc

SEQ ID NO: 975672 - RNA, 21 nt, Mycobacterium avium subsp. paratuberculosis
gggccgcagccgcgcggccgg

SEQ ID NO: 975673 - RNA, 21 nt, Mycobacterium avium subsp. paratuberculosis
gggccgaugaccgcggcgggc

SEQ ID NO: 975674 - RNA, 15 nt, Mycobacterium avium subsp. paratuberculosis
gggccgaccggccgg

SEQ ID NO: 975675 - RNA, 18 nt, Mycobacterium avium subsp. paratuberculosis
gggccgacagcacgccgg

SEQ ID NO: 975676 - RNA, 14 nt, Mycobacterium avium subsp. paratuberculosis
gggccgccacggcg

SEQ ID NO: 975677 - RNA, 17 nt, Mycobacterium avium subsp. paratuberculosis
gggccgccacggcgcca

SEQ ID NO: 975678 - RNA, 12 nt, Mycobacterium avium subsp. paratuberculosis
gggccgccagcc

SEQ ID NO: 975679 - RNA, 21 nt, Mycobacterium avium subsp. paratuberculosis
gggccgcauccagcgccgcca

SEQ ID NO: 975680 - RNA, 22 nt, Mycobacterium avium subsp. paratuberculosis
gggccgcaauacggugcccgcc

SEQ ID NO: 975681 - RNA, 14 nt, Mycobacterium avium subsp. paratuberculosis
gggccgcagcgcgg

SEQ ID NO: 975682 - RNA, 17 nt, Mycobacterium avium subsp. paratuberculosis
gggccgcagcgcggcga

SEQ ID NO: 975683 - RNA, 14 nt, Mycobacterium avium subsp. paratuberculosis
gggccgccgcggac

SEQ ID NO: 975684 - RNA, 15 nt, Mycobacterium avium subsp. paratuberculosis
gggccgccgcggcgg

SEQ ID NO: 975685 - RNA, 18 nt, Mycobacterium avium subsp. paratuberculosis
gggccgccgaugcgcccg

SEQ ID NO: 975686 - RNA, 20 nt, Mycobacterium avium subsp. paratuberculosis
gggccgccagguuggcggcg

SEQ ID NO: 975687 - RNA, 15 nt, Mycobacterium avium subsp. paratuberculosis
gggccgcgccgaggc

SEQ ID NO: 975688 - RNA, 12 nt, Mycobacterium avium subsp. paratuberculosis
gggccgcgggcc

SEQ ID NO: 975689 - RNA, 13 nt, Mycobacterium avium subsp. paratuberculosis
gggccgcgcgggc

SEQ ID NO: 975690 - RNA, 13 nt, Mycobacterium avium subsp. paratuberculosis
gggccgcgagcgc

SEQ ID NO: 975691 - RNA, 15 nt, Mycobacterium avium subsp. paratuberculosis
gggccgcgagcgcua

SEQ ID NO: 975692 - RNA, 21 nt, Mycobacterium avium subsp. paratuberculosis
gggccgcgaugaggcucaggc

SEQ ID NO: 975693 - RNA, 20 nt, Mycobacterium avium subsp. paratuberculosis
gggccgccggguggcggggc

SEQ ID NO: 975694 - RNA, 13 nt, Mycobacterium avium subsp. paratuberculosis
gggccggcagccg

SEQ ID NO: 975695 - RNA, 12 nt, Mycobacterium avium subsp. paratuberculosis
gggccggccaga

SEQ ID NO: 975696 - RNA, 17 nt, Mycobacterium avium subsp. paratuberculosis
gggccgcuuguucgggc

SEQ ID NO: 975697 - RNA, 13 nt, Mycobacterium avium subsp. paratuberculosis
gggccggacagcg

SEQ ID NO: 975698 - RNA, 16 nt, Mycobacterium avium subsp. paratuberculosis
gggccggcgggggcgc

SEQ ID NO: 975699 - RNA, 13 nt, Mycobacterium avium subsp. paratuberculosis
gggccggcggggu

SEQ ID NO: 975700 - RNA, 18 nt, Mycobacterium avium subsp. paratuberculosis
gggccggcgugcugggcc

SEQ ID NO: 975701 - RNA, 14 nt, Mycobacterium avium subsp. paratuberculosis
gggccggcggccag

SEQ ID NO: 975702 - RNA, 19 nt, Mycobacterium avium subsp. paratuberculosis
gggccggcgaugcccguga

SEQ ID NO: 975703 - RNA, 13 nt, Mycobacterium avium subsp. paratuberculosis
gggccggcgccgg

SEQ ID NO: 975704 - RNA, 21 nt, Mycobacterium avium subsp. paratuberculosis
gggccggcgcggugggcggcg

SEQ ID NO: 975705 - RNA, 13 nt, Mycobacterium avium subsp. paratuberculosis
gggccgggcaccg

SEQ ID NO: 975706 - RNA, 18 nt, Mycobacterium avium subsp. paratuberculosis
gggccgggcgugcccggc

SEQ ID NO: 975707 - RNA, 12 nt, Mycobacterium avium subsp. paratuberculosis
gggccgggggcg

SEQ ID NO: 975708 - RNA, 17 nt, Mycobacterium avium subsp. paratuberculosis
gggccgggggcggcggc

SEQ ID NO: 975709 - RNA, 17 nt, Mycobacterium avium subsp. paratuberculosis
gggccguccgggugcgg

SEQ ID NO: 975710 - RNA, 17 nt, Mycobacterium avium subsp. paratuberculosis
gggccugaccaaggaca

SEQ ID NO: 975711 - RNA, 12 nt, Mycobacterium avium subsp. paratuberculosis
gggccuccacca

SEQ ID NO: 975712 - RNA, 13 nt, Mycobacterium avium subsp. paratuberculosis
gggccuccaccac

SEQ ID NO: 975713 - RNA, 18 nt, Mycobacterium avium subsp. paratuberculosis
gggccuggcgcuccagcc

SEQ ID NO: 975714 - RNA, 19 nt, Mycobacterium avium subsp. paratuberculosis
gggccuaugccgcgugaca

SEQ ID NO: 975715 - RNA, 18 nt, Mycobacterium avium subsp. paratuberculosis
gggccguucagcgggcgg

SEQ ID NO: 975716 - RNA, 19 nt, Mycobacterium avium subsp. paratuberculosis
gggccguucagcgggcggu

SEQ ID NO: 975717 - RNA, 19 nt, Mycobacterium avium subsp. paratuberculosis
gggguagacggcaugccgg

SEQ ID NO: 975718 - RNA, 16 nt, Mycobacterium avium subsp. paratuberculosis
gggguagaggccgcgg

SEQ ID NO: 975719 - RNA, 19 nt, Mycobacterium avium subsp. paratuberculosis
ggggucaccuuggccggau

SEQ ID NO: 975720 - RNA, 14 nt, Mycobacterium avium subsp. paratuberculosis
ggggucgacccgcc

SEQ ID NO: 975721 - RNA, 22 nt, Mycobacterium avium subsp. paratuberculosis
ggggucgacccgccgcagcccg

SEQ ID NO: 975722 - RNA, 23 nt, Mycobacterium avium subsp. paratuberculosis
ggggucccaauccucgccgagca

SEQ ID NO: 975723 - RNA, 16 nt, Mycobacterium avium subsp. paratuberculosis
gggguacucggcggcg

SEQ ID NO: 975724 - RNA, 19 nt, Mycobacterium avium subsp. paratuberculosis
gggguaguucagcgcgcgg

SEQ ID NO: 975725 - RNA, 20 nt, Mycobacterium avium subsp. paratuberculosis
gggggugucguagcggcugu

SEQ ID NO: 975726 - RNA, 24 nt, Mycobacterium avium subsp. paratuberculosis
gggggucgacccgccgcagcccgc

SEQ ID NO: 975727 - RNA, 13 nt, Mycobacterium avium subsp. paratuberculosis
gggggucgacugg

SEQ ID NO: 975728 - RNA, 22 nt, Mycobacterium avium subsp. paratuberculosis
gggggucgacugggccaggucg

SEQ ID NO: 975729 - RNA, 15 nt, Mycobacterium avium subsp. paratuberculosis
gggggugccgcagcg

SEQ ID NO: 975730 - RNA, 20 nt, Mycobacterium avium subsp. paratuberculosis
gggggugccgcagcggcggc

SEQ ID NO: 975731 - RNA, 19 nt, Mycobacterium avium subsp. paratuberculosis
gggggcgcgggcggcaggu

SEQ ID NO: 975732 - RNA, 13 nt, Mycobacterium avium subsp. paratuberculosis
gggggcggccggg

SEQ ID NO: 975733 - RNA, 23 nt, Mycobacterium avium subsp. paratuberculosis
gggggcggccgggccgcggcggu

SEQ ID NO: 975734 - RNA, 18 nt, Mycobacterium avium subsp. paratuberculosis
gggggucaucagugaccg

SEQ ID NO: 975735 - RNA, 21 nt, Mycobacterium avium subsp. paratuberculosis
gggguucguugcgccgccagg

SEQ ID NO: 975736 - RNA, 20 nt, Mycobacterium avium subsp. paratuberculosis
gggguuccaccguucgggug

SEQ ID NO: 975737 - RNA, 15 nt, Mycobacterium avium subsp. paratuberculosis
gggguucccggccgg

SEQ ID NO: 975738 - RNA, 20 nt, Mycobacterium avium subsp. paratuberculosis
gggguguucaccgcgccggg

SEQ ID NO: 975739 - RNA, 15 nt, Mycobacterium avium subsp. paratuberculosis
ggggugccgccgggg

SEQ ID NO: 975740 - RNA, 20 nt, Mycobacterium avium subsp. paratuberculosis
gggguggugaaacgaguuca

SEQ ID NO: 975741 - RNA, 15 nt, Mycobacterium avium subsp. paratuberculosis
ggggugugcggcacg

SEQ ID NO: 975742 - RNA, 18 nt, Mycobacterium avium subsp. paratuberculosis
ggggugcccaccagcauc

SEQ ID NO: 975743 - RNA, 18 nt, Mycobacterium avium subsp. paratuberculosis
ggggugacuucgagccgg

SEQ ID NO: 975744 - RNA, 21 nt, Mycobacterium avium subsp. paratuberculosis
ggggucggcgucgggccgggg

SEQ ID NO: 975745 - RNA, 23 nt, Mycobacterium avium subsp. paratuberculosis
ggggugaggcacccgcugcacca

SEQ ID NO: 975746 - RNA, 17 nt, Mycobacterium avium subsp. paratuberculosis
ggggucggugaccagcc

SEQ ID NO: 975747 - RNA, 20 nt, Mycobacterium avium subsp. paratuberculosis
ggggucguaccaccaccagu

SEQ ID NO: 975748 - RNA, 13 nt, Mycobacterium avium subsp. paratuberculosis
ggggucgcgccgg

SEQ ID NO: 975749 - RNA, 13 nt, Mycobacterium avium subsp. paratuberculosis
ggggucgcgggcg

SEQ ID NO: 975750 - RNA, 19 nt, Mycobacterium avium subsp. paratuberculosis
ggguagccggcccgcagcc

SEQ ID NO: 975751 - RNA, 14 nt, Mycobacterium avium subsp. paratuberculosis
ggguagcgccgccg

SEQ ID NO: 975752 - RNA, 13 nt, Mycobacterium avium subsp. paratuberculosis
ggguagggcggcg

SEQ ID NO: 975753 - RNA, 21 nt, Mycobacterium avium subsp. paratuberculosis
ggguagaucuccucggacccg

SEQ ID NO: 975754 - RNA, 23 nt, Mycobacterium avium subsp. paratuberculosis
ggguagcccgucgacgggccacc

SEQ ID NO: 975755 - RNA, 21 nt, Mycobacterium avium subsp. paratuberculosis
ggguacaccgagccggggcug

SEQ ID NO: 975756 - RNA, 15 nt, Mycobacterium avium subsp. paratuberculosis
ggguacagccgcagg

SEQ ID NO: 975757 - RNA, 14 nt, Mycobacterium avium subsp. paratuberculosis
ggguacggcggccg

SEQ ID NO: 975758 - RNA, 16 nt, Mycobacterium avium subsp. paratuberculosis
ggguacucggcggcgg

SEQ ID NO: 975759 - RNA, 17 nt, Mycobacterium avium subsp. paratuberculosis
ggguaaccgcagccggg

SEQ ID NO: 975760 - RNA, 17 nt, Mycobacterium avium subsp. paratuberculosis
gggguuggaaggggucg

SEQ ID NO: 975761 - RNA, 17 nt, Mycobacterium avium subsp. paratuberculosis
gggguugaagucuucgg

SEQ ID NO: 975762 - RNA, 22 nt, Mycobacterium avium subsp. paratuberculosis
gggguugaccuugaccagcuug

SEQ ID NO: 975763 - RNA, 20 nt, Mycobacterium avium subsp. paratuberculosis
gggucaaaacaacgcgcagc

SEQ ID NO: 975764 - RNA, 21 nt, Mycobacterium avium subsp. paratuberculosis
gggucaagauaccggccggcg

SEQ ID NO: 975765 - RNA, 18 nt, Mycobacterium avium subsp. paratuberculosis
gggucaauugccacagcc

SEQ ID NO: 975766 - RNA, 16 nt, Mycobacterium avium subsp. paratuberculosis
gggucacacccucggc

SEQ ID NO: 975767 - RNA, 17 nt, Mycobacterium avium subsp. paratuberculosis
gggucacacccucggcc

SEQ ID NO: 975768 - RNA, 21 nt, Mycobacterium avium subsp. paratuberculosis
gggucacggauacccgcggcc

SEQ ID NO: 975769 - RNA, 17 nt, Mycobacterium avium subsp. paratuberculosis
gggucaccggccgagcc

SEQ ID NO: 975770 - RNA, 21 nt, Mycobacterium avium subsp. paratuberculosis
gggucagcgcuuccagcgcgg

SEQ ID NO: 975771 - RNA, 20 nt, Mycobacterium avium subsp. paratuberculosis
gggucagccacgggcggucg

SEQ ID NO: 975772 - RNA, 18 nt, Mycobacterium avium subsp. paratuberculosis
gggucagaccgcggcggu

SEQ ID NO: 975773 - RNA, 22 nt, Mycobacterium avium subsp. paratuberculosis
gggucagcaccaccaacagcag

SEQ ID NO: 975774 - RNA, 21 nt, Mycobacterium avium subsp. paratuberculosis
ggguccacgccgagggcggcg

SEQ ID NO: 975775 - RNA, 15 nt, Mycobacterium avium subsp. paratuberculosis
ggguccagccgccgg

SEQ ID NO: 975776 - RNA, 13 nt, Mycobacterium avium subsp. paratuberculosis
ggguccagccgcg

SEQ ID NO: 975777 - RNA, 14 nt, Mycobacterium avium subsp. paratuberculosis
ggguccagccgcgg

SEQ ID NO: 975778 - RNA, 22 nt, Mycobacterium avium subsp. paratuberculosis
gggucccaauccucgccgagca

SEQ ID NO: 975779 - RNA, 14 nt, Mycobacterium avium subsp. paratuberculosis
ggguccagggugcc

SEQ ID NO: 975780 - RNA, 19 nt, Mycobacterium avium subsp. paratuberculosis
ggguccgaccagcacccgg

SEQ ID NO: 975781 - RNA, 16 nt, Mycobacterium avium subsp. paratuberculosis
ggguccgcgguccucc

SEQ ID NO: 975782 - RNA, 14 nt, Mycobacterium avium subsp. paratuberculosis
ggguccuaucagga

SEQ ID NO: 975783 - RNA, 20 nt, Mycobacterium avium subsp. paratuberculosis
ggguccuaucaggacuggac

SEQ ID NO: 975784 - RNA, 18 nt, Mycobacterium avium subsp. paratuberculosis
ggguccucgauggcggcg

SEQ ID NO: 975785 - RNA, 21 nt, Mycobacterium avium subsp. paratuberculosis
gggucaggaacaccgagccgg

SEQ ID NO: 975786 - RNA, 15 nt, Mycobacterium avium subsp. paratuberculosis
gggucaucagugacc

SEQ ID NO: 975787 - RNA, 17 nt, Mycobacterium avium subsp. paratuberculosis
gggucauccagccgugg

SEQ ID NO: 975788 - RNA, 13 nt, Mycobacterium avium subsp. paratuberculosis
gggucgagcgcgc

SEQ ID NO: 975789 - RNA, 13 nt, Mycobacterium avium subsp. paratuberculosis
gggucgccaggcc

SEQ ID NO: 975790 - RNA, 21 nt, Mycobacterium avium subsp. paratuberculosis
gggucgccgaucucggccaac

SEQ ID NO: 975791 - RNA, 19 nt, Mycobacterium avium subsp. paratuberculosis
gggucgauaugcugcaacg

SEQ ID NO: 975792 - RNA, 20 nt, Mycobacterium avium subsp. paratuberculosis
ggguccuugccggcggcggg

SEQ ID NO: 975793 - RNA, 16 nt, Mycobacterium avium subsp. paratuberculosis
gggucgguggcccagc

SEQ ID NO: 975794 - RNA, 16 nt, Mycobacterium avium subsp. paratuberculosis
gggucguagagcgcga

SEQ ID NO: 975795 - RNA, 16 nt, Mycobacterium avium subsp. paratuberculosis
gggucgccgggcaggu

SEQ ID NO: 975796 - RNA, 22 nt, Mycobacterium avium subsp. paratuberculosis
gggucgcgccgguagagcgcca

SEQ ID NO: 975797 - RNA, 15 nt, Mycobacterium avium subsp. paratuberculosis
gggucgcgggcgccg

SEQ ID NO: 975798 - RNA, 22 nt, Mycobacterium avium subsp. paratuberculosis
gggugaaacacaaacucgccca

SEQ ID NO: 975799 - RNA, 18 nt, Mycobacterium avium subsp. paratuberculosis
gggugaacgaggccgcgc

SEQ ID NO: 975800 - RNA, 21 nt, Mycobacterium avium subsp. paratuberculosis
gggucuucucgaagcgcagca

SEQ ID NO: 975801 - RNA, 18 nt, Mycobacterium avium subsp. paratuberculosis
gggucugugaccacgguc

SEQ ID NO: 975802 - RNA, 22 nt, Mycobacterium avium subsp. paratuberculosis
gggugacccgggcgauggugcc

SEQ ID NO: 975803 - RNA, 19 nt, Mycobacterium avium subsp. paratuberculosis
gggugaccggcgcgcagca

SEQ ID NO: 975804 - RNA, 15 nt, Mycobacterium avium subsp. paratuberculosis
gggugaccggcggcc

SEQ ID NO: 975805 - RNA, 18 nt, Mycobacterium avium subsp. paratuberculosis
gggugaccggcggccagc

SEQ ID NO: 975806 - RNA, 13 nt, Mycobacterium avium subsp. paratuberculosis
gggugacgaucca

SEQ ID NO: 975807 - RNA, 21 nt, Mycobacterium avium subsp. paratuberculosis
gggugacgcgaaugucgacca

SEQ ID NO: 975808 - RNA, 17 nt, Mycobacterium avium subsp. paratuberculosis
gggucucagcgcccgcc

SEQ ID NO: 975809 - RNA, 14 nt, Mycobacterium avium subsp. paratuberculosis
gggucucgcccacc

SEQ ID NO: 975810 - RNA, 18 nt, Mycobacterium avium subsp. paratuberculosis
gggucucgggcagcagca

SEQ ID NO: 975811 - RNA, 17 nt, Mycobacterium avium subsp. paratuberculosis
gggucgggugcggcggu

SEQ ID NO: 975812 - RNA, 18 nt, Mycobacterium avium subsp. paratuberculosis
gggucuuccacgccggug

SEQ ID NO: 975813 - RNA, 14 nt, Mycobacterium avium subsp. paratuberculosis
gggucugccacgcc

SEQ ID NO: 975814 - RNA, 20 nt, Mycobacterium avium subsp. paratuberculosis
gggcuuuagaaggccgccuc

SEQ ID NO: 975815 - RNA, 21 nt, Mycobacterium avium subsp. paratuberculosis
gggcuucgaacgcccgcacca

SEQ ID NO: 975816 - RNA, 21 nt, Mycobacterium avium subsp. paratuberculosis
gggcuugcgcaacagcgugca

SEQ ID NO: 975817 - RNA, 18 nt, Mycobacterium avium subsp. paratuberculosis
gggcuggcgcuggaucug

SEQ ID NO: 975818 - RNA, 13 nt, Mycobacterium avium subsp. paratuberculosis
gggcuggcggcga

SEQ ID NO: 975819 - RNA, 16 nt, Mycobacterium avium subsp. paratuberculosis
gggcugcgggccaggc

SEQ ID NO: 975820 - RNA, 18 nt, Mycobacterium avium subsp. paratuberculosis
gggcugcgcuugcggcgc

SEQ ID NO: 975821 - RNA, 16 nt, Mycobacterium avium subsp. paratuberculosis
gggcugucgggcaggc

SEQ ID NO: 975822 - RNA, 13 nt, Mycobacterium avium subsp. paratuberculosis
gggcugugccggc

SEQ ID NO: 975823 - RNA, 16 nt, Mycobacterium avium subsp. paratuberculosis
gggcugugccggcggg

SEQ ID NO: 975824 - RNA, 18 nt, Mycobacterium avium subsp. paratuberculosis
gggcugugggcgcagggc

SEQ ID NO: 975825 - RNA, 20 nt, Mycobacterium avium subsp. paratuberculosis
gggcuguccgcguggccgag

SEQ ID NO: 975826 - RNA, 17 nt, Mycobacterium avium subsp. paratuberculosis
gggcuguccucccagcg

SEQ ID NO: 975827 - RNA, 14 nt, Mycobacterium avium subsp. paratuberculosis
gggcugggcggggu

SEQ ID NO: 975828 - RNA, 17 nt, Mycobacterium avium subsp. paratuberculosis
gggcuggugcgcagccg

SEQ ID NO: 975829 - RNA, 18 nt, Mycobacterium avium subsp. paratuberculosis
ggggacggugcagccggg

SEQ ID NO: 975830 - RNA, 22 nt, Mycobacterium avium subsp. paratuberculosis
ggggacggugcagccgggggcg

SEQ ID NO: 975831 - RNA, 12 nt, Mycobacterium avium subsp. paratuberculosis
ggggagaggcgc

SEQ ID NO: 975832 - RNA, 13 nt, Mycobacterium avium subsp. paratuberculosis
ggggaggcccagc

SEQ ID NO: 975833 - RNA, 21 nt, Mycobacterium avium subsp. paratuberculosis
ggggagggucgguggcccagc

SEQ ID NO: 975834 - RNA, 18 nt, Mycobacterium avium subsp. paratuberculosis
ggggagccgugcagcgcc

SEQ ID NO: 975835 - RNA, 20 nt, Mycobacterium avium subsp. paratuberculosis
ggggaauggcggucagcggg

SEQ ID NO: 975836 - RNA, 16 nt, Mycobacterium avium subsp. paratuberculosis
ggggacccgcaccgga

SEQ ID NO: 975837 - RNA, 17 nt, Mycobacterium avium subsp. paratuberculosis
ggggaacaccggcgagg

SEQ ID NO: 975838 - RNA, 20 nt, Mycobacterium avium subsp. paratuberculosis
ggggaaggugcgggcggggc

SEQ ID NO: 975839 - RNA, 16 nt, Mycobacterium avium subsp. paratuberculosis
ggggaagucgaccggg

SEQ ID NO: 975840 - RNA, 16 nt, Mycobacterium avium subsp. paratuberculosis
ggggaagccggccagu

SEQ ID NO: 975841 - RNA, 21 nt, Mycobacterium avium subsp. paratuberculosis
ggggcagaccgugugccagcc

SEQ ID NO: 975842 - RNA, 14 nt, Mycobacterium avium subsp. paratuberculosis
ggggcagcagcaga

SEQ ID NO: 975843 - RNA, 18 nt, Mycobacterium avium subsp. paratuberculosis
ggggcagcagcgcccacc

SEQ ID NO: 975844 - RNA, 22 nt, Mycobacterium avium subsp. paratuberculosis
ggggcacgcgcgcccggcaccg

SEQ ID NO: 975845 - RNA, 21 nt, Mycobacterium avium subsp. paratuberculosis
ggggcacguccccgugcagcc

SEQ ID NO: 975846 - RNA, 17 nt, Mycobacterium avium subsp. paratuberculosis
ggggaugucgucgggcg

SEQ ID NO: 975847 - RNA, 16 nt, Mycobacterium avium subsp. paratuberculosis
ggggauggugcgccgg

SEQ ID NO: 975848 - RNA, 17 nt, Mycobacterium avium subsp. paratuberculosis
ggggauggugcgccggg

SEQ ID NO: 975849 - RNA, 20 nt, Mycobacterium avium subsp. paratuberculosis
ggggauggugcgccgggucg

SEQ ID NO: 975850 - RNA, 17 nt, Mycobacterium avium subsp. paratuberculosis
ggggauguaugcggucc

SEQ ID NO: 975851 - RNA, 16 nt, Mycobacterium avium subsp. paratuberculosis
ggggaguucgcgguug

SEQ ID NO: 975852 - RNA, 22 nt, Mycobacterium avium subsp. paratuberculosis
ggggaucaggaugacgccgcgg

SEQ ID NO: 975853 - RNA, 18 nt, Mycobacterium avium subsp. paratuberculosis
ggggauccagcggcggcc

SEQ ID NO: 975854 - RNA, 19 nt, Mycobacterium avium subsp. paratuberculosis
ggggauccgccugcgcggg

SEQ ID NO: 975855 - RNA, 23 nt, Mycobacterium avium subsp. paratuberculosis
gggggaccagcgcaaccgcggcg

SEQ ID NO: 975856 - RNA, 15 nt, Mycobacterium avium subsp. paratuberculosis
gggggacgaaccagu

SEQ ID NO: 975857 - RNA, 12 nt, Mycobacterium avium subsp. paratuberculosis
gggggccaggcg

SEQ ID NO: 975858 - RNA, 19 nt, Mycobacterium avium subsp. paratuberculosis
gggggauccgccugcgcgg

SEQ ID NO: 975859 - RNA, 22 nt, Mycobacterium avium subsp. paratuberculosis
gggggcgccgcggcgccgccac

SEQ ID NO: 975860 - RNA, 13 nt, Mycobacterium avium subsp. paratuberculosis
gggggcgagccgg

SEQ ID NO: 975861 - RNA, 14 nt, Mycobacterium avium subsp. paratuberculosis
gggggcgagccggc

SEQ ID NO: 975862 - RNA, 22 nt, Mycobacterium avium subsp. paratuberculosis
ggggcuucgaacgcccgcacca

SEQ ID NO: 975863 - RNA, 20 nt, Mycobacterium avium subsp. paratuberculosis
ggggcuguccucccagcgcc

SEQ ID NO: 975864 - RNA, 23 nt, Mycobacterium avium subsp. paratuberculosis
ggggcuguccucccagcgcccgg

SEQ ID NO: 975865 - RNA, 23 nt, Mycobacterium avium subsp. paratuberculosis
ggggcuggccgcacggugcagca

SEQ ID NO: 975866 - RNA, 17 nt, Mycobacterium avium subsp. paratuberculosis
ggggcugcgcggcuugc

SEQ ID NO: 975867 - RNA, 16 nt, Mycobacterium avium subsp. paratuberculosis
ggggcugcgggccagg

SEQ ID NO: 975868 - RNA, 18 nt, Mycobacterium avium subsp. paratuberculosis
ggggcugcgggccaggcg

SEQ ID NO: 975869 - RNA, 19 nt, Mycobacterium avium subsp. paratuberculosis
ggggcucagccgaagccgg

SEQ ID NO: 975870 - RNA, 17 nt, Mycobacterium avium subsp. paratuberculosis
ggggcguuggugcggga

SEQ ID NO: 975871 - RNA, 13 nt, Mycobacterium avium subsp. paratuberculosis
ggggcggccgggc

SEQ ID NO: 975872 - RNA, 16 nt, Mycobacterium avium subsp. paratuberculosis
ggggcggugcagccgg

SEQ ID NO: 975873 - RNA, 17 nt, Mycobacterium avium subsp. paratuberculosis
ggggcggugcagccggg

SEQ ID NO: 975874 - RNA, 18 nt, Mycobacterium avium subsp. paratuberculosis
ggggcggugcagccgggu

SEQ ID NO: 975875 - RNA, 17 nt, Mycobacterium avium subsp. paratuberculosis
ggggcguacgcgcugcc

SEQ ID NO: 975876 - RNA, 14 nt, Mycobacterium avium subsp. paratuberculosis
ggggcgucgccgcc

SEQ ID NO: 975877 - RNA, 12 nt, Mycobacterium avium subsp. paratuberculosis
ggggcgggcacg

SEQ ID NO: 975878 - RNA, 17 nt, Mycobacterium avium subsp. paratuberculosis
ggggcggcggcgccggg

SEQ ID NO: 975879 - RNA, 12 nt, Mycobacterium avium subsp. paratuberculosis
ggggcggcgggc

SEQ ID NO: 975880 - RNA, 17 nt, Mycobacterium avium subsp. paratuberculosis
ggggcggcggggugacg

SEQ ID NO: 975881 - RNA, 18 nt, Mycobacterium avium subsp. paratuberculosis
ggggcgaccuugcgcagc

SEQ ID NO: 975882 - RNA, 21 nt, Mycobacterium avium subsp. paratuberculosis
ggggccucgaugcggccgucg

SEQ ID NO: 975883 - RNA, 19 nt, Mycobacterium avium subsp. paratuberculosis
ggggccggcgcggugggcg

SEQ ID NO: 975884 - RNA, 15 nt, Mycobacterium avium subsp. paratuberculosis
ggggccggcggcggc

SEQ ID NO: 975885 - RNA, 18 nt, Mycobacterium avium subsp. paratuberculosis
ggggccggcggcggccag

SEQ ID NO: 975886 - RNA, 17 nt, Mycobacterium avium subsp. paratuberculosis
ggggccggacggugacg

SEQ ID NO: 975887 - RNA, 15 nt, Mycobacterium avium subsp. paratuberculosis
ggggcgcgggcggca

SEQ ID NO: 975888 - RNA, 17 nt, Mycobacterium avium subsp. paratuberculosis
ggggcgcgggcggcagg

SEQ ID NO: 975889 - RNA, 19 nt, Mycobacterium avium subsp. paratuberculosis
ggggcgccgcggcgccgcc

SEQ ID NO: 975890 - RNA, 23 nt, Mycobacterium avium subsp. paratuberculosis
ggggcgcggcaucgugaugcggg

SEQ ID NO: 975891 - RNA, 17 nt, Mycobacterium avium subsp. paratuberculosis
ggggcgccgacagucgc

SEQ ID NO: 975892 - RNA, 22 nt, Mycobacterium avium subsp. paratuberculosis
ggggcgccgccgaacagcagcg

SEQ ID NO: 975893 - RNA, 14 nt, Mycobacterium avium subsp. paratuberculosis
ggggcgcagcccgg

SEQ ID NO: 975894 - RNA, 18 nt, Mycobacterium avium subsp. paratuberculosis
ggggcgcagcccggcggu

SEQ ID NO: 975895 - RNA, 17 nt, Mycobacterium avium subsp. paratuberculosis
ggggcaucccugacacg

SEQ ID NO: 975896 - RNA, 18 nt, Mycobacterium avium subsp. paratuberculosis
ggggcauggugucaggau

SEQ ID NO: 975897 - RNA, 15 nt, Mycobacterium avium subsp. paratuberculosis
ggggccaccaggcgc

SEQ ID NO: 975898 - RNA, 15 nt, Mycobacterium avium subsp. paratuberculosis
ggggcagggcauccg

SEQ ID NO: 975899 - RNA, 16 nt, Mycobacterium avium subsp. paratuberculosis
ggggcagggcauccgg

SEQ ID NO: 975900 - RNA, 13 nt, Mycobacterium avium subsp. paratuberculosis
ggggccgccgucg

SEQ ID NO: 975901 - RNA, 14 nt, Mycobacterium avium subsp. paratuberculosis
ggggcccggcccgg

SEQ ID NO: 975902 - RNA, 20 nt, Mycobacterium avium subsp. paratuberculosis
ggggcccaauaccguuccgc

SEQ ID NO: 975903 - RNA, 23 nt, Mycobacterium avium subsp. paratuberculosis
gggagcacgugaugagcgaggac

SEQ ID NO: 975904 - RNA, 13 nt, Mycobacterium avium subsp. paratuberculosis
gggagagcgcggg

SEQ ID NO: 975905 - RNA, 18 nt, Mycobacterium avium subsp. paratuberculosis
gggagccgugcagcgccc

SEQ ID NO: 975906 - RNA, 16 nt, Mycobacterium avium subsp. paratuberculosis
gggaggacagcgcggu

SEQ ID NO: 975907 - RNA, 14 nt, Mycobacterium avium subsp. paratuberculosis
gggaggacagggag

SEQ ID NO: 975908 - RNA, 21 nt, Mycobacterium avium subsp. paratuberculosis
gggaggacagggaggacagca

SEQ ID NO: 975909 - RNA, 21 nt, Mycobacterium avium subsp. paratuberculosis
gggacugcgccggggccgcgg

SEQ ID NO: 975910 - RNA, 14 nt, Mycobacterium avium subsp. paratuberculosis
gggacuggauggcg

SEQ ID NO: 975911 - RNA, 12 nt, Mycobacterium avium subsp. paratuberculosis
gggacugcagcg

SEQ ID NO: 975912 - RNA, 18 nt, Mycobacterium avium subsp. paratuberculosis
gggacuccggggacgggu

SEQ ID NO: 975913 - RNA, 18 nt, Mycobacterium avium subsp. paratuberculosis
gggacgggucggcggcga

SEQ ID NO: 975914 - RNA, 21 nt, Mycobacterium avium subsp. paratuberculosis
gggacgggucggugguucgcg

SEQ ID NO: 975915 - RNA, 23 nt, Mycobacterium avium subsp. paratuberculosis
gggacggguugcaggccacgccc

SEQ ID NO: 975916 - RNA, 13 nt, Mycobacterium avium subsp. paratuberculosis
gggacggcggcga

SEQ ID NO: 975917 - RNA, 12 nt, Mycobacterium avium subsp. paratuberculosis
gggacggccagc

SEQ ID NO: 975918 - RNA, 16 nt, Mycobacterium avium subsp. paratuberculosis
gggacggccagcaggg

SEQ ID NO: 975919 - RNA, 19 nt, Mycobacterium avium subsp. paratuberculosis
gggacggcggguggggguc

SEQ ID NO: 975920 - RNA, 13 nt, Mycobacterium avium subsp. paratuberculosis
gggacgcggcagg

SEQ ID NO: 975921 - RNA, 16 nt, Mycobacterium avium subsp. paratuberculosis
gggacgcggcaggcgc

SEQ ID NO: 975922 - RNA, 20 nt, Mycobacterium avium subsp. paratuberculosis
gggacgcgguccagcuuguc

SEQ ID NO: 975923 - RNA, 14 nt, Mycobacterium avium subsp. paratuberculosis
gggacgcugaucua

SEQ ID NO: 975924 - RNA, 15 nt, Mycobacterium avium subsp. paratuberculosis
gggacacggcggcgc

SEQ ID NO: 975925 - RNA, 19 nt, Mycobacterium avium subsp. paratuberculosis
gggacagcaccaccagguc

SEQ ID NO: 975926 - RNA, 12 nt, Mycobacterium avium subsp. paratuberculosis
gggacagccgcg

SEQ ID NO: 975927 - RNA, 14 nt, Mycobacterium avium subsp. paratuberculosis
gggacauccgugag

SEQ ID NO: 975928 - RNA, 20 nt, Mycobacterium avium subsp. paratuberculosis
gggacaucgucgcgcccagg

SEQ ID NO: 975929 - RNA, 20 nt, Mycobacterium avium subsp. paratuberculosis
gggacagguagcgcagcccg

SEQ ID NO: 975930 - RNA, 21 nt, Mycobacterium avium subsp. paratuberculosis
gggaccugggucugcggccgg

SEQ ID NO: 975931 - RNA, 17 nt, Mycobacterium avium subsp. paratuberculosis
gggaccgucgcgcagcc

SEQ ID NO: 975932 - RNA, 19 nt, Mycobacterium avium subsp. paratuberculosis
gggaccgucgcgcagcccg

SEQ ID NO: 975933 - RNA, 13 nt, Mycobacterium avium subsp. paratuberculosis
gggaccgcgggcg

SEQ ID NO: 975934 - RNA, 23 nt, Mycobacterium avium subsp. paratuberculosis
gggaccacccgcagcgcggcgga

SEQ ID NO: 975935 - RNA, 24 nt, Mycobacterium avium subsp. paratuberculosis
gggaccgaggugccgcgggucgau

SEQ ID NO: 975936 - RNA, 21 nt, Mycobacterium avium subsp. paratuberculosis
gggaccgcacgccggguuggg

SEQ ID NO: 975937 - RNA, 16 nt, Mycobacterium avium subsp. paratuberculosis
gggaauggggcccggu

SEQ ID NO: 975938 - RNA, 16 nt, Mycobacterium avium subsp. paratuberculosis
gggaaucccacccgca

SEQ ID NO: 975939 - RNA, 17 nt, Mycobacterium avium subsp. paratuberculosis
gggaaggugcgggcggg

SEQ ID NO: 975940 - RNA, 18 nt, Mycobacterium avium subsp. paratuberculosis
gggaaguagggcagcccg

SEQ ID NO: 975941 - RNA, 19 nt, Mycobacterium avium subsp. paratuberculosis
gggaagucgaccggggcgc

SEQ ID NO: 975942 - RNA, 17 nt, Mycobacterium avium subsp. paratuberculosis
gggaaucacgccccagg

SEQ ID NO: 975943 - RNA, 20 nt, Mycobacterium avium subsp. paratuberculosis
gggaagcccagcacccgcuc

SEQ ID NO: 975944 - RNA, 21 nt, Mycobacterium avium subsp. paratuberculosis
gggaagagcggcgugaccggg

SEQ ID NO: 975945 - RNA, 13 nt, Mycobacterium avium subsp. paratuberculosis
gggaagggcccgg

SEQ ID NO: 975946 - RNA, 15 nt, Mycobacterium avium subsp. paratuberculosis
gggaagggcuccccg

SEQ ID NO: 975947 - RNA, 12 nt, Mycobacterium avium subsp. paratuberculosis
gggaagcuggug

SEQ ID NO: 975948 - RNA, 17 nt, Mycobacterium avium subsp. paratuberculosis
gggaagccgcagcaggu

SEQ ID NO: 975949 - RNA, 15 nt, Mycobacterium avium subsp. paratuberculosis
gggaaaggcagcagc

SEQ ID NO: 975950 - RNA, 17 nt, Mycobacterium avium subsp. paratuberculosis
gggaacggucagccgcg

SEQ ID NO: 975951 - RNA, 19 nt, Mycobacterium avium subsp. paratuberculosis
gggaacgucauggccagcu

SEQ ID NO: 975952 - RNA, 20 nt, Mycobacterium avium subsp. paratuberculosis
gggaacgaucggcuccagcg

SEQ ID NO: 975953 - RNA, 12 nt, Mycobacterium avium subsp. paratuberculosis
gggaacagccag

SEQ ID NO: 975954 - RNA, 22 nt, Mycobacterium avium subsp. paratuberculosis
gggagugacguugagcacccgg

SEQ ID NO: 975955 - RNA, 15 nt, Mycobacterium avium subsp. paratuberculosis
gggaguggccggcgu

SEQ ID NO: 975956 - RNA, 13 nt, Mycobacterium avium subsp. paratuberculosis
gggauagggcgcg

SEQ ID NO: 975957 - RNA, 21 nt, Mycobacterium avium subsp. paratuberculosis
gggaggccagcaccuucagcg

SEQ ID NO: 975958 - RNA, 23 nt, Mycobacterium avium subsp. paratuberculosis
gggaggcggcgguauucgucacc

SEQ ID NO: 975959 - RNA, 21 nt, Mycobacterium avium subsp. paratuberculosis
gggagguacucgagcgugccc

SEQ ID NO: 975960 - RNA, 19 nt, Mycobacterium avium subsp. paratuberculosis
gggaucgcgcagccgcggu

SEQ ID NO: 975961 - RNA, 20 nt, Mycobacterium avium subsp. paratuberculosis
gggaucggaccgcaccacca

SEQ ID NO: 975962 - RNA, 20 nt, Mycobacterium avium subsp. paratuberculosis
gggauccggauugccgggca

SEQ ID NO: 975963 - RNA, 22 nt, Mycobacterium avium subsp. paratuberculosis
gggauuuggcuagcgggcgcgc

SEQ ID NO: 975964 - RNA, 15 nt, Mycobacterium avium subsp. paratuberculosis
gggauuucccgggcg

SEQ ID NO: 975965 - RNA, 14 nt, Mycobacterium avium subsp. paratuberculosis
gggauugccgggca

SEQ ID NO: 975966 - RNA, 22 nt, Mycobacterium avium subsp. paratuberculosis
gggauugccgggcaccagcgac

SEQ ID NO: 975967 - RNA, 22 nt, Mycobacterium avium subsp. paratuberculosis
gggcaaccacagcggcgcauga

SEQ ID NO: 975968 - RNA, 15 nt, Mycobacterium avium subsp. paratuberculosis
gggcaacagcgcgcc

SEQ ID NO: 975969 - RNA, 16 nt, Mycobacterium avium subsp. paratuberculosis
gggcaacagcgcgccg

SEQ ID NO: 975970 - RNA, 18 nt, Mycobacterium avium subsp. paratuberculosis
gggaugucgugggcgugc

SEQ ID NO: 975971 - RNA, 15 nt, Mycobacterium avium subsp. paratuberculosis
gggaugugcugcagg

SEQ ID NO: 975972 - RNA, 16 nt, Mycobacterium avium subsp. paratuberculosis
gggauggugagcccga

SEQ ID NO: 975973 - RNA, 21 nt, Mycobacterium avium subsp. paratuberculosis
gggaugccugcccgcgcaggc

SEQ ID NO: 975974 - RNA, 13 nt, Mycobacterium avium subsp. paratuberculosis
gggaugcgcaucc

SEQ ID NO: 975975 - RNA, 21 nt, Mycobacterium avium subsp. paratuberculosis
gggaucugcgccgccuccggg

SEQ ID NO: 975976 - RNA, 22 nt, Mycobacterium avium subsp. paratuberculosis
gggcagcaccagcggcaccagg

SEQ ID NO: 975977 - RNA, 13 nt, Mycobacterium avium subsp. paratuberculosis
gggcagcccaggu

SEQ ID NO: 975978 - RNA, 12 nt, Mycobacterium avium subsp. paratuberculosis
gggcagccgcgc

SEQ ID NO: 975979 - RNA, 16 nt, Mycobacterium avium subsp. paratuberculosis
gggcagccgcgcgugc

SEQ ID NO: 975980 - RNA, 19 nt, Mycobacterium avium subsp. paratuberculosis
gggcagcccgaacagccgg

SEQ ID NO: 975981 - RNA, 13 nt, Mycobacterium avium subsp. paratuberculosis
gggcagcccgccg

SEQ ID NO: 975982 - RNA, 21 nt, Mycobacterium avium subsp. paratuberculosis
gggcagcccgccgcggaucgg

SEQ ID NO: 975983 - RNA, 13 nt, Mycobacterium avium subsp. paratuberculosis
gggcagcccgggu

SEQ ID NO: 975984 - RNA, 12 nt, Mycobacterium avium subsp. paratuberculosis
gggcagccagcc

SEQ ID NO: 975985 - RNA, 16 nt, Mycobacterium avium subsp. paratuberculosis
gggcagcagcaccagc

SEQ ID NO: 975986 - RNA, 13 nt, Mycobacterium avium subsp. paratuberculosis
gggcagcucgucg

SEQ ID NO: 975987 - RNA, 20 nt, Mycobacterium avium subsp. paratuberculosis
gggcagcugauagcccgccg

SEQ ID NO: 975988 - RNA, 17 nt, Mycobacterium avium subsp. paratuberculosis
gggcagcgcgaccagcc

SEQ ID NO: 975989 - RNA, 23 nt, Mycobacterium avium subsp. paratuberculosis
gggcagguacugcuugccgccgg

SEQ ID NO: 975990 - RNA, 16 nt, Mycobacterium avium subsp. paratuberculosis
gggcaggauggucagc

SEQ ID NO: 975991 - RNA, 22 nt, Mycobacterium avium subsp. paratuberculosis
gggcaggcucagguaggcgcgg

SEQ ID NO: 975992 - RNA, 19 nt, Mycobacterium avium subsp. paratuberculosis
gggcagggucgcggagcgg

SEQ ID NO: 975993 - RNA, 20 nt, Mycobacterium avium subsp. paratuberculosis
gggcaggguuuucacgucga

SEQ ID NO: 975994 - RNA, 13 nt, Mycobacterium avium subsp. paratuberculosis
gggcacucccuug

SEQ ID NO: 975995 - RNA, 20 nt, Mycobacterium avium subsp. paratuberculosis
gggcacggucagguggaugg

SEQ ID NO: 975996 - RNA, 16 nt, Mycobacterium avium subsp. paratuberculosis
gggcacggugggacgg

SEQ ID NO: 975997 - RNA, 15 nt, Mycobacterium avium subsp. paratuberculosis
gggcacgucggccag

SEQ ID NO: 975998 - RNA, 19 nt, Mycobacterium avium subsp. paratuberculosis
gggcacgucggccaggauc

SEQ ID NO: 975999 - RNA, 19 nt, Mycobacterium avium subsp. paratuberculosis
gggcagaccgugugccagc

SEQ ID NO: 976000 - RNA, 19 nt, Mycobacterium avium subsp. paratuberculosis
gggcaccccaucggccagg

SEQ ID NO: 976001 - RNA, 22 nt, Mycobacterium avium subsp. paratuberculosis
gggcaccccaucggccaggaac

SEQ ID NO: 976002 - RNA, 22 nt, Mycobacterium avium subsp. paratuberculosis
gggcaccgucgauuucaagggg

SEQ ID NO: 976003 - RNA, 16 nt, Mycobacterium avium subsp. paratuberculosis
gggcaccucggccagg

SEQ ID NO: 976004 - RNA, 20 nt, Mycobacterium avium subsp. paratuberculosis
gggcaccugauaggggucgg

SEQ ID NO: 976005 - RNA, 16 nt, Mycobacterium avium subsp. paratuberculosis
gggcaccgcgcccgcc

SEQ ID NO: 976006 - RNA, 17 nt, Mycobacterium avium subsp. paratuberculosis
gggcaccgcgcccgccc

SEQ ID NO: 976007 - RNA, 17 nt, Mycobacterium avium subsp. paratuberculosis
gggcaccggcaccgccc

SEQ ID NO: 976008 - RNA, 19 nt, Mycobacterium avium subsp. paratuberculosis
gggcacgaauucgguggcg

SEQ ID NO: 976009 - RNA, 17 nt, Mycobacterium avium subsp. paratuberculosis
gggcacgcgcgcccggc

SEQ ID NO: 976010 - RNA, 21 nt, Mycobacterium avium subsp. paratuberculosis
gggcaaucgcugcgcccgccg

SEQ ID NO: 976011 - RNA, 16 nt, Mycobacterium avium subsp. paratuberculosis
gggcacauagcucagg

SEQ ID NO: 976012 - RNA, 17 nt, Mycobacterium avium subsp. paratuberculosis
gggcacauagcucaggu

SEQ ID NO: 976013 - RNA, 17 nt, Mycobacterium avium subsp. paratuberculosis
gggcaccacggcggcau

SEQ ID NO: 976014 - RNA, 15 nt, Mycobacterium avium subsp. paratuberculosis
ggcugugggcgcagg

SEQ ID NO: 976015 - RNA, 18 nt, Mycobacterium avium subsp. paratuberculosis
ggcuguggaugacgcagc

SEQ ID NO: 976016 - RNA, 13 nt, Mycobacterium avium subsp. paratuberculosis
ggcugucggcgcc

SEQ ID NO: 976017 - RNA, 14 nt, Mycobacterium avium subsp. paratuberculosis
ggcugucggaggcc

SEQ ID NO: 976018 - RNA, 15 nt, Mycobacterium avium subsp. paratuberculosis
ggcugucggaggccu

SEQ ID NO: 976019 - RNA, 14 nt, Mycobacterium avium subsp. paratuberculosis
ggcuguccucccag

SEQ ID NO: 976020 - RNA, 15 nt, Mycobacterium avium subsp. paratuberculosis
ggcuguccaccugca

SEQ ID NO: 976021 - RNA, 13 nt, Mycobacterium avium subsp. paratuberculosis
ggcuguccagcag

SEQ ID NO: 976022 - RNA, 14 nt, Mycobacterium avium subsp. paratuberculosis
ggcuguccagcagc

SEQ ID NO: 976023 - RNA, 19 nt, Mycobacterium avium subsp. paratuberculosis
ggcuguagcacccggccgg

SEQ ID NO: 976024 - RNA, 21 nt, Mycobacterium avium subsp. paratuberculosis
ggcuguagcacccggccggcg

SEQ ID NO: 976025 - RNA, 20 nt, Mycobacterium avium subsp. paratuberculosis
ggcuggucggccuggcccaa

SEQ ID NO: 976026 - RNA, 14 nt, Mycobacterium avium subsp. paratuberculosis
ggcuggucggcggc

SEQ ID NO: 976027 - RNA, 15 nt, Mycobacterium avium subsp. paratuberculosis
ggcuggucggcggcc

SEQ ID NO: 976028 - RNA, 13 nt, Mycobacterium avium subsp. paratuberculosis
ggcuggugcagca

SEQ ID NO: 976029 - RNA, 18 nt, Mycobacterium avium subsp. paratuberculosis
ggcuggugcagcagcugg

SEQ ID NO: 976030 - RNA, 16 nt, Mycobacterium avium subsp. paratuberculosis
ggcuggugcgcagccg

SEQ ID NO: 976031 - RNA, 17 nt, Mycobacterium avium subsp. paratuberculosis
ggcugggcagccgcgcg

SEQ ID NO: 976032 - RNA, 16 nt, Mycobacterium avium subsp. paratuberculosis
ggcuggcgugcggcgc

SEQ ID NO: 976033 - RNA, 14 nt, Mycobacterium avium subsp. paratuberculosis
ggcugggucaccac

SEQ ID NO: 976034 - RNA, 22 nt, Mycobacterium avium subsp. paratuberculosis
ggcugggcuuccacagcccguu

SEQ ID NO: 976035 - RNA, 12 nt, Mycobacterium avium subsp. paratuberculosis
ggcuggccagcu

SEQ ID NO: 976036 - RNA, 15 nt, Mycobacterium avium subsp. paratuberculosis
ggcuggccaggcugg

SEQ ID NO: 976037 - RNA, 21 nt, Mycobacterium avium subsp. paratuberculosis
ggcuggcccggcgcggcggcg

SEQ ID NO: 976038 - RNA, 20 nt, Mycobacterium avium subsp. paratuberculosis
ggcuggcaugccggaacacc

SEQ ID NO: 976039 - RNA, 13 nt, Mycobacterium avium subsp. paratuberculosis
ggcuggcaacagu

SEQ ID NO: 976040 - RNA, 16 nt, Mycobacterium avium subsp. paratuberculosis
ggcugcuggcgcuggg

SEQ ID NO: 976041 - RNA, 23 nt, Mycobacterium avium subsp. paratuberculosis
ggcuggacaccacgucgucggcc

SEQ ID NO: 976042 - RNA, 18 nt, Mycobacterium avium subsp. paratuberculosis
ggcugcugcacgucgccg

SEQ ID NO: 976043 - RNA, 21 nt, Mycobacterium avium subsp. paratuberculosis
ggcugcugcacgucgccggcg

SEQ ID NO: 976044 - RNA, 15 nt, Mycobacterium avium subsp. paratuberculosis
ggcugcucggcgggc

SEQ ID NO: 976045 - RNA, 15 nt, Mycobacterium avium subsp. paratuberculosis
ggcugcgguuccggg

SEQ ID NO: 976046 - RNA, 17 nt, Mycobacterium avium subsp. paratuberculosis
ggcugcgguuggccggc

SEQ ID NO: 976047 - RNA, 23 nt, Mycobacterium avium subsp. paratuberculosis
ggcugcgguuggccggccgggcg

SEQ ID NO: 976048 - RNA, 20 nt, Mycobacterium avium subsp. paratuberculosis
ggcuuccuccucggcgcgga

SEQ ID NO: 976049 - RNA, 14 nt, Mycobacterium avium subsp. paratuberculosis
ggcuuccuccucgg

SEQ ID NO: 976050 - RNA, 15 nt, Mycobacterium avium subsp. paratuberculosis
ggcuuccuccucggc

SEQ ID NO: 976051 - RNA, 20 nt, Mycobacterium avium subsp. paratuberculosis
ggcuucgccgccgcaccggc

SEQ ID NO: 976052 - RNA, 14 nt, Mycobacterium avium subsp. paratuberculosis
ggcuuccaccugcg

SEQ ID NO: 976053 - RNA, 19 nt, Mycobacterium avium subsp. paratuberculosis
ggcuuaccggcgggcggcg

SEQ ID NO: 976054 - RNA, 21 nt, Mycobacterium avium subsp. paratuberculosis
ggcuuaccggcgggcggcggc

SEQ ID NO: 976055 - RNA, 15 nt, Mycobacterium avium subsp. paratuberculosis
ggcuugaaaguccgc

SEQ ID NO: 976056 - RNA, 15 nt, Mycobacterium avium subsp. paratuberculosis
ggcucugccugcagg

SEQ ID NO: 976057 - RNA, 22 nt, Mycobacterium avium subsp. paratuberculosis
ggcucgucggcgaacagugcac

SEQ ID NO: 976058 - RNA, 20 nt, Mycobacterium avium subsp. paratuberculosis
ggcucguggaacgacgccag

SEQ ID NO: 976059 - RNA, 19 nt, Mycobacterium avium subsp. paratuberculosis
ggcucgugcagccggcggc

SEQ ID NO: 976060 - RNA, 20 nt, Mycobacterium avium subsp. paratuberculosis
ggcucgugcagccggcggcg

SEQ ID NO: 976061 - RNA, 19 nt, Mycobacterium avium subsp. paratuberculosis
ggcucggugcgccagauca

SEQ ID NO: 976062 - RNA, 17 nt, Mycobacterium avium subsp. paratuberculosis
ggcucggucuccuccag

SEQ ID NO: 976063 - RNA, 14 nt, Mycobacterium avium subsp. paratuberculosis
ggcucggcccgccg

SEQ ID NO: 976064 - RNA, 15 nt, Mycobacterium avium subsp. paratuberculosis
ggcucggcgccccac

SEQ ID NO: 976065 - RNA, 20 nt, Mycobacterium avium subsp. paratuberculosis
ggcucgauguugaucgccau

SEQ ID NO: 976066 - RNA, 15 nt, Mycobacterium avium subsp. paratuberculosis
ggcucgagggcggcg

SEQ ID NO: 976067 - RNA, 17 nt, Mycobacterium avium subsp. paratuberculosis
ggcucgccugcgagcgu

SEQ ID NO: 976068 - RNA, 18 nt, Mycobacterium avium subsp. paratuberculosis
ggcucgccgggcugcacg

SEQ ID NO: 976069 - RNA, 23 nt, Mycobacterium avium subsp. paratuberculosis
ggcucgcgcuggcggccaucgcc

SEQ ID NO: 976070 - RNA, 14 nt, Mycobacterium avium subsp. paratuberculosis
ggcucgcgggggcc

SEQ ID NO: 976071 - RNA, 14 nt, Mycobacterium avium subsp. paratuberculosis
ggcucgcggguguc

SEQ ID NO: 976072 - RNA, 13 nt, Mycobacterium avium subsp. paratuberculosis
ggcuccacagcag

SEQ ID NO: 976073 - RNA, 20 nt, Mycobacterium avium subsp. paratuberculosis
ggcuccaccgcgccggcggc

SEQ ID NO: 976074 - RNA, 22 nt, Mycobacterium avium subsp. paratuberculosis
ggcuccaccgcgccggcggcgg

SEQ ID NO: 976075 - RNA, 19 nt, Mycobacterium avium subsp. paratuberculosis
ggcucccagucccagcaca

SEQ ID NO: 976076 - RNA, 21 nt, Mycobacterium avium subsp. paratuberculosis
ggcuccugccguucggccagc

SEQ ID NO: 976077 - RNA, 20 nt, Mycobacterium avium subsp. paratuberculosis
ggcucgaacaacccggccgc

SEQ ID NO: 976078 - RNA, 21 nt, Mycobacterium avium subsp. paratuberculosis
ggcucgaacaacccggccgcg

SEQ ID NO: 976079 - RNA, 19 nt, Mycobacterium avium subsp. paratuberculosis
ggcucgagcaacaccaccu

SEQ ID NO: 976080 - RNA, 20 nt, Mycobacterium avium subsp. paratuberculosis
ggcucgaaguggcagcgcuc

SEQ ID NO: 976081 - RNA, 13 nt, Mycobacterium avium subsp. paratuberculosis
ggcucgagcccca

SEQ ID NO: 976082 - RNA, 20 nt, Mycobacterium avium subsp. paratuberculosis
ggcguagggcagcccgagca

SEQ ID NO: 976083 - RNA, 15 nt, Mycobacterium avium subsp. paratuberculosis
ggcguagcgggucag

SEQ ID NO: 976084 - RNA, 14 nt, Mycobacterium avium subsp. paratuberculosis
ggcguagugcgccc

SEQ ID NO: 976085 - RNA, 19 nt, Mycobacterium avium subsp. paratuberculosis
ggcguagugggucggcggc

SEQ ID NO: 976086 - RNA, 20 nt, Mycobacterium avium subsp. paratuberculosis
ggcguagugggucggcggcu

SEQ ID NO: 976087 - RNA, 17 nt, Mycobacterium avium subsp. paratuberculosis
ggcugaucucggcgguc

SEQ ID NO: 976088 - RNA, 12 nt, Mycobacterium avium subsp. paratuberculosis
ggcugagcagcu

SEQ ID NO: 976089 - RNA, 16 nt, Mycobacterium avium subsp. paratuberculosis
ggcugagcagcucgcg

SEQ ID NO: 976090 - RNA, 17 nt, Mycobacterium avium subsp. paratuberculosis
ggcugagcaccgggguc

SEQ ID NO: 976091 - RNA, 20 nt, Mycobacterium avium subsp. paratuberculosis
ggcugaacgccagcagccgc

SEQ ID NO: 976092 - RNA, 20 nt, Mycobacterium avium subsp. paratuberculosis
ggcugaccacgcuccagaug

SEQ ID NO: 976093 - RNA, 14 nt, Mycobacterium avium subsp. paratuberculosis
ggcugacccgcccg

SEQ ID NO: 976094 - RNA, 15 nt, Mycobacterium avium subsp. paratuberculosis
ggcugaccgccagga

SEQ ID NO: 976095 - RNA, 23 nt, Mycobacterium avium subsp. paratuberculosis
ggcugccucgacgaugggugugg

SEQ ID NO: 976096 - RNA, 19 nt, Mycobacterium avium subsp. paratuberculosis
ggcugccggugcugcugua

SEQ ID NO: 976097 - RNA, 18 nt, Mycobacterium avium subsp. paratuberculosis
ggcugccguagaaccgcu

SEQ ID NO: 976098 - RNA, 17 nt, Mycobacterium avium subsp. paratuberculosis
ggcugccggccaaggca

SEQ ID NO: 976099 - RNA, 19 nt, Mycobacterium avium subsp. paratuberculosis
ggcugcgcguucggcgcca

SEQ ID NO: 976100 - RNA, 13 nt, Mycobacterium avium subsp. paratuberculosis
ggcugcgcggcuu

SEQ ID NO: 976101 - RNA, 21 nt, Mycobacterium avium subsp. paratuberculosis
ggcugcgcacguagcccagcg

SEQ ID NO: 976102 - RNA, 23 nt, Mycobacterium avium subsp. paratuberculosis
ggcugcgcacguagcccagcgcg

SEQ ID NO: 976103 - RNA, 19 nt, Mycobacterium avium subsp. paratuberculosis
ggcugcgccgcgcuugcga

SEQ ID NO: 976104 - RNA, 15 nt, Mycobacterium avium subsp. paratuberculosis
ggcugcccucuuccu

SEQ ID NO: 976105 - RNA, 22 nt, Mycobacterium avium subsp. paratuberculosis
ggcugccgaccucgauggcgac

SEQ ID NO: 976106 - RNA, 12 nt, Mycobacterium avium subsp. paratuberculosis
ggcugcccuggg

SEQ ID NO: 976107 - RNA, 15 nt, Mycobacterium avium subsp. paratuberculosis
ggcugcccugggagg

SEQ ID NO: 976108 - RNA, 17 nt, Mycobacterium avium subsp. paratuberculosis
ggcugcccgcgcggcuc

SEQ ID NO: 976109 - RNA, 18 nt, Mycobacterium avium subsp. paratuberculosis
ggcugcccggcccgccgc

SEQ ID NO: 976110 - RNA, 19 nt, Mycobacterium avium subsp. paratuberculosis
ggcugcccgacccgcacca

SEQ ID NO: 976111 - RNA, 22 nt, Mycobacterium avium subsp. paratuberculosis
ggcugcacgucacgggccaggc

SEQ ID NO: 976112 - RNA, 23 nt, Mycobacterium avium subsp. paratuberculosis
ggcugcacgucacgggccaggcg

SEQ ID NO: 976113 - RNA, 15 nt, Mycobacterium avium subsp. paratuberculosis
ggcugcacccucugc

SEQ ID NO: 976114 - RNA, 16 nt, Mycobacterium avium subsp. paratuberculosis
ggcugcacccucugcc

SEQ ID NO: 976115 - RNA, 14 nt, Mycobacterium avium subsp. paratuberculosis
ggcgacggccagcg

SEQ ID NO: 976116 - RNA, 22 nt, Mycobacterium avium subsp. paratuberculosis
ggcgacgcugguggccugcaac

SEQ ID NO: 976117 - RNA, 21 nt, Mycobacterium avium subsp. paratuberculosis
ggcgacggccagcgcggcggu

SEQ ID NO: 976118 - RNA, 16 nt, Mycobacterium avium subsp. paratuberculosis
ggcgacggcgacgacc

SEQ ID NO: 976119 - RNA, 17 nt, Mycobacterium avium subsp. paratuberculosis
ggcgacggcgacggcca

SEQ ID NO: 976120 - RNA, 16 nt, Mycobacterium avium subsp. paratuberculosis
ggcgacggcgacggcg

SEQ ID NO: 976121 - RNA, 17 nt, Mycobacterium avium subsp. paratuberculosis
ggcgacggcgcucaccg

SEQ ID NO: 976122 - RNA, 13 nt, Mycobacterium avium subsp. paratuberculosis
ggcgacggcggcg

SEQ ID NO: 976123 - RNA, 17 nt, Mycobacterium avium subsp. paratuberculosis
ggcgacgccgcgcuggc

SEQ ID NO: 976124 - RNA, 17 nt, Mycobacterium avium subsp. paratuberculosis
ggcgacgccgcggaagc

SEQ ID NO: 976125 - RNA, 16 nt, Mycobacterium avium subsp. paratuberculosis
ggcgacgccggcgagg

SEQ ID NO: 976126 - RNA, 13 nt, Mycobacterium avium subsp. paratuberculosis
ggcgacgccgccg

SEQ ID NO: 976127 - RNA, 15 nt, Mycobacterium avium subsp. paratuberculosis
ggcgacgccgccguc

SEQ ID NO: 976128 - RNA, 22 nt, Mycobacterium avium subsp. paratuberculosis
ggcgacgcucaggcguccagcc

SEQ ID NO: 976129 - RNA, 20 nt, Mycobacterium avium subsp. paratuberculosis
ggcgacgaugaagacccgcc

SEQ ID NO: 976130 - RNA, 18 nt, Mycobacterium avium subsp. paratuberculosis
ggcgacgaugccggccgg

SEQ ID NO: 976131 - RNA, 16 nt, Mycobacterium avium subsp. paratuberculosis
ggcgacgauggccagg

SEQ ID NO: 976132 - RNA, 22 nt, Mycobacterium avium subsp. paratuberculosis
ggcgacgaaccuggcugccugg

SEQ ID NO: 976133 - RNA, 16 nt, Mycobacterium avium subsp. paratuberculosis
ggcgaccuugcgcagc

SEQ ID NO: 976134 - RNA, 20 nt, Mycobacterium avium subsp. paratuberculosis
ggcgacgaagcagcucgcgu

SEQ ID NO: 976135 - RNA, 19 nt, Mycobacterium avium subsp. paratuberculosis
ggcgacgaagucgacggcg

SEQ ID NO: 976136 - RNA, 22 nt, Mycobacterium avium subsp. paratuberculosis
ggcgagcucguucucggcgaac

SEQ ID NO: 976137 - RNA, 16 nt, Mycobacterium avium subsp. paratuberculosis
ggcgagcugcgggugc

SEQ ID NO: 976138 - RNA, 15 nt, Mycobacterium avium subsp. paratuberculosis
ggcgagcucaacagc

SEQ ID NO: 976139 - RNA, 13 nt, Mycobacterium avium subsp. paratuberculosis
ggcgagcgcgugc

SEQ ID NO: 976140 - RNA, 13 nt, Mycobacterium avium subsp. paratuberculosis
ggcgagccgggcc

SEQ ID NO: 976141 - RNA, 17 nt, Mycobacterium avium subsp. paratuberculosis
ggcgagccgggccgggu

SEQ ID NO: 976142 - RNA, 22 nt, Mycobacterium avium subsp. paratuberculosis
ggcgagcgacgccacggggcug

SEQ ID NO: 976143 - RNA, 15 nt, Mycobacterium avium subsp. paratuberculosis
ggcgagccgcucccg

SEQ ID NO: 976144 - RNA, 18 nt, Mycobacterium avium subsp. paratuberculosis
ggcgagccggccguagcg

SEQ ID NO: 976145 - RNA, 17 nt, Mycobacterium avium subsp. paratuberculosis
ggcgagcagcagcgcgg

SEQ ID NO: 976146 - RNA, 17 nt, Mycobacterium avium subsp. paratuberculosis
ggcgacugcgugcuggg

SEQ ID NO: 976147 - RNA, 22 nt, Mycobacterium avium subsp. paratuberculosis
ggcgagcaauuaaccggcaggc

SEQ ID NO: 976148 - RNA, 21 nt, Mycobacterium avium subsp. paratuberculosis
ggcgacgggccgaucacgcgg

SEQ ID NO: 976149 - RNA, 21 nt, Mycobacterium avium subsp. paratuberculosis
ggcgacggcgguucgaagcgc

SEQ ID NO: 976150 - RNA, 13 nt, Mycobacterium avium subsp. paratuberculosis
ggcgacggcgucc

SEQ ID NO: 976151 - RNA, 17 nt, Mycobacterium avium subsp. paratuberculosis
ggcgacggcguccagcu

SEQ ID NO: 976152 - RNA, 19 nt, Mycobacterium avium subsp. paratuberculosis
ggcgacgguggcgcccagc

SEQ ID NO: 976153 - RNA, 14 nt, Mycobacterium avium subsp. paratuberculosis
ggcgacggcagcgc

SEQ ID NO: 976154 - RNA, 14 nt, Mycobacterium avium subsp. paratuberculosis
ggcgacgucgccgg

SEQ ID NO: 976155 - RNA, 19 nt, Mycobacterium avium subsp. paratuberculosis
ggcgacgucgugcacgccg

SEQ ID NO: 976156 - RNA, 20 nt, Mycobacterium avium subsp. paratuberculosis
ggcgacgugccggcggcagg

SEQ ID NO: 976157 - RNA, 13 nt, Mycobacterium avium subsp. paratuberculosis
ggccuuguccuug

SEQ ID NO: 976158 - RNA, 14 nt, Mycobacterium avium subsp. paratuberculosis
ggcgaacaccagca

SEQ ID NO: 976159 - RNA, 23 nt, Mycobacterium avium subsp. paratuberculosis
ggcgaacaccagcccggccgagg

SEQ ID NO: 976160 - RNA, 14 nt, Mycobacterium avium subsp. paratuberculosis
ggcgaacaccugcu

SEQ ID NO: 976161 - RNA, 13 nt, Mycobacterium avium subsp. paratuberculosis
ggccgagcagccg

SEQ ID NO: 976162 - RNA, 21 nt, Mycobacterium avium subsp. paratuberculosis
ggccgagcagccgggccagca

SEQ ID NO: 976163 - RNA, 23 nt, Mycobacterium avium subsp. paratuberculosis
ggccgacugauccaccaucuucc

SEQ ID NO: 976164 - RNA, 13 nt, Mycobacterium avium subsp. paratuberculosis
ggccgagagccgg

SEQ ID NO: 976165 - RNA, 15 nt, Mycobacterium avium subsp. paratuberculosis
ggccgacgcccagca

SEQ ID NO: 976166 - RNA, 13 nt, Mycobacterium avium subsp. paratuberculosis
ggccgacgccggc

SEQ ID NO: 976167 - RNA, 17 nt, Mycobacterium avium subsp. paratuberculosis
ggccgacgccggccacc

SEQ ID NO: 976168 - RNA, 15 nt, Mycobacterium avium subsp. paratuberculosis
ggccgacgcggccuc

SEQ ID NO: 976169 - RNA, 22 nt, Mycobacterium avium subsp. paratuberculosis
ggccgacauggacgcggccuca

SEQ ID NO: 976170 - RNA, 22 nt, Mycobacterium avium subsp. paratuberculosis
ggccgacccugcguccggcccg

SEQ ID NO: 976171 - RNA, 22 nt, Mycobacterium avium subsp. paratuberculosis
ggccgaccgacaguucggcgcg

SEQ ID NO: 976172 - RNA, 15 nt, Mycobacterium avium subsp. paratuberculosis
ggccgaauccggccg

SEQ ID NO: 976173 - RNA, 22 nt, Mycobacterium avium subsp. paratuberculosis
ggccgacacguaggccgccugc

SEQ ID NO: 976174 - RNA, 16 nt, Mycobacterium avium subsp. paratuberculosis
ggccgacagcacgccg

SEQ ID NO: 976175 - RNA, 20 nt, Mycobacterium avium subsp. paratuberculosis
ggccgacagcacgccgggca

SEQ ID NO: 976176 - RNA, 16 nt, Mycobacterium avium subsp. paratuberculosis
ggcgacccccgguguc

SEQ ID NO: 976177 - RNA, 16 nt, Mycobacterium avium subsp. paratuberculosis
ggcgaccaugcccagc

SEQ ID NO: 976178 - RNA, 19 nt, Mycobacterium avium subsp. paratuberculosis
ggcgaccaugcccagcagu

SEQ ID NO: 976179 - RNA, 23 nt, Mycobacterium avium subsp. paratuberculosis
ggcgaccaugccgcgggccagca

SEQ ID NO: 976180 - RNA, 19 nt, Mycobacterium avium subsp. paratuberculosis
ggcgaccaguaggccagca

SEQ ID NO: 976181 - RNA, 15 nt, Mycobacterium avium subsp. paratuberculosis
ggcgaccagccccuc

SEQ ID NO: 976182 - RNA, 21 nt, Mycobacterium avium subsp. paratuberculosis
ggcgaccagcgacggcagguc

SEQ ID NO: 976183 - RNA, 20 nt, Mycobacterium avium subsp. paratuberculosis
ggcgaccagcgagcccagcu

SEQ ID NO: 976184 - RNA, 12 nt, Mycobacterium avium subsp. paratuberculosis
ggcgaccacacc

SEQ ID NO: 976185 - RNA, 18 nt, Mycobacterium avium subsp. paratuberculosis
ggcgaccacaccgccggc

SEQ ID NO: 976186 - RNA, 18 nt, Mycobacterium avium subsp. paratuberculosis
ggcgaccaccaccgccca

SEQ ID NO: 976187 - RNA, 21 nt, Mycobacterium avium subsp. paratuberculosis
ggcgaccaccacggccgcagc

SEQ ID NO: 976188 - RNA, 19 nt, Mycobacterium avium subsp. paratuberculosis
ggcgaccuccugcaaggcc

SEQ ID NO: 976189 - RNA, 23 nt, Mycobacterium avium subsp. paratuberculosis
ggcgaccuccugcaaggcccccg

SEQ ID NO: 976190 - RNA, 16 nt, Mycobacterium avium subsp. paratuberculosis
ggcgaccucggggaug

SEQ ID NO: 976191 - RNA, 21 nt, Mycobacterium avium subsp. paratuberculosis
ggcgaccuggacgccgcacgc

SEQ ID NO: 976192 - RNA, 17 nt, Mycobacterium avium subsp. paratuberculosis
ggcgaccgcccggggcg

SEQ ID NO: 976193 - RNA, 15 nt, Mycobacterium avium subsp. paratuberculosis
ggcgaccuggugcuc

SEQ ID NO: 976194 - RNA, 14 nt, Mycobacterium avium subsp. paratuberculosis
ggcgaccgcgcagg

SEQ ID NO: 976195 - RNA, 15 nt, Mycobacterium avium subsp. paratuberculosis
ggcgaccccggccag

SEQ ID NO: 976196 - RNA, 17 nt, Mycobacterium avium subsp. paratuberculosis
ggcgaccccguucgccg

SEQ ID NO: 976197 - RNA, 16 nt, Mycobacterium avium subsp. paratuberculosis
ggcgacaucgccgcgg

SEQ ID NO: 976198 - RNA, 20 nt, Mycobacterium avium subsp. paratuberculosis
ggcgacaucgccgcggccgg

SEQ ID NO: 976199 - RNA, 15 nt, Mycobacterium avium subsp. paratuberculosis
ggcgacaucggcaca

SEQ ID NO: 976200 - RNA, 19 nt, Mycobacterium avium subsp. paratuberculosis
ggcgacauuggccgcgcgc

SEQ ID NO: 976201 - RNA, 13 nt, Mycobacterium avium subsp. paratuberculosis
ggcgaaccgccgc

SEQ ID NO: 976202 - RNA, 20 nt, Mycobacterium avium subsp. paratuberculosis
ggcgaacauggcggccagcc

SEQ ID NO: 976203 - RNA, 12 nt, Mycobacterium avium subsp. paratuberculosis
ggcgaaccagca

SEQ ID NO: 976204 - RNA, 18 nt, Mycobacterium avium subsp. paratuberculosis
ggcgaaccagcgcccgcu

SEQ ID NO: 976205 - RNA, 15 nt, Mycobacterium avium subsp. paratuberculosis
ggcgaaccagggcag

SEQ ID NO: 976206 - RNA, 18 nt, Mycobacterium avium subsp. paratuberculosis
ggcgaaccagggcagcca

SEQ ID NO: 976207 - RNA, 17 nt, Mycobacterium avium subsp. paratuberculosis
ggcgauaggcggccagc

SEQ ID NO: 976208 - RNA, 18 nt, Mycobacterium avium subsp. paratuberculosis
ggcgauaggcggccagcu

SEQ ID NO: 976209 - RNA, 14 nt, Mycobacterium avium subsp. paratuberculosis
ggcgaucagcccgc

SEQ ID NO: 976210 - RNA, 21 nt, Mycobacterium avium subsp. paratuberculosis
ggcgaugacgucgucgcggcg

SEQ ID NO: 976211 - RNA, 23 nt, Mycobacterium avium subsp. paratuberculosis
ggcgaugacgucgucgcggcgcu

SEQ ID NO: 976212 - RNA, 16 nt, Mycobacterium avium subsp. paratuberculosis
ggcgaucaccccggcg

SEQ ID NO: 976213 - RNA, 14 nt, Mycobacterium avium subsp. paratuberculosis
ggcgaucagcagca

SEQ ID NO: 976214 - RNA, 23 nt, Mycobacterium avium subsp. paratuberculosis
ggcgaucaccgcggccaccuggg

SEQ ID NO: 976215 - RNA, 21 nt, Mycobacterium avium subsp. paratuberculosis
ggcgaucaccgggacaccgcu

SEQ ID NO: 976216 - RNA, 22 nt, Mycobacterium avium subsp. paratuberculosis
ggcgaucaccuugcggccggcg

SEQ ID NO: 976217 - RNA, 19 nt, Mycobacterium avium subsp. paratuberculosis
ggcgaucagaugcucgucg

SEQ ID NO: 976218 - RNA, 13 nt, Mycobacterium avium subsp. paratuberculosis
ggcgccacgcaca

SEQ ID NO: 976219 - RNA, 18 nt, Mycobacterium avium subsp. paratuberculosis
ggcgccagcagcaccuga

SEQ ID NO: 976220 - RNA, 18 nt, Mycobacterium avium subsp. paratuberculosis
ggcgccaccggcuggccg

SEQ ID NO: 976221 - RNA, 19 nt, Mycobacterium avium subsp. paratuberculosis
ggcgccaccgggaccugcu

SEQ ID NO: 976222 - RNA, 20 nt, Mycobacterium avium subsp. paratuberculosis
ggcgcagggccgcuacgccg

SEQ ID NO: 976223 - RNA, 14 nt, Mycobacterium avium subsp. paratuberculosis
ggcgcagggcggcc

SEQ ID NO: 976224 - RNA, 13 nt, Mycobacterium avium subsp. paratuberculosis
ggcgcagcgucuc

SEQ ID NO: 976225 - RNA, 15 nt, Mycobacterium avium subsp. paratuberculosis
ggcgcagcggcccga

SEQ ID NO: 976226 - RNA, 18 nt, Mycobacterium avium subsp. paratuberculosis
ggcgcacggcgcccaggu

SEQ ID NO: 976227 - RNA, 12 nt, Mycobacterium avium subsp. paratuberculosis
ggcgcagcgcga

SEQ ID NO: 976228 - RNA, 16 nt, Mycobacterium avium subsp. paratuberculosis
ggcgcaccaggguguc

SEQ ID NO: 976229 - RNA, 17 nt, Mycobacterium avium subsp. paratuberculosis
ggcgcaccccgaaccag

SEQ ID NO: 976230 - RNA, 21 nt, Mycobacterium avium subsp. paratuberculosis
ggcgcaccccgaaccaguucg

SEQ ID NO: 976231 - RNA, 16 nt, Mycobacterium avium subsp. paratuberculosis
ggcgcaccgcccgcgg

SEQ ID NO: 976232 - RNA, 15 nt, Mycobacterium avium subsp. paratuberculosis
ggcgcaccgccgcgg

SEQ ID NO: 976233 - RNA, 18 nt, Mycobacterium avium subsp. paratuberculosis
ggcgcaccgcgcgccagg

SEQ ID NO: 976234 - RNA, 22 nt, Mycobacterium avium subsp. paratuberculosis
ggcgcaccgugucgucgcugac

SEQ ID NO: 976235 - RNA, 14 nt, Mycobacterium avium subsp. paratuberculosis
ggcgcaccgcggcc

SEQ ID NO: 976236 - RNA, 15 nt, Mycobacterium avium subsp. paratuberculosis
ggcgcaccgcggccu

SEQ ID NO: 976237 - RNA, 16 nt, Mycobacterium avium subsp. paratuberculosis
ggcgcaccgcggccuc

SEQ ID NO: 976238 - RNA, 21 nt, Mycobacterium avium subsp. paratuberculosis
ggcgauuucgucggcgguggg

SEQ ID NO: 976239 - RNA, 15 nt, Mycobacterium avium subsp. paratuberculosis
ggcgcaccaggcgcc

SEQ ID NO: 976240 - RNA, 16 nt, Mycobacterium avium subsp. paratuberculosis
ggcgcaccaggcgcca

SEQ ID NO: 976241 - RNA, 20 nt, Mycobacterium avium subsp. paratuberculosis
ggcgcaccaccagcucgucg

SEQ ID NO: 976242 - RNA, 23 nt, Mycobacterium avium subsp. paratuberculosis
ggcgcaccaaccggccccgagcg

SEQ ID NO: 976243 - RNA, 17 nt, Mycobacterium avium subsp. paratuberculosis
ggcgcaccacgaccucc

SEQ ID NO: 976244 - RNA, 23 nt, Mycobacterium avium subsp. paratuberculosis
ggcgauguugaccacccgcagcg

SEQ ID NO: 976245 - RNA, 14 nt, Mycobacterium avium subsp. paratuberculosis
ggcgaugccgagcc

SEQ ID NO: 976246 - RNA, 13 nt, Mycobacterium avium subsp. paratuberculosis
ggcgaugccgagg

SEQ ID NO: 976247 - RNA, 14 nt, Mycobacterium avium subsp. paratuberculosis
ggcgaugcccagcc

SEQ ID NO: 976248 - RNA, 15 nt, Mycobacterium avium subsp. paratuberculosis
ggcgaugcgcuccag

SEQ ID NO: 976249 - RNA, 17 nt, Mycobacterium avium subsp. paratuberculosis
ggcgaugcgcuccagca

SEQ ID NO: 976250 - RNA, 14 nt, Mycobacterium avium subsp. paratuberculosis
ggcgaugccgccga

SEQ ID NO: 976251 - RNA, 17 nt, Mycobacterium avium subsp. paratuberculosis
ggcgaugccggacucug

SEQ ID NO: 976252 - RNA, 19 nt, Mycobacterium avium subsp. paratuberculosis
ggcggugucgaagaccggu

SEQ ID NO: 976253 - RNA, 20 nt, Mycobacterium avium subsp. paratuberculosis
ggcggugucgaaggccgggg

SEQ ID NO: 976254 - RNA, 22 nt, Mycobacterium avium subsp. paratuberculosis
ggcggugucgaaggccggggug

SEQ ID NO: 976255 - RNA, 18 nt, Mycobacterium avium subsp. paratuberculosis
ggcggugucgcccagcug

SEQ ID NO: 976256 - RNA, 14 nt, Mycobacterium avium subsp. paratuberculosis
ggcgguggcggcga

SEQ ID NO: 976257 - RNA, 19 nt, Mycobacterium avium subsp. paratuberculosis
ggcgguaucgguggauccg

SEQ ID NO: 976258 - RNA, 22 nt, Mycobacterium avium subsp. paratuberculosis
ggcgguggugauggacggggcg

SEQ ID NO: 976259 - RNA, 18 nt, Mycobacterium avium subsp. paratuberculosis
ggcgguacgcgccgcgcg

SEQ ID NO: 976260 - RNA, 20 nt, Mycobacterium avium subsp. paratuberculosis
ggcggggugcgcggcgagcg

SEQ ID NO: 976261 - RNA, 17 nt, Mycobacterium avium subsp. paratuberculosis
ggcggggugggcaccug

SEQ ID NO: 976262 - RNA, 14 nt, Mycobacterium avium subsp. paratuberculosis
ggcgggucugugac

SEQ ID NO: 976263 - RNA, 13 nt, Mycobacterium avium subsp. paratuberculosis
ggcgggugggggu

SEQ ID NO: 976264 - RNA, 18 nt, Mycobacterium avium subsp. paratuberculosis
ggcgggcucgagccccag

SEQ ID NO: 976265 - RNA, 12 nt, Mycobacterium avium subsp. paratuberculosis
ggcgggcggcgg

SEQ ID NO: 976266 - RNA, 14 nt, Mycobacterium avium subsp. paratuberculosis
ggcgggcggcggcg

SEQ ID NO: 976267 - RNA, 20 nt, Mycobacterium avium subsp. paratuberculosis
ggcgggcggcggcugggccg

SEQ ID NO: 976268 - RNA, 13 nt, Mycobacterium avium subsp. paratuberculosis
ggcggggccucca

SEQ ID NO: 976269 - RNA, 19 nt, Mycobacterium avium subsp. paratuberculosis
ggcggggccuccaccagcg

SEQ ID NO: 976270 - RNA, 21 nt, Mycobacterium avium subsp. paratuberculosis
ggcggggccuccaccagcggc

SEQ ID NO: 976271 - RNA, 23 nt, Mycobacterium avium subsp. paratuberculosis
ggcggggccuccaccagcggcgc

SEQ ID NO: 976272 - RNA, 14 nt, Mycobacterium avium subsp. paratuberculosis
ggcggggcgugccc

SEQ ID NO: 976273 - RNA, 21 nt, Mycobacterium avium subsp. paratuberculosis
ggcggggcgugcccggcgccg

SEQ ID NO: 976274 - RNA, 14 nt, Mycobacterium avium subsp. paratuberculosis
ggcgggggcaggga

SEQ ID NO: 976275 - RNA, 15 nt, Mycobacterium avium subsp. paratuberculosis
ggcgggcugcgggca

SEQ ID NO: 976276 - RNA, 18 nt, Mycobacterium avium subsp. paratuberculosis
ggcggggggagaggcgcg

SEQ ID NO: 976277 - RNA, 18 nt, Mycobacterium avium subsp. paratuberculosis
ggcgggguccacgcagug

SEQ ID NO: 976278 - RNA, 14 nt, Mycobacterium avium subsp. paratuberculosis
ggcgggagccggcg

SEQ ID NO: 976279 - RNA, 17 nt, Mycobacterium avium subsp. paratuberculosis
ggcgggagccggcggcg

SEQ ID NO: 976280 - RNA, 17 nt, Mycobacterium avium subsp. paratuberculosis
ggcgggaucgcggcggu

SEQ ID NO: 976281 - RNA, 19 nt, Mycobacterium avium subsp. paratuberculosis
ggcgggcacgucgcgcggg

SEQ ID NO: 976282 - RNA, 23 nt, Mycobacterium avium subsp. paratuberculosis
ggcgggcgcguugaugccgugcg

SEQ ID NO: 976283 - RNA, 11 nt, Mycobacterium avium subsp. paratuberculosis
ggcgggcgcgc

SEQ ID NO: 976284 - RNA, 13 nt, Mycobacterium avium subsp. paratuberculosis
ggcgggcgcgccg

SEQ ID NO: 976285 - RNA, 11 nt, Mycobacterium avium subsp. paratuberculosis
ggcgggccucg

SEQ ID NO: 976286 - RNA, 14 nt, Mycobacterium avium subsp. paratuberculosis
ggcgggccucgccg

SEQ ID NO: 976287 - RNA, 12 nt, Mycobacterium avium subsp. paratuberculosis
ggcgggccggcg

SEQ ID NO: 976288 - RNA, 16 nt, Mycobacterium avium subsp. paratuberculosis
ggcgggcccgcagcuc

SEQ ID NO: 976289 - RNA, 14 nt, Mycobacterium avium subsp. paratuberculosis
ggcgggcccagcag

SEQ ID NO: 976290 - RNA, 12 nt, Mycobacterium avium subsp. paratuberculosis
ggcgggccaggc

SEQ ID NO: 976291 - RNA, 13 nt, Mycobacterium avium subsp. paratuberculosis
ggcgggccaggcg

SEQ ID NO: 976292 - RNA, 13 nt, Mycobacterium avium subsp. paratuberculosis
ggcggcggccagc

SEQ ID NO: 976293 - RNA, 15 nt, Mycobacterium avium subsp. paratuberculosis
ggcggcggcccgccg

SEQ ID NO: 976294 - RNA, 16 nt, Mycobacterium avium subsp. paratuberculosis
ggcggcggcccgccgc

SEQ ID NO: 976295 - RNA, 20 nt, Mycobacterium avium subsp. paratuberculosis
ggcggcggaaucgcaaccag

SEQ ID NO: 976296 - RNA, 20 nt, Mycobacterium avium subsp. paratuberculosis
ggcggcggaccgucgguguc

SEQ ID NO: 976297 - RNA, 15 nt, Mycobacterium avium subsp. paratuberculosis
ggcggcgcuggucgg

SEQ ID NO: 976298 - RNA, 17 nt, Mycobacterium avium subsp. paratuberculosis
ggcggcgcuggucggcg

SEQ ID NO: 976299 - RNA, 14 nt, Mycobacterium avium subsp. paratuberculosis
ggcggcgggcccgg

SEQ ID NO: 976300 - RNA, 21 nt, Mycobacterium avium subsp. paratuberculosis
ggcggcgcucagcgcggcggg

SEQ ID NO: 976301 - RNA, 23 nt, Mycobacterium avium subsp. paratuberculosis
ggcggcggccgcgucgccgaucg

SEQ ID NO: 976302 - RNA, 15 nt, Mycobacterium avium subsp. paratuberculosis
ggcggcggcgccggg

SEQ ID NO: 976303 - RNA, 14 nt, Mycobacterium avium subsp. paratuberculosis
ggcggcggcgcggg

SEQ ID NO: 976304 - RNA, 11 nt, Mycobacterium avium subsp. paratuberculosis
ggcggccgggg

SEQ ID NO: 976305 - RNA, 17 nt, Mycobacterium avium subsp. paratuberculosis
ggcggcgcggcaggaau

SEQ ID NO: 976306 - RNA, 14 nt, Mycobacterium avium subsp. paratuberculosis
ggcggcgcggcggu

SEQ ID NO: 976307 - RNA, 17 nt, Mycobacterium avium subsp. paratuberculosis
ggcggcgcgggcggcgu

SEQ ID NO: 976308 - RNA, 13 nt, Mycobacterium avium subsp. paratuberculosis
ggcggcacccagg

SEQ ID NO: 976309 - RNA, 19 nt, Mycobacterium avium subsp. paratuberculosis
ggcggcaccgauaguagcc

SEQ ID NO: 976310 - RNA, 15 nt, Mycobacterium avium subsp. paratuberculosis
ggcggcaaguccggg

SEQ ID NO: 976311 - RNA, 22 nt, Mycobacterium avium subsp. paratuberculosis
ggcggcagcgacucgggcagga

SEQ ID NO: 976312 - RNA, 23 nt, Mycobacterium avium subsp. paratuberculosis
ggcggcagcgacucgggcaggau

SEQ ID NO: 976313 - RNA, 13 nt, Mycobacterium avium subsp. paratuberculosis
ggcggcagcgcgg

SEQ ID NO: 976314 - RNA, 12 nt, Mycobacterium avium subsp. paratuberculosis
ggcggcagcagc

SEQ ID NO: 976315 - RNA, 14 nt, Mycobacterium avium subsp. paratuberculosis
ggcggcagcagcug

SEQ ID NO: 976316 - RNA, 15 nt, Mycobacterium avium subsp. paratuberculosis
ggcggcagcagcugc

SEQ ID NO: 976317 - RNA, 14 nt, Mycobacterium avium subsp. paratuberculosis
ggcggcagccaggc

SEQ ID NO: 976318 - RNA, 17 nt, Mycobacterium avium subsp. paratuberculosis
ggcggcaaaacgcuggg

SEQ ID NO: 976319 - RNA, 14 nt, Mycobacterium avium subsp. paratuberculosis
ggcggaugggugcg

SEQ ID NO: 976320 - RNA, 20 nt, Mycobacterium avium subsp. paratuberculosis
ggcggauucucgcucugccg

SEQ ID NO: 976321 - RNA, 14 nt, Mycobacterium avium subsp. paratuberculosis
ggcggauuggugcc

SEQ ID NO: 976322 - RNA, 14 nt, Mycobacterium avium subsp. paratuberculosis
ggcggaugcgcugg

SEQ ID NO: 976323 - RNA, 19 nt, Mycobacterium avium subsp. paratuberculosis
ggcggaggcgaaugcggcc

SEQ ID NO: 976324 - RNA, 17 nt, Mycobacterium avium subsp. paratuberculosis
ggcggauauagccgacg

SEQ ID NO: 976325 - RNA, 15 nt, Mycobacterium avium subsp. paratuberculosis
ggcggaucggcccga

SEQ ID NO: 976326 - RNA, 18 nt, Mycobacterium avium subsp. paratuberculosis
ggcggacugcccgaccgc

SEQ ID NO: 976327 - RNA, 15 nt, Mycobacterium avium subsp. paratuberculosis
ggcggaccggcggcc

SEQ ID NO: 976328 - RNA, 18 nt, Mycobacterium avium subsp. paratuberculosis
ggcggaccggcggccgcc

SEQ ID NO: 976329 - RNA, 15 nt, Mycobacterium avium subsp. paratuberculosis
ggcggacggucccga

SEQ ID NO: 976330 - RNA, 15 nt, Mycobacterium avium subsp. paratuberculosis
ggcggcagucgcagc

SEQ ID NO: 976331 - RNA, 16 nt, Mycobacterium avium subsp. paratuberculosis
ggcggcagucgcagca

SEQ ID NO: 976332 - RNA, 19 nt, Mycobacterium avium subsp. paratuberculosis
ggcggcagugcgccguccc

SEQ ID NO: 976333 - RNA, 14 nt, Mycobacterium avium subsp. paratuberculosis
ggcggcagguuggg

SEQ ID NO: 976334 - RNA, 17 nt, Mycobacterium avium subsp. paratuberculosis
ggcggcauccccagcug

SEQ ID NO: 976335 - RNA, 16 nt, Mycobacterium avium subsp. paratuberculosis
ggcggcaucgcgccgc

SEQ ID NO: 976336 - RNA, 15 nt, Mycobacterium avium subsp. paratuberculosis
ggcggcaucgcgcgc

SEQ ID NO: 976337 - RNA, 21 nt, Mycobacterium avium subsp. paratuberculosis
ggcggcaucgcgcgcggcggc

SEQ ID NO: 976338 - RNA, 11 nt, Mycobacterium avium subsp. paratuberculosis
ggcggccagcg

SEQ ID NO: 976339 - RNA, 16 nt, Mycobacterium avium subsp. paratuberculosis
ggcggccagccgcgcg

SEQ ID NO: 976340 - RNA, 15 nt, Mycobacterium avium subsp. paratuberculosis
ggcggccagccgcuc

SEQ ID NO: 976341 - RNA, 14 nt, Mycobacterium avium subsp. paratuberculosis
ggcggccagcagca

SEQ ID NO: 976342 - RNA, 13 nt, Mycobacterium avium subsp. paratuberculosis
ggcggccagcagc

SEQ ID NO: 976343 - RNA, 12 nt, Mycobacterium avium subsp. paratuberculosis
ggcggccagcac

SEQ ID NO: 976344 - RNA, 22 nt, Mycobacterium avium subsp. paratuberculosis
ggcggccacgaucgcggccagc

SEQ ID NO: 976345 - RNA, 15 nt, Mycobacterium avium subsp. paratuberculosis
ggcggccacgcaggc

SEQ ID NO: 976346 - RNA, 16 nt, Mycobacterium avium subsp. paratuberculosis
ggcggccaccgcgccc

SEQ ID NO: 976347 - RNA, 15 nt, Mycobacterium avium subsp. paratuberculosis
ggcggccaccucgcc

SEQ ID NO: 976348 - RNA, 21 nt, Mycobacterium avium subsp. paratuberculosis
ggcggccaccucgccgcaggc

SEQ ID NO: 976349 - RNA, 19 nt, Mycobacterium avium subsp. paratuberculosis
ggcggccaaucccaccaug

SEQ ID NO: 976350 - RNA, 21 nt, Mycobacterium avium subsp. paratuberculosis
ggcggccacacuggccaugcu

SEQ ID NO: 976351 - RNA, 11 nt, Mycobacterium avium subsp. paratuberculosis
ggcggccacca

SEQ ID NO: 976352 - RNA, 20 nt, Mycobacterium avium subsp. paratuberculosis
ggcggccaccaacggcagca

SEQ ID NO: 976353 - RNA, 14 nt, Mycobacterium avium subsp. paratuberculosis
ggcggccaccacuu

SEQ ID NO: 976354 - RNA, 16 nt, Mycobacterium avium subsp. paratuberculosis
ggcggccaccacuucc

SEQ ID NO: 976355 - RNA, 17 nt, Mycobacterium avium subsp. paratuberculosis
ggcggccaccagccggc

SEQ ID NO: 976356 - RNA, 15 nt, Mycobacterium avium subsp. paratuberculosis
ggcggccaccaugcc

SEQ ID NO: 976357 - RNA, 19 nt, Mycobacterium avium subsp. paratuberculosis
ggcggccaccaugggcggg

SEQ ID NO: 976358 - RNA, 20 nt, Mycobacterium avium subsp. paratuberculosis
ggcggccaccaugggcggga

SEQ ID NO: 976359 - RNA, 16 nt, Mycobacterium avium subsp. paratuberculosis
ggcggccaggccggcg

SEQ ID NO: 976360 - RNA, 14 nt, Mycobacterium avium subsp. paratuberculosis
ggcggccagcgccc

SEQ ID NO: 976361 - RNA, 13 nt, Mycobacterium avium subsp. paratuberculosis
ggcggccagcgcg

SEQ ID NO: 976362 - RNA, 20 nt, Mycobacterium avium subsp. paratuberculosis
ggcggccagcgcgacgcgca

SEQ ID NO: 976363 - RNA, 16 nt, Mycobacterium avium subsp. paratuberculosis
ggcggccagcucccgg

SEQ ID NO: 976364 - RNA, 14 nt, Mycobacterium avium subsp. paratuberculosis
ggcggccggccagc

SEQ ID NO: 976365 - RNA, 15 nt, Mycobacterium avium subsp. paratuberculosis
ggcggccggccagcg

SEQ ID NO: 976366 - RNA, 20 nt, Mycobacterium avium subsp. paratuberculosis
ggcggccggccccggccggg

SEQ ID NO: 976367 - RNA, 14 nt, Mycobacterium avium subsp. paratuberculosis
ggcggccggccgcg

SEQ ID NO: 976368 - RNA, 17 nt, Mycobacterium avium subsp. paratuberculosis
ggcggccggccgcgccc

SEQ ID NO: 976369 - RNA, 21 nt, Mycobacterium avium subsp. paratuberculosis
ggcggccggccgcgcgcggcg

SEQ ID NO: 976370 - RNA, 16 nt, Mycobacterium avium subsp. paratuberculosis
ggcggccagggcggcg

SEQ ID NO: 976371 - RNA, 22 nt, Mycobacterium avium subsp. paratuberculosis
ggcggccauauaggggugggcg

SEQ ID NO: 976372 - RNA, 20 nt, Mycobacterium avium subsp. paratuberculosis
ggcggccagcucggcccgcu

SEQ ID NO: 976373 - RNA, 22 nt, Mycobacterium avium subsp. paratuberculosis
ggcggccaucucgugcccgggc

SEQ ID NO: 976374 - RNA, 14 nt, Mycobacterium avium subsp. paratuberculosis
ggcggccugcggcg

SEQ ID NO: 976375 - RNA, 13 nt, Mycobacterium avium subsp. paratuberculosis
ggcggccugcucg

SEQ ID NO: 976376 - RNA, 21 nt, Mycobacterium avium subsp. paratuberculosis
ggcggccugcacccaggucau

SEQ ID NO: 976377 - RNA, 17 nt, Mycobacterium avium subsp. paratuberculosis
ggcggccugcaccucgg

SEQ ID NO: 976378 - RNA, 14 nt, Mycobacterium avium subsp. paratuberculosis
ggcggccgggugua

SEQ ID NO: 976379 - RNA, 20 nt, Mycobacterium avium subsp. paratuberculosis
ggcggccggguguagcuggg

SEQ ID NO: 976380 - RNA, 13 nt, Mycobacterium avium subsp. paratuberculosis
ggcggccggggug

SEQ ID NO: 976381 - RNA, 12 nt, Mycobacterium avium subsp. paratuberculosis
ggcgcugcucgg

SEQ ID NO: 976382 - RNA, 12 nt, Mycobacterium avium subsp. paratuberculosis
ggcggacccagc

SEQ ID NO: 976383 - RNA, 19 nt, Mycobacterium avium subsp. paratuberculosis
ggcggacccagcuccucgg

SEQ ID NO: 976384 - RNA, 12 nt, Mycobacterium avium subsp. paratuberculosis
ggcggacccgcu

SEQ ID NO: 976385 - RNA, 16 nt, Mycobacterium avium subsp. paratuberculosis
ggcggacccggaggcg

SEQ ID NO: 976386 - RNA, 14 nt, Mycobacterium avium subsp. paratuberculosis
ggcgcugcccgccg

SEQ ID NO: 976387 - RNA, 14 nt, Mycobacterium avium subsp. paratuberculosis
ggcgcugcccgcga

SEQ ID NO: 976388 - RNA, 15 nt, Mycobacterium avium subsp. paratuberculosis
ggcgcugcagcagcc

SEQ ID NO: 976389 - RNA, 17 nt, Mycobacterium avium subsp. paratuberculosis
ggcgcugcagcagcccg

SEQ ID NO: 976390 - RNA, 14 nt, Mycobacterium avium subsp. paratuberculosis
ggcgcugccgagca

SEQ ID NO: 976391 - RNA, 15 nt, Mycobacterium avium subsp. paratuberculosis
ggcgcugccgagcac

SEQ ID NO: 976392 - RNA, 20 nt, Mycobacterium avium subsp. paratuberculosis
ggcgcugcccgucgaccucc

SEQ ID NO: 976393 - RNA, 23 nt, Mycobacterium avium subsp. paratuberculosis
ggcgcugcccgucgaccuccucg

SEQ ID NO: 976394 - RNA, 16 nt, Mycobacterium avium subsp. paratuberculosis
ggcgcugcgcgguggc

SEQ ID NO: 976395 - RNA, 12 nt, Mycobacterium avium subsp. paratuberculosis
ggcgcggcggcc

SEQ ID NO: 976396 - RNA, 11 nt, Mycobacterium avium subsp. paratuberculosis
ggcgcggcggc

SEQ ID NO: 976397 - RNA, 12 nt, Mycobacterium avium subsp. paratuberculosis
ggcgcggcggca

SEQ ID NO: 976398 - RNA, 20 nt, Mycobacterium avium subsp. paratuberculosis
ggcgcgguugcccgcacccu

SEQ ID NO: 976399 - RNA, 21 nt, Mycobacterium avium subsp. paratuberculosis
ggcgcggugcgccgacagcug

SEQ ID NO: 976400 - RNA, 16 nt, Mycobacterium avium subsp. paratuberculosis
ggcgcggugcucggcg

SEQ ID NO: 976401 - RNA, 18 nt, Mycobacterium avium subsp. paratuberculosis
ggcgcgguuucggcgucg

SEQ ID NO: 976402 - RNA, 20 nt, Mycobacterium avium subsp. paratuberculosis
ggcgcgucgcugggcagccg

SEQ ID NO: 976403 - RNA, 21 nt, Mycobacterium avium subsp. paratuberculosis
ggcgcgucgguaaucggcggu

SEQ ID NO: 976404 - RNA, 16 nt, Mycobacterium avium subsp. paratuberculosis
ggcgcguccgcgggcg

SEQ ID NO: 976405 - RNA, 23 nt, Mycobacterium avium subsp. paratuberculosis
ggcgcguccgcgggcggggccug

SEQ ID NO: 976406 - RNA, 20 nt, Mycobacterium avium subsp. paratuberculosis
ggcgcgcguauuccagcgcc

SEQ ID NO: 976407 - RNA, 13 nt, Mycobacterium avium subsp. paratuberculosis
ggcgcgccgagcg

SEQ ID NO: 976408 - RNA, 20 nt, Mycobacterium avium subsp. paratuberculosis
ggcgcgcccacccgcgccgg

SEQ ID NO: 976409 - RNA, 22 nt, Mycobacterium avium subsp. paratuberculosis
ggcgcgcccacccgcgccggca

SEQ ID NO: 976410 - RNA, 13 nt, Mycobacterium avium subsp. paratuberculosis
ggcgcgccccggc

SEQ ID NO: 976411 - RNA, 19 nt, Mycobacterium avium subsp. paratuberculosis
ggcgcgcccgagucacccg

SEQ ID NO: 976412 - RNA, 21 nt, Mycobacterium avium subsp. paratuberculosis
ggcgcggccgauucggcgccg

SEQ ID NO: 976413 - RNA, 13 nt, Mycobacterium avium subsp. paratuberculosis
ggcgcggccagcu

SEQ ID NO: 976414 - RNA, 14 nt, Mycobacterium avium subsp. paratuberculosis
ggcgcggcgcagcg

SEQ ID NO: 976415 - RNA, 14 nt, Mycobacterium avium subsp. paratuberculosis
ggcgcgcugcggcg

SEQ ID NO: 976416 - RNA, 17 nt, Mycobacterium avium subsp. paratuberculosis
ggcgcggacagcgcggu

SEQ ID NO: 976417 - RNA, 20 nt, Mycobacterium avium subsp. paratuberculosis
ggcgcgcucgguggacaggu

SEQ ID NO: 976418 - RNA, 14 nt, Mycobacterium avium subsp. paratuberculosis
ggcgcgcugcaggc

SEQ ID NO: 976419 - RNA, 16 nt, Mycobacterium avium subsp. paratuberculosis
ggcgcgcugcaggccc

SEQ ID NO: 976420 - RNA, 21 nt, Mycobacterium avium subsp. paratuberculosis
ggcgccgccggucgcccccuc

SEQ ID NO: 976421 - RNA, 16 nt, Mycobacterium avium subsp. paratuberculosis
ggcgccgccggcgucg

SEQ ID NO: 976422 - RNA, 14 nt, Mycobacterium avium subsp. paratuberculosis
ggcgccgccggggc

SEQ ID NO: 976423 - RNA, 13 nt, Mycobacterium avium subsp. paratuberculosis
ggcgccgcgggcg

SEQ ID NO: 976424 - RNA, 16 nt, Mycobacterium avium subsp. paratuberculosis
ggcgccgcgggcgccg

SEQ ID NO: 976425 - RNA, 13 nt, Mycobacterium avium subsp. paratuberculosis
ggcgccgcggggc

SEQ ID NO: 976426 - RNA, 14 nt, Mycobacterium avium subsp. paratuberculosis
ggcgccgcgcagcc

SEQ ID NO: 976427 - RNA, 17 nt, Mycobacterium avium subsp. paratuberculosis
ggcgccgccguucgccg

SEQ ID NO: 976428 - RNA, 20 nt, Mycobacterium avium subsp. paratuberculosis
ggcgccgccguucgccggcg

SEQ ID NO: 976429 - RNA, 18 nt, Mycobacterium avium subsp. paratuberculosis
ggcgccaggccggcgacg

SEQ ID NO: 976430 - RNA, 11 nt, Mycobacterium avium subsp. paratuberculosis
ggcgccaggcc

SEQ ID NO: 976431 - RNA, 13 nt, Mycobacterium avium subsp. paratuberculosis
ggcgccagcggcc

SEQ ID NO: 976432 - RNA, 13 nt, Mycobacterium avium subsp. paratuberculosis
ggcgccagccgca

SEQ ID NO: 976433 - RNA, 19 nt, Mycobacterium avium subsp. paratuberculosis
ggcgccauccgccacccgc

SEQ ID NO: 976434 - RNA, 16 nt, Mycobacterium avium subsp. paratuberculosis
ggcgcgaaucccggcc

SEQ ID NO: 976435 - RNA, 22 nt, Mycobacterium avium subsp. paratuberculosis
ggcgcgaaucccggccucgugc

SEQ ID NO: 976436 - RNA, 21 nt, Mycobacterium avium subsp. paratuberculosis
ggcgcgaauuccucagcgccc

SEQ ID NO: 976437 - RNA, 14 nt, Mycobacterium avium subsp. paratuberculosis
ggcgcgaaccgggc

SEQ ID NO: 976438 - RNA, 18 nt, Mycobacterium avium subsp. paratuberculosis
ggcgcgaaccgggccagg

SEQ ID NO: 976439 - RNA, 19 nt, Mycobacterium avium subsp. paratuberculosis
ggcgcgaaccgggccagga

SEQ ID NO: 976440 - RNA, 13 nt, Mycobacterium avium subsp. paratuberculosis
ggcgcgaaagcgc

SEQ ID NO: 976441 - RNA, 18 nt, Mycobacterium avium subsp. paratuberculosis
ggcgcgacggucacgcug

SEQ ID NO: 976442 - RNA, 21 nt, Mycobacterium avium subsp. paratuberculosis
ggcgcgcaggcgcgcggccag

SEQ ID NO: 976443 - RNA, 17 nt, Mycobacterium avium subsp. paratuberculosis
ggcgcgcagucgcaggc

SEQ ID NO: 976444 - RNA, 22 nt, Mycobacterium avium subsp. paratuberculosis
ggcgcgcaucugcucggcgucc

SEQ ID NO: 976445 - RNA, 21 nt, Mycobacterium avium subsp. paratuberculosis
ggcgcgcaucgucgcggcgcu

SEQ ID NO: 976446 - RNA, 19 nt, Mycobacterium avium subsp. paratuberculosis
ggcgcgcaucguggcuuug

SEQ ID NO: 976447 - RNA, 17 nt, Mycobacterium avium subsp. paratuberculosis
ggcgcgcaucugcucgg

SEQ ID NO: 976448 - RNA, 11 nt, Mycobacterium avium subsp. paratuberculosis
ggcgccgucgg

SEQ ID NO: 976449 - RNA, 16 nt, Mycobacterium avium subsp. paratuberculosis
ggcgccguccgcggcg

SEQ ID NO: 976450 - RNA, 18 nt, Mycobacterium avium subsp. paratuberculosis
ggcgccgucgaccagcuu

SEQ ID NO: 976451 - RNA, 13 nt, Mycobacterium avium subsp. paratuberculosis
ggcgccgggcggg

SEQ ID NO: 976452 - RNA, 18 nt, Mycobacterium avium subsp. paratuberculosis
ggcgccggcugcccgcga

SEQ ID NO: 976453 - RNA, 17 nt, Mycobacterium avium subsp. paratuberculosis
ggcgccgggcagcccgg

SEQ ID NO: 976454 - RNA, 23 nt, Mycobacterium avium subsp. paratuberculosis
ggcgccggguuguagcaggcggu

SEQ ID NO: 976455 - RNA, 20 nt, Mycobacterium avium subsp. paratuberculosis
ggcgccggucgacgcggggc

SEQ ID NO: 976456 - RNA, 21 nt, Mycobacterium avium subsp. paratuberculosis
ggcgccggucgacgcggggcg

SEQ ID NO: 976457 - RNA, 20 nt, Mycobacterium avium subsp. paratuberculosis
ggcgccggcgggugagccgg

SEQ ID NO: 976458 - RNA, 17 nt, Mycobacterium avium subsp. paratuberculosis
ggcgccggcggucagcu

SEQ ID NO: 976459 - RNA, 13 nt, Mycobacterium avium subsp. paratuberculosis
ggcgccggcgucc

SEQ ID NO: 976460 - RNA, 20 nt, Mycobacterium avium subsp. paratuberculosis
ggcgccgcucgaccccucgg

SEQ ID NO: 976461 - RNA, 16 nt, Mycobacterium avium subsp. paratuberculosis
ggcgccgcgcgccagc

SEQ ID NO: 976462 - RNA, 19 nt, Mycobacterium avium subsp. paratuberculosis
ggcgccgcguaccagcgcc

SEQ ID NO: 976463 - RNA, 18 nt, Mycobacterium avium subsp. paratuberculosis
ggccaauuacgcugcggc

SEQ ID NO: 976464 - RNA, 15 nt, Mycobacterium avium subsp. paratuberculosis
ggccaccgccccagc

SEQ ID NO: 976465 - RNA, 17 nt, Mycobacterium avium subsp. paratuberculosis
ggccaccgccgccagca

SEQ ID NO: 976466 - RNA, 18 nt, Mycobacterium avium subsp. paratuberculosis
ggccaccgccgccagcag

SEQ ID NO: 976467 - RNA, 16 nt, Mycobacterium avium subsp. paratuberculosis
ggccaccgccugcgcg

SEQ ID NO: 976468 - RNA, 23 nt, Mycobacterium avium subsp. paratuberculosis
ggccaccgccugcgcgaucgccg

SEQ ID NO: 976469 - RNA, 23 nt, Mycobacterium avium subsp. paratuberculosis
ggccaccgcgacgcugccggggc

SEQ ID NO: 976470 - RNA, 12 nt, Mycobacterium avium subsp. paratuberculosis
ggccaccgcgcc

SEQ ID NO: 976471 - RNA, 18 nt, Mycobacterium avium subsp. paratuberculosis
ggccaccgcgccgucuuc

SEQ ID NO: 976472 - RNA, 15 nt, Mycobacterium avium subsp. paratuberculosis
ggccaccgcgcgcug

SEQ ID NO: 976473 - RNA, 14 nt, Mycobacterium avium subsp. paratuberculosis
ggccaccgcgcggc

SEQ ID NO: 976474 - RNA, 18 nt, Mycobacterium avium subsp. paratuberculosis
ggccaccgcgcggcgguc

SEQ ID NO: 976475 - RNA, 14 nt, Mycobacterium avium subsp. paratuberculosis
ggccaaggccagca

SEQ ID NO: 976476 - RNA, 15 nt, Mycobacterium avium subsp. paratuberculosis
ggccaaggccagcaa

SEQ ID NO: 976477 - RNA, 16 nt, Mycobacterium avium subsp. paratuberculosis
ggcauuccagugcucu

SEQ ID NO: 976478 - RNA, 14 nt, Mycobacterium avium subsp. paratuberculosis
ggccacgcaggcgu

SEQ ID NO: 976479 - RNA, 19 nt, Mycobacterium avium subsp. paratuberculosis
ggccacgcagguccaggau

SEQ ID NO: 976480 - RNA, 17 nt, Mycobacterium avium subsp. paratuberculosis
ggccaccugggcggggc

SEQ ID NO: 976481 - RNA, 15 nt, Mycobacterium avium subsp. paratuberculosis
ggccacgcccacgcc

SEQ ID NO: 976482 - RNA, 16 nt, Mycobacterium avium subsp. paratuberculosis
ggccacgcucucgccg

SEQ ID NO: 976483 - RNA, 14 nt, Mycobacterium avium subsp. paratuberculosis
ggccacgcucggcg

SEQ ID NO: 976484 - RNA, 16 nt, Mycobacterium avium subsp. paratuberculosis
ggccagauacuccucg

SEQ ID NO: 976485 - RNA, 23 nt, Mycobacterium avium subsp. paratuberculosis
ggccagaucgacgccgcgguggc

SEQ ID NO: 976486 - RNA, 23 nt, Mycobacterium avium subsp. paratuberculosis
ggccagaccgcacaauccgguca

SEQ ID NO: 976487 - RNA, 21 nt, Mycobacterium avium subsp. paratuberculosis
ggccaccuuggacaggcccag

SEQ ID NO: 976488 - RNA, 22 nt, Mycobacterium avium subsp. paratuberculosis
ggccaccuuggacaggcccagc

SEQ ID NO: 976489 - RNA, 15 nt, Mycobacterium avium subsp. paratuberculosis
ggccaccuggccggu

SEQ ID NO: 976490 - RNA, 19 nt, Mycobacterium avium subsp. paratuberculosis
ggccacgauccgcgcggcc

SEQ ID NO: 976491 - RNA, 21 nt, Mycobacterium avium subsp. paratuberculosis
ggccacgaucgcgaucgccga

SEQ ID NO: 976492 - RNA, 19 nt, Mycobacterium avium subsp. paratuberculosis
ggccacgaucgcggccagc

SEQ ID NO: 976493 - RNA, 20 nt, Mycobacterium avium subsp. paratuberculosis
ggccacgaucgcggccagcg

SEQ ID NO: 976494 - RNA, 21 nt, Mycobacterium avium subsp. paratuberculosis
ggccacgaucgcggccagcgu

SEQ ID NO: 976495 - RNA, 17 nt, Mycobacterium avium subsp. paratuberculosis
ggccaccggcgccaggu

SEQ ID NO: 976496 - RNA, 18 nt, Mycobacterium avium subsp. paratuberculosis
ggccaccggcgcgacggc

SEQ ID NO: 976497 - RNA, 13 nt, Mycobacterium avium subsp. paratuberculosis
ggccaccggcucc

SEQ ID NO: 976498 - RNA, 13 nt, Mycobacterium avium subsp. paratuberculosis
ggccaccgggccg

SEQ ID NO: 976499 - RNA, 13 nt, Mycobacterium avium subsp. paratuberculosis
ggccaccgucuuc

SEQ ID NO: 976500 - RNA, 20 nt, Mycobacterium avium subsp. paratuberculosis
ggccaccgucuucggggccg

SEQ ID NO: 976501 - RNA, 13 nt, Mycobacterium avium subsp. paratuberculosis
ggccaccucgccg

SEQ ID NO: 976502 - RNA, 20 nt, Mycobacterium avium subsp. paratuberculosis
ggccaccucgccgcaggcgu

SEQ ID NO: 976503 - RNA, 17 nt, Mycobacterium avium subsp. paratuberculosis
ggccaccucgucccagc

SEQ ID NO: 976504 - RNA, 20 nt, Mycobacterium avium subsp. paratuberculosis
ggccaccucgucccagcgca

SEQ ID NO: 976505 - RNA, 14 nt, Mycobacterium avium subsp. paratuberculosis
ggccaccucgucgg

SEQ ID NO: 976506 - RNA, 19 nt, Mycobacterium avium subsp. paratuberculosis
ggccaccucgucggcgguc

SEQ ID NO: 976507 - RNA, 16 nt, Mycobacterium avium subsp. paratuberculosis
ggcaugccgcccgggc

SEQ ID NO: 976508 - RNA, 14 nt, Mycobacterium avium subsp. paratuberculosis
ggcaugccggccgg

SEQ ID NO: 976509 - RNA, 21 nt, Mycobacterium avium subsp. paratuberculosis
ggcaugccgucggcgcccggc

SEQ ID NO: 976510 - RNA, 21 nt, Mycobacterium avium subsp. paratuberculosis
ggcaugccguucagcgcggcc

SEQ ID NO: 976511 - RNA, 15 nt, Mycobacterium avium subsp. paratuberculosis
ggcaucgucggcgcc

SEQ ID NO: 976512 - RNA, 21 nt, Mycobacterium avium subsp. paratuberculosis
ggcaucgucggggacgaagac

SEQ ID NO: 976513 - RNA, 14 nt, Mycobacterium avium subsp. paratuberculosis
ggcaucgcgccgca

SEQ ID NO: 976514 - RNA, 19 nt, Mycobacterium avium subsp. paratuberculosis
ggcaucgcgcgcggcggcc

SEQ ID NO: 976515 - RNA, 22 nt, Mycobacterium avium subsp. paratuberculosis
ggcaucgcgcgcggcggccacc

SEQ ID NO: 976516 - RNA, 23 nt, Mycobacterium avium subsp. paratuberculosis
ggcaggguugccccaaaacgggc

SEQ ID NO: 976517 - RNA, 16 nt, Mycobacterium avium subsp. paratuberculosis
ggcagggccaggccgu

SEQ ID NO: 976518 - RNA, 19 nt, Mycobacterium avium subsp. paratuberculosis
ggcagguucauccccgcgg

SEQ ID NO: 976519 - RNA, 18 nt, Mycobacterium avium subsp. paratuberculosis
ggcaggugagccgggugc

SEQ ID NO: 976520 - RNA, 18 nt, Mycobacterium avium subsp. paratuberculosis
ggcaggucggugcgcggg

SEQ ID NO: 976521 - RNA, 18 nt, Mycobacterium avium subsp. paratuberculosis
ggcaggucgucgucgccg

SEQ ID NO: 976522 - RNA, 22 nt, Mycobacterium avium subsp. paratuberculosis
ggcaggucgucgucgccgcgcg

SEQ ID NO: 976523 - RNA, 22 nt, Mycobacterium avium subsp. paratuberculosis
ggcaggucggccagcgccgccc

SEQ ID NO: 976524 - RNA, 15 nt, Mycobacterium avium subsp. paratuberculosis
ggcaggucggccagc

SEQ ID NO: 976525 - RNA, 13 nt, Mycobacterium avium subsp. paratuberculosis
ggcagcgccagcg

SEQ ID NO: 976526 - RNA, 15 nt, Mycobacterium avium subsp. paratuberculosis
ggcagcgccagcggg

SEQ ID NO: 976527 - RNA, 23 nt, Mycobacterium avium subsp. paratuberculosis
ggcagcucgucgacguccucgcc

SEQ ID NO: 976528 - RNA, 19 nt, Mycobacterium avium subsp. paratuberculosis
ggcagcucgucggcgcgcc

SEQ ID NO: 976529 - RNA, 16 nt, Mycobacterium avium subsp. paratuberculosis
ggcagcucggcggccc

SEQ ID NO: 976530 - RNA, 20 nt, Mycobacterium avium subsp. paratuberculosis
ggcagcucggcggcccgccg

SEQ ID NO: 976531 - RNA, 15 nt, Mycobacterium avium subsp. paratuberculosis
ggcagcucggcgggc

SEQ ID NO: 976532 - RNA, 16 nt, Mycobacterium avium subsp. paratuberculosis
ggcagcuugaugcugg

SEQ ID NO: 976533 - RNA, 18 nt, Mycobacterium avium subsp. paratuberculosis
ggcagcuugaugcuggca

SEQ ID NO: 976534 - RNA, 15 nt, Mycobacterium avium subsp. paratuberculosis
ggcaggaacgccuug

SEQ ID NO: 976535 - RNA, 20 nt, Mycobacterium avium subsp. paratuberculosis
ggcaggccccuccagcugga

SEQ ID NO: 976536 - RNA, 14 nt, Mycobacterium avium subsp. paratuberculosis
ggcaggccgcggcc

SEQ ID NO: 976537 - RNA, 12 nt, Mycobacterium avium subsp. paratuberculosis
ggcaggccgccc

SEQ ID NO: 976538 - RNA, 14 nt, Mycobacterium avium subsp. paratuberculosis
ggcaggccgcccga

SEQ ID NO: 976539 - RNA, 15 nt, Mycobacterium avium subsp. paratuberculosis
ggcaggccggcagcc

SEQ ID NO: 976540 - RNA, 18 nt, Mycobacterium avium subsp. paratuberculosis
ggcaggccggcagccggc

SEQ ID NO: 976541 - RNA, 15 nt, Mycobacterium avium subsp. paratuberculosis
ggcaggcacgguguc

SEQ ID NO: 976542 - RNA, 15 nt, Mycobacterium avium subsp. paratuberculosis
ggcaggcucagcagc

SEQ ID NO: 976543 - RNA, 16 nt, Mycobacterium avium subsp. paratuberculosis
ggcaggcucagcagca

SEQ ID NO: 976544 - RNA, 17 nt, Mycobacterium avium subsp. paratuberculosis
ggcaggcucagcagcac

SEQ ID NO: 976545 - RNA, 16 nt, Mycobacterium avium subsp. paratuberculosis
ggcaggcucagguagg

SEQ ID NO: 976546 - RNA, 21 nt, Mycobacterium avium subsp. paratuberculosis
ggcagggcauccgggaggcca

SEQ ID NO: 976547 - RNA, 12 nt, Mycobacterium avium subsp. paratuberculosis
ggcagggccagc

SEQ ID NO: 976548 - RNA, 14 nt, Mycobacterium avium subsp. paratuberculosis
ggcagggccagcac

SEQ ID NO: 976549 - RNA, 15 nt, Mycobacterium avium subsp. paratuberculosis
ggcagggccagcagc

SEQ ID NO: 976550 - RNA, 23 nt, Mycobacterium avium subsp. paratuberculosis
ggcagggaauucagccugccucc

SEQ ID NO: 976551 - RNA, 15 nt, Mycobacterium avium subsp. paratuberculosis
ggcaggccggugcug

SEQ ID NO: 976552 - RNA, 14 nt, Mycobacterium avium subsp. paratuberculosis
ggcaggcggccagg

SEQ ID NO: 976553 - RNA, 16 nt, Mycobacterium avium subsp. paratuberculosis
ggcaggcggccagggc

SEQ ID NO: 976554 - RNA, 14 nt, Mycobacterium avium subsp. paratuberculosis
ggcaggcgccccag

SEQ ID NO: 976555 - RNA, 20 nt, Mycobacterium avium subsp. paratuberculosis
ggcaaggcguuccaucugcu

SEQ ID NO: 976556 - RNA, 19 nt, Mycobacterium avium subsp. paratuberculosis
ggcaagcccuuuggcggcc

SEQ ID NO: 976557 - RNA, 13 nt, Mycobacterium avium subsp. paratuberculosis
ggcaaggccagca

SEQ ID NO: 976558 - RNA, 15 nt, Mycobacterium avium subsp. paratuberculosis
ggcaaggccagcaac

SEQ ID NO: 976559 - RNA, 17 nt, Mycobacterium avium subsp. paratuberculosis
ggcagaccaggaccagg

SEQ ID NO: 976560 - RNA, 19 nt, Mycobacterium avium subsp. paratuberculosis
ggcagaucugcaggguuuc

SEQ ID NO: 976561 - RNA, 17 nt, Mycobacterium avium subsp. paratuberculosis
ggcagaucgcggcccgc

SEQ ID NO: 976562 - RNA, 19 nt, Mycobacterium avium subsp. paratuberculosis
ggcagaucgcggcccgccg

SEQ ID NO: 976563 - RNA, 16 nt, Mycobacterium avium subsp. paratuberculosis
ggcagaucgucggcac

SEQ ID NO: 976564 - RNA, 13 nt, Mycobacterium avium subsp. paratuberculosis
ggcagccaggcgu

SEQ ID NO: 976565 - RNA, 16 nt, Mycobacterium avium subsp. paratuberculosis
ggcagccccagcgagc

SEQ ID NO: 976566 - RNA, 18 nt, Mycobacterium avium subsp. paratuberculosis
ggcagcaaccggcggcug

SEQ ID NO: 976567 - RNA, 21 nt, Mycobacterium avium subsp. paratuberculosis
ggcagcgacagcgcgucggcc

SEQ ID NO: 976568 - RNA, 18 nt, Mycobacterium avium subsp. paratuberculosis
ggcagcgacucgggcagg

SEQ ID NO: 976569 - RNA, 15 nt, Mycobacterium avium subsp. paratuberculosis
ggcagcgagcacagc

SEQ ID NO: 976570 - RNA, 20 nt, Mycobacterium avium subsp. paratuberculosis
ggcagccggcugagcagcca

SEQ ID NO: 976571 - RNA, 21 nt, Mycobacterium avium subsp. paratuberculosis
ggcagccgggcgaucauccag

SEQ ID NO: 976572 - RNA, 13 nt, Mycobacterium avium subsp. paratuberculosis
ggcagccggggug

SEQ ID NO: 976573 - RNA, 12 nt, Mycobacterium avium subsp. paratuberculosis
ggcagcccgccg

SEQ ID NO: 976574 - RNA, 15 nt, Mycobacterium avium subsp. paratuberculosis
ggcagcccggaggcg

SEQ ID NO: 976575 - RNA, 14 nt, Mycobacterium avium subsp. paratuberculosis
ggcagccgcuuggc

SEQ ID NO: 976576 - RNA, 13 nt, Mycobacterium avium subsp. paratuberculosis
ggcagccggcgcc

SEQ ID NO: 976577 - RNA, 17 nt, Mycobacterium avium subsp. paratuberculosis
ggccccacgcgcucagc

SEQ ID NO: 976578 - RNA, 21 nt, Mycobacterium avium subsp. paratuberculosis
ggccccacgcgcucagcgcgg

SEQ ID NO: 976579 - RNA, 13 nt, Mycobacterium avium subsp. paratuberculosis
ggccccacgggcc

SEQ ID NO: 976580 - RNA, 12 nt, Mycobacterium avium subsp. paratuberculosis
ggccccagcccg

SEQ ID NO: 976581 - RNA, 17 nt, Mycobacterium avium subsp. paratuberculosis
ggcccccgccccagccc

SEQ ID NO: 976582 - RNA, 19 nt, Mycobacterium avium subsp. paratuberculosis
ggcccccgccccagcccgg

SEQ ID NO: 976583 - RNA, 21 nt, Mycobacterium avium subsp. paratuberculosis
ggcccccgccccagcccggcu

SEQ ID NO: 976584 - RNA, 21 nt, Mycobacterium avium subsp. paratuberculosis
ggccccccgggcaccagcgcg

SEQ ID NO: 976585 - RNA, 16 nt, Mycobacterium avium subsp. paratuberculosis
ggccccuccagccgcc

SEQ ID NO: 976586 - RNA, 18 nt, Mycobacterium avium subsp. paratuberculosis
ggccccuaccgccgagcg

SEQ ID NO: 976587 - RNA, 21 nt, Mycobacterium avium subsp. paratuberculosis
ggccccuaccgccgagcguga

SEQ ID NO: 976588 - RNA, 20 nt, Mycobacterium avium subsp. paratuberculosis
ggccccgguuuucgccucgg

SEQ ID NO: 976589 - RNA, 17 nt, Mycobacterium avium subsp. paratuberculosis
ggccccguucgguggcc

SEQ ID NO: 976590 - RNA, 17 nt, Mycobacterium avium subsp. paratuberculosis
ggccccgggggaccagc

SEQ ID NO: 976591 - RNA, 19 nt, Mycobacterium avium subsp. paratuberculosis
ggccccgguagccagcacc

SEQ ID NO: 976592 - RNA, 19 nt, Mycobacterium avium subsp. paratuberculosis
ggccccgguggaugggcuc

SEQ ID NO: 976593 - RNA, 22 nt, Mycobacterium avium subsp. paratuberculosis
ggccccgcgugacggccgcggc

SEQ ID NO: 976594 - RNA, 23 nt, Mycobacterium avium subsp. paratuberculosis
ggccccgcugccguccggcggca

SEQ ID NO: 976595 - RNA, 17 nt, Mycobacterium avium subsp. paratuberculosis
ggccccggauccgucgc

SEQ ID NO: 976596 - RNA, 15 nt, Mycobacterium avium subsp. paratuberculosis
ggccccggccgagcg

SEQ ID NO: 976597 - RNA, 14 nt, Mycobacterium avium subsp. paratuberculosis
ggccccggccgggc

SEQ ID NO: 976598 - RNA, 13 nt, Mycobacterium avium subsp. paratuberculosis
ggccccgcccggc

SEQ ID NO: 976599 - RNA, 23 nt, Mycobacterium avium subsp. paratuberculosis
ggccccgcccggcgcgcagccca

SEQ ID NO: 976600 - RNA, 19 nt, Mycobacterium avium subsp. paratuberculosis
ggcccaucgcggucagcgu

SEQ ID NO: 976601 - RNA, 19 nt, Mycobacterium avium subsp. paratuberculosis
ggcccagguucuccggccc

SEQ ID NO: 976602 - RNA, 15 nt, Mycobacterium avium subsp. paratuberculosis
ggcccaggccaacag

SEQ ID NO: 976603 - RNA, 19 nt, Mycobacterium avium subsp. paratuberculosis
ggcccaggccaacagcagc

SEQ ID NO: 976604 - RNA, 20 nt, Mycobacterium avium subsp. paratuberculosis
ggcccaggccgacgccggcc

SEQ ID NO: 976605 - RNA, 16 nt, Mycobacterium avium subsp. paratuberculosis
ggcccaggcaguagcc

SEQ ID NO: 976606 - RNA, 20 nt, Mycobacterium avium subsp. paratuberculosis
ggcccagcuccaaugcggcc

SEQ ID NO: 976607 - RNA, 20 nt, Mycobacterium avium subsp. paratuberculosis
ggcccagcucguugccggcg

SEQ ID NO: 976608 - RNA, 22 nt, Mycobacterium avium subsp. paratuberculosis
ggcccagcucguugccggcggc

SEQ ID NO: 976609 - RNA, 21 nt, Mycobacterium avium subsp. paratuberculosis
ggcccagcgucaacucgucgg

SEQ ID NO: 976610 - RNA, 23 nt, Mycobacterium avium subsp. paratuberculosis
ggcccagcgucaacucgucggcg

SEQ ID NO: 976611 - RNA, 17 nt, Mycobacterium avium subsp. paratuberculosis
ggcccagccggccgacg

SEQ ID NO: 976612 - RNA, 17 nt, Mycobacterium avium subsp. paratuberculosis
ggcccagccggucgccg

SEQ ID NO: 976613 - RNA, 16 nt, Mycobacterium avium subsp. paratuberculosis
ggcccagcccgccgcg

SEQ ID NO: 976614 - RNA, 13 nt, Mycobacterium avium subsp. paratuberculosis
ggcccagcccggc

SEQ ID NO: 976615 - RNA, 20 nt, Mycobacterium avium subsp. paratuberculosis
ggcccagcccggccagcacc

SEQ ID NO: 976616 - RNA, 16 nt, Mycobacterium avium subsp. paratuberculosis
ggcccagcccggcccc

SEQ ID NO: 976617 - RNA, 22 nt, Mycobacterium avium subsp. paratuberculosis
ggcccagacgaugucgucgccg

SEQ ID NO: 976618 - RNA, 14 nt, Mycobacterium avium subsp. paratuberculosis
ggcccagcccgccg

SEQ ID NO: 976619 - RNA, 14 nt, Mycobacterium avium subsp. paratuberculosis
ggcccagcccaccg

SEQ ID NO: 976620 - RNA, 15 nt, Mycobacterium avium subsp. paratuberculosis
ggcccaccgccacca

SEQ ID NO: 976621 - RNA, 19 nt, Mycobacterium avium subsp. paratuberculosis
ggcccaccgccaccaggcc

SEQ ID NO: 976622 - RNA, 13 nt, Mycobacterium avium subsp. paratuberculosis
ggcccaccgcguc

SEQ ID NO: 976623 - RNA, 15 nt, Mycobacterium avium subsp. paratuberculosis
ggcccaccggcccgg

SEQ ID NO: 976624 - RNA, 20 nt, Mycobacterium avium subsp. paratuberculosis
ggcccaccggcccggcgggc

SEQ ID NO: 976625 - RNA, 15 nt, Mycobacterium avium subsp. paratuberculosis
ggcccaccgucgcca

SEQ ID NO: 976626 - RNA, 22 nt, Mycobacterium avium subsp. paratuberculosis
ggcccagcagauagcccagcca

SEQ ID NO: 976627 - RNA, 12 nt, Mycobacterium avium subsp. paratuberculosis
ggcccagcagcc

SEQ ID NO: 976628 - RNA, 19 nt, Mycobacterium avium subsp. paratuberculosis
ggcccagcagccugccccc

SEQ ID NO: 976629 - RNA, 16 nt, Mycobacterium avium subsp. paratuberculosis
ggcccacccgcagggc

SEQ ID NO: 976630 - RNA, 23 nt, Mycobacterium avium subsp. paratuberculosis
ggccaugaauucgaacugggugg

SEQ ID NO: 976631 - RNA, 19 nt, Mycobacterium avium subsp. paratuberculosis
ggccaucacggugccgagu

SEQ ID NO: 976632 - RNA, 13 nt, Mycobacterium avium subsp. paratuberculosis
ggccaucuucagu

SEQ ID NO: 976633 - RNA, 14 nt, Mycobacterium avium subsp. paratuberculosis
ggccaugccgcgcu

SEQ ID NO: 976634 - RNA, 16 nt, Mycobacterium avium subsp. paratuberculosis
ggcccacagcuugccg

SEQ ID NO: 976635 - RNA, 14 nt, Mycobacterium avium subsp. paratuberculosis
ggcccacagcagcc

SEQ ID NO: 976636 - RNA, 23 nt, Mycobacterium avium subsp. paratuberculosis
ggcccacacgcgauagaccucac

SEQ ID NO: 976637 - RNA, 14 nt, Mycobacterium avium subsp. paratuberculosis
ggccauggccagga

SEQ ID NO: 976638 - RNA, 20 nt, Mycobacterium avium subsp. paratuberculosis
ggccaggucgccgcgcagca

SEQ ID NO: 976639 - RNA, 14 nt, Mycobacterium avium subsp. paratuberculosis
ggccaguucccggg

SEQ ID NO: 976640 - RNA, 18 nt, Mycobacterium avium subsp. paratuberculosis
ggccaguucgucgcgcga

SEQ ID NO: 976641 - RNA, 23 nt, Mycobacterium avium subsp. paratuberculosis
ggccaguucgucgcgcgacuggg

SEQ ID NO: 976642 - RNA, 22 nt, Mycobacterium avium subsp. paratuberculosis
ggccaguugaaguccggcgguc

SEQ ID NO: 976643 - RNA, 23 nt, Mycobacterium avium subsp. paratuberculosis
ggccaguugaaguccggcggucg

SEQ ID NO: 976644 - RNA, 17 nt, Mycobacterium avium subsp. paratuberculosis
ggccaggucccaggcgu

SEQ ID NO: 976645 - RNA, 19 nt, Mycobacterium avium subsp. paratuberculosis
ggccagggugucccagcgc

SEQ ID NO: 976646 - RNA, 16 nt, Mycobacterium avium subsp. paratuberculosis
ggccagguacuccucg

SEQ ID NO: 976647 - RNA, 17 nt, Mycobacterium avium subsp. paratuberculosis
ggccagguacuccucga

SEQ ID NO: 976648 - RNA, 23 nt, Mycobacterium avium subsp. paratuberculosis
ggccagguacugaucaccgcgcu

SEQ ID NO: 976649 - RNA, 16 nt, Mycobacterium avium subsp. paratuberculosis
ggccagaugcccgccc

SEQ ID NO: 976650 - RNA, 17 nt, Mycobacterium avium subsp. paratuberculosis
ggccagaugcccgcccc

SEQ ID NO: 976651 - RNA, 19 nt, Mycobacterium avium subsp. paratuberculosis
ggccagaugcccgccccgc

SEQ ID NO: 976652 - RNA, 19 nt, Mycobacterium avium subsp. paratuberculosis
ggccagcaacagcagcggc

SEQ ID NO: 976653 - RNA, 18 nt, Mycobacterium avium subsp. paratuberculosis
ggccagcaaccggaaugg

SEQ ID NO: 976654 - RNA, 17 nt, Mycobacterium avium subsp. paratuberculosis
ggccagcacccgcucgc

SEQ ID NO: 976655 - RNA, 17 nt, Mycobacterium avium subsp. paratuberculosis
ggccagcaccgccagcg

SEQ ID NO: 976656 - RNA, 18 nt, Mycobacterium avium subsp. paratuberculosis
ggccagcaccgccagcgc

SEQ ID NO: 976657 - RNA, 13 nt, Mycobacterium avium subsp. paratuberculosis
ggccagcacccag

SEQ ID NO: 976658 - RNA, 11 nt, Mycobacterium avium subsp. paratuberculosis
ggccagcacca

SEQ ID NO: 976659 - RNA, 14 nt, Mycobacterium avium subsp. paratuberculosis
ggccagcaccacca

SEQ ID NO: 976660 - RNA, 21 nt, Mycobacterium avium subsp. paratuberculosis
ggccagcaccaccgcgagcgg

SEQ ID NO: 976661 - RNA, 16 nt, Mycobacterium avium subsp. paratuberculosis
ggccagcaccagcgcg

SEQ ID NO: 976662 - RNA, 19 nt, Mycobacterium avium subsp. paratuberculosis
ggccagcaccagcgcgcgg

SEQ ID NO: 976663 - RNA, 17 nt, Mycobacterium avium subsp. paratuberculosis
ggccagcaccagcgugu

SEQ ID NO: 976664 - RNA, 14 nt, Mycobacterium avium subsp. paratuberculosis
ggccagcacggcca

SEQ ID NO: 976665 - RNA, 16 nt, Mycobacterium avium subsp. paratuberculosis
ggccagcacggcggcg

SEQ ID NO: 976666 - RNA, 19 nt, Mycobacterium avium subsp. paratuberculosis
ggccagcucgaccgcggcg

SEQ ID NO: 976667 - RNA, 17 nt, Mycobacterium avium subsp. paratuberculosis
ggccagcucgccgccga

SEQ ID NO: 976668 - RNA, 19 nt, Mycobacterium avium subsp. paratuberculosis
ggccagcucgccgccgacg

SEQ ID NO: 976669 - RNA, 14 nt, Mycobacterium avium subsp. paratuberculosis
ggccagcuccgcca

SEQ ID NO: 976670 - RNA, 20 nt, Mycobacterium avium subsp. paratuberculosis
ggccagcagauacuccucgc

SEQ ID NO: 976671 - RNA, 13 nt, Mycobacterium avium subsp. paratuberculosis
ggccagcacgccg

SEQ ID NO: 976672 - RNA, 17 nt, Mycobacterium avium subsp. paratuberculosis
ggccagcacgaccccgc

SEQ ID NO: 976673 - RNA, 21 nt, Mycobacterium avium subsp. paratuberculosis
ggccagcacgaccccgcccac

SEQ ID NO: 976674 - RNA, 19 nt, Mycobacterium avium subsp. paratuberculosis
ggccagcacgcaggcgugg

SEQ ID NO: 976675 - RNA, 16 nt, Mycobacterium avium subsp. paratuberculosis
ggccaggcgcgcgcug

SEQ ID NO: 976676 - RNA, 19 nt, Mycobacterium avium subsp. paratuberculosis
ggccaggguagaggcggcg

SEQ ID NO: 976677 - RNA, 22 nt, Mycobacterium avium subsp. paratuberculosis
ggccaggguagaggcggcgacc

SEQ ID NO: 976678 - RNA, 13 nt, Mycobacterium avium subsp. paratuberculosis
ggccagggcggcc

SEQ ID NO: 976679 - RNA, 18 nt, Mycobacterium avium subsp. paratuberculosis
ggccagggcggcgccggc

SEQ ID NO: 976680 - RNA, 16 nt, Mycobacterium avium subsp. paratuberculosis
ggccaggaagccggcg

SEQ ID NO: 976681 - RNA, 20 nt, Mycobacterium avium subsp. paratuberculosis
ggccaggaagccggcgacga

SEQ ID NO: 976682 - RNA, 19 nt, Mycobacterium avium subsp. paratuberculosis
ggccagcuuuccggccgcc

SEQ ID NO: 976683 - RNA, 16 nt, Mycobacterium avium subsp. paratuberculosis
ggccagcuugcagcug

SEQ ID NO: 976684 - RNA, 20 nt, Mycobacterium avium subsp. paratuberculosis
ggccagcugauagccgcccu

SEQ ID NO: 976685 - RNA, 22 nt, Mycobacterium avium subsp. paratuberculosis
ggccagcugauagccgcccugc

SEQ ID NO: 976686 - RNA, 21 nt, Mycobacterium avium subsp. paratuberculosis
ggccagcugcaccggggccgg

SEQ ID NO: 976687 - RNA, 22 nt, Mycobacterium avium subsp. paratuberculosis
ggccagcugcggguugcgggcc

SEQ ID NO: 976688 - RNA, 19 nt, Mycobacterium avium subsp. paratuberculosis
ggccagcugcccgccgacg

SEQ ID NO: 976689 - RNA, 17 nt, Mycobacterium avium subsp. paratuberculosis
ggccagcugcgacagca

SEQ ID NO: 976690 - RNA, 22 nt, Mycobacterium avium subsp. paratuberculosis
ggccagcucggucagccgggcg

SEQ ID NO: 976691 - RNA, 13 nt, Mycobacterium avium subsp. paratuberculosis
ggccagcucggcg

SEQ ID NO: 976692 - RNA, 15 nt, Mycobacterium avium subsp. paratuberculosis
ggccagcucggcggc

SEQ ID NO: 976693 - RNA, 22 nt, Mycobacterium avium subsp. paratuberculosis
ggcccgacggguucgcgcagcc

SEQ ID NO: 976694 - RNA, 23 nt, Mycobacterium avium subsp. paratuberculosis
ggcccgagguccucgcgcaacug

SEQ ID NO: 976695 - RNA, 14 nt, Mycobacterium avium subsp. paratuberculosis
ggcccgagcccugc

SEQ ID NO: 976696 - RNA, 17 nt, Mycobacterium avium subsp. paratuberculosis
ggcccgagcccugcgcc

SEQ ID NO: 976697 - RNA, 22 nt, Mycobacterium avium subsp. paratuberculosis
ggcccgauagcuugagccccgc

SEQ ID NO: 976698 - RNA, 20 nt, Mycobacterium avium subsp. paratuberculosis
ggcccgaucaccaggcccag

SEQ ID NO: 976699 - RNA, 19 nt, Mycobacterium avium subsp. paratuberculosis
ggcccgaucgcggcgagcu

SEQ ID NO: 976700 - RNA, 19 nt, Mycobacterium avium subsp. paratuberculosis
ggcccgaucgcgucgacga

SEQ ID NO: 976701 - RNA, 16 nt, Mycobacterium avium subsp. paratuberculosis
ggcccgcagccagcgc

SEQ ID NO: 976702 - RNA, 20 nt, Mycobacterium avium subsp. paratuberculosis
ggcccgcagccagcgcagca

SEQ ID NO: 976703 - RNA, 17 nt, Mycobacterium avium subsp. paratuberculosis
ggcccgcagccgcuggc

SEQ ID NO: 976704 - RNA, 15 nt, Mycobacterium avium subsp. paratuberculosis
ggcccgcagcgccuc

SEQ ID NO: 976705 - RNA, 20 nt, Mycobacterium avium subsp. paratuberculosis
ggcccgcaggaucgagccgg

SEQ ID NO: 976706 - RNA, 19 nt, Mycobacterium avium subsp. paratuberculosis
ggcccgcaccacccagccc

SEQ ID NO: 976707 - RNA, 24 nt, Mycobacterium avium subsp. paratuberculosis
ggcccgcaccacccagcccuuggc

SEQ ID NO: 976708 - RNA, 14 nt, Mycobacterium avium subsp. paratuberculosis
ggcccgcucgggcc

SEQ ID NO: 976709 - RNA, 16 nt, Mycobacterium avium subsp. paratuberculosis
ggcccgcugcagcgcc

SEQ ID NO: 976710 - RNA, 13 nt, Mycobacterium avium subsp. paratuberculosis
ggcccgcugcggc

SEQ ID NO: 976711 - RNA, 20 nt, Mycobacterium avium subsp. paratuberculosis
ggcccgcugugguccucguc

SEQ ID NO: 976712 - RNA, 16 nt, Mycobacterium avium subsp. paratuberculosis
ggcccggaccgccgcg

SEQ ID NO: 976713 - RNA, 18 nt, Mycobacterium avium subsp. paratuberculosis
ggcccggaccgccgcggc

SEQ ID NO: 976714 - RNA, 21 nt, Mycobacterium avium subsp. paratuberculosis
ggcccggaccgccgcggcggc

SEQ ID NO: 976715 - RNA, 22 nt, Mycobacterium avium subsp. paratuberculosis
ggcccggcaccggugcggcggu

SEQ ID NO: 976716 - RNA, 23 nt, Mycobacterium avium subsp. paratuberculosis
ggcccggcaccggugcggcggug

SEQ ID NO: 976717 - RNA, 16 nt, Mycobacterium avium subsp. paratuberculosis
ggcccggcacuggcga

SEQ ID NO: 976718 - RNA, 19 nt, Mycobacterium avium subsp. paratuberculosis
ggcccgcguaaccggcggc

SEQ ID NO: 976719 - RNA, 12 nt, Mycobacterium avium subsp. paratuberculosis
ggcccgcggggc

SEQ ID NO: 976720 - RNA, 21 nt, Mycobacterium avium subsp. paratuberculosis
ggcccgcggggcguacgcgcu

SEQ ID NO: 976721 - RNA, 13 nt, Mycobacterium avium subsp. paratuberculosis
ggcccgcggcguc

SEQ ID NO: 976722 - RNA, 15 nt, Mycobacterium avium subsp. paratuberculosis
ggcccgcgcgggguc

SEQ ID NO: 976723 - RNA, 13 nt, Mycobacterium avium subsp. paratuberculosis
ggcccgcgccggc

SEQ ID NO: 976724 - RNA, 14 nt, Mycobacterium avium subsp. paratuberculosis
ggcccgcgccggcg

SEQ ID NO: 976725 - RNA, 15 nt, Mycobacterium avium subsp. paratuberculosis
ggcccgcgccccggc

SEQ ID NO: 976726 - RNA, 17 nt, Mycobacterium avium subsp. paratuberculosis
ggcccgcgccccggcgg

SEQ ID NO: 976727 - RNA, 19 nt, Mycobacterium avium subsp. paratuberculosis
ggcccgcgccccggcggcc

SEQ ID NO: 976728 - RNA, 17 nt, Mycobacterium avium subsp. paratuberculosis
ggcccgccucggcggcc

SEQ ID NO: 976729 - RNA, 23 nt, Mycobacterium avium subsp. paratuberculosis
ggcccgccgcggcuccagcagcg

SEQ ID NO: 976730 - RNA, 23 nt, Mycobacterium avium subsp. paratuberculosis
ggcccgccgcucaccgccgagcc

SEQ ID NO: 976731 - RNA, 17 nt, Mycobacterium avium subsp. paratuberculosis
ggcccgccgcugcagcu

SEQ ID NO: 976732 - RNA, 16 nt, Mycobacterium avium subsp. paratuberculosis
ggcccgccgggcgcca

SEQ ID NO: 976733 - RNA, 15 nt, Mycobacterium avium subsp. paratuberculosis
ggcccgccgguggcc

SEQ ID NO: 976734 - RNA, 19 nt, Mycobacterium avium subsp. paratuberculosis
ggcccgccguagcgccggc

SEQ ID NO: 976735 - RNA, 15 nt, Mycobacterium avium subsp. paratuberculosis
ggcccgcccggcggc

SEQ ID NO: 976736 - RNA, 19 nt, Mycobacterium avium subsp. paratuberculosis
ggcccgcccguagacccac

SEQ ID NO: 976737 - RNA, 12 nt, Mycobacterium avium subsp. paratuberculosis
ggcccgcccagc

SEQ ID NO: 976738 - RNA, 20 nt, Mycobacterium avium subsp. paratuberculosis
ggcccgccccugaggguguc

SEQ ID NO: 976739 - RNA, 18 nt, Mycobacterium avium subsp. paratuberculosis
ggcccgcccgcagcggcg

SEQ ID NO: 976740 - RNA, 15 nt, Mycobacterium avium subsp. paratuberculosis
ggcccgccgccggcg

SEQ ID NO: 976741 - RNA, 13 nt, Mycobacterium avium subsp. paratuberculosis
ggcccgccgcgcc

SEQ ID NO: 976742 - RNA, 14 nt, Mycobacterium avium subsp. paratuberculosis
ggcccgccgcgccc

SEQ ID NO: 976743 - RNA, 18 nt, Mycobacterium avium subsp. paratuberculosis
ggcccgccgcgcccggcu

SEQ ID NO: 976744 - RNA, 16 nt, Mycobacterium avium subsp. paratuberculosis
ggcccgcaugcaccgg

SEQ ID NO: 976745 - RNA, 15 nt, Mycobacterium avium subsp. paratuberculosis
ggcccgaugcggacc

SEQ ID NO: 976746 - RNA, 21 nt, Mycobacterium avium subsp. paratuberculosis
ggcccgccacgugcggcugcg

SEQ ID NO: 976747 - RNA, 14 nt, Mycobacterium avium subsp. paratuberculosis
ggcccgucaggccu

SEQ ID NO: 976748 - RNA, 21 nt, Mycobacterium avium subsp. paratuberculosis
ggcccguccagaucggccagc

SEQ ID NO: 976749 - RNA, 15 nt, Mycobacterium avium subsp. paratuberculosis
ggcccguccccacca

SEQ ID NO: 976750 - RNA, 21 nt, Mycobacterium avium subsp. paratuberculosis
ggcccguccgccccgcugccg

SEQ ID NO: 976751 - RNA, 22 nt, Mycobacterium avium subsp. paratuberculosis
ggcccguccgccccgcugccgg

SEQ ID NO: 976752 - RNA, 19 nt, Mycobacterium avium subsp. paratuberculosis
ggcccgguugagugcgccg

SEQ ID NO: 976753 - RNA, 20 nt, Mycobacterium avium subsp. paratuberculosis
ggcccggucgacuugggcgg

SEQ ID NO: 976754 - RNA, 21 nt, Mycobacterium avium subsp. paratuberculosis
ggcccggucgucgagcaccgg

SEQ ID NO: 976755 - RNA, 22 nt, Mycobacterium avium subsp. paratuberculosis
ggcccgguccaguugugccgca

SEQ ID NO: 976756 - RNA, 16 nt, Mycobacterium avium subsp. paratuberculosis
ggcccgugucgcggcc

SEQ ID NO: 976757 - RNA, 15 nt, Mycobacterium avium subsp. paratuberculosis
ggcccgucgccacca

SEQ ID NO: 976758 - RNA, 24 nt, Mycobacterium avium subsp. paratuberculosis
ggcccgucgccgaucagcaccagg

SEQ ID NO: 976759 - RNA, 13 nt, Mycobacterium avium subsp. paratuberculosis
ggcccgucgccgg

SEQ ID NO: 976760 - RNA, 15 nt, Mycobacterium avium subsp. paratuberculosis
ggcccuccgcggcgc

SEQ ID NO: 976761 - RNA, 15 nt, Mycobacterium avium subsp. paratuberculosis
ggcccucggccagcc

SEQ ID NO: 976762 - RNA, 19 nt, Mycobacterium avium subsp. paratuberculosis
ggcccggggacacccucgg

SEQ ID NO: 976763 - RNA, 15 nt, Mycobacterium avium subsp. paratuberculosis
ggcccggcgugggcc

SEQ ID NO: 976764 - RNA, 21 nt, Mycobacterium avium subsp. paratuberculosis
ggcccggcgugggccgcagcg

SEQ ID NO: 976765 - RNA, 13 nt, Mycobacterium avium subsp. paratuberculosis
ggcccgggcggcg

SEQ ID NO: 976766 - RNA, 23 nt, Mycobacterium avium subsp. paratuberculosis
ggcccgggcggcgaguccggcca

SEQ ID NO: 976767 - RNA, 21 nt, Mycobacterium avium subsp. paratuberculosis
ggcccgggguggauccgucgc

SEQ ID NO: 976768 - RNA, 22 nt, Mycobacterium avium subsp. paratuberculosis
ggcccgguagauauggcccucc

SEQ ID NO: 976769 - RNA, 15 nt, Mycobacterium avium subsp. paratuberculosis
ggcccggcggccggc

SEQ ID NO: 976770 - RNA, 16 nt, Mycobacterium avium subsp. paratuberculosis
ggcccggcgcggccgg

SEQ ID NO: 976771 - RNA, 16 nt, Mycobacterium avium subsp. paratuberculosis
ggcccggcgcggcggc

SEQ ID NO: 976772 - RNA, 20 nt, Mycobacterium avium subsp. paratuberculosis
ggcccgggaagccgcagcag

SEQ ID NO: 976773 - RNA, 21 nt, Mycobacterium avium subsp. paratuberculosis
ggcccgggaagccgcagcagg

SEQ ID NO: 976774 - RNA, 19 nt, Mycobacterium avium subsp. paratuberculosis
ggcccgggaugggccugga

SEQ ID NO: 976775 - RNA, 13 nt, Mycobacterium avium subsp. paratuberculosis
ggcccgggcaggc

SEQ ID NO: 976776 - RNA, 15 nt, Mycobacterium avium subsp. paratuberculosis
ggcccgggcaggcau

SEQ ID NO: 976777 - RNA, 13 nt, Mycobacterium avium subsp. paratuberculosis
ggcccggcccgcu

SEQ ID NO: 976778 - RNA, 14 nt, Mycobacterium avium subsp. paratuberculosis
ggcccggcgcggcc

SEQ ID NO: 976779 - RNA, 17 nt, Mycobacterium avium subsp. paratuberculosis
ggcccggccacucgccg

SEQ ID NO: 976780 - RNA, 15 nt, Mycobacterium avium subsp. paratuberculosis
ggcccggccggcgcg

SEQ ID NO: 976781 - RNA, 17 nt, Mycobacterium avium subsp. paratuberculosis
ggcccggcgaaucagca

SEQ ID NO: 976782 - RNA, 18 nt, Mycobacterium avium subsp. paratuberculosis
ggcccggcgaaucagcag

SEQ ID NO: 976783 - RNA, 19 nt, Mycobacterium avium subsp. paratuberculosis
ggcccggcgaaucagcagc

SEQ ID NO: 976784 - RNA, 15 nt, Mycobacterium avium subsp. paratuberculosis
ggcccuggcagguga

SEQ ID NO: 976785 - RNA, 17 nt, Mycobacterium avium subsp. paratuberculosis
ggcccuggucggccagg

SEQ ID NO: 976786 - RNA, 15 nt, Mycobacterium avium subsp. paratuberculosis
ggcccugcugcagcg

SEQ ID NO: 976787 - RNA, 18 nt, Mycobacterium avium subsp. paratuberculosis
ggcccugcggccagugcc

SEQ ID NO: 976788 - RNA, 19 nt, Mycobacterium avium subsp. paratuberculosis
ggcccugcucuucgcgcgc

SEQ ID NO: 976789 - RNA, 13 nt, Mycobacterium avium subsp. paratuberculosis
ggcccugcgcggc

SEQ ID NO: 976790 - RNA, 15 nt, Mycobacterium avium subsp. paratuberculosis
ggcccugcgcggccu

SEQ ID NO: 976791 - RNA, 20 nt, Mycobacterium avium subsp. paratuberculosis
ggcccugcgcggccugcagc

SEQ ID NO: 976792 - RNA, 20 nt, Mycobacterium avium subsp. paratuberculosis
ggcccucguccgacagcgcc

SEQ ID NO: 976793 - RNA, 12 nt, Mycobacterium avium subsp. paratuberculosis
ggcccugcagcg

SEQ ID NO: 976794 - RNA, 16 nt, Mycobacterium avium subsp. paratuberculosis
ggccgaaacgcccggc

SEQ ID NO: 976795 - RNA, 16 nt, Mycobacterium avium subsp. paratuberculosis
ggcccuugccccacca

SEQ ID NO: 976796 - RNA, 17 nt, Mycobacterium avium subsp. paratuberculosis
ggccgaacacggccgcc

SEQ ID NO: 976797 - RNA, 14 nt, Mycobacterium avium subsp. paratuberculosis
ggccgaacagcagc

SEQ ID NO: 976798 - RNA, 15 nt, Mycobacterium avium subsp. paratuberculosis
ggccgaacagcagcg

SEQ ID NO: 976799 - RNA, 15 nt, Mycobacterium avium subsp. paratuberculosis
ggccgaaggcggcgc

SEQ ID NO: 976800 - RNA, 16 nt, Mycobacterium avium subsp. paratuberculosis
ggccgaaggcggcgcc

SEQ ID NO: 976801 - RNA, 14 nt, Mycobacterium avium subsp. paratuberculosis
ggccgaaccgcagc

SEQ ID NO: 976802 - RNA, 16 nt, Mycobacterium avium subsp. paratuberculosis
ggccgaaccgcagccg

SEQ ID NO: 976803 - RNA, 17 nt, Mycobacterium avium subsp. paratuberculosis
ggccgaacucucccagg

SEQ ID NO: 976804 - RNA, 15 nt, Mycobacterium avium subsp. paratuberculosis
ggcaacagcgcgccg

SEQ ID NO: 976805 - RNA, 16 nt, Mycobacterium avium subsp. paratuberculosis
ggcaacaccggcggcg

SEQ ID NO: 976806 - RNA, 17 nt, Mycobacterium avium subsp. paratuberculosis
ggcaacaccggcggcga

SEQ ID NO: 976807 - RNA, 14 nt, Mycobacterium avium subsp. paratuberculosis
ggcaacacgucguc

SEQ ID NO: 976808 - RNA, 16 nt, Mycobacterium avium subsp. paratuberculosis
ggcaaccgcagcaucu

SEQ ID NO: 976809 - RNA, 17 nt, Mycobacterium avium subsp. paratuberculosis
ggcaagcagcggcagcc

SEQ ID NO: 976810 - RNA, 23 nt, Mycobacterium avium subsp. paratuberculosis
ggcaagcagcggcagccacggca

SEQ ID NO: 976811 - RNA, 20 nt, Mycobacterium avium subsp. paratuberculosis
ggcaagcaguaugcccgccg

SEQ ID NO: 976812 - RNA, 21 nt, Mycobacterium avium subsp. paratuberculosis
ggauucucgcucugccgggcc

SEQ ID NO: 976813 - RNA, 23 nt, Mycobacterium avium subsp. paratuberculosis
ggauucccgaccccgccagcacc

SEQ ID NO: 976814 - RNA, 19 nt, Mycobacterium avium subsp. paratuberculosis
ggauucagcgucgccaugc

SEQ ID NO: 976815 - RNA, 16 nt, Mycobacterium avium subsp. paratuberculosis
ggauucggcgcggcuc

SEQ ID NO: 976816 - RNA, 14 nt, Mycobacterium avium subsp. paratuberculosis
ggauucggguggcg

SEQ ID NO: 976817 - RNA, 13 nt, Mycobacterium avium subsp. paratuberculosis
ggauuccagcgcg

SEQ ID NO: 976818 - RNA, 15 nt, Mycobacterium avium subsp. paratuberculosis
ggaugucuccgcgca

SEQ ID NO: 976819 - RNA, 20 nt, Mycobacterium avium subsp. paratuberculosis
ggaugucggacucgcgccgg

SEQ ID NO: 976820 - RNA, 17 nt, Mycobacterium avium subsp. paratuberculosis
ggauguccgaccgguug

SEQ ID NO: 976821 - RNA, 17 nt, Mycobacterium avium subsp. paratuberculosis
ggaugucgucgggcgcg

SEQ ID NO: 976822 - RNA, 19 nt, Mycobacterium avium subsp. paratuberculosis
ggauggcuguggaugacgc

SEQ ID NO: 976823 - RNA, 15 nt, Mycobacterium avium subsp. paratuberculosis
ggaugugcugcaggu

SEQ ID NO: 976824 - RNA, 19 nt, Mycobacterium avium subsp. paratuberculosis
ggaugccggggcagcaccc

SEQ ID NO: 976825 - RNA, 23 nt, Mycobacterium avium subsp. paratuberculosis
ggaugccaguccugggccggggc

SEQ ID NO: 976826 - RNA, 11 nt, Mycobacterium avium subsp. paratuberculosis
ggaugcccagg

SEQ ID NO: 976827 - RNA, 12 nt, Mycobacterium avium subsp. paratuberculosis
ggaugcccagga

SEQ ID NO: 976828 - RNA, 17 nt, Mycobacterium avium subsp. paratuberculosis
ggaugcccaggccggcg

SEQ ID NO: 976829 - RNA, 22 nt, Mycobacterium avium subsp. paratuberculosis
ggaugccgaacgcgauccacug

SEQ ID NO: 976830 - RNA, 15 nt, Mycobacterium avium subsp. paratuberculosis
ggaugccgagcagcu

SEQ ID NO: 976831 - RNA, 13 nt, Mycobacterium avium subsp. paratuberculosis
ggaugccgcccac

SEQ ID NO: 976832 - RNA, 15 nt, Mycobacterium avium subsp. paratuberculosis
ggaugcggucgauca

SEQ ID NO: 976833 - RNA, 19 nt, Mycobacterium avium subsp. paratuberculosis
ggaugcggcgcccacagca

SEQ ID NO: 976834 - RNA, 21 nt, Mycobacterium avium subsp. paratuberculosis
ggaugcucaccggucagcugg

SEQ ID NO: 976835 - RNA, 15 nt, Mycobacterium avium subsp. paratuberculosis
ggauggccagcaggu

SEQ ID NO: 976836 - RNA, 23 nt, Mycobacterium avium subsp. paratuberculosis
ggauggagcgcgacgggcugcug

SEQ ID NO: 976837 - RNA, 12 nt, Mycobacterium avium subsp. paratuberculosis
ggauggccgggc

SEQ ID NO: 976838 - RNA, 13 nt, Mycobacterium avium subsp. paratuberculosis
ggauggccgggca

SEQ ID NO: 976839 - RNA, 16 nt, Mycobacterium avium subsp. paratuberculosis
ggauggcgcccagccc

SEQ ID NO: 976840 - RNA, 21 nt, Mycobacterium avium subsp. paratuberculosis
ggauggcgcccagcccgagca

SEQ ID NO: 976841 - RNA, 15 nt, Mycobacterium avium subsp. paratuberculosis
ggaugaucagcaggu

SEQ ID NO: 976842 - RNA, 15 nt, Mycobacterium avium subsp. paratuberculosis
ggaugaucggcgccu

SEQ ID NO: 976843 - RNA, 22 nt, Mycobacterium avium subsp. paratuberculosis
ggaugagcugggcggcgcgcug

SEQ ID NO: 976844 - RNA, 17 nt, Mycobacterium avium subsp. paratuberculosis
ggaugacgugcaccacc

SEQ ID NO: 976845 - RNA, 17 nt, Mycobacterium avium subsp. paratuberculosis
ggaugacgccgcgguug

SEQ ID NO: 976846 - RNA, 16 nt, Mycobacterium avium subsp. paratuberculosis
ggaugaccgcccagga

SEQ ID NO: 976847 - RNA, 18 nt, Mycobacterium avium subsp. paratuberculosis
ggaucgugucccggcgcc

SEQ ID NO: 976848 - RNA, 12 nt, Mycobacterium avium subsp. paratuberculosis
ggaucuccagca

SEQ ID NO: 976849 - RNA, 19 nt, Mycobacterium avium subsp. paratuberculosis
ggaucugcacgucggcggc

SEQ ID NO: 976850 - RNA, 16 nt, Mycobacterium avium subsp. paratuberculosis
ggaucugggcggcggg

SEQ ID NO: 976851 - RNA, 13 nt, Mycobacterium avium subsp. paratuberculosis
ggaucagcuccuc

SEQ ID NO: 976852 - RNA, 23 nt, Mycobacterium avium subsp. paratuberculosis
ggaucaugucgguaaggcaggca

SEQ ID NO: 976853 - RNA, 16 nt, Mycobacterium avium subsp. paratuberculosis
ggaucggaccgcacca

SEQ ID NO: 976854 - RNA, 15 nt, Mycobacterium avium subsp. paratuberculosis
ggauccagcggcggc

SEQ ID NO: 976855 - RNA, 13 nt, Mycobacterium avium subsp. paratuberculosis
ggaucggccagca

SEQ ID NO: 976856 - RNA, 12 nt, Mycobacterium avium subsp. paratuberculosis
ggaucggcggcg

SEQ ID NO: 976857 - RNA, 16 nt, Mycobacterium avium subsp. paratuberculosis
ggaucggcgggcgccg

SEQ ID NO: 976858 - RNA, 16 nt, Mycobacterium avium subsp. paratuberculosis
ggaucggcggggcgcg

SEQ ID NO: 976859 - RNA, 13 nt, Mycobacterium avium subsp. paratuberculosis
ggaucgucgccgg

SEQ ID NO: 976860 - RNA, 16 nt, Mycobacterium avium subsp. paratuberculosis
ggaucggugcaggccg

SEQ ID NO: 976861 - RNA, 16 nt, Mycobacterium avium subsp. paratuberculosis
ggaucggugcgcggcg

SEQ ID NO: 976862 - RNA, 13 nt, Mycobacterium avium subsp. paratuberculosis
ggaucgguuucuc

SEQ ID NO: 976863 - RNA, 20 nt, Mycobacterium avium subsp. paratuberculosis
ggaucgguuucuccaccccc

SEQ ID NO: 976864 - RNA, 18 nt, Mycobacterium avium subsp. paratuberculosis
ggaguuggaucgccgcaa

SEQ ID NO: 976865 - RNA, 17 nt, Mycobacterium avium subsp. paratuberculosis
ggaguucgcccgcagca

SEQ ID NO: 976866 - RNA, 19 nt, Mycobacterium avium subsp. paratuberculosis
ggagcccagcuuggcgccc

SEQ ID NO: 976867 - RNA, 13 nt, Mycobacterium avium subsp. paratuberculosis
ggagccggccgcc

SEQ ID NO: 976868 - RNA, 13 nt, Mycobacterium avium subsp. paratuberculosis
ggagccggcggcg

SEQ ID NO: 976869 - RNA, 20 nt, Mycobacterium avium subsp. paratuberculosis
ggagccggagaacuaucugg

SEQ ID NO: 976870 - RNA, 21 nt, Mycobacterium avium subsp. paratuberculosis
ggauaacgcaaaacggugcgg

SEQ ID NO: 976871 - RNA, 16 nt, Mycobacterium avium subsp. paratuberculosis
ggauacccgcggccuc

SEQ ID NO: 976872 - RNA, 20 nt, Mycobacterium avium subsp. paratuberculosis
ggacuggcugagcagcaccc

SEQ ID NO: 976873 - RNA, 16 nt, Mycobacterium avium subsp. paratuberculosis
ggacugcgccggggcc

SEQ ID NO: 976874 - RNA, 17 nt, Mycobacterium avium subsp. paratuberculosis
ggagcacgugaugagcg

SEQ ID NO: 976875 - RNA, 20 nt, Mycobacterium avium subsp. paratuberculosis
ggagaggcccggcagccggg

SEQ ID NO: 976876 - RNA, 19 nt, Mycobacterium avium subsp. paratuberculosis
ggagaaaccgucggcccgc

SEQ ID NO: 976877 - RNA, 20 nt, Mycobacterium avium subsp. paratuberculosis
ggacuucugguugacgccga

SEQ ID NO: 976878 - RNA, 19 nt, Mycobacterium avium subsp. paratuberculosis
ggagaccaggucggccuuc

SEQ ID NO: 976879 - RNA, 16 nt, Mycobacterium avium subsp. paratuberculosis
ggagacgucggccggg

SEQ ID NO: 976880 - RNA, 17 nt, Mycobacterium avium subsp. paratuberculosis
ggagacguugccgcaca

SEQ ID NO: 976881 - RNA, 24 nt, Mycobacterium avium subsp. paratuberculosis
ggacggaucgagucccgcgcggcg

SEQ ID NO: 976882 - RNA, 15 nt, Mycobacterium avium subsp. paratuberculosis
ggacgcggucgccgc

SEQ ID NO: 976883 - RNA, 21 nt, Mycobacterium avium subsp. paratuberculosis
ggacgcugcgguacacguggc

SEQ ID NO: 976884 - RNA, 21 nt, Mycobacterium avium subsp. paratuberculosis
ggacgcugaacagcccgagca

SEQ ID NO: 976885 - RNA, 15 nt, Mycobacterium avium subsp. paratuberculosis
ggacgcgcgcggcgu

SEQ ID NO: 976886 - RNA, 15 nt, Mycobacterium avium subsp. paratuberculosis
ggacgcggccagcgc

SEQ ID NO: 976887 - RNA, 21 nt, Mycobacterium avium subsp. paratuberculosis
ggacgaggcccgcaagaugug

SEQ ID NO: 976888 - RNA, 14 nt, Mycobacterium avium subsp. paratuberculosis
ggacgaggcgagua

SEQ ID NO: 976889 - RNA, 22 nt, Mycobacterium avium subsp. paratuberculosis
ggacgcgcacacggccucgccc

SEQ ID NO: 976890 - RNA, 17 nt, Mycobacterium avium subsp. paratuberculosis
ggacgacggcgccgccc

SEQ ID NO: 976891 - RNA, 17 nt, Mycobacterium avium subsp. paratuberculosis
ggacgaaacccggcgga

SEQ ID NO: 976892 - RNA, 14 nt, Mycobacterium avium subsp. paratuberculosis
ggacgaagaccggg

SEQ ID NO: 976893 - RNA, 18 nt, Mycobacterium avium subsp. paratuberculosis
ggaccuugucgggccgcg

SEQ ID NO: 976894 - RNA, 23 nt, Mycobacterium avium subsp. paratuberculosis
ggacacggcugcacccucugcca

SEQ ID NO: 976895 - RNA, 16 nt, Mycobacterium avium subsp. paratuberculosis
ggacacguuggccaga

SEQ ID NO: 976896 - RNA, 15 nt, Mycobacterium avium subsp. paratuberculosis
ggacagcagccgcuc

SEQ ID NO: 976897 - RNA, 20 nt, Mycobacterium avium subsp. paratuberculosis
ggacagccacagcucgggca

SEQ ID NO: 976898 - RNA, 17 nt, Mycobacterium avium subsp. paratuberculosis
ggacagccggggcagcu

SEQ ID NO: 976899 - RNA, 17 nt, Mycobacterium avium subsp. paratuberculosis
ggacagcgcggugaugu

SEQ ID NO: 976900 - RNA, 20 nt, Mycobacterium avium subsp. paratuberculosis
ggacagcucaccgggcucgg

SEQ ID NO: 976901 - RNA, 16 nt, Mycobacterium avium subsp. paratuberculosis
ggacagcucgccggcc

SEQ ID NO: 976902 - RNA, 22 nt, Mycobacterium avium subsp. paratuberculosis
ggacaggaacgggccggcgucc

SEQ ID NO: 976903 - RNA, 16 nt, Mycobacterium avium subsp. paratuberculosis
ggacaggaucuggacg

SEQ ID NO: 976904 - RNA, 22 nt, Mycobacterium avium subsp. paratuberculosis
ggacaggaugcguucggccagu

SEQ ID NO: 976905 - RNA, 23 nt, Mycobacterium avium subsp. paratuberculosis
ggacaggcacucgcccagggcgu

SEQ ID NO: 976906 - RNA, 17 nt, Mycobacterium avium subsp. paratuberculosis
ggacagcgucaccaaug

SEQ ID NO: 976907 - RNA, 14 nt, Mycobacterium avium subsp. paratuberculosis
ggacagcugacgau

SEQ ID NO: 976908 - RNA, 20 nt, Mycobacterium avium subsp. paratuberculosis
ggacagcugcgcgggcgcgg

SEQ ID NO: 976909 - RNA, 22 nt, Mycobacterium avium subsp. paratuberculosis
ggacagcugcgcgggcgcggcc

SEQ ID NO: 976910 - RNA, 16 nt, Mycobacterium avium subsp. paratuberculosis
ggaccggcgccggccg

SEQ ID NO: 976911 - RNA, 17 nt, Mycobacterium avium subsp. paratuberculosis
ggaccggcucguagcug

SEQ ID NO: 976912 - RNA, 21 nt, Mycobacterium avium subsp. paratuberculosis
ggaccggcucguagcuggugc

SEQ ID NO: 976913 - RNA, 15 nt, Mycobacterium avium subsp. paratuberculosis
ggaccgggcccggcg

SEQ ID NO: 976914 - RNA, 17 nt, Mycobacterium avium subsp. paratuberculosis
ggaccgggcccggcgcc

SEQ ID NO: 976915 - RNA, 13 nt, Mycobacterium avium subsp. paratuberculosis
ggaccgggcgggc

SEQ ID NO: 976916 - RNA, 15 nt, Mycobacterium avium subsp. paratuberculosis
ggaccgggcgggcug

SEQ ID NO: 976917 - RNA, 22 nt, Mycobacterium avium subsp. paratuberculosis
ggaccgguuuuccgucuucgac

SEQ ID NO: 976918 - RNA, 14 nt, Mycobacterium avium subsp. paratuberculosis
ggaccgcgcgccgg

SEQ ID NO: 976919 - RNA, 22 nt, Mycobacterium avium subsp. paratuberculosis
ggaccgcgcgccggccagcacg

SEQ ID NO: 976920 - RNA, 18 nt, Mycobacterium avium subsp. paratuberculosis
ggaccgcgcgggccagcg

SEQ ID NO: 976921 - RNA, 19 nt, Mycobacterium avium subsp. paratuberculosis
ggaccgcgcgggccagcgc

SEQ ID NO: 976922 - RNA, 15 nt, Mycobacterium avium subsp. paratuberculosis
ggaccgcgcagucgg

SEQ ID NO: 976923 - RNA, 23 nt, Mycobacterium avium subsp. paratuberculosis
ggaccgccgcggcgcccggcgcc

SEQ ID NO: 976924 - RNA, 13 nt, Mycobacterium avium subsp. paratuberculosis
ggaccggccagca

SEQ ID NO: 976925 - RNA, 16 nt, Mycobacterium avium subsp. paratuberculosis
ggaccggccagcagcc

SEQ ID NO: 976926 - RNA, 18 nt, Mycobacterium avium subsp. paratuberculosis
ggaccggccagcagccgc

SEQ ID NO: 976927 - RNA, 14 nt, Mycobacterium avium subsp. paratuberculosis
ggaccggccgugcg

SEQ ID NO: 976928 - RNA, 14 nt, Mycobacterium avium subsp. paratuberculosis
ggacagggcggcga

SEQ ID NO: 976929 - RNA, 16 nt, Mycobacterium avium subsp. paratuberculosis
ggacagggcggcgacc

SEQ ID NO: 976930 - RNA, 16 nt, Mycobacterium avium subsp. paratuberculosis
ggacccguugggccag

SEQ ID NO: 976931 - RNA, 15 nt, Mycobacterium avium subsp. paratuberculosis
ggaccgagccgcgcg

SEQ ID NO: 976932 - RNA, 16 nt, Mycobacterium avium subsp. paratuberculosis
ggaccgauccggcgcc

SEQ ID NO: 976933 - RNA, 16 nt, Mycobacterium avium subsp. paratuberculosis
ggaagucagcgcguga

SEQ ID NO: 976934 - RNA, 13 nt, Mycobacterium avium subsp. paratuberculosis
ggaaguuggccuc

SEQ ID NO: 976935 - RNA, 16 nt, Mycobacterium avium subsp. paratuberculosis
ggaaguuggccuccca

SEQ ID NO: 976936 - RNA, 17 nt, Mycobacterium avium subsp. paratuberculosis
ggaauacagcagcugcg

SEQ ID NO: 976937 - RNA, 20 nt, Mycobacterium avium subsp. paratuberculosis
ggaauucagugaggccagca

SEQ ID NO: 976938 - RNA, 18 nt, Mycobacterium avium subsp. paratuberculosis
ggaaugcaggaucgcggu

SEQ ID NO: 976939 - RNA, 20 nt, Mycobacterium avium subsp. paratuberculosis
ggaauggcaaggccagcaac

SEQ ID NO: 976940 - RNA, 17 nt, Mycobacterium avium subsp. paratuberculosis
ggaauucgggugcggcg

SEQ ID NO: 976941 - RNA, 20 nt, Mycobacterium avium subsp. paratuberculosis
ggacaccacgaucagcgcgu

SEQ ID NO: 976942 - RNA, 13 nt, Mycobacterium avium subsp. paratuberculosis
ggacacggccagc

SEQ ID NO: 976943 - RNA, 14 nt, Mycobacterium avium subsp. paratuberculosis
ggacacggccagcg

SEQ ID NO: 976944 - RNA, 13 nt, Mycobacterium avium subsp. paratuberculosis
ggacacggcggcg

SEQ ID NO: 976945 - RNA, 19 nt, Mycobacterium avium subsp. paratuberculosis
ggacaccucggccagcgcc

SEQ ID NO: 976946 - RNA, 17 nt, Mycobacterium avium subsp. paratuberculosis
ggacaccuuggcggcca

SEQ ID NO: 976947 - RNA, 14 nt, Mycobacterium avium subsp. paratuberculosis
ggacaccagguugg

SEQ ID NO: 976948 - RNA, 12 nt, Mycobacterium avium subsp. paratuberculosis
ggacaccagguu

SEQ ID NO: 976949 - RNA, 12 nt, Mycobacterium avium subsp. paratuberculosis
ggacacccucgg

SEQ ID NO: 976950 - RNA, 22 nt, Mycobacterium avium subsp. paratuberculosis
ggacaccgucaugccguugaug

SEQ ID NO: 976951 - RNA, 18 nt, Mycobacterium avium subsp. paratuberculosis
ggaacgucauggccagcu

SEQ ID NO: 976952 - RNA, 14 nt, Mycobacterium avium subsp. paratuberculosis
ggaacuccugcagg

SEQ ID NO: 976953 - RNA, 15 nt, Mycobacterium avium subsp. paratuberculosis
ggaacugacuucgga

SEQ ID NO: 976954 - RNA, 14 nt, Mycobacterium avium subsp. paratuberculosis
ggaagccccaggcc

SEQ ID NO: 976955 - RNA, 24 nt, Mycobacterium avium subsp. paratuberculosis
ggaaguagcccuuggacuccccca

SEQ ID NO: 976956 - RNA, 15 nt, Mycobacterium avium subsp. paratuberculosis
ggaaguagggcagcc

SEQ ID NO: 976957 - RNA, 16 nt, Mycobacterium avium subsp. paratuberculosis
ggaaguagggcagccc

SEQ ID NO: 976958 - RNA, 17 nt, Mycobacterium avium subsp. paratuberculosis
ggaagcgguugagccac

SEQ ID NO: 976959 - RNA, 21 nt, Mycobacterium avium subsp. paratuberculosis
ggaagcugccguugcgccagc

SEQ ID NO: 976960 - RNA, 16 nt, Mycobacterium avium subsp. paratuberculosis
ggaagccuggcacgac

SEQ ID NO: 976961 - RNA, 16 nt, Mycobacterium avium subsp. paratuberculosis
ggaagccggcgacgac

SEQ ID NO: 976962 - RNA, 16 nt, Mycobacterium avium subsp. paratuberculosis
ggaacaccacggccgg

SEQ ID NO: 976963 - RNA, 18 nt, Mycobacterium avium subsp. paratuberculosis
ggaacaccacggccggca

SEQ ID NO: 976964 - RNA, 13 nt, Mycobacterium avium subsp. paratuberculosis
ggaacaucuccag

SEQ ID NO: 976965 - RNA, 21 nt, Mycobacterium avium subsp. paratuberculosis
ggaacagacucagcccggccc

SEQ ID NO: 976966 - RNA, 14 nt, Mycobacterium avium subsp. paratuberculosis
ggaacagcccgccc

SEQ ID NO: 976967 - RNA, 14 nt, Mycobacterium avium subsp. paratuberculosis
ggaacaccgccuug

SEQ ID NO: 976968 - RNA, 21 nt, Mycobacterium avium subsp. paratuberculosis
ggaacaccgccuugcccggcu

SEQ ID NO: 976969 - RNA, 16 nt, Mycobacterium avium subsp. paratuberculosis
ggaacacgugauccag

SEQ ID NO: 976970 - RNA, 20 nt, Mycobacterium avium subsp. paratuberculosis
ggaacagcuggucccacagc

SEQ ID NO: 976971 - RNA, 18 nt, Mycobacterium avium subsp. paratuberculosis
gcuuuacgaggcgugcag

SEQ ID NO: 976972 - RNA, 19 nt, Mycobacterium avium subsp. paratuberculosis
gcuuuacgaggcgugcagc

SEQ ID NO: 976973 - RNA, 17 nt, Mycobacterium avium subsp. paratuberculosis
gcuuguucgggcccaca

SEQ ID NO: 976974 - RNA, 17 nt, Mycobacterium avium subsp. paratuberculosis
gcuuuccaaccaggcgc

SEQ ID NO: 976975 - RNA, 12 nt, Mycobacterium avium subsp. paratuberculosis
gcuuuccaccuc

SEQ ID NO: 976976 - RNA, 16 nt, Mycobacterium avium subsp. paratuberculosis
gcuugucagcggccuc

SEQ ID NO: 976977 - RNA, 22 nt, Mycobacterium avium subsp. paratuberculosis
gcuugugaaugggcugcgcguc

SEQ ID NO: 976978 - RNA, 23 nt, Mycobacterium avium subsp. paratuberculosis
gcuugugaaugggcugcgcgucg

SEQ ID NO: 976979 - RNA, 23 nt, Mycobacterium avium subsp. paratuberculosis
gcuugucguagcggcgccaccgg

SEQ ID NO: 976980 - RNA, 19 nt, Mycobacterium avium subsp. paratuberculosis
gcuuggucagcgcggcccg

SEQ ID NO: 976981 - RNA, 14 nt, Mycobacterium avium subsp. paratuberculosis
gcuuggucaugaac

SEQ ID NO: 976982 - RNA, 19 nt, Mycobacterium avium subsp. paratuberculosis
gcuuggguugcuccucggu

SEQ ID NO: 976983 - RNA, 15 nt, Mycobacterium avium subsp. paratuberculosis
gcuuggucgccugca

SEQ ID NO: 976984 - RNA, 17 nt, Mycobacterium avium subsp. paratuberculosis
gcuuggucuccggcccc

SEQ ID NO: 976985 - RNA, 16 nt, Mycobacterium avium subsp. paratuberculosis
gcuuggugaaggacuc

SEQ ID NO: 976986 - RNA, 15 nt, Mycobacterium avium subsp. paratuberculosis
gcuugggcagcagcu

SEQ ID NO: 976987 - RNA, 23 nt, Mycobacterium avium subsp. paratuberculosis
gcuugggcgccucgccgaccuug

SEQ ID NO: 976988 - RNA, 15 nt, Mycobacterium avium subsp. paratuberculosis
gcuugggccggugca

SEQ ID NO: 976989 - RNA, 19 nt, Mycobacterium avium subsp. paratuberculosis
gcuuggccagcucggcggc

SEQ ID NO: 976990 - RNA, 13 nt, Mycobacterium avium subsp. paratuberculosis
gcuugaagcccuc

SEQ ID NO: 976991 - RNA, 18 nt, Mycobacterium avium subsp. paratuberculosis
gcuugaacagcacccccu

SEQ ID NO: 976992 - RNA, 16 nt, Mycobacterium avium subsp. paratuberculosis
gcuugagccccgccgg

SEQ ID NO: 976993 - RNA, 20 nt, Mycobacterium avium subsp. paratuberculosis
gcuugaugaugucggcggcc

SEQ ID NO: 976994 - RNA, 15 nt, Mycobacterium avium subsp. paratuberculosis
gcuugaucgcaccca

SEQ ID NO: 976995 - RNA, 16 nt, Mycobacterium avium subsp. paratuberculosis
gcuugccccggucccg

SEQ ID NO: 976996 - RNA, 16 nt, Mycobacterium avium subsp. paratuberculosis
gcuugccagccgggcc

SEQ ID NO: 976997 - RNA, 13 nt, Mycobacterium avium subsp. paratuberculosis
gcuugcggcucaa

SEQ ID NO: 976998 - RNA, 15 nt, Mycobacterium avium subsp. paratuberculosis
gcuugcgccgcagcg

SEQ ID NO: 976999 - RNA, 20 nt, Mycobacterium avium subsp. paratuberculosis
gcuugccgccgcagcgcagc

SEQ ID NO: 977000 - RNA, 15 nt, Mycobacterium avium subsp. paratuberculosis
gcuucgggcgcgcgc

SEQ ID NO: 977001 - RNA, 20 nt, Mycobacterium avium subsp. paratuberculosis
gcuucgggucgccggucugg

SEQ ID NO: 977002 - RNA, 20 nt, Mycobacterium avium subsp. paratuberculosis
gcuucguacggcccgggaag

SEQ ID NO: 977003 - RNA, 15 nt, Mycobacterium avium subsp. paratuberculosis
gcuucugcagcucgc

SEQ ID NO: 977004 - RNA, 23 nt, Mycobacterium avium subsp. paratuberculosis
gcuuccagaugcgucaacccguu

SEQ ID NO: 977005 - RNA, 21 nt, Mycobacterium avium subsp. paratuberculosis
gcuucgaacgcccgcaccacg

SEQ ID NO: 977006 - RNA, 19 nt, Mycobacterium avium subsp. paratuberculosis
gcuuccgaucaacggcagc

SEQ ID NO: 977007 - RNA, 13 nt, Mycobacterium avium subsp. paratuberculosis
gcuuccgccgaga

SEQ ID NO: 977008 - RNA, 18 nt, Mycobacterium avium subsp. paratuberculosis
gcuuccccaaccuggacg

SEQ ID NO: 977009 - RNA, 18 nt, Mycobacterium avium subsp. paratuberculosis
gcuucccggcggucgccg

SEQ ID NO: 977010 - RNA, 20 nt, Mycobacterium avium subsp. paratuberculosis
gcuuaccggcgggcggcggc

SEQ ID NO: 977011 - RNA, 22 nt, Mycobacterium avium subsp. paratuberculosis
gcuucacguucggcgagugagg

SEQ ID NO: 977012 - RNA, 19 nt, Mycobacterium avium subsp. paratuberculosis
gcuucacggucggagccca

SEQ ID NO: 977013 - RNA, 23 nt, Mycobacterium avium subsp. paratuberculosis
gcuguuuuaggcagccaaugggg

SEQ ID NO: 977014 - RNA, 17 nt, Mycobacterium avium subsp. paratuberculosis
gcuguugcucggggcuc

SEQ ID NO: 977015 - RNA, 23 nt, Mycobacterium avium subsp. paratuberculosis
gcuguuggauuuggccgucaucu

SEQ ID NO: 977016 - RNA, 22 nt, Mycobacterium avium subsp. paratuberculosis
gcuguuggccagcuugcagcug

SEQ ID NO: 977017 - RNA, 18 nt, Mycobacterium avium subsp. paratuberculosis
gcuguugacgggccgcgg

SEQ ID NO: 977018 - RNA, 14 nt, Mycobacterium avium subsp. paratuberculosis
gcuguccaccugca

SEQ ID NO: 977019 - RNA, 15 nt, Mycobacterium avium subsp. paratuberculosis
gcuguccaccugcac

SEQ ID NO: 977020 - RNA, 20 nt, Mycobacterium avium subsp. paratuberculosis
gcuggugcgcagcccgccgg

SEQ ID NO: 977021 - RNA, 16 nt, Mycobacterium avium subsp. paratuberculosis
gcuggugcgcgccggc

SEQ ID NO: 977022 - RNA, 13 nt, Mycobacterium avium subsp. paratuberculosis
gcuguaggccagc

SEQ ID NO: 977023 - RNA, 16 nt, Mycobacterium avium subsp. paratuberculosis
gcuguaggccagcccg

SEQ ID NO: 977024 - RNA, 19 nt, Mycobacterium avium subsp. paratuberculosis
gcuguagcggucgugcggg

SEQ ID NO: 977025 - RNA, 15 nt, Mycobacterium avium subsp. paratuberculosis
gcuggugcagcaggg

SEQ ID NO: 977026 - RNA, 18 nt, Mycobacterium avium subsp. paratuberculosis
gcuggugacgugcaccug

SEQ ID NO: 977027 - RNA, 22 nt, Mycobacterium avium subsp. paratuberculosis
gcuggucuugccgugcagcagu

SEQ ID NO: 977028 - RNA, 22 nt, Mycobacterium avium subsp. paratuberculosis
gcuggugaacucgccgaucggg

SEQ ID NO: 977029 - RNA, 15 nt, Mycobacterium avium subsp. paratuberculosis
gcuggucggccuggc

SEQ ID NO: 977030 - RNA, 21 nt, Mycobacterium avium subsp. paratuberculosis
gcuggucacccacuggcggcc

SEQ ID NO: 977031 - RNA, 22 nt, Mycobacterium avium subsp. paratuberculosis
gcuggucacccacuggcggccg

SEQ ID NO: 977032 - RNA, 20 nt, Mycobacterium avium subsp. paratuberculosis
gcuggauggcgcccagcccg

SEQ ID NO: 977033 - RNA, 14 nt, Mycobacterium avium subsp. paratuberculosis
gcuggcaacaguag

SEQ ID NO: 977034 - RNA, 22 nt, Mycobacterium avium subsp. paratuberculosis
gcugcuccgggggcaccgccag

SEQ ID NO: 977035 - RNA, 14 nt, Mycobacterium avium subsp. paratuberculosis
gcugcgugcccgga

SEQ ID NO: 977036 - RNA, 21 nt, Mycobacterium avium subsp. paratuberculosis
gcugcgcuugcggcgcagcca

SEQ ID NO: 977037 - RNA, 22 nt, Mycobacterium avium subsp. paratuberculosis
gcugcggaaaugcccgcgcccc

SEQ ID NO: 977038 - RNA, 18 nt, Mycobacterium avium subsp. paratuberculosis
gcugcgcccagcgcgcga

SEQ ID NO: 977039 - RNA, 14 nt, Mycobacterium avium subsp. paratuberculosis
gcugcgcccgccgc

SEQ ID NO: 977040 - RNA, 18 nt, Mycobacterium avium subsp. paratuberculosis
gcugcgcgccggcggccg

SEQ ID NO: 977041 - RNA, 22 nt, Mycobacterium avium subsp. paratuberculosis
gcugcgcgcguuguccagcagc

SEQ ID NO: 977042 - RNA, 15 nt, Mycobacterium avium subsp. paratuberculosis
gcugcgcgcgcgauc

SEQ ID NO: 977043 - RNA, 13 nt, Mycobacterium avium subsp. paratuberculosis
gcugcgcguucgg

SEQ ID NO: 977044 - RNA, 13 nt, Mycobacterium avium subsp. paratuberculosis
gcugcgcggcuug

SEQ ID NO: 977045 - RNA, 19 nt, Mycobacterium avium subsp. paratuberculosis
gcugcgcgggucggcgccg

SEQ ID NO: 977046 - RNA, 12 nt, Mycobacterium avium subsp. paratuberculosis
gcugcgcggccg

SEQ ID NO: 977047 - RNA, 13 nt, Mycobacterium avium subsp. paratuberculosis
gcugcgcggcggc

SEQ ID NO: 977048 - RNA, 14 nt, Mycobacterium avium subsp. paratuberculosis
gcugcgcggcggcg

SEQ ID NO: 977049 - RNA, 21 nt, Mycobacterium avium subsp. paratuberculosis
gcuggaaaccucuugcggcgc

SEQ ID NO: 977050 - RNA, 12 nt, Mycobacterium avium subsp. paratuberculosis
gcuggaacagcg

SEQ ID NO: 977051 - RNA, 15 nt, Mycobacterium avium subsp. paratuberculosis
gcuggaacagcgggc

SEQ ID NO: 977052 - RNA, 19 nt, Mycobacterium avium subsp. paratuberculosis
gcuggaacagcgggccggc

SEQ ID NO: 977053 - RNA, 20 nt, Mycobacterium avium subsp. paratuberculosis
gcuggaaguucgcuggcggg

SEQ ID NO: 977054 - RNA, 15 nt, Mycobacterium avium subsp. paratuberculosis
gcuggaaucccgccu

SEQ ID NO: 977055 - RNA, 23 nt, Mycobacterium avium subsp. paratuberculosis
gcuggacacccccgauccgccgu

SEQ ID NO: 977056 - RNA, 14 nt, Mycobacterium avium subsp. paratuberculosis
gcuggaauaccuug

SEQ ID NO: 977057 - RNA, 22 nt, Mycobacterium avium subsp. paratuberculosis
gcuggacagccacagcucgggc

SEQ ID NO: 977058 - RNA, 12 nt, Mycobacterium avium subsp. paratuberculosis
gcuggaucugcc

SEQ ID NO: 977059 - RNA, 12 nt, Mycobacterium avium subsp. paratuberculosis
gcugcugcucgg

SEQ ID NO: 977060 - RNA, 13 nt, Mycobacterium avium subsp. paratuberculosis
gcugcugcucggc

SEQ ID NO: 977061 - RNA, 14 nt, Mycobacterium avium subsp. paratuberculosis
gcugcugcgcggca

SEQ ID NO: 977062 - RNA, 15 nt, Mycobacterium avium subsp. paratuberculosis
gcugcugccgccgca

SEQ ID NO: 977063 - RNA, 17 nt, Mycobacterium avium subsp. paratuberculosis
gcugcugggacgggucg

SEQ ID NO: 977064 - RNA, 13 nt, Mycobacterium avium subsp. paratuberculosis
gcugcugggugcc

SEQ ID NO: 977065 - RNA, 18 nt, Mycobacterium avium subsp. paratuberculosis
gcugccggacaccccggc

SEQ ID NO: 977066 - RNA, 16 nt, Mycobacterium avium subsp. paratuberculosis
gcugccgcugcgccgg

SEQ ID NO: 977067 - RNA, 13 nt, Mycobacterium avium subsp. paratuberculosis
gcugccgccgccg

SEQ ID NO: 977068 - RNA, 15 nt, Mycobacterium avium subsp. paratuberculosis
gcugccgccgccggc

SEQ ID NO: 977069 - RNA, 18 nt, Mycobacterium avium subsp. paratuberculosis
gcugccgcccccgcuggc

SEQ ID NO: 977070 - RNA, 19 nt, Mycobacterium avium subsp. paratuberculosis
gcugccgcccccgcuggcg

SEQ ID NO: 977071 - RNA, 18 nt, Mycobacterium avium subsp. paratuberculosis
gcugccgcgacucggugu

SEQ ID NO: 977072 - RNA, 20 nt, Mycobacterium avium subsp. paratuberculosis
gcugccgcgccccgagcagc

SEQ ID NO: 977073 - RNA, 22 nt, Mycobacterium avium subsp. paratuberculosis
gcugccgcgccccgagcagcgg

SEQ ID NO: 977074 - RNA, 14 nt, Mycobacterium avium subsp. paratuberculosis
gcugccgcgcgccg

SEQ ID NO: 977075 - RNA, 15 nt, Mycobacterium avium subsp. paratuberculosis
gcugccgaccaggaa

SEQ ID NO: 977076 - RNA, 22 nt, Mycobacterium avium subsp. paratuberculosis
gcugccaggcgguggccgaacc

SEQ ID NO: 977077 - RNA, 16 nt, Mycobacterium avium subsp. paratuberculosis
gcugccagggccgggc

SEQ ID NO: 977078 - RNA, 23 nt, Mycobacterium avium subsp. paratuberculosis
gcugcgcacccgguccggcuggu

SEQ ID NO: 977079 - RNA, 19 nt, Mycobacterium avium subsp. paratuberculosis
gcugcgcacguagcccagc

SEQ ID NO: 977080 - RNA, 20 nt, Mycobacterium avium subsp. paratuberculosis
gcugcgcagacccgguggcc

SEQ ID NO: 977081 - RNA, 22 nt, Mycobacterium avium subsp. paratuberculosis
gcugcgcagcaccguccgcaga

SEQ ID NO: 977082 - RNA, 15 nt, Mycobacterium avium subsp. paratuberculosis
gcugcgcagccgugc

SEQ ID NO: 977083 - RNA, 13 nt, Mycobacterium avium subsp. paratuberculosis
gcugcgcagcagc

SEQ ID NO: 977084 - RNA, 14 nt, Mycobacterium avium subsp. paratuberculosis
gcugcgagcccggc

SEQ ID NO: 977085 - RNA, 15 nt, Mycobacterium avium subsp. paratuberculosis
gcugcgagcccggcc

SEQ ID NO: 977086 - RNA, 21 nt, Mycobacterium avium subsp. paratuberculosis
gcugccguagcgcugggugaa

SEQ ID NO: 977087 - RNA, 17 nt, Mycobacterium avium subsp. paratuberculosis
gcugccguccacccggc

SEQ ID NO: 977088 - RNA, 16 nt, Mycobacterium avium subsp. paratuberculosis
gcugccguccggcggc

SEQ ID NO: 977089 - RNA, 16 nt, Mycobacterium avium subsp. paratuberculosis
gcugccggggugcagc

SEQ ID NO: 977090 - RNA, 23 nt, Mycobacterium avium subsp. paratuberculosis
gcugccggugcugcucgagggcc

SEQ ID NO: 977091 - RNA, 16 nt, Mycobacterium avium subsp. paratuberculosis
gcugccggccggcagc

SEQ ID NO: 977092 - RNA, 16 nt, Mycobacterium avium subsp. paratuberculosis
gcugccggccggggcg

SEQ ID NO: 977093 - RNA, 15 nt, Mycobacterium avium subsp. paratuberculosis
gcugccggcggccgc

SEQ ID NO: 977094 - RNA, 19 nt, Mycobacterium avium subsp. paratuberculosis
gcugccggcggccgccggc

SEQ ID NO: 977095 - RNA, 20 nt, Mycobacterium avium subsp. paratuberculosis
gcugaaguucaccaccgcgc

SEQ ID NO: 977096 - RNA, 19 nt, Mycobacterium avium subsp. paratuberculosis
gcugaaugaacgaccuggu

SEQ ID NO: 977097 - RNA, 13 nt, Mycobacterium avium subsp. paratuberculosis
gcugaccguggug

SEQ ID NO: 977098 - RNA, 22 nt, Mycobacterium avium subsp. paratuberculosis
gcugaccugugcgccccacggc

SEQ ID NO: 977099 - RNA, 21 nt, Mycobacterium avium subsp. paratuberculosis
gcugacgaugauccuggccug

SEQ ID NO: 977100 - RNA, 16 nt, Mycobacterium avium subsp. paratuberculosis
gcugacgaugcggccg

SEQ ID NO: 977101 - RNA, 20 nt, Mycobacterium avium subsp. paratuberculosis
gcugacgauggcgaccgcgc

SEQ ID NO: 977102 - RNA, 21 nt, Mycobacterium avium subsp. paratuberculosis
gcucucguccucgaacaggcu

SEQ ID NO: 977103 - RNA, 14 nt, Mycobacterium avium subsp. paratuberculosis
gcugaacagcagca

SEQ ID NO: 977104 - RNA, 15 nt, Mycobacterium avium subsp. paratuberculosis
gcugaacagcagcag

SEQ ID NO: 977105 - RNA, 14 nt, Mycobacterium avium subsp. paratuberculosis
gcugaagcgcuggg

SEQ ID NO: 977106 - RNA, 20 nt, Mycobacterium avium subsp. paratuberculosis
gcugaacgcgauccaggugu

SEQ ID NO: 977107 - RNA, 15 nt, Mycobacterium avium subsp. paratuberculosis
gcugaacgggcagcc

SEQ ID NO: 977108 - RNA, 14 nt, Mycobacterium avium subsp. paratuberculosis
gcugaacagcgcgc

SEQ ID NO: 977109 - RNA, 16 nt, Mycobacterium avium subsp. paratuberculosis
gcugaacagcgcgccg

SEQ ID NO: 977110 - RNA, 20 nt, Mycobacterium avium subsp. paratuberculosis
gcugaagaucaacagccgcc

SEQ ID NO: 977111 - RNA, 22 nt, Mycobacterium avium subsp. paratuberculosis
gcugccaaaguuggcaucccgc

SEQ ID NO: 977112 - RNA, 16 nt, Mycobacterium avium subsp. paratuberculosis
gcugcaggcuggucug

SEQ ID NO: 977113 - RNA, 22 nt, Mycobacterium avium subsp. paratuberculosis
gcugcagcuccucggcggccuc

SEQ ID NO: 977114 - RNA, 22 nt, Mycobacterium avium subsp. paratuberculosis
gcugcagcgccgaggccagcac

SEQ ID NO: 977115 - RNA, 18 nt, Mycobacterium avium subsp. paratuberculosis
gcugcagcgcgaggcgca

SEQ ID NO: 977116 - RNA, 14 nt, Mycobacterium avium subsp. paratuberculosis
gcugcagcggcggc

SEQ ID NO: 977117 - RNA, 16 nt, Mycobacterium avium subsp. paratuberculosis
gcugcagcggcggcca

SEQ ID NO: 977118 - RNA, 17 nt, Mycobacterium avium subsp. paratuberculosis
gcugcagcggcggccag

SEQ ID NO: 977119 - RNA, 18 nt, Mycobacterium avium subsp. paratuberculosis
gcugcagcggcggccagu

SEQ ID NO: 977120 - RNA, 19 nt, Mycobacterium avium subsp. paratuberculosis
gcugcagcgacugcacccg

SEQ ID NO: 977121 - RNA, 14 nt, Mycobacterium avium subsp. paratuberculosis
gcugcagccgggcg

SEQ ID NO: 977122 - RNA, 20 nt, Mycobacterium avium subsp. paratuberculosis
gcugcagccgguccggcggc

SEQ ID NO: 977123 - RNA, 15 nt, Mycobacterium avium subsp. paratuberculosis
gcugcagccggccgg

SEQ ID NO: 977124 - RNA, 20 nt, Mycobacterium avium subsp. paratuberculosis
gcugcagccggccggcggac

SEQ ID NO: 977125 - RNA, 18 nt, Mycobacterium avium subsp. paratuberculosis
gcugaucucggcggucug

SEQ ID NO: 977126 - RNA, 15 nt, Mycobacterium avium subsp. paratuberculosis
gcugaucgaguccuc

SEQ ID NO: 977127 - RNA, 14 nt, Mycobacterium avium subsp. paratuberculosis
gcugaucgcggccg

SEQ ID NO: 977128 - RNA, 19 nt, Mycobacterium avium subsp. paratuberculosis
gcugaucgcgauccgggcg

SEQ ID NO: 977129 - RNA, 22 nt, Mycobacterium avium subsp. paratuberculosis
gcugaucagccggcgagcgcgc

SEQ ID NO: 977130 - RNA, 13 nt, Mycobacterium avium subsp. paratuberculosis
gcugagccgccga

SEQ ID NO: 977131 - RNA, 16 nt, Mycobacterium avium subsp. paratuberculosis
gcugagccgccgagcc

SEQ ID NO: 977132 - RNA, 14 nt, Mycobacterium avium subsp. paratuberculosis
gcugagccggcccu

SEQ ID NO: 977133 - RNA, 17 nt, Mycobacterium avium subsp. paratuberculosis
gcugagcgccaggccau

SEQ ID NO: 977134 - RNA, 17 nt, Mycobacterium avium subsp. paratuberculosis
gcugagcgacauggucg

SEQ ID NO: 977135 - RNA, 18 nt, Mycobacterium avium subsp. paratuberculosis
gcugauagcccgccgcgg

SEQ ID NO: 977136 - RNA, 14 nt, Mycobacterium avium subsp. paratuberculosis
gcugagcagcaggu

SEQ ID NO: 977137 - RNA, 15 nt, Mycobacterium avium subsp. paratuberculosis
gcucgucgucgccga

SEQ ID NO: 977138 - RNA, 16 nt, Mycobacterium avium subsp. paratuberculosis
gcucgucggcgcgggc

SEQ ID NO: 977139 - RNA, 22 nt, Mycobacterium avium subsp. paratuberculosis
gcucgucggcgcgggccagcag

SEQ ID NO: 977140 - RNA, 14 nt, Mycobacterium avium subsp. paratuberculosis
gcucgucggcgggc

SEQ ID NO: 977141 - RNA, 15 nt, Mycobacterium avium subsp. paratuberculosis
gcucgucggggcagc

SEQ ID NO: 977142 - RNA, 14 nt, Mycobacterium avium subsp. paratuberculosis
gcucgucgcgggcg

SEQ ID NO: 977143 - RNA, 18 nt, Mycobacterium avium subsp. paratuberculosis
gcucgucggccagcgagu

SEQ ID NO: 977144 - RNA, 15 nt, Mycobacterium avium subsp. paratuberculosis
gcucgugcagccggc

SEQ ID NO: 977145 - RNA, 20 nt, Mycobacterium avium subsp. paratuberculosis
gcucgugaugguccagcacc

SEQ ID NO: 977146 - RNA, 22 nt, Mycobacterium avium subsp. paratuberculosis
gcucggucgcgaagacgcuggc

SEQ ID NO: 977147 - RNA, 15 nt, Mycobacterium avium subsp. paratuberculosis
gcucggucaacccga

SEQ ID NO: 977148 - RNA, 20 nt, Mycobacterium avium subsp. paratuberculosis
gcucggucaagccggccagc

SEQ ID NO: 977149 - RNA, 22 nt, Mycobacterium avium subsp. paratuberculosis
gcucggucaagccggccagcag

SEQ ID NO: 977150 - RNA, 16 nt, Mycobacterium avium subsp. paratuberculosis
gcucggugauccacgc

SEQ ID NO: 977151 - RNA, 23 nt, Mycobacterium avium subsp. paratuberculosis
gcucggugaugaucgccgggucg

SEQ ID NO: 977152 - RNA, 20 nt, Mycobacterium avium subsp. paratuberculosis
gcucggugcgcauggcgugc

SEQ ID NO: 977153 - RNA, 21 nt, Mycobacterium avium subsp. paratuberculosis
gcucgugggaaugcggcuggg

SEQ ID NO: 977154 - RNA, 12 nt, Mycobacterium avium subsp. paratuberculosis
gcucuccugcuu

SEQ ID NO: 977155 - RNA, 21 nt, Mycobacterium avium subsp. paratuberculosis
gcucgcguucgggcccggccg

SEQ ID NO: 977156 - RNA, 22 nt, Mycobacterium avium subsp. paratuberculosis
gcucgcguucgggcccggccgc

SEQ ID NO: 977157 - RNA, 18 nt, Mycobacterium avium subsp. paratuberculosis
gcucgggugucgccgagc

SEQ ID NO: 977158 - RNA, 15 nt, Mycobacterium avium subsp. paratuberculosis
gcucgcuugccagcc

SEQ ID NO: 977159 - RNA, 21 nt, Mycobacterium avium subsp. paratuberculosis
gcucgcuugccagccgggccg

SEQ ID NO: 977160 - RNA, 13 nt, Mycobacterium avium subsp. paratuberculosis
gcucgggcgccuc

SEQ ID NO: 977161 - RNA, 24 nt, Mycobacterium avium subsp. paratuberculosis
gcucgggcgcgaacagcgccgacu

SEQ ID NO: 977162 - RNA, 24 nt, Mycobacterium avium subsp. paratuberculosis
gcucgccgaaaugccgugccagcc

SEQ ID NO: 977163 - RNA, 19 nt, Mycobacterium avium subsp. paratuberculosis
gcucgccgauguggcgggc

SEQ ID NO: 977164 - RNA, 20 nt, Mycobacterium avium subsp. paratuberculosis
gcucgccgauguggcgggcg

SEQ ID NO: 977165 - RNA, 14 nt, Mycobacterium avium subsp. paratuberculosis
gcucgccggcgcgc

SEQ ID NO: 977166 - RNA, 14 nt, Mycobacterium avium subsp. paratuberculosis
gcucgccggcggcc

SEQ ID NO: 977167 - RNA, 15 nt, Mycobacterium avium subsp. paratuberculosis
gcucgccggcggccg

SEQ ID NO: 977168 - RNA, 15 nt, Mycobacterium avium subsp. paratuberculosis
gcucgccgcgcggcc

SEQ ID NO: 977169 - RNA, 21 nt, Mycobacterium avium subsp. paratuberculosis
gcucgcgguugggccgccggc

SEQ ID NO: 977170 - RNA, 23 nt, Mycobacterium avium subsp. paratuberculosis
gcucgcgguugggccgccggccg

SEQ ID NO: 977171 - RNA, 22 nt, Mycobacterium avium subsp. paratuberculosis
gcucgcgggugcggcgcugccg

SEQ ID NO: 977172 - RNA, 21 nt, Mycobacterium avium subsp. paratuberculosis
gcucgcgagggcgggccagcu

SEQ ID NO: 977173 - RNA, 15 nt, Mycobacterium avium subsp. paratuberculosis
gcucgcgaagcgcga

SEQ ID NO: 977174 - RNA, 21 nt, Mycobacterium avium subsp. paratuberculosis
gcucgccguagaauccgccgu

SEQ ID NO: 977175 - RNA, 15 nt, Mycobacterium avium subsp. paratuberculosis
gcucgccagaccggu

SEQ ID NO: 977176 - RNA, 13 nt, Mycobacterium avium subsp. paratuberculosis
gcucgccagacuc

SEQ ID NO: 977177 - RNA, 21 nt, Mycobacterium avium subsp. paratuberculosis
gcucgccagacucacggcggc

SEQ ID NO: 977178 - RNA, 14 nt, Mycobacterium avium subsp. paratuberculosis
gcucgcccagcgcg

SEQ ID NO: 977179 - RNA, 16 nt, Mycobacterium avium subsp. paratuberculosis
gcucgcccagcgcggc

SEQ ID NO: 977180 - RNA, 17 nt, Mycobacterium avium subsp. paratuberculosis
gcucgcccagcgcggcg

SEQ ID NO: 977181 - RNA, 21 nt, Mycobacterium avium subsp. paratuberculosis
gcucgcccgggcuaucgcccg

SEQ ID NO: 977182 - RNA, 13 nt, Mycobacterium avium subsp. paratuberculosis
gcucgaucaccca

SEQ ID NO: 977183 - RNA, 18 nt, Mycobacterium avium subsp. paratuberculosis
gcucgaggccgcgggcgu

SEQ ID NO: 977184 - RNA, 16 nt, Mycobacterium avium subsp. paratuberculosis
gcucgaucgcguucug

SEQ ID NO: 977185 - RNA, 13 nt, Mycobacterium avium subsp. paratuberculosis
gcucgaucuggcg

SEQ ID NO: 977186 - RNA, 18 nt, Mycobacterium avium subsp. paratuberculosis
gcucgaucggcgcgccga

SEQ ID NO: 977187 - RNA, 15 nt, Mycobacterium avium subsp. paratuberculosis
gcucgaugcgcgcca

SEQ ID NO: 977188 - RNA, 14 nt, Mycobacterium avium subsp. paratuberculosis
gcucgaugcggccc

SEQ ID NO: 977189 - RNA, 17 nt, Mycobacterium avium subsp. paratuberculosis
gcucgaugcggcccugg

SEQ ID NO: 977190 - RNA, 15 nt, Mycobacterium avium subsp. paratuberculosis
gcucgauggccagcg

SEQ ID NO: 977191 - RNA, 13 nt, Mycobacterium avium subsp. paratuberculosis
gcucgagcaucac

SEQ ID NO: 977192 - RNA, 18 nt, Mycobacterium avium subsp. paratuberculosis
gcucgagcaucuccagcc

SEQ ID NO: 977193 - RNA, 18 nt, Mycobacterium avium subsp. paratuberculosis
gcucgaggccccgcguga

SEQ ID NO: 977194 - RNA, 16 nt, Mycobacterium avium subsp. paratuberculosis
gcucgagggccuccac

SEQ ID NO: 977195 - RNA, 18 nt, Mycobacterium avium subsp. paratuberculosis
gcucgagggccuccacca

SEQ ID NO: 977196 - RNA, 14 nt, Mycobacterium avium subsp. paratuberculosis
gcucgacggccggc

SEQ ID NO: 977197 - RNA, 17 nt, Mycobacterium avium subsp. paratuberculosis
gcucgaccucggcgacc

SEQ ID NO: 977198 - RNA, 18 nt, Mycobacterium avium subsp. paratuberculosis
gcucgacgaacuccgcgc

SEQ ID NO: 977199 - RNA, 15 nt, Mycobacterium avium subsp. paratuberculosis
gcucgaccccucggc

SEQ ID NO: 977200 - RNA, 19 nt, Mycobacterium avium subsp. paratuberculosis
gcucgacacgauguugaug

SEQ ID NO: 977201 - RNA, 16 nt, Mycobacterium avium subsp. paratuberculosis
gcucgacaggcagccc

SEQ ID NO: 977202 - RNA, 22 nt, Mycobacterium avium subsp. paratuberculosis
gcucgacaggcagcccggcugc

SEQ ID NO: 977203 - RNA, 17 nt, Mycobacterium avium subsp. paratuberculosis
gcucgacaucggccgcc

SEQ ID NO: 977204 - RNA, 13 nt, Mycobacterium avium subsp. paratuberculosis
gcucgaccagccc

SEQ ID NO: 977205 - RNA, 15 nt, Mycobacterium avium subsp. paratuberculosis
gcucgaccagccggg

SEQ ID NO: 977206 - RNA, 14 nt, Mycobacterium avium subsp. paratuberculosis
gcucgaccagcgcc

SEQ ID NO: 977207 - RNA, 17 nt, Mycobacterium avium subsp. paratuberculosis
gcuccuugagccgccgc

SEQ ID NO: 977208 - RNA, 13 nt, Mycobacterium avium subsp. paratuberculosis
gcucgaaccugga

SEQ ID NO: 977209 - RNA, 11 nt, Mycobacterium avium subsp. paratuberculosis
gcuccugcagc

SEQ ID NO: 977210 - RNA, 12 nt, Mycobacterium avium subsp. paratuberculosis
gcuccugcaggc

SEQ ID NO: 977211 - RNA, 13 nt, Mycobacterium avium subsp. paratuberculosis
gcuccucggcggc

SEQ ID NO: 977212 - RNA, 20 nt, Mycobacterium avium subsp. paratuberculosis
gcuccucggucagcggcgug

SEQ ID NO: 977213 - RNA, 19 nt, Mycobacterium avium subsp. paratuberculosis
gcuccucgcggaacugcuc

SEQ ID NO: 977214 - RNA, 15 nt, Mycobacterium avium subsp. paratuberculosis
gcuccggcccgagca

SEQ ID NO: 977215 - RNA, 17 nt, Mycobacterium avium subsp. paratuberculosis
gcuccggccgcgccggc

SEQ ID NO: 977216 - RNA, 13 nt, Mycobacterium avium subsp. paratuberculosis
gcuccgccgacac

SEQ ID NO: 977217 - RNA, 13 nt, Mycobacterium avium subsp. paratuberculosis
gcuccgcggccag

SEQ ID NO: 977218 - RNA, 15 nt, Mycobacterium avium subsp. paratuberculosis
gcuccgcggccagcu

SEQ ID NO: 977219 - RNA, 15 nt, Mycobacterium avium subsp. paratuberculosis
gcuccgcggcgggcg

SEQ ID NO: 977220 - RNA, 18 nt, Mycobacterium avium subsp. paratuberculosis
gcuccucgaccacgcaca

SEQ ID NO: 977221 - RNA, 14 nt, Mycobacterium avium subsp. paratuberculosis
gcuccucggccagc

SEQ ID NO: 977222 - RNA, 16 nt, Mycobacterium avium subsp. paratuberculosis
gcuccucggccagcac

SEQ ID NO: 977223 - RNA, 17 nt, Mycobacterium avium subsp. paratuberculosis
gcuccucggccagcacc

SEQ ID NO: 977224 - RNA, 18 nt, Mycobacterium avium subsp. paratuberculosis
gcuccucggccagcacca

SEQ ID NO: 977225 - RNA, 23 nt, Mycobacterium avium subsp. paratuberculosis
gcuccucggccagcaccagcagc

SEQ ID NO: 977226 - RNA, 24 nt, Mycobacterium avium subsp. paratuberculosis
gcuccucggccagcaccagcagcc

SEQ ID NO: 977227 - RNA, 15 nt, Mycobacterium avium subsp. paratuberculosis
gcuccucggccagcg

SEQ ID NO: 977228 - RNA, 15 nt, Mycobacterium avium subsp. paratuberculosis
gcuccgagcggaugc

SEQ ID NO: 977229 - RNA, 12 nt, Mycobacterium avium subsp. paratuberculosis
gcuccgccaccc

SEQ ID NO: 977230 - RNA, 21 nt, Mycobacterium avium subsp. paratuberculosis
gcucccggcagaucgcggccc

SEQ ID NO: 977231 - RNA, 22 nt, Mycobacterium avium subsp. paratuberculosis
gcucccggcagaucgcggcccg

SEQ ID NO: 977232 - RNA, 15 nt, Mycobacterium avium subsp. paratuberculosis
gcucccggcgcagca

SEQ ID NO: 977233 - RNA, 17 nt, Mycobacterium avium subsp. paratuberculosis
gcucccggcgccgccgu

SEQ ID NO: 977234 - RNA, 14 nt, Mycobacterium avium subsp. paratuberculosis
gcuccauggcggcg

SEQ ID NO: 977235 - RNA, 16 nt, Mycobacterium avium subsp. paratuberculosis
gcuccauggcggcgac

SEQ ID NO: 977236 - RNA, 20 nt, Mycobacterium avium subsp. paratuberculosis
gcuccagcuaggagccugcu

SEQ ID NO: 977237 - RNA, 21 nt, Mycobacterium avium subsp. paratuberculosis
gcuccagcgggcggcgguggc

SEQ ID NO: 977238 - RNA, 22 nt, Mycobacterium avium subsp. paratuberculosis
gcuccagcgggcggcgguggcc

SEQ ID NO: 977239 - RNA, 18 nt, Mycobacterium avium subsp. paratuberculosis
gcucaugagcccuccagc

SEQ ID NO: 977240 - RNA, 19 nt, Mycobacterium avium subsp. paratuberculosis
gcucaugagcccuccagcu

SEQ ID NO: 977241 - RNA, 21 nt, Mycobacterium avium subsp. paratuberculosis
gcucaucuacgucgucgccgg

SEQ ID NO: 977242 - RNA, 17 nt, Mycobacterium avium subsp. paratuberculosis
gcuccacaucugccggc

SEQ ID NO: 977243 - RNA, 19 nt, Mycobacterium avium subsp. paratuberculosis
gcuccacaucugccggcag

SEQ ID NO: 977244 - RNA, 14 nt, Mycobacterium avium subsp. paratuberculosis
gcuccagcaggcgc

SEQ ID NO: 977245 - RNA, 16 nt, Mycobacterium avium subsp. paratuberculosis
gcuccagcaggcgcgc

SEQ ID NO: 977246 - RNA, 19 nt, Mycobacterium avium subsp. paratuberculosis
gcuccagcaggcgcgccga

SEQ ID NO: 977247 - RNA, 22 nt, Mycobacterium avium subsp. paratuberculosis
gcuccagcaggcgcgccgagcg

SEQ ID NO: 977248 - RNA, 18 nt, Mycobacterium avium subsp. paratuberculosis
gcuccagcggccacaccg

SEQ ID NO: 977249 - RNA, 18 nt, Mycobacterium avium subsp. paratuberculosis
gcuccagcgcccgccgca

SEQ ID NO: 977250 - RNA, 22 nt, Mycobacterium avium subsp. paratuberculosis
gcgguaugcccgggccgucauc

SEQ ID NO: 977251 - RNA, 16 nt, Mycobacterium avium subsp. paratuberculosis
gcggucaccaaggcga

SEQ ID NO: 977252 - RNA, 15 nt, Mycobacterium avium subsp. paratuberculosis
gcucaucaggcggcc

SEQ ID NO: 977253 - RNA, 19 nt, Mycobacterium avium subsp. paratuberculosis
gcucaucaggcggccggcc

SEQ ID NO: 977254 - RNA, 21 nt, Mycobacterium avium subsp. paratuberculosis
gcggucagcaccgucaccgcc

SEQ ID NO: 977255 - RNA, 15 nt, Mycobacterium avium subsp. paratuberculosis
gcucauacagcggcg

SEQ ID NO: 977256 - RNA, 17 nt, Mycobacterium avium subsp. paratuberculosis
aaauccagaacagccag

SEQ ID NO: 977257 - RNA, 15 nt, Mycobacterium avium subsp. paratuberculosis
guuuguccugcucgg

SEQ ID NO: 977258 - RNA, 23 nt, Mycobacterium avium subsp. paratuberculosis
guuugcgccggcuccaccgcgcc

SEQ ID NO: 977259 - RNA, 17 nt, Mycobacterium avium subsp. paratuberculosis
guuugaucaccaccugg

SEQ ID NO: 977260 - RNA, 19 nt, Mycobacterium avium subsp. paratuberculosis
guuucgaccugcgggugca

SEQ ID NO: 977261 - RNA, 13 nt, Mycobacterium avium subsp. paratuberculosis
guuucggccggcc

SEQ ID NO: 977262 - RNA, 22 nt, Mycobacterium avium subsp. paratuberculosis
guuucggggguaaaccgccagc

SEQ ID NO: 977263 - RNA, 22 nt, Mycobacterium avium subsp. paratuberculosis
guuucggaguggaacagccgga

SEQ ID NO: 977264 - RNA, 20 nt, Mycobacterium avium subsp. paratuberculosis
guuuccggcuucaaaaaccu

SEQ ID NO: 977265 - RNA, 13 nt, Mycobacterium avium subsp. paratuberculosis
guuuccccaccag

SEQ ID NO: 977266 - RNA, 19 nt, Mycobacterium avium subsp. paratuberculosis
guugucgucgggcaccacg

SEQ ID NO: 977267 - RNA, 15 nt, Mycobacterium avium subsp. paratuberculosis
guuguccggaacacc

SEQ ID NO: 977268 - RNA, 21 nt, Mycobacterium avium subsp. paratuberculosis
guugcuuggguugcuccucgg

SEQ ID NO: 977269 - RNA, 21 nt, Mycobacterium avium subsp. paratuberculosis
guuggccgccacgaugcugau

SEQ ID NO: 977270 - RNA, 15 nt, Mycobacterium avium subsp. paratuberculosis
guuggccggccgggc

SEQ ID NO: 977271 - RNA, 20 nt, Mycobacterium avium subsp. paratuberculosis
guuggacaugaagcccccgu

SEQ ID NO: 977272 - RNA, 19 nt, Mycobacterium avium subsp. paratuberculosis
guuggcccgcacccgccgc

SEQ ID NO: 977273 - RNA, 12 nt, Mycobacterium avium subsp. paratuberculosis
guuggcgguggu

SEQ ID NO: 977274 - RNA, 23 nt, Mycobacterium avium subsp. paratuberculosis
guugguugcggccccgccagcag

SEQ ID NO: 977275 - RNA, 13 nt, Mycobacterium avium subsp. paratuberculosis
guuggugcggggu

SEQ ID NO: 977276 - RNA, 13 nt, Mycobacterium avium subsp. paratuberculosis
guugcggguggag

SEQ ID NO: 977277 - RNA, 14 nt, Mycobacterium avium subsp. paratuberculosis
guugcgggccaggu

SEQ ID NO: 977278 - RNA, 14 nt, Mycobacterium avium subsp. paratuberculosis
guugcgguccagga

SEQ ID NO: 977279 - RNA, 19 nt, Mycobacterium avium subsp. paratuberculosis
guugcgguugccccacccc

SEQ ID NO: 977280 - RNA, 16 nt, Mycobacterium avium subsp. paratuberculosis
guugcgccgccagggc

SEQ ID NO: 977281 - RNA, 19 nt, Mycobacterium avium subsp. paratuberculosis
guugcgaaagcccaggccc

SEQ ID NO: 977282 - RNA, 16 nt, Mycobacterium avium subsp. paratuberculosis
guugcgcggaaugcuc

SEQ ID NO: 977283 - RNA, 19 nt, Mycobacterium avium subsp. paratuberculosis
guugcgccguccggccacg

SEQ ID NO: 977284 - RNA, 19 nt, Mycobacterium avium subsp. paratuberculosis
guugcuguacugggguguc

SEQ ID NO: 977285 - RNA, 18 nt, Mycobacterium avium subsp. paratuberculosis
guugcaccggcaccgcgg

SEQ ID NO: 977286 - RNA, 17 nt, Mycobacterium avium subsp. paratuberculosis
guugcacacccggugcg

SEQ ID NO: 977287 - RNA, 20 nt, Mycobacterium avium subsp. paratuberculosis
guugcacucucgcggcaagg

SEQ ID NO: 977288 - RNA, 18 nt, Mycobacterium avium subsp. paratuberculosis
guugcagcacaacggccu

SEQ ID NO: 977289 - RNA, 17 nt, Mycobacterium avium subsp. paratuberculosis
guugcaggugcgcgguc

SEQ ID NO: 977290 - RNA, 16 nt, Mycobacterium avium subsp. paratuberculosis
guugcaggcggaccug

SEQ ID NO: 977291 - RNA, 20 nt, Mycobacterium avium subsp. paratuberculosis
guugccggcggcgaagccgg

SEQ ID NO: 977292 - RNA, 22 nt, Mycobacterium avium subsp. paratuberculosis
guugccguuguccuugagccgg

SEQ ID NO: 977293 - RNA, 15 nt, Mycobacterium avium subsp. paratuberculosis
guugccucggccagc

SEQ ID NO: 977294 - RNA, 18 nt, Mycobacterium avium subsp. paratuberculosis
guugccucggccagcacc

SEQ ID NO: 977295 - RNA, 18 nt, Mycobacterium avium subsp. paratuberculosis
guugccggcggccagcau

SEQ ID NO: 977296 - RNA, 14 nt, Mycobacterium avium subsp. paratuberculosis
guugcgcagcagcc

SEQ ID NO: 977297 - RNA, 18 nt, Mycobacterium avium subsp. paratuberculosis
guucucgggggcgggcac

SEQ ID NO: 977298 - RNA, 13 nt, Mycobacterium avium subsp. paratuberculosis
guucuccagcacc

SEQ ID NO: 977299 - RNA, 21 nt, Mycobacterium avium subsp. paratuberculosis
guucucgcacccggucaggua

SEQ ID NO: 977300 - RNA, 21 nt, Mycobacterium avium subsp. paratuberculosis
guucuccgaggcguccuccuc

SEQ ID NO: 977301 - RNA, 20 nt, Mycobacterium avium subsp. paratuberculosis
guugagcccggaccggccgu

SEQ ID NO: 977302 - RNA, 15 nt, Mycobacterium avium subsp. paratuberculosis
guugaggcggcggcg

SEQ ID NO: 977303 - RNA, 22 nt, Mycobacterium avium subsp. paratuberculosis
guugaggcggcggcgggccagg

SEQ ID NO: 977304 - RNA, 16 nt, Mycobacterium avium subsp. paratuberculosis
guuccaccagcggccg

SEQ ID NO: 977305 - RNA, 23 nt, Mycobacterium avium subsp. paratuberculosis
guuccaccagcggccgucgccgg

SEQ ID NO: 977306 - RNA, 17 nt, Mycobacterium avium subsp. paratuberculosis
guucaugaucggcagga

SEQ ID NO: 977307 - RNA, 20 nt, Mycobacterium avium subsp. paratuberculosis
guucagggugcguuccaggu

SEQ ID NO: 977308 - RNA, 18 nt, Mycobacterium avium subsp. paratuberculosis
guucagcugcagccggcc

SEQ ID NO: 977309 - RNA, 15 nt, Mycobacterium avium subsp. paratuberculosis
guucacccguggcug

SEQ ID NO: 977310 - RNA, 21 nt, Mycobacterium avium subsp. paratuberculosis
guucacccguggcugaccacg

SEQ ID NO: 977311 - RNA, 13 nt, Mycobacterium avium subsp. paratuberculosis
guucagcgcggcc

SEQ ID NO: 977312 - RNA, 14 nt, Mycobacterium avium subsp. paratuberculosis
guucacgcggcugg

SEQ ID NO: 977313 - RNA, 17 nt, Mycobacterium avium subsp. paratuberculosis
guucaccgccaccagca

SEQ ID NO: 977314 - RNA, 19 nt, Mycobacterium avium subsp. paratuberculosis
guucaccgccaccagcagg

SEQ ID NO: 977315 - RNA, 23 nt, Mycobacterium avium subsp. paratuberculosis
guucggucucggcggcgcccagg

SEQ ID NO: 977316 - RNA, 17 nt, Mycobacterium avium subsp. paratuberculosis
guucggcggcgcggccc

SEQ ID NO: 977317 - RNA, 22 nt, Mycobacterium avium subsp. paratuberculosis
guucggcgacgcugguggccug

SEQ ID NO: 977318 - RNA, 18 nt, Mycobacterium avium subsp. paratuberculosis
guucggcgggggcaggga

SEQ ID NO: 977319 - RNA, 13 nt, Mycobacterium avium subsp. paratuberculosis
guucggcucugca

SEQ ID NO: 977320 - RNA, 15 nt, Mycobacterium avium subsp. paratuberculosis
guucgccaccacggu

SEQ ID NO: 977321 - RNA, 15 nt, Mycobacterium avium subsp. paratuberculosis
guucgccggccagca

SEQ ID NO: 977322 - RNA, 17 nt, Mycobacterium avium subsp. paratuberculosis
guucgccggccagcacg

SEQ ID NO: 977323 - RNA, 23 nt, Mycobacterium avium subsp. paratuberculosis
guucgccggcgacggccagcgcg

SEQ ID NO: 977324 - RNA, 20 nt, Mycobacterium avium subsp. paratuberculosis
guucgccgguaccgccggcc

SEQ ID NO: 977325 - RNA, 15 nt, Mycobacterium avium subsp. paratuberculosis
guuccaugucgacga

SEQ ID NO: 977326 - RNA, 20 nt, Mycobacterium avium subsp. paratuberculosis
guuccgaacgugcagcuucc

SEQ ID NO: 977327 - RNA, 19 nt, Mycobacterium avium subsp. paratuberculosis
guguugaucucgucgauga

SEQ ID NO: 977328 - RNA, 19 nt, Mycobacterium avium subsp. paratuberculosis
guguugacguaacacccug

SEQ ID NO: 977329 - RNA, 12 nt, Mycobacterium avium subsp. paratuberculosis
guguugcucugg

SEQ ID NO: 977330 - RNA, 13 nt, Mycobacterium avium subsp. paratuberculosis
gugugcaccagcg

SEQ ID NO: 977331 - RNA, 21 nt, Mycobacterium avium subsp. paratuberculosis
guguggaucgcuucggccagc

SEQ ID NO: 977332 - RNA, 16 nt, Mycobacterium avium subsp. paratuberculosis
guguggcacccgggug

SEQ ID NO: 977333 - RNA, 14 nt, Mycobacterium avium subsp. paratuberculosis
guguggcagguggc

SEQ ID NO: 977334 - RNA, 20 nt, Mycobacterium avium subsp. paratuberculosis
gugugcucagcucccgagca

SEQ ID NO: 977335 - RNA, 16 nt, Mycobacterium avium subsp. paratuberculosis
guguucggcgccagcc

SEQ ID NO: 977336 - RNA, 12 nt, Mycobacterium avium subsp. paratuberculosis
guguuccaggua

SEQ ID NO: 977337 - RNA, 19 nt, Mycobacterium avium subsp. paratuberculosis
guguucuggaugcccaggg

SEQ ID NO: 977338 - RNA, 19 nt, Mycobacterium avium subsp. paratuberculosis
guguucgggucgguggcga

SEQ ID NO: 977339 - RNA, 12 nt, Mycobacterium avium subsp. paratuberculosis
guguucucacgg

SEQ ID NO: 977340 - RNA, 13 nt, Mycobacterium avium subsp. paratuberculosis
guguggugccggg

SEQ ID NO: 977341 - RNA, 16 nt, Mycobacterium avium subsp. paratuberculosis
guguggccgcgguggu

SEQ ID NO: 977342 - RNA, 17 nt, Mycobacterium avium subsp. paratuberculosis
guguggccgcgguggug

SEQ ID NO: 977343 - RNA, 14 nt, Mycobacterium avium subsp. paratuberculosis
gugugggcgcccgc

SEQ ID NO: 977344 - RNA, 19 nt, Mycobacterium avium subsp. paratuberculosis
guguggggaauccgguggg

SEQ ID NO: 977345 - RNA, 23 nt, Mycobacterium avium subsp. paratuberculosis
gugguuggcgaucagggcggcgc

SEQ ID NO: 977346 - RNA, 16 nt, Mycobacterium avium subsp. paratuberculosis
gugguugagcagcaga

SEQ ID NO: 977347 - RNA, 14 nt, Mycobacterium avium subsp. paratuberculosis
gugguugccccagc

SEQ ID NO: 977348 - RNA, 21 nt, Mycobacterium avium subsp. paratuberculosis
gugguguucuggaugcccagg

SEQ ID NO: 977349 - RNA, 13 nt, Mycobacterium avium subsp. paratuberculosis
guggugugcaagg

SEQ ID NO: 977350 - RNA, 15 nt, Mycobacterium avium subsp. paratuberculosis
gugguggugcggacg

SEQ ID NO: 977351 - RNA, 14 nt, Mycobacterium avium subsp. paratuberculosis
guggugguggugcc

SEQ ID NO: 977352 - RNA, 14 nt, Mycobacterium avium subsp. paratuberculosis
gugggucagcuuca

SEQ ID NO: 977353 - RNA, 16 nt, Mycobacterium avium subsp. paratuberculosis
guggguauccgccgcc

SEQ ID NO: 977354 - RNA, 14 nt, Mycobacterium avium subsp. paratuberculosis
gugggucagcgagg

SEQ ID NO: 977355 - RNA, 14 nt, Mycobacterium avium subsp. paratuberculosis
gugggucggcggcu

SEQ ID NO: 977356 - RNA, 18 nt, Mycobacterium avium subsp. paratuberculosis
gugggcaccggcaccgcc

SEQ ID NO: 977357 - RNA, 17 nt, Mycobacterium avium subsp. paratuberculosis
gugggguugaagcuggc

SEQ ID NO: 977358 - RNA, 13 nt, Mycobacterium avium subsp. paratuberculosis
gugggguggugga

SEQ ID NO: 977359 - RNA, 16 nt, Mycobacterium avium subsp. paratuberculosis
gugucggcggggccgg

SEQ ID NO: 977360 - RNA, 21 nt, Mycobacterium avium subsp. paratuberculosis
gugucgggguggugggcgcga

SEQ ID NO: 977361 - RNA, 16 nt, Mycobacterium avium subsp. paratuberculosis
gugucguagcggcugu

SEQ ID NO: 977362 - RNA, 15 nt, Mycobacterium avium subsp. paratuberculosis
gugucgugugcguga

SEQ ID NO: 977363 - RNA, 20 nt, Mycobacterium avium subsp. paratuberculosis
gugucacguccacgccgcgg

SEQ ID NO: 977364 - RNA, 22 nt, Mycobacterium avium subsp. paratuberculosis
gugucacuacccgcgauggcac

SEQ ID NO: 977365 - RNA, 14 nt, Mycobacterium avium subsp. paratuberculosis
guguagcugcgggu

SEQ ID NO: 977366 - RNA, 22 nt, Mycobacterium avium subsp. paratuberculosis
guguagcugggccccuccagcc

SEQ ID NO: 977367 - RNA, 15 nt, Mycobacterium avium subsp. paratuberculosis
guguagcccggugcc

SEQ ID NO: 977368 - RNA, 21 nt, Mycobacterium avium subsp. paratuberculosis
guguagccguaacgaugccgc

SEQ ID NO: 977369 - RNA, 22 nt, Mycobacterium avium subsp. paratuberculosis
guguccagaacucggcggcggu

SEQ ID NO: 977370 - RNA, 20 nt, Mycobacterium avium subsp. paratuberculosis
gugucaucuccguguugauc

SEQ ID NO: 977371 - RNA, 15 nt, Mycobacterium avium subsp. paratuberculosis
gugucaugugccucg

SEQ ID NO: 977372 - RNA, 23 nt, Mycobacterium avium subsp. paratuberculosis
gugucagcgcgaccucgguggug

SEQ ID NO: 977373 - RNA, 13 nt, Mycobacterium avium subsp. paratuberculosis
gugucagggcagc

SEQ ID NO: 977374 - RNA, 18 nt, Mycobacterium avium subsp. paratuberculosis
gugcaggguguuggacga

SEQ ID NO: 977375 - RNA, 17 nt, Mycobacterium avium subsp. paratuberculosis
gugcagggucagcagca

SEQ ID NO: 977376 - RNA, 19 nt, Mycobacterium avium subsp. paratuberculosis
guggaaaucgagcgcgcug

SEQ ID NO: 977377 - RNA, 14 nt, Mycobacterium avium subsp. paratuberculosis
gugcugugcugccu

SEQ ID NO: 977378 - RNA, 14 nt, Mycobacterium avium subsp. paratuberculosis
gugcugggccacga

SEQ ID NO: 977379 - RNA, 14 nt, Mycobacterium avium subsp. paratuberculosis
gugcugggccgggc

SEQ ID NO: 977380 - RNA, 14 nt, Mycobacterium avium subsp. paratuberculosis
guggaagauguugc

SEQ ID NO: 977381 - RNA, 10 nt, Mycobacterium avium subsp. paratuberculosis
guggaacacg

SEQ ID NO: 977382 - RNA, 19 nt, Mycobacterium avium subsp. paratuberculosis
guggaagguguuggugcgg

SEQ ID NO: 977383 - RNA, 13 nt, Mycobacterium avium subsp. paratuberculosis
guggaagccgcga

SEQ ID NO: 977384 - RNA, 14 nt, Mycobacterium avium subsp. paratuberculosis
guggaugacgcagc

SEQ ID NO: 977385 - RNA, 17 nt, Mycobacterium avium subsp. paratuberculosis
guggauggucaccgggg

SEQ ID NO: 977386 - RNA, 17 nt, Mycobacterium avium subsp. paratuberculosis
guggaucuccagcagcu

SEQ ID NO: 977387 - RNA, 20 nt, Mycobacterium avium subsp. paratuberculosis
guggaucuccagcagcuuca

SEQ ID NO: 977388 - RNA, 18 nt, Mycobacterium avium subsp. paratuberculosis
gugggacggcgggugggg

SEQ ID NO: 977389 - RNA, 15 nt, Mycobacterium avium subsp. paratuberculosis
gugggacugggcgcc

SEQ ID NO: 977390 - RNA, 20 nt, Mycobacterium avium subsp. paratuberculosis
gugggccaucaucggugcca

SEQ ID NO: 977391 - RNA, 13 nt, Mycobacterium avium subsp. paratuberculosis
gugggcccgccgu

SEQ ID NO: 977392 - RNA, 19 nt, Mycobacterium avium subsp. paratuberculosis
gugggccgcagcgcggcga

SEQ ID NO: 977393 - RNA, 13 nt, Mycobacterium avium subsp. paratuberculosis
gugggcagcccca

SEQ ID NO: 977394 - RNA, 22 nt, Mycobacterium avium subsp. paratuberculosis
guggcgcacagaucgucucggc

SEQ ID NO: 977395 - RNA, 16 nt, Mycobacterium avium subsp. paratuberculosis
guggcggucccggcgg

SEQ ID NO: 977396 - RNA, 19 nt, Mycobacterium avium subsp. paratuberculosis
guggcggucggugcgcagc

SEQ ID NO: 977397 - RNA, 15 nt, Mycobacterium avium subsp. paratuberculosis
guggcgggccaggcg

SEQ ID NO: 977398 - RNA, 17 nt, Mycobacterium avium subsp. paratuberculosis
guggcggugccgcggcg

SEQ ID NO: 977399 - RNA, 19 nt, Mycobacterium avium subsp. paratuberculosis
guggcgugcagcgcggcga

SEQ ID NO: 977400 - RNA, 13 nt, Mycobacterium avium subsp. paratuberculosis
guggcgugccggg

SEQ ID NO: 977401 - RNA, 15 nt, Mycobacterium avium subsp. paratuberculosis
guggcgugccgggcg

SEQ ID NO: 977402 - RNA, 15 nt, Mycobacterium avium subsp. paratuberculosis
guggcguagucggug

SEQ ID NO: 977403 - RNA, 17 nt, Mycobacterium avium subsp. paratuberculosis
guggcgucggcgcgcac

SEQ ID NO: 977404 - RNA, 18 nt, Mycobacterium avium subsp. paratuberculosis
guggcgaacugcaccagc

SEQ ID NO: 977405 - RNA, 16 nt, Mycobacterium avium subsp. paratuberculosis
guggcgacaacaggcg

SEQ ID NO: 977406 - RNA, 22 nt, Mycobacterium avium subsp. paratuberculosis
guggcccgccacgugcggcugc

SEQ ID NO: 977407 - RNA, 21 nt, Mycobacterium avium subsp. paratuberculosis
guggccugcaacuggucgugc

SEQ ID NO: 977408 - RNA, 17 nt, Mycobacterium avium subsp. paratuberculosis
guggcccauguggccug

SEQ ID NO: 977409 - RNA, 14 nt, Mycobacterium avium subsp. paratuberculosis
guggccccagcccg

SEQ ID NO: 977410 - RNA, 20 nt, Mycobacterium avium subsp. paratuberculosis
guggccccucauugggaccg

SEQ ID NO: 977411 - RNA, 16 nt, Mycobacterium avium subsp. paratuberculosis
guggcccagccgcuga

SEQ ID NO: 977412 - RNA, 17 nt, Mycobacterium avium subsp. paratuberculosis
guggcccagccggugcg

SEQ ID NO: 977413 - RNA, 18 nt, Mycobacterium avium subsp. paratuberculosis
guggcccagccggugcga

SEQ ID NO: 977414 - RNA, 20 nt, Mycobacterium avium subsp. paratuberculosis
guggccaguucgucgcgcga

SEQ ID NO: 977415 - RNA, 15 nt, Mycobacterium avium subsp. paratuberculosis
guggccaucgcggcc

SEQ ID NO: 977416 - RNA, 18 nt, Mycobacterium avium subsp. paratuberculosis
guggccagcgccagcgcc

SEQ ID NO: 977417 - RNA, 11 nt, Mycobacterium avium subsp. paratuberculosis
guggccagcac

SEQ ID NO: 977418 - RNA, 15 nt, Mycobacterium avium subsp. paratuberculosis
guggccagcaccagc

SEQ ID NO: 977419 - RNA, 16 nt, Mycobacterium avium subsp. paratuberculosis
guggccagcaccagcc

SEQ ID NO: 977420 - RNA, 13 nt, Mycobacterium avium subsp. paratuberculosis
guggccaccgcga

SEQ ID NO: 977421 - RNA, 18 nt, Mycobacterium avium subsp. paratuberculosis
guggccaaaaagugccgg

SEQ ID NO: 977422 - RNA, 15 nt, Mycobacterium avium subsp. paratuberculosis
guggcagggccagca

SEQ ID NO: 977423 - RNA, 16 nt, Mycobacterium avium subsp. paratuberculosis
guggcagggccagcag

SEQ ID NO: 977424 - RNA, 23 nt, Mycobacterium avium subsp. paratuberculosis
guggcagcgcuccugcagcgcgg

SEQ ID NO: 977425 - RNA, 15 nt, Mycobacterium avium subsp. paratuberculosis
gugaaugggcugcgc

SEQ ID NO: 977426 - RNA, 14 nt, Mycobacterium avium subsp. paratuberculosis
gugaauucaucguc

SEQ ID NO: 977427 - RNA, 20 nt, Mycobacterium avium subsp. paratuberculosis
gugaaugucguagcggucgg

SEQ ID NO: 977428 - RNA, 17 nt, Mycobacterium avium subsp. paratuberculosis
gugacaacggugguggc

SEQ ID NO: 977429 - RNA, 19 nt, Mycobacterium avium subsp. paratuberculosis
gugaaguuggcggcgguga

SEQ ID NO: 977430 - RNA, 15 nt, Mycobacterium avium subsp. paratuberculosis
gugaaguuaguuuca

SEQ ID NO: 977431 - RNA, 15 nt, Mycobacterium avium subsp. paratuberculosis
gugaagcuaguuuca

SEQ ID NO: 977432 - RNA, 12 nt, Mycobacterium avium subsp. paratuberculosis
gugaaggggucc

SEQ ID NO: 977433 - RNA, 22 nt, Mycobacterium avium subsp. paratuberculosis
gugaagguccgguaggcguugu

SEQ ID NO: 977434 - RNA, 18 nt, Mycobacterium avium subsp. paratuberculosis
gugaaggugcccuccucg

SEQ ID NO: 977435 - RNA, 22 nt, Mycobacterium avium subsp. paratuberculosis
gugaagucaacgcacucauggg

SEQ ID NO: 977436 - RNA, 18 nt, Mycobacterium avium subsp. paratuberculosis
gugaagaucgcccgccgc

SEQ ID NO: 977437 - RNA, 16 nt, Mycobacterium avium subsp. paratuberculosis
gugacacagccaaagc

SEQ ID NO: 977438 - RNA, 15 nt, Mycobacterium avium subsp. paratuberculosis
gugacaggggcagca

SEQ ID NO: 977439 - RNA, 17 nt, Mycobacterium avium subsp. paratuberculosis
gugacaggggcagcagc

SEQ ID NO: 977440 - RNA, 18 nt, Mycobacterium avium subsp. paratuberculosis
gugacaggggcagcagca

SEQ ID NO: 977441 - RNA, 23 nt, Mycobacterium avium subsp. paratuberculosis
gugacagucgagggcuaaccacc

SEQ ID NO: 977442 - RNA, 17 nt, Mycobacterium avium subsp. paratuberculosis
gugaccagugcagagcg

SEQ ID NO: 977443 - RNA, 21 nt, Mycobacterium avium subsp. paratuberculosis
gugaccagccacauguucucc

SEQ ID NO: 977444 - RNA, 17 nt, Mycobacterium avium subsp. paratuberculosis
gugaccacggucacagc

SEQ ID NO: 977445 - RNA, 18 nt, Mycobacterium avium subsp. paratuberculosis
gugaccacggucacagcc

SEQ ID NO: 977446 - RNA, 16 nt, Mycobacterium avium subsp. paratuberculosis
gugaccaaugcgguga

SEQ ID NO: 977447 - RNA, 13 nt, Mycobacterium avium subsp. paratuberculosis
gugaccaccugca

SEQ ID NO: 977448 - RNA, 19 nt, Mycobacterium avium subsp. paratuberculosis
gugaccacgccgugcccgg

SEQ ID NO: 977449 - RNA, 13 nt, Mycobacterium avium subsp. paratuberculosis
gugacaucgccac

SEQ ID NO: 977450 - RNA, 15 nt, Mycobacterium avium subsp. paratuberculosis
gugacccgcucgggc

SEQ ID NO: 977451 - RNA, 17 nt, Mycobacterium avium subsp. paratuberculosis
gugaccucgagcagcgc

SEQ ID NO: 977452 - RNA, 14 nt, Mycobacterium avium subsp. paratuberculosis
gugaccgggaagua

SEQ ID NO: 977453 - RNA, 18 nt, Mycobacterium avium subsp. paratuberculosis
gugaccgccuuggcgcgc

SEQ ID NO: 977454 - RNA, 11 nt, Mycobacterium avium subsp. paratuberculosis
gugaccgcgcc

SEQ ID NO: 977455 - RNA, 23 nt, Mycobacterium avium subsp. paratuberculosis
gugaccggaucggccagcagguc

SEQ ID NO: 977456 - RNA, 18 nt, Mycobacterium avium subsp. paratuberculosis
gugaccggcgccgggucg

SEQ ID NO: 977457 - RNA, 15 nt, Mycobacterium avium subsp. paratuberculosis
gugaccggcgcgcag

SEQ ID NO: 977458 - RNA, 21 nt, Mycobacterium avium subsp. paratuberculosis
gugaccggcggccagcgagga

SEQ ID NO: 977459 - RNA, 16 nt, Mycobacterium avium subsp. paratuberculosis
gugacgugcaccugca

SEQ ID NO: 977460 - RNA, 15 nt, Mycobacterium avium subsp. paratuberculosis
gugacggcggggcgg

SEQ ID NO: 977461 - RNA, 19 nt, Mycobacterium avium subsp. paratuberculosis
gugacggucacggugacgg

SEQ ID NO: 977462 - RNA, 15 nt, Mycobacterium avium subsp. paratuberculosis
gugacggccgcggcg

SEQ ID NO: 977463 - RNA, 13 nt, Mycobacterium avium subsp. paratuberculosis
gugacggccguga

SEQ ID NO: 977464 - RNA, 20 nt, Mycobacterium avium subsp. paratuberculosis
gugacggccgugaugccggg

SEQ ID NO: 977465 - RNA, 22 nt, Mycobacterium avium subsp. paratuberculosis
gugacgccgcuguccucgucgg

SEQ ID NO: 977466 - RNA, 19 nt, Mycobacterium avium subsp. paratuberculosis
gugacgauccggucgauga

SEQ ID NO: 977467 - RNA, 21 nt, Mycobacterium avium subsp. paratuberculosis
gugacgccgacguaggacagc

SEQ ID NO: 977468 - RNA, 13 nt, Mycobacterium avium subsp. paratuberculosis
gugacgaccuggu

SEQ ID NO: 977469 - RNA, 22 nt, Mycobacterium avium subsp. paratuberculosis
gugcaagggcgacauguccggg

SEQ ID NO: 977470 - RNA, 13 nt, Mycobacterium avium subsp. paratuberculosis
gugaucugcacca

SEQ ID NO: 977471 - RNA, 18 nt, Mycobacterium avium subsp. paratuberculosis
gugaucuggucggccagc

SEQ ID NO: 977472 - RNA, 20 nt, Mycobacterium avium subsp. paratuberculosis
gugaucucaccggcggcggc

SEQ ID NO: 977473 - RNA, 16 nt, Mycobacterium avium subsp. paratuberculosis
gugaucggccaggcgc

SEQ ID NO: 977474 - RNA, 19 nt, Mycobacterium avium subsp. paratuberculosis
gugaucggucugccuggcg

SEQ ID NO: 977475 - RNA, 17 nt, Mycobacterium avium subsp. paratuberculosis
gugaucuucgugcucau

SEQ ID NO: 977476 - RNA, 21 nt, Mycobacterium avium subsp. paratuberculosis
gugaucgcgaacgcgccggug

SEQ ID NO: 977477 - RNA, 13 nt, Mycobacterium avium subsp. paratuberculosis
gugaucgccagcc

SEQ ID NO: 977478 - RNA, 17 nt, Mycobacterium avium subsp. paratuberculosis
gugauccacuccagcac

SEQ ID NO: 977479 - RNA, 18 nt, Mycobacterium avium subsp. paratuberculosis
gugauccacuccagcacc

SEQ ID NO: 977480 - RNA, 24 nt, Mycobacterium avium subsp. paratuberculosis
gugauccagcccugcucggccagc

SEQ ID NO: 977481 - RNA, 17 nt, Mycobacterium avium subsp. paratuberculosis
gugcagaucguccaucg

SEQ ID NO: 977482 - RNA, 22 nt, Mycobacterium avium subsp. paratuberculosis
gugcagauagguggucucccag

SEQ ID NO: 977483 - RNA, 14 nt, Mycobacterium avium subsp. paratuberculosis
gugcagcgggcugg

SEQ ID NO: 977484 - RNA, 19 nt, Mycobacterium avium subsp. paratuberculosis
gugcagcgugguccagcac

SEQ ID NO: 977485 - RNA, 14 nt, Mycobacterium avium subsp. paratuberculosis
gugcaggcagccgu

SEQ ID NO: 977486 - RNA, 23 nt, Mycobacterium avium subsp. paratuberculosis
gugcacgccgagcagcaccggca

SEQ ID NO: 977487 - RNA, 19 nt, Mycobacterium avium subsp. paratuberculosis
gugcacgccguggcggcgg

SEQ ID NO: 977488 - RNA, 17 nt, Mycobacterium avium subsp. paratuberculosis
gugcacgaucgcgguga

SEQ ID NO: 977489 - RNA, 23 nt, Mycobacterium avium subsp. paratuberculosis
gugcacgcguucggacaccucgg

SEQ ID NO: 977490 - RNA, 19 nt, Mycobacterium avium subsp. paratuberculosis
gugcacggacagcucaccg

SEQ ID NO: 977491 - RNA, 16 nt, Mycobacterium avium subsp. paratuberculosis
gugagguggcugggcg

SEQ ID NO: 977492 - RNA, 16 nt, Mycobacterium avium subsp. paratuberculosis
gugaggacgcccggcg

SEQ ID NO: 977493 - RNA, 15 nt, Mycobacterium avium subsp. paratuberculosis
gugaggggcgcgcgc

SEQ ID NO: 977494 - RNA, 15 nt, Mycobacterium avium subsp. paratuberculosis
gugaggccaggcguu

SEQ ID NO: 977495 - RNA, 13 nt, Mycobacterium avium subsp. paratuberculosis
gugaggcgcgccg

SEQ ID NO: 977496 - RNA, 12 nt, Mycobacterium avium subsp. paratuberculosis
gugaggcccggc

SEQ ID NO: 977497 - RNA, 20 nt, Mycobacterium avium subsp. paratuberculosis
gugaggcacccgcugcacca

SEQ ID NO: 977498 - RNA, 22 nt, Mycobacterium avium subsp. paratuberculosis
gugaggcaccgaacgccagcag

SEQ ID NO: 977499 - RNA, 20 nt, Mycobacterium avium subsp. paratuberculosis
gugagccgccacagcgccuc

SEQ ID NO: 977500 - RNA, 15 nt, Mycobacterium avium subsp. paratuberculosis
gugagcggcgcgucc

SEQ ID NO: 977501 - RNA, 22 nt, Mycobacterium avium subsp. paratuberculosis
gugagcgacaccaggucgaggu

SEQ ID NO: 977502 - RNA, 20 nt, Mycobacterium avium subsp. paratuberculosis
gugagccucagggcgcgcug

SEQ ID NO: 977503 - RNA, 23 nt, Mycobacterium avium subsp. paratuberculosis
gucuuuuuauuuguuguuuuugg

SEQ ID NO: 977504 - RNA, 17 nt, Mycobacterium avium subsp. paratuberculosis
gucuuucaucgccccgg

SEQ ID NO: 977505 - RNA, 21 nt, Mycobacterium avium subsp. paratuberculosis
gucuuggugcgagccaccucg

SEQ ID NO: 977506 - RNA, 12 nt, Mycobacterium avium subsp. paratuberculosis
gugaacagcagc

SEQ ID NO: 977507 - RNA, 13 nt, Mycobacterium avium subsp. paratuberculosis
gugaacagcagcc

SEQ ID NO: 977508 - RNA, 23 nt, Mycobacterium avium subsp. paratuberculosis
gucuguucacuacuuuuccgguu

SEQ ID NO: 977509 - RNA, 21 nt, Mycobacterium avium subsp. paratuberculosis
gucugugaccacggucacagc

SEQ ID NO: 977510 - RNA, 18 nt, Mycobacterium avium subsp. paratuberculosis
gucuucagcccgcgcaug

SEQ ID NO: 977511 - RNA, 17 nt, Mycobacterium avium subsp. paratuberculosis
gucuucucggccaggcu

SEQ ID NO: 977512 - RNA, 21 nt, Mycobacterium avium subsp. paratuberculosis
gucuucucggccaggcucacg

SEQ ID NO: 977513 - RNA, 20 nt, Mycobacterium avium subsp. paratuberculosis
gucuucggucgcgacccggu

SEQ ID NO: 977514 - RNA, 23 nt, Mycobacterium avium subsp. paratuberculosis
gucuucggucgcgacccggucca

SEQ ID NO: 977515 - RNA, 13 nt, Mycobacterium avium subsp. paratuberculosis
gucuucgaccgca

SEQ ID NO: 977516 - RNA, 15 nt, Mycobacterium avium subsp. paratuberculosis
gucuuccgggccacc

SEQ ID NO: 977517 - RNA, 18 nt, Mycobacterium avium subsp. paratuberculosis
gucuugaucucggcggcg

SEQ ID NO: 977518 - RNA, 18 nt, Mycobacterium avium subsp. paratuberculosis
gucuucuucagccgcagc

SEQ ID NO: 977519 - RNA, 13 nt, Mycobacterium avium subsp. paratuberculosis
gucuucuuggccg

SEQ ID NO: 977520 - RNA, 14 nt, Mycobacterium avium subsp. paratuberculosis
gucuuggccaggcc

SEQ ID NO: 977521 - RNA, 16 nt, Mycobacterium avium subsp. paratuberculosis
gucuuggccaggcccu

SEQ ID NO: 977522 - RNA, 12 nt, Mycobacterium avium subsp. paratuberculosis
gucuuggcggcc

SEQ ID NO: 977523 - RNA, 14 nt, Mycobacterium avium subsp. paratuberculosis
gucguugcacacca

SEQ ID NO: 977524 - RNA, 20 nt, Mycobacterium avium subsp. paratuberculosis
gucguugacgcugggcggcg

SEQ ID NO: 977525 - RNA, 23 nt, Mycobacterium avium subsp. paratuberculosis
gucgugcaacucccgcgccgcgg

SEQ ID NO: 977526 - RNA, 13 nt, Mycobacterium avium subsp. paratuberculosis
gucgugcagcacc

SEQ ID NO: 977527 - RNA, 20 nt, Mycobacterium avium subsp. paratuberculosis
gucgugcgggaugccgagca

SEQ ID NO: 977528 - RNA, 19 nt, Mycobacterium avium subsp. paratuberculosis
gucguggguauccgccgcc

SEQ ID NO: 977529 - RNA, 21 nt, Mycobacterium avium subsp. paratuberculosis
gucguggcgacaucgccgcgg

SEQ ID NO: 977530 - RNA, 18 nt, Mycobacterium avium subsp. paratuberculosis
gucucagcgcccgcccgg

SEQ ID NO: 977531 - RNA, 16 nt, Mycobacterium avium subsp. paratuberculosis
gucguugugggccagc

SEQ ID NO: 977532 - RNA, 19 nt, Mycobacterium avium subsp. paratuberculosis
gucguugugggccagcgcg

SEQ ID NO: 977533 - RNA, 15 nt, Mycobacterium avium subsp. paratuberculosis
gucguugccggugcc

SEQ ID NO: 977534 - RNA, 16 nt, Mycobacterium avium subsp. paratuberculosis
gucguucucgggggcg

SEQ ID NO: 977535 - RNA, 18 nt, Mycobacterium avium subsp. paratuberculosis
gucguuggcccgccgcgg

SEQ ID NO: 977536 - RNA, 16 nt, Mycobacterium avium subsp. paratuberculosis
gucucgggcagcagca

SEQ ID NO: 977537 - RNA, 19 nt, Mycobacterium avium subsp. paratuberculosis
gucucggcgccgucgccgg

SEQ ID NO: 977538 - RNA, 21 nt, Mycobacterium avium subsp. paratuberculosis
gucucggcgucucggcgucuc

SEQ ID NO: 977539 - RNA, 19 nt, Mycobacterium avium subsp. paratuberculosis
gucucgccccggccguucu

SEQ ID NO: 977540 - RNA, 17 nt, Mycobacterium avium subsp. paratuberculosis
gucucgaccgcggcgcc

SEQ ID NO: 977541 - RNA, 22 nt, Mycobacterium avium subsp. paratuberculosis
gucucgaccgcggcgccgaugg

SEQ ID NO: 977542 - RNA, 16 nt, Mycobacterium avium subsp. paratuberculosis
gucucgaucugcacca

SEQ ID NO: 977543 - RNA, 21 nt, Mycobacterium avium subsp. paratuberculosis
gucucgcgggaguggccggcg

SEQ ID NO: 977544 - RNA, 12 nt, Mycobacterium avium subsp. paratuberculosis
gucucccgggcg

SEQ ID NO: 977545 - RNA, 18 nt, Mycobacterium avium subsp. paratuberculosis
gucuccucgaccagcgcg

SEQ ID NO: 977546 - RNA, 21 nt, Mycobacterium avium subsp. paratuberculosis
gucuggcggguguucagcccc

SEQ ID NO: 977547 - RNA, 18 nt, Mycobacterium avium subsp. paratuberculosis
gucuggcagccggccggc

SEQ ID NO: 977548 - RNA, 22 nt, Mycobacterium avium subsp. paratuberculosis
gucugggccgccgagcagauca

SEQ ID NO: 977549 - RNA, 19 nt, Mycobacterium avium subsp. paratuberculosis
gucugggcgaccaugccgc

SEQ ID NO: 977550 - RNA, 16 nt, Mycobacterium avium subsp. paratuberculosis
gucugcggccgcgacu

SEQ ID NO: 977551 - RNA, 16 nt, Mycobacterium avium subsp. paratuberculosis
gucugcggugugggca

SEQ ID NO: 977552 - RNA, 22 nt, Mycobacterium avium subsp. paratuberculosis
gucugcuugugaaugggcugcg

SEQ ID NO: 977553 - RNA, 12 nt, Mycobacterium avium subsp. paratuberculosis
gucugcucgccu

SEQ ID NO: 977554 - RNA, 16 nt, Mycobacterium avium subsp. paratuberculosis
gucugcagcagccgcu

SEQ ID NO: 977555 - RNA, 22 nt, Mycobacterium avium subsp. paratuberculosis
gucugcagcagccgcugcuggg

SEQ ID NO: 977556 - RNA, 13 nt, Mycobacterium avium subsp. paratuberculosis
gucugccgggaca

SEQ ID NO: 977557 - RNA, 19 nt, Mycobacterium avium subsp. paratuberculosis
gucugcccgccgccgaugc

SEQ ID NO: 977558 - RNA, 22 nt, Mycobacterium avium subsp. paratuberculosis
gucugcccgccgccgaugcuga

SEQ ID NO: 977559 - RNA, 13 nt, Mycobacterium avium subsp. paratuberculosis
gucggugcccagg

SEQ ID NO: 977560 - RNA, 22 nt, Mycobacterium avium subsp. paratuberculosis
gucggugcccaggucgcccaga

SEQ ID NO: 977561 - RNA, 17 nt, Mycobacterium avium subsp. paratuberculosis
gucggugggggccaggc

SEQ ID NO: 977562 - RNA, 13 nt, Mycobacterium avium subsp. paratuberculosis
gucggugggguga

SEQ ID NO: 977563 - RNA, 21 nt, Mycobacterium avium subsp. paratuberculosis
gucgucguuguuggcggcggu

SEQ ID NO: 977564 - RNA, 17 nt, Mycobacterium avium subsp. paratuberculosis
gucgucgugcgcgggcg

SEQ ID NO: 977565 - RNA, 13 nt, Mycobacterium avium subsp. paratuberculosis
gucguacaccucg

SEQ ID NO: 977566 - RNA, 19 nt, Mycobacterium avium subsp. paratuberculosis
gucgucgggccgcagcacg

SEQ ID NO: 977567 - RNA, 16 nt, Mycobacterium avium subsp. paratuberculosis
gucgucgggcgcggug

SEQ ID NO: 977568 - RNA, 22 nt, Mycobacterium avium subsp. paratuberculosis
gucgucggucaggccggcgccg

SEQ ID NO: 977569 - RNA, 20 nt, Mycobacterium avium subsp. paratuberculosis
gucgucggugaacgccggug

SEQ ID NO: 977570 - RNA, 14 nt, Mycobacterium avium subsp. paratuberculosis
gucguacagcagcc

SEQ ID NO: 977571 - RNA, 15 nt, Mycobacterium avium subsp. paratuberculosis
gucgucgucgaaggc

SEQ ID NO: 977572 - RNA, 17 nt, Mycobacterium avium subsp. paratuberculosis
gucgucgucgccgccgg

SEQ ID NO: 977573 - RNA, 18 nt, Mycobacterium avium subsp. paratuberculosis
gucgggacgcggcaggcg

SEQ ID NO: 977574 - RNA, 18 nt, Mycobacterium avium subsp. paratuberculosis
gucgggacggccagcagg

SEQ ID NO: 977575 - RNA, 20 nt, Mycobacterium avium subsp. paratuberculosis
gucgggaccgaugccgcuga

SEQ ID NO: 977576 - RNA, 16 nt, Mycobacterium avium subsp. paratuberculosis
gucgggaccgucgcgc

SEQ ID NO: 977577 - RNA, 14 nt, Mycobacterium avium subsp. paratuberculosis
gucgggacguccgc

SEQ ID NO: 977578 - RNA, 15 nt, Mycobacterium avium subsp. paratuberculosis
gucgggacgucggcg

SEQ ID NO: 977579 - RNA, 22 nt, Mycobacterium avium subsp. paratuberculosis
gucgggauagggcgcgucgauc

SEQ ID NO: 977580 - RNA, 14 nt, Mycobacterium avium subsp. paratuberculosis
gucgggcaccugcu

SEQ ID NO: 977581 - RNA, 14 nt, Mycobacterium avium subsp. paratuberculosis
gucgggccaacugg

SEQ ID NO: 977582 - RNA, 18 nt, Mycobacterium avium subsp. paratuberculosis
gucgggcaccgccaggaa

SEQ ID NO: 977583 - RNA, 14 nt, Mycobacterium avium subsp. paratuberculosis
gucggggcggcggg

SEQ ID NO: 977584 - RNA, 15 nt, Mycobacterium avium subsp. paratuberculosis
gucggggcgucggcg

SEQ ID NO: 977585 - RNA, 16 nt, Mycobacterium avium subsp. paratuberculosis
gucggggcuggcggcg

SEQ ID NO: 977586 - RNA, 16 nt, Mycobacterium avium subsp. paratuberculosis
gucggggucggcgccg

SEQ ID NO: 977587 - RNA, 15 nt, Mycobacterium avium subsp. paratuberculosis
gucggugaggcuggg

SEQ ID NO: 977588 - RNA, 13 nt, Mycobacterium avium subsp. paratuberculosis
gucgggcgccggc

SEQ ID NO: 977589 - RNA, 18 nt, Mycobacterium avium subsp. paratuberculosis
gucgggccguccgccggc

SEQ ID NO: 977590 - RNA, 13 nt, Mycobacterium avium subsp. paratuberculosis
gucgggccgcagc

SEQ ID NO: 977591 - RNA, 16 nt, Mycobacterium avium subsp. paratuberculosis
gucgcuguaggccagc

SEQ ID NO: 977592 - RNA, 19 nt, Mycobacterium avium subsp. paratuberculosis
gucgcugccgccgccggcg

SEQ ID NO: 977593 - RNA, 20 nt, Mycobacterium avium subsp. paratuberculosis
gucggcaccuccugcacccg

SEQ ID NO: 977594 - RNA, 19 nt, Mycobacterium avium subsp. paratuberculosis
gucggcauagcgccgcucg

SEQ ID NO: 977595 - RNA, 23 nt, Mycobacterium avium subsp. paratuberculosis
gucgggaaaucggacccagcccg

SEQ ID NO: 977596 - RNA, 12 nt, Mycobacterium avium subsp. paratuberculosis
gucggcucgccg

SEQ ID NO: 977597 - RNA, 21 nt, Mycobacterium avium subsp. paratuberculosis
gucggcggguagaaccagccc

SEQ ID NO: 977598 - RNA, 16 nt, Mycobacterium avium subsp. paratuberculosis
gucggcguagggcagc

SEQ ID NO: 977599 - RNA, 20 nt, Mycobacterium avium subsp. paratuberculosis
gucggcguccgugccguccg

SEQ ID NO: 977600 - RNA, 14 nt, Mycobacterium avium subsp. paratuberculosis
gucggccagcagcg

SEQ ID NO: 977601 - RNA, 15 nt, Mycobacterium avium subsp. paratuberculosis
gucggccagcgccgc

SEQ ID NO: 977602 - RNA, 17 nt, Mycobacterium avium subsp. paratuberculosis
gucggccagauagauga

SEQ ID NO: 977603 - RNA, 16 nt, Mycobacterium avium subsp. paratuberculosis
gucggccacgcucgcc

SEQ ID NO: 977604 - RNA, 19 nt, Mycobacterium avium subsp. paratuberculosis
gucggccaacagugcgcag

SEQ ID NO: 977605 - RNA, 23 nt, Mycobacterium avium subsp. paratuberculosis
gucgcacaaccgugacugggugg

SEQ ID NO: 977606 - RNA, 14 nt, Mycobacterium avium subsp. paratuberculosis
gucgcacagccgca

SEQ ID NO: 977607 - RNA, 15 nt, Mycobacterium avium subsp. paratuberculosis
gucgcacagccgcag

SEQ ID NO: 977608 - RNA, 19 nt, Mycobacterium avium subsp. paratuberculosis
gucgcacagccgcagcagc

SEQ ID NO: 977609 - RNA, 15 nt, Mycobacterium avium subsp. paratuberculosis
gucgcagcccgggug

SEQ ID NO: 977610 - RNA, 14 nt, Mycobacterium avium subsp. paratuberculosis
gucgcccggcggca

SEQ ID NO: 977611 - RNA, 15 nt, Mycobacterium avium subsp. paratuberculosis
gucgcccggcgucca

SEQ ID NO: 977612 - RNA, 19 nt, Mycobacterium avium subsp. paratuberculosis
gucgcccggguagggcagc

SEQ ID NO: 977613 - RNA, 16 nt, Mycobacterium avium subsp. paratuberculosis
gucgccgcgcagcacc

SEQ ID NO: 977614 - RNA, 15 nt, Mycobacterium avium subsp. paratuberculosis
gucgccgcgccgccg

SEQ ID NO: 977615 - RNA, 16 nt, Mycobacterium avium subsp. paratuberculosis
gucgccggccgccagc

SEQ ID NO: 977616 - RNA, 20 nt, Mycobacterium avium subsp. paratuberculosis
gucgccggccgccagcgccc

SEQ ID NO: 977617 - RNA, 13 nt, Mycobacterium avium subsp. paratuberculosis
gucgccgaccagg

SEQ ID NO: 977618 - RNA, 14 nt, Mycobacterium avium subsp. paratuberculosis
gucgccgacgccga

SEQ ID NO: 977619 - RNA, 22 nt, Mycobacterium avium subsp. paratuberculosis
gucgccgacguagacgagccgg

SEQ ID NO: 977620 - RNA, 18 nt, Mycobacterium avium subsp. paratuberculosis
gucgcccuggauauccag

SEQ ID NO: 977621 - RNA, 20 nt, Mycobacterium avium subsp. paratuberculosis
gucgccgaacgugcgcggcg

SEQ ID NO: 977622 - RNA, 18 nt, Mycobacterium avium subsp. paratuberculosis
gucgccgaauccggcggg

SEQ ID NO: 977623 - RNA, 13 nt, Mycobacterium avium subsp. paratuberculosis
gucgccgacagcg

SEQ ID NO: 977624 - RNA, 16 nt, Mycobacterium avium subsp. paratuberculosis
gucgccgaugcgccgc

SEQ ID NO: 977625 - RNA, 21 nt, Mycobacterium avium subsp. paratuberculosis
gucgccgauggagaccucuuc

SEQ ID NO: 977626 - RNA, 21 nt, Mycobacterium avium subsp. paratuberculosis
gucgccgcagaucagggcgau

SEQ ID NO: 977627 - RNA, 16 nt, Mycobacterium avium subsp. paratuberculosis
gucgccgaucucggcc

SEQ ID NO: 977628 - RNA, 19 nt, Mycobacterium avium subsp. paratuberculosis
gucgcggaacagccggcuc

SEQ ID NO: 977629 - RNA, 21 nt, Mycobacterium avium subsp. paratuberculosis
gucgcggaaccggccggggcg

SEQ ID NO: 977630 - RNA, 22 nt, Mycobacterium avium subsp. paratuberculosis
gucgcggaggaugccggccagc

SEQ ID NO: 977631 - RNA, 19 nt, Mycobacterium avium subsp. paratuberculosis
gucgcggacccuggccagc

SEQ ID NO: 977632 - RNA, 19 nt, Mycobacterium avium subsp. paratuberculosis
gucgcggaugcgggcgcug

SEQ ID NO: 977633 - RNA, 13 nt, Mycobacterium avium subsp. paratuberculosis
gucgcggccggga

SEQ ID NO: 977634 - RNA, 16 nt, Mycobacterium avium subsp. paratuberculosis
gucgcggcccagcacc

SEQ ID NO: 977635 - RNA, 18 nt, Mycobacterium avium subsp. paratuberculosis
gucgcggcgaaccagcau

SEQ ID NO: 977636 - RNA, 23 nt, Mycobacterium avium subsp. paratuberculosis
gucgcggcgcuaaagccaccagc

SEQ ID NO: 977637 - RNA, 12 nt, Mycobacterium avium subsp. paratuberculosis
gucgcggcggcg

SEQ ID NO: 977638 - RNA, 13 nt, Mycobacterium avium subsp. paratuberculosis
gucgcggcugccg

SEQ ID NO: 977639 - RNA, 12 nt, Mycobacterium avium subsp. paratuberculosis
gucgcggcugcg

SEQ ID NO: 977640 - RNA, 14 nt, Mycobacterium avium subsp. paratuberculosis
gucgcggcugcgca

SEQ ID NO: 977641 - RNA, 21 nt, Mycobacterium avium subsp. paratuberculosis
gucgcggcuggugccgccggc

SEQ ID NO: 977642 - RNA, 22 nt, Mycobacterium avium subsp. paratuberculosis
gucgcggcuggugccgccggcg

SEQ ID NO: 977643 - RNA, 22 nt, Mycobacterium avium subsp. paratuberculosis
gucgcgggcccgggccacccgc

SEQ ID NO: 977644 - RNA, 20 nt, Mycobacterium avium subsp. paratuberculosis
gucgcgggaaucccacccgc

SEQ ID NO: 977645 - RNA, 15 nt, Mycobacterium avium subsp. paratuberculosis
gucgcugcagcggcg

SEQ ID NO: 977646 - RNA, 18 nt, Mycobacterium avium subsp. paratuberculosis
gucgcugaguaugcagau

SEQ ID NO: 977647 - RNA, 18 nt, Mycobacterium avium subsp. paratuberculosis
gucgcugacccgccgcaa

SEQ ID NO: 977648 - RNA, 13 nt, Mycobacterium avium subsp. paratuberculosis
gucgcugaccuuc

SEQ ID NO: 977649 - RNA, 19 nt, Mycobacterium avium subsp. paratuberculosis
gucgccuucuggcuggggu

SEQ ID NO: 977650 - RNA, 16 nt, Mycobacterium avium subsp. paratuberculosis
gucgccuuguuggccc

SEQ ID NO: 977651 - RNA, 17 nt, Mycobacterium avium subsp. paratuberculosis
gucgcgacgagcgggcc

SEQ ID NO: 977652 - RNA, 18 nt, Mycobacterium avium subsp. paratuberculosis
gucgccuccugcuggcgc

SEQ ID NO: 977653 - RNA, 20 nt, Mycobacterium avium subsp. paratuberculosis
gucgccuccugcuggcgcug

SEQ ID NO: 977654 - RNA, 16 nt, Mycobacterium avium subsp. paratuberculosis
gucgccguggcggccc

SEQ ID NO: 977655 - RNA, 19 nt, Mycobacterium avium subsp. paratuberculosis
gucgccgguggugcaccgg

SEQ ID NO: 977656 - RNA, 18 nt, Mycobacterium avium subsp. paratuberculosis
gucgccggugugcagcca

SEQ ID NO: 977657 - RNA, 18 nt, Mycobacterium avium subsp. paratuberculosis
gucgccgguggccgccgg

SEQ ID NO: 977658 - RNA, 13 nt, Mycobacterium avium subsp. paratuberculosis
gucgccggcggcc

SEQ ID NO: 977659 - RNA, 15 nt, Mycobacterium avium subsp. paratuberculosis
gucgccgggcugggu

SEQ ID NO: 977660 - RNA, 16 nt, Mycobacterium avium subsp. paratuberculosis
gucgccgggcuggguc

SEQ ID NO: 977661 - RNA, 13 nt, Mycobacterium avium subsp. paratuberculosis
gucgccgggcuug

SEQ ID NO: 977662 - RNA, 17 nt, Mycobacterium avium subsp. paratuberculosis
guccugcucggcgacgc

SEQ ID NO: 977663 - RNA, 18 nt, Mycobacterium avium subsp. paratuberculosis
guccuucuccgccgggcu

SEQ ID NO: 977664 - RNA, 21 nt, Mycobacterium avium subsp. paratuberculosis
guccugcuucagcucgcugau

SEQ ID NO: 977665 - RNA, 19 nt, Mycobacterium avium subsp. paratuberculosis
guccuugacccggccgcac

SEQ ID NO: 977666 - RNA, 17 nt, Mycobacterium avium subsp. paratuberculosis
guccuuguggcccaggc

SEQ ID NO: 977667 - RNA, 14 nt, Mycobacterium avium subsp. paratuberculosis
guccuugcccagca

SEQ ID NO: 977668 - RNA, 17 nt, Mycobacterium avium subsp. paratuberculosis
guccuugcugcccaggg

SEQ ID NO: 977669 - RNA, 17 nt, Mycobacterium avium subsp. paratuberculosis
guccuugggcuccucga

SEQ ID NO: 977670 - RNA, 14 nt, Mycobacterium avium subsp. paratuberculosis
gucgaccgccgcga

SEQ ID NO: 977671 - RNA, 15 nt, Mycobacterium avium subsp. paratuberculosis
gucgaccgcggccug

SEQ ID NO: 977672 - RNA, 21 nt, Mycobacterium avium subsp. paratuberculosis
gucgaccucggccaccaccuc

SEQ ID NO: 977673 - RNA, 16 nt, Mycobacterium avium subsp. paratuberculosis
gucgacgaucugcaca

SEQ ID NO: 977674 - RNA, 14 nt, Mycobacterium avium subsp. paratuberculosis
gucgacgaugcguu

SEQ ID NO: 977675 - RNA, 16 nt, Mycobacterium avium subsp. paratuberculosis
gucgacgauggcccgg

SEQ ID NO: 977676 - RNA, 15 nt, Mycobacterium avium subsp. paratuberculosis
gucgacgagcaggcu

SEQ ID NO: 977677 - RNA, 14 nt, Mycobacterium avium subsp. paratuberculosis
gucgacgagcccgc

SEQ ID NO: 977678 - RNA, 16 nt, Mycobacterium avium subsp. paratuberculosis
gucgacgagcccgcgc

SEQ ID NO: 977679 - RNA, 18 nt, Mycobacterium avium subsp. paratuberculosis
gucgacgaacuuggacgg

SEQ ID NO: 977680 - RNA, 14 nt, Mycobacterium avium subsp. paratuberculosis
gucgacccgccgca

SEQ ID NO: 977681 - RNA, 17 nt, Mycobacterium avium subsp. paratuberculosis
gucgacccgcggcgccg

SEQ ID NO: 977682 - RNA, 20 nt, Mycobacterium avium subsp. paratuberculosis
gucgacccaggucgaguuca

SEQ ID NO: 977683 - RNA, 14 nt, Mycobacterium avium subsp. paratuberculosis
gucgaccccgccgg

SEQ ID NO: 977684 - RNA, 15 nt, Mycobacterium avium subsp. paratuberculosis
gucgaccccgccggc

SEQ ID NO: 977685 - RNA, 20 nt, Mycobacterium avium subsp. paratuberculosis
gucgaccccgccggcccggu

SEQ ID NO: 977686 - RNA, 15 nt, Mycobacterium avium subsp. paratuberculosis
gucgaccagcgggcu

SEQ ID NO: 977687 - RNA, 23 nt, Mycobacterium avium subsp. paratuberculosis
gucgaccaggacgucggccggcu

SEQ ID NO: 977688 - RNA, 18 nt, Mycobacterium avium subsp. paratuberculosis
gucgaccacccgcagcuc

SEQ ID NO: 977689 - RNA, 15 nt, Mycobacterium avium subsp. paratuberculosis
gucgaccaccgggua

SEQ ID NO: 977690 - RNA, 20 nt, Mycobacterium avium subsp. paratuberculosis
gucgaccacgaagggcgcca

SEQ ID NO: 977691 - RNA, 22 nt, Mycobacterium avium subsp. paratuberculosis
gucgaccaagacggugggcccg

SEQ ID NO: 977692 - RNA, 13 nt, Mycobacterium avium subsp. paratuberculosis
gucgacagccuga

SEQ ID NO: 977693 - RNA, 23 nt, Mycobacterium avium subsp. paratuberculosis
gucgacagccugaccgcggguga

SEQ ID NO: 977694 - RNA, 16 nt, Mycobacterium avium subsp. paratuberculosis
gucgagcggcuugccg

SEQ ID NO: 977695 - RNA, 14 nt, Mycobacterium avium subsp. paratuberculosis
gucgagcuccucgg

SEQ ID NO: 977696 - RNA, 19 nt, Mycobacterium avium subsp. paratuberculosis
gucgagcgucacgccgcgc

SEQ ID NO: 977697 - RNA, 23 nt, Mycobacterium avium subsp. paratuberculosis
gucgagcgucacgccgcgcccgu

SEQ ID NO: 977698 - RNA, 14 nt, Mycobacterium avium subsp. paratuberculosis
gucgagcgcucgcg

SEQ ID NO: 977699 - RNA, 16 nt, Mycobacterium avium subsp. paratuberculosis
gucgauccccgcagcu

SEQ ID NO: 977700 - RNA, 13 nt, Mycobacterium avium subsp. paratuberculosis
gucgagcagccgc

SEQ ID NO: 977701 - RNA, 15 nt, Mycobacterium avium subsp. paratuberculosis
gucgagcagccgcaa

SEQ ID NO: 977702 - RNA, 17 nt, Mycobacterium avium subsp. paratuberculosis
gucgagccggugccgag

SEQ ID NO: 977703 - RNA, 18 nt, Mycobacterium avium subsp. paratuberculosis
gucgagccggugccgagg

SEQ ID NO: 977704 - RNA, 15 nt, Mycobacterium avium subsp. paratuberculosis
gucgagccgcucgcg

SEQ ID NO: 977705 - RNA, 16 nt, Mycobacterium avium subsp. paratuberculosis
gucgacgcccaccugg

SEQ ID NO: 977706 - RNA, 19 nt, Mycobacterium avium subsp. paratuberculosis
gucgacggagucgucggcg

SEQ ID NO: 977707 - RNA, 16 nt, Mycobacterium avium subsp. paratuberculosis
gucgacggcaagcagu

SEQ ID NO: 977708 - RNA, 13 nt, Mycobacterium avium subsp. paratuberculosis
gucgacgcgggcg

SEQ ID NO: 977709 - RNA, 17 nt, Mycobacterium avium subsp. paratuberculosis
gucgacgcugcaggugg

SEQ ID NO: 977710 - RNA, 13 nt, Mycobacterium avium subsp. paratuberculosis
gucgacgggaaga

SEQ ID NO: 977711 - RNA, 18 nt, Mycobacterium avium subsp. paratuberculosis
gucgacgguuugcccggc

SEQ ID NO: 977712 - RNA, 15 nt, Mycobacterium avium subsp. paratuberculosis
gucgacgucgagggc

SEQ ID NO: 977713 - RNA, 19 nt, Mycobacterium avium subsp. paratuberculosis
gucgacgugcucggcggcc

SEQ ID NO: 977714 - RNA, 16 nt, Mycobacterium avium subsp. paratuberculosis
gucgacguucgccgcc

SEQ ID NO: 977715 - RNA, 14 nt, Mycobacterium avium subsp. paratuberculosis
gucgagcagcagcc

SEQ ID NO: 977716 - RNA, 21 nt, Mycobacterium avium subsp. paratuberculosis
gucgagcagcagccgccgggc

SEQ ID NO: 977717 - RNA, 13 nt, Mycobacterium avium subsp. paratuberculosis
guccucccgggug

SEQ ID NO: 977718 - RNA, 11 nt, Mycobacterium avium subsp. paratuberculosis
guccuccucgu

SEQ ID NO: 977719 - RNA, 11 nt, Mycobacterium avium subsp. paratuberculosis
guccuccugcg

SEQ ID NO: 977720 - RNA, 14 nt, Mycobacterium avium subsp. paratuberculosis
guccucccagcgcc

SEQ ID NO: 977721 - RNA, 22 nt, Mycobacterium avium subsp. paratuberculosis
guccuccgucgagucggccacc

SEQ ID NO: 977722 - RNA, 16 nt, Mycobacterium avium subsp. paratuberculosis
guccugcaggcaggcc

SEQ ID NO: 977723 - RNA, 21 nt, Mycobacterium avium subsp. paratuberculosis
guccugcaggcaggccggcag

SEQ ID NO: 977724 - RNA, 14 nt, Mycobacterium avium subsp. paratuberculosis
guccugcagcagcc

SEQ ID NO: 977725 - RNA, 17 nt, Mycobacterium avium subsp. paratuberculosis
guccugcagcagccgga

SEQ ID NO: 977726 - RNA, 18 nt, Mycobacterium avium subsp. paratuberculosis
guccugcagcucgccggc

SEQ ID NO: 977727 - RNA, 17 nt, Mycobacterium avium subsp. paratuberculosis
guccgggccggccagac

SEQ ID NO: 977728 - RNA, 18 nt, Mycobacterium avium subsp. paratuberculosis
guccggggugagcagggc

SEQ ID NO: 977729 - RNA, 14 nt, Mycobacterium avium subsp. paratuberculosis
guccggggugggca

SEQ ID NO: 977730 - RNA, 16 nt, Mycobacterium avium subsp. paratuberculosis
guccgggcguagugca

SEQ ID NO: 977731 - RNA, 20 nt, Mycobacterium avium subsp. paratuberculosis
guccgggcguagugcagcug

SEQ ID NO: 977732 - RNA, 18 nt, Mycobacterium avium subsp. paratuberculosis
guccggcucggugccgcg

SEQ ID NO: 977733 - RNA, 17 nt, Mycobacterium avium subsp. paratuberculosis
guccggcucugccugca

SEQ ID NO: 977734 - RNA, 19 nt, Mycobacterium avium subsp. paratuberculosis
guccggcucugccugcagg

SEQ ID NO: 977735 - RNA, 19 nt, Mycobacterium avium subsp. paratuberculosis
guccggcgacaugcgcagc

SEQ ID NO: 977736 - RNA, 21 nt, Mycobacterium avium subsp. paratuberculosis
guccggcgaguacccgccgca

SEQ ID NO: 977737 - RNA, 14 nt, Mycobacterium avium subsp. paratuberculosis
guccggcgccagcc

SEQ ID NO: 977738 - RNA, 15 nt, Mycobacterium avium subsp. paratuberculosis
gucccgaucaccuug

SEQ ID NO: 977739 - RNA, 15 nt, Mycobacterium avium subsp. paratuberculosis
gucccgcccggcgcc

SEQ ID NO: 977740 - RNA, 14 nt, Mycobacterium avium subsp. paratuberculosis
gucccgcggcggcg

SEQ ID NO: 977741 - RNA, 17 nt, Mycobacterium avium subsp. paratuberculosis
gucccgcguggccgcca

SEQ ID NO: 977742 - RNA, 19 nt, Mycobacterium avium subsp. paratuberculosis
gucccaucgcugccacgua

SEQ ID NO: 977743 - RNA, 22 nt, Mycobacterium avium subsp. paratuberculosis
gucccaguuguuuccccagccc

SEQ ID NO: 977744 - RNA, 20 nt, Mycobacterium avium subsp. paratuberculosis
gucccaggugggcgcgcagc

SEQ ID NO: 977745 - RNA, 20 nt, Mycobacterium avium subsp. paratuberculosis
gucccggcgcaccaggcgcc

SEQ ID NO: 977746 - RNA, 20 nt, Mycobacterium avium subsp. paratuberculosis
guccgcggaggcgagcagcc

SEQ ID NO: 977747 - RNA, 15 nt, Mycobacterium avium subsp. paratuberculosis
guccgcggccgcggc

SEQ ID NO: 977748 - RNA, 15 nt, Mycobacterium avium subsp. paratuberculosis
guccgcggcggaggg

SEQ ID NO: 977749 - RNA, 21 nt, Mycobacterium avium subsp. paratuberculosis
guccgcggcggcgugccgccc

SEQ ID NO: 977750 - RNA, 14 nt, Mycobacterium avium subsp. paratuberculosis
guccgcggugaugc

SEQ ID NO: 977751 - RNA, 14 nt, Mycobacterium avium subsp. paratuberculosis
guccgcgguggugg

SEQ ID NO: 977752 - RNA, 21 nt, Mycobacterium avium subsp. paratuberculosis
guccggaugcggcgcccacag

SEQ ID NO: 977753 - RNA, 16 nt, Mycobacterium avium subsp. paratuberculosis
guccggaaucaccuug

SEQ ID NO: 977754 - RNA, 17 nt, Mycobacterium avium subsp. paratuberculosis
guccggacacggccagc

SEQ ID NO: 977755 - RNA, 13 nt, Mycobacterium avium subsp. paratuberculosis
guccgcuccacca

SEQ ID NO: 977756 - RNA, 19 nt, Mycobacterium avium subsp. paratuberculosis
guccggauagccgucggcg

SEQ ID NO: 977757 - RNA, 16 nt, Mycobacterium avium subsp. paratuberculosis
guccggcaggcucagc

SEQ ID NO: 977758 - RNA, 20 nt, Mycobacterium avium subsp. paratuberculosis
guccggcaggcucagcagca

SEQ ID NO: 977759 - RNA, 21 nt, Mycobacterium avium subsp. paratuberculosis
guccggccaggucgccgcgca

SEQ ID NO: 977760 - RNA, 16 nt, Mycobacterium avium subsp. paratuberculosis
gucaagccggccagca

SEQ ID NO: 977761 - RNA, 19 nt, Mycobacterium avium subsp. paratuberculosis
gucaagccggccagcagcg

SEQ ID NO: 977762 - RNA, 19 nt, Mycobacterium avium subsp. paratuberculosis
ggugaagccgugcacgccg

SEQ ID NO: 977763 - RNA, 18 nt, Mycobacterium avium subsp. paratuberculosis
ggugaaguuggcggcggu

SEQ ID NO: 977764 - RNA, 16 nt, Mycobacterium avium subsp. paratuberculosis
ggugaacagguaggcg

SEQ ID NO: 977765 - RNA, 16 nt, Mycobacterium avium subsp. paratuberculosis
ggugaacgggccgcac

SEQ ID NO: 977766 - RNA, 15 nt, Mycobacterium avium subsp. paratuberculosis
ggugaacgccugcgg

SEQ ID NO: 977767 - RNA, 20 nt, Mycobacterium avium subsp. paratuberculosis
gucaccccggccaucaugcc

SEQ ID NO: 977768 - RNA, 18 nt, Mycobacterium avium subsp. paratuberculosis
gucacccgguugagcacc

SEQ ID NO: 977769 - RNA, 21 nt, Mycobacterium avium subsp. paratuberculosis
gucaccgaccccucggcggcc

SEQ ID NO: 977770 - RNA, 16 nt, Mycobacterium avium subsp. paratuberculosis
gucacggacagccggc

SEQ ID NO: 977771 - RNA, 18 nt, Mycobacterium avium subsp. paratuberculosis
gucacggauacccgcggc

SEQ ID NO: 977772 - RNA, 17 nt, Mycobacterium avium subsp. paratuberculosis
gucacggccgccagcag

SEQ ID NO: 977773 - RNA, 11 nt, Mycobacterium avium subsp. paratuberculosis
gucaccgcgcu

SEQ ID NO: 977774 - RNA, 20 nt, Mycobacterium avium subsp. paratuberculosis
gucaccgcugaugccgccga

SEQ ID NO: 977775 - RNA, 18 nt, Mycobacterium avium subsp. paratuberculosis
gucaccgccaggaccacc

SEQ ID NO: 977776 - RNA, 13 nt, Mycobacterium avium subsp. paratuberculosis
gucacgcaucagg

SEQ ID NO: 977777 - RNA, 19 nt, Mycobacterium avium subsp. paratuberculosis
gucaccggaugcacgugca

SEQ ID NO: 977778 - RNA, 16 nt, Mycobacterium avium subsp. paratuberculosis
gucacuccucgaucug

SEQ ID NO: 977779 - RNA, 15 nt, Mycobacterium avium subsp. paratuberculosis
gucacucuggcguga

SEQ ID NO: 977780 - RNA, 14 nt, Mycobacterium avium subsp. paratuberculosis
gucacgggccaggc

SEQ ID NO: 977781 - RNA, 15 nt, Mycobacterium avium subsp. paratuberculosis
gucacgggccaggcg

SEQ ID NO: 977782 - RNA, 18 nt, Mycobacterium avium subsp. paratuberculosis
gucacguccacgccgcgg

SEQ ID NO: 977783 - RNA, 20 nt, Mycobacterium avium subsp. paratuberculosis
gucacgugcacccacgccag

SEQ ID NO: 977784 - RNA, 18 nt, Mycobacterium avium subsp. paratuberculosis
gucagcagggccucgccg

SEQ ID NO: 977785 - RNA, 17 nt, Mycobacterium avium subsp. paratuberculosis
gucagcagcacccgguc

SEQ ID NO: 977786 - RNA, 21 nt, Mycobacterium avium subsp. paratuberculosis
gucagcagcacccggucgccg

SEQ ID NO: 977787 - RNA, 23 nt, Mycobacterium avium subsp. paratuberculosis
gucagcacgucggucagcgagcg

SEQ ID NO: 977788 - RNA, 20 nt, Mycobacterium avium subsp. paratuberculosis
gucagggcgacuccggcgcc

SEQ ID NO: 977789 - RNA, 23 nt, Mycobacterium avium subsp. paratuberculosis
gucaggccgugcacgaacagggu

SEQ ID NO: 977790 - RNA, 17 nt, Mycobacterium avium subsp. paratuberculosis
gucaggggugccggagg

SEQ ID NO: 977791 - RNA, 18 nt, Mycobacterium avium subsp. paratuberculosis
gucagcgccgcccgcagu

SEQ ID NO: 977792 - RNA, 17 nt, Mycobacterium avium subsp. paratuberculosis
gucaggcccagcgaggc

SEQ ID NO: 977793 - RNA, 19 nt, Mycobacterium avium subsp. paratuberculosis
gucaggcauuccaccgcgc

SEQ ID NO: 977794 - RNA, 16 nt, Mycobacterium avium subsp. paratuberculosis
gucaggccggucagcg

SEQ ID NO: 977795 - RNA, 23 nt, Mycobacterium avium subsp. paratuberculosis
gucagcgaggcguagcugcaggc

SEQ ID NO: 977796 - RNA, 15 nt, Mycobacterium avium subsp. paratuberculosis
gucagcccccaccgc

SEQ ID NO: 977797 - RNA, 21 nt, Mycobacterium avium subsp. paratuberculosis
guccaacacuuuuaaggagca

SEQ ID NO: 977798 - RNA, 17 nt, Mycobacterium avium subsp. paratuberculosis
guccaaaacaucccgga

SEQ ID NO: 977799 - RNA, 21 nt, Mycobacterium avium subsp. paratuberculosis
gucaugugccucgcgcaucag

SEQ ID NO: 977800 - RNA, 16 nt, Mycobacterium avium subsp. paratuberculosis
gucaugguggcggcgc

SEQ ID NO: 977801 - RNA, 23 nt, Mycobacterium avium subsp. paratuberculosis
gucaucgugugggcgcccgcggc

SEQ ID NO: 977802 - RNA, 16 nt, Mycobacterium avium subsp. paratuberculosis
gucauggcgaccgcga

SEQ ID NO: 977803 - RNA, 19 nt, Mycobacterium avium subsp. paratuberculosis
gucaucgacuugccgccgc

SEQ ID NO: 977804 - RNA, 12 nt, Mycobacterium avium subsp. paratuberculosis
gucauccccauc

SEQ ID NO: 977805 - RNA, 18 nt, Mycobacterium avium subsp. paratuberculosis
gucaggguguaggccgcg

SEQ ID NO: 977806 - RNA, 13 nt, Mycobacterium avium subsp. paratuberculosis
gucaggucggcga

SEQ ID NO: 977807 - RNA, 17 nt, Mycobacterium avium subsp. paratuberculosis
guccacccccgcgguga

SEQ ID NO: 977808 - RNA, 18 nt, Mycobacterium avium subsp. paratuberculosis
guccaccaucaacauugu

SEQ ID NO: 977809 - RNA, 20 nt, Mycobacterium avium subsp. paratuberculosis
guccaccaauggcggccacg

SEQ ID NO: 977810 - RNA, 16 nt, Mycobacterium avium subsp. paratuberculosis
guccagcgucgcggcc

SEQ ID NO: 977811 - RNA, 22 nt, Mycobacterium avium subsp. paratuberculosis
guccagcgucuggcagccggcc

SEQ ID NO: 977812 - RNA, 15 nt, Mycobacterium avium subsp. paratuberculosis
guccagcgugccgcg

SEQ ID NO: 977813 - RNA, 11 nt, Mycobacterium avium subsp. paratuberculosis
guccagcggcc

SEQ ID NO: 977814 - RNA, 14 nt, Mycobacterium avium subsp. paratuberculosis
guccagcgcgguga

SEQ ID NO: 977815 - RNA, 20 nt, Mycobacterium avium subsp. paratuberculosis
guccagcgcggugagcagca

SEQ ID NO: 977816 - RNA, 17 nt, Mycobacterium avium subsp. paratuberculosis
guccagcgcgagguccu

SEQ ID NO: 977817 - RNA, 21 nt, Mycobacterium avium subsp. paratuberculosis
guccagcgaaucgaccggguu

SEQ ID NO: 977818 - RNA, 23 nt, Mycobacterium avium subsp. paratuberculosis
guccagcccgcgccagcucggcg

SEQ ID NO: 977819 - RNA, 11 nt, Mycobacterium avium subsp. paratuberculosis
guccagccggu

SEQ ID NO: 977820 - RNA, 24 nt, Mycobacterium avium subsp. paratuberculosis
guccaccggcggauucucgcucug

SEQ ID NO: 977821 - RNA, 16 nt, Mycobacterium avium subsp. paratuberculosis
guccaccggucgacga

SEQ ID NO: 977822 - RNA, 12 nt, Mycobacterium avium subsp. paratuberculosis
guccagccagcc

SEQ ID NO: 977823 - RNA, 17 nt, Mycobacterium avium subsp. paratuberculosis
guccaugcccgcccacg

SEQ ID NO: 977824 - RNA, 17 nt, Mycobacterium avium subsp. paratuberculosis
guccaucauggcgcugc

SEQ ID NO: 977825 - RNA, 23 nt, Mycobacterium avium subsp. paratuberculosis
gucccagaucguagggcucggcg

SEQ ID NO: 977826 - RNA, 19 nt, Mycobacterium avium subsp. paratuberculosis
gucccagaugcgcgacggc

SEQ ID NO: 977827 - RNA, 19 nt, Mycobacterium avium subsp. paratuberculosis
gucccagcacagccgucgc

SEQ ID NO: 977828 - RNA, 14 nt, Mycobacterium avium subsp. paratuberculosis
guccauggccuuga

SEQ ID NO: 977829 - RNA, 18 nt, Mycobacterium avium subsp. paratuberculosis
guccauggucgagccgca

SEQ ID NO: 977830 - RNA, 23 nt, Mycobacterium avium subsp. paratuberculosis
guccagcgugugcgugguggggc

SEQ ID NO: 977831 - RNA, 18 nt, Mycobacterium avium subsp. paratuberculosis
guccagcucccaggacgc

SEQ ID NO: 977832 - RNA, 21 nt, Mycobacterium avium subsp. paratuberculosis
guccagcugcgcgccggcggc

SEQ ID NO: 977833 - RNA, 22 nt, Mycobacterium avium subsp. paratuberculosis
guccagcugcgcgccggcggcc

SEQ ID NO: 977834 - RNA, 20 nt, Mycobacterium avium subsp. paratuberculosis
guccaggauccccguccagc

SEQ ID NO: 977835 - RNA, 16 nt, Mycobacterium avium subsp. paratuberculosis
guccaggauccgcacc

SEQ ID NO: 977836 - RNA, 17 nt, Mycobacterium avium subsp. paratuberculosis
guccaggaucugcagca

SEQ ID NO: 977837 - RNA, 18 nt, Mycobacterium avium subsp. paratuberculosis
guccaggaucugcagcac

SEQ ID NO: 977838 - RNA, 14 nt, Mycobacterium avium subsp. paratuberculosis
guccaggcgccggg

SEQ ID NO: 977839 - RNA, 12 nt, Mycobacterium avium subsp. paratuberculosis
uacgagcagcaa

SEQ ID NO: 977840 - RNA, 17 nt, Mycobacterium avium subsp. paratuberculosis
uacgcaucggcgccgga

SEQ ID NO: 977841 - RNA, 18 nt, Mycobacterium avium subsp. paratuberculosis
uacgccucaccccagcgc

SEQ ID NO: 977842 - RNA, 16 nt, Mycobacterium avium subsp. paratuberculosis
uacgccaucagcacca

SEQ ID NO: 977843 - RNA, 14 nt, Mycobacterium avium subsp. paratuberculosis
uacgcgagcugcuu

SEQ ID NO: 977844 - RNA, 22 nt, Mycobacterium avium subsp. paratuberculosis
uacucgggugaguaguccagca

SEQ ID NO: 977845 - RNA, 19 nt, Mycobacterium avium subsp. paratuberculosis
uacucgguguagagcaccu

SEQ ID NO: 977846 - RNA, 21 nt, Mycobacterium avium subsp. paratuberculosis
uacugcugcgggugcggccag

SEQ ID NO: 977847 - RNA, 21 nt, Mycobacterium avium subsp. paratuberculosis
uacugccgcugcuuugucuca

SEQ ID NO: 977848 - RNA, 15 nt, Mycobacterium avium subsp. paratuberculosis
uacuugcggccgcga

SEQ ID NO: 977849 - RNA, 13 nt, Mycobacterium avium subsp. paratuberculosis
uaccgcuuggccc

SEQ ID NO: 977850 - RNA, 14 nt, Mycobacterium avium subsp. paratuberculosis
uaccgcuuggccca

SEQ ID NO: 977851 - RNA, 21 nt, Mycobacterium avium subsp. paratuberculosis
uaccgaugaccaccgcugugg

SEQ ID NO: 977852 - RNA, 16 nt, Mycobacterium avium subsp. paratuberculosis
uacccgaccagcaccg

SEQ ID NO: 977853 - RNA, 16 nt, Mycobacterium avium subsp. paratuberculosis
uacccgcgauggcaca

SEQ ID NO: 977854 - RNA, 20 nt, Mycobacterium avium subsp. paratuberculosis
uacccgcgcauguuggugau

SEQ ID NO: 977855 - RNA, 16 nt, Mycobacterium avium subsp. paratuberculosis
uacccgcccagcacca

SEQ ID NO: 977856 - RNA, 23 nt, Mycobacterium avium subsp. paratuberculosis
uacccgccgcaccucgccggccg

SEQ ID NO: 977857 - RNA, 11 nt, Mycobacterium avium subsp. paratuberculosis
uaccagcucac

SEQ ID NO: 977858 - RNA, 14 nt, Mycobacterium avium subsp. paratuberculosis
uaccagggcgagga

SEQ ID NO: 977859 - RNA, 16 nt, Mycobacterium avium subsp. paratuberculosis
uaccccagcaaaaccc

SEQ ID NO: 977860 - RNA, 20 nt, Mycobacterium avium subsp. paratuberculosis
uaccagcugcccaccagcag

SEQ ID NO: 977861 - RNA, 21 nt, Mycobacterium avium subsp. paratuberculosis
uaccagcugcccaccagcagg

SEQ ID NO: 977862 - RNA, 22 nt, Mycobacterium avium subsp. paratuberculosis
uacaagugaugaccuggauagg

SEQ ID NO: 977863 - RNA, 14 nt, Mycobacterium avium subsp. paratuberculosis
uacaggugcagcag

SEQ ID NO: 977864 - RNA, 18 nt, Mycobacterium avium subsp. paratuberculosis
uacaaagccggucuuggg

SEQ ID NO: 977865 - RNA, 18 nt, Mycobacterium avium subsp. paratuberculosis
uaacucggccuucgccuc

SEQ ID NO: 977866 - RNA, 17 nt, Mycobacterium avium subsp. paratuberculosis
uaagucgaugccgcccc

SEQ ID NO: 977867 - RNA, 20 nt, Mycobacterium avium subsp. paratuberculosis
uaagugucguggggcucagc

SEQ ID NO: 977868 - RNA, 17 nt, Mycobacterium avium subsp. paratuberculosis
uaaggccgaggcgagug

SEQ ID NO: 977869 - RNA, 16 nt, Mycobacterium avium subsp. paratuberculosis
uaagcggauugaccag

SEQ ID NO: 977870 - RNA, 15 nt, Mycobacterium avium subsp. paratuberculosis
uaagcgacgagguga

SEQ ID NO: 977871 - RNA, 14 nt, Mycobacterium avium subsp. paratuberculosis
uaaccaccggugac

SEQ ID NO: 977872 - RNA, 13 nt, Mycobacterium avium subsp. paratuberculosis
uaaaccagcagcg

SEQ ID NO: 977873 - RNA, 16 nt, Mycobacterium avium subsp. paratuberculosis
uaaaccgccagcagcg

SEQ ID NO: 977874 - RNA, 14 nt, Mycobacterium avium subsp. paratuberculosis
uaaagccaccagcg

SEQ ID NO: 977875 - RNA, 15 nt, Mycobacterium avium subsp. paratuberculosis
uaaagcauuggccca

SEQ ID NO: 977876 - RNA, 23 nt, Mycobacterium avium subsp. paratuberculosis
ucacaucggacaucggcagcagg

SEQ ID NO: 977877 - RNA, 22 nt, Mycobacterium avium subsp. paratuberculosis
ucaccaggcugcucggcgggcu

SEQ ID NO: 977878 - RNA, 13 nt, Mycobacterium avium subsp. paratuberculosis
ucaccagcgcggu

SEQ ID NO: 977879 - RNA, 21 nt, Mycobacterium avium subsp. paratuberculosis
ucaccagcgcggucaaaccca

SEQ ID NO: 977880 - RNA, 18 nt, Mycobacterium avium subsp. paratuberculosis
ucaccagcgccucggccu

SEQ ID NO: 977881 - RNA, 23 nt, Mycobacterium avium subsp. paratuberculosis
ucaccacgcuguagggccaccac

SEQ ID NO: 977882 - RNA, 19 nt, Mycobacterium avium subsp. paratuberculosis
ucaccaccggagcggcggu

SEQ ID NO: 977883 - RNA, 14 nt, Mycobacterium avium subsp. paratuberculosis
ucaccaggcccagg

SEQ ID NO: 977884 - RNA, 16 nt, Mycobacterium avium subsp. paratuberculosis
ucaccagcugucccag

SEQ ID NO: 977885 - RNA, 21 nt, Mycobacterium avium subsp. paratuberculosis
ucaccagcugucccagugcgu

SEQ ID NO: 977886 - RNA, 17 nt, Mycobacterium avium subsp. paratuberculosis
ucaccagcucccacgac

SEQ ID NO: 977887 - RNA, 21 nt, Mycobacterium avium subsp. paratuberculosis
ucaccagcggcugcagcagau

SEQ ID NO: 977888 - RNA, 11 nt, Mycobacterium avium subsp. paratuberculosis
ucacagcgccc

SEQ ID NO: 977889 - RNA, 23 nt, Mycobacterium avium subsp. paratuberculosis
ucacagcgcggcggugagccgcc

SEQ ID NO: 977890 - RNA, 20 nt, Mycobacterium avium subsp. paratuberculosis
ucacagcucaccugcgugcc

SEQ ID NO: 977891 - RNA, 15 nt, Mycobacterium avium subsp. paratuberculosis
ucaacgcgccgaaca

SEQ ID NO: 977892 - RNA, 18 nt, Mycobacterium avium subsp. paratuberculosis
ucaacgcgccgaacaacg

SEQ ID NO: 977893 - RNA, 14 nt, Mycobacterium avium subsp. paratuberculosis
ucaacgcggacacg

SEQ ID NO: 977894 - RNA, 18 nt, Mycobacterium avium subsp. paratuberculosis
ucaacccgagcaccgggc

SEQ ID NO: 977895 - RNA, 15 nt, Mycobacterium avium subsp. paratuberculosis
ucaaacuccgugucc

SEQ ID NO: 977896 - RNA, 19 nt, Mycobacterium avium subsp. paratuberculosis
ucacguucggcgagugagg

SEQ ID NO: 977897 - RNA, 15 nt, Mycobacterium avium subsp. paratuberculosis
ucacgucgagcggcc

SEQ ID NO: 977898 - RNA, 22 nt, Mycobacterium avium subsp. paratuberculosis
ucacgggccaggcgcgcgcugg

SEQ ID NO: 977899 - RNA, 23 nt, Mycobacterium avium subsp. paratuberculosis
ucacgucgcgcuugccgaagucc

SEQ ID NO: 977900 - RNA, 15 nt, Mycobacterium avium subsp. paratuberculosis
ucacggcgggucggg

SEQ ID NO: 977901 - RNA, 18 nt, Mycobacterium avium subsp. paratuberculosis
ucacggcggcagcgcggc

SEQ ID NO: 977902 - RNA, 21 nt, Mycobacterium avium subsp. paratuberculosis
ucacggcggcagcgcggcguu

SEQ ID NO: 977903 - RNA, 20 nt, Mycobacterium avium subsp. paratuberculosis
ucacgcaucagggccagccg

SEQ ID NO: 977904 - RNA, 14 nt, Mycobacterium avium subsp. paratuberculosis
ucacgccgcgcccg

SEQ ID NO: 977905 - RNA, 15 nt, Mycobacterium avium subsp. paratuberculosis
ucacgccggugagca

SEQ ID NO: 977906 - RNA, 20 nt, Mycobacterium avium subsp. paratuberculosis
ucacggauacccgcggccuc

SEQ ID NO: 977907 - RNA, 17 nt, Mycobacterium avium subsp. paratuberculosis
ucagaaccggggccagc

SEQ ID NO: 977908 - RNA, 19 nt, Mycobacterium avium subsp. paratuberculosis
ucagaaccggggccagcac

SEQ ID NO: 977909 - RNA, 22 nt, Mycobacterium avium subsp. paratuberculosis
aaaucguauugguagaacucgg

SEQ ID NO: 977910 - RNA, 20 nt, Mycobacterium avium subsp. paratuberculosis
ucagcaacccgaaagccccc

SEQ ID NO: 977911 - RNA, 24 nt, Mycobacterium avium subsp. paratuberculosis
ucagagcagcgccugcugccagga

SEQ ID NO: 977912 - RNA, 17 nt, Mycobacterium avium subsp. paratuberculosis
ucaggucgauggucugc

SEQ ID NO: 977913 - RNA, 22 nt, Mycobacterium avium subsp. paratuberculosis
ucaggucgauggucugcccgcc

SEQ ID NO: 977914 - RNA, 12 nt, Mycobacterium avium subsp. paratuberculosis
ucagguagugca

SEQ ID NO: 977915 - RNA, 15 nt, Mycobacterium avium subsp. paratuberculosis
ucaggcgcugggugc

SEQ ID NO: 977916 - RNA, 16 nt, Mycobacterium avium subsp. paratuberculosis
ucaggcguccagcacc

SEQ ID NO: 977917 - RNA, 16 nt, Mycobacterium avium subsp. paratuberculosis
ucagugaccagugcag

SEQ ID NO: 977918 - RNA, 17 nt, Mycobacterium avium subsp. paratuberculosis
ucagugaccagugcaga

SEQ ID NO: 977919 - RNA, 17 nt, Mycobacterium avium subsp. paratuberculosis
ucagugaggccagcacc

SEQ ID NO: 977920 - RNA, 15 nt, Mycobacterium avium subsp. paratuberculosis
ucagugcgagaaaau

SEQ ID NO: 977921 - RNA, 17 nt, Mycobacterium avium subsp. paratuberculosis
ucaggaauuugcggccc

SEQ ID NO: 977922 - RNA, 22 nt, Mycobacterium avium subsp. paratuberculosis
ucagcucguggcgggcccgggc

SEQ ID NO: 977923 - RNA, 21 nt, Mycobacterium avium subsp. paratuberculosis
ucagcucuucgauggccaucg

SEQ ID NO: 977924 - RNA, 21 nt, Mycobacterium avium subsp. paratuberculosis
ucaggccgucucgagccggcg

SEQ ID NO: 977925 - RNA, 12 nt, Mycobacterium avium subsp. paratuberculosis
ucaggcgcagcc

SEQ ID NO: 977926 - RNA, 13 nt, Mycobacterium avium subsp. paratuberculosis
ucaggccggccug

SEQ ID NO: 977927 - RNA, 16 nt, Mycobacterium avium subsp. paratuberculosis
ucaggccccacccgca

SEQ ID NO: 977928 - RNA, 21 nt, Mycobacterium avium subsp. paratuberculosis
ucagcaccaccaacagcagcg

SEQ ID NO: 977929 - RNA, 23 nt, Mycobacterium avium subsp. paratuberculosis
ucagcaccgggugauaccggccc

SEQ ID NO: 977930 - RNA, 18 nt, Mycobacterium avium subsp. paratuberculosis
ucagcaccgucaccgccu

SEQ ID NO: 977931 - RNA, 18 nt, Mycobacterium avium subsp. paratuberculosis
ucagcaccguccacagcc

SEQ ID NO: 977932 - RNA, 15 nt, Mycobacterium avium subsp. paratuberculosis
ucagcaccgagaaca

SEQ ID NO: 977933 - RNA, 14 nt, Mycobacterium avium subsp. paratuberculosis
ucagcaccgcgaac

SEQ ID NO: 977934 - RNA, 24 nt, Mycobacterium avium subsp. paratuberculosis
ucagcaccgcgaacaucgccagca

SEQ ID NO: 977935 - RNA, 16 nt, Mycobacterium avium subsp. paratuberculosis
ucagcaccgcggagga

SEQ ID NO: 977936 - RNA, 14 nt, Mycobacterium avium subsp. paratuberculosis
ucagcacgcggauc

SEQ ID NO: 977937 - RNA, 23 nt, Mycobacterium avium subsp. paratuberculosis
ucagcaguuuggucauguaccag

SEQ ID NO: 977938 - RNA, 14 nt, Mycobacterium avium subsp. paratuberculosis
ucagcagcaccugg

SEQ ID NO: 977939 - RNA, 18 nt, Mycobacterium avium subsp. paratuberculosis
ucagcagcacccgggccu

SEQ ID NO: 977940 - RNA, 13 nt, Mycobacterium avium subsp. paratuberculosis
ucagcagcgcggu

SEQ ID NO: 977941 - RNA, 19 nt, Mycobacterium avium subsp. paratuberculosis
ucagcagccggcagacgaa

SEQ ID NO: 977942 - RNA, 14 nt, Mycobacterium avium subsp. paratuberculosis
ucagcagccgggcc

SEQ ID NO: 977943 - RNA, 15 nt, Mycobacterium avium subsp. paratuberculosis
ucagcagccgggccu

SEQ ID NO: 977944 - RNA, 18 nt, Mycobacterium avium subsp. paratuberculosis
ucagcagcugcuggcgug

SEQ ID NO: 977945 - RNA, 20 nt, Mycobacterium avium subsp. paratuberculosis
ucagcaggcccucggccagc

SEQ ID NO: 977946 - RNA, 13 nt, Mycobacterium avium subsp. paratuberculosis
ucagcaugucgcc

SEQ ID NO: 977947 - RNA, 20 nt, Mycobacterium avium subsp. paratuberculosis
ucagcaucggguagaucucc

SEQ ID NO: 977948 - RNA, 11 nt, Mycobacterium avium subsp. paratuberculosis
ucagcggccuc

SEQ ID NO: 977949 - RNA, 10 nt, Mycobacterium avium subsp. paratuberculosis
ucagcggcag

SEQ ID NO: 977950 - RNA, 19 nt, Mycobacterium avium subsp. paratuberculosis
ucagcggcccgaucaccag

SEQ ID NO: 977951 - RNA, 15 nt, Mycobacterium avium subsp. paratuberculosis
ucagcgcuuccagcg

SEQ ID NO: 977952 - RNA, 17 nt, Mycobacterium avium subsp. paratuberculosis
ucagcgcuccuggccgg

SEQ ID NO: 977953 - RNA, 20 nt, Mycobacterium avium subsp. paratuberculosis
ucagcgucucgccggggaac

SEQ ID NO: 977954 - RNA, 21 nt, Mycobacterium avium subsp. paratuberculosis
ucagcucccccgacaccgcca

SEQ ID NO: 977955 - RNA, 17 nt, Mycobacterium avium subsp. paratuberculosis
ucagcucgcgcccggcc

SEQ ID NO: 977956 - RNA, 14 nt, Mycobacterium avium subsp. paratuberculosis
ucagcucggcggcc

SEQ ID NO: 977957 - RNA, 17 nt, Mycobacterium avium subsp. paratuberculosis
ucagccaaaccgugucc

SEQ ID NO: 977958 - RNA, 20 nt, Mycobacterium avium subsp. paratuberculosis
ucagccacgccggcacaccg

SEQ ID NO: 977959 - RNA, 22 nt, Mycobacterium avium subsp. paratuberculosis
ucagcccggaaaaccccacccc

SEQ ID NO: 977960 - RNA, 19 nt, Mycobacterium avium subsp. paratuberculosis
ucagcccggcguccugcag

SEQ ID NO: 977961 - RNA, 16 nt, Mycobacterium avium subsp. paratuberculosis
ucagccccucguccag

SEQ ID NO: 977962 - RNA, 20 nt, Mycobacterium avium subsp. paratuberculosis
ucagccccucguccaggugc

SEQ ID NO: 977963 - RNA, 14 nt, Mycobacterium avium subsp. paratuberculosis
ucagccgagccggg

SEQ ID NO: 977964 - RNA, 22 nt, Mycobacterium avium subsp. paratuberculosis
ucagcgccagcaacacccagcc

SEQ ID NO: 977965 - RNA, 17 nt, Mycobacterium avium subsp. paratuberculosis
ucagcgccaccagcacc

SEQ ID NO: 977966 - RNA, 22 nt, Mycobacterium avium subsp. paratuberculosis
ucagcgcccgcccggcccggcg

SEQ ID NO: 977967 - RNA, 16 nt, Mycobacterium avium subsp. paratuberculosis
ucagcgcccaggauga

SEQ ID NO: 977968 - RNA, 15 nt, Mycobacterium avium subsp. paratuberculosis
uauucgucaccccac

SEQ ID NO: 977969 - RNA, 18 nt, Mycobacterium avium subsp. paratuberculosis
uaugcccgccgcgucagc

SEQ ID NO: 977970 - RNA, 15 nt, Mycobacterium avium subsp. paratuberculosis
uaucucugauuugaa

SEQ ID NO: 977971 - RNA, 13 nt, Mycobacterium avium subsp. paratuberculosis
uaucgagcaccag

SEQ ID NO: 977972 - RNA, 19 nt, Mycobacterium avium subsp. paratuberculosis
uaucggccgcggggccggc

SEQ ID NO: 977973 - RNA, 14 nt, Mycobacterium avium subsp. paratuberculosis
uaucaggacuggac

SEQ ID NO: 977974 - RNA, 18 nt, Mycobacterium avium subsp. paratuberculosis
uagguggcgaccaccgac

SEQ ID NO: 977975 - RNA, 17 nt, Mycobacterium avium subsp. paratuberculosis
uaguacaccgggcuggu

SEQ ID NO: 977976 - RNA, 16 nt, Mycobacterium avium subsp. paratuberculosis
uaguggugcaggugcc

SEQ ID NO: 977977 - RNA, 17 nt, Mycobacterium avium subsp. paratuberculosis
uaguggcgugcggccuc

SEQ ID NO: 977978 - RNA, 13 nt, Mycobacterium avium subsp. paratuberculosis
uagucggugcagu

SEQ ID NO: 977979 - RNA, 14 nt, Mycobacterium avium subsp. paratuberculosis
uagucggcccaggc

SEQ ID NO: 977980 - RNA, 21 nt, Mycobacterium avium subsp. paratuberculosis
uagucggcgccgacggccagc

SEQ ID NO: 977981 - RNA, 17 nt, Mycobacterium avium subsp. paratuberculosis
uccgcuggugcgcgccg

SEQ ID NO: 977982 - RNA, 16 nt, Mycobacterium avium subsp. paratuberculosis
uccgcugaacgggcag

SEQ ID NO: 977983 - RNA, 21 nt, Mycobacterium avium subsp. paratuberculosis
uccggaucaaccacaccagca

SEQ ID NO: 977984 - RNA, 22 nt, Mycobacterium avium subsp. paratuberculosis
uccggaucaaccacaccagcau

SEQ ID NO: 977985 - RNA, 17 nt, Mycobacterium avium subsp. paratuberculosis
uccggacacggccagcg

SEQ ID NO: 977986 - RNA, 18 nt, Mycobacterium avium subsp. paratuberculosis
uccggaugccggcuuggg

SEQ ID NO: 977987 - RNA, 20 nt, Mycobacterium avium subsp. paratuberculosis
uccggauugccgggcagcgg

SEQ ID NO: 977988 - RNA, 18 nt, Mycobacterium avium subsp. paratuberculosis
uccggccagguccacacc

SEQ ID NO: 977989 - RNA, 18 nt, Mycobacterium avium subsp. paratuberculosis
uccggccaguccagcgaa

SEQ ID NO: 977990 - RNA, 16 nt, Mycobacterium avium subsp. paratuberculosis
uccggccccgcugccg

SEQ ID NO: 977991 - RNA, 16 nt, Mycobacterium avium subsp. paratuberculosis
uccggcccgcucggcg

SEQ ID NO: 977992 - RNA, 19 nt, Mycobacterium avium subsp. paratuberculosis
uccggcaggcucagcagca

SEQ ID NO: 977993 - RNA, 17 nt, Mycobacterium avium subsp. paratuberculosis
uccggcaguacgcgccg

SEQ ID NO: 977994 - RNA, 21 nt, Mycobacterium avium subsp. paratuberculosis
uccggcagcgcgcccaggcug

SEQ ID NO: 977995 - RNA, 13 nt, Mycobacterium avium subsp. paratuberculosis
uccggcagcagcg

SEQ ID NO: 977996 - RNA, 22 nt, Mycobacterium avium subsp. paratuberculosis
uccgggccaccgucuucggggc

SEQ ID NO: 977997 - RNA, 18 nt, Mycobacterium avium subsp. paratuberculosis
uccgggcacgcagcggcg

SEQ ID NO: 977998 - RNA, 23 nt, Mycobacterium avium subsp. paratuberculosis
uccgggcgccauccgccacccgc

SEQ ID NO: 977999 - RNA, 18 nt, Mycobacterium avium subsp. paratuberculosis
uccgggcgcccagaagcc

SEQ ID NO: 978000 - RNA, 16 nt, Mycobacterium avium subsp. paratuberculosis
uccgggcggccagccg

SEQ ID NO: 978001 - RNA, 15 nt, Mycobacterium avium subsp. paratuberculosis
uccgggcguagugca

SEQ ID NO: 978002 - RNA, 18 nt, Mycobacterium avium subsp. paratuberculosis
uccgggcguagugcagcu

SEQ ID NO: 978003 - RNA, 11 nt, Mycobacterium avium subsp. paratuberculosis
uccgggccgcc

SEQ ID NO: 978004 - RNA, 22 nt, Mycobacterium avium subsp. paratuberculosis
uccgggcgaccccggccaggau

SEQ ID NO: 978005 - RNA, 23 nt, Mycobacterium avium subsp. paratuberculosis
uccgggcugugggcgcagggccg

SEQ ID NO: 978006 - RNA, 22 nt, Mycobacterium avium subsp. paratuberculosis
uccgggcugaccucgcgcaccg

SEQ ID NO: 978007 - RNA, 20 nt, Mycobacterium avium subsp. paratuberculosis
uccggggaaccgcccuucca

SEQ ID NO: 978008 - RNA, 20 nt, Mycobacterium avium subsp. paratuberculosis
uccggguugggcgccugcgg

SEQ ID NO: 978009 - RNA, 14 nt, Mycobacterium avium subsp. paratuberculosis
uccgggugucgacg

SEQ ID NO: 978010 - RNA, 15 nt, Mycobacterium avium subsp. paratuberculosis
uccggggucacggau

SEQ ID NO: 978011 - RNA, 18 nt, Mycobacterium avium subsp. paratuberculosis
uccggggugggcacgucg

SEQ ID NO: 978012 - RNA, 18 nt, Mycobacterium avium subsp. paratuberculosis
uccggguccuaucaggac

SEQ ID NO: 978013 - RNA, 14 nt, Mycobacterium avium subsp. paratuberculosis
uccggucgaccuug

SEQ ID NO: 978014 - RNA, 16 nt, Mycobacterium avium subsp. paratuberculosis
uccggucgaucaccuc

SEQ ID NO: 978015 - RNA, 12 nt, Mycobacterium avium subsp. paratuberculosis
uccggucagcac

SEQ ID NO: 978016 - RNA, 14 nt, Mycobacterium avium subsp. paratuberculosis
uccggucagcaccg

SEQ ID NO: 978017 - RNA, 12 nt, Mycobacterium avium subsp. paratuberculosis
uccgguccagau

SEQ ID NO: 978018 - RNA, 19 nt, Mycobacterium avium subsp. paratuberculosis
uccggcgugcagcacgccc

SEQ ID NO: 978019 - RNA, 14 nt, Mycobacterium avium subsp. paratuberculosis
uccggcggucagca

SEQ ID NO: 978020 - RNA, 21 nt, Mycobacterium avium subsp. paratuberculosis
uccggcggcgcucagcgcggc

SEQ ID NO: 978021 - RNA, 23 nt, Mycobacterium avium subsp. paratuberculosis
uccggcgggcuggugcgcagccg

SEQ ID NO: 978022 - RNA, 14 nt, Mycobacterium avium subsp. paratuberculosis
uccggcggucgcug

SEQ ID NO: 978023 - RNA, 20 nt, Mycobacterium avium subsp. paratuberculosis
uccggcggucgcugcagcgg

SEQ ID NO: 978024 - RNA, 22 nt, Mycobacterium avium subsp. paratuberculosis
uccggcggucgcugcagcggcg

SEQ ID NO: 978025 - RNA, 19 nt, Mycobacterium avium subsp. paratuberculosis
uccggcuggucggccuggc

SEQ ID NO: 978026 - RNA, 19 nt, Mycobacterium avium subsp. paratuberculosis
uccggcugaacgccagcag

SEQ ID NO: 978027 - RNA, 20 nt, Mycobacterium avium subsp. paratuberculosis
uccggcgccagcccggugau

SEQ ID NO: 978028 - RNA, 12 nt, Mycobacterium avium subsp. paratuberculosis
uccggcccuggu

SEQ ID NO: 978029 - RNA, 21 nt, Mycobacterium avium subsp. paratuberculosis
uccggcccuggucggccaggg

SEQ ID NO: 978030 - RNA, 22 nt, Mycobacterium avium subsp. paratuberculosis
uccggccgugaugcgccggcgg

SEQ ID NO: 978031 - RNA, 23 nt, Mycobacterium avium subsp. paratuberculosis
uccggccgugaugcgccggcggu

SEQ ID NO: 978032 - RNA, 23 nt, Mycobacterium avium subsp. paratuberculosis
uccggcggcaccacccgcggccg

SEQ ID NO: 978033 - RNA, 23 nt, Mycobacterium avium subsp. paratuberculosis
uccggcgcgaucggccgcugccc

SEQ ID NO: 978034 - RNA, 18 nt, Mycobacterium avium subsp. paratuberculosis
uccggcgccggucagcgg

SEQ ID NO: 978035 - RNA, 22 nt, Mycobacterium avium subsp. paratuberculosis
uccggcgccggucagcggcaac

SEQ ID NO: 978036 - RNA, 16 nt, Mycobacterium avium subsp. paratuberculosis
uccggcgccgcgggcg

SEQ ID NO: 978037 - RNA, 22 nt, Mycobacterium avium subsp. paratuberculosis
uccggcgccgcgggcgccguag

SEQ ID NO: 978038 - RNA, 21 nt, Mycobacterium avium subsp. paratuberculosis
uccggugaccgcgacgcugcc

SEQ ID NO: 978039 - RNA, 18 nt, Mycobacterium avium subsp. paratuberculosis
uccggugauugaauggaa

SEQ ID NO: 978040 - RNA, 21 nt, Mycobacterium avium subsp. paratuberculosis
uccggugauugaauggaaugu

SEQ ID NO: 978041 - RNA, 20 nt, Mycobacterium avium subsp. paratuberculosis
uccgucggccuugcgccacu

SEQ ID NO: 978042 - RNA, 13 nt, Mycobacterium avium subsp. paratuberculosis
uccgucuuggcca

SEQ ID NO: 978043 - RNA, 14 nt, Mycobacterium avium subsp. paratuberculosis
uccgucuuggccag

SEQ ID NO: 978044 - RNA, 18 nt, Mycobacterium avium subsp. paratuberculosis
uccgugccacggccgcgg

SEQ ID NO: 978045 - RNA, 16 nt, Mycobacterium avium subsp. paratuberculosis
uccucacaccucgcua

SEQ ID NO: 978046 - RNA, 12 nt, Mycobacterium avium subsp. paratuberculosis
uccugcuggccg

SEQ ID NO: 978047 - RNA, 15 nt, Mycobacterium avium subsp. paratuberculosis
uccugcuggccgggc

SEQ ID NO: 978048 - RNA, 19 nt, Mycobacterium avium subsp. paratuberculosis
uccugcuggccgggcucga

SEQ ID NO: 978049 - RNA, 21 nt, Mycobacterium avium subsp. paratuberculosis
uccuggaaggacgucaggccg

SEQ ID NO: 978050 - RNA, 15 nt, Mycobacterium avium subsp. paratuberculosis
uccuggacgucgucg

SEQ ID NO: 978051 - RNA, 15 nt, Mycobacterium avium subsp. paratuberculosis
uccugcuugaccgug

SEQ ID NO: 978052 - RNA, 13 nt, Mycobacterium avium subsp. paratuberculosis
uccuggcucagga

SEQ ID NO: 978053 - RNA, 18 nt, Mycobacterium avium subsp. paratuberculosis
uccuggcgcuggugcagc

SEQ ID NO: 978054 - RNA, 16 nt, Mycobacterium avium subsp. paratuberculosis
uccuggaugaacagca

SEQ ID NO: 978055 - RNA, 21 nt, Mycobacterium avium subsp. paratuberculosis
uccuggccaacucgaccugcc

SEQ ID NO: 978056 - RNA, 11 nt, Mycobacterium avium subsp. paratuberculosis
uccuggcccuu

SEQ ID NO: 978057 - RNA, 15 nt, Mycobacterium avium subsp. paratuberculosis
uccugcaggcaggcc

SEQ ID NO: 978058 - RNA, 22 nt, Mycobacterium avium subsp. paratuberculosis
uccugcagcgcggcgaucagcu

SEQ ID NO: 978059 - RNA, 22 nt, Mycobacterium avium subsp. paratuberculosis
uccugugcaccgugcugugcug

SEQ ID NO: 978060 - RNA, 16 nt, Mycobacterium avium subsp. paratuberculosis
uccuggugcaccaggu

SEQ ID NO: 978061 - RNA, 15 nt, Mycobacterium avium subsp. paratuberculosis
uccugguagucgucg

SEQ ID NO: 978062 - RNA, 15 nt, Mycobacterium avium subsp. paratuberculosis
uccugggacagccgg

SEQ ID NO: 978063 - RNA, 15 nt, Mycobacterium avium subsp. paratuberculosis
uccugggccgggaug

SEQ ID NO: 978064 - RNA, 13 nt, Mycobacterium avium subsp. paratuberculosis
uccugggccuggc

SEQ ID NO: 978065 - RNA, 14 nt, Mycobacterium avium subsp. paratuberculosis
uccugggccuggcg

SEQ ID NO: 978066 - RNA, 14 nt, Mycobacterium avium subsp. paratuberculosis
uccucagcagcuag

SEQ ID NO: 978067 - RNA, 15 nt, Mycobacterium avium subsp. paratuberculosis
uccuccucggccagc

SEQ ID NO: 978068 - RNA, 19 nt, Mycobacterium avium subsp. paratuberculosis
uccuccucggccagcccca

SEQ ID NO: 978069 - RNA, 22 nt, Mycobacterium avium subsp. paratuberculosis
uccuccugcgacggcagcaccu

SEQ ID NO: 978070 - RNA, 16 nt, Mycobacterium avium subsp. paratuberculosis
uccucccagcccucgu

SEQ ID NO: 978071 - RNA, 11 nt, Mycobacterium avium subsp. paratuberculosis
uccucccagcg

SEQ ID NO: 978072 - RNA, 13 nt, Mycobacterium avium subsp. paratuberculosis
uccucccagcgcc

SEQ ID NO: 978073 - RNA, 19 nt, Mycobacterium avium subsp. paratuberculosis
uccucguucuggcccgcca

SEQ ID NO: 978074 - RNA, 22 nt, Mycobacterium avium subsp. paratuberculosis
uccucggcgauguugaccaccc

SEQ ID NO: 978075 - RNA, 15 nt, Mycobacterium avium subsp. paratuberculosis
uccucggggugguga

SEQ ID NO: 978076 - RNA, 17 nt, Mycobacterium avium subsp. paratuberculosis
uccucggugugcugacc

SEQ ID NO: 978077 - RNA, 19 nt, Mycobacterium avium subsp. paratuberculosis
uccucgauccgguccagcc

SEQ ID NO: 978078 - RNA, 15 nt, Mycobacterium avium subsp. paratuberculosis
uccucgcugccggcc

SEQ ID NO: 978079 - RNA, 16 nt, Mycobacterium avium subsp. paratuberculosis
uccucgcugccggccg

SEQ ID NO: 978080 - RNA, 20 nt, Mycobacterium avium subsp. paratuberculosis
uccucgcgccgccacgcggc

SEQ ID NO: 978081 - RNA, 21 nt, Mycobacterium avium subsp. paratuberculosis
uccucgcggaacugcucccag

SEQ ID NO: 978082 - RNA, 23 nt, Mycobacterium avium subsp. paratuberculosis
uccucgacggcgaagccggcguc

SEQ ID NO: 978083 - RNA, 19 nt, Mycobacterium avium subsp. paratuberculosis
uccucgaggguuugagcau

SEQ ID NO: 978084 - RNA, 16 nt, Mycobacterium avium subsp. paratuberculosis
uccucgacguaggcca

SEQ ID NO: 978085 - RNA, 16 nt, Mycobacterium avium subsp. paratuberculosis
uccuccugcgccggca

SEQ ID NO: 978086 - RNA, 15 nt, Mycobacterium avium subsp. paratuberculosis
uccucgaccacccgc

SEQ ID NO: 978087 - RNA, 18 nt, Mycobacterium avium subsp. paratuberculosis
uccucucggcgccgucca

SEQ ID NO: 978088 - RNA, 14 nt, Mycobacterium avium subsp. paratuberculosis
uccucugcgcgcca

SEQ ID NO: 978089 - RNA, 15 nt, Mycobacterium avium subsp. paratuberculosis
ucgcaggcagcagca

SEQ ID NO: 978090 - RNA, 16 nt, Mycobacterium avium subsp. paratuberculosis
ucgcacuugaagcuga

SEQ ID NO: 978091 - RNA, 16 nt, Mycobacterium avium subsp. paratuberculosis
ucgcagauggucggga

SEQ ID NO: 978092 - RNA, 23 nt, Mycobacterium avium subsp. paratuberculosis
ucgcagauggucgggacgucggc

SEQ ID NO: 978093 - RNA, 17 nt, Mycobacterium avium subsp. paratuberculosis
ucgcaccugccgucgac

SEQ ID NO: 978094 - RNA, 15 nt, Mycobacterium avium subsp. paratuberculosis
ucgcacaccagcacg

SEQ ID NO: 978095 - RNA, 19 nt, Mycobacterium avium subsp. paratuberculosis
ucgcacagccgcagcagcc

SEQ ID NO: 978096 - RNA, 13 nt, Mycobacterium avium subsp. paratuberculosis
ucgcacaggaugc

SEQ ID NO: 978097 - RNA, 12 nt, Mycobacterium avium subsp. paratuberculosis
ucgauugccgcg

SEQ ID NO: 978098 - RNA, 16 nt, Mycobacterium avium subsp. paratuberculosis
ucgaugucgcccggcg

SEQ ID NO: 978099 - RNA, 21 nt, Mycobacterium avium subsp. paratuberculosis
ucgaugggaaccgcucggcuc

SEQ ID NO: 978100 - RNA, 18 nt, Mycobacterium avium subsp. paratuberculosis
ucgauggucgccuuguug

SEQ ID NO: 978101 - RNA, 19 nt, Mycobacterium avium subsp. paratuberculosis
ucgaugguguagccgugcc

SEQ ID NO: 978102 - RNA, 21 nt, Mycobacterium avium subsp. paratuberculosis
ucgauggcguagcgggucagc

SEQ ID NO: 978103 - RNA, 21 nt, Mycobacterium avium subsp. paratuberculosis
ucgauggccucgucgcggaac

SEQ ID NO: 978104 - RNA, 16 nt, Mycobacterium avium subsp. paratuberculosis
ucgaugaaccgcugcu

SEQ ID NO: 978105 - RNA, 12 nt, Mycobacterium avium subsp. paratuberculosis
ucgaucucggug

SEQ ID NO: 978106 - RNA, 16 nt, Mycobacterium avium subsp. paratuberculosis
ucgaucugcaccagcg

SEQ ID NO: 978107 - RNA, 13 nt, Mycobacterium avium subsp. paratuberculosis
ucgaucuccucgg

SEQ ID NO: 978108 - RNA, 19 nt, Mycobacterium avium subsp. paratuberculosis
ucgaucgccgcgcccagca

SEQ ID NO: 978109 - RNA, 18 nt, Mycobacterium avium subsp. paratuberculosis
ucgauggaaggugcugaa

SEQ ID NO: 978110 - RNA, 19 nt, Mycobacterium avium subsp. paratuberculosis
ucgauggacgccagcauga

SEQ ID NO: 978111 - RNA, 13 nt, Mycobacterium avium subsp. paratuberculosis
ucgaugcgcaccu

SEQ ID NO: 978112 - RNA, 16 nt, Mycobacterium avium subsp. paratuberculosis
ucgaugcgcgccagca

SEQ ID NO: 978113 - RNA, 21 nt, Mycobacterium avium subsp. paratuberculosis
ucgaugccguagaccagcauc

SEQ ID NO: 978114 - RNA, 18 nt, Mycobacterium avium subsp. paratuberculosis
ucgaugccgccccugcug

SEQ ID NO: 978115 - RNA, 17 nt, Mycobacterium avium subsp. paratuberculosis
ucgaugccggccagcgg

SEQ ID NO: 978116 - RNA, 19 nt, Mycobacterium avium subsp. paratuberculosis
ucgaugccggccagcggcc

SEQ ID NO: 978117 - RNA, 19 nt, Mycobacterium avium subsp. paratuberculosis
ucgaugccguugugcacca

SEQ ID NO: 978118 - RNA, 18 nt, Mycobacterium avium subsp. paratuberculosis
ucgaugcauucguccauc

SEQ ID NO: 978119 - RNA, 19 nt, Mycobacterium avium subsp. paratuberculosis
ucgaugaauccgcgcagca

SEQ ID NO: 978120 - RNA, 19 nt, Mycobacterium avium subsp. paratuberculosis
ucgaucaaaucccgcagcu

SEQ ID NO: 978121 - RNA, 18 nt, Mycobacterium avium subsp. paratuberculosis
ucgagugcucgauggcca

SEQ ID NO: 978122 - RNA, 14 nt, Mycobacterium avium subsp. paratuberculosis
ucgaguuuggccag

SEQ ID NO: 978123 - RNA, 17 nt, Mycobacterium avium subsp. paratuberculosis
ucgaguaggcccagucc

SEQ ID NO: 978124 - RNA, 23 nt, Mycobacterium avium subsp. paratuberculosis
ucgagucccgcgcggcgcagggc

SEQ ID NO: 978125 - RNA, 20 nt, Mycobacterium avium subsp. paratuberculosis
ucgaggucggugaggcuggg

SEQ ID NO: 978126 - RNA, 12 nt, Mycobacterium avium subsp. paratuberculosis
ucgaggcgcugc

SEQ ID NO: 978127 - RNA, 20 nt, Mycobacterium avium subsp. paratuberculosis
ucgagggcguccuuccaacg

SEQ ID NO: 978128 - RNA, 21 nt, Mycobacterium avium subsp. paratuberculosis
ucgaggaucgcggccacgccc

SEQ ID NO: 978129 - RNA, 14 nt, Mycobacterium avium subsp. paratuberculosis
ucgaggaucucccg

SEQ ID NO: 978130 - RNA, 14 nt, Mycobacterium avium subsp. paratuberculosis
ucgagcugcacggg

SEQ ID NO: 978131 - RNA, 14 nt, Mycobacterium avium subsp. paratuberculosis
ucgagcugggcccg

SEQ ID NO: 978132 - RNA, 23 nt, Mycobacterium avium subsp. paratuberculosis
ucgagcuccuccggguccccgcc

SEQ ID NO: 978133 - RNA, 16 nt, Mycobacterium avium subsp. paratuberculosis
ucgagcgugggcccua

SEQ ID NO: 978134 - RNA, 20 nt, Mycobacterium avium subsp. paratuberculosis
ucgagcgcggcccgccgaac

SEQ ID NO: 978135 - RNA, 12 nt, Mycobacterium avium subsp. paratuberculosis
ucgagcggcgcc

SEQ ID NO: 978136 - RNA, 15 nt, Mycobacterium avium subsp. paratuberculosis
ucgagcagcaccacc

SEQ ID NO: 978137 - RNA, 20 nt, Mycobacterium avium subsp. paratuberculosis
ucgagcacgcccugcggcug

SEQ ID NO: 978138 - RNA, 19 nt, Mycobacterium avium subsp. paratuberculosis
ucgagcaccuccagauaga

SEQ ID NO: 978139 - RNA, 20 nt, Mycobacterium avium subsp. paratuberculosis
ucgagcaccuccagauagag

SEQ ID NO: 978140 - RNA, 20 nt, Mycobacterium avium subsp. paratuberculosis
ucgagccgcucgcgcaccgg

SEQ ID NO: 978141 - RNA, 12 nt, Mycobacterium avium subsp. paratuberculosis
ucgagcgcaccg

SEQ ID NO: 978142 - RNA, 21 nt, Mycobacterium avium subsp. paratuberculosis
ucgagcccaccgcgcccagcc

SEQ ID NO: 978143 - RNA, 15 nt, Mycobacterium avium subsp. paratuberculosis
ucgagcaugcgggug

SEQ ID NO: 978144 - RNA, 14 nt, Mycobacterium avium subsp. paratuberculosis
ucgagccaccacug

SEQ ID NO: 978145 - RNA, 16 nt, Mycobacterium avium subsp. paratuberculosis
ucgagauucugcagcc

SEQ ID NO: 978146 - RNA, 15 nt, Mycobacterium avium subsp. paratuberculosis
ucgagcaacaccacc

SEQ ID NO: 978147 - RNA, 13 nt, Mycobacterium avium subsp. paratuberculosis
ucgagcaccagca

SEQ ID NO: 978148 - RNA, 13 nt, Mycobacterium avium subsp. paratuberculosis
ucgagcaccagcg

SEQ ID NO: 978149 - RNA, 16 nt, Mycobacterium avium subsp. paratuberculosis
ucgagaucagcaccgg

SEQ ID NO: 978150 - RNA, 21 nt, Mycobacterium avium subsp. paratuberculosis
ucgagaccaugucggccaggu

SEQ ID NO: 978151 - RNA, 13 nt, Mycobacterium avium subsp. paratuberculosis
ucgacuccagcac

SEQ ID NO: 978152 - RNA, 20 nt, Mycobacterium avium subsp. paratuberculosis
ucgacguucggcgggcaggc

SEQ ID NO: 978153 - RNA, 17 nt, Mycobacterium avium subsp. paratuberculosis
ucgacuggaucaucgac

SEQ ID NO: 978154 - RNA, 13 nt, Mycobacterium avium subsp. paratuberculosis
ucgaccaccgccg

SEQ ID NO: 978155 - RNA, 15 nt, Mycobacterium avium subsp. paratuberculosis
ucgaccacgcacacc

SEQ ID NO: 978156 - RNA, 16 nt, Mycobacterium avium subsp. paratuberculosis
ucgaccacgcacacca

SEQ ID NO: 978157 - RNA, 18 nt, Mycobacterium avium subsp. paratuberculosis
ucgaccaggcucacgcug

SEQ ID NO: 978158 - RNA, 17 nt, Mycobacterium avium subsp. paratuberculosis
ucgaccccaacccgaag

SEQ ID NO: 978159 - RNA, 21 nt, Mycobacterium avium subsp. paratuberculosis
ucgaccggggcgccccgcugg

SEQ ID NO: 978160 - RNA, 21 nt, Mycobacterium avium subsp. paratuberculosis
ucgaccgguucgucaacgccc

SEQ ID NO: 978161 - RNA, 18 nt, Mycobacterium avium subsp. paratuberculosis
ucgaccgugaggcccggc

SEQ ID NO: 978162 - RNA, 15 nt, Mycobacterium avium subsp. paratuberculosis
ucgaccgucacgcug

SEQ ID NO: 978163 - RNA, 19 nt, Mycobacterium avium subsp. paratuberculosis
ucgaccgcggcuccggccg

SEQ ID NO: 978164 - RNA, 19 nt, Mycobacterium avium subsp. paratuberculosis
ucgacccgguagcgcagca

SEQ ID NO: 978165 - RNA, 15 nt, Mycobacterium avium subsp. paratuberculosis
ucgacgacgccagcu

SEQ ID NO: 978166 - RNA, 15 nt, Mycobacterium avium subsp. paratuberculosis
ucgacgacggguggg

SEQ ID NO: 978167 - RNA, 21 nt, Mycobacterium avium subsp. paratuberculosis
ucgacgacguugcgggccagg

SEQ ID NO: 978168 - RNA, 22 nt, Mycobacterium avium subsp. paratuberculosis
ucgacgacguugcgggccaggu

SEQ ID NO: 978169 - RNA, 20 nt, Mycobacterium avium subsp. paratuberculosis
ucgaccugggucaucaccuu

SEQ ID NO: 978170 - RNA, 21 nt, Mycobacterium avium subsp. paratuberculosis
ucgacgagguugucccgggcg

SEQ ID NO: 978171 - RNA, 17 nt, Mycobacterium avium subsp. paratuberculosis
ucgacgccaugggccca

SEQ ID NO: 978172 - RNA, 13 nt, Mycobacterium avium subsp. paratuberculosis
ucgacgcccugcc

SEQ ID NO: 978173 - RNA, 16 nt, Mycobacterium avium subsp. paratuberculosis
ucgacgagcaggcuga

SEQ ID NO: 978174 - RNA, 22 nt, Mycobacterium avium subsp. paratuberculosis
ucgacgaugaaauccgggaccg

SEQ ID NO: 978175 - RNA, 14 nt, Mycobacterium avium subsp. paratuberculosis
ucgacggugcugcc

SEQ ID NO: 978176 - RNA, 22 nt, Mycobacterium avium subsp. paratuberculosis
ucgacgguugccucggccagca

SEQ ID NO: 978177 - RNA, 19 nt, Mycobacterium avium subsp. paratuberculosis
ucgacgucauccggcugcc

SEQ ID NO: 978178 - RNA, 15 nt, Mycobacterium avium subsp. paratuberculosis
ucgacgguuugcccg

SEQ ID NO: 978179 - RNA, 15 nt, Mycobacterium avium subsp. paratuberculosis
ucgacguccaggccg

SEQ ID NO: 978180 - RNA, 17 nt, Mycobacterium avium subsp. paratuberculosis
ucgacguccaggccggc

SEQ ID NO: 978181 - RNA, 16 nt, Mycobacterium avium subsp. paratuberculosis
ucgacguggugcaccg

SEQ ID NO: 978182 - RNA, 18 nt, Mycobacterium avium subsp. paratuberculosis
ucgacguggugcaccgcc

SEQ ID NO: 978183 - RNA, 23 nt, Mycobacterium avium subsp. paratuberculosis
ucgacguggugcaccgccagcgc

SEQ ID NO: 978184 - RNA, 17 nt, Mycobacterium avium subsp. paratuberculosis
ucgacgggccaccagcg

SEQ ID NO: 978185 - RNA, 15 nt, Mycobacterium avium subsp. paratuberculosis
ucgacggccgcgccg

SEQ ID NO: 978186 - RNA, 15 nt, Mycobacterium avium subsp. paratuberculosis
ucgacgcugagcacc

SEQ ID NO: 978187 - RNA, 14 nt, Mycobacterium avium subsp. paratuberculosis
ucgacgccgggcag

SEQ ID NO: 978188 - RNA, 18 nt, Mycobacterium avium subsp. paratuberculosis
ucgacggaucgcccuggc

SEQ ID NO: 978189 - RNA, 20 nt, Mycobacterium avium subsp. paratuberculosis
ucgacgccucggugcggaac

SEQ ID NO: 978190 - RNA, 17 nt, Mycobacterium avium subsp. paratuberculosis
ucgacgcgaccggcccg

SEQ ID NO: 978191 - RNA, 20 nt, Mycobacterium avium subsp. paratuberculosis
ucgacgcgcacccgggaccg

SEQ ID NO: 978192 - RNA, 22 nt, Mycobacterium avium subsp. paratuberculosis
ucgacgcgcugcuugacccgcu

SEQ ID NO: 978193 - RNA, 21 nt, Mycobacterium avium subsp. paratuberculosis
ucgacgccgcgguggccggga

SEQ ID NO: 978194 - RNA, 14 nt, Mycobacterium avium subsp. paratuberculosis
ucgacgccgcugcc

SEQ ID NO: 978195 - RNA, 16 nt, Mycobacterium avium subsp. paratuberculosis
ucgacaccgcacggcc

SEQ ID NO: 978196 - RNA, 14 nt, Mycobacterium avium subsp. paratuberculosis
ucgaagaagagggc

SEQ ID NO: 978197 - RNA, 23 nt, Mycobacterium avium subsp. paratuberculosis
ucgaacggcggaaccgggccgcu

SEQ ID NO: 978198 - RNA, 22 nt, Mycobacterium avium subsp. paratuberculosis
ucgaaccgccgcgcucgcacca

SEQ ID NO: 978199 - RNA, 13 nt, Mycobacterium avium subsp. paratuberculosis
ucgaaggccaggu

SEQ ID NO: 978200 - RNA, 13 nt, Mycobacterium avium subsp. paratuberculosis
ucgaaggccugga

SEQ ID NO: 978201 - RNA, 19 nt, Mycobacterium avium subsp. paratuberculosis
ucgaaggucugcagcagcc

SEQ ID NO: 978202 - RNA, 23 nt, Mycobacterium avium subsp. paratuberculosis
ucgaagaucgccugcagggauuc

SEQ ID NO: 978203 - RNA, 16 nt, Mycobacterium avium subsp. paratuberculosis
ucgaagcgcagcagcu

SEQ ID NO: 978204 - RNA, 16 nt, Mycobacterium avium subsp. paratuberculosis
ucgaagcggugcacca

SEQ ID NO: 978205 - RNA, 16 nt, Mycobacterium avium subsp. paratuberculosis
ucgaaauagcggcgca

SEQ ID NO: 978206 - RNA, 20 nt, Mycobacterium avium subsp. paratuberculosis
ucgaaacggaugggcgaggg

SEQ ID NO: 978207 - RNA, 20 nt, Mycobacterium avium subsp. paratuberculosis
ucgaaaagcuucuugcugcc

SEQ ID NO: 978208 - RNA, 21 nt, Mycobacterium avium subsp. paratuberculosis
ucgaacagguuugagcgugcc

SEQ ID NO: 978209 - RNA, 19 nt, Mycobacterium avium subsp. paratuberculosis
ucgaacagcgggcagagcu

SEQ ID NO: 978210 - RNA, 19 nt, Mycobacterium avium subsp. paratuberculosis
ucgaacacgccgucguggg

SEQ ID NO: 978211 - RNA, 17 nt, Mycobacterium avium subsp. paratuberculosis
uccuugggcauggugaa

SEQ ID NO: 978212 - RNA, 13 nt, Mycobacterium avium subsp. paratuberculosis
uccuuggccaggc

SEQ ID NO: 978213 - RNA, 14 nt, Mycobacterium avium subsp. paratuberculosis
uccuuggccaggcg

SEQ ID NO: 978214 - RNA, 13 nt, Mycobacterium avium subsp. paratuberculosis
uccuuggccgcca

SEQ ID NO: 978215 - RNA, 12 nt, Mycobacterium avium subsp. paratuberculosis
uccuugagcccc

SEQ ID NO: 978216 - RNA, 22 nt, Mycobacterium avium subsp. paratuberculosis
uccuugacgaacgacguguuca

SEQ ID NO: 978217 - RNA, 13 nt, Mycobacterium avium subsp. paratuberculosis
uccgauaccagcc

SEQ ID NO: 978218 - RNA, 17 nt, Mycobacterium avium subsp. paratuberculosis
uccgaguuggccggcac

SEQ ID NO: 978219 - RNA, 22 nt, Mycobacterium avium subsp. paratuberculosis
uccgagcgcugcccgugccgca

SEQ ID NO: 978220 - RNA, 13 nt, Mycobacterium avium subsp. paratuberculosis
uccgaggucagcg

SEQ ID NO: 978221 - RNA, 14 nt, Mycobacterium avium subsp. paratuberculosis
uccgaggccccgcc

SEQ ID NO: 978222 - RNA, 21 nt, Mycobacterium avium subsp. paratuberculosis
uccgaggcgucagggguuggc

SEQ ID NO: 978223 - RNA, 21 nt, Mycobacterium avium subsp. paratuberculosis
uccgaggcguccuccucgucc

SEQ ID NO: 978224 - RNA, 14 nt, Mycobacterium avium subsp. paratuberculosis
uccgaucagcagca

SEQ ID NO: 978225 - RNA, 15 nt, Mycobacterium avium subsp. paratuberculosis
uccgaucagcagcac

SEQ ID NO: 978226 - RNA, 14 nt, Mycobacterium avium subsp. paratuberculosis
uccgcaacgcggcg

SEQ ID NO: 978227 - RNA, 15 nt, Mycobacterium avium subsp. paratuberculosis
uccgcacccgggccc

SEQ ID NO: 978228 - RNA, 16 nt, Mycobacterium avium subsp. paratuberculosis
uccgcaugucgaagaa

SEQ ID NO: 978229 - RNA, 16 nt, Mycobacterium avium subsp. paratuberculosis
uccgcagccgcugccg

SEQ ID NO: 978230 - RNA, 20 nt, Mycobacterium avium subsp. paratuberculosis
uccgcagauacaucucggug

SEQ ID NO: 978231 - RNA, 15 nt, Mycobacterium avium subsp. paratuberculosis
uccgccaccuccucc

SEQ ID NO: 978232 - RNA, 16 nt, Mycobacterium avium subsp. paratuberculosis
uccgccaccuccuccg

SEQ ID NO: 978233 - RNA, 21 nt, Mycobacterium avium subsp. paratuberculosis
uccgccaccuccuccgguccg

SEQ ID NO: 978234 - RNA, 23 nt, Mycobacterium avium subsp. paratuberculosis
uccgccaccuccuccgguccggg

SEQ ID NO: 978235 - RNA, 13 nt, Mycobacterium avium subsp. paratuberculosis
uccgcgucggccc

SEQ ID NO: 978236 - RNA, 20 nt, Mycobacterium avium subsp. paratuberculosis
uccgcgguccuccuggauga

SEQ ID NO: 978237 - RNA, 19 nt, Mycobacterium avium subsp. paratuberculosis
uccgcggucgaccaagacg

SEQ ID NO: 978238 - RNA, 18 nt, Mycobacterium avium subsp. paratuberculosis
uccgcgguuuggucagcg

SEQ ID NO: 978239 - RNA, 21 nt, Mycobacterium avium subsp. paratuberculosis
uccgcgguuuggucagcgccc

SEQ ID NO: 978240 - RNA, 17 nt, Mycobacterium avium subsp. paratuberculosis
uccgcggccgcggcgcg

SEQ ID NO: 978241 - RNA, 11 nt, Mycobacterium avium subsp. paratuberculosis
uccgcggcgcc

SEQ ID NO: 978242 - RNA, 15 nt, Mycobacterium avium subsp. paratuberculosis
uccgcggcgccguag

SEQ ID NO: 978243 - RNA, 14 nt, Mycobacterium avium subsp. paratuberculosis
uccgcgcuggcguu

SEQ ID NO: 978244 - RNA, 19 nt, Mycobacterium avium subsp. paratuberculosis
uccgcggaggcgagcagcc

SEQ ID NO: 978245 - RNA, 20 nt, Mycobacterium avium subsp. paratuberculosis
uccgcgccggucccgcggcg

SEQ ID NO: 978246 - RNA, 17 nt, Mycobacterium avium subsp. paratuberculosis
uccgcgcgagcgcgcug

SEQ ID NO: 978247 - RNA, 15 nt, Mycobacterium avium subsp. paratuberculosis
uccgcgcgcggcacg

SEQ ID NO: 978248 - RNA, 12 nt, Mycobacterium avium subsp. paratuberculosis
uccgcgcggcca

SEQ ID NO: 978249 - RNA, 15 nt, Mycobacterium avium subsp. paratuberculosis
uccgcgcagcagcgu

SEQ ID NO: 978250 - RNA, 18 nt, Mycobacterium avium subsp. paratuberculosis
uccgcgaucgucucgucg

SEQ ID NO: 978251 - RNA, 16 nt, Mycobacterium avium subsp. paratuberculosis
uccgcgagccgagccg

SEQ ID NO: 978252 - RNA, 14 nt, Mycobacterium avium subsp. paratuberculosis
uccgcgacgacacc

SEQ ID NO: 978253 - RNA, 19 nt, Mycobacterium avium subsp. paratuberculosis
uccgcgacgccaacaacua

SEQ ID NO: 978254 - RNA, 21 nt, Mycobacterium avium subsp. paratuberculosis
uccgcgacaucggcgccgacg

SEQ ID NO: 978255 - RNA, 20 nt, Mycobacterium avium subsp. paratuberculosis
uccgcgaaauugauagcuuc

SEQ ID NO: 978256 - RNA, 13 nt, Mycobacterium avium subsp. paratuberculosis
uccgccgcgcccg

SEQ ID NO: 978257 - RNA, 23 nt, Mycobacterium avium subsp. paratuberculosis
uccgccggagacgacucuuccag

SEQ ID NO: 978258 - RNA, 19 nt, Mycobacterium avium subsp. paratuberculosis
uccgccgcagcggcgccgc

SEQ ID NO: 978259 - RNA, 15 nt, Mycobacterium avium subsp. paratuberculosis
uccgccgccagcgcc

SEQ ID NO: 978260 - RNA, 15 nt, Mycobacterium avium subsp. paratuberculosis
uccgccgccgggccu

SEQ ID NO: 978261 - RNA, 17 nt, Mycobacterium avium subsp. paratuberculosis
uccgccgccgucccacc

SEQ ID NO: 978262 - RNA, 23 nt, Mycobacterium avium subsp. paratuberculosis
uccgcccguagaugcggcccagc

SEQ ID NO: 978263 - RNA, 14 nt, Mycobacterium avium subsp. paratuberculosis
uccgcccggcccgc

SEQ ID NO: 978264 - RNA, 11 nt, Mycobacterium avium subsp. paratuberculosis
uccgcccggcg

SEQ ID NO: 978265 - RNA, 19 nt, Mycobacterium avium subsp. paratuberculosis
uccgccccgagaucccagc

SEQ ID NO: 978266 - RNA, 17 nt, Mycobacterium avium subsp. paratuberculosis
uccgacgauccgggccg

SEQ ID NO: 978267 - RNA, 19 nt, Mycobacterium avium subsp. paratuberculosis
uccgacggcugcgguuggc

SEQ ID NO: 978268 - RNA, 13 nt, Mycobacterium avium subsp. paratuberculosis
uccgacggcuggg

SEQ ID NO: 978269 - RNA, 10 nt, Mycobacterium avium subsp. paratuberculosis
ucccuuguug

SEQ ID NO: 978270 - RNA, 19 nt, Mycobacterium avium subsp. paratuberculosis
uccgaacgugcagcuuccg

SEQ ID NO: 978271 - RNA, 16 nt, Mycobacterium avium subsp. paratuberculosis
uccgacagcccccgca

SEQ ID NO: 978272 - RNA, 20 nt, Mycobacterium avium subsp. paratuberculosis
uccgaccagcacccgggccu

SEQ ID NO: 978273 - RNA, 15 nt, Mycobacterium avium subsp. paratuberculosis
ucccuccggcaggcc

SEQ ID NO: 978274 - RNA, 18 nt, Mycobacterium avium subsp. paratuberculosis
ucccugacacgaccgccu

SEQ ID NO: 978275 - RNA, 13 nt, Mycobacterium avium subsp. paratuberculosis
ucccguuggucuc

SEQ ID NO: 978276 - RNA, 21 nt, Mycobacterium avium subsp. paratuberculosis
ucccuagcgugccguccagcu

SEQ ID NO: 978277 - RNA, 18 nt, Mycobacterium avium subsp. paratuberculosis
ucccugagcuuuucgucg

SEQ ID NO: 978278 - RNA, 21 nt, Mycobacterium avium subsp. paratuberculosis
ucccugcucgucgacgcugac

SEQ ID NO: 978279 - RNA, 20 nt, Mycobacterium avium subsp. paratuberculosis
ucccugcggcugcaucaugc

SEQ ID NO: 978280 - RNA, 16 nt, Mycobacterium avium subsp. paratuberculosis
ucccgcgagcugcccc

SEQ ID NO: 978281 - RNA, 16 nt, Mycobacterium avium subsp. paratuberculosis
ucccgcgccgcggcca

SEQ ID NO: 978282 - RNA, 20 nt, Mycobacterium avium subsp. paratuberculosis
ucccgcgccgcggccagcgc

SEQ ID NO: 978283 - RNA, 15 nt, Mycobacterium avium subsp. paratuberculosis
ucccgcggcggcgcc

SEQ ID NO: 978284 - RNA, 18 nt, Mycobacterium avium subsp. paratuberculosis
ucccgcgggucgcggccc

SEQ ID NO: 978285 - RNA, 20 nt, Mycobacterium avium subsp. paratuberculosis
ucccgcaauugcgccagcag

SEQ ID NO: 978286 - RNA, 22 nt, Mycobacterium avium subsp. paratuberculosis
ucccgcaauugcgccagcagca

SEQ ID NO: 978287 - RNA, 12 nt, Mycobacterium avium subsp. paratuberculosis
ucccgccgaccc

SEQ ID NO: 978288 - RNA, 15 nt, Mycobacterium avium subsp. paratuberculosis
ucccgcccggcgccg

SEQ ID NO: 978289 - RNA, 17 nt, Mycobacterium avium subsp. paratuberculosis
ucccgccgaacccgccc

SEQ ID NO: 978290 - RNA, 14 nt, Mycobacterium avium subsp. paratuberculosis
ucccgccgccgaac

SEQ ID NO: 978291 - RNA, 21 nt, Mycobacterium avium subsp. paratuberculosis
ucccgccgccgucgguguagc

SEQ ID NO: 978292 - RNA, 23 nt, Mycobacterium avium subsp. paratuberculosis
ucccgccggaugcggcucccacc

SEQ ID NO: 978293 - RNA, 20 nt, Mycobacterium avium subsp. paratuberculosis
ucccgccggugaucucccgu

SEQ ID NO: 978294 - RNA, 14 nt, Mycobacterium avium subsp. paratuberculosis
ucccguccugggcc

SEQ ID NO: 978295 - RNA, 18 nt, Mycobacterium avium subsp. paratuberculosis
ucccgucggccaucagcc

SEQ ID NO: 978296 - RNA, 21 nt, Mycobacterium avium subsp. paratuberculosis
ucccguaggucgccuccaggu

SEQ ID NO: 978297 - RNA, 17 nt, Mycobacterium avium subsp. paratuberculosis
ucccgugcgccgcccac

SEQ ID NO: 978298 - RNA, 20 nt, Mycobacterium avium subsp. paratuberculosis
ucccggugaugccggcaucc

SEQ ID NO: 978299 - RNA, 14 nt, Mycobacterium avium subsp. paratuberculosis
ucccggugucgccg

SEQ ID NO: 978300 - RNA, 13 nt, Mycobacterium avium subsp. paratuberculosis
ucccggccacccc

SEQ ID NO: 978301 - RNA, 19 nt, Mycobacterium avium subsp. paratuberculosis
ucccggcagaucgcggccc

SEQ ID NO: 978302 - RNA, 20 nt, Mycobacterium avium subsp. paratuberculosis
ucccggccgccgggacgggc

SEQ ID NO: 978303 - RNA, 18 nt, Mycobacterium avium subsp. paratuberculosis
ucccggcgggcagguuca

SEQ ID NO: 978304 - RNA, 16 nt, Mycobacterium avium subsp. paratuberculosis
ucccggcgcaccaggc

SEQ ID NO: 978305 - RNA, 14 nt, Mycobacterium avium subsp. paratuberculosis
ucccggcgccgccg

SEQ ID NO: 978306 - RNA, 15 nt, Mycobacterium avium subsp. paratuberculosis
ucccgggggaagccc

SEQ ID NO: 978307 - RNA, 21 nt, Mycobacterium avium subsp. paratuberculosis
ucccgggggaagcccagcacc

SEQ ID NO: 978308 - RNA, 12 nt, Mycobacterium avium subsp. paratuberculosis
uccccuuuggcg

SEQ ID NO: 978309 - RNA, 20 nt, Mycobacterium avium subsp. paratuberculosis
ucccgaugucggcgaacacc

SEQ ID NO: 978310 - RNA, 13 nt, Mycobacterium avium subsp. paratuberculosis
ucccgacuccuca

SEQ ID NO: 978311 - RNA, 15 nt, Mycobacterium avium subsp. paratuberculosis
ucccgacuccucaca

SEQ ID NO: 978312 - RNA, 16 nt, Mycobacterium avium subsp. paratuberculosis
ucccgacuccucacac

SEQ ID NO: 978313 - RNA, 13 nt, Mycobacterium avium subsp. paratuberculosis
ucccgacgcggcg

SEQ ID NO: 978314 - RNA, 15 nt, Mycobacterium avium subsp. paratuberculosis
ucccgacgcggcgcg

SEQ ID NO: 978315 - RNA, 14 nt, Mycobacterium avium subsp. paratuberculosis
uccccguccagccc

SEQ ID NO: 978316 - RNA, 15 nt, Mycobacterium avium subsp. paratuberculosis
uccccggccagcacg

SEQ ID NO: 978317 - RNA, 21 nt, Mycobacterium avium subsp. paratuberculosis
uccccgggcccagcaccacca

SEQ ID NO: 978318 - RNA, 13 nt, Mycobacterium avium subsp. paratuberculosis
uccccggcggccg

SEQ ID NO: 978319 - RNA, 17 nt, Mycobacterium avium subsp. paratuberculosis
uccccggcggccggccc

SEQ ID NO: 978320 - RNA, 22 nt, Mycobacterium avium subsp. paratuberculosis
uccccggcgggcucgccggccc

SEQ ID NO: 978321 - RNA, 16 nt, Mycobacterium avium subsp. paratuberculosis
uccccggcgugucgcg

SEQ ID NO: 978322 - RNA, 18 nt, Mycobacterium avium subsp. paratuberculosis
uccccgauuucgcggccg

SEQ ID NO: 978323 - RNA, 17 nt, Mycobacterium avium subsp. paratuberculosis
uccccgaccacaccggc

SEQ ID NO: 978324 - RNA, 20 nt, Mycobacterium avium subsp. paratuberculosis
uccccgaccacaccggcgcu

SEQ ID NO: 978325 - RNA, 15 nt, Mycobacterium avium subsp. paratuberculosis
uccccgcggugccgc

SEQ ID NO: 978326 - RNA, 21 nt, Mycobacterium avium subsp. paratuberculosis
uccccgcguuggccagcgccu

SEQ ID NO: 978327 - RNA, 23 nt, Mycobacterium avium subsp. paratuberculosis
ucccacguggugaucagcauccg

SEQ ID NO: 978328 - RNA, 14 nt, Mycobacterium avium subsp. paratuberculosis
ucccacugcccgua

SEQ ID NO: 978329 - RNA, 19 nt, Mycobacterium avium subsp. paratuberculosis
ucccagaauucgccggggc

SEQ ID NO: 978330 - RNA, 21 nt, Mycobacterium avium subsp. paratuberculosis
ucccagccgccggccaccagg

SEQ ID NO: 978331 - RNA, 13 nt, Mycobacterium avium subsp. paratuberculosis
ucccaggccagga

SEQ ID NO: 978332 - RNA, 17 nt, Mycobacterium avium subsp. paratuberculosis
ucccaggguuggucgga

SEQ ID NO: 978333 - RNA, 16 nt, Mycobacterium avium subsp. paratuberculosis
ucccaggcguggucgg

SEQ ID NO: 978334 - RNA, 22 nt, Mycobacterium avium subsp. paratuberculosis
ucccaguuguuuccccagcccg

SEQ ID NO: 978335 - RNA, 16 nt, Mycobacterium avium subsp. paratuberculosis
ucccaguccggccagc

SEQ ID NO: 978336 - RNA, 15 nt, Mycobacterium avium subsp. paratuberculosis
ucccaucagugcggc

SEQ ID NO: 978337 - RNA, 22 nt, Mycobacterium avium subsp. paratuberculosis
ucccaucggggcuacaaaacca

SEQ ID NO: 978338 - RNA, 19 nt, Mycobacterium avium subsp. paratuberculosis
ucccccaaaacccggcauu

SEQ ID NO: 978339 - RNA, 13 nt, Mycobacterium avium subsp. paratuberculosis
ucccccacccgca

SEQ ID NO: 978340 - RNA, 15 nt, Mycobacterium avium subsp. paratuberculosis
ucccccgccgaccgg

SEQ ID NO: 978341 - RNA, 13 nt, Mycobacterium avium subsp. paratuberculosis
ucccccgacccgc

SEQ ID NO: 978342 - RNA, 13 nt, Mycobacterium avium subsp. paratuberculosis
uccccccgcgccg

SEQ ID NO: 978343 - RNA, 16 nt, Mycobacterium avium subsp. paratuberculosis
uccccauccgcggcca

SEQ ID NO: 978344 - RNA, 18 nt, Mycobacterium avium subsp. paratuberculosis
uccccaccaggcgcgggc

SEQ ID NO: 978345 - RNA, 15 nt, Mycobacterium avium subsp. paratuberculosis
uccauugggccgcgg

SEQ ID NO: 978346 - RNA, 15 nt, Mycobacterium avium subsp. paratuberculosis
uccauucgggccagc

SEQ ID NO: 978347 - RNA, 22 nt, Mycobacterium avium subsp. paratuberculosis
ucccacauucggcgaaccaggc

SEQ ID NO: 978348 - RNA, 17 nt, Mycobacterium avium subsp. paratuberculosis
uccauggugaacugguu

SEQ ID NO: 978349 - RNA, 15 nt, Mycobacterium avium subsp. paratuberculosis
uccauggccuugacg

SEQ ID NO: 978350 - RNA, 19 nt, Mycobacterium avium subsp. paratuberculosis
uccaugucgucggcggacu

SEQ ID NO: 978351 - RNA, 19 nt, Mycobacterium avium subsp. paratuberculosis
uccauguaguucagcagcc

SEQ ID NO: 978352 - RNA, 17 nt, Mycobacterium avium subsp. paratuberculosis
uccaugaaccggucguu

SEQ ID NO: 978353 - RNA, 20 nt, Mycobacterium avium subsp. paratuberculosis
uccaugaaccggucguuggc

SEQ ID NO: 978354 - RNA, 19 nt, Mycobacterium avium subsp. paratuberculosis
uccaucagcgcccgcgcgg

SEQ ID NO: 978355 - RNA, 16 nt, Mycobacterium avium subsp. paratuberculosis
uccauccgcuugccgc

SEQ ID NO: 978356 - RNA, 19 nt, Mycobacterium avium subsp. paratuberculosis
uccaucgacgcugagucua

SEQ ID NO: 978357 - RNA, 15 nt, Mycobacterium avium subsp. paratuberculosis
uccaucccgcugaag

SEQ ID NO: 978358 - RNA, 19 nt, Mycobacterium avium subsp. paratuberculosis
uccaguucggccagcgcgg

SEQ ID NO: 978359 - RNA, 23 nt, Mycobacterium avium subsp. paratuberculosis
uccagguguaggcguggcaggcc

SEQ ID NO: 978360 - RNA, 14 nt, Mycobacterium avium subsp. paratuberculosis
uccagguggccaug

SEQ ID NO: 978361 - RNA, 17 nt, Mycobacterium avium subsp. paratuberculosis
uccaggugaacagcagc

SEQ ID NO: 978362 - RNA, 18 nt, Mycobacterium avium subsp. paratuberculosis
uccaggugaacagcagcc

SEQ ID NO: 978363 - RNA, 15 nt, Mycobacterium avium subsp. paratuberculosis
uccagguccuugaac

SEQ ID NO: 978364 - RNA, 18 nt, Mycobacterium avium subsp. paratuberculosis
uccaggcguucgacccca

SEQ ID NO: 978365 - RNA, 20 nt, Mycobacterium avium subsp. paratuberculosis
uccaggcguucgaccccaac

SEQ ID NO: 978366 - RNA, 15 nt, Mycobacterium avium subsp. paratuberculosis
uccagucggccguga

SEQ ID NO: 978367 - RNA, 16 nt, Mycobacterium avium subsp. paratuberculosis
uccaguccggccguga

SEQ ID NO: 978368 - RNA, 23 nt, Mycobacterium avium subsp. paratuberculosis
uccaguggcugucgggugccgcc

SEQ ID NO: 978369 - RNA, 16 nt, Mycobacterium avium subsp. paratuberculosis
uccagcgucgcggccg

SEQ ID NO: 978370 - RNA, 20 nt, Mycobacterium avium subsp. paratuberculosis
uccagcgucgcggccgggaa

SEQ ID NO: 978371 - RNA, 16 nt, Mycobacterium avium subsp. paratuberculosis
uccaggaccgcgcgcc

SEQ ID NO: 978372 - RNA, 23 nt, Mycobacterium avium subsp. paratuberculosis
uccaggaugagcugggcggcgcg

SEQ ID NO: 978373 - RNA, 15 nt, Mycobacterium avium subsp. paratuberculosis
uccagcggcggccuu

SEQ ID NO: 978374 - RNA, 15 nt, Mycobacterium avium subsp. paratuberculosis
uccagcggguccagc

SEQ ID NO: 978375 - RNA, 17 nt, Mycobacterium avium subsp. paratuberculosis
uccagcggguugccgcu

SEQ ID NO: 978376 - RNA, 22 nt, Mycobacterium avium subsp. paratuberculosis
uccagcgccggcaccagcagcc

SEQ ID NO: 978377 - RNA, 13 nt, Mycobacterium avium subsp. paratuberculosis
uccagcgccgcca

SEQ ID NO: 978378 - RNA, 16 nt, Mycobacterium avium subsp. paratuberculosis
uccagcgcggucucga

SEQ ID NO: 978379 - RNA, 20 nt, Mycobacterium avium subsp. paratuberculosis
uccagcgcggugagcagcau

SEQ ID NO: 978380 - RNA, 17 nt, Mycobacterium avium subsp. paratuberculosis
uccagcgcgucgcugcc

SEQ ID NO: 978381 - RNA, 18 nt, Mycobacterium avium subsp. paratuberculosis
uccagcgcgucgcugccg

SEQ ID NO: 978382 - RNA, 17 nt, Mycobacterium avium subsp. paratuberculosis
uccagcaggcuggcguu

SEQ ID NO: 978383 - RNA, 15 nt, Mycobacterium avium subsp. paratuberculosis
uccagcaggcgcgcc

SEQ ID NO: 978384 - RNA, 11 nt, Mycobacterium avium subsp. paratuberculosis
uccagcaggcu

SEQ ID NO: 978385 - RNA, 13 nt, Mycobacterium avium subsp. paratuberculosis
uccagaacucggc

SEQ ID NO: 978386 - RNA, 13 nt, Mycobacterium avium subsp. paratuberculosis
uccagaacagcca

SEQ ID NO: 978387 - RNA, 23 nt, Mycobacterium avium subsp. paratuberculosis
uccacccccuacgccguggccug

SEQ ID NO: 978388 - RNA, 21 nt, Mycobacterium avium subsp. paratuberculosis
uccaccauggcuuccgccgag

SEQ ID NO: 978389 - RNA, 15 nt, Mycobacterium avium subsp. paratuberculosis
uccaccaucuuccau

SEQ ID NO: 978390 - RNA, 12 nt, Mycobacterium avium subsp. paratuberculosis
uccaccagguga

SEQ ID NO: 978391 - RNA, 20 nt, Mycobacterium avium subsp. paratuberculosis
uccaccagguucgcgcagcu

SEQ ID NO: 978392 - RNA, 22 nt, Mycobacterium avium subsp. paratuberculosis
uccacgucgcgauagggccggc

SEQ ID NO: 978393 - RNA, 15 nt, Mycobacterium avium subsp. paratuberculosis
uccacggucagcgcg

SEQ ID NO: 978394 - RNA, 16 nt, Mycobacterium avium subsp. paratuberculosis
uccacggucagcgcgu

SEQ ID NO: 978395 - RNA, 22 nt, Mycobacterium avium subsp. paratuberculosis
uccacgaccuggcgggccagcu

SEQ ID NO: 978396 - RNA, 17 nt, Mycobacterium avium subsp. paratuberculosis
uccacgcccggacccgc

SEQ ID NO: 978397 - RNA, 22 nt, Mycobacterium avium subsp. paratuberculosis
uccaagccgggcggcagcagcu

SEQ ID NO: 978398 - RNA, 13 nt, Mycobacterium avium subsp. paratuberculosis
uccaacgcggcca

SEQ ID NO: 978399 - RNA, 19 nt, Mycobacterium avium subsp. paratuberculosis
uccaaccaccguggcccca

SEQ ID NO: 978400 - RNA, 22 nt, Mycobacterium avium subsp. paratuberculosis
ucaugugguugggccaggccuc

SEQ ID NO: 978401 - RNA, 20 nt, Mycobacterium avium subsp. paratuberculosis
ucaguucguucauccggguu

SEQ ID NO: 978402 - RNA, 20 nt, Mycobacterium avium subsp. paratuberculosis
ucaguuggucgaugucggug

SEQ ID NO: 978403 - RNA, 19 nt, Mycobacterium avium subsp. paratuberculosis
ugaaacuagcuucacgguc

SEQ ID NO: 978404 - RNA, 19 nt, Mycobacterium avium subsp. paratuberculosis
ugaaacuagcuucacguuc

SEQ ID NO: 978405 - RNA, 19 nt, Mycobacterium avium subsp. paratuberculosis
ugaaguaguacgaccgcga

SEQ ID NO: 978406 - RNA, 19 nt, Mycobacterium avium subsp. paratuberculosis
ugaaggaggcggucgacug

SEQ ID NO: 978407 - RNA, 21 nt, Mycobacterium avium subsp. paratuberculosis
ugaaggaggcggucgacuggu

SEQ ID NO: 978408 - RNA, 16 nt, Mycobacterium avium subsp. paratuberculosis
ugaagucguucuccag

SEQ ID NO: 978409 - RNA, 16 nt, Mycobacterium avium subsp. paratuberculosis
ugaagucggugcccag

SEQ ID NO: 978410 - RNA, 16 nt, Mycobacterium avium subsp. paratuberculosis
ugaacugguuccacac

SEQ ID NO: 978411 - RNA, 20 nt, Mycobacterium avium subsp. paratuberculosis
ugaacugguuccacaccacc

SEQ ID NO: 978412 - RNA, 19 nt, Mycobacterium avium subsp. paratuberculosis
ugaacuuaacuucacgcuc

SEQ ID NO: 978413 - RNA, 23 nt, Mycobacterium avium subsp. paratuberculosis
ugaacuucaccgucugcuggccc

SEQ ID NO: 978414 - RNA, 19 nt, Mycobacterium avium subsp. paratuberculosis
ugaagaagcgggccaaaga

SEQ ID NO: 978415 - RNA, 12 nt, Mycobacterium avium subsp. paratuberculosis
ugaagcccagcg

SEQ ID NO: 978416 - RNA, 22 nt, Mycobacterium avium subsp. paratuberculosis
ugaagacgcgaaagcagcguuc

SEQ ID NO: 978417 - RNA, 22 nt, Mycobacterium avium subsp. paratuberculosis
ugaagaccggaagccuguuggc

SEQ ID NO: 978418 - RNA, 15 nt, Mycobacterium avium subsp. paratuberculosis
ugaagaccuggccgg

SEQ ID NO: 978419 - RNA, 21 nt, Mycobacterium avium subsp. paratuberculosis
ugaacgcggugggcaccagca

SEQ ID NO: 978420 - RNA, 16 nt, Mycobacterium avium subsp. paratuberculosis
ugaacgcgccgucguc

SEQ ID NO: 978421 - RNA, 18 nt, Mycobacterium avium subsp. paratuberculosis
ugaaccuggccaccagca

SEQ ID NO: 978422 - RNA, 14 nt, Mycobacterium avium subsp. paratuberculosis
ugaaccugcugggc

SEQ ID NO: 978423 - RNA, 15 nt, Mycobacterium avium subsp. paratuberculosis
ugaacggcaccagcg

SEQ ID NO: 978424 - RNA, 15 nt, Mycobacterium avium subsp. paratuberculosis
ugaacucgcgggcga

SEQ ID NO: 978425 - RNA, 18 nt, Mycobacterium avium subsp. paratuberculosis
ugaacuccgacuccagca

SEQ ID NO: 978426 - RNA, 20 nt, Mycobacterium avium subsp. paratuberculosis
ugaacuccgggcccaccagg

SEQ ID NO: 978427 - RNA, 12 nt, Mycobacterium avium subsp. paratuberculosis
ugaacuccucga

SEQ ID NO: 978428 - RNA, 13 nt, Mycobacterium avium subsp. paratuberculosis
ugaacagcagcag

SEQ ID NO: 978429 - RNA, 18 nt, Mycobacterium avium subsp. paratuberculosis
ugaacagcagcagcagcg

SEQ ID NO: 978430 - RNA, 17 nt, Mycobacterium avium subsp. paratuberculosis
ucuuugaucucaucguc

SEQ ID NO: 978431 - RNA, 22 nt, Mycobacterium avium subsp. paratuberculosis
ucuuugguagucugcacugcgg

SEQ ID NO: 978432 - RNA, 16 nt, Mycobacterium avium subsp. paratuberculosis
ucuuggacagcagcag

SEQ ID NO: 978433 - RNA, 15 nt, Mycobacterium avium subsp. paratuberculosis
ucuuggacagcagca

SEQ ID NO: 978434 - RNA, 12 nt, Mycobacterium avium subsp. paratuberculosis
ucuuggccgcgg

SEQ ID NO: 978435 - RNA, 12 nt, Mycobacterium avium subsp. paratuberculosis
ucuuggccggag

SEQ ID NO: 978436 - RNA, 16 nt, Mycobacterium avium subsp. paratuberculosis
ucuuggucagcggcag

SEQ ID NO: 978437 - RNA, 12 nt, Mycobacterium avium subsp. paratuberculosis
ucuugcagccgg

SEQ ID NO: 978438 - RNA, 21 nt, Mycobacterium avium subsp. paratuberculosis
ucuugccggcuuccucgcgga

SEQ ID NO: 978439 - RNA, 21 nt, Mycobacterium avium subsp. paratuberculosis
ucuucuuggcgggcgacuucu

SEQ ID NO: 978440 - RNA, 18 nt, Mycobacterium avium subsp. paratuberculosis
ucuugaccgcagccuucu

SEQ ID NO: 978441 - RNA, 17 nt, Mycobacterium avium subsp. paratuberculosis
ucuugacggcgacggcg

SEQ ID NO: 978442 - RNA, 21 nt, Mycobacterium avium subsp. paratuberculosis
ucuugaacgcguacagcgccc

SEQ ID NO: 978443 - RNA, 16 nt, Mycobacterium avium subsp. paratuberculosis
ucuucgacgauguugg

SEQ ID NO: 978444 - RNA, 15 nt, Mycobacterium avium subsp. paratuberculosis
ucuucuuccugcuug

SEQ ID NO: 978445 - RNA, 18 nt, Mycobacterium avium subsp. paratuberculosis
ucuucucgaagcgcagca

SEQ ID NO: 978446 - RNA, 22 nt, Mycobacterium avium subsp. paratuberculosis
ucuucucgaagcgcagcagcuc

SEQ ID NO: 978447 - RNA, 18 nt, Mycobacterium avium subsp. paratuberculosis
ucuucucguucugcgugc

SEQ ID NO: 978448 - RNA, 14 nt, Mycobacterium avium subsp. paratuberculosis
ucuucccgccgccg

SEQ ID NO: 978449 - RNA, 15 nt, Mycobacterium avium subsp. paratuberculosis
ucuucccgccgccgu

SEQ ID NO: 978450 - RNA, 23 nt, Mycobacterium avium subsp. paratuberculosis
ucuucaugugguugggccaggcc

SEQ ID NO: 978451 - RNA, 13 nt, Mycobacterium avium subsp. paratuberculosis
ucugcccugcacu

SEQ ID NO: 978452 - RNA, 15 nt, Mycobacterium avium subsp. paratuberculosis
ucugcccugcacuuc

SEQ ID NO: 978453 - RNA, 15 nt, Mycobacterium avium subsp. paratuberculosis
ucugcccggccagca

SEQ ID NO: 978454 - RNA, 17 nt, Mycobacterium avium subsp. paratuberculosis
ucugcccggccagcagg

SEQ ID NO: 978455 - RNA, 20 nt, Mycobacterium avium subsp. paratuberculosis
ucugcgccgugaagggcccg

SEQ ID NO: 978456 - RNA, 21 nt, Mycobacterium avium subsp. paratuberculosis
ucugcgccuuuugcacccgcc

SEQ ID NO: 978457 - RNA, 12 nt, Mycobacterium avium subsp. paratuberculosis
ucugcgccgccu

SEQ ID NO: 978458 - RNA, 18 nt, Mycobacterium avium subsp. paratuberculosis
ucugcgccgccuccgggc

SEQ ID NO: 978459 - RNA, 21 nt, Mycobacterium avium subsp. paratuberculosis
ucugcgccagcuccagcagcc

SEQ ID NO: 978460 - RNA, 13 nt, Mycobacterium avium subsp. paratuberculosis
ucugccugcagga

SEQ ID NO: 978461 - RNA, 17 nt, Mycobacterium avium subsp. paratuberculosis
ucugcucgccagacuca

SEQ ID NO: 978462 - RNA, 13 nt, Mycobacterium avium subsp. paratuberculosis
ucugcggccgcga

SEQ ID NO: 978463 - RNA, 14 nt, Mycobacterium avium subsp. paratuberculosis
ucugcggcucggcg

SEQ ID NO: 978464 - RNA, 20 nt, Mycobacterium avium subsp. paratuberculosis
ucuggaagccuggcacgacg

SEQ ID NO: 978465 - RNA, 17 nt, Mycobacterium avium subsp. paratuberculosis
ucuggaagauguccucg

SEQ ID NO: 978466 - RNA, 16 nt, Mycobacterium avium subsp. paratuberculosis
ucuggccggagcggug

SEQ ID NO: 978467 - RNA, 23 nt, Mycobacterium avium subsp. paratuberculosis
ucuggccgaucuugucgaccuug

SEQ ID NO: 978468 - RNA, 16 nt, Mycobacterium avium subsp. paratuberculosis
ucuggcccgccaucgc

SEQ ID NO: 978469 - RNA, 20 nt, Mycobacterium avium subsp. paratuberculosis
ucuggcgguuggacaggccg

SEQ ID NO: 978470 - RNA, 18 nt, Mycobacterium avium subsp. paratuberculosis
ucugaaaugccgggccgg

SEQ ID NO: 978471 - RNA, 12 nt, Mycobacterium avium subsp. paratuberculosis
ucucgucggccg

SEQ ID NO: 978472 - RNA, 19 nt, Mycobacterium avium subsp. paratuberculosis
ucucgucggcggcggccug

SEQ ID NO: 978473 - RNA, 20 nt, Mycobacterium avium subsp. paratuberculosis
ucucggcguacagcccgcgg

SEQ ID NO: 978474 - RNA, 17 nt, Mycobacterium avium subsp. paratuberculosis
ucucgggcaccacgccg

SEQ ID NO: 978475 - RNA, 16 nt, Mycobacterium avium subsp. paratuberculosis
ucucgggcagcagcac

SEQ ID NO: 978476 - RNA, 11 nt, Mycobacterium avium subsp. paratuberculosis
ugaccaccggc

SEQ ID NO: 978477 - RNA, 22 nt, Mycobacterium avium subsp. paratuberculosis
ugaccacccucagggagcugcc

SEQ ID NO: 978478 - RNA, 18 nt, Mycobacterium avium subsp. paratuberculosis
ugaccaccgaccggcucu

SEQ ID NO: 978479 - RNA, 17 nt, Mycobacterium avium subsp. paratuberculosis
ugaccacggcgcggaug

SEQ ID NO: 978480 - RNA, 13 nt, Mycobacterium avium subsp. paratuberculosis
ugacccagcgcgg

SEQ ID NO: 978481 - RNA, 18 nt, Mycobacterium avium subsp. paratuberculosis
ugaccccgguuucguugu

SEQ ID NO: 978482 - RNA, 17 nt, Mycobacterium avium subsp. paratuberculosis
ugaccccguugcacagg

SEQ ID NO: 978483 - RNA, 22 nt, Mycobacterium avium subsp. paratuberculosis
ugacccugccgucaccggccau

SEQ ID NO: 978484 - RNA, 14 nt, Mycobacterium avium subsp. paratuberculosis
ugacccucagcagg

SEQ ID NO: 978485 - RNA, 18 nt, Mycobacterium avium subsp. paratuberculosis
ugacccggcccaucaccg

SEQ ID NO: 978486 - RNA, 23 nt, Mycobacterium avium subsp. paratuberculosis
ugacccggcccaucaccggaccg

SEQ ID NO: 978487 - RNA, 15 nt, Mycobacterium avium subsp. paratuberculosis
ugaccaacgccgccu

SEQ ID NO: 978488 - RNA, 19 nt, Mycobacterium avium subsp. paratuberculosis
ugacauccccgguugucgc

SEQ ID NO: 978489 - RNA, 14 nt, Mycobacterium avium subsp. paratuberculosis
ugaccgugcuuggc

SEQ ID NO: 978490 - RNA, 21 nt, Mycobacterium avium subsp. paratuberculosis
ugaccgaggcgaucgcggcca

SEQ ID NO: 978491 - RNA, 24 nt, Mycobacterium avium subsp. paratuberculosis
ugaccgagucgucgcgcaccagcu

SEQ ID NO: 978492 - RNA, 17 nt, Mycobacterium avium subsp. paratuberculosis
ugaccgacauggccagc

SEQ ID NO: 978493 - RNA, 22 nt, Mycobacterium avium subsp. paratuberculosis
ugaccgacauggccagcaccau

SEQ ID NO: 978494 - RNA, 15 nt, Mycobacterium avium subsp. paratuberculosis
ugacgaacgccacca

SEQ ID NO: 978495 - RNA, 19 nt, Mycobacterium avium subsp. paratuberculosis
ugacgaacgcgccgcccac

SEQ ID NO: 978496 - RNA, 15 nt, Mycobacterium avium subsp. paratuberculosis
ugacgaccuugucgc

SEQ ID NO: 978497 - RNA, 20 nt, Mycobacterium avium subsp. paratuberculosis
ugacgaccuugucgcgcacc

SEQ ID NO: 978498 - RNA, 21 nt, Mycobacterium avium subsp. paratuberculosis
ugacgaccuugucgcgcaccc

SEQ ID NO: 978499 - RNA, 18 nt, Mycobacterium avium subsp. paratuberculosis
ugacgacguuggccagca

SEQ ID NO: 978500 - RNA, 18 nt, Mycobacterium avium subsp. paratuberculosis
ugacgaugauccuggccu

SEQ ID NO: 978501 - RNA, 19 nt, Mycobacterium avium subsp. paratuberculosis
ugacgcucggcgccggccg

SEQ ID NO: 978502 - RNA, 16 nt, Mycobacterium avium subsp. paratuberculosis
ugacgcucgacggccg

SEQ ID NO: 978503 - RNA, 18 nt, Mycobacterium avium subsp. paratuberculosis
ugacgcucgcguggccug

SEQ ID NO: 978504 - RNA, 22 nt, Mycobacterium avium subsp. paratuberculosis
ugacgcgaaugucgaccaccgg

SEQ ID NO: 978505 - RNA, 13 nt, Mycobacterium avium subsp. paratuberculosis
ugacgccgggccg

SEQ ID NO: 978506 - RNA, 18 nt, Mycobacterium avium subsp. paratuberculosis
ugacgccugcggcccagc

SEQ ID NO: 978507 - RNA, 19 nt, Mycobacterium avium subsp. paratuberculosis
ugacgccgccgaaccccag

SEQ ID NO: 978508 - RNA, 22 nt, Mycobacterium avium subsp. paratuberculosis
ugacgccgcgguuggucaccag

SEQ ID NO: 978509 - RNA, 14 nt, Mycobacterium avium subsp. paratuberculosis
ugacgcccuccugg

SEQ ID NO: 978510 - RNA, 21 nt, Mycobacterium avium subsp. paratuberculosis
ugacgcccccggugacgaucc

SEQ ID NO: 978511 - RNA, 17 nt, Mycobacterium avium subsp. paratuberculosis
ugagacggccagcagca

SEQ ID NO: 978512 - RNA, 14 nt, Mycobacterium avium subsp. paratuberculosis
ugagacgacccaac

SEQ ID NO: 978513 - RNA, 19 nt, Mycobacterium avium subsp. paratuberculosis
ugagaaagucgaucuggcg

SEQ ID NO: 978514 - RNA, 20 nt, Mycobacterium avium subsp. paratuberculosis
ugacuucggaggucagcagg

SEQ ID NO: 978515 - RNA, 22 nt, Mycobacterium avium subsp. paratuberculosis
ugacguagaagucgauugccgc

SEQ ID NO: 978516 - RNA, 22 nt, Mycobacterium avium subsp. paratuberculosis
ugacgucgcgcugccggcccga

SEQ ID NO: 978517 - RNA, 14 nt, Mycobacterium avium subsp. paratuberculosis
ugacguccuugacc

SEQ ID NO: 978518 - RNA, 18 nt, Mycobacterium avium subsp. paratuberculosis
ugacggcuuccgcggacg

SEQ ID NO: 978519 - RNA, 16 nt, Mycobacterium avium subsp. paratuberculosis
ugacggcggcgcccug

SEQ ID NO: 978520 - RNA, 15 nt, Mycobacterium avium subsp. paratuberculosis
ugacguuggugaucg

SEQ ID NO: 978521 - RNA, 15 nt, Mycobacterium avium subsp. paratuberculosis
ugacgucggucagca

SEQ ID NO: 978522 - RNA, 13 nt, Mycobacterium avium subsp. paratuberculosis
ugacgugcaccac

SEQ ID NO: 978523 - RNA, 20 nt, Mycobacterium avium subsp. paratuberculosis
ugaucagguccuugcgcgcc

SEQ ID NO: 978524 - RNA, 20 nt, Mycobacterium avium subsp. paratuberculosis
ugaucagguucaccagcacg

SEQ ID NO: 978525 - RNA, 16 nt, Mycobacterium avium subsp. paratuberculosis
ugauccggcacugaag

SEQ ID NO: 978526 - RNA, 14 nt, Mycobacterium avium subsp. paratuberculosis
ugaucgaaaggacg

SEQ ID NO: 978527 - RNA, 13 nt, Mycobacterium avium subsp. paratuberculosis
ugaucuucuccag

SEQ ID NO: 978528 - RNA, 12 nt, Mycobacterium avium subsp. paratuberculosis
ugaucuugaccg

SEQ ID NO: 978529 - RNA, 16 nt, Mycobacterium avium subsp. paratuberculosis
ugaucuugaucgccuu

SEQ ID NO: 978530 - RNA, 14 nt, Mycobacterium avium subsp. paratuberculosis
ugaucugcaccagc

SEQ ID NO: 978531 - RNA, 18 nt, Mycobacterium avium subsp. paratuberculosis
ugaucugguuccacagcu

SEQ ID NO: 978532 - RNA, 20 nt, Mycobacterium avium subsp. paratuberculosis
ugaucgccaugcuggcacuc

SEQ ID NO: 978533 - RNA, 13 nt, Mycobacterium avium subsp. paratuberculosis
ugaucggccaggc

SEQ ID NO: 978534 - RNA, 14 nt, Mycobacterium avium subsp. paratuberculosis
ugaucggccaggcg

SEQ ID NO: 978535 - RNA, 15 nt, Mycobacterium avium subsp. paratuberculosis
ugauaccggcccagc

SEQ ID NO: 978536 - RNA, 18 nt, Mycobacterium avium subsp. paratuberculosis
ugagugcgccgugcagca

SEQ ID NO: 978537 - RNA, 22 nt, Mycobacterium avium subsp. paratuberculosis
ugaggucgcgcaggaugcccag

SEQ ID NO: 978538 - RNA, 19 nt, Mycobacterium avium subsp. paratuberculosis
ugagucugggucacgcuga

SEQ ID NO: 978539 - RNA, 23 nt, Mycobacterium avium subsp. paratuberculosis
ugaggcgacccccggugucugac

SEQ ID NO: 978540 - RNA, 21 nt, Mycobacterium avium subsp. paratuberculosis
ugaguucggugaacugcagcc

SEQ ID NO: 978541 - RNA, 22 nt, Mycobacterium avium subsp. paratuberculosis
ugaguucggugaacugcagccc

SEQ ID NO: 978542 - RNA, 15 nt, Mycobacterium avium subsp. paratuberculosis
ugagcucgcggcgca

SEQ ID NO: 978543 - RNA, 12 nt, Mycobacterium avium subsp. paratuberculosis
ugaggaacgcga

SEQ ID NO: 978544 - RNA, 19 nt, Mycobacterium avium subsp. paratuberculosis
ugaggacgcccggcgagug

SEQ ID NO: 978545 - RNA, 22 nt, Mycobacterium avium subsp. paratuberculosis
ugaggcggcggcgggccagggc

SEQ ID NO: 978546 - RNA, 23 nt, Mycobacterium avium subsp. paratuberculosis
ugaggcgcgccgguaaugggcga

SEQ ID NO: 978547 - RNA, 18 nt, Mycobacterium avium subsp. paratuberculosis
ugagcaagucggcgguga

SEQ ID NO: 978548 - RNA, 15 nt, Mycobacterium avium subsp. paratuberculosis
ugagcgguggccacg

SEQ ID NO: 978549 - RNA, 19 nt, Mycobacterium avium subsp. paratuberculosis
ugagcgguggccacgcccc

SEQ ID NO: 978550 - RNA, 15 nt, Mycobacterium avium subsp. paratuberculosis
ugagauccagcagcc

SEQ ID NO: 978551 - RNA, 16 nt, Mycobacterium avium subsp. paratuberculosis
ugcaucucgaccuggg

SEQ ID NO: 978552 - RNA, 20 nt, Mycobacterium avium subsp. paratuberculosis
ugcaucugcgagaugcccac

SEQ ID NO: 978553 - RNA, 20 nt, Mycobacterium avium subsp. paratuberculosis
ugcaucaugccgcccaucac

SEQ ID NO: 978554 - RNA, 20 nt, Mycobacterium avium subsp. paratuberculosis
ugcaucggcaguccgcgccg

SEQ ID NO: 978555 - RNA, 15 nt, Mycobacterium avium subsp. paratuberculosis
ugcaucauguccagg

SEQ ID NO: 978556 - RNA, 20 nt, Mycobacterium avium subsp. paratuberculosis
ugccaccaccacggccagga

SEQ ID NO: 978557 - RNA, 22 nt, Mycobacterium avium subsp. paratuberculosis
ugccaccaccacggccaggaag

SEQ ID NO: 978558 - RNA, 13 nt, Mycobacterium avium subsp. paratuberculosis
ugcauacagcagg

SEQ ID NO: 978559 - RNA, 11 nt, Mycobacterium avium subsp. paratuberculosis
ugcagguggcc

SEQ ID NO: 978560 - RNA, 16 nt, Mycobacterium avium subsp. paratuberculosis
ugcagguuccggauca

SEQ ID NO: 978561 - RNA, 22 nt, Mycobacterium avium subsp. paratuberculosis
ugcagcuccucggcggccucgg

SEQ ID NO: 978562 - RNA, 16 nt, Mycobacterium avium subsp. paratuberculosis
ugcagcucggugcaga

SEQ ID NO: 978563 - RNA, 17 nt, Mycobacterium avium subsp. paratuberculosis
ugcacacggccuugccg

SEQ ID NO: 978564 - RNA, 18 nt, Mycobacterium avium subsp. paratuberculosis
ugcacaaccgcugcugcu

SEQ ID NO: 978565 - RNA, 18 nt, Mycobacterium avium subsp. paratuberculosis
ugcacaccaccagcgagg

SEQ ID NO: 978566 - RNA, 21 nt, Mycobacterium avium subsp. paratuberculosis
ugcaccacccaggccacccgg

SEQ ID NO: 978567 - RNA, 15 nt, Mycobacterium avium subsp. paratuberculosis
ugcaccaccgugccg

SEQ ID NO: 978568 - RNA, 18 nt, Mycobacterium avium subsp. paratuberculosis
ugcacaucccgaaugaga

SEQ ID NO: 978569 - RNA, 22 nt, Mycobacterium avium subsp. paratuberculosis
ugcacaugcccgucgggcgggg

SEQ ID NO: 978570 - RNA, 17 nt, Mycobacterium avium subsp. paratuberculosis
ugcaccugggugaucuu

SEQ ID NO: 978571 - RNA, 13 nt, Mycobacterium avium subsp. paratuberculosis
ugcaccugcggca

SEQ ID NO: 978572 - RNA, 22 nt, Mycobacterium avium subsp. paratuberculosis
ugcaccguggugacccggaccg

SEQ ID NO: 978573 - RNA, 13 nt, Mycobacterium avium subsp. paratuberculosis
ugcaccuugcccg

SEQ ID NO: 978574 - RNA, 14 nt, Mycobacterium avium subsp. paratuberculosis
ugcacguccucguc

SEQ ID NO: 978575 - RNA, 18 nt, Mycobacterium avium subsp. paratuberculosis
ugcacgucacgggccagg

SEQ ID NO: 978576 - RNA, 19 nt, Mycobacterium avium subsp. paratuberculosis
ugcacgucacgggccaggc

SEQ ID NO: 978577 - RNA, 15 nt, Mycobacterium avium subsp. paratuberculosis
ugcaccggcagccag

SEQ ID NO: 978578 - RNA, 17 nt, Mycobacterium avium subsp. paratuberculosis
ugcaccggggccggcgg

SEQ ID NO: 978579 - RNA, 21 nt, Mycobacterium avium subsp. paratuberculosis
ugcaccagcgauccggcgcgu

SEQ ID NO: 978580 - RNA, 13 nt, Mycobacterium avium subsp. paratuberculosis
ugcaccagcgcgg

SEQ ID NO: 978581 - RNA, 22 nt, Mycobacterium avium subsp. paratuberculosis
ugcaccaggacgcgaccggcca

SEQ ID NO: 978582 - RNA, 14 nt, Mycobacterium avium subsp. paratuberculosis
ugcacugccgaccc

SEQ ID NO: 978583 - RNA, 19 nt, Mycobacterium avium subsp. paratuberculosis
ugcacucucgcggcaaggc

SEQ ID NO: 978584 - RNA, 21 nt, Mycobacterium avium subsp. paratuberculosis
ugcagauagguggucucccag

SEQ ID NO: 978585 - RNA, 13 nt, Mycobacterium avium subsp. paratuberculosis
ugcagaucaccac

SEQ ID NO: 978586 - RNA, 23 nt, Mycobacterium avium subsp. paratuberculosis
ugcacuucgcuguaguagccggg

SEQ ID NO: 978587 - RNA, 19 nt, Mycobacterium avium subsp. paratuberculosis
ugcagauccagaugccggg

SEQ ID NO: 978588 - RNA, 21 nt, Mycobacterium avium subsp. paratuberculosis
ugcagaugucgguggccuugg

SEQ ID NO: 978589 - RNA, 20 nt, Mycobacterium avium subsp. paratuberculosis
ugcagcccgcugaccaggcc

SEQ ID NO: 978590 - RNA, 12 nt, Mycobacterium avium subsp. paratuberculosis
ugcagcacagcg

SEQ ID NO: 978591 - RNA, 16 nt, Mycobacterium avium subsp. paratuberculosis
ugcagcacauccagcc

SEQ ID NO: 978592 - RNA, 12 nt, Mycobacterium avium subsp. paratuberculosis
ugcagcaccagg

SEQ ID NO: 978593 - RNA, 19 nt, Mycobacterium avium subsp. paratuberculosis
ugcagcaccgccagcaucc

SEQ ID NO: 978594 - RNA, 14 nt, Mycobacterium avium subsp. paratuberculosis
ugcagccgcccguc

SEQ ID NO: 978595 - RNA, 20 nt, Mycobacterium avium subsp. paratuberculosis
ugcagccgcggucuuuggcg

SEQ ID NO: 978596 - RNA, 14 nt, Mycobacterium avium subsp. paratuberculosis
ugcagccgcugccg

SEQ ID NO: 978597 - RNA, 19 nt, Mycobacterium avium subsp. paratuberculosis
ugcagccgcugccgcaccc

SEQ ID NO: 978598 - RNA, 17 nt, Mycobacterium avium subsp. paratuberculosis
ugcagccggcgcggcag

SEQ ID NO: 978599 - RNA, 22 nt, Mycobacterium avium subsp. paratuberculosis
ugcagccgggccugcagcaacu

SEQ ID NO: 978600 - RNA, 22 nt, Mycobacterium avium subsp. paratuberculosis
ugcagccgggcggcgccgaacc

SEQ ID NO: 978601 - RNA, 21 nt, Mycobacterium avium subsp. paratuberculosis
ugcagccgggggcggugcagc

SEQ ID NO: 978602 - RNA, 22 nt, Mycobacterium avium subsp. paratuberculosis
ugcagccgggggcggugcagcc

SEQ ID NO: 978603 - RNA, 23 nt, Mycobacterium avium subsp. paratuberculosis
ugcagccgguccggcggcaccac

SEQ ID NO: 978604 - RNA, 20 nt, Mycobacterium avium subsp. paratuberculosis
ugcagcggguuuggccgcgg

SEQ ID NO: 978605 - RNA, 20 nt, Mycobacterium avium subsp. paratuberculosis
ugcagcgugguccagcacgu

SEQ ID NO: 978606 - RNA, 21 nt, Mycobacterium avium subsp. paratuberculosis
ugcaaccgcuuuuccaccauc

SEQ ID NO: 978607 - RNA, 21 nt, Mycobacterium avium subsp. paratuberculosis
ugcaacgccgccgacagcacc

SEQ ID NO: 978608 - RNA, 22 nt, Mycobacterium avium subsp. paratuberculosis
ugcaacgccgccgacagcaccu

SEQ ID NO: 978609 - RNA, 23 nt, Mycobacterium avium subsp. paratuberculosis
ugcaacuaccgacggcaccucuc

SEQ ID NO: 978610 - RNA, 22 nt, Mycobacterium avium subsp. paratuberculosis
ugcaacuggucgugcagcaccg

SEQ ID NO: 978611 - RNA, 15 nt, Mycobacterium avium subsp. paratuberculosis
ugcaagcucgccagg

SEQ ID NO: 978612 - RNA, 14 nt, Mycobacterium avium subsp. paratuberculosis
ugcaaggcgggggu

SEQ ID NO: 978613 - RNA, 20 nt, Mycobacterium avium subsp. paratuberculosis
ugauuccgccgggcggcagc

SEQ ID NO: 978614 - RNA, 21 nt, Mycobacterium avium subsp. paratuberculosis
ugaugacguagucguccucgu

SEQ ID NO: 978615 - RNA, 15 nt, Mycobacterium avium subsp. paratuberculosis
ugccuuagcccggcc

SEQ ID NO: 978616 - RNA, 18 nt, Mycobacterium avium subsp. paratuberculosis
ugccucuucggcgcgccg

SEQ ID NO: 978617 - RNA, 17 nt, Mycobacterium avium subsp. paratuberculosis
ugccucuucgucggccg

SEQ ID NO: 978618 - RNA, 23 nt, Mycobacterium avium subsp. paratuberculosis
ugccucuucgucggccggcaguu

SEQ ID NO: 978619 - RNA, 17 nt, Mycobacterium avium subsp. paratuberculosis
ugccucgacgaugggug

SEQ ID NO: 978620 - RNA, 14 nt, Mycobacterium avium subsp. paratuberculosis
ugccucggccagca

SEQ ID NO: 978621 - RNA, 22 nt, Mycobacterium avium subsp. paratuberculosis
ugccugcccgcgcaggccccgg

SEQ ID NO: 978622 - RNA, 12 nt, Mycobacterium avium subsp. paratuberculosis
ugccaccgcugg

SEQ ID NO: 978623 - RNA, 22 nt, Mycobacterium avium subsp. paratuberculosis
ugccagaccacaagggccaccg

SEQ ID NO: 978624 - RNA, 22 nt, Mycobacterium avium subsp. paratuberculosis
ugccagacgaacgcggccgcca

SEQ ID NO: 978625 - RNA, 20 nt, Mycobacterium avium subsp. paratuberculosis
ugccggcauaggccagcacc

SEQ ID NO: 978626 - RNA, 20 nt, Mycobacterium avium subsp. paratuberculosis
ugccggcauccucggcgcgu

SEQ ID NO: 978627 - RNA, 21 nt, Mycobacterium avium subsp. paratuberculosis
ugccggccagcuuuccggccg

SEQ ID NO: 978628 - RNA, 22 nt, Mycobacterium avium subsp. paratuberculosis
ugccggccagcuuuccggccgc

SEQ ID NO: 978629 - RNA, 19 nt, Mycobacterium avium subsp. paratuberculosis
ugccggccaggcacagcag

SEQ ID NO: 978630 - RNA, 16 nt, Mycobacterium avium subsp. paratuberculosis
ugccggccggcagcug

SEQ ID NO: 978631 - RNA, 18 nt, Mycobacterium avium subsp. paratuberculosis
ugccggccggcagcugcc

SEQ ID NO: 978632 - RNA, 13 nt, Mycobacterium avium subsp. paratuberculosis
ugccggccgccgc

SEQ ID NO: 978633 - RNA, 16 nt, Mycobacterium avium subsp. paratuberculosis
ugccggccugacugag

SEQ ID NO: 978634 - RNA, 19 nt, Mycobacterium avium subsp. paratuberculosis
ugccggccuggcccagccg

SEQ ID NO: 978635 - RNA, 16 nt, Mycobacterium avium subsp. paratuberculosis
ugccggggcagcaccc

SEQ ID NO: 978636 - RNA, 20 nt, Mycobacterium avium subsp. paratuberculosis
ugccggcgauccgcgcggcg

SEQ ID NO: 978637 - RNA, 16 nt, Mycobacterium avium subsp. paratuberculosis
ugccggcgcaccgcgu

SEQ ID NO: 978638 - RNA, 17 nt, Mycobacterium avium subsp. paratuberculosis
ugccggcgaaccucacc

SEQ ID NO: 978639 - RNA, 19 nt, Mycobacterium avium subsp. paratuberculosis
ugccggcgaccagccccuc

SEQ ID NO: 978640 - RNA, 13 nt, Mycobacterium avium subsp. paratuberculosis
ugccguagagccg

SEQ ID NO: 978641 - RNA, 18 nt, Mycobacterium avium subsp. paratuberculosis
ugccguagaucucgcgcc

SEQ ID NO: 978642 - RNA, 15 nt, Mycobacterium avium subsp. paratuberculosis
ugccguacaugguga

SEQ ID NO: 978643 - RNA, 14 nt, Mycobacterium avium subsp. paratuberculosis
ugccgucgcgggcg

SEQ ID NO: 978644 - RNA, 18 nt, Mycobacterium avium subsp. paratuberculosis
ugccgucgaucgcccgcu

SEQ ID NO: 978645 - RNA, 13 nt, Mycobacterium avium subsp. paratuberculosis
ugccguagcgcau

SEQ ID NO: 978646 - RNA, 13 nt, Mycobacterium avium subsp. paratuberculosis
ugccguccggcgg

SEQ ID NO: 978647 - RNA, 15 nt, Mycobacterium avium subsp. paratuberculosis
ugccguccggguccg

SEQ ID NO: 978648 - RNA, 14 nt, Mycobacterium avium subsp. paratuberculosis
ugccguccgggucg

SEQ ID NO: 978649 - RNA, 15 nt, Mycobacterium avium subsp. paratuberculosis
ugccggugcagcacc

SEQ ID NO: 978650 - RNA, 19 nt, Mycobacterium avium subsp. paratuberculosis
ugccggguuucggcccggc

SEQ ID NO: 978651 - RNA, 18 nt, Mycobacterium avium subsp. paratuberculosis
ugccggucauccgggcca

SEQ ID NO: 978652 - RNA, 20 nt, Mycobacterium avium subsp. paratuberculosis
ugccggugacggucagggug

SEQ ID NO: 978653 - RNA, 16 nt, Mycobacterium avium subsp. paratuberculosis
ugccgggucgcagcgg

SEQ ID NO: 978654 - RNA, 18 nt, Mycobacterium avium subsp. paratuberculosis
ugccgggugaugcagugg

SEQ ID NO: 978655 - RNA, 15 nt, Mycobacterium avium subsp. paratuberculosis
ugcgaaugacgcgca

SEQ ID NO: 978656 - RNA, 13 nt, Mycobacterium avium subsp. paratuberculosis
ugcgagccaccuc

SEQ ID NO: 978657 - RNA, 20 nt, Mycobacterium avium subsp. paratuberculosis
ugcgagccgagcacgcagcc

SEQ ID NO: 978658 - RNA, 16 nt, Mycobacterium avium subsp. paratuberculosis
ugcgagccggagccuu

SEQ ID NO: 978659 - RNA, 14 nt, Mycobacterium avium subsp. paratuberculosis
ugcgacaccgcguc

SEQ ID NO: 978660 - RNA, 22 nt, Mycobacterium avium subsp. paratuberculosis
ugcgagcgugaaguuaguuuca

SEQ ID NO: 978661 - RNA, 23 nt, Mycobacterium avium subsp. paratuberculosis
ugcgagcgugaaguuaguuucac

SEQ ID NO: 978662 - RNA, 14 nt, Mycobacterium avium subsp. paratuberculosis
ugcgaaagcgcggg

SEQ ID NO: 978663 - RNA, 21 nt, Mycobacterium avium subsp. paratuberculosis
ugcgaagacccgaaacuggga

SEQ ID NO: 978664 - RNA, 17 nt, Mycobacterium avium subsp. paratuberculosis
ugcgccaguuugccguc

SEQ ID NO: 978665 - RNA, 17 nt, Mycobacterium avium subsp. paratuberculosis
ugcgcccgaucgugcgc

SEQ ID NO: 978666 - RNA, 14 nt, Mycobacterium avium subsp. paratuberculosis
ugcgcccgccgcca

SEQ ID NO: 978667 - RNA, 21 nt, Mycobacterium avium subsp. paratuberculosis
ugcgcccgccgccaccacggc

SEQ ID NO: 978668 - RNA, 21 nt, Mycobacterium avium subsp. paratuberculosis
ugcgccacgcccgcagcgcau

SEQ ID NO: 978669 - RNA, 16 nt, Mycobacterium avium subsp. paratuberculosis
ugcgccagcagcagcg

SEQ ID NO: 978670 - RNA, 19 nt, Mycobacterium avium subsp. paratuberculosis
ugcgccagcagcagcgcgg

SEQ ID NO: 978671 - RNA, 11 nt, Mycobacterium avium subsp. paratuberculosis
ugcgccaggca

SEQ ID NO: 978672 - RNA, 23 nt, Mycobacterium avium subsp. paratuberculosis
ugcgcccgggaaguucacguccu

SEQ ID NO: 978673 - RNA, 21 nt, Mycobacterium avium subsp. paratuberculosis
ugcgcccguagcggcggaacu

SEQ ID NO: 978674 - RNA, 20 nt, Mycobacterium avium subsp. paratuberculosis
ugcgcccgucgucgccgaug

SEQ ID NO: 978675 - RNA, 16 nt, Mycobacterium avium subsp. paratuberculosis
ugcgccgaacgugcac

SEQ ID NO: 978676 - RNA, 21 nt, Mycobacterium avium subsp. paratuberculosis
ugcgccgacagcugagcagcc

SEQ ID NO: 978677 - RNA, 14 nt, Mycobacterium avium subsp. paratuberculosis
ugcgccgcagcggu

SEQ ID NO: 978678 - RNA, 20 nt, Mycobacterium avium subsp. paratuberculosis
ugcgccgccagggcgcggcg

SEQ ID NO: 978679 - RNA, 18 nt, Mycobacterium avium subsp. paratuberculosis
ugcgccgccuccgggcug

SEQ ID NO: 978680 - RNA, 17 nt, Mycobacterium avium subsp. paratuberculosis
ugcgccgcgagcgcagc

SEQ ID NO: 978681 - RNA, 21 nt, Mycobacterium avium subsp. paratuberculosis
ugcgccgcgagcgcagcaggu

SEQ ID NO: 978682 - RNA, 18 nt, Mycobacterium avium subsp. paratuberculosis
ugcgccagaucagcgugg

SEQ ID NO: 978683 - RNA, 23 nt, Mycobacterium avium subsp. paratuberculosis
ugcgccagaucagcguggucagc

SEQ ID NO: 978684 - RNA, 20 nt, Mycobacterium avium subsp. paratuberculosis
ugcgccagaucgcugaugcg

SEQ ID NO: 978685 - RNA, 17 nt, Mycobacterium avium subsp. paratuberculosis
ugcgcacgaucugcagg

SEQ ID NO: 978686 - RNA, 19 nt, Mycobacterium avium subsp. paratuberculosis
ugcgcacgaucugcaggcc

SEQ ID NO: 978687 - RNA, 20 nt, Mycobacterium avium subsp. paratuberculosis
ugcgcacgaucugcaggccg

SEQ ID NO: 978688 - RNA, 14 nt, Mycobacterium avium subsp. paratuberculosis
ugcgcaccgugccg

SEQ ID NO: 978689 - RNA, 15 nt, Mycobacterium avium subsp. paratuberculosis
ugcgaugggugaucg

SEQ ID NO: 978690 - RNA, 16 nt, Mycobacterium avium subsp. paratuberculosis
ugcgcaccaucaccug

SEQ ID NO: 978691 - RNA, 14 nt, Mycobacterium avium subsp. paratuberculosis
ugcgcaccacgccc

SEQ ID NO: 978692 - RNA, 14 nt, Mycobacterium avium subsp. paratuberculosis
ugcgcaccagcagg

SEQ ID NO: 978693 - RNA, 23 nt, Mycobacterium avium subsp. paratuberculosis
ugcgcaaguagcgcuccaccagg

SEQ ID NO: 978694 - RNA, 18 nt, Mycobacterium avium subsp. paratuberculosis
ugcucagguugcgcagca

SEQ ID NO: 978695 - RNA, 21 nt, Mycobacterium avium subsp. paratuberculosis
ugcucagcggccaucgccgcc

SEQ ID NO: 978696 - RNA, 22 nt, Mycobacterium avium subsp. paratuberculosis
ugcucagcggccaucgccgcca

SEQ ID NO: 978697 - RNA, 17 nt, Mycobacterium avium subsp. paratuberculosis
ugcucaugagcccucca

SEQ ID NO: 978698 - RNA, 16 nt, Mycobacterium avium subsp. paratuberculosis
ugcuccagcaggcgcg

SEQ ID NO: 978699 - RNA, 15 nt, Mycobacterium avium subsp. paratuberculosis
ugcuccacacuggcu

SEQ ID NO: 978700 - RNA, 16 nt, Mycobacterium avium subsp. paratuberculosis
ugcucgaccagcgccg

SEQ ID NO: 978701 - RNA, 19 nt, Mycobacterium avium subsp. paratuberculosis
ugcuccucggucagcggcg

SEQ ID NO: 978702 - RNA, 21 nt, Mycobacterium avium subsp. paratuberculosis
ugcuccucgaaccucgcggcg

SEQ ID NO: 978703 - RNA, 19 nt, Mycobacterium avium subsp. paratuberculosis
ugcuagcgagcgggcacgc

SEQ ID NO: 978704 - RNA, 13 nt, Mycobacterium avium subsp. paratuberculosis
ugcggcucccacc

SEQ ID NO: 978705 - RNA, 13 nt, Mycobacterium avium subsp. paratuberculosis
ugcggcgggccgc

SEQ ID NO: 978706 - RNA, 16 nt, Mycobacterium avium subsp. paratuberculosis
ugcggcgcccacagca

SEQ ID NO: 978707 - RNA, 20 nt, Mycobacterium avium subsp. paratuberculosis
ugcggcgcggucgcaggccg

SEQ ID NO: 978708 - RNA, 22 nt, Mycobacterium avium subsp. paratuberculosis
ugcggcggcagucgcagcagca

SEQ ID NO: 978709 - RNA, 18 nt, Mycobacterium avium subsp. paratuberculosis
ugcggcggccggccagca

SEQ ID NO: 978710 - RNA, 21 nt, Mycobacterium avium subsp. paratuberculosis
ugcggcgucgucuuggccugc

SEQ ID NO: 978711 - RNA, 24 nt, Mycobacterium avium subsp. paratuberculosis
ugcggcgucgucuuggccugcugu

SEQ ID NO: 978712 - RNA, 14 nt, Mycobacterium avium subsp. paratuberculosis
ugcggcaccuccag

SEQ ID NO: 978713 - RNA, 20 nt, Mycobacterium avium subsp. paratuberculosis
ugcggcaccuccagcccggc

SEQ ID NO: 978714 - RNA, 22 nt, Mycobacterium avium subsp. paratuberculosis
ugcggcaccacgcugugcucga

SEQ ID NO: 978715 - RNA, 13 nt, Mycobacterium avium subsp. paratuberculosis
ugcggcaccagcc

SEQ ID NO: 978716 - RNA, 20 nt, Mycobacterium avium subsp. paratuberculosis
ugcggcacggcgaggucggg

SEQ ID NO: 978717 - RNA, 17 nt, Mycobacterium avium subsp. paratuberculosis
ugcggcgaaccgggccc

SEQ ID NO: 978718 - RNA, 20 nt, Mycobacterium avium subsp. paratuberculosis
ugcggcgaacgcgucccggg

SEQ ID NO: 978719 - RNA, 23 nt, Mycobacterium avium subsp. paratuberculosis
ugcggcgaacgcgucccgggccu

SEQ ID NO: 978720 - RNA, 18 nt, Mycobacterium avium subsp. paratuberculosis
ugcggcagggccaccguc

SEQ ID NO: 978721 - RNA, 18 nt, Mycobacterium avium subsp. paratuberculosis
ugcggcaggucggccagc

SEQ ID NO: 978722 - RNA, 20 nt, Mycobacterium avium subsp. paratuberculosis
ugcggcaggucggccagcgc

SEQ ID NO: 978723 - RNA, 14 nt, Mycobacterium avium subsp. paratuberculosis
ugcggaacaccgcc

SEQ ID NO: 978724 - RNA, 21 nt, Mycobacterium avium subsp. paratuberculosis
ugcgccggcaacuggccgccc

SEQ ID NO: 978725 - RNA, 19 nt, Mycobacterium avium subsp. paratuberculosis
ugcgccggcgcggccagcu

SEQ ID NO: 978726 - RNA, 17 nt, Mycobacterium avium subsp. paratuberculosis
ugcgccggcggccgcga

SEQ ID NO: 978727 - RNA, 13 nt, Mycobacterium avium subsp. paratuberculosis
ugcgccggggccg

SEQ ID NO: 978728 - RNA, 22 nt, Mycobacterium avium subsp. paratuberculosis
ugcgccggcuuucgaagagccg

SEQ ID NO: 978729 - RNA, 21 nt, Mycobacterium avium subsp. paratuberculosis
ugcgccgguucgcuggcggcc

SEQ ID NO: 978730 - RNA, 13 nt, Mycobacterium avium subsp. paratuberculosis
ugcgguuggccgg

SEQ ID NO: 978731 - RNA, 14 nt, Mycobacterium avium subsp. paratuberculosis
ugcgguuggccgga

SEQ ID NO: 978732 - RNA, 14 nt, Mycobacterium avium subsp. paratuberculosis
ugcgguuggccggc

SEQ ID NO: 978733 - RNA, 18 nt, Mycobacterium avium subsp. paratuberculosis
ugcgguugagcaccagcc

SEQ ID NO: 978734 - RNA, 21 nt, Mycobacterium avium subsp. paratuberculosis
ugcgguguaaccguggcaggc

SEQ ID NO: 978735 - RNA, 21 nt, Mycobacterium avium subsp. paratuberculosis
ugcgggagaaaugggccaggu

SEQ ID NO: 978736 - RNA, 23 nt, Mycobacterium avium subsp. paratuberculosis
ugcggucgaugacgccgcgccgc

SEQ ID NO: 978737 - RNA, 15 nt, Mycobacterium avium subsp. paratuberculosis
ugcgguccccggaga

SEQ ID NO: 978738 - RNA, 15 nt, Mycobacterium avium subsp. paratuberculosis
ugcgggaccagcgcc

SEQ ID NO: 978739 - RNA, 15 nt, Mycobacterium avium subsp. paratuberculosis
ugcggugaucccagg

SEQ ID NO: 978740 - RNA, 16 nt, Mycobacterium avium subsp. paratuberculosis
ugcggugccgggccag

SEQ ID NO: 978741 - RNA, 16 nt, Mycobacterium avium subsp. paratuberculosis
ugcggugcggccgcgc

SEQ ID NO: 978742 - RNA, 18 nt, Mycobacterium avium subsp. paratuberculosis
ugcggugcugccgugccg

SEQ ID NO: 978743 - RNA, 16 nt, Mycobacterium avium subsp. paratuberculosis
ugcggucgucgcccac

SEQ ID NO: 978744 - RNA, 15 nt, Mycobacterium avium subsp. paratuberculosis
ugcggucgcgcagcc

SEQ ID NO: 978745 - RNA, 22 nt, Mycobacterium avium subsp. paratuberculosis
ugcggucgcgcagccgggcggc

SEQ ID NO: 978746 - RNA, 15 nt, Mycobacterium avium subsp. paratuberculosis
ugcgugccagcagcu

SEQ ID NO: 978747 - RNA, 18 nt, Mycobacterium avium subsp. paratuberculosis
ugcguguggcgcacgccc

SEQ ID NO: 978748 - RNA, 18 nt, Mycobacterium avium subsp. paratuberculosis
ugcgugccuugcacccag

SEQ ID NO: 978749 - RNA, 19 nt, Mycobacterium avium subsp. paratuberculosis
ugcgugacuugucgggccg

SEQ ID NO: 978750 - RNA, 15 nt, Mycobacterium avium subsp. paratuberculosis
ugcgucuuuucccac

SEQ ID NO: 978751 - RNA, 12 nt, Mycobacterium avium subsp. paratuberculosis
ugcgucacgcug

SEQ ID NO: 978752 - RNA, 17 nt, Mycobacterium avium subsp. paratuberculosis
ugcguccagaccggccg

SEQ ID NO: 978753 - RNA, 12 nt, Mycobacterium avium subsp. paratuberculosis
ugcguccggccc

SEQ ID NO: 978754 - RNA, 14 nt, Mycobacterium avium subsp. paratuberculosis
ugcgucccgcgccg

SEQ ID NO: 978755 - RNA, 23 nt, Mycobacterium avium subsp. paratuberculosis
uggaaugugccugcgggcccagc

SEQ ID NO: 978756 - RNA, 13 nt, Mycobacterium avium subsp. paratuberculosis
uggaaggugcuga

SEQ ID NO: 978757 - RNA, 20 nt, Mycobacterium avium subsp. paratuberculosis
uggacagcgauugcacaccg

SEQ ID NO: 978758 - RNA, 15 nt, Mycobacterium avium subsp. paratuberculosis
uggacagcagcagcu

SEQ ID NO: 978759 - RNA, 12 nt, Mycobacterium avium subsp. paratuberculosis
uggacagcagcc

SEQ ID NO: 978760 - RNA, 19 nt, Mycobacterium avium subsp. paratuberculosis
uggacauucacgaggccgg

SEQ ID NO: 978761 - RNA, 18 nt, Mycobacterium avium subsp. paratuberculosis
uggacaggucgaugaugu

SEQ ID NO: 978762 - RNA, 12 nt, Mycobacterium avium subsp. paratuberculosis
uggacgagcagc

SEQ ID NO: 978763 - RNA, 22 nt, Mycobacterium avium subsp. paratuberculosis
uggacccgaccuuuugcccggc

SEQ ID NO: 978764 - RNA, 14 nt, Mycobacterium avium subsp. paratuberculosis
uggaagauguccuc

SEQ ID NO: 978765 - RNA, 21 nt, Mycobacterium avium subsp. paratuberculosis
uggaacgcgucgcgccagcgg

SEQ ID NO: 978766 - RNA, 14 nt, Mycobacterium avium subsp. paratuberculosis
uggaacgccgagga

SEQ ID NO: 978767 - RNA, 23 nt, Mycobacterium avium subsp. paratuberculosis
uggaacaucccggagccgucggc

SEQ ID NO: 978768 - RNA, 13 nt, Mycobacterium avium subsp. paratuberculosis
uggaacaucucca

SEQ ID NO: 978769 - RNA, 19 nt, Mycobacterium avium subsp. paratuberculosis
uggaacaucuccagcgcgg

SEQ ID NO: 978770 - RNA, 16 nt, Mycobacterium avium subsp. paratuberculosis
ugcuuugccuuagccc

SEQ ID NO: 978771 - RNA, 16 nt, Mycobacterium avium subsp. paratuberculosis
ugcuuggucagcgcgg

SEQ ID NO: 978772 - RNA, 22 nt, Mycobacterium avium subsp. paratuberculosis
ugcuuggcggcgcacuccauca

SEQ ID NO: 978773 - RNA, 16 nt, Mycobacterium avium subsp. paratuberculosis
ugcuugggcagcagcu

SEQ ID NO: 978774 - RNA, 22 nt, Mycobacterium avium subsp. paratuberculosis
ugcuugcccgacgagucgccgu

SEQ ID NO: 978775 - RNA, 19 nt, Mycobacterium avium subsp. paratuberculosis
ugcuugccgaugucggcgu

SEQ ID NO: 978776 - RNA, 16 nt, Mycobacterium avium subsp. paratuberculosis
ugcuugccgccgggcc

SEQ ID NO: 978777 - RNA, 13 nt, Mycobacterium avium subsp. paratuberculosis
ugcuucugggugu

SEQ ID NO: 978778 - RNA, 17 nt, Mycobacterium avium subsp. paratuberculosis
ugcuugaacgccgcccc

SEQ ID NO: 978779 - RNA, 12 nt, Mycobacterium avium subsp. paratuberculosis
ugcuugaacagc

SEQ ID NO: 978780 - RNA, 22 nt, Mycobacterium avium subsp. paratuberculosis
ugcuuccgaucaacggcagcga

SEQ ID NO: 978781 - RNA, 17 nt, Mycobacterium avium subsp. paratuberculosis
ugcuuagccccucccac

SEQ ID NO: 978782 - RNA, 19 nt, Mycobacterium avium subsp. paratuberculosis
ugcuuagccccucccacca

SEQ ID NO: 978783 - RNA, 23 nt, Mycobacterium avium subsp. paratuberculosis
ugcuuagccccucccaccacggc

SEQ ID NO: 978784 - RNA, 20 nt, Mycobacterium avium subsp. paratuberculosis
ugcugucgcgggucuggcuc

SEQ ID NO: 978785 - RNA, 23 nt, Mycobacterium avium subsp. paratuberculosis
ugcuguacgacaacagugccuac

SEQ ID NO: 978786 - RNA, 22 nt, Mycobacterium avium subsp. paratuberculosis
ugcuggucuugccgugcagcag

SEQ ID NO: 978787 - RNA, 14 nt, Mycobacterium avium subsp. paratuberculosis
ugcugcgcagaccc

SEQ ID NO: 978788 - RNA, 20 nt, Mycobacterium avium subsp. paratuberculosis
ugcugcgcagcagcgccagc

SEQ ID NO: 978789 - RNA, 19 nt, Mycobacterium avium subsp. paratuberculosis
ugcugccugccguugggga

SEQ ID NO: 978790 - RNA, 13 nt, Mycobacterium avium subsp. paratuberculosis
ugcugcucggccg

SEQ ID NO: 978791 - RNA, 14 nt, Mycobacterium avium subsp. paratuberculosis
ugcugcucggccgc

SEQ ID NO: 978792 - RNA, 15 nt, Mycobacterium avium subsp. paratuberculosis
ugcugcgggucagca

SEQ ID NO: 978793 - RNA, 15 nt, Mycobacterium avium subsp. paratuberculosis
ugcuggacggcccga

SEQ ID NO: 978794 - RNA, 22 nt, Mycobacterium avium subsp. paratuberculosis
ugcugggacgggucggcggcga

SEQ ID NO: 978795 - RNA, 13 nt, Mycobacterium avium subsp. paratuberculosis
ugcuggcggccuu

SEQ ID NO: 978796 - RNA, 23 nt, Mycobacterium avium subsp. paratuberculosis
ugcuggcgugaaucuuggccagc

SEQ ID NO: 978797 - RNA, 23 nt, Mycobacterium avium subsp. paratuberculosis
ugcuggcgaugugaucgcggccc

SEQ ID NO: 978798 - RNA, 12 nt, Mycobacterium avium subsp. paratuberculosis
ugcuggccacca

SEQ ID NO: 978799 - RNA, 15 nt, Mycobacterium avium subsp. paratuberculosis
ugcuggccaucgcgg

SEQ ID NO: 978800 - RNA, 20 nt, Mycobacterium avium subsp. paratuberculosis
ugcugcccauccaggccagc

SEQ ID NO: 978801 - RNA, 15 nt, Mycobacterium avium subsp. paratuberculosis
ugcugcccgcggccg

SEQ ID NO: 978802 - RNA, 16 nt, Mycobacterium avium subsp. paratuberculosis
ugcugcccgcggccgc

SEQ ID NO: 978803 - RNA, 12 nt, Mycobacterium avium subsp. paratuberculosis
ugcugcccggcg

SEQ ID NO: 978804 - RNA, 19 nt, Mycobacterium avium subsp. paratuberculosis
ugcugccgccgcagcagcc

SEQ ID NO: 978805 - RNA, 21 nt, Mycobacterium avium subsp. paratuberculosis
ugcugcagcgcccgggccagg

SEQ ID NO: 978806 - RNA, 22 nt, Mycobacterium avium subsp. paratuberculosis
ugcugcagcgcccgggccagga

SEQ ID NO: 978807 - RNA, 17 nt, Mycobacterium avium subsp. paratuberculosis
ugcugcacccaccggcg

SEQ ID NO: 978808 - RNA, 16 nt, Mycobacterium avium subsp. paratuberculosis
ugcugcaacggcuggc

SEQ ID NO: 978809 - RNA, 21 nt, Mycobacterium avium subsp. paratuberculosis
ugcugagccgccgagccggca

SEQ ID NO: 978810 - RNA, 12 nt, Mycobacterium avium subsp. paratuberculosis
ugcugagcugcg

SEQ ID NO: 978811 - RNA, 15 nt, Mycobacterium avium subsp. paratuberculosis
ugcugacaccucgga

SEQ ID NO: 978812 - RNA, 21 nt, Mycobacterium avium subsp. paratuberculosis
ugcugacaccucggaucgucu

SEQ ID NO: 978813 - RNA, 13 nt, Mycobacterium avium subsp. paratuberculosis
ugcucugccuacu

SEQ ID NO: 978814 - RNA, 13 nt, Mycobacterium avium subsp. paratuberculosis
ugcucgucggccg

SEQ ID NO: 978815 - RNA, 14 nt, Mycobacterium avium subsp. paratuberculosis
ugcucucggccucc

SEQ ID NO: 978816 - RNA, 22 nt, Mycobacterium avium subsp. paratuberculosis
ugcucuccgcuguucggguaga

SEQ ID NO: 978817 - RNA, 18 nt, Mycobacterium avium subsp. paratuberculosis
ugcucgaucggcgcgccg

SEQ ID NO: 978818 - RNA, 12 nt, Mycobacterium avium subsp. paratuberculosis
ugcucgagcaca

SEQ ID NO: 978819 - RNA, 17 nt, Mycobacterium avium subsp. paratuberculosis
ugcucgagggccuccac

SEQ ID NO: 978820 - RNA, 15 nt, Mycobacterium avium subsp. paratuberculosis
ugcucgauggccagc

SEQ ID NO: 978821 - RNA, 13 nt, Mycobacterium avium subsp. paratuberculosis
ugcucgaugaaga

SEQ ID NO: 978822 - RNA, 22 nt, Mycobacterium avium subsp. paratuberculosis
ugcucgccugacuaagucacca

SEQ ID NO: 978823 - RNA, 21 nt, Mycobacterium avium subsp. paratuberculosis
ugcucgcgcugccgcgcgccg

SEQ ID NO: 978824 - RNA, 17 nt, Mycobacterium avium subsp. paratuberculosis
ugcucgcgcagcagcug

SEQ ID NO: 978825 - RNA, 22 nt, Mycobacterium avium subsp. paratuberculosis
ugcucgccgcguacgccgccuu

SEQ ID NO: 978826 - RNA, 21 nt, Mycobacterium avium subsp. paratuberculosis
ugcucgcgggccaccgcggcg

SEQ ID NO: 978827 - RNA, 22 nt, Mycobacterium avium subsp. paratuberculosis
ugcucggcgacgcugugcucgg

SEQ ID NO: 978828 - RNA, 19 nt, Mycobacterium avium subsp. paratuberculosis
ugcucggcgcgcggggccg

SEQ ID NO: 978829 - RNA, 21 nt, Mycobacterium avium subsp. paratuberculosis
ugcucggcgcgcggggccggc

SEQ ID NO: 978830 - RNA, 17 nt, Mycobacterium avium subsp. paratuberculosis
ugcucggcggcgcaggc

SEQ ID NO: 978831 - RNA, 22 nt, Mycobacterium avium subsp. paratuberculosis
ugcucggcgggucacucgaccu

SEQ ID NO: 978832 - RNA, 15 nt, Mycobacterium avium subsp. paratuberculosis
ugcucgucgcgggcg

SEQ ID NO: 978833 - RNA, 15 nt, Mycobacterium avium subsp. paratuberculosis
ugcucggugaugccg

SEQ ID NO: 978834 - RNA, 18 nt, Mycobacterium avium subsp. paratuberculosis
ugugaucgagcaccagcg

SEQ ID NO: 978835 - RNA, 17 nt, Mycobacterium avium subsp. paratuberculosis
ugugcacgauggacagg

SEQ ID NO: 978836 - RNA, 20 nt, Mycobacterium avium subsp. paratuberculosis
ugugccgcaaggcauuccag

SEQ ID NO: 978837 - RNA, 14 nt, Mycobacterium avium subsp. paratuberculosis
ugucguugaugccg

SEQ ID NO: 978838 - RNA, 20 nt, Mycobacterium avium subsp. paratuberculosis
ugucuccgcgcagccaggug

SEQ ID NO: 978839 - RNA, 22 nt, Mycobacterium avium subsp. paratuberculosis
ugucgucgcugacgccgagcag

SEQ ID NO: 978840 - RNA, 20 nt, Mycobacterium avium subsp. paratuberculosis
ugucggaggccuccaggcug

SEQ ID NO: 978841 - RNA, 16 nt, Mycobacterium avium subsp. paratuberculosis
ugucggccagcgcggc

SEQ ID NO: 978842 - RNA, 12 nt, Mycobacterium avium subsp. paratuberculosis
ugucggccaggu

SEQ ID NO: 978843 - RNA, 21 nt, Mycobacterium avium subsp. paratuberculosis
ugucggcgaaccagggcagcc

SEQ ID NO: 978844 - RNA, 19 nt, Mycobacterium avium subsp. paratuberculosis
ugucggcgauccacgccuc

SEQ ID NO: 978845 - RNA, 15 nt, Mycobacterium avium subsp. paratuberculosis
ugucggcgccaccgg

SEQ ID NO: 978846 - RNA, 19 nt, Mycobacterium avium subsp. paratuberculosis
ugucgacgccgugcugccg

SEQ ID NO: 978847 - RNA, 15 nt, Mycobacterium avium subsp. paratuberculosis
ugucgaccucggcca

SEQ ID NO: 978848 - RNA, 13 nt, Mycobacterium avium subsp. paratuberculosis
ugucgcaaagaca

SEQ ID NO: 978849 - RNA, 20 nt, Mycobacterium avium subsp. paratuberculosis
ugucgauggcggaacugacu

SEQ ID NO: 978850 - RNA, 21 nt, Mycobacterium avium subsp. paratuberculosis
uguccucgucggggaacuccu

SEQ ID NO: 978851 - RNA, 20 nt, Mycobacterium avium subsp. paratuberculosis
uguccucccagcgcccgggc

SEQ ID NO: 978852 - RNA, 19 nt, Mycobacterium avium subsp. paratuberculosis
uguccugcaccgacugcgg

SEQ ID NO: 978853 - RNA, 20 nt, Mycobacterium avium subsp. paratuberculosis
uguccugcaccgacugcggc

SEQ ID NO: 978854 - RNA, 17 nt, Mycobacterium avium subsp. paratuberculosis
uguccuggcccuugacc

SEQ ID NO: 978855 - RNA, 11 nt, Mycobacterium avium subsp. paratuberculosis
uguccgagcgg

SEQ ID NO: 978856 - RNA, 15 nt, Mycobacterium avium subsp. paratuberculosis
uguccgagcgggccg

SEQ ID NO: 978857 - RNA, 18 nt, Mycobacterium avium subsp. paratuberculosis
uguccgaugacgagcagc

SEQ ID NO: 978858 - RNA, 14 nt, Mycobacterium avium subsp. paratuberculosis
uguccgcguggccg

SEQ ID NO: 978859 - RNA, 17 nt, Mycobacterium avium subsp. paratuberculosis
uguccggcaggcucagc

SEQ ID NO: 978860 - RNA, 21 nt, Mycobacterium avium subsp. paratuberculosis
uguccggcaggcucagcagca

SEQ ID NO: 978861 - RNA, 16 nt, Mycobacterium avium subsp. paratuberculosis
uguccggggugagcag

SEQ ID NO: 978862 - RNA, 21 nt, Mycobacterium avium subsp. paratuberculosis
uguccggucucggucgcggcg

SEQ ID NO: 978863 - RNA, 16 nt, Mycobacterium avium subsp. paratuberculosis
uguccggcucugccug

SEQ ID NO: 978864 - RNA, 18 nt, Mycobacterium avium subsp. paratuberculosis
uguccgguaggccggccg

SEQ ID NO: 978865 - RNA, 19 nt, Mycobacterium avium subsp. paratuberculosis
ugucccgcgcccgcgaaca

SEQ ID NO: 978866 - RNA, 19 nt, Mycobacterium avium subsp. paratuberculosis
ugucccagcgccacuggcu

SEQ ID NO: 978867 - RNA, 14 nt, Mycobacterium avium subsp. paratuberculosis
ugucaccgacgcca

SEQ ID NO: 978868 - RNA, 11 nt, Mycobacterium avium subsp. paratuberculosis
uguagcgcagc

SEQ ID NO: 978869 - RNA, 15 nt, Mycobacterium avium subsp. paratuberculosis
uguagccgguccugg

SEQ ID NO: 978870 - RNA, 22 nt, Mycobacterium avium subsp. paratuberculosis
uguagccugcggccugcacagg

SEQ ID NO: 978871 - RNA, 21 nt, Mycobacterium avium subsp. paratuberculosis
uguagcccucccggaacagcu

SEQ ID NO: 978872 - RNA, 11 nt, Mycobacterium avium subsp. paratuberculosis
uguaucaggau

SEQ ID NO: 978873 - RNA, 16 nt, Mycobacterium avium subsp. paratuberculosis
uggguauccgccgcca

SEQ ID NO: 978874 - RNA, 21 nt, Mycobacterium avium subsp. paratuberculosis
uggucgggcaugccggccggc

SEQ ID NO: 978875 - RNA, 12 nt, Mycobacterium avium subsp. paratuberculosis
uggucgggcgca

SEQ ID NO: 978876 - RNA, 22 nt, Mycobacterium avium subsp. paratuberculosis
uggucggugcccugugaggcgu

SEQ ID NO: 978877 - RNA, 15 nt, Mycobacterium avium subsp. paratuberculosis
uggucguugcacacc

SEQ ID NO: 978878 - RNA, 19 nt, Mycobacterium avium subsp. paratuberculosis
uggucgugcagcaccgcca

SEQ ID NO: 978879 - RNA, 15 nt, Mycobacterium avium subsp. paratuberculosis
uggucucccgggcgg

SEQ ID NO: 978880 - RNA, 13 nt, Mycobacterium avium subsp. paratuberculosis
uggugcagcagcu

SEQ ID NO: 978881 - RNA, 15 nt, Mycobacterium avium subsp. paratuberculosis
uggugaugaucccgg

SEQ ID NO: 978882 - RNA, 19 nt, Mycobacterium avium subsp. paratuberculosis
uggugauagaucaucccgg

SEQ ID NO: 978883 - RNA, 12 nt, Mycobacterium avium subsp. paratuberculosis
uggugauccggg

SEQ ID NO: 978884 - RNA, 21 nt, Mycobacterium avium subsp. paratuberculosis
uggugaucgccgcggacccca

SEQ ID NO: 978885 - RNA, 15 nt, Mycobacterium avium subsp. paratuberculosis
uggugaucggccagg

SEQ ID NO: 978886 - RNA, 16 nt, Mycobacterium avium subsp. paratuberculosis
uggugaucggccaggc

SEQ ID NO: 978887 - RNA, 15 nt, Mycobacterium avium subsp. paratuberculosis
uggugccgcugacgg

SEQ ID NO: 978888 - RNA, 18 nt, Mycobacterium avium subsp. paratuberculosis
uggugccgcugacggucg

SEQ ID NO: 978889 - RNA, 15 nt, Mycobacterium avium subsp. paratuberculosis
uggugcgcagcccgc

SEQ ID NO: 978890 - RNA, 14 nt, Mycobacterium avium subsp. paratuberculosis
uggugcgggccagc

SEQ ID NO: 978891 - RNA, 15 nt, Mycobacterium avium subsp. paratuberculosis
uggugcgggccagca

SEQ ID NO: 978892 - RNA, 18 nt, Mycobacterium avium subsp. paratuberculosis
uggugcccaccgggcagc

SEQ ID NO: 978893 - RNA, 21 nt, Mycobacterium avium subsp. paratuberculosis
uggugccgccggugaacacga

SEQ ID NO: 978894 - RNA, 15 nt, Mycobacterium avium subsp. paratuberculosis
ugguuaccagcucac

SEQ ID NO: 978895 - RNA, 13 nt, Mycobacterium avium subsp. paratuberculosis
ugguguucugcuc

SEQ ID NO: 978896 - RNA, 14 nt, Mycobacterium avium subsp. paratuberculosis
ugguguggaagaag

SEQ ID NO: 978897 - RNA, 19 nt, Mycobacterium avium subsp. paratuberculosis
ugguguggcgucggccggg

SEQ ID NO: 978898 - RNA, 22 nt, Mycobacterium avium subsp. paratuberculosis
uggugugauacaggagggccag

SEQ ID NO: 978899 - RNA, 15 nt, Mycobacterium avium subsp. paratuberculosis
uggugugcaaggcga

SEQ ID NO: 978900 - RNA, 19 nt, Mycobacterium avium subsp. paratuberculosis
uggugugcaccagcgaucc

SEQ ID NO: 978901 - RNA, 21 nt, Mycobacterium avium subsp. paratuberculosis
ugguguaggcgaucgggaaca

SEQ ID NO: 978902 - RNA, 22 nt, Mycobacterium avium subsp. paratuberculosis
ugguggucgucgacgagcccgc

SEQ ID NO: 978903 - RNA, 16 nt, Mycobacterium avium subsp. paratuberculosis
ugguggacggucagcg

SEQ ID NO: 978904 - RNA, 19 nt, Mycobacterium avium subsp. paratuberculosis
ugguggacggucagcgcgc

SEQ ID NO: 978905 - RNA, 15 nt, Mycobacterium avium subsp. paratuberculosis
ugguggcagcggacc

SEQ ID NO: 978906 - RNA, 16 nt, Mycobacterium avium subsp. paratuberculosis
ugguggcagcggaccc

SEQ ID NO: 978907 - RNA, 12 nt, Mycobacterium avium subsp. paratuberculosis
ugguggccgcgg

SEQ ID NO: 978908 - RNA, 23 nt, Mycobacterium avium subsp. paratuberculosis
uggugggccaucgccaggaacca

SEQ ID NO: 978909 - RNA, 13 nt, Mycobacterium avium subsp. paratuberculosis
uggugggcgugcc

SEQ ID NO: 978910 - RNA, 15 nt, Mycobacterium avium subsp. paratuberculosis
uggugggcagaugcc

SEQ ID NO: 978911 - RNA, 18 nt, Mycobacterium avium subsp. paratuberculosis
uggugggcagaugcccgc

SEQ ID NO: 978912 - RNA, 20 nt, Mycobacterium avium subsp. paratuberculosis
uggugggcagccggcaacuc

SEQ ID NO: 978913 - RNA, 15 nt, Mycobacterium avium subsp. paratuberculosis
ugguuucgguccagg

SEQ ID NO: 978914 - RNA, 16 nt, Mycobacterium avium subsp. paratuberculosis
ugguuucgguccaggu

SEQ ID NO: 978915 - RNA, 19 nt, Mycobacterium avium subsp. paratuberculosis
ugguuggcccgcaccaccc

SEQ ID NO: 978916 - RNA, 17 nt, Mycobacterium avium subsp. paratuberculosis
ugguugagcagcagacc

SEQ ID NO: 978917 - RNA, 17 nt, Mycobacterium avium subsp. paratuberculosis
ugguuccccccauacac

SEQ ID NO: 978918 - RNA, 19 nt, Mycobacterium avium subsp. paratuberculosis
uggcgaauuccccguaguc

SEQ ID NO: 978919 - RNA, 20 nt, Mycobacterium avium subsp. paratuberculosis
uggcgacaggaaccuggucg

SEQ ID NO: 978920 - RNA, 20 nt, Mycobacterium avium subsp. paratuberculosis
uggcgacaucgccgcggccg

SEQ ID NO: 978921 - RNA, 20 nt, Mycobacterium avium subsp. paratuberculosis
uggcgaccaccgaccccugc

SEQ ID NO: 978922 - RNA, 17 nt, Mycobacterium avium subsp. paratuberculosis
uggccugguggcccagg

SEQ ID NO: 978923 - RNA, 17 nt, Mycobacterium avium subsp. paratuberculosis
uggccugcggcaacagc

SEQ ID NO: 978924 - RNA, 13 nt, Mycobacterium avium subsp. paratuberculosis
uggccugcccggc

SEQ ID NO: 978925 - RNA, 15 nt, Mycobacterium avium subsp. paratuberculosis
uggccugcccggcgg

SEQ ID NO: 978926 - RNA, 12 nt, Mycobacterium avium subsp. paratuberculosis
uggccgagcagc

SEQ ID NO: 978927 - RNA, 20 nt, Mycobacterium avium subsp. paratuberculosis
uggcccggucggaguccagc

SEQ ID NO: 978928 - RNA, 15 nt, Mycobacterium avium subsp. paratuberculosis
uggcccuucgaccuc

SEQ ID NO: 978929 - RNA, 17 nt, Mycobacterium avium subsp. paratuberculosis
uggccgaaccgcucguc

SEQ ID NO: 978930 - RNA, 15 nt, Mycobacterium avium subsp. paratuberculosis
uggcgaccgcggccg

SEQ ID NO: 978931 - RNA, 18 nt, Mycobacterium avium subsp. paratuberculosis
uggcgaccaucagccugc

SEQ ID NO: 978932 - RNA, 17 nt, Mycobacterium avium subsp. paratuberculosis
uggcgaccgguccgcgg

SEQ ID NO: 978933 - RNA, 16 nt, Mycobacterium avium subsp. paratuberculosis
uggcgacgaagucgac

SEQ ID NO: 978934 - RNA, 13 nt, Mycobacterium avium subsp. paratuberculosis
uggcgcagggcgu

SEQ ID NO: 978935 - RNA, 19 nt, Mycobacterium avium subsp. paratuberculosis
uggcucaacacguccuggc

SEQ ID NO: 978936 - RNA, 20 nt, Mycobacterium avium subsp. paratuberculosis
uggcucagcgcaccgccguc

SEQ ID NO: 978937 - RNA, 16 nt, Mycobacterium avium subsp. paratuberculosis
uggcgguuggacaggc

SEQ ID NO: 978938 - RNA, 15 nt, Mycobacterium avium subsp. paratuberculosis
uggcggcggccaggg

SEQ ID NO: 978939 - RNA, 13 nt, Mycobacterium avium subsp. paratuberculosis
uggcggcggccuu

SEQ ID NO: 978940 - RNA, 19 nt, Mycobacterium avium subsp. paratuberculosis
uggcggcgggccagcucgu

SEQ ID NO: 978941 - RNA, 18 nt, Mycobacterium avium subsp. paratuberculosis
uggcggcgugcaguccca

SEQ ID NO: 978942 - RNA, 20 nt, Mycobacterium avium subsp. paratuberculosis
uggcggcgugcagucccaga

SEQ ID NO: 978943 - RNA, 22 nt, Mycobacterium avium subsp. paratuberculosis
uggcggcgugggguucccggcc

SEQ ID NO: 978944 - RNA, 23 nt, Mycobacterium avium subsp. paratuberculosis
uggcggcgugggguucccggccg

SEQ ID NO: 978945 - RNA, 16 nt, Mycobacterium avium subsp. paratuberculosis
uggcggccaggccggc

SEQ ID NO: 978946 - RNA, 15 nt, Mycobacterium avium subsp. paratuberculosis
uggcggccagcgcgc

SEQ ID NO: 978947 - RNA, 15 nt, Mycobacterium avium subsp. paratuberculosis
uggcggcccgcgccg

SEQ ID NO: 978948 - RNA, 13 nt, Mycobacterium avium subsp. paratuberculosis
uggcggccggccg

SEQ ID NO: 978949 - RNA, 14 nt, Mycobacterium avium subsp. paratuberculosis
uggcggccgggucg

SEQ ID NO: 978950 - RNA, 13 nt, Mycobacterium avium subsp. paratuberculosis
uggcggccugcuc

SEQ ID NO: 978951 - RNA, 20 nt, Mycobacterium avium subsp. paratuberculosis
uggcggcgaacgcgcggucg

SEQ ID NO: 978952 - RNA, 17 nt, Mycobacterium avium subsp. paratuberculosis
uggcggcgaugucgucg

SEQ ID NO: 978953 - RNA, 20 nt, Mycobacterium avium subsp. paratuberculosis
uggcggcgccggaugccagc

SEQ ID NO: 978954 - RNA, 21 nt, Mycobacterium avium subsp. paratuberculosis
uggcggcgccggaugccagca

SEQ ID NO: 978955 - RNA, 17 nt, Mycobacterium avium subsp. paratuberculosis
uggcgcccgcguacagc

SEQ ID NO: 978956 - RNA, 12 nt, Mycobacterium avium subsp. paratuberculosis
uggcgcccagcg

SEQ ID NO: 978957 - RNA, 18 nt, Mycobacterium avium subsp. paratuberculosis
uggcgcgaaucccggccu

SEQ ID NO: 978958 - RNA, 16 nt, Mycobacterium avium subsp. paratuberculosis
ugggaaugcggcuggg

SEQ ID NO: 978959 - RNA, 14 nt, Mycobacterium avium subsp. paratuberculosis
ugggaagcaucaau

SEQ ID NO: 978960 - RNA, 16 nt, Mycobacterium avium subsp. paratuberculosis
ugggacggcggguggg

SEQ ID NO: 978961 - RNA, 18 nt, Mycobacterium avium subsp. paratuberculosis
ugggacggaaaucgccug

SEQ ID NO: 978962 - RNA, 18 nt, Mycobacterium avium subsp. paratuberculosis
uggcugugcacgauggac

SEQ ID NO: 978963 - RNA, 22 nt, Mycobacterium avium subsp. paratuberculosis
uggcugucggggaccguccccg

SEQ ID NO: 978964 - RNA, 21 nt, Mycobacterium avium subsp. paratuberculosis
uggcugggcgcuagcugcgcc

SEQ ID NO: 978965 - RNA, 13 nt, Mycobacterium avium subsp. paratuberculosis
uggcucucguccu

SEQ ID NO: 978966 - RNA, 12 nt, Mycobacterium avium subsp. paratuberculosis
uggcugaacagc

SEQ ID NO: 978967 - RNA, 13 nt, Mycobacterium avium subsp. paratuberculosis
uggcugagcagca

SEQ ID NO: 978968 - RNA, 14 nt, Mycobacterium avium subsp. paratuberculosis
uggcugagcagcac

SEQ ID NO: 978969 - RNA, 19 nt, Mycobacterium avium subsp. paratuberculosis
uggcugaggccgccccggc

SEQ ID NO: 978970 - RNA, 20 nt, Mycobacterium avium subsp. paratuberculosis
uggcugcacgucacgggcca

SEQ ID NO: 978971 - RNA, 23 nt, Mycobacterium avium subsp. paratuberculosis
uggggugaggcacccgcugcacc

SEQ ID NO: 978972 - RNA, 14 nt, Mycobacterium avium subsp. paratuberculosis
uggggugguggaau

SEQ ID NO: 978973 - RNA, 16 nt, Mycobacterium avium subsp. paratuberculosis
uggggugucagcgcga

SEQ ID NO: 978974 - RNA, 18 nt, Mycobacterium avium subsp. paratuberculosis
ugggcgaccacguccagc

SEQ ID NO: 978975 - RNA, 23 nt, Mycobacterium avium subsp. paratuberculosis
ugggcgacgucgucgcccacccg

SEQ ID NO: 978976 - RNA, 22 nt, Mycobacterium avium subsp. paratuberculosis
ugggcgaacagcagcacccggg

SEQ ID NO: 978977 - RNA, 21 nt, Mycobacterium avium subsp. paratuberculosis
ugggcuccgaccgugaagcua

SEQ ID NO: 978978 - RNA, 21 nt, Mycobacterium avium subsp. paratuberculosis
ugggcuccucgaccacgcaca

SEQ ID NO: 978979 - RNA, 20 nt, Mycobacterium avium subsp. paratuberculosis
ugggcucgagcaacaccacc

SEQ ID NO: 978980 - RNA, 23 nt, Mycobacterium avium subsp. paratuberculosis
ugggcucgagcaacaccaccuug

SEQ ID NO: 978981 - RNA, 20 nt, Mycobacterium avium subsp. paratuberculosis
ugggcucgagugccggcagc

SEQ ID NO: 978982 - RNA, 22 nt, Mycobacterium avium subsp. paratuberculosis
ugggcugcaucuccagccgcgg

SEQ ID NO: 978983 - RNA, 15 nt, Mycobacterium avium subsp. paratuberculosis
ugggcagcgcggcca

SEQ ID NO: 978984 - RNA, 22 nt, Mycobacterium avium subsp. paratuberculosis
ugggcagcggaaucgcccgggc

SEQ ID NO: 978985 - RNA, 17 nt, Mycobacterium avium subsp. paratuberculosis
ugggcauggugaagccc

SEQ ID NO: 978986 - RNA, 17 nt, Mycobacterium avium subsp. paratuberculosis
ugggccucguccaggga

SEQ ID NO: 978987 - RNA, 23 nt, Mycobacterium avium subsp. paratuberculosis
ugggccgucaggagugcucggcg

SEQ ID NO: 978988 - RNA, 22 nt, Mycobacterium avium subsp. paratuberculosis
ugggccggcgcccgucacgcug

SEQ ID NO: 978989 - RNA, 16 nt, Mycobacterium avium subsp. paratuberculosis
ugggccgcagcgcggc

SEQ ID NO: 978990 - RNA, 17 nt, Mycobacterium avium subsp. paratuberculosis
ugggccgcagcgcggcg

SEQ ID NO: 978991 - RNA, 23 nt, Mycobacterium avium subsp. paratuberculosis
ugggccaucccggggacaccggg

SEQ ID NO: 978992 - RNA, 18 nt, Mycobacterium avium subsp. paratuberculosis
ugggccaucggcagaccc

SEQ ID NO: 978993 - RNA, 13 nt, Mycobacterium avium subsp. paratuberculosis
ugggccagguccu

SEQ ID NO: 978994 - RNA, 13 nt, Mycobacterium avium subsp. paratuberculosis
ugggccagcgcgg

SEQ ID NO: 978995 - RNA, 12 nt, Mycobacterium avium subsp. paratuberculosis
uggcaaggccag

SEQ ID NO: 978996 - RNA, 13 nt, Mycobacterium avium subsp. paratuberculosis
uggcaaggccagc

SEQ ID NO: 978997 - RNA, 17 nt, Mycobacterium avium subsp. paratuberculosis
uggcaaggccagcaacc

SEQ ID NO: 978998 - RNA, 17 nt, Mycobacterium avium subsp. paratuberculosis
uggcagggccagcagcc

SEQ ID NO: 978999 - RNA, 11 nt, Mycobacterium avium subsp. paratuberculosis
uggcagguggc

SEQ ID NO: 979000 - RNA, 14 nt, Mycobacterium avium subsp. paratuberculosis
uggcagguggcgua

SEQ ID NO: 979001 - RNA, 18 nt, Mycobacterium avium subsp. paratuberculosis
uggcaucccgcgccugcc

SEQ ID NO: 979002 - RNA, 14 nt, Mycobacterium avium subsp. paratuberculosis
uggcauccgucggc

SEQ ID NO: 979003 - RNA, 15 nt, Mycobacterium avium subsp. paratuberculosis
uggccaccagguccu

SEQ ID NO: 979004 - RNA, 12 nt, Mycobacterium avium subsp. paratuberculosis
uggccccagccc

SEQ ID NO: 979005 - RNA, 18 nt, Mycobacterium avium subsp. paratuberculosis
uggcccccgccccagccc

SEQ ID NO: 979006 - RNA, 15 nt, Mycobacterium avium subsp. paratuberculosis
uggccccgggccgca

SEQ ID NO: 979007 - RNA, 21 nt, Mycobacterium avium subsp. paratuberculosis
uggccccgggccgcagggugg

SEQ ID NO: 979008 - RNA, 15 nt, Mycobacterium avium subsp. paratuberculosis
uggcccgcaccaccc

SEQ ID NO: 979009 - RNA, 19 nt, Mycobacterium avium subsp. paratuberculosis
uggcccgcaccacccagcc

SEQ ID NO: 979010 - RNA, 18 nt, Mycobacterium avium subsp. paratuberculosis
uggcccgacccguucuug

SEQ ID NO: 979011 - RNA, 15 nt, Mycobacterium avium subsp. paratuberculosis
uggcccagccggccg

SEQ ID NO: 979012 - RNA, 22 nt, Mycobacterium avium subsp. paratuberculosis
uggcccagccggugcgagccgc

SEQ ID NO: 979013 - RNA, 12 nt, Mycobacterium avium subsp. paratuberculosis
uggcccaggcag

SEQ ID NO: 979014 - RNA, 16 nt, Mycobacterium avium subsp. paratuberculosis
uggcccauguggccug

SEQ ID NO: 979015 - RNA, 17 nt, Mycobacterium avium subsp. paratuberculosis
uggcccaccgaaucacc

SEQ ID NO: 979016 - RNA, 19 nt, Mycobacterium avium subsp. paratuberculosis
uggcccaccgaaucaccca

SEQ ID NO: 979017 - RNA, 21 nt, Mycobacterium avium subsp. paratuberculosis
uggcccacgacgucugggccg

SEQ ID NO: 979018 - RNA, 16 nt, Mycobacterium avium subsp. paratuberculosis
uggcccacgcagccgu

SEQ ID NO: 979019 - RNA, 17 nt, Mycobacterium avium subsp. paratuberculosis
uggccacgcuggcgucc

SEQ ID NO: 979020 - RNA, 21 nt, Mycobacterium avium subsp. paratuberculosis
uggccaccgcaucgccgaggg

SEQ ID NO: 979021 - RNA, 19 nt, Mycobacterium avium subsp. paratuberculosis
uggaguggucaggcccagg

SEQ ID NO: 979022 - RNA, 15 nt, Mycobacterium avium subsp. paratuberculosis
uggaguagcuggauu

SEQ ID NO: 979023 - RNA, 14 nt, Mycobacterium avium subsp. paratuberculosis
uggaucaccaucac

SEQ ID NO: 979024 - RNA, 19 nt, Mycobacterium avium subsp. paratuberculosis
uggaucgcgcaggugaugc

SEQ ID NO: 979025 - RNA, 18 nt, Mycobacterium avium subsp. paratuberculosis
uggaucgcuucggccagc

SEQ ID NO: 979026 - RNA, 22 nt, Mycobacterium avium subsp. paratuberculosis
uggaucgcuucggccagcgcgu

SEQ ID NO: 979027 - RNA, 20 nt, Mycobacterium avium subsp. paratuberculosis
uggauccgaucagcagcacc

SEQ ID NO: 979028 - RNA, 16 nt, Mycobacterium avium subsp. paratuberculosis
uggaucuccagcagcu

SEQ ID NO: 979029 - RNA, 17 nt, Mycobacterium avium subsp. paratuberculosis
uggagauggccagcacc

SEQ ID NO: 979030 - RNA, 18 nt, Mycobacterium avium subsp. paratuberculosis
uggagauggccagcacca

SEQ ID NO: 979031 - RNA, 19 nt, Mycobacterium avium subsp. paratuberculosis
uggagauggccagcaccac

SEQ ID NO: 979032 - RNA, 15 nt, Mycobacterium avium subsp. paratuberculosis
uggagaucaccgcgu

SEQ ID NO: 979033 - RNA, 12 nt, Mycobacterium avium subsp. paratuberculosis
uggagccgacca

SEQ ID NO: 979034 - RNA, 14 nt, Mycobacterium avium subsp. paratuberculosis
uggagcacagcacg

SEQ ID NO: 979035 - RNA, 17 nt, Mycobacterium avium subsp. paratuberculosis
uggagcacagcacggca

SEQ ID NO: 979036 - RNA, 21 nt, Mycobacterium avium subsp. paratuberculosis
uggaggcgagcaacucuugcg

SEQ ID NO: 979037 - RNA, 20 nt, Mycobacterium avium subsp. paratuberculosis
uggagcugaaguucaccacc

SEQ ID NO: 979038 - RNA, 23 nt, Mycobacterium avium subsp. paratuberculosis
uggacgucgucgcuguccucgag

SEQ ID NO: 979039 - RNA, 14 nt, Mycobacterium avium subsp. paratuberculosis
uggacgguuucacc

SEQ ID NO: 979040 - RNA, 21 nt, Mycobacterium avium subsp. paratuberculosis
uggacgcccagaacugggccg

SEQ ID NO: 979041 - RNA, 17 nt, Mycobacterium avium subsp. paratuberculosis
uggacgaugcggggccg

SEQ ID NO: 979042 - RNA, 18 nt, Mycobacterium avium subsp. paratuberculosis
uggacgccgcacgcgacc

SEQ ID NO: 979043 - RNA, 19 nt, Mycobacterium avium subsp. paratuberculosis
uggacgcgauggcgcuggc

SEQ ID NO: 979044 - RNA, 23 nt, Mycobacterium avium subsp. paratuberculosis
uggagaaguccuuguggcccagg

SEQ ID NO: 979045 - RNA, 23 nt, Mycobacterium avium subsp. paratuberculosis
uggagaaguggcuggucacaccc

SEQ ID NO: 979046 - RNA, 15 nt, Mycobacterium avium subsp. paratuberculosis
uucgcugcccucggu

SEQ ID NO: 979047 - RNA, 22 nt, Mycobacterium avium subsp. paratuberculosis
uucgcugccccggcgaggccag

SEQ ID NO: 979048 - RNA, 12 nt, Mycobacterium avium subsp. paratuberculosis
uucgccggugac

SEQ ID NO: 979049 - RNA, 23 nt, Mycobacterium avium subsp. paratuberculosis
uucgccggugaccugcagcgccu

SEQ ID NO: 979050 - RNA, 16 nt, Mycobacterium avium subsp. paratuberculosis
uucgccgcgcuugcga

SEQ ID NO: 979051 - RNA, 11 nt, Mycobacterium avium subsp. paratuberculosis
uucgccgccgc

SEQ ID NO: 979052 - RNA, 11 nt, Mycobacterium avium subsp. paratuberculosis
uucgguccagg

SEQ ID NO: 979053 - RNA, 23 nt, Mycobacterium avium subsp. paratuberculosis
uucggaacccugccccacggccc

SEQ ID NO: 979054 - RNA, 14 nt, Mycobacterium avium subsp. paratuberculosis
uucucgaagcgcag

SEQ ID NO: 979055 - RNA, 17 nt, Mycobacterium avium subsp. paratuberculosis
uucucgaagcgcagcag

SEQ ID NO: 979056 - RNA, 14 nt, Mycobacterium avium subsp. paratuberculosis
uucucgcacagcac

SEQ ID NO: 979057 - RNA, 17 nt, Mycobacterium avium subsp. paratuberculosis
uucucgcacagcaccag

SEQ ID NO: 979058 - RNA, 14 nt, Mycobacterium avium subsp. paratuberculosis
uucucgccaauaaa

SEQ ID NO: 979059 - RNA, 14 nt, Mycobacterium avium subsp. paratuberculosis
uucucgaccaagaa

SEQ ID NO: 979060 - RNA, 14 nt, Mycobacterium avium subsp. paratuberculosis
uucugcaccagcuc

SEQ ID NO: 979061 - RNA, 23 nt, Mycobacterium avium subsp. paratuberculosis
uuccaccguggucggcagcaccg

SEQ ID NO: 979062 - RNA, 17 nt, Mycobacterium avium subsp. paratuberculosis
uuccagaaccggcagga

SEQ ID NO: 979063 - RNA, 11 nt, Mycobacterium avium subsp. paratuberculosis
uuccagcgcca

SEQ ID NO: 979064 - RNA, 14 nt, Mycobacterium avium subsp. paratuberculosis
uuccagcacccggc

SEQ ID NO: 979065 - RNA, 21 nt, Mycobacterium avium subsp. paratuberculosis
uuccagcacccggcccacgcc

SEQ ID NO: 979066 - RNA, 22 nt, Mycobacterium avium subsp. paratuberculosis
uuccagcacccggcccacgccg

SEQ ID NO: 979067 - RNA, 14 nt, Mycobacterium avium subsp. paratuberculosis
uuccagcaccaccc

SEQ ID NO: 979068 - RNA, 19 nt, Mycobacterium avium subsp. paratuberculosis
uuccaucgggcccagcagc

SEQ ID NO: 979069 - RNA, 20 nt, Mycobacterium avium subsp. paratuberculosis
uuccaucgggcccagcagcc

SEQ ID NO: 979070 - RNA, 14 nt, Mycobacterium avium subsp. paratuberculosis
uuccaucagcgccc

SEQ ID NO: 979071 - RNA, 19 nt, Mycobacterium avium subsp. paratuberculosis
uuccauucacgguccauca

SEQ ID NO: 979072 - RNA, 19 nt, Mycobacterium avium subsp. paratuberculosis
uuccagguguaggcguggc

SEQ ID NO: 979073 - RNA, 11 nt, Mycobacterium avium subsp. paratuberculosis
uuccagcgccg

SEQ ID NO: 979074 - RNA, 23 nt, Mycobacterium avium subsp. paratuberculosis
uuccagcgccggcaccagcagcc

SEQ ID NO: 979075 - RNA, 21 nt, Mycobacterium avium subsp. paratuberculosis
uucccgaccccgccagcaccg

SEQ ID NO: 979076 - RNA, 19 nt, Mycobacterium avium subsp. paratuberculosis
uuccucgacguaggccaga

SEQ ID NO: 979077 - RNA, 12 nt, Mycobacterium avium subsp. paratuberculosis
uuccuccucuuc

SEQ ID NO: 979078 - RNA, 13 nt, Mycobacterium avium subsp. paratuberculosis
uuccucagcgccc

SEQ ID NO: 979079 - RNA, 19 nt, Mycobacterium avium subsp. paratuberculosis
uuccgcugaugcggccgga

SEQ ID NO: 979080 - RNA, 19 nt, Mycobacterium avium subsp. paratuberculosis
uuccugcgaccgccgccgc

SEQ ID NO: 979081 - RNA, 14 nt, Mycobacterium avium subsp. paratuberculosis
uugccaacugcagc

SEQ ID NO: 979082 - RNA, 16 nt, Mycobacterium avium subsp. paratuberculosis
uugccaacugcagcaa

SEQ ID NO: 979083 - RNA, 19 nt, Mycobacterium avium subsp. paratuberculosis
uugccgcuggucaggccga

SEQ ID NO: 979084 - RNA, 22 nt, Mycobacterium avium subsp. paratuberculosis
uugccggcggcgggcucggagu

SEQ ID NO: 979085 - RNA, 18 nt, Mycobacterium avium subsp. paratuberculosis
uugccggccaucugcugg

SEQ ID NO: 979086 - RNA, 19 nt, Mycobacterium avium subsp. paratuberculosis
uugccgcgcgcccgcggcc

SEQ ID NO: 979087 - RNA, 10 nt, Mycobacterium avium subsp. paratuberculosis
uugccgccgc

SEQ ID NO: 979088 - RNA, 15 nt, Mycobacterium avium subsp. paratuberculosis
uugcccgacuccuca

SEQ ID NO: 979089 - RNA, 20 nt, Mycobacterium avium subsp. paratuberculosis
uugcccucgucgaccagggc

SEQ ID NO: 979090 - RNA, 16 nt, Mycobacterium avium subsp. paratuberculosis
uugcccugcgugcaga

SEQ ID NO: 979091 - RNA, 17 nt, Mycobacterium avium subsp. paratuberculosis
uugcccugaacgucuug

SEQ ID NO: 979092 - RNA, 12 nt, Mycobacterium avium subsp. paratuberculosis
uugcugaacacc

SEQ ID NO: 979093 - RNA, 21 nt, Mycobacterium avium subsp. paratuberculosis
uugcgccgccagggcgcggcg

SEQ ID NO: 979094 - RNA, 17 nt, Mycobacterium avium subsp. paratuberculosis
uugcgccgcgagcgcag

SEQ ID NO: 979095 - RNA, 16 nt, Mycobacterium avium subsp. paratuberculosis
uugcgccgcaacggcg

SEQ ID NO: 979096 - RNA, 21 nt, Mycobacterium avium subsp. paratuberculosis
uugcgccggguggccggggcc

SEQ ID NO: 979097 - RNA, 15 nt, Mycobacterium avium subsp. paratuberculosis
uugcgccagcagcaa

SEQ ID NO: 979098 - RNA, 16 nt, Mycobacterium avium subsp. paratuberculosis
uugcgcaucagcgcca

SEQ ID NO: 979099 - RNA, 13 nt, Mycobacterium avium subsp. paratuberculosis
uugcgcagcagca

SEQ ID NO: 979100 - RNA, 12 nt, Mycobacterium avium subsp. paratuberculosis
uugaccaggugg

SEQ ID NO: 979101 - RNA, 14 nt, Mycobacterium avium subsp. paratuberculosis
uugaccuugaccag

SEQ ID NO: 979102 - RNA, 17 nt, Mycobacterium avium subsp. paratuberculosis
uugacgcccccggugac

SEQ ID NO: 979103 - RNA, 13 nt, Mycobacterium avium subsp. paratuberculosis
uugacgcccuccu

SEQ ID NO: 979104 - RNA, 15 nt, Mycobacterium avium subsp. paratuberculosis
uugaccgccuuggcc

SEQ ID NO: 979105 - RNA, 18 nt, Mycobacterium avium subsp. paratuberculosis
uugaccgccuuggccacg

SEQ ID NO: 979106 - RNA, 22 nt, Mycobacterium avium subsp. paratuberculosis
uugacccggccggucgccugcu

SEQ ID NO: 979107 - RNA, 15 nt, Mycobacterium avium subsp. paratuberculosis
uugacguaacacccu

SEQ ID NO: 979108 - RNA, 14 nt, Mycobacterium avium subsp. paratuberculosis
uugaacgccgccaa

SEQ ID NO: 979109 - RNA, 14 nt, Mycobacterium avium subsp. paratuberculosis
uugaagccggugag

SEQ ID NO: 979110 - RNA, 13 nt, Mycobacterium avium subsp. paratuberculosis
uugaagcccugcu

SEQ ID NO: 979111 - RNA, 11 nt, Mycobacterium avium subsp. paratuberculosis
uugaacagcac

SEQ ID NO: 979112 - RNA, 15 nt, Mycobacterium avium subsp. paratuberculosis
uucagcagccggcag

SEQ ID NO: 979113 - RNA, 15 nt, Mycobacterium avium subsp. paratuberculosis
uucaggccacgcagg

SEQ ID NO: 979114 - RNA, 18 nt, Mycobacterium avium subsp. paratuberculosis
uucacgucgaucacgccg

SEQ ID NO: 979115 - RNA, 19 nt, Mycobacterium avium subsp. paratuberculosis
uucaccccguugagcagcg

SEQ ID NO: 979116 - RNA, 11 nt, Mycobacterium avium subsp. paratuberculosis
uucaccgugcg

SEQ ID NO: 979117 - RNA, 17 nt, Mycobacterium avium subsp. paratuberculosis
uucaccgccaccagcag

SEQ ID NO: 979118 - RNA, 15 nt, Mycobacterium avium subsp. paratuberculosis
uuagccccucccacc

SEQ ID NO: 979119 - RNA, 14 nt, Mycobacterium avium subsp. paratuberculosis
uuaaggagcaaucg

SEQ ID NO: 979120 - RNA, 21 nt, Mycobacterium avium subsp. paratuberculosis
uguggaccgcgcagucggcgu

SEQ ID NO: 979121 - RNA, 22 nt, Mycobacterium avium subsp. paratuberculosis
uguggacgaugcggggccggcg

SEQ ID NO: 979122 - RNA, 19 nt, Mycobacterium avium subsp. paratuberculosis
uguggaagggccccggcau

SEQ ID NO: 979123 - RNA, 16 nt, Mycobacterium avium subsp. paratuberculosis
uguggagaccaggucc

SEQ ID NO: 979124 - RNA, 19 nt, Mycobacterium avium subsp. paratuberculosis
uuucaaguccucccaaccc

SEQ ID NO: 979125 - RNA, 18 nt, Mycobacterium avium subsp. paratuberculosis
uuugccaucccgguggac

SEQ ID NO: 979126 - RNA, 12 nt, Mycobacterium avium subsp. paratuberculosis
uuugccacugag

SEQ ID NO: 979127 - RNA, 17 nt, Mycobacterium avium subsp. paratuberculosis
uuugccacugagcgcag

SEQ ID NO: 979128 - RNA, 18 nt, Mycobacterium avium subsp. paratuberculosis
uuugaucagcucgccgau

SEQ ID NO: 979129 - RNA, 23 nt, Mycobacterium avium subsp. paratuberculosis
uuucggggguaaaccgccagcag

SEQ ID NO: 979130 - RNA, 15 nt, Mycobacterium avium subsp. paratuberculosis
uuuccguccggcgac

SEQ ID NO: 979131 - RNA, 14 nt, Mycobacterium avium subsp. paratuberculosis
uuucgcucagccgu

SEQ ID NO: 979132 - RNA, 12 nt, Mycobacterium avium subsp. paratuberculosis
uuucgcgcggca

SEQ ID NO: 979133 - RNA, 19 nt, Mycobacterium avium subsp. paratuberculosis
uuucgcgcaccaccucggc

SEQ ID NO: 979134 - RNA, 17 nt, Mycobacterium avium subsp. paratuberculosis
uuucccgcgagcugccc

SEQ ID NO: 979135 - RNA, 23 nt, Mycobacterium avium subsp. paratuberculosis
uuucccgucgucgaugcgcagca

SEQ ID NO: 979136 - RNA, 12 nt, Mycobacterium avium subsp. paratuberculosis
uuuccaucuggg

SEQ ID NO: 979137 - RNA, 20 nt, Mycobacterium avium subsp. paratuberculosis
uuuccaguccggcgcccggc

SEQ ID NO: 979138 - RNA, 16 nt, Mycobacterium avium subsp. paratuberculosis
uuucccgacuccucac

SEQ ID NO: 979139 - RNA, 23 nt, Mycobacterium avium subsp. paratuberculosis
uuuccccagcccggaucccagaa

SEQ ID NO: 979140 - RNA, 19 nt, Mycobacterium avium subsp. paratuberculosis
uuuuugugggugguccagg

SEQ ID NO: 979141 - RNA, 16 nt, Mycobacterium avium subsp. paratuberculosis
uuuucccggccgccgg

SEQ ID NO: 979142 - RNA, 19 nt, Mycobacterium avium subsp. paratuberculosis
uuuggccauaccuagcacu

SEQ ID NO: 979143 - RNA, 17 nt, Mycobacterium avium subsp. paratuberculosis
uuuguccggcucugccu

SEQ ID NO: 979144 - RNA, 23 nt, Mycobacterium avium subsp. paratuberculosis
uuuguacaagugaugaccuggau

SEQ ID NO: 979145 - RNA, 19 nt, Mycobacterium avium subsp. paratuberculosis
aagauggcgugccacagca

SEQ ID NO: 979146 - RNA, 15 nt, Mycobacterium avium subsp. paratuberculosis
aagauguaucaggau

SEQ ID NO: 979147 - RNA, 16 nt, Mycobacterium avium subsp. paratuberculosis
aagauguccucgggaa

SEQ ID NO: 979148 - RNA, 19 nt, Mycobacterium avium subsp. paratuberculosis
aagaugucgccguacauca

SEQ ID NO: 979149 - RNA, 16 nt, Mycobacterium avium subsp. paratuberculosis
aagaucccgcuggcca

SEQ ID NO: 979150 - RNA, 13 nt, Mycobacterium avium subsp. paratuberculosis
aagcaucaauacg

SEQ ID NO: 979151 - RNA, 13 nt, Mycobacterium avium subsp. paratuberculosis
aagcauuggccca

SEQ ID NO: 979152 - RNA, 22 nt, Mycobacterium avium subsp. paratuberculosis
aagcagcucgcguagcgaggug

SEQ ID NO: 979153 - RNA, 19 nt, Mycobacterium avium subsp. paratuberculosis
aagcaccgcgaacagcacg

SEQ ID NO: 979154 - RNA, 21 nt, Mycobacterium avium subsp. paratuberculosis
aagagugcgauagcuucccuu

SEQ ID NO: 979155 - RNA, 22 nt, Mycobacterium avium subsp. paratuberculosis
aagacguaggcggccagcagca

SEQ ID NO: 979156 - RNA, 23 nt, Mycobacterium avium subsp. paratuberculosis
aagacguaggcggccagcagcac

SEQ ID NO: 979157 - RNA, 16 nt, Mycobacterium avium subsp. paratuberculosis
aagacggugggcccgc

SEQ ID NO: 979158 - RNA, 12 nt, Mycobacterium avium subsp. paratuberculosis
aagacccgaaac

SEQ ID NO: 979159 - RNA, 13 nt, Mycobacterium avium subsp. paratuberculosis
aagaaguuucccc

SEQ ID NO: 979160 - RNA, 22 nt, Mycobacterium avium subsp. paratuberculosis
aaguccgggucgcggaucucgu

SEQ ID NO: 979161 - RNA, 13 nt, Mycobacterium avium subsp. paratuberculosis
aagucggugcccu

SEQ ID NO: 979162 - RNA, 14 nt, Mycobacterium avium subsp. paratuberculosis
aagugcccgccuca

SEQ ID NO: 979163 - RNA, 18 nt, Mycobacterium avium subsp. paratuberculosis
aagugcccgccucacagc

SEQ ID NO: 979164 - RNA, 15 nt, Mycobacterium avium subsp. paratuberculosis
aaguuaacuucacgc

SEQ ID NO: 979165 - RNA, 18 nt, Mycobacterium avium subsp. paratuberculosis
aaguggaccgcgugugcc

SEQ ID NO: 979166 - RNA, 19 nt, Mycobacterium avium subsp. paratuberculosis
aaguguuguuugagaacuc

SEQ ID NO: 979167 - RNA, 21 nt, Mycobacterium avium subsp. paratuberculosis
aaguuggccaccggggucacc

SEQ ID NO: 979168 - RNA, 19 nt, Mycobacterium avium subsp. paratuberculosis
aaguuggcgucgggcaccu

SEQ ID NO: 979169 - RNA, 15 nt, Mycobacterium avium subsp. paratuberculosis
aaguuggucaccacc

SEQ ID NO: 979170 - RNA, 22 nt, Mycobacterium avium subsp. paratuberculosis
aaguuggucaccaccaacgcca

SEQ ID NO: 979171 - RNA, 14 nt, Mycobacterium avium subsp. paratuberculosis
aaggcagcagccau

SEQ ID NO: 979172 - RNA, 16 nt, Mycobacterium avium subsp. paratuberculosis
aaggccagcacgcagg

SEQ ID NO: 979173 - RNA, 12 nt, Mycobacterium avium subsp. paratuberculosis
aaggccagcaac

SEQ ID NO: 979174 - RNA, 21 nt, Mycobacterium avium subsp. paratuberculosis
aaggccgacagguagcaggcg

SEQ ID NO: 979175 - RNA, 21 nt, Mycobacterium avium subsp. paratuberculosis
aaggccgcgcgcaucucgaau

SEQ ID NO: 979176 - RNA, 13 nt, Mycobacterium avium subsp. paratuberculosis
aaggccuggaaca

SEQ ID NO: 979177 - RNA, 16 nt, Mycobacterium avium subsp. paratuberculosis
aaggcgaacaccagcc

SEQ ID NO: 979178 - RNA, 12 nt, Mycobacterium avium subsp. paratuberculosis
aaggccugcgcc

SEQ ID NO: 979179 - RNA, 22 nt, Mycobacterium avium subsp. paratuberculosis
aaggugccgcgaugcccgccgg

SEQ ID NO: 979180 - RNA, 12 nt, Mycobacterium avium subsp. paratuberculosis
aaggagcaaucg

SEQ ID NO: 979181 - RNA, 15 nt, Mycobacterium avium subsp. paratuberculosis
aagcuagcuucacgc

SEQ ID NO: 979182 - RNA, 14 nt, Mycobacterium avium subsp. paratuberculosis
aagcgcugaaccgg

SEQ ID NO: 979183 - RNA, 17 nt, Mycobacterium avium subsp. paratuberculosis
aagcggauugaccagca

SEQ ID NO: 979184 - RNA, 19 nt, Mycobacterium avium subsp. paratuberculosis
aagcguauccggccagccg

SEQ ID NO: 979185 - RNA, 18 nt, Mycobacterium avium subsp. paratuberculosis
aaugucauuugagcggcc

SEQ ID NO: 979186 - RNA, 12 nt, Mycobacterium avium subsp. paratuberculosis
aaugggccaugc

SEQ ID NO: 979187 - RNA, 11 nt, Mycobacterium avium subsp. paratuberculosis
aauggcagcag

SEQ ID NO: 979188 - RNA, 13 nt, Mycobacterium avium subsp. paratuberculosis
aauggcagcagcc

SEQ ID NO: 979189 - RNA, 12 nt, Mycobacterium avium subsp. paratuberculosis
aaucggacccag

SEQ ID NO: 979190 - RNA, 16 nt, Mycobacterium avium subsp. paratuberculosis
aaucggacccagcccg

SEQ ID NO: 979191 - RNA, 16 nt, Mycobacterium avium subsp. paratuberculosis
aaucgcaaccagugca

SEQ ID NO: 979192 - RNA, 15 nt, Mycobacterium avium subsp. paratuberculosis
aaucggcgccggcuc

SEQ ID NO: 979193 - RNA, 19 nt, Mycobacterium avium subsp. paratuberculosis
aaucucucgaccuugccgu

SEQ ID NO: 979194 - RNA, 19 nt, Mycobacterium avium subsp. paratuberculosis
aaucucgaaguggacaugc

SEQ ID NO: 979195 - RNA, 22 nt, Mycobacterium avium subsp. paratuberculosis
aauacaccguccagcucagcgc

SEQ ID NO: 979196 - RNA, 23 nt, Mycobacterium avium subsp. paratuberculosis
aaucaccgcgguguugagcgcgu

SEQ ID NO: 979197 - RNA, 21 nt, Mycobacterium avium subsp. paratuberculosis
aaucaccuugcccugcgugca

SEQ ID NO: 979198 - RNA, 11 nt, Mycobacterium avium subsp. paratuberculosis
aaucagcagcu

SEQ ID NO: 979199 - RNA, 21 nt, Mycobacterium avium subsp. paratuberculosis
accgagugcggcgcggugcgc

SEQ ID NO: 979200 - RNA, 17 nt, Mycobacterium avium subsp. paratuberculosis
accgaggcgaagguggc

SEQ ID NO: 979201 - RNA, 16 nt, Mycobacterium avium subsp. paratuberculosis
accgcaucgaaccgcc

SEQ ID NO: 979202 - RNA, 12 nt, Mycobacterium avium subsp. paratuberculosis
accgccagcacc

SEQ ID NO: 979203 - RNA, 15 nt, Mycobacterium avium subsp. paratuberculosis
accgccagcaccgcg

SEQ ID NO: 979204 - RNA, 20 nt, Mycobacterium avium subsp. paratuberculosis
accgccacgccguugggcgc

SEQ ID NO: 979205 - RNA, 12 nt, Mycobacterium avium subsp. paratuberculosis
accgccagccac

SEQ ID NO: 979206 - RNA, 23 nt, Mycobacterium avium subsp. paratuberculosis
accgccacggcgacgaccaccag

SEQ ID NO: 979207 - RNA, 20 nt, Mycobacterium avium subsp. paratuberculosis
accgccgcacccagcgggcg

SEQ ID NO: 979208 - RNA, 15 nt, Mycobacterium avium subsp. paratuberculosis
accgccgccagcagc

SEQ ID NO: 979209 - RNA, 16 nt, Mycobacterium avium subsp. paratuberculosis
accgccgccagcagca

SEQ ID NO: 979210 - RNA, 14 nt, Mycobacterium avium subsp. paratuberculosis
accgccaggaagac

SEQ ID NO: 979211 - RNA, 14 nt, Mycobacterium avium subsp. paratuberculosis
accgccaggaccac

SEQ ID NO: 979212 - RNA, 13 nt, Mycobacterium avium subsp. paratuberculosis
accgccaggcugg

SEQ ID NO: 979213 - RNA, 23 nt, Mycobacterium avium subsp. paratuberculosis
accgcccgcggugugcuggccag

SEQ ID NO: 979214 - RNA, 13 nt, Mycobacterium avium subsp. paratuberculosis
accgcuuggccca

SEQ ID NO: 979215 - RNA, 14 nt, Mycobacterium avium subsp. paratuberculosis
accgcuugcggcuc

SEQ ID NO: 979216 - RNA, 20 nt, Mycobacterium avium subsp. paratuberculosis
accggacugcuugggcgccu

SEQ ID NO: 979217 - RNA, 12 nt, Mycobacterium avium subsp. paratuberculosis
accggacagcug

SEQ ID NO: 979218 - RNA, 18 nt, Mycobacterium avium subsp. paratuberculosis
accggaccggccagcagc

SEQ ID NO: 979219 - RNA, 14 nt, Mycobacterium avium subsp. paratuberculosis
accggaauggcagc

SEQ ID NO: 979220 - RNA, 19 nt, Mycobacterium avium subsp. paratuberculosis
accggaauggcagcagccg

SEQ ID NO: 979221 - RNA, 20 nt, Mycobacterium avium subsp. paratuberculosis
accggaagaucagcaggcug

SEQ ID NO: 979222 - RNA, 17 nt, Mycobacterium avium subsp. paratuberculosis
accgcggugaccgcccg

SEQ ID NO: 979223 - RNA, 19 nt, Mycobacterium avium subsp. paratuberculosis
accgcguccgaggcgguuc

SEQ ID NO: 979224 - RNA, 16 nt, Mycobacterium avium subsp. paratuberculosis
accgcguccugcaggc

SEQ ID NO: 979225 - RNA, 23 nt, Mycobacterium avium subsp. paratuberculosis
accgcgucgaccaccgccggccc

SEQ ID NO: 979226 - RNA, 13 nt, Mycobacterium avium subsp. paratuberculosis
accgcgucggagg

SEQ ID NO: 979227 - RNA, 20 nt, Mycobacterium avium subsp. paratuberculosis
accgcguuggccgccacgau

SEQ ID NO: 979228 - RNA, 16 nt, Mycobacterium avium subsp. paratuberculosis
accgcguugucggcga

SEQ ID NO: 979229 - RNA, 16 nt, Mycobacterium avium subsp. paratuberculosis
accgcuccccgagcac

SEQ ID NO: 979230 - RNA, 22 nt, Mycobacterium avium subsp. paratuberculosis
accgcgaucgccgacgucggaa

SEQ ID NO: 979231 - RNA, 16 nt, Mycobacterium avium subsp. paratuberculosis
accgcgcagaaccgca

SEQ ID NO: 979232 - RNA, 15 nt, Mycobacterium avium subsp. paratuberculosis
accgcgggcaucgcc

SEQ ID NO: 979233 - RNA, 15 nt, Mycobacterium avium subsp. paratuberculosis
accgcgggccaggcc

SEQ ID NO: 979234 - RNA, 20 nt, Mycobacterium avium subsp. paratuberculosis
accgcgggccaggcccaccg

SEQ ID NO: 979235 - RNA, 13 nt, Mycobacterium avium subsp. paratuberculosis
accgcgggcgcgc

SEQ ID NO: 979236 - RNA, 17 nt, Mycobacterium avium subsp. paratuberculosis
accgcggggugcccggc

SEQ ID NO: 979237 - RNA, 18 nt, Mycobacterium avium subsp. paratuberculosis
accgcgggugaggggcgc

SEQ ID NO: 979238 - RNA, 20 nt, Mycobacterium avium subsp. paratuberculosis
accgcggcguugcccggguc

SEQ ID NO: 979239 - RNA, 22 nt, Mycobacterium avium subsp. paratuberculosis
accgcggcggcgucgaccgccc

SEQ ID NO: 979240 - RNA, 23 nt, Mycobacterium avium subsp. paratuberculosis
accgcggcggcgucgaccgcccc

SEQ ID NO: 979241 - RNA, 14 nt, Mycobacterium avium subsp. paratuberculosis
accgcggccucggc

SEQ ID NO: 979242 - RNA, 14 nt, Mycobacterium avium subsp. paratuberculosis
accgcggccucguc

SEQ ID NO: 979243 - RNA, 15 nt, Mycobacterium avium subsp. paratuberculosis
accgcgagcggguga

SEQ ID NO: 979244 - RNA, 20 nt, Mycobacterium avium subsp. paratuberculosis
accgccgcggcgcccggcgc

SEQ ID NO: 979245 - RNA, 17 nt, Mycobacterium avium subsp. paratuberculosis
accgcgaguucgcgcac

SEQ ID NO: 979246 - RNA, 20 nt, Mycobacterium avium subsp. paratuberculosis
accgccggacaccaccgcgg

SEQ ID NO: 979247 - RNA, 16 nt, Mycobacterium avium subsp. paratuberculosis
accgccggcagcggcu

SEQ ID NO: 979248 - RNA, 15 nt, Mycobacterium avium subsp. paratuberculosis
accgccggccaggcg

SEQ ID NO: 979249 - RNA, 20 nt, Mycobacterium avium subsp. paratuberculosis
accgcgaccgguccgugcca

SEQ ID NO: 979250 - RNA, 17 nt, Mycobacterium avium subsp. paratuberculosis
accgcgacgaccucgcc

SEQ ID NO: 979251 - RNA, 18 nt, Mycobacterium avium subsp. paratuberculosis
accgcgacggcgcccgcc

SEQ ID NO: 979252 - RNA, 23 nt, Mycobacterium avium subsp. paratuberculosis
accgcgacggugagcaacaccgg

SEQ ID NO: 979253 - RNA, 16 nt, Mycobacterium avium subsp. paratuberculosis
accgcgagacccgguc

SEQ ID NO: 979254 - RNA, 16 nt, Mycobacterium avium subsp. paratuberculosis
accgccgcgggcuccc

SEQ ID NO: 979255 - RNA, 20 nt, Mycobacterium avium subsp. paratuberculosis
accgccgcgggcucccgcuc

SEQ ID NO: 979256 - RNA, 20 nt, Mycobacterium avium subsp. paratuberculosis
accgccgcgcggccgggcuc

SEQ ID NO: 979257 - RNA, 22 nt, Mycobacterium avium subsp. paratuberculosis
accgccgcgcggccgggcuccc

SEQ ID NO: 979258 - RNA, 21 nt, Mycobacterium avium subsp. paratuberculosis
accgaauuguccagcaguuug

SEQ ID NO: 979259 - RNA, 18 nt, Mycobacterium avium subsp. paratuberculosis
accgaagggaaaggcagc

SEQ ID NO: 979260 - RNA, 22 nt, Mycobacterium avium subsp. paratuberculosis
accgaagggaaaggcagcagcc

SEQ ID NO: 979261 - RNA, 23 nt, Mycobacterium avium subsp. paratuberculosis
accgaagggaaaggcagcagcca

SEQ ID NO: 979262 - RNA, 14 nt, Mycobacterium avium subsp. paratuberculosis
accgacggccgcac

SEQ ID NO: 979263 - RNA, 18 nt, Mycobacterium avium subsp. paratuberculosis
accgacggccgcacccca

SEQ ID NO: 979264 - RNA, 22 nt, Mycobacterium avium subsp. paratuberculosis
accgacggccgcaccccacccg

SEQ ID NO: 979265 - RNA, 22 nt, Mycobacterium avium subsp. paratuberculosis
accgacggcuggaaucccgccu

SEQ ID NO: 979266 - RNA, 20 nt, Mycobacterium avium subsp. paratuberculosis
accgagauggugaagugccg

SEQ ID NO: 979267 - RNA, 13 nt, Mycobacterium avium subsp. paratuberculosis
accgagcagcugc

SEQ ID NO: 979268 - RNA, 11 nt, Mycobacterium avium subsp. paratuberculosis
accgagccggc

SEQ ID NO: 979269 - RNA, 15 nt, Mycobacterium avium subsp. paratuberculosis
accgagccggggcug

SEQ ID NO: 979270 - RNA, 14 nt, Mycobacterium avium subsp. paratuberculosis
accgagcugggccg

SEQ ID NO: 979271 - RNA, 15 nt, Mycobacterium avium subsp. paratuberculosis
accgagcggggugug

SEQ ID NO: 979272 - RNA, 21 nt, Mycobacterium avium subsp. paratuberculosis
accgaggcaaucgagcgggcg

SEQ ID NO: 979273 - RNA, 13 nt, Mycobacterium avium subsp. paratuberculosis
accgacaguccca

SEQ ID NO: 979274 - RNA, 17 nt, Mycobacterium avium subsp. paratuberculosis
accgacagucccaccag

SEQ ID NO: 979275 - RNA, 17 nt, Mycobacterium avium subsp. paratuberculosis
accgacauggccagcac

SEQ ID NO: 979276 - RNA, 14 nt, Mycobacterium avium subsp. paratuberculosis
accgacgccagcgg

SEQ ID NO: 979277 - RNA, 20 nt, Mycobacterium avium subsp. paratuberculosis
accgacggagccgagcacca

SEQ ID NO: 979278 - RNA, 22 nt, Mycobacterium avium subsp. paratuberculosis
acccugcguccggcccggcguc

SEQ ID NO: 979279 - RNA, 17 nt, Mycobacterium avium subsp. paratuberculosis
acccuggcgaaccgcgg

SEQ ID NO: 979280 - RNA, 13 nt, Mycobacterium avium subsp. paratuberculosis
acccuucggccgg

SEQ ID NO: 979281 - RNA, 17 nt, Mycobacterium avium subsp. paratuberculosis
acccuucggccggcagc

SEQ ID NO: 979282 - RNA, 16 nt, Mycobacterium avium subsp. paratuberculosis
acccucagggagcugc

SEQ ID NO: 979283 - RNA, 18 nt, Mycobacterium avium subsp. paratuberculosis
acccucgccgccgccgau

SEQ ID NO: 979284 - RNA, 16 nt, Mycobacterium avium subsp. paratuberculosis
acccucagaccauggc

SEQ ID NO: 979285 - RNA, 21 nt, Mycobacterium avium subsp. paratuberculosis
acccucaccccgcccagcgca

SEQ ID NO: 979286 - RNA, 14 nt, Mycobacterium avium subsp. paratuberculosis
acccguugucgguc

SEQ ID NO: 979287 - RNA, 14 nt, Mycobacterium avium subsp. paratuberculosis
acccguugcagcac

SEQ ID NO: 979288 - RNA, 14 nt, Mycobacterium avium subsp. paratuberculosis
acccguugcgcccc

SEQ ID NO: 979289 - RNA, 15 nt, Mycobacterium avium subsp. paratuberculosis
acccguuccccggcc

SEQ ID NO: 979290 - RNA, 15 nt, Mycobacterium avium subsp. paratuberculosis
acccguuggcaggcc

SEQ ID NO: 979291 - RNA, 17 nt, Mycobacterium avium subsp. paratuberculosis
acccguuugaggcgagc

SEQ ID NO: 979292 - RNA, 22 nt, Mycobacterium avium subsp. paratuberculosis
acccguuugaggcgagcaauua

SEQ ID NO: 979293 - RNA, 23 nt, Mycobacterium avium subsp. paratuberculosis
acccgucgcgggucagcgucgcc

SEQ ID NO: 979294 - RNA, 23 nt, Mycobacterium avium subsp. paratuberculosis
acccguggugggcgaacagcagc

SEQ ID NO: 979295 - RNA, 11 nt, Mycobacterium avium subsp. paratuberculosis
acccgcggcgc

SEQ ID NO: 979296 - RNA, 14 nt, Mycobacterium avium subsp. paratuberculosis
acccgcuccagcgg

SEQ ID NO: 979297 - RNA, 19 nt, Mycobacterium avium subsp. paratuberculosis
acccgcugauccagcagcg

SEQ ID NO: 979298 - RNA, 22 nt, Mycobacterium avium subsp. paratuberculosis
acccggacgaugacccagccca

SEQ ID NO: 979299 - RNA, 21 nt, Mycobacterium avium subsp. paratuberculosis
acccgcugucaauccccgcgg

SEQ ID NO: 979300 - RNA, 17 nt, Mycobacterium avium subsp. paratuberculosis
acccgccgcaccucgcc

SEQ ID NO: 979301 - RNA, 21 nt, Mycobacterium avium subsp. paratuberculosis
acccgccgcggcaacgccagc

SEQ ID NO: 979302 - RNA, 23 nt, Mycobacterium avium subsp. paratuberculosis
acccgccgcggcaacgccagcca

SEQ ID NO: 979303 - RNA, 18 nt, Mycobacterium avium subsp. paratuberculosis
acccgccgcggccgaacc

SEQ ID NO: 979304 - RNA, 14 nt, Mycobacterium avium subsp. paratuberculosis
acccgcgaccccuc

SEQ ID NO: 979305 - RNA, 16 nt, Mycobacterium avium subsp. paratuberculosis
acccgguggcccgguc

SEQ ID NO: 979306 - RNA, 23 nt, Mycobacterium avium subsp. paratuberculosis
acccgggcccggucgucgccgga

SEQ ID NO: 979307 - RNA, 22 nt, Mycobacterium avium subsp. paratuberculosis
acccgguccggcuggucggccu

SEQ ID NO: 979308 - RNA, 16 nt, Mycobacterium avium subsp. paratuberculosis
acccggcucuccaucu

SEQ ID NO: 979309 - RNA, 22 nt, Mycobacterium avium subsp. paratuberculosis
acccggcgugcuccagcaggcg

SEQ ID NO: 979310 - RNA, 17 nt, Mycobacterium avium subsp. paratuberculosis
acccgggcagcuuccgc

SEQ ID NO: 979311 - RNA, 15 nt, Mycobacterium avium subsp. paratuberculosis
acccggcgcccggcc

SEQ ID NO: 979312 - RNA, 13 nt, Mycobacterium avium subsp. paratuberculosis
acccggccacgcc

SEQ ID NO: 979313 - RNA, 14 nt, Mycobacterium avium subsp. paratuberculosis
acccggccacgccg

SEQ ID NO: 979314 - RNA, 21 nt, Mycobacterium avium subsp. paratuberculosis
acccggccacgccggguuugu

SEQ ID NO: 979315 - RNA, 20 nt, Mycobacterium avium subsp. paratuberculosis
acccggcccaccaccgccuc

SEQ ID NO: 979316 - RNA, 15 nt, Mycobacterium avium subsp. paratuberculosis
acccggcccacgccg

SEQ ID NO: 979317 - RNA, 16 nt, Mycobacterium avium subsp. paratuberculosis
acccggcccccugagg

SEQ ID NO: 979318 - RNA, 16 nt, Mycobacterium avium subsp. paratuberculosis
acccggccgagcgcgc

SEQ ID NO: 979319 - RNA, 17 nt, Mycobacterium avium subsp. paratuberculosis
acccauucacgcagcug

SEQ ID NO: 979320 - RNA, 19 nt, Mycobacterium avium subsp. paratuberculosis
acccauucacgcagcuggc

SEQ ID NO: 979321 - RNA, 22 nt, Mycobacterium avium subsp. paratuberculosis
acccaugauggugggcaccgcg

SEQ ID NO: 979322 - RNA, 14 nt, Mycobacterium avium subsp. paratuberculosis
accccgcucggcca

SEQ ID NO: 979323 - RNA, 19 nt, Mycobacterium avium subsp. paratuberculosis
accccgcucggccagcgcg

SEQ ID NO: 979324 - RNA, 16 nt, Mycobacterium avium subsp. paratuberculosis
accccgcugcucuugu

SEQ ID NO: 979325 - RNA, 20 nt, Mycobacterium avium subsp. paratuberculosis
accccggcgacggcgguggg

SEQ ID NO: 979326 - RNA, 20 nt, Mycobacterium avium subsp. paratuberculosis
accccggcgaugaccgggac

SEQ ID NO: 979327 - RNA, 13 nt, Mycobacterium avium subsp. paratuberculosis
accccgggcggcu

SEQ ID NO: 979328 - RNA, 15 nt, Mycobacterium avium subsp. paratuberculosis
accccguaggugcac

SEQ ID NO: 979329 - RNA, 17 nt, Mycobacterium avium subsp. paratuberculosis
accccgucgagcagccg

SEQ ID NO: 979330 - RNA, 15 nt, Mycobacterium avium subsp. paratuberculosis
acccgacuucggcuc

SEQ ID NO: 979331 - RNA, 16 nt, Mycobacterium avium subsp. paratuberculosis
acccgauccagacggu

SEQ ID NO: 979332 - RNA, 20 nt, Mycobacterium avium subsp. paratuberculosis
acccgaucgaucaucgccuc

SEQ ID NO: 979333 - RNA, 20 nt, Mycobacterium avium subsp. paratuberculosis
acccgaagcccaagugcccg

SEQ ID NO: 979334 - RNA, 19 nt, Mycobacterium avium subsp. paratuberculosis
acccgaaagcccccagcuc

SEQ ID NO: 979335 - RNA, 19 nt, Mycobacterium avium subsp. paratuberculosis
acccgaaaagcaccaggcu

SEQ ID NO: 979336 - RNA, 22 nt, Mycobacterium avium subsp. paratuberculosis
acccgaaaagcaccaggcucgc

SEQ ID NO: 979337 - RNA, 14 nt, Mycobacterium avium subsp. paratuberculosis
acccgaccagcacc

SEQ ID NO: 979338 - RNA, 17 nt, Mycobacterium avium subsp. paratuberculosis
acccgaccagcaccgcg

SEQ ID NO: 979339 - RNA, 19 nt, Mycobacterium avium subsp. paratuberculosis
acccgcaacgcugaccgca

SEQ ID NO: 979340 - RNA, 20 nt, Mycobacterium avium subsp. paratuberculosis
acccgcaaggccgccagccg

SEQ ID NO: 979341 - RNA, 21 nt, Mycobacterium avium subsp. paratuberculosis
acccgcaaggccgccagccgc

SEQ ID NO: 979342 - RNA, 12 nt, Mycobacterium avium subsp. paratuberculosis
acccgcaccacc

SEQ ID NO: 979343 - RNA, 13 nt, Mycobacterium avium subsp. paratuberculosis
acccgccagcccg

SEQ ID NO: 979344 - RNA, 22 nt, Mycobacterium avium subsp. paratuberculosis
acccgcauccgccgggcggcgu

SEQ ID NO: 979345 - RNA, 16 nt, Mycobacterium avium subsp. paratuberculosis
acccgccauggcggca

SEQ ID NO: 979346 - RNA, 15 nt, Mycobacterium avium subsp. paratuberculosis
acccgcaggccauga

SEQ ID NO: 979347 - RNA, 13 nt, Mycobacterium avium subsp. paratuberculosis
acccgcagggcgc

SEQ ID NO: 979348 - RNA, 16 nt, Mycobacterium avium subsp. paratuberculosis
acccagguggaugcga

SEQ ID NO: 979349 - RNA, 14 nt, Mycobacterium avium subsp. paratuberculosis
acccacggccacaa

SEQ ID NO: 979350 - RNA, 17 nt, Mycobacterium avium subsp. paratuberculosis
acccacggccacaacgu

SEQ ID NO: 979351 - RNA, 19 nt, Mycobacterium avium subsp. paratuberculosis
acccaccggcgcagcgcgu

SEQ ID NO: 979352 - RNA, 19 nt, Mycobacterium avium subsp. paratuberculosis
acccagcuugaccacccgg

SEQ ID NO: 979353 - RNA, 19 nt, Mycobacterium avium subsp. paratuberculosis
acccaggaaaaccagcgac

SEQ ID NO: 979354 - RNA, 15 nt, Mycobacterium avium subsp. paratuberculosis
acccaggccacccgg

SEQ ID NO: 979355 - RNA, 11 nt, Mycobacterium avium subsp. paratuberculosis
acccacuggcg

SEQ ID NO: 979356 - RNA, 15 nt, Mycobacterium avium subsp. paratuberculosis
accauuugcccagca

SEQ ID NO: 979357 - RNA, 17 nt, Mycobacterium avium subsp. paratuberculosis
accauuugcccagcagg

SEQ ID NO: 979358 - RNA, 15 nt, Mycobacterium avium subsp. paratuberculosis
acccaaaacaucggc

SEQ ID NO: 979359 - RNA, 16 nt, Mycobacterium avium subsp. paratuberculosis
accaugucggccaggu

SEQ ID NO: 979360 - RNA, 20 nt, Mycobacterium avium subsp. paratuberculosis
accaugucggcgacccgcac

SEQ ID NO: 979361 - RNA, 16 nt, Mycobacterium avium subsp. paratuberculosis
accauccgguccagau

SEQ ID NO: 979362 - RNA, 20 nt, Mycobacterium avium subsp. paratuberculosis
accaucgggucgucggcguc

SEQ ID NO: 979363 - RNA, 14 nt, Mycobacterium avium subsp. paratuberculosis
accaucuacgaccu

SEQ ID NO: 979364 - RNA, 15 nt, Mycobacterium avium subsp. paratuberculosis
accaugcccagcagu

SEQ ID NO: 979365 - RNA, 14 nt, Mycobacterium avium subsp. paratuberculosis
accaugacccacgg

SEQ ID NO: 979366 - RNA, 12 nt, Mycobacterium avium subsp. paratuberculosis
accaucuuccau

SEQ ID NO: 979367 - RNA, 19 nt, Mycobacterium avium subsp. paratuberculosis
accaggaugcccaggauga

SEQ ID NO: 979368 - RNA, 20 nt, Mycobacterium avium subsp. paratuberculosis
accauccgcgacgccagcac

SEQ ID NO: 979369 - RNA, 21 nt, Mycobacterium avium subsp. paratuberculosis
accaccuucaucgccgucgcc

SEQ ID NO: 979370 - RNA, 17 nt, Mycobacterium avium subsp. paratuberculosis
accaccgugcuggccac

SEQ ID NO: 979371 - RNA, 18 nt, Mycobacterium avium subsp. paratuberculosis
accaccgugcuggccacc

SEQ ID NO: 979372 - RNA, 18 nt, Mycobacterium avium subsp. paratuberculosis
accaccguggccccagcc

SEQ ID NO: 979373 - RNA, 22 nt, Mycobacterium avium subsp. paratuberculosis
accaccguggccccagccaccg

SEQ ID NO: 979374 - RNA, 13 nt, Mycobacterium avium subsp. paratuberculosis
accacccacuccc

SEQ ID NO: 979375 - RNA, 16 nt, Mycobacterium avium subsp. paratuberculosis
accaccgucaccgccg

SEQ ID NO: 979376 - RNA, 19 nt, Mycobacterium avium subsp. paratuberculosis
accacaucgguugcuccgg

SEQ ID NO: 979377 - RNA, 20 nt, Mycobacterium avium subsp. paratuberculosis
accaccagcgguaaccaccc

SEQ ID NO: 979378 - RNA, 20 nt, Mycobacterium avium subsp. paratuberculosis
accaccagcgugcugccgga

SEQ ID NO: 979379 - RNA, 15 nt, Mycobacterium avium subsp. paratuberculosis
accaccagccgcagg

SEQ ID NO: 979380 - RNA, 17 nt, Mycobacterium avium subsp. paratuberculosis
accaccaggagcaccug

SEQ ID NO: 979381 - RNA, 20 nt, Mycobacterium avium subsp. paratuberculosis
accaccaggagcaccugcgc

SEQ ID NO: 979382 - RNA, 20 nt, Mycobacterium avium subsp. paratuberculosis
accacgcugagcaaccgccg

SEQ ID NO: 979383 - RNA, 22 nt, Mycobacterium avium subsp. paratuberculosis
accacgcuguagggccaccacg

SEQ ID NO: 979384 - RNA, 23 nt, Mycobacterium avium subsp. paratuberculosis
accacguagccgaccuugaccca

SEQ ID NO: 979385 - RNA, 20 nt, Mycobacterium avium subsp. paratuberculosis
accacgucggguucgccggu

SEQ ID NO: 979386 - RNA, 19 nt, Mycobacterium avium subsp. paratuberculosis
accacgugcgcgaagcugg

SEQ ID NO: 979387 - RNA, 21 nt, Mycobacterium avium subsp. paratuberculosis
accacgugcgcgaagcugggg

SEQ ID NO: 979388 - RNA, 15 nt, Mycobacterium avium subsp. paratuberculosis
accacguccagcugg

SEQ ID NO: 979389 - RNA, 16 nt, Mycobacterium avium subsp. paratuberculosis
accacguccagcuggg

SEQ ID NO: 979390 - RNA, 19 nt, Mycobacterium avium subsp. paratuberculosis
accacguccaccagcacca

SEQ ID NO: 979391 - RNA, 13 nt, Mycobacterium avium subsp. paratuberculosis
accacgccagccu

SEQ ID NO: 979392 - RNA, 18 nt, Mycobacterium avium subsp. paratuberculosis
accacguugcacggcagc

SEQ ID NO: 979393 - RNA, 16 nt, Mycobacterium avium subsp. paratuberculosis
accacguugcgcggcc

SEQ ID NO: 979394 - RNA, 14 nt, Mycobacterium avium subsp. paratuberculosis
accacuuccagcac

SEQ ID NO: 979395 - RNA, 18 nt, Mycobacterium avium subsp. paratuberculosis
accagcugcccaccagca

SEQ ID NO: 979396 - RNA, 19 nt, Mycobacterium avium subsp. paratuberculosis
accagcugcccaccagcag

SEQ ID NO: 979397 - RNA, 20 nt, Mycobacterium avium subsp. paratuberculosis
accagcugcccaccagcagg

SEQ ID NO: 979398 - RNA, 16 nt, Mycobacterium avium subsp. paratuberculosis
accagcgggcugugcc

SEQ ID NO: 979399 - RNA, 13 nt, Mycobacterium avium subsp. paratuberculosis
accagcgggucga

SEQ ID NO: 979400 - RNA, 22 nt, Mycobacterium avium subsp. paratuberculosis
accagcguuccagcacccggcc

SEQ ID NO: 979401 - RNA, 19 nt, Mycobacterium avium subsp. paratuberculosis
accagccgcggacggccag

SEQ ID NO: 979402 - RNA, 20 nt, Mycobacterium avium subsp. paratuberculosis
accagccgcggacggccagc

SEQ ID NO: 979403 - RNA, 22 nt, Mycobacterium avium subsp. paratuberculosis
accagccgcggacggccagccc

SEQ ID NO: 979404 - RNA, 16 nt, Mycobacterium avium subsp. paratuberculosis
accagcggcugcagca

SEQ ID NO: 979405 - RNA, 16 nt, Mycobacterium avium subsp. paratuberculosis
accagcggccgucgcc

SEQ ID NO: 979406 - RNA, 19 nt, Mycobacterium avium subsp. paratuberculosis
accagcggcgcgucgcugg

SEQ ID NO: 979407 - RNA, 22 nt, Mycobacterium avium subsp. paratuberculosis
accagcggcgcgucgcugggca

SEQ ID NO: 979408 - RNA, 11 nt, Mycobacterium avium subsp. paratuberculosis
accagcggcag

SEQ ID NO: 979409 - RNA, 14 nt, Mycobacterium avium subsp. paratuberculosis
accagcggcagcag

SEQ ID NO: 979410 - RNA, 15 nt, Mycobacterium avium subsp. paratuberculosis
accagcggcagcagc

SEQ ID NO: 979411 - RNA, 19 nt, Mycobacterium avium subsp. paratuberculosis
accagcggcagcagcacca

SEQ ID NO: 979412 - RNA, 14 nt, Mycobacterium avium subsp. paratuberculosis
accagcggcaccag

SEQ ID NO: 979413 - RNA, 23 nt, Mycobacterium avium subsp. paratuberculosis
accagccggucuuggacagcagc

SEQ ID NO: 979414 - RNA, 21 nt, Mycobacterium avium subsp. paratuberculosis
accagccggguccgcacccgg

SEQ ID NO: 979415 - RNA, 16 nt, Mycobacterium avium subsp. paratuberculosis
accacuugaaggaggc

SEQ ID NO: 979416 - RNA, 14 nt, Mycobacterium avium subsp. paratuberculosis
accagcacggcggc

SEQ ID NO: 979417 - RNA, 16 nt, Mycobacterium avium subsp. paratuberculosis
accagcacgacaccga

SEQ ID NO: 979418 - RNA, 17 nt, Mycobacterium avium subsp. paratuberculosis
accagcacguugugcuc

SEQ ID NO: 979419 - RNA, 15 nt, Mycobacterium avium subsp. paratuberculosis
accagcacccagcac

SEQ ID NO: 979420 - RNA, 15 nt, Mycobacterium avium subsp. paratuberculosis
accagcaccgcaucc

SEQ ID NO: 979421 - RNA, 23 nt, Mycobacterium avium subsp. paratuberculosis
accagcaccggcaccgccagcca

SEQ ID NO: 979422 - RNA, 16 nt, Mycobacterium avium subsp. paratuberculosis
accagcagccagccca

SEQ ID NO: 979423 - RNA, 15 nt, Mycobacterium avium subsp. paratuberculosis
accagcagccgcagc

SEQ ID NO: 979424 - RNA, 19 nt, Mycobacterium avium subsp. paratuberculosis
accagcagccgcagcgcgc

SEQ ID NO: 979425 - RNA, 13 nt, Mycobacterium avium subsp. paratuberculosis
accaagcgcgaca

SEQ ID NO: 979426 - RNA, 14 nt, Mycobacterium avium subsp. paratuberculosis
accaagcgcgacaa

SEQ ID NO: 979427 - RNA, 18 nt, Mycobacterium avium subsp. paratuberculosis
accacaccggcgcugccc

SEQ ID NO: 979428 - RNA, 22 nt, Mycobacterium avium subsp. paratuberculosis
accacacgugcggauggccccg

SEQ ID NO: 979429 - RNA, 18 nt, Mycobacterium avium subsp. paratuberculosis
accaaacgaagugaugcu

SEQ ID NO: 979430 - RNA, 18 nt, Mycobacterium avium subsp. paratuberculosis
acaucggcgugucgggug

SEQ ID NO: 979431 - RNA, 18 nt, Mycobacterium avium subsp. paratuberculosis
acaucgggauuggcggcc

SEQ ID NO: 979432 - RNA, 20 nt, Mycobacterium avium subsp. paratuberculosis
acaucggugaccgucgccga

SEQ ID NO: 979433 - RNA, 13 nt, Mycobacterium avium subsp. paratuberculosis
acaugcccggcga

SEQ ID NO: 979434 - RNA, 17 nt, Mycobacterium avium subsp. paratuberculosis
acaugccgagcagcacc

SEQ ID NO: 979435 - RNA, 19 nt, Mycobacterium avium subsp. paratuberculosis
acaugccgaggcacagcag

SEQ ID NO: 979436 - RNA, 13 nt, Mycobacterium avium subsp. paratuberculosis
acauccgugaggg

SEQ ID NO: 979437 - RNA, 22 nt, Mycobacterium avium subsp. paratuberculosis
acauccgugagggaccuccagc

SEQ ID NO: 979438 - RNA, 19 nt, Mycobacterium avium subsp. paratuberculosis
acaucccgaaugagacgac

SEQ ID NO: 979439 - RNA, 17 nt, Mycobacterium avium subsp. paratuberculosis
acauacgccucacccca

SEQ ID NO: 979440 - RNA, 20 nt, Mycobacterium avium subsp. paratuberculosis
acagccaaacagguuggcgc

SEQ ID NO: 979441 - RNA, 17 nt, Mycobacterium avium subsp. paratuberculosis
acagcauuggaaagucc

SEQ ID NO: 979442 - RNA, 23 nt, Mycobacterium avium subsp. paratuberculosis
acagcaugaagaucagcaccguc

SEQ ID NO: 979443 - RNA, 17 nt, Mycobacterium avium subsp. paratuberculosis
acagcaguuccgacauc

SEQ ID NO: 979444 - RNA, 21 nt, Mycobacterium avium subsp. paratuberculosis
acagcagggucgagaucagca

SEQ ID NO: 979445 - RNA, 14 nt, Mycobacterium avium subsp. paratuberculosis
acagcagcgcgccg

SEQ ID NO: 979446 - RNA, 9 nt, Mycobacterium avium subsp. paratuberculosis
acagcagcu

SEQ ID NO: 979447 - RNA, 16 nt, Mycobacterium avium subsp. paratuberculosis
acagaaaucgcgcaga

SEQ ID NO: 979448 - RNA, 22 nt, Mycobacterium avium subsp. paratuberculosis
acacgugggcaaucugcccugc

SEQ ID NO: 979449 - RNA, 16 nt, Mycobacterium avium subsp. paratuberculosis
acacguugagcccgga

SEQ ID NO: 979450 - RNA, 19 nt, Mycobacterium avium subsp. paratuberculosis
acacguuggccagaugccc

SEQ ID NO: 979451 - RNA, 18 nt, Mycobacterium avium subsp. paratuberculosis
acacguacagcggcggcc

SEQ ID NO: 979452 - RNA, 19 nt, Mycobacterium avium subsp. paratuberculosis
acacguagcgguccagcgu

SEQ ID NO: 979453 - RNA, 16 nt, Mycobacterium avium subsp. paratuberculosis
acacgcggacagggcg

SEQ ID NO: 979454 - RNA, 16 nt, Mycobacterium avium subsp. paratuberculosis
acacgccuggacaggg

SEQ ID NO: 979455 - RNA, 21 nt, Mycobacterium avium subsp. paratuberculosis
acacgccggccguucgccggc

SEQ ID NO: 979456 - RNA, 15 nt, Mycobacterium avium subsp. paratuberculosis
acacggcaggcggcc

SEQ ID NO: 979457 - RNA, 15 nt, Mycobacterium avium subsp. paratuberculosis
acaccaccugcacgg

SEQ ID NO: 979458 - RNA, 14 nt, Mycobacterium avium subsp. paratuberculosis
acaccaccgccagg

SEQ ID NO: 979459 - RNA, 15 nt, Mycobacterium avium subsp. paratuberculosis
acaccaccagcgagg

SEQ ID NO: 979460 - RNA, 13 nt, Mycobacterium avium subsp. paratuberculosis
acaccaccgccag

SEQ ID NO: 979461 - RNA, 21 nt, Mycobacterium avium subsp. paratuberculosis
acaccaccggccgcccggcga

SEQ ID NO: 979462 - RNA, 21 nt, Mycobacterium avium subsp. paratuberculosis
acaccagcggucggcgguucg

SEQ ID NO: 979463 - RNA, 11 nt, Mycobacterium avium subsp. paratuberculosis
acaccagcacc

SEQ ID NO: 979464 - RNA, 13 nt, Mycobacterium avium subsp. paratuberculosis
acacccagccgcu

SEQ ID NO: 979465 - RNA, 12 nt, Mycobacterium avium subsp. paratuberculosis
acaccccacacc

SEQ ID NO: 979466 - RNA, 21 nt, Mycobacterium avium subsp. paratuberculosis
acaccccgaccgacgcgguca

SEQ ID NO: 979467 - RNA, 13 nt, Mycobacterium avium subsp. paratuberculosis
acaccccgcgagu

SEQ ID NO: 979468 - RNA, 13 nt, Mycobacterium avium subsp. paratuberculosis
acacccugcgcca

SEQ ID NO: 979469 - RNA, 21 nt, Mycobacterium avium subsp. paratuberculosis
acacccuuuuccaucugggcg

SEQ ID NO: 979470 - RNA, 12 nt, Mycobacterium avium subsp. paratuberculosis
acaccgaaagcc

SEQ ID NO: 979471 - RNA, 11 nt, Mycobacterium avium subsp. paratuberculosis
acaccgaaccg

SEQ ID NO: 979472 - RNA, 14 nt, Mycobacterium avium subsp. paratuberculosis
acaccgccagcagc

SEQ ID NO: 979473 - RNA, 15 nt, Mycobacterium avium subsp. paratuberculosis
acaccgucgcgcacc

SEQ ID NO: 979474 - RNA, 19 nt, Mycobacterium avium subsp. paratuberculosis
acaccgggugcguccagac

SEQ ID NO: 979475 - RNA, 15 nt, Mycobacterium avium subsp. paratuberculosis
acaccguccagcuca

SEQ ID NO: 979476 - RNA, 16 nt, Mycobacterium avium subsp. paratuberculosis
acaccgugguggcggc

SEQ ID NO: 979477 - RNA, 15 nt, Mycobacterium avium subsp. paratuberculosis
acaccggggccaggu

SEQ ID NO: 979478 - RNA, 13 nt, Mycobacterium avium subsp. paratuberculosis
acaccggcgguca

SEQ ID NO: 979479 - RNA, 21 nt, Mycobacterium avium subsp. paratuberculosis
acaccggauggcuguggauga

SEQ ID NO: 979480 - RNA, 19 nt, Mycobacterium avium subsp. paratuberculosis
acacgaacaccggcggauc

SEQ ID NO: 979481 - RNA, 22 nt, Mycobacterium avium subsp. paratuberculosis
acacgaucucggucgccagcac

SEQ ID NO: 979482 - RNA, 23 nt, Mycobacterium avium subsp. paratuberculosis
acacgaucucggucgccagcacc

SEQ ID NO: 979483 - RNA, 19 nt, Mycobacterium avium subsp. paratuberculosis
acacgcaggugcgccgcuc

SEQ ID NO: 979484 - RNA, 11 nt, Mycobacterium avium subsp. paratuberculosis
acaccuuggcu

SEQ ID NO: 979485 - RNA, 15 nt, Mycobacterium avium subsp. paratuberculosis
acaccuugucggcga

SEQ ID NO: 979486 - RNA, 22 nt, Mycobacterium avium subsp. paratuberculosis
acaccucgccguccuugacgaa

SEQ ID NO: 979487 - RNA, 16 nt, Mycobacterium avium subsp. paratuberculosis
acaccucgccuccagc

SEQ ID NO: 979488 - RNA, 17 nt, Mycobacterium avium subsp. paratuberculosis
acaccucggccagcgcc

SEQ ID NO: 979489 - RNA, 19 nt, Mycobacterium avium subsp. paratuberculosis
acaccucggccagcgccgc

SEQ ID NO: 979490 - RNA, 18 nt, Mycobacterium avium subsp. paratuberculosis
acaccucggcgaccucgg

SEQ ID NO: 979491 - RNA, 14 nt, Mycobacterium avium subsp. paratuberculosis
acaccugcaucacg

SEQ ID NO: 979492 - RNA, 22 nt, Mycobacterium avium subsp. paratuberculosis
acaaggucgaccgcgcaccggc

SEQ ID NO: 979493 - RNA, 18 nt, Mycobacterium avium subsp. paratuberculosis
acaauguuuuucugcucu

SEQ ID NO: 979494 - RNA, 23 nt, Mycobacterium avium subsp. paratuberculosis
acacaaaagcacccaaaacaucg

SEQ ID NO: 979495 - RNA, 20 nt, Mycobacterium avium subsp. paratuberculosis
acacaaggaaggaggugguc

SEQ ID NO: 979496 - RNA, 16 nt, Mycobacterium avium subsp. paratuberculosis
acacaggaccagcacu

SEQ ID NO: 979497 - RNA, 11 nt, Mycobacterium avium subsp. paratuberculosis
acacagcagca

SEQ ID NO: 979498 - RNA, 13 nt, Mycobacterium avium subsp. paratuberculosis
acacagcagcagc

SEQ ID NO: 979499 - RNA, 19 nt, Mycobacterium avium subsp. paratuberculosis
acacagcagcagcaccagg

SEQ ID NO: 979500 - RNA, 21 nt, Mycobacterium avium subsp. paratuberculosis
acaacauccgcgacgacacca

SEQ ID NO: 979501 - RNA, 15 nt, Mycobacterium avium subsp. paratuberculosis
acaaccgcugcugcu

SEQ ID NO: 979502 - RNA, 20 nt, Mycobacterium avium subsp. paratuberculosis
acaaccguugaggcgagccg

SEQ ID NO: 979503 - RNA, 19 nt, Mycobacterium avium subsp. paratuberculosis
acaaccgcugcugcugccc

SEQ ID NO: 979504 - RNA, 16 nt, Mycobacterium avium subsp. paratuberculosis
acaacgcgcacaacag

SEQ ID NO: 979505 - RNA, 20 nt, Mycobacterium avium subsp. paratuberculosis
acaacggaucgagcgcaccg

SEQ ID NO: 979506 - RNA, 17 nt, Mycobacterium avium subsp. paratuberculosis
acaacuacgagcagcaa

SEQ ID NO: 979507 - RNA, 16 nt, Mycobacterium avium subsp. paratuberculosis
acaacacgucuggcag

SEQ ID NO: 979508 - RNA, 14 nt, Mycobacterium avium subsp. paratuberculosis
acucucccaggaca

SEQ ID NO: 979509 - RNA, 21 nt, Mycobacterium avium subsp. paratuberculosis
acucgggaaaugcgucggcag

SEQ ID NO: 979510 - RNA, 16 nt, Mycobacterium avium subsp. paratuberculosis
acucgguguagagcac

SEQ ID NO: 979511 - RNA, 16 nt, Mycobacterium avium subsp. paratuberculosis
acucguuggccggcuc

SEQ ID NO: 979512 - RNA, 22 nt, Mycobacterium avium subsp. paratuberculosis
acucgucguggcggugcucuug

SEQ ID NO: 979513 - RNA, 15 nt, Mycobacterium avium subsp. paratuberculosis
acucgugcggcgccg

SEQ ID NO: 979514 - RNA, 18 nt, Mycobacterium avium subsp. paratuberculosis
acucgugcggcgccgccc

SEQ ID NO: 979515 - RNA, 15 nt, Mycobacterium avium subsp. paratuberculosis
acuccgacuccagca

SEQ ID NO: 979516 - RNA, 18 nt, Mycobacterium avium subsp. paratuberculosis
acuccgacuccagcagcg

SEQ ID NO: 979517 - RNA, 18 nt, Mycobacterium avium subsp. paratuberculosis
acucccgcgccgcggcca

SEQ ID NO: 979518 - RNA, 18 nt, Mycobacterium avium subsp. paratuberculosis
acucccagccgccggcca

SEQ ID NO: 979519 - RNA, 22 nt, Mycobacterium avium subsp. paratuberculosis
acucccagccgccggccaccag

SEQ ID NO: 979520 - RNA, 15 nt, Mycobacterium avium subsp. paratuberculosis
acucccaggccgcgg

SEQ ID NO: 979521 - RNA, 15 nt, Mycobacterium avium subsp. paratuberculosis
acucgcgcaggguca

SEQ ID NO: 979522 - RNA, 15 nt, Mycobacterium avium subsp. paratuberculosis
acucgccggcggcgc

SEQ ID NO: 979523 - RNA, 18 nt, Mycobacterium avium subsp. paratuberculosis
acucgccguggaauucga

SEQ ID NO: 979524 - RNA, 11 nt, Mycobacterium avium subsp. paratuberculosis
acucagaacag

SEQ ID NO: 979525 - RNA, 22 nt, Mycobacterium avium subsp. paratuberculosis
acucacggcggcagcgcggcgu

SEQ ID NO: 979526 - RNA, 20 nt, Mycobacterium avium subsp. paratuberculosis
acuccaccaaacgaagugau

SEQ ID NO: 979527 - RNA, 18 nt, Mycobacterium avium subsp. paratuberculosis
acuccagcagcgccuugc

SEQ ID NO: 979528 - RNA, 12 nt, Mycobacterium avium subsp. paratuberculosis
acuccagcagcg

SEQ ID NO: 979529 - RNA, 11 nt, Mycobacterium avium subsp. paratuberculosis
acuccagcacc

SEQ ID NO: 979530 - RNA, 23 nt, Mycobacterium avium subsp. paratuberculosis
acuccagcaccagcacggcgacc

SEQ ID NO: 979531 - RNA, 15 nt, Mycobacterium avium subsp. paratuberculosis
acuccaucccgugcg

SEQ ID NO: 979532 - RNA, 23 nt, Mycobacterium avium subsp. paratuberculosis
acuccaggguucucgcggcggcc

SEQ ID NO: 979533 - RNA, 22 nt, Mycobacterium avium subsp. paratuberculosis
acuccaucacgaccucgaacac

SEQ ID NO: 979534 - RNA, 16 nt, Mycobacterium avium subsp. paratuberculosis
acuccagcggcggccc

SEQ ID NO: 979535 - RNA, 13 nt, Mycobacterium avium subsp. paratuberculosis
acuagcgcggcgg

SEQ ID NO: 979536 - RNA, 14 nt, Mycobacterium avium subsp. paratuberculosis
acguucgagucggc

SEQ ID NO: 979537 - RNA, 15 nt, Mycobacterium avium subsp. paratuberculosis
acguugagcccggac

SEQ ID NO: 979538 - RNA, 17 nt, Mycobacterium avium subsp. paratuberculosis
acguugcgcggccgcau

SEQ ID NO: 979539 - RNA, 17 nt, Mycobacterium avium subsp. paratuberculosis
acgucacgggccaggcg

SEQ ID NO: 979540 - RNA, 14 nt, Mycobacterium avium subsp. paratuberculosis
acgucagcccgcgu

SEQ ID NO: 979541 - RNA, 12 nt, Mycobacterium avium subsp. paratuberculosis
acguaggacagc

SEQ ID NO: 979542 - RNA, 20 nt, Mycobacterium avium subsp. paratuberculosis
acguagcgcggccgcccguc

SEQ ID NO: 979543 - RNA, 23 nt, Mycobacterium avium subsp. paratuberculosis
acgggccauguccccgaccauca

SEQ ID NO: 979544 - RNA, 14 nt, Mycobacterium avium subsp. paratuberculosis
acguacuccugcgc

SEQ ID NO: 979545 - RNA, 24 nt, Mycobacterium avium subsp. paratuberculosis
acguaguccggccaguccagcgaa

SEQ ID NO: 979546 - RNA, 18 nt, Mycobacterium avium subsp. paratuberculosis
acguagucgaccgggauc

SEQ ID NO: 979547 - RNA, 23 nt, Mycobacterium avium subsp. paratuberculosis
acguagucgccgauggagaccuc

SEQ ID NO: 979548 - RNA, 13 nt, Mycobacterium avium subsp. paratuberculosis
acguaggcggcca

SEQ ID NO: 979549 - RNA, 19 nt, Mycobacterium avium subsp. paratuberculosis
acgggaacucggccagcug

SEQ ID NO: 979550 - RNA, 17 nt, Mycobacterium avium subsp. paratuberculosis
acgggaccacccgcagc

SEQ ID NO: 979551 - RNA, 18 nt, Mycobacterium avium subsp. paratuberculosis
acgggacguuggcggacu

SEQ ID NO: 979552 - RNA, 18 nt, Mycobacterium avium subsp. paratuberculosis
acgggaugaucggcgccu

SEQ ID NO: 979553 - RNA, 18 nt, Mycobacterium avium subsp. paratuberculosis
acgggauggagccgccca

SEQ ID NO: 979554 - RNA, 14 nt, Mycobacterium avium subsp. paratuberculosis
acgucugggccgcc

SEQ ID NO: 979555 - RNA, 15 nt, Mycobacterium avium subsp. paratuberculosis
acgugacgaccuggu

SEQ ID NO: 979556 - RNA, 14 nt, Mycobacterium avium subsp. paratuberculosis
acgugauccaggua

SEQ ID NO: 979557 - RNA, 13 nt, Mycobacterium avium subsp. paratuberculosis
acgugcaccaccg

SEQ ID NO: 979558 - RNA, 16 nt, Mycobacterium avium subsp. paratuberculosis
acguggacgcgcgcgg

SEQ ID NO: 979559 - RNA, 13 nt, Mycobacterium avium subsp. paratuberculosis
acguggaucucga

SEQ ID NO: 979560 - RNA, 22 nt, Mycobacterium avium subsp. paratuberculosis
acguggcaacgugccacaggcc

SEQ ID NO: 979561 - RNA, 15 nt, Mycobacterium avium subsp. paratuberculosis
acgugucccugcggc

SEQ ID NO: 979562 - RNA, 16 nt, Mycobacterium avium subsp. paratuberculosis
acgugguugcguucgc

SEQ ID NO: 979563 - RNA, 13 nt, Mycobacterium avium subsp. paratuberculosis
acguggccgggcu

SEQ ID NO: 979564 - RNA, 21 nt, Mycobacterium avium subsp. paratuberculosis
acguggcucagcggcaggugc

SEQ ID NO: 979565 - RNA, 13 nt, Mycobacterium avium subsp. paratuberculosis
acguggugcaccg

SEQ ID NO: 979566 - RNA, 16 nt, Mycobacterium avium subsp. paratuberculosis
acgugggcgccccugg

SEQ ID NO: 979567 - RNA, 15 nt, Mycobacterium avium subsp. paratuberculosis
acgugggcggccacc

SEQ ID NO: 979568 - RNA, 23 nt, Mycobacterium avium subsp. paratuberculosis
acgugggucaaccgguagaagau

SEQ ID NO: 979569 - RNA, 22 nt, Mycobacterium avium subsp. paratuberculosis
acguguucucacggcgaauauu

SEQ ID NO: 979570 - RNA, 19 nt, Mycobacterium avium subsp. paratuberculosis
acgcgggaccgggcccggc

SEQ ID NO: 979571 - RNA, 17 nt, Mycobacterium avium subsp. paratuberculosis
acgcggcuggcccggcg

SEQ ID NO: 979572 - RNA, 22 nt, Mycobacterium avium subsp. paratuberculosis
acgcggucugcggugcgcccag

SEQ ID NO: 979573 - RNA, 21 nt, Mycobacterium avium subsp. paratuberculosis
acgcggugagcgcgccggccc

SEQ ID NO: 979574 - RNA, 19 nt, Mycobacterium avium subsp. paratuberculosis
acgcggggcggcggcgccg

SEQ ID NO: 979575 - RNA, 22 nt, Mycobacterium avium subsp. paratuberculosis
acgcggaucgcgcugaccaggc

SEQ ID NO: 979576 - RNA, 16 nt, Mycobacterium avium subsp. paratuberculosis
acgcgcugcuugaccc

SEQ ID NO: 979577 - RNA, 17 nt, Mycobacterium avium subsp. paratuberculosis
acgcgcgggugcgggcg

SEQ ID NO: 979578 - RNA, 17 nt, Mycobacterium avium subsp. paratuberculosis
acgcgccgggcaacagc

SEQ ID NO: 979579 - RNA, 18 nt, Mycobacterium avium subsp. paratuberculosis
acgcgccgucgucggaca

SEQ ID NO: 979580 - RNA, 16 nt, Mycobacterium avium subsp. paratuberculosis
acgcgccggccagccg

SEQ ID NO: 979581 - RNA, 17 nt, Mycobacterium avium subsp. paratuberculosis
acgcgccaaugguuuuc

SEQ ID NO: 979582 - RNA, 19 nt, Mycobacterium avium subsp. paratuberculosis
acgcgaucagguccggaau

SEQ ID NO: 979583 - RNA, 20 nt, Mycobacterium avium subsp. paratuberculosis
acgcgaucagguccggaauc

SEQ ID NO: 979584 - RNA, 17 nt, Mycobacterium avium subsp. paratuberculosis
acgcgauggcggcgcgc

SEQ ID NO: 979585 - RNA, 17 nt, Mycobacterium avium subsp. paratuberculosis
acgcgacgaagccggug

SEQ ID NO: 979586 - RNA, 21 nt, Mycobacterium avium subsp. paratuberculosis
acgcgacggucgugcugggcc

SEQ ID NO: 979587 - RNA, 14 nt, Mycobacterium avium subsp. paratuberculosis
acgcgaccggccau

SEQ ID NO: 979588 - RNA, 23 nt, Mycobacterium avium subsp. paratuberculosis
acgcgaccgucgggacggccagc

SEQ ID NO: 979589 - RNA, 18 nt, Mycobacterium avium subsp. paratuberculosis
acgcucgggcuucggcgu

SEQ ID NO: 979590 - RNA, 18 nt, Mycobacterium avium subsp. paratuberculosis
acgcucggcaggcgggga

SEQ ID NO: 979591 - RNA, 18 nt, Mycobacterium avium subsp. paratuberculosis
acgcucggccagggugac

SEQ ID NO: 979592 - RNA, 13 nt, Mycobacterium avium subsp. paratuberculosis
acgcucggcgccg

SEQ ID NO: 979593 - RNA, 16 nt, Mycobacterium avium subsp. paratuberculosis
acgcucggcgccgagc

SEQ ID NO: 979594 - RNA, 14 nt, Mycobacterium avium subsp. paratuberculosis
acgcucggcggcgc

SEQ ID NO: 979595 - RNA, 16 nt, Mycobacterium avium subsp. paratuberculosis
acgcucggcggcgcgc

SEQ ID NO: 979596 - RNA, 13 nt, Mycobacterium avium subsp. paratuberculosis
acgcugaccgugg

SEQ ID NO: 979597 - RNA, 22 nt, Mycobacterium avium subsp. paratuberculosis
acgcugaccugugcgccccacg

SEQ ID NO: 979598 - RNA, 20 nt, Mycobacterium avium subsp. paratuberculosis
acgcugacgaugcggccggc

SEQ ID NO: 979599 - RNA, 14 nt, Mycobacterium avium subsp. paratuberculosis
acgcucucgccggu

SEQ ID NO: 979600 - RNA, 12 nt, Mycobacterium avium subsp. paratuberculosis
acgcugaacagc

SEQ ID NO: 979601 - RNA, 13 nt, Mycobacterium avium subsp. paratuberculosis
acgcugaagccca

SEQ ID NO: 979602 - RNA, 16 nt, Mycobacterium avium subsp. paratuberculosis
acgcugaagcccaccg

SEQ ID NO: 979603 - RNA, 19 nt, Mycobacterium avium subsp. paratuberculosis
acgcucgacggccggcguc

SEQ ID NO: 979604 - RNA, 22 nt, Mycobacterium avium subsp. paratuberculosis
acgcucgcgguugggccgccgg

SEQ ID NO: 979605 - RNA, 17 nt, Mycobacterium avium subsp. paratuberculosis
acgcucgccggcggccg

SEQ ID NO: 979606 - RNA, 20 nt, Mycobacterium avium subsp. paratuberculosis
acgcucaggcguccagccag

SEQ ID NO: 979607 - RNA, 14 nt, Mycobacterium avium subsp. paratuberculosis
acgcucacccggcc

SEQ ID NO: 979608 - RNA, 17 nt, Mycobacterium avium subsp. paratuberculosis
acgcuagcgugacaguc

SEQ ID NO: 979609 - RNA, 19 nt, Mycobacterium avium subsp. paratuberculosis
acgcgguggugcucgcccc

SEQ ID NO: 979610 - RNA, 23 nt, Mycobacterium avium subsp. paratuberculosis
acgcgucgacaguuaggucuugu

SEQ ID NO: 979611 - RNA, 15 nt, Mycobacterium avium subsp. paratuberculosis
acgcgucgaccgccg

SEQ ID NO: 979612 - RNA, 14 nt, Mycobacterium avium subsp. paratuberculosis
acgcguagccgacc

SEQ ID NO: 979613 - RNA, 17 nt, Mycobacterium avium subsp. paratuberculosis
acgcguugaccagaccg

SEQ ID NO: 979614 - RNA, 22 nt, Mycobacterium avium subsp. paratuberculosis
acggcuggcgcaggugugcggc

SEQ ID NO: 979615 - RNA, 21 nt, Mycobacterium avium subsp. paratuberculosis
acggcucggucaagccggcca

SEQ ID NO: 979616 - RNA, 15 nt, Mycobacterium avium subsp. paratuberculosis
acggcucgugggugg

SEQ ID NO: 979617 - RNA, 14 nt, Mycobacterium avium subsp. paratuberculosis
acggcuacuucuuc

SEQ ID NO: 979618 - RNA, 23 nt, Mycobacterium avium subsp. paratuberculosis
acggcguggcugaggccgccccg

SEQ ID NO: 979619 - RNA, 16 nt, Mycobacterium avium subsp. paratuberculosis
acggcgucggcggccu

SEQ ID NO: 979620 - RNA, 17 nt, Mycobacterium avium subsp. paratuberculosis
acggcgucggcggccug

SEQ ID NO: 979621 - RNA, 19 nt, Mycobacterium avium subsp. paratuberculosis
acggcggugacguuccagc

SEQ ID NO: 979622 - RNA, 18 nt, Mycobacterium avium subsp. paratuberculosis
acggcgcgugcuguugca

SEQ ID NO: 979623 - RNA, 18 nt, Mycobacterium avium subsp. paratuberculosis
acggcgcgguggcgugca

SEQ ID NO: 979624 - RNA, 15 nt, Mycobacterium avium subsp. paratuberculosis
acggcgcccgccccg

SEQ ID NO: 979625 - RNA, 13 nt, Mycobacterium avium subsp. paratuberculosis
acggcgccgugcg

SEQ ID NO: 979626 - RNA, 11 nt, Mycobacterium avium subsp. paratuberculosis
acggcaugccg

SEQ ID NO: 979627 - RNA, 23 nt, Mycobacterium avium subsp. paratuberculosis
acggcgauguaggacgccgcacc

SEQ ID NO: 979628 - RNA, 18 nt, Mycobacterium avium subsp. paratuberculosis
acggcaggcggcccgcuc

SEQ ID NO: 979629 - RNA, 14 nt, Mycobacterium avium subsp. paratuberculosis
acggcagcaccgcc

SEQ ID NO: 979630 - RNA, 21 nt, Mycobacterium avium subsp. paratuberculosis
acggcacccgcagcuccagcg

SEQ ID NO: 979631 - RNA, 14 nt, Mycobacterium avium subsp. paratuberculosis
acggcacccggccc

SEQ ID NO: 979632 - RNA, 13 nt, Mycobacterium avium subsp. paratuberculosis
acggcaccaccac

SEQ ID NO: 979633 - RNA, 22 nt, Mycobacterium avium subsp. paratuberculosis
acggcaccgacagggccagcgc

SEQ ID NO: 979634 - RNA, 19 nt, Mycobacterium avium subsp. paratuberculosis
acggcaccgccggcggccu

SEQ ID NO: 979635 - RNA, 16 nt, Mycobacterium avium subsp. paratuberculosis
acggcaccgcgagcac

SEQ ID NO: 979636 - RNA, 22 nt, Mycobacterium avium subsp. paratuberculosis
acggaguuggaucgccgcaacu

SEQ ID NO: 979637 - RNA, 17 nt, Mycobacterium avium subsp. paratuberculosis
acgcuuccgugcuugcc

SEQ ID NO: 979638 - RNA, 18 nt, Mycobacterium avium subsp. paratuberculosis
acgcuuccgugcuugccc

SEQ ID NO: 979639 - RNA, 14 nt, Mycobacterium avium subsp. paratuberculosis
acgcuucuccgccu

SEQ ID NO: 979640 - RNA, 23 nt, Mycobacterium avium subsp. paratuberculosis
acgcugagcacccgcccggacgc

SEQ ID NO: 979641 - RNA, 22 nt, Mycobacterium avium subsp. paratuberculosis
acgcugagccgcucgucgaguc

SEQ ID NO: 979642 - RNA, 16 nt, Mycobacterium avium subsp. paratuberculosis
acgcugagcgccaggc

SEQ ID NO: 979643 - RNA, 14 nt, Mycobacterium avium subsp. paratuberculosis
acgcugcggcgccg

SEQ ID NO: 979644 - RNA, 12 nt, Mycobacterium avium subsp. paratuberculosis
acgcugccgggg

SEQ ID NO: 979645 - RNA, 15 nt, Mycobacterium avium subsp. paratuberculosis
acgcaucaccacgcu

SEQ ID NO: 979646 - RNA, 14 nt, Mycobacterium avium subsp. paratuberculosis
acgccaacaacuac

SEQ ID NO: 979647 - RNA, 22 nt, Mycobacterium avium subsp. paratuberculosis
acgccaccaucgaguaggccca

SEQ ID NO: 979648 - RNA, 17 nt, Mycobacterium avium subsp. paratuberculosis
acgccaccaccuccucg

SEQ ID NO: 979649 - RNA, 15 nt, Mycobacterium avium subsp. paratuberculosis
acgccacggcggccg

SEQ ID NO: 979650 - RNA, 15 nt, Mycobacterium avium subsp. paratuberculosis
acgccacguagcagc

SEQ ID NO: 979651 - RNA, 15 nt, Mycobacterium avium subsp. paratuberculosis
acgccagcagccgca

SEQ ID NO: 979652 - RNA, 18 nt, Mycobacterium avium subsp. paratuberculosis
acgccagcagccgcagca

SEQ ID NO: 979653 - RNA, 15 nt, Mycobacterium avium subsp. paratuberculosis
acgccagcagcugcg

SEQ ID NO: 979654 - RNA, 14 nt, Mycobacterium avium subsp. paratuberculosis
acgccagcgccgca

SEQ ID NO: 979655 - RNA, 12 nt, Mycobacterium avium subsp. paratuberculosis
acgccagcugcc

SEQ ID NO: 979656 - RNA, 16 nt, Mycobacterium avium subsp. paratuberculosis
acgccagcugggcagc

SEQ ID NO: 979657 - RNA, 21 nt, Mycobacterium avium subsp. paratuberculosis
acgccagcggcagcgccagcg

SEQ ID NO: 979658 - RNA, 17 nt, Mycobacterium avium subsp. paratuberculosis
acgccaucgccucggcc

SEQ ID NO: 979659 - RNA, 23 nt, Mycobacterium avium subsp. paratuberculosis
acgccaucgccucggccaccaga

SEQ ID NO: 979660 - RNA, 15 nt, Mycobacterium avium subsp. paratuberculosis
acgcagugccgcacc

SEQ ID NO: 979661 - RNA, 20 nt, Mycobacterium avium subsp. paratuberculosis
acgcagugccgcaccagcac

SEQ ID NO: 979662 - RNA, 21 nt, Mycobacterium avium subsp. paratuberculosis
acgcagugccgcaccagcacc

SEQ ID NO: 979663 - RNA, 16 nt, Mycobacterium avium subsp. paratuberculosis
acgcagaucuugugcc

SEQ ID NO: 979664 - RNA, 20 nt, Mycobacterium avium subsp. paratuberculosis
acgcagaucuugugccagcc

SEQ ID NO: 979665 - RNA, 19 nt, Mycobacterium avium subsp. paratuberculosis
acgcacaccgcgcgcaggc

SEQ ID NO: 979666 - RNA, 18 nt, Mycobacterium avium subsp. paratuberculosis
accggaucggccagcagg

SEQ ID NO: 979667 - RNA, 19 nt, Mycobacterium avium subsp. paratuberculosis
accggaucggcuagcagcu

SEQ ID NO: 979668 - RNA, 20 nt, Mycobacterium avium subsp. paratuberculosis
accggaucggcuagcagcuc

SEQ ID NO: 979669 - RNA, 22 nt, Mycobacterium avium subsp. paratuberculosis
accggaucgaccaacuccaccg

SEQ ID NO: 979670 - RNA, 22 nt, Mycobacterium avium subsp. paratuberculosis
acgcgaacaccagaugccgcuc

SEQ ID NO: 979671 - RNA, 17 nt, Mycobacterium avium subsp. paratuberculosis
acgccuugcgguuggcc

SEQ ID NO: 979672 - RNA, 17 nt, Mycobacterium avium subsp. paratuberculosis
acgccugcggcccagcg

SEQ ID NO: 979673 - RNA, 14 nt, Mycobacterium avium subsp. paratuberculosis
acgccugcaccuug

SEQ ID NO: 979674 - RNA, 15 nt, Mycobacterium avium subsp. paratuberculosis
acgccuccacauacg

SEQ ID NO: 979675 - RNA, 18 nt, Mycobacterium avium subsp. paratuberculosis
acgccucgggccggcagc

SEQ ID NO: 979676 - RNA, 20 nt, Mycobacterium avium subsp. paratuberculosis
acgccucggugcggaacacc

SEQ ID NO: 979677 - RNA, 21 nt, Mycobacterium avium subsp. paratuberculosis
acgccucccccacccgcacgg

SEQ ID NO: 979678 - RNA, 18 nt, Mycobacterium avium subsp. paratuberculosis
acgccuccgaauccagcg

SEQ ID NO: 979679 - RNA, 20 nt, Mycobacterium avium subsp. paratuberculosis
acgccucgucgaccgcggcc

SEQ ID NO: 979680 - RNA, 14 nt, Mycobacterium avium subsp. paratuberculosis
acgccgugcugccg

SEQ ID NO: 979681 - RNA, 18 nt, Mycobacterium avium subsp. paratuberculosis
acgccucaggcgagcacc

SEQ ID NO: 979682 - RNA, 17 nt, Mycobacterium avium subsp. paratuberculosis
acgccguccgacgugcu

SEQ ID NO: 979683 - RNA, 13 nt, Mycobacterium avium subsp. paratuberculosis
acgccgucgagcc

SEQ ID NO: 979684 - RNA, 13 nt, Mycobacterium avium subsp. paratuberculosis
acgccgucugguc

SEQ ID NO: 979685 - RNA, 14 nt, Mycobacterium avium subsp. paratuberculosis
acgccgugcaggag

SEQ ID NO: 979686 - RNA, 14 nt, Mycobacterium avium subsp. paratuberculosis
acgccgggcucgcc

SEQ ID NO: 979687 - RNA, 23 nt, Mycobacterium avium subsp. paratuberculosis
acgccggguuuguccggccaggu

SEQ ID NO: 979688 - RNA, 19 nt, Mycobacterium avium subsp. paratuberculosis
acgccgguagccgcucgcc

SEQ ID NO: 979689 - RNA, 21 nt, Mycobacterium avium subsp. paratuberculosis
acgccggugaaaccggcgccg

SEQ ID NO: 979690 - RNA, 18 nt, Mycobacterium avium subsp. paratuberculosis
acgccgccgaaccccagc

SEQ ID NO: 979691 - RNA, 14 nt, Mycobacterium avium subsp. paratuberculosis
acgccgccgcgaac

SEQ ID NO: 979692 - RNA, 13 nt, Mycobacterium avium subsp. paratuberculosis
acgccgcaccgca

SEQ ID NO: 979693 - RNA, 21 nt, Mycobacterium avium subsp. paratuberculosis
acgccgccuccgacagccgca

SEQ ID NO: 979694 - RNA, 19 nt, Mycobacterium avium subsp. paratuberculosis
acgccgcgcgcagcacaaa

SEQ ID NO: 979695 - RNA, 13 nt, Mycobacterium avium subsp. paratuberculosis
acgccgcgcaccc

SEQ ID NO: 979696 - RNA, 12 nt, Mycobacterium avium subsp. paratuberculosis
acgccgcgcacg

SEQ ID NO: 979697 - RNA, 13 nt, Mycobacterium avium subsp. paratuberculosis
acgccgcgggagg

SEQ ID NO: 979698 - RNA, 22 nt, Mycobacterium avium subsp. paratuberculosis
acgccgcgcucgugcugcugcu

SEQ ID NO: 979699 - RNA, 24 nt, Mycobacterium avium subsp. paratuberculosis
acgccgaguaacucggccuucgcc

SEQ ID NO: 979700 - RNA, 21 nt, Mycobacterium avium subsp. paratuberculosis
acgccgauguuuugggugcuu

SEQ ID NO: 979701 - RNA, 22 nt, Mycobacterium avium subsp. paratuberculosis
acgccgauguuuugggugcuuu

SEQ ID NO: 979702 - RNA, 20 nt, Mycobacterium avium subsp. paratuberculosis
acgccgauccgcagccgcug

SEQ ID NO: 979703 - RNA, 19 nt, Mycobacterium avium subsp. paratuberculosis
acgcccuuggcgcccagcg

SEQ ID NO: 979704 - RNA, 16 nt, Mycobacterium avium subsp. paratuberculosis
acgcccguucgagcgc

SEQ ID NO: 979705 - RNA, 15 nt, Mycobacterium avium subsp. paratuberculosis
acgccgacaccagcg

SEQ ID NO: 979706 - RNA, 21 nt, Mycobacterium avium subsp. paratuberculosis
acgccgaccacccccagcccg

SEQ ID NO: 979707 - RNA, 22 nt, Mycobacterium avium subsp. paratuberculosis
acgcccaccugguuggcccgca

SEQ ID NO: 979708 - RNA, 17 nt, Mycobacterium avium subsp. paratuberculosis
acgcccaccacaucggu

SEQ ID NO: 979709 - RNA, 14 nt, Mycobacterium avium subsp. paratuberculosis
acgcccacagcuga

SEQ ID NO: 979710 - RNA, 17 nt, Mycobacterium avium subsp. paratuberculosis
acgcccuagcgggccag

SEQ ID NO: 979711 - RNA, 14 nt, Mycobacterium avium subsp. paratuberculosis
acgcccugccacag

SEQ ID NO: 979712 - RNA, 15 nt, Mycobacterium avium subsp. paratuberculosis
acgcccugccacagc

SEQ ID NO: 979713 - RNA, 22 nt, Mycobacterium avium subsp. paratuberculosis
acgcccgaucccgggccguuca

SEQ ID NO: 979714 - RNA, 16 nt, Mycobacterium avium subsp. paratuberculosis
acgcccggccaccugg

SEQ ID NO: 979715 - RNA, 15 nt, Mycobacterium avium subsp. paratuberculosis
acgcccggcuucgcc

SEQ ID NO: 979716 - RNA, 15 nt, Mycobacterium avium subsp. paratuberculosis
acugaccugagaggu

SEQ ID NO: 979717 - RNA, 15 nt, Mycobacterium avium subsp. paratuberculosis
acuugcggccgcgac

SEQ ID NO: 979718 - RNA, 23 nt, Mycobacterium avium subsp. paratuberculosis
acuugcgccggguggccggggcc

SEQ ID NO: 979719 - RNA, 17 nt, Mycobacterium avium subsp. paratuberculosis
acuugaugcugcccggc

SEQ ID NO: 979720 - RNA, 14 nt, Mycobacterium avium subsp. paratuberculosis
acuugcccagauug

SEQ ID NO: 979721 - RNA, 16 nt, Mycobacterium avium subsp. paratuberculosis
acuugaccagcagcug

SEQ ID NO: 979722 - RNA, 22 nt, Mycobacterium avium subsp. paratuberculosis
acuucggcucggcgacaacagc

SEQ ID NO: 979723 - RNA, 22 nt, Mycobacterium avium subsp. paratuberculosis
acuucuacggcgggccggcgcc

SEQ ID NO: 979724 - RNA, 13 nt, Mycobacterium avium subsp. paratuberculosis
acuuucgcggcaa

SEQ ID NO: 979725 - RNA, 17 nt, Mycobacterium avium subsp. paratuberculosis
agaaaagcgaccagcgc

SEQ ID NO: 979726 - RNA, 23 nt, Mycobacterium avium subsp. paratuberculosis
agaaaagcgaccagcgcgccggc

SEQ ID NO: 979727 - RNA, 13 nt, Mycobacterium avium subsp. paratuberculosis
agaggcgggcacu

SEQ ID NO: 979728 - RNA, 17 nt, Mycobacterium avium subsp. paratuberculosis
agaggcuguccagcagc

SEQ ID NO: 979729 - RNA, 12 nt, Mycobacterium avium subsp. paratuberculosis
agagugcaacua

SEQ ID NO: 979730 - RNA, 22 nt, Mycobacterium avium subsp. paratuberculosis
agagcggugacaucgccaccug

SEQ ID NO: 979731 - RNA, 22 nt, Mycobacterium avium subsp. paratuberculosis
agagcggcacgaucggcagcgc

SEQ ID NO: 979732 - RNA, 17 nt, Mycobacterium avium subsp. paratuberculosis
agagcgggauccccacc

SEQ ID NO: 979733 - RNA, 13 nt, Mycobacterium avium subsp. paratuberculosis
agagcaccgcgcu

SEQ ID NO: 979734 - RNA, 16 nt, Mycobacterium avium subsp. paratuberculosis
agagcagcgccugcug

SEQ ID NO: 979735 - RNA, 21 nt, Mycobacterium avium subsp. paratuberculosis
agagcaggaccgagccgcgcg

SEQ ID NO: 979736 - RNA, 20 nt, Mycobacterium avium subsp. paratuberculosis
agacucagcccggcccagcc

SEQ ID NO: 979737 - RNA, 15 nt, Mycobacterium avium subsp. paratuberculosis
agacgcuggccacga

SEQ ID NO: 979738 - RNA, 18 nt, Mycobacterium avium subsp. paratuberculosis
agacgcgaaagcacccga

SEQ ID NO: 979739 - RNA, 17 nt, Mycobacterium avium subsp. paratuberculosis
agacgcgggcgcccagc

SEQ ID NO: 979740 - RNA, 21 nt, Mycobacterium avium subsp. paratuberculosis
agaccgggucguagccgaagc

SEQ ID NO: 979741 - RNA, 18 nt, Mycobacterium avium subsp. paratuberculosis
agacacaaaagcgcccga

SEQ ID NO: 979742 - RNA, 16 nt, Mycobacterium avium subsp. paratuberculosis
agaagcgcgcauagag

SEQ ID NO: 979743 - RNA, 22 nt, Mycobacterium avium subsp. paratuberculosis
agaagggcgaauccaaggagaa

SEQ ID NO: 979744 - RNA, 21 nt, Mycobacterium avium subsp. paratuberculosis
agaaggcgaacgggcuggcca

SEQ ID NO: 979745 - RNA, 22 nt, Mycobacterium avium subsp. paratuberculosis
agaaggcgaacgggcuggccag

SEQ ID NO: 979746 - RNA, 20 nt, Mycobacterium avium subsp. paratuberculosis
agaaggcgucaucguggaca

SEQ ID NO: 979747 - RNA, 21 nt, Mycobacterium avium subsp. paratuberculosis
agcaacgcgguguuggcggcg

SEQ ID NO: 979748 - RNA, 21 nt, Mycobacterium avium subsp. paratuberculosis
agcaacgacccggccaccgcc

SEQ ID NO: 979749 - RNA, 13 nt, Mycobacterium avium subsp. paratuberculosis
agcaacagcagcg

SEQ ID NO: 979750 - RNA, 19 nt, Mycobacterium avium subsp. paratuberculosis
agcaacaccagcuggaugg

SEQ ID NO: 979751 - RNA, 16 nt, Mycobacterium avium subsp. paratuberculosis
agcaaccgccguggca

SEQ ID NO: 979752 - RNA, 22 nt, Mycobacterium avium subsp. paratuberculosis
agcaaccgccguggcagggcca

SEQ ID NO: 979753 - RNA, 11 nt, Mycobacterium avium subsp. paratuberculosis
agcaaccggga

SEQ ID NO: 979754 - RNA, 20 nt, Mycobacterium avium subsp. paratuberculosis
agcaaagguaguccagcaca

SEQ ID NO: 979755 - RNA, 13 nt, Mycobacterium avium subsp. paratuberculosis
agcaaacccagca

SEQ ID NO: 979756 - RNA, 14 nt, Mycobacterium avium subsp. paratuberculosis
agcaaacccagcac

SEQ ID NO: 979757 - RNA, 15 nt, Mycobacterium avium subsp. paratuberculosis
agcaaacccagcacc

SEQ ID NO: 979758 - RNA, 21 nt, Mycobacterium avium subsp. paratuberculosis
agcagaacgccaucaccagcg

SEQ ID NO: 979759 - RNA, 13 nt, Mycobacterium avium subsp. paratuberculosis
agcagaccgaacc

SEQ ID NO: 979760 - RNA, 23 nt, Mycobacterium avium subsp. paratuberculosis
agcagacgguaugcccgccgcgu

SEQ ID NO: 979761 - RNA, 17 nt, Mycobacterium avium subsp. paratuberculosis
agcagaaaauagcccag

SEQ ID NO: 979762 - RNA, 17 nt, Mycobacterium avium subsp. paratuberculosis
agcagauccucagcagc

SEQ ID NO: 979763 - RNA, 17 nt, Mycobacterium avium subsp. paratuberculosis
agcagaugccgcccagg

SEQ ID NO: 979764 - RNA, 20 nt, Mycobacterium avium subsp. paratuberculosis
agcagaugccgcccaggugc

SEQ ID NO: 979765 - RNA, 22 nt, Mycobacterium avium subsp. paratuberculosis
agcagaucaucgagggcguccu

SEQ ID NO: 979766 - RNA, 18 nt, Mycobacterium avium subsp. paratuberculosis
agcagaucgggucccaga

SEQ ID NO: 979767 - RNA, 19 nt, Mycobacterium avium subsp. paratuberculosis
agcagaucuuccaucacgc

SEQ ID NO: 979768 - RNA, 15 nt, Mycobacterium avium subsp. paratuberculosis
agcagcaccacccgc

SEQ ID NO: 979769 - RNA, 22 nt, Mycobacterium avium subsp. paratuberculosis
agcagcacauccgguugcaccg

SEQ ID NO: 979770 - RNA, 12 nt, Mycobacterium avium subsp. paratuberculosis
agcagcaccaga

SEQ ID NO: 979771 - RNA, 13 nt, Mycobacterium avium subsp. paratuberculosis
agcagcaccagcg

SEQ ID NO: 979772 - RNA, 15 nt, Mycobacterium avium subsp. paratuberculosis
agcagcaccaggcug

SEQ ID NO: 979773 - RNA, 14 nt, Mycobacterium avium subsp. paratuberculosis
agcagcagcgcgcg

SEQ ID NO: 979774 - RNA, 15 nt, Mycobacterium avium subsp. paratuberculosis
agcagcagcgcggug

SEQ ID NO: 979775 - RNA, 16 nt, Mycobacterium avium subsp. paratuberculosis
agcagcagccacgcca

SEQ ID NO: 979776 - RNA, 20 nt, Mycobacterium avium subsp. paratuberculosis
agcagcaccuggauccaguu

SEQ ID NO: 979777 - RNA, 12 nt, Mycobacterium avium subsp. paratuberculosis
agcagcacccgg

SEQ ID NO: 979778 - RNA, 16 nt, Mycobacterium avium subsp. paratuberculosis
agcagcacccggguga

SEQ ID NO: 979779 - RNA, 12 nt, Mycobacterium avium subsp. paratuberculosis
agcagcaccgca

SEQ ID NO: 979780 - RNA, 12 nt, Mycobacterium avium subsp. paratuberculosis
agcagcaccgcg

SEQ ID NO: 979781 - RNA, 16 nt, Mycobacterium avium subsp. paratuberculosis
agcagcaccggcgccu

SEQ ID NO: 979782 - RNA, 16 nt, Mycobacterium avium subsp. paratuberculosis
agcacgugaugcagcu

SEQ ID NO: 979783 - RNA, 13 nt, Mycobacterium avium subsp. paratuberculosis
agcacguguucgg

SEQ ID NO: 979784 - RNA, 13 nt, Mycobacterium avium subsp. paratuberculosis
agcacggcggcgc

SEQ ID NO: 979785 - RNA, 13 nt, Mycobacterium avium subsp. paratuberculosis
agcacggcggcgu

SEQ ID NO: 979786 - RNA, 22 nt, Mycobacterium avium subsp. paratuberculosis
agcacguccccgggcaccccgg

SEQ ID NO: 979787 - RNA, 20 nt, Mycobacterium avium subsp. paratuberculosis
agcacgucgggguggccggc

SEQ ID NO: 979788 - RNA, 21 nt, Mycobacterium avium subsp. paratuberculosis
agcacgucgggguggccggcc

SEQ ID NO: 979789 - RNA, 16 nt, Mycobacterium avium subsp. paratuberculosis
agcacgucgcggcccu

SEQ ID NO: 979790 - RNA, 23 nt, Mycobacterium avium subsp. paratuberculosis
agcacgccguccuuggccgccag

SEQ ID NO: 979791 - RNA, 13 nt, Mycobacterium avium subsp. paratuberculosis
agcacgccgggca

SEQ ID NO: 979792 - RNA, 14 nt, Mycobacterium avium subsp. paratuberculosis
agcacgcccagccc

SEQ ID NO: 979793 - RNA, 18 nt, Mycobacterium avium subsp. paratuberculosis
agcacgcccagcccgcgg

SEQ ID NO: 979794 - RNA, 13 nt, Mycobacterium avium subsp. paratuberculosis
agcacgcccucgg

SEQ ID NO: 979795 - RNA, 19 nt, Mycobacterium avium subsp. paratuberculosis
agcacggcaaugguugcgg

SEQ ID NO: 979796 - RNA, 17 nt, Mycobacterium avium subsp. paratuberculosis
agcacggccaccagcag

SEQ ID NO: 979797 - RNA, 22 nt, Mycobacterium avium subsp. paratuberculosis
agcacgcggaccuuggugucgg

SEQ ID NO: 979798 - RNA, 22 nt, Mycobacterium avium subsp. paratuberculosis
agcacgcugaagcccaccgccg

SEQ ID NO: 979799 - RNA, 12 nt, Mycobacterium avium subsp. paratuberculosis
agcacggccacu

SEQ ID NO: 979800 - RNA, 14 nt, Mycobacterium avium subsp. paratuberculosis
agcacggccgccag

SEQ ID NO: 979801 - RNA, 16 nt, Mycobacterium avium subsp. paratuberculosis
agcacgggcgggcaga

SEQ ID NO: 979802 - RNA, 16 nt, Mycobacterium avium subsp. paratuberculosis
agcacgaacagcagcg

SEQ ID NO: 979803 - RNA, 19 nt, Mycobacterium avium subsp. paratuberculosis
agcacgaacagcagcggga

SEQ ID NO: 979804 - RNA, 16 nt, Mycobacterium avium subsp. paratuberculosis
agcacgaccgccagca

SEQ ID NO: 979805 - RNA, 19 nt, Mycobacterium avium subsp. paratuberculosis
agcacgaccgccagcagca

SEQ ID NO: 979806 - RNA, 15 nt, Mycobacterium avium subsp. paratuberculosis
agcacauccagcccu

SEQ ID NO: 979807 - RNA, 18 nt, Mycobacterium avium subsp. paratuberculosis
agcaccaccaacagcagc

SEQ ID NO: 979808 - RNA, 19 nt, Mycobacterium avium subsp. paratuberculosis
agcaccaccaacagcagcg

SEQ ID NO: 979809 - RNA, 13 nt, Mycobacterium avium subsp. paratuberculosis
agcaccacccggg

SEQ ID NO: 979810 - RNA, 18 nt, Mycobacterium avium subsp. paratuberculosis
agcaccacuuccagcacc

SEQ ID NO: 979811 - RNA, 19 nt, Mycobacterium avium subsp. paratuberculosis
agcaccaccgcgagcgggu

SEQ ID NO: 979812 - RNA, 13 nt, Mycobacterium avium subsp. paratuberculosis
agcaccacgaggc

SEQ ID NO: 979813 - RNA, 18 nt, Mycobacterium avium subsp. paratuberculosis
agcaccaccgucaccgcc

SEQ ID NO: 979814 - RNA, 22 nt, Mycobacterium avium subsp. paratuberculosis
agcacaaaagggcccaugccgc

SEQ ID NO: 979815 - RNA, 14 nt, Mycobacterium avium subsp. paratuberculosis
agcacacccucacc

SEQ ID NO: 979816 - RNA, 19 nt, Mycobacterium avium subsp. paratuberculosis
agcacaccgucgcccgccc

SEQ ID NO: 979817 - RNA, 13 nt, Mycobacterium avium subsp. paratuberculosis
agcacaccuucca

SEQ ID NO: 979818 - RNA, 20 nt, Mycobacterium avium subsp. paratuberculosis
agcacccccucggcgccggu

SEQ ID NO: 979819 - RNA, 19 nt, Mycobacterium avium subsp. paratuberculosis
agcacccgcagccgcgagu

SEQ ID NO: 979820 - RNA, 21 nt, Mycobacterium avium subsp. paratuberculosis
agcacccgcagcucgccgagc

SEQ ID NO: 979821 - RNA, 14 nt, Mycobacterium avium subsp. paratuberculosis
agcacccaggugcu

SEQ ID NO: 979822 - RNA, 14 nt, Mycobacterium avium subsp. paratuberculosis
agcacccgcccgga

SEQ ID NO: 979823 - RNA, 23 nt, Mycobacterium avium subsp. paratuberculosis
agcacccgcucgcgggcccgcgc

SEQ ID NO: 979824 - RNA, 16 nt, Mycobacterium avium subsp. paratuberculosis
agcaccagucggccau

SEQ ID NO: 979825 - RNA, 17 nt, Mycobacterium avium subsp. paratuberculosis
agcacccagcacagcga

SEQ ID NO: 979826 - RNA, 9 nt, Mycobacterium avium subsp. paratuberculosis
agcaccagc

SEQ ID NO: 979827 - RNA, 17 nt, Mycobacterium avium subsp. paratuberculosis
agcaccacggcccgcgc

SEQ ID NO: 979828 - RNA, 15 nt, Mycobacterium avium subsp. paratuberculosis
agcaccagcagccgg

SEQ ID NO: 979829 - RNA, 13 nt, Mycobacterium avium subsp. paratuberculosis
agcaccagcagcc

SEQ ID NO: 979830 - RNA, 23 nt, Mycobacterium avium subsp. paratuberculosis
agcaccaggucguugccggugcc

SEQ ID NO: 979831 - RNA, 15 nt, Mycobacterium avium subsp. paratuberculosis
agcaccaggcgcacc

SEQ ID NO: 979832 - RNA, 16 nt, Mycobacterium avium subsp. paratuberculosis
agcaccaggcgcacca

SEQ ID NO: 979833 - RNA, 19 nt, Mycobacterium avium subsp. paratuberculosis
agcaccaggcgcaccagcu

SEQ ID NO: 979834 - RNA, 21 nt, Mycobacterium avium subsp. paratuberculosis
agcaccaggcgcaccagcuga

SEQ ID NO: 979835 - RNA, 18 nt, Mycobacterium avium subsp. paratuberculosis
agcaccaggcgggucacc

SEQ ID NO: 979836 - RNA, 19 nt, Mycobacterium avium subsp. paratuberculosis
agcaccaggcgggucaccu

SEQ ID NO: 979837 - RNA, 13 nt, Mycobacterium avium subsp. paratuberculosis
agcaccaggcuga

SEQ ID NO: 979838 - RNA, 17 nt, Mycobacterium avium subsp. paratuberculosis
agcaccaggcccuccug

SEQ ID NO: 979839 - RNA, 23 nt, Mycobacterium avium subsp. paratuberculosis
agcaccaggcccuccugggugag

SEQ ID NO: 979840 - RNA, 19 nt, Mycobacterium avium subsp. paratuberculosis
agcaccagcguggccggca

SEQ ID NO: 979841 - RNA, 14 nt, Mycobacterium avium subsp. paratuberculosis
agcaccucgaucuu

SEQ ID NO: 979842 - RNA, 16 nt, Mycobacterium avium subsp. paratuberculosis
agcaccucgcccugca

SEQ ID NO: 979843 - RNA, 19 nt, Mycobacterium avium subsp. paratuberculosis
agcaccucgucgcccggcg

SEQ ID NO: 979844 - RNA, 20 nt, Mycobacterium avium subsp. paratuberculosis
agcaccucgucgcccggcgu

SEQ ID NO: 979845 - RNA, 23 nt, Mycobacterium avium subsp. paratuberculosis
agcaccugcucgaugcgcgccag

SEQ ID NO: 979846 - RNA, 16 nt, Mycobacterium avium subsp. paratuberculosis
agcaccuggagcgggu

SEQ ID NO: 979847 - RNA, 16 nt, Mycobacterium avium subsp. paratuberculosis
agcaccuggccguuca

SEQ ID NO: 979848 - RNA, 18 nt, Mycobacterium avium subsp. paratuberculosis
agcaccuggcgcaccgcc

SEQ ID NO: 979849 - RNA, 22 nt, Mycobacterium avium subsp. paratuberculosis
agcaccgugccgucggcgucga

SEQ ID NO: 979850 - RNA, 17 nt, Mycobacterium avium subsp. paratuberculosis
agcaccggcaccgccag

SEQ ID NO: 979851 - RNA, 20 nt, Mycobacterium avium subsp. paratuberculosis
agcaccggcaccgccagcca

SEQ ID NO: 979852 - RNA, 11 nt, Mycobacterium avium subsp. paratuberculosis
agcaccgcgcg

SEQ ID NO: 979853 - RNA, 15 nt, Mycobacterium avium subsp. paratuberculosis
agcaccgucaccgcc

SEQ ID NO: 979854 - RNA, 15 nt, Mycobacterium avium subsp. paratuberculosis
agcaccgucagccag

SEQ ID NO: 979855 - RNA, 13 nt, Mycobacterium avium subsp. paratuberculosis
agcaccggcuggu

SEQ ID NO: 979856 - RNA, 17 nt, Mycobacterium avium subsp. paratuberculosis
agcaccggcuggugcag

SEQ ID NO: 979857 - RNA, 21 nt, Mycobacterium avium subsp. paratuberculosis
agcaccgggaacagccaggcg

SEQ ID NO: 979858 - RNA, 19 nt, Mycobacterium avium subsp. paratuberculosis
agcaccgggcgucggggcc

SEQ ID NO: 979859 - RNA, 12 nt, Mycobacterium avium subsp. paratuberculosis
agcaccggggcc

SEQ ID NO: 979860 - RNA, 14 nt, Mycobacterium avium subsp. paratuberculosis
agcaccggggucug

SEQ ID NO: 979861 - RNA, 19 nt, Mycobacterium avium subsp. paratuberculosis
agcaccggggucugcacga

SEQ ID NO: 979862 - RNA, 19 nt, Mycobacterium avium subsp. paratuberculosis
agcaccggcagcaccgccg

SEQ ID NO: 979863 - RNA, 22 nt, Mycobacterium avium subsp. paratuberculosis
agcaccggcagcaccgccgagc

SEQ ID NO: 979864 - RNA, 18 nt, Mycobacterium avium subsp. paratuberculosis
agcaccgcgacccaggcc

SEQ ID NO: 979865 - RNA, 22 nt, Mycobacterium avium subsp. paratuberculosis
agcaccgccgucccgucacggc

SEQ ID NO: 979866 - RNA, 20 nt, Mycobacterium avium subsp. paratuberculosis
agcaccgcguuguccggggu

SEQ ID NO: 979867 - RNA, 16 nt, Mycobacterium avium subsp. paratuberculosis
agcaccgccgagccgu

SEQ ID NO: 979868 - RNA, 21 nt, Mycobacterium avium subsp. paratuberculosis
agcaccgccaccggcccggcc

SEQ ID NO: 979869 - RNA, 15 nt, Mycobacterium avium subsp. paratuberculosis
agcaccgaugccaga

SEQ ID NO: 979870 - RNA, 17 nt, Mycobacterium avium subsp. paratuberculosis
agcacccggucgccggu

SEQ ID NO: 979871 - RNA, 18 nt, Mycobacterium avium subsp. paratuberculosis
agcacccggcccacgccg

SEQ ID NO: 979872 - RNA, 18 nt, Mycobacterium avium subsp. paratuberculosis
agcaccgagaacagaugc

SEQ ID NO: 979873 - RNA, 20 nt, Mycobacterium avium subsp. paratuberculosis
agcagguccucgaucgacac

SEQ ID NO: 979874 - RNA, 17 nt, Mycobacterium avium subsp. paratuberculosis
agcagguaaaccagcag

SEQ ID NO: 979875 - RNA, 15 nt, Mycobacterium avium subsp. paratuberculosis
agcaggucggccagc

SEQ ID NO: 979876 - RNA, 13 nt, Mycobacterium avium subsp. paratuberculosis
agcaggucggcgu

SEQ ID NO: 979877 - RNA, 15 nt, Mycobacterium avium subsp. paratuberculosis
agcaggcgguggugg

SEQ ID NO: 979878 - RNA, 16 nt, Mycobacterium avium subsp. paratuberculosis
agcaggcggugguggg

SEQ ID NO: 979879 - RNA, 13 nt, Mycobacterium avium subsp. paratuberculosis
agcagggcggcga

SEQ ID NO: 979880 - RNA, 21 nt, Mycobacterium avium subsp. paratuberculosis
agcagcuugaucgccggggcg

SEQ ID NO: 979881 - RNA, 19 nt, Mycobacterium avium subsp. paratuberculosis
agcaggccaggugcagcug

SEQ ID NO: 979882 - RNA, 13 nt, Mycobacterium avium subsp. paratuberculosis
agcaggcgcgcag

SEQ ID NO: 979883 - RNA, 20 nt, Mycobacterium avium subsp. paratuberculosis
agcagcucgcguagcgaggu

SEQ ID NO: 979884 - RNA, 19 nt, Mycobacterium avium subsp. paratuberculosis
agcagcugcacccgcucca

SEQ ID NO: 979885 - RNA, 23 nt, Mycobacterium avium subsp. paratuberculosis
agcagcugcgcgucgaagaaguc

SEQ ID NO: 979886 - RNA, 16 nt, Mycobacterium avium subsp. paratuberculosis
agcagcucggcggccu

SEQ ID NO: 979887 - RNA, 23 nt, Mycobacterium avium subsp. paratuberculosis
agcagcucgucguacucggguga

SEQ ID NO: 979888 - RNA, 15 nt, Mycobacterium avium subsp. paratuberculosis
agcagcgccagcacc

SEQ ID NO: 979889 - RNA, 18 nt, Mycobacterium avium subsp. paratuberculosis
agcagcgccagcaccgcc

SEQ ID NO: 979890 - RNA, 20 nt, Mycobacterium avium subsp. paratuberculosis
agcagcgccagcaccgccug

SEQ ID NO: 979891 - RNA, 19 nt, Mycobacterium avium subsp. paratuberculosis
agcagcgccagcagcggca

SEQ ID NO: 979892 - RNA, 20 nt, Mycobacterium avium subsp. paratuberculosis
agcagcgcggcuuggccacc

SEQ ID NO: 979893 - RNA, 21 nt, Mycobacterium avium subsp. paratuberculosis
agcagcgcggcuuggccacca

SEQ ID NO: 979894 - RNA, 22 nt, Mycobacterium avium subsp. paratuberculosis
agcagcgcggcuuggccaccac

SEQ ID NO: 979895 - RNA, 19 nt, Mycobacterium avium subsp. paratuberculosis
agcagcgccgccaccggcc

SEQ ID NO: 979896 - RNA, 14 nt, Mycobacterium avium subsp. paratuberculosis
agcagcgccucgcu

SEQ ID NO: 979897 - RNA, 22 nt, Mycobacterium avium subsp. paratuberculosis
agcagcgccugcugccaggaca

SEQ ID NO: 979898 - RNA, 17 nt, Mycobacterium avium subsp. paratuberculosis
agcagcgggaucagcuc

SEQ ID NO: 979899 - RNA, 20 nt, Mycobacterium avium subsp. paratuberculosis
agcagcgucugcgccccggc

SEQ ID NO: 979900 - RNA, 21 nt, Mycobacterium avium subsp. paratuberculosis
agcagcggccggcgcagccgg

SEQ ID NO: 979901 - RNA, 16 nt, Mycobacterium avium subsp. paratuberculosis
agcagcggcucggccu

SEQ ID NO: 979902 - RNA, 17 nt, Mycobacterium avium subsp. paratuberculosis
agcagcggcucggccuu

SEQ ID NO: 979903 - RNA, 12 nt, Mycobacterium avium subsp. paratuberculosis
agcagccagcug

SEQ ID NO: 979904 - RNA, 13 nt, Mycobacterium avium subsp. paratuberculosis
agcagccagcugg

SEQ ID NO: 979905 - RNA, 17 nt, Mycobacterium avium subsp. paratuberculosis
agcagccacgccagcca

SEQ ID NO: 979906 - RNA, 18 nt, Mycobacterium avium subsp. paratuberculosis
agcagccacgccagccag

SEQ ID NO: 979907 - RNA, 16 nt, Mycobacterium avium subsp. paratuberculosis
agcagcaggucggcca

SEQ ID NO: 979908 - RNA, 21 nt, Mycobacterium avium subsp. paratuberculosis
agcagcaggucggccagcugc

SEQ ID NO: 979909 - RNA, 22 nt, Mycobacterium avium subsp. paratuberculosis
agcagcaggucggccagcugcg

SEQ ID NO: 979910 - RNA, 20 nt, Mycobacterium avium subsp. paratuberculosis
agcagcgcaagcugauucgg

SEQ ID NO: 979911 - RNA, 17 nt, Mycobacterium avium subsp. paratuberculosis
agcagcgaggccucgcc

SEQ ID NO: 979912 - RNA, 20 nt, Mycobacterium avium subsp. paratuberculosis
agcagcgacuugaccagcag

SEQ ID NO: 979913 - RNA, 21 nt, Mycobacterium avium subsp. paratuberculosis
agcagcgacuugaccagcagc

SEQ ID NO: 979914 - RNA, 18 nt, Mycobacterium avium subsp. paratuberculosis
agcagcgagaaccggcgc

SEQ ID NO: 979915 - RNA, 19 nt, Mycobacterium avium subsp. paratuberculosis
agcagccugccccccuuga

SEQ ID NO: 979916 - RNA, 14 nt, Mycobacterium avium subsp. paratuberculosis
agcagcgaacccgc

SEQ ID NO: 979917 - RNA, 17 nt, Mycobacterium avium subsp. paratuberculosis
agcagcgaacccgccag

SEQ ID NO: 979918 - RNA, 12 nt, Mycobacterium avium subsp. paratuberculosis
agcagccgcaac

SEQ ID NO: 979919 - RNA, 21 nt, Mycobacterium avium subsp. paratuberculosis
agcagccgcgcgagcaucacc

SEQ ID NO: 979920 - RNA, 15 nt, Mycobacterium avium subsp. paratuberculosis
agcagccggaaggcc

SEQ ID NO: 979921 - RNA, 15 nt, Mycobacterium avium subsp. paratuberculosis
agcagccgggccagc

SEQ ID NO: 979922 - RNA, 18 nt, Mycobacterium avium subsp. paratuberculosis
agcagccgggccagcaac

SEQ ID NO: 979923 - RNA, 21 nt, Mycobacterium avium subsp. paratuberculosis
agcagccgggugcccaucugc

SEQ ID NO: 979924 - RNA, 23 nt, Mycobacterium avium subsp. paratuberculosis
agcagccgggugcccaucugcac

SEQ ID NO: 979925 - RNA, 15 nt, Mycobacterium avium subsp. paratuberculosis
agcagccgguacagc

SEQ ID NO: 979926 - RNA, 17 nt, Mycobacterium avium subsp. paratuberculosis
agcagcccgaacagccg

SEQ ID NO: 979927 - RNA, 19 nt, Mycobacterium avium subsp. paratuberculosis
agcagcccgaccaccuccc

SEQ ID NO: 979928 - RNA, 13 nt, Mycobacterium avium subsp. paratuberculosis
agcagcccggcga

SEQ ID NO: 979929 - RNA, 15 nt, Mycobacterium avium subsp. paratuberculosis
agcagccagcccagc

SEQ ID NO: 979930 - RNA, 22 nt, Mycobacterium avium subsp. paratuberculosis
agcaguuuggucauccgcucca

SEQ ID NO: 979931 - RNA, 22 nt, Mycobacterium avium subsp. paratuberculosis
agcagugccccguccggcgcca

SEQ ID NO: 979932 - RNA, 16 nt, Mycobacterium avium subsp. paratuberculosis
agcaguucgaugcgcu

SEQ ID NO: 979933 - RNA, 18 nt, Mycobacterium avium subsp. paratuberculosis
agcaguucguagcgggag

SEQ ID NO: 979934 - RNA, 17 nt, Mycobacterium avium subsp. paratuberculosis
agcagucggccugcagc

SEQ ID NO: 979935 - RNA, 13 nt, Mycobacterium avium subsp. paratuberculosis
agcaucgccgagc

SEQ ID NO: 979936 - RNA, 17 nt, Mycobacterium avium subsp. paratuberculosis
agcaucgccgagcgcau

SEQ ID NO: 979937 - RNA, 20 nt, Mycobacterium avium subsp. paratuberculosis
agcaucuuggccacgggguc

SEQ ID NO: 979938 - RNA, 13 nt, Mycobacterium avium subsp. paratuberculosis
agcaucuccgagu

SEQ ID NO: 979939 - RNA, 19 nt, Mycobacterium avium subsp. paratuberculosis
agcaucucuugaugcagcg

SEQ ID NO: 979940 - RNA, 13 nt, Mycobacterium avium subsp. paratuberculosis
agcaucagcugcc

SEQ ID NO: 979941 - RNA, 18 nt, Mycobacterium avium subsp. paratuberculosis
agccagucggucaacgug

SEQ ID NO: 979942 - RNA, 12 nt, Mycobacterium avium subsp. paratuberculosis
agccaggacagc

SEQ ID NO: 979943 - RNA, 15 nt, Mycobacterium avium subsp. paratuberculosis
agccauggcggcccg

SEQ ID NO: 979944 - RNA, 24 nt, Mycobacterium avium subsp. paratuberculosis
agccauggcggcccgcgccggcgu

SEQ ID NO: 979945 - RNA, 19 nt, Mycobacterium avium subsp. paratuberculosis
agccagaccucgccgacgg

SEQ ID NO: 979946 - RNA, 20 nt, Mycobacterium avium subsp. paratuberculosis
agccacucgccgugagaagu

SEQ ID NO: 979947 - RNA, 13 nt, Mycobacterium avium subsp. paratuberculosis
agccacuccacca

SEQ ID NO: 979948 - RNA, 15 nt, Mycobacterium avium subsp. paratuberculosis
agccacgagcccagc

SEQ ID NO: 979949 - RNA, 16 nt, Mycobacterium avium subsp. paratuberculosis
agccacgagcccagcc

SEQ ID NO: 979950 - RNA, 17 nt, Mycobacterium avium subsp. paratuberculosis
agccacgagcccagccg

SEQ ID NO: 979951 - RNA, 18 nt, Mycobacterium avium subsp. paratuberculosis
agccacgagcccagccgu

SEQ ID NO: 979952 - RNA, 18 nt, Mycobacterium avium subsp. paratuberculosis
agccacgccggcacaccg

SEQ ID NO: 979953 - RNA, 13 nt, Mycobacterium avium subsp. paratuberculosis
agccagcaccgcc

SEQ ID NO: 979954 - RNA, 16 nt, Mycobacterium avium subsp. paratuberculosis
agccagcccguggcca

SEQ ID NO: 979955 - RNA, 16 nt, Mycobacterium avium subsp. paratuberculosis
agccagccgcccagca

SEQ ID NO: 979956 - RNA, 23 nt, Mycobacterium avium subsp. paratuberculosis
agccaaucgccgaugaccacccu

SEQ ID NO: 979957 - RNA, 15 nt, Mycobacterium avium subsp. paratuberculosis
agcauuucgcgcacg

SEQ ID NO: 979958 - RNA, 19 nt, Mycobacterium avium subsp. paratuberculosis
agccaaaccgugucccgga

SEQ ID NO: 979959 - RNA, 22 nt, Mycobacterium avium subsp. paratuberculosis
agccaaccgccggggaagaucu

SEQ ID NO: 979960 - RNA, 17 nt, Mycobacterium avium subsp. paratuberculosis
agcaugaucaccgccag

SEQ ID NO: 979961 - RNA, 20 nt, Mycobacterium avium subsp. paratuberculosis
agcaugcgccagagcgcgaa

SEQ ID NO: 979962 - RNA, 16 nt, Mycobacterium avium subsp. paratuberculosis
agcaugccgagcaccu

SEQ ID NO: 979963 - RNA, 17 nt, Mycobacterium avium subsp. paratuberculosis
agcgauuacgaccaguu

SEQ ID NO: 979964 - RNA, 22 nt, Mycobacterium avium subsp. paratuberculosis
agcgaugggcgcgaucaggcug

SEQ ID NO: 979965 - RNA, 22 nt, Mycobacterium avium subsp. paratuberculosis
agcgauacccguugcgccccac

SEQ ID NO: 979966 - RNA, 21 nt, Mycobacterium avium subsp. paratuberculosis
agcgagucgaagccguggcag

SEQ ID NO: 979967 - RNA, 22 nt, Mycobacterium avium subsp. paratuberculosis
agcgagucgagaaacgcgcgca

SEQ ID NO: 979968 - RNA, 11 nt, Mycobacterium avium subsp. paratuberculosis
agcgagucggc

SEQ ID NO: 979969 - RNA, 20 nt, Mycobacterium avium subsp. paratuberculosis
agcgcagaucgcgcaucacc

SEQ ID NO: 979970 - RNA, 16 nt, Mycobacterium avium subsp. paratuberculosis
agcgcagcaccuccga

SEQ ID NO: 979971 - RNA, 20 nt, Mycobacterium avium subsp. paratuberculosis
agcgcagcacugagcggcag

SEQ ID NO: 979972 - RNA, 12 nt, Mycobacterium avium subsp. paratuberculosis
agcgcagcagcu

SEQ ID NO: 979973 - RNA, 16 nt, Mycobacterium avium subsp. paratuberculosis
agcgcagcaucggcag

SEQ ID NO: 979974 - RNA, 16 nt, Mycobacterium avium subsp. paratuberculosis
agcgcacgucgccgcc

SEQ ID NO: 979975 - RNA, 16 nt, Mycobacterium avium subsp. paratuberculosis
agcgcacacagcagca

SEQ ID NO: 979976 - RNA, 21 nt, Mycobacterium avium subsp. paratuberculosis
agcgcaacguguacucggcgu

SEQ ID NO: 979977 - RNA, 17 nt, Mycobacterium avium subsp. paratuberculosis
agcgcaucggucaccag

SEQ ID NO: 979978 - RNA, 18 nt, Mycobacterium avium subsp. paratuberculosis
agcgcauccgacaccgcc

SEQ ID NO: 979979 - RNA, 21 nt, Mycobacterium avium subsp. paratuberculosis
agcgcauguaggacaccccgg

SEQ ID NO: 979980 - RNA, 18 nt, Mycobacterium avium subsp. paratuberculosis
agcgcagcgccaggcaga

SEQ ID NO: 979981 - RNA, 16 nt, Mycobacterium avium subsp. paratuberculosis
agcgcagcuccagguc

SEQ ID NO: 979982 - RNA, 17 nt, Mycobacterium avium subsp. paratuberculosis
agcgccaggugggugaa

SEQ ID NO: 979983 - RNA, 19 nt, Mycobacterium avium subsp. paratuberculosis
agcgccagggugccccgca

SEQ ID NO: 979984 - RNA, 16 nt, Mycobacterium avium subsp. paratuberculosis
agcgccagcguggcca

SEQ ID NO: 979985 - RNA, 19 nt, Mycobacterium avium subsp. paratuberculosis
agcgccagcguggccagca

SEQ ID NO: 979986 - RNA, 21 nt, Mycobacterium avium subsp. paratuberculosis
agcgccagcgagugggugaag

SEQ ID NO: 979987 - RNA, 22 nt, Mycobacterium avium subsp. paratuberculosis
agcgccagcgcggugcccagcc

SEQ ID NO: 979988 - RNA, 15 nt, Mycobacterium avium subsp. paratuberculosis
agcgccagcgggaua

SEQ ID NO: 979989 - RNA, 16 nt, Mycobacterium avium subsp. paratuberculosis
agcgccagcgggauac

SEQ ID NO: 979990 - RNA, 22 nt, Mycobacterium avium subsp. paratuberculosis
agcgccagcgggauacccauga

SEQ ID NO: 979991 - RNA, 20 nt, Mycobacterium avium subsp. paratuberculosis
agcgccagcaacacccagcc

SEQ ID NO: 979992 - RNA, 19 nt, Mycobacterium avium subsp. paratuberculosis
agcgcuucgcgcuguucgg

SEQ ID NO: 979993 - RNA, 15 nt, Mycobacterium avium subsp. paratuberculosis
agcgcucgacgaggc

SEQ ID NO: 979994 - RNA, 17 nt, Mycobacterium avium subsp. paratuberculosis
agcgcuugucgcagacc

SEQ ID NO: 979995 - RNA, 13 nt, Mycobacterium avium subsp. paratuberculosis
agcggaucggccu

SEQ ID NO: 979996 - RNA, 16 nt, Mycobacterium avium subsp. paratuberculosis
agcggaucggcggcga

SEQ ID NO: 979997 - RNA, 19 nt, Mycobacterium avium subsp. paratuberculosis
agcggaugccggaggcgcc

SEQ ID NO: 979998 - RNA, 18 nt, Mycobacterium avium subsp. paratuberculosis
agcggauugaccagcacg

SEQ ID NO: 979999 - RNA, 16 nt, Mycobacterium avium subsp. paratuberculosis
agcggauuggucgggc

SEQ ID NO: 980000 - RNA, 18 nt, Mycobacterium avium subsp. paratuberculosis
agcgcgaccagcccggcc

SEQ ID NO: 980001 - RNA, 12 nt, Mycobacterium avium subsp. paratuberculosis
agcgcgaccagu

SEQ ID NO: 980002 - RNA, 20 nt, Mycobacterium avium subsp. paratuberculosis
agcgcgacgccgacgcccag

SEQ ID NO: 980003 - RNA, 21 nt, Mycobacterium avium subsp. paratuberculosis
agcgcgacgcgcaugcccugg

SEQ ID NO: 980004 - RNA, 13 nt, Mycobacterium avium subsp. paratuberculosis
agcgcgacggccu

SEQ ID NO: 980005 - RNA, 16 nt, Mycobacterium avium subsp. paratuberculosis
agcgcgaagcccucuu

SEQ ID NO: 980006 - RNA, 16 nt, Mycobacterium avium subsp. paratuberculosis
agcgcgaaaaccagca

SEQ ID NO: 980007 - RNA, 18 nt, Mycobacterium avium subsp. paratuberculosis
agcgcgaaaaccagcacc

SEQ ID NO: 980008 - RNA, 15 nt, Mycobacterium avium subsp. paratuberculosis
agcgcgaaagcagca

SEQ ID NO: 980009 - RNA, 20 nt, Mycobacterium avium subsp. paratuberculosis
agcgccuucuccagcuccuc

SEQ ID NO: 980010 - RNA, 15 nt, Mycobacterium avium subsp. paratuberculosis
agcgcguugcggccg

SEQ ID NO: 980011 - RNA, 22 nt, Mycobacterium avium subsp. paratuberculosis
agcgcguugcggccguccagcg

SEQ ID NO: 980012 - RNA, 16 nt, Mycobacterium avium subsp. paratuberculosis
agcgcguuggccaggu

SEQ ID NO: 980013 - RNA, 22 nt, Mycobacterium avium subsp. paratuberculosis
agcgcgucgucgauggccacca

SEQ ID NO: 980014 - RNA, 19 nt, Mycobacterium avium subsp. paratuberculosis
agcgcgucgcgcccggcgu

SEQ ID NO: 980015 - RNA, 18 nt, Mycobacterium avium subsp. paratuberculosis
agcgcgucggccagcacc

SEQ ID NO: 980016 - RNA, 16 nt, Mycobacterium avium subsp. paratuberculosis
agcgcgucggccagcg

SEQ ID NO: 980017 - RNA, 19 nt, Mycobacterium avium subsp. paratuberculosis
agcgcgucggccagcgcgc

SEQ ID NO: 980018 - RNA, 13 nt, Mycobacterium avium subsp. paratuberculosis
agcgcguccaggu

SEQ ID NO: 980019 - RNA, 23 nt, Mycobacterium avium subsp. paratuberculosis
agcgcguccaggugcgccgccgc

SEQ ID NO: 980020 - RNA, 16 nt, Mycobacterium avium subsp. paratuberculosis
agcgcggugcccagcc

SEQ ID NO: 980021 - RNA, 23 nt, Mycobacterium avium subsp. paratuberculosis
agcgcgguguacagcgcgccgcg

SEQ ID NO: 980022 - RNA, 19 nt, Mycobacterium avium subsp. paratuberculosis
agcgcguacuccgacagau

SEQ ID NO: 980023 - RNA, 23 nt, Mycobacterium avium subsp. paratuberculosis
agcgcguagucggcgucggccac

SEQ ID NO: 980024 - RNA, 16 nt, Mycobacterium avium subsp. paratuberculosis
agcgcccggccagccg

SEQ ID NO: 980025 - RNA, 16 nt, Mycobacterium avium subsp. paratuberculosis
agcgcccgggccagga

SEQ ID NO: 980026 - RNA, 22 nt, Mycobacterium avium subsp. paratuberculosis
agcgcccggucgaggucggcca

SEQ ID NO: 980027 - RNA, 23 nt, Mycobacterium avium subsp. paratuberculosis
agcgcccggaugucgggcgaggu

SEQ ID NO: 980028 - RNA, 14 nt, Mycobacterium avium subsp. paratuberculosis
agcgcccgcccgga

SEQ ID NO: 980029 - RNA, 20 nt, Mycobacterium avium subsp. paratuberculosis
agcgcccgcccggcccggcg

SEQ ID NO: 980030 - RNA, 18 nt, Mycobacterium avium subsp. paratuberculosis
agcgccccgccgggggag

SEQ ID NO: 980031 - RNA, 16 nt, Mycobacterium avium subsp. paratuberculosis
agcgccgccagccgca

SEQ ID NO: 980032 - RNA, 19 nt, Mycobacterium avium subsp. paratuberculosis
agcgccgcccgggcggccc

SEQ ID NO: 980033 - RNA, 18 nt, Mycobacterium avium subsp. paratuberculosis
agcgccgccaaccagguc

SEQ ID NO: 980034 - RNA, 16 nt, Mycobacterium avium subsp. paratuberculosis
agcgccgaggccagca

SEQ ID NO: 980035 - RNA, 21 nt, Mycobacterium avium subsp. paratuberculosis
agcgccgcaacggcucccagg

SEQ ID NO: 980036 - RNA, 22 nt, Mycobacterium avium subsp. paratuberculosis
agcgccgucaucaccgccgagg

SEQ ID NO: 980037 - RNA, 22 nt, Mycobacterium avium subsp. paratuberculosis
agcgccggacgcuaagcgcuga

SEQ ID NO: 980038 - RNA, 22 nt, Mycobacterium avium subsp. paratuberculosis
agcgccgcguugucggcguccu

SEQ ID NO: 980039 - RNA, 16 nt, Mycobacterium avium subsp. paratuberculosis
agcgccggcaccagca

SEQ ID NO: 980040 - RNA, 19 nt, Mycobacterium avium subsp. paratuberculosis
agcgccggcaccagcagcc

SEQ ID NO: 980041 - RNA, 19 nt, Mycobacterium avium subsp. paratuberculosis
agcgccgcgacgaacugcc

SEQ ID NO: 980042 - RNA, 18 nt, Mycobacterium avium subsp. paratuberculosis
agcgccgcgcgcgcggcc

SEQ ID NO: 980043 - RNA, 19 nt, Mycobacterium avium subsp. paratuberculosis
agcgccgcgcgcgcggccu

SEQ ID NO: 980044 - RNA, 20 nt, Mycobacterium avium subsp. paratuberculosis
agcgccgcgcgcgcggccuc

SEQ ID NO: 980045 - RNA, 22 nt, Mycobacterium avium subsp. paratuberculosis
agcgccgcgcgcgcggccucca

SEQ ID NO: 980046 - RNA, 17 nt, Mycobacterium avium subsp. paratuberculosis
agcgccugcugccagga

SEQ ID NO: 980047 - RNA, 18 nt, Mycobacterium avium subsp. paratuberculosis
agcgccugguccucccgg

SEQ ID NO: 980048 - RNA, 13 nt, Mycobacterium avium subsp. paratuberculosis
agcgccuccagcc

SEQ ID NO: 980049 - RNA, 20 nt, Mycobacterium avium subsp. paratuberculosis
agcgccuccagccgcuccuc

SEQ ID NO: 980050 - RNA, 16 nt, Mycobacterium avium subsp. paratuberculosis
agcgccucgucgagcc

SEQ ID NO: 980051 - RNA, 14 nt, Mycobacterium avium subsp. paratuberculosis
agcgccucgagcaa

SEQ ID NO: 980052 - RNA, 14 nt, Mycobacterium avium subsp. paratuberculosis
agcgccucgagcac

SEQ ID NO: 980053 - RNA, 18 nt, Mycobacterium avium subsp. paratuberculosis
agcgccucggcguggcag

SEQ ID NO: 980054 - RNA, 20 nt, Mycobacterium avium subsp. paratuberculosis
agcgccucggcguggcaggc

SEQ ID NO: 980055 - RNA, 21 nt, Mycobacterium avium subsp. paratuberculosis
agcgccucggcguggcaggcg

SEQ ID NO: 980056 - RNA, 16 nt, Mycobacterium avium subsp. paratuberculosis
agcuaaaccccacggc

SEQ ID NO: 980057 - RNA, 16 nt, Mycobacterium avium subsp. paratuberculosis
agcuaguuucacgcuc

SEQ ID NO: 980058 - RNA, 16 nt, Mycobacterium avium subsp. paratuberculosis
agcuaggccagcagcg

SEQ ID NO: 980059 - RNA, 22 nt, Mycobacterium avium subsp. paratuberculosis
agcuaggucguggcgccgagga

SEQ ID NO: 980060 - RNA, 17 nt, Mycobacterium avium subsp. paratuberculosis
agcuagcccagaacugc

SEQ ID NO: 980061 - RNA, 18 nt, Mycobacterium avium subsp. paratuberculosis
agcuagcccagaacugcu

SEQ ID NO: 980062 - RNA, 19 nt, Mycobacterium avium subsp. paratuberculosis
agcguuuccagcgccggca

SEQ ID NO: 980063 - RNA, 14 nt, Mycobacterium avium subsp. paratuberculosis
agcguugccgcgcg

SEQ ID NO: 980064 - RNA, 21 nt, Mycobacterium avium subsp. paratuberculosis
agcguugccggccgaagugcu

SEQ ID NO: 980065 - RNA, 17 nt, Mycobacterium avium subsp. paratuberculosis
agcguugcgccagcagg

SEQ ID NO: 980066 - RNA, 16 nt, Mycobacterium avium subsp. paratuberculosis
agcgugacgccgggcc

SEQ ID NO: 980067 - RNA, 16 nt, Mycobacterium avium subsp. paratuberculosis
agcgugcccgcgccca

SEQ ID NO: 980068 - RNA, 18 nt, Mycobacterium avium subsp. paratuberculosis
agcgugcccgcgcccacc

SEQ ID NO: 980069 - RNA, 20 nt, Mycobacterium avium subsp. paratuberculosis
agcgugcccgcgcccaccug

SEQ ID NO: 980070 - RNA, 21 nt, Mycobacterium avium subsp. paratuberculosis
agcgugcccgcgcccaccugg

SEQ ID NO: 980071 - RNA, 22 nt, Mycobacterium avium subsp. paratuberculosis
agcgugcccgcgcccaccugga

SEQ ID NO: 980072 - RNA, 18 nt, Mycobacterium avium subsp. paratuberculosis
agcguuccgucggcgagu

SEQ ID NO: 980073 - RNA, 23 nt, Mycobacterium avium subsp. paratuberculosis
agcgucgccaugccgucgcgcac

SEQ ID NO: 980074 - RNA, 18 nt, Mycobacterium avium subsp. paratuberculosis
agcgucgccgccccgagu

SEQ ID NO: 980075 - RNA, 16 nt, Mycobacterium avium subsp. paratuberculosis
agcgucgacugcaccg

SEQ ID NO: 980076 - RNA, 20 nt, Mycobacterium avium subsp. paratuberculosis
agcgucuuggacgcccgguc

SEQ ID NO: 980077 - RNA, 12 nt, Mycobacterium avium subsp. paratuberculosis
agcgugaacacc

SEQ ID NO: 980078 - RNA, 20 nt, Mycobacterium avium subsp. paratuberculosis
agcgugaacagcgcccggcc

SEQ ID NO: 980079 - RNA, 13 nt, Mycobacterium avium subsp. paratuberculosis
agcgucgccacca

SEQ ID NO: 980080 - RNA, 14 nt, Mycobacterium avium subsp. paratuberculosis
agcgucaccuucac

SEQ ID NO: 980081 - RNA, 21 nt, Mycobacterium avium subsp. paratuberculosis
agcgucaccuucaccacggcc

SEQ ID NO: 980082 - RNA, 15 nt, Mycobacterium avium subsp. paratuberculosis
agcgucacgccagcg

SEQ ID NO: 980083 - RNA, 12 nt, Mycobacterium avium subsp. paratuberculosis
agcgucacgcug

SEQ ID NO: 980084 - RNA, 21 nt, Mycobacterium avium subsp. paratuberculosis
agcgucacgcuggcgugacag

SEQ ID NO: 980085 - RNA, 16 nt, Mycobacterium avium subsp. paratuberculosis
agcgucaccaaugcgc

SEQ ID NO: 980086 - RNA, 15 nt, Mycobacterium avium subsp. paratuberculosis
agcggggugcccacc

SEQ ID NO: 980087 - RNA, 20 nt, Mycobacterium avium subsp. paratuberculosis
agcggguccagccgccggcg

SEQ ID NO: 980088 - RNA, 20 nt, Mycobacterium avium subsp. paratuberculosis
agcgggucgucgggccgggg

SEQ ID NO: 980089 - RNA, 21 nt, Mycobacterium avium subsp. paratuberculosis
agcgggucgucgggccgggga

SEQ ID NO: 980090 - RNA, 17 nt, Mycobacterium avium subsp. paratuberculosis
agcgggugaaucgacac

SEQ ID NO: 980091 - RNA, 22 nt, Mycobacterium avium subsp. paratuberculosis
agcgggugaaucgacaccgcac

SEQ ID NO: 980092 - RNA, 13 nt, Mycobacterium avium subsp. paratuberculosis
agcggcagcagca

SEQ ID NO: 980093 - RNA, 22 nt, Mycobacterium avium subsp. paratuberculosis
agcggcaggucccaggccagga

SEQ ID NO: 980094 - RNA, 16 nt, Mycobacterium avium subsp. paratuberculosis
agcggcagauggucuc

SEQ ID NO: 980095 - RNA, 22 nt, Mycobacterium avium subsp. paratuberculosis
agcggcaacacgccggcggcca

SEQ ID NO: 980096 - RNA, 23 nt, Mycobacterium avium subsp. paratuberculosis
agcggcaaaauagcugcgacaga

SEQ ID NO: 980097 - RNA, 19 nt, Mycobacterium avium subsp. paratuberculosis
agcggcaacugggcggccu

SEQ ID NO: 980098 - RNA, 17 nt, Mycobacterium avium subsp. paratuberculosis
agcucgacaucggccgc

SEQ ID NO: 980099 - RNA, 21 nt, Mycobacterium avium subsp. paratuberculosis
agcucgcaaacgaaucgagcc

SEQ ID NO: 980100 - RNA, 20 nt, Mycobacterium avium subsp. paratuberculosis
agcuccuggaagaagucggu

SEQ ID NO: 980101 - RNA, 20 nt, Mycobacterium avium subsp. paratuberculosis
agcuccucgcggaacugcuc

SEQ ID NO: 980102 - RNA, 23 nt, Mycobacterium avium subsp. paratuberculosis
agcuccucgcggaacugcuccca

SEQ ID NO: 980103 - RNA, 22 nt, Mycobacterium avium subsp. paratuberculosis
agcucgcgucgacgucgggcac

SEQ ID NO: 980104 - RNA, 13 nt, Mycobacterium avium subsp. paratuberculosis
agcucggcagccc

SEQ ID NO: 980105 - RNA, 17 nt, Mycobacterium avium subsp. paratuberculosis
agcucggccuugagccg

SEQ ID NO: 980106 - RNA, 21 nt, Mycobacterium avium subsp. paratuberculosis
agcucggcccgcugcgcggcc

SEQ ID NO: 980107 - RNA, 23 nt, Mycobacterium avium subsp. paratuberculosis
agcucggccaccagcgcccgccc

SEQ ID NO: 980108 - RNA, 14 nt, Mycobacterium avium subsp. paratuberculosis
agcucgccgcggcc

SEQ ID NO: 980109 - RNA, 18 nt, Mycobacterium avium subsp. paratuberculosis
agcucgccgcggccacgc

SEQ ID NO: 980110 - RNA, 19 nt, Mycobacterium avium subsp. paratuberculosis
agcucgacgacuucggccu

SEQ ID NO: 980111 - RNA, 16 nt, Mycobacterium avium subsp. paratuberculosis
agcucgcggcgcagcu

SEQ ID NO: 980112 - RNA, 16 nt, Mycobacterium avium subsp. paratuberculosis
agcucgcgggccugcu

SEQ ID NO: 980113 - RNA, 22 nt, Mycobacterium avium subsp. paratuberculosis
agcucgcgcugaagccgcugga

SEQ ID NO: 980114 - RNA, 21 nt, Mycobacterium avium subsp. paratuberculosis
agcucgcgccgacccgcccgc

SEQ ID NO: 980115 - RNA, 14 nt, Mycobacterium avium subsp. paratuberculosis
agcucgcgcagccg

SEQ ID NO: 980116 - RNA, 15 nt, Mycobacterium avium subsp. paratuberculosis
agcucgcgcagcugg

SEQ ID NO: 980117 - RNA, 19 nt, Mycobacterium avium subsp. paratuberculosis
agcucgcgcagcuggccgu

SEQ ID NO: 980118 - RNA, 16 nt, Mycobacterium avium subsp. paratuberculosis
agcuccaaugcggccg

SEQ ID NO: 980119 - RNA, 14 nt, Mycobacterium avium subsp. paratuberculosis
agcuccagcagccc

SEQ ID NO: 980120 - RNA, 23 nt, Mycobacterium avium subsp. paratuberculosis
agcuccacgccgccgggaacagc

SEQ ID NO: 980121 - RNA, 13 nt, Mycobacterium avium subsp. paratuberculosis
agcuccaacagcc

SEQ ID NO: 980122 - RNA, 15 nt, Mycobacterium avium subsp. paratuberculosis
agcuccgccacccug

SEQ ID NO: 980123 - RNA, 22 nt, Mycobacterium avium subsp. paratuberculosis
agcuccggguaggacaccguca

SEQ ID NO: 980124 - RNA, 21 nt, Mycobacterium avium subsp. paratuberculosis
agcuccgggucgaccgccucg

SEQ ID NO: 980125 - RNA, 19 nt, Mycobacterium avium subsp. paratuberculosis
agcuccagcgaguuggcca

SEQ ID NO: 980126 - RNA, 23 nt, Mycobacterium avium subsp. paratuberculosis
agcucccccgacaccgccagcag

SEQ ID NO: 980127 - RNA, 17 nt, Mycobacterium avium subsp. paratuberculosis
agcucccgagcaucgcc

SEQ ID NO: 980128 - RNA, 21 nt, Mycobacterium avium subsp. paratuberculosis
agcucccgagcaucgccgagc

SEQ ID NO: 980129 - RNA, 14 nt, Mycobacterium avium subsp. paratuberculosis
agcugaccggccac

SEQ ID NO: 980130 - RNA, 15 nt, Mycobacterium avium subsp. paratuberculosis
agcugaccggccacc

SEQ ID NO: 980131 - RNA, 13 nt, Mycobacterium avium subsp. paratuberculosis
agcugacggccau

SEQ ID NO: 980132 - RNA, 22 nt, Mycobacterium avium subsp. paratuberculosis
agcucgucggguguggcgccgu

SEQ ID NO: 980133 - RNA, 20 nt, Mycobacterium avium subsp. paratuberculosis
agcucgugaugguccagcac

SEQ ID NO: 980134 - RNA, 21 nt, Mycobacterium avium subsp. paratuberculosis
agcucgguggcgucggcggcc

SEQ ID NO: 980135 - RNA, 16 nt, Mycobacterium avium subsp. paratuberculosis
agcucggucaccagcg

SEQ ID NO: 980136 - RNA, 17 nt, Mycobacterium avium subsp. paratuberculosis
agcucggugaucugcac

SEQ ID NO: 980137 - RNA, 23 nt, Mycobacterium avium subsp. paratuberculosis
agcucggugcagaccccggcguc

SEQ ID NO: 980138 - RNA, 16 nt, Mycobacterium avium subsp. paratuberculosis
agcucggcguggucga

SEQ ID NO: 980139 - RNA, 13 nt, Mycobacterium avium subsp. paratuberculosis
agcucggcggcca

SEQ ID NO: 980140 - RNA, 22 nt, Mycobacterium avium subsp. paratuberculosis
agcucgggcgcgaacagcgccg

SEQ ID NO: 980141 - RNA, 15 nt, Mycobacterium avium subsp. paratuberculosis
agcugagcagcaggu

SEQ ID NO: 980142 - RNA, 12 nt, Mycobacterium avium subsp. paratuberculosis
agcugagcagcc

SEQ ID NO: 980143 - RNA, 22 nt, Mycobacterium avium subsp. paratuberculosis
agcugaucggcguuggcggcgu

SEQ ID NO: 980144 - RNA, 12 nt, Mycobacterium avium subsp. paratuberculosis
agcugauuguug

SEQ ID NO: 980145 - RNA, 19 nt, Mycobacterium avium subsp. paratuberculosis
agcugcgggugcucagccu

SEQ ID NO: 980146 - RNA, 22 nt, Mycobacterium avium subsp. paratuberculosis
agcugcugccgccgcagcagcc

SEQ ID NO: 980147 - RNA, 15 nt, Mycobacterium avium subsp. paratuberculosis
agcugcucggccacc

SEQ ID NO: 980148 - RNA, 21 nt, Mycobacterium avium subsp. paratuberculosis
agcugcucggccaccgcgcgg

SEQ ID NO: 980149 - RNA, 18 nt, Mycobacterium avium subsp. paratuberculosis
agcgacuugccgccggcg

SEQ ID NO: 980150 - RNA, 18 nt, Mycobacterium avium subsp. paratuberculosis
agcgagacgaccaggaug

SEQ ID NO: 980151 - RNA, 13 nt, Mycobacterium avium subsp. paratuberculosis
agcgagcccagcu

SEQ ID NO: 980152 - RNA, 12 nt, Mycobacterium avium subsp. paratuberculosis
agcgagccgaga

SEQ ID NO: 980153 - RNA, 23 nt, Mycobacterium avium subsp. paratuberculosis
agcgaggggguggguccggucag

SEQ ID NO: 980154 - RNA, 16 nt, Mycobacterium avium subsp. paratuberculosis
agcgaggugugaggag

SEQ ID NO: 980155 - RNA, 19 nt, Mycobacterium avium subsp. paratuberculosis
agcgaggugugaggagucg

SEQ ID NO: 980156 - RNA, 21 nt, Mycobacterium avium subsp. paratuberculosis
agcgagccggcacgcgcgccg

SEQ ID NO: 980157 - RNA, 22 nt, Mycobacterium avium subsp. paratuberculosis
agcgacauggucgggcgcacca

SEQ ID NO: 980158 - RNA, 16 nt, Mycobacterium avium subsp. paratuberculosis
agcgacucggccagga

SEQ ID NO: 980159 - RNA, 15 nt, Mycobacterium avium subsp. paratuberculosis
agcgacaaaggaggg

SEQ ID NO: 980160 - RNA, 14 nt, Mycobacterium avium subsp. paratuberculosis
agcgacaacguggu

SEQ ID NO: 980161 - RNA, 16 nt, Mycobacterium avium subsp. paratuberculosis
agcgacaaucggcucg

SEQ ID NO: 980162 - RNA, 22 nt, Mycobacterium avium subsp. paratuberculosis
agcgacaaucucgggcaccccu

SEQ ID NO: 980163 - RNA, 15 nt, Mycobacterium avium subsp. paratuberculosis
agcgaagcgggacug

SEQ ID NO: 980164 - RNA, 15 nt, Mycobacterium avium subsp. paratuberculosis
agccuugcuggcggc

SEQ ID NO: 980165 - RNA, 16 nt, Mycobacterium avium subsp. paratuberculosis
agccuuggucgcggcc

SEQ ID NO: 980166 - RNA, 20 nt, Mycobacterium avium subsp. paratuberculosis
agccuuggccgcaggcggcc

SEQ ID NO: 980167 - RNA, 21 nt, Mycobacterium avium subsp. paratuberculosis
agccuucuuggcgggcgccuu

SEQ ID NO: 980168 - RNA, 18 nt, Mycobacterium avium subsp. paratuberculosis
agccuucuucgccgcaac

SEQ ID NO: 980169 - RNA, 18 nt, Mycobacterium avium subsp. paratuberculosis
agccuuugccgugcucgg

SEQ ID NO: 980170 - RNA, 22 nt, Mycobacterium avium subsp. paratuberculosis
agccuuuccacaucugcuugau

SEQ ID NO: 980171 - RNA, 13 nt, Mycobacterium avium subsp. paratuberculosis
agccuguuggcca

SEQ ID NO: 980172 - RNA, 19 nt, Mycobacterium avium subsp. paratuberculosis
agccuguuggccagauacu

SEQ ID NO: 980173 - RNA, 23 nt, Mycobacterium avium subsp. paratuberculosis
agccuguuggccagauacuccuc

SEQ ID NO: 980174 - RNA, 21 nt, Mycobacterium avium subsp. paratuberculosis
agccuaugaggcgacccccgg

SEQ ID NO: 980175 - RNA, 20 nt, Mycobacterium avium subsp. paratuberculosis
agccugccccccuugagccg

SEQ ID NO: 980176 - RNA, 16 nt, Mycobacterium avium subsp. paratuberculosis
agccguaacgaugccg

SEQ ID NO: 980177 - RNA, 19 nt, Mycobacterium avium subsp. paratuberculosis
agccggugaucgcggcgcu

SEQ ID NO: 980178 - RNA, 15 nt, Mycobacterium avium subsp. paratuberculosis
agccguaggccaggu

SEQ ID NO: 980179 - RNA, 19 nt, Mycobacterium avium subsp. paratuberculosis
agccgguggcagcccggcu

SEQ ID NO: 980180 - RNA, 18 nt, Mycobacterium avium subsp. paratuberculosis
agccgguggcggccacga

SEQ ID NO: 980181 - RNA, 19 nt, Mycobacterium avium subsp. paratuberculosis
agccgguggcggccacgau

SEQ ID NO: 980182 - RNA, 14 nt, Mycobacterium avium subsp. paratuberculosis
agccgucggcggcc

SEQ ID NO: 980183 - RNA, 15 nt, Mycobacterium avium subsp. paratuberculosis
agccgucggcggccu

SEQ ID NO: 980184 - RNA, 16 nt, Mycobacterium avium subsp. paratuberculosis
agccgucggcggccuu

SEQ ID NO: 980185 - RNA, 20 nt, Mycobacterium avium subsp. paratuberculosis
agccgucgguguccaggucg

SEQ ID NO: 980186 - RNA, 12 nt, Mycobacterium avium subsp. paratuberculosis
agccgucccugu

SEQ ID NO: 980187 - RNA, 22 nt, Mycobacterium avium subsp. paratuberculosis
agccgucccuguucgcgccggu

SEQ ID NO: 980188 - RNA, 14 nt, Mycobacterium avium subsp. paratuberculosis
agccgugccccagg

SEQ ID NO: 980189 - RNA, 22 nt, Mycobacterium avium subsp. paratuberculosis
agccgugccccaggucggggug

SEQ ID NO: 980190 - RNA, 12 nt, Mycobacterium avium subsp. paratuberculosis
agccgugcagcg

SEQ ID NO: 980191 - RNA, 14 nt, Mycobacterium avium subsp. paratuberculosis
agccguggcaggca

SEQ ID NO: 980192 - RNA, 21 nt, Mycobacterium avium subsp. paratuberculosis
agccgugggugccgacgagcu

SEQ ID NO: 980193 - RNA, 17 nt, Mycobacterium avium subsp. paratuberculosis
agccguucgcgccgaga

SEQ ID NO: 980194 - RNA, 22 nt, Mycobacterium avium subsp. paratuberculosis
agccguugaugcgcaccgcggc

SEQ ID NO: 980195 - RNA, 14 nt, Mycobacterium avium subsp. paratuberculosis
agccguugccgccg

SEQ ID NO: 980196 - RNA, 15 nt, Mycobacterium avium subsp. paratuberculosis
agccguugccgccgc

SEQ ID NO: 980197 - RNA, 20 nt, Mycobacterium avium subsp. paratuberculosis
agccguucucguccugggcc

SEQ ID NO: 980198 - RNA, 17 nt, Mycobacterium avium subsp. paratuberculosis
agccguugggcagcucg

SEQ ID NO: 980199 - RNA, 20 nt, Mycobacterium avium subsp. paratuberculosis
agccgguacggaucgccgga

SEQ ID NO: 980200 - RNA, 19 nt, Mycobacterium avium subsp. paratuberculosis
agccgguagaucagcgccu

SEQ ID NO: 980201 - RNA, 16 nt, Mycobacterium avium subsp. paratuberculosis
agccgggugaacccga

SEQ ID NO: 980202 - RNA, 23 nt, Mycobacterium avium subsp. paratuberculosis
agccgggugcgggccagcagccg

SEQ ID NO: 980203 - RNA, 18 nt, Mycobacterium avium subsp. paratuberculosis
agccgguccgaccgccac

SEQ ID NO: 980204 - RNA, 16 nt, Mycobacterium avium subsp. paratuberculosis
agccggucgcagguga

SEQ ID NO: 980205 - RNA, 19 nt, Mycobacterium avium subsp. paratuberculosis
agccggucgugcgacuccu

SEQ ID NO: 980206 - RNA, 16 nt, Mycobacterium avium subsp. paratuberculosis
agccggugcccaucgc

SEQ ID NO: 980207 - RNA, 21 nt, Mycobacterium avium subsp. paratuberculosis
agccggucuuggacagcagca

SEQ ID NO: 980208 - RNA, 19 nt, Mycobacterium avium subsp. paratuberculosis
agccgggaaucgagggcgc

SEQ ID NO: 980209 - RNA, 18 nt, Mycobacterium avium subsp. paratuberculosis
agccgggccaggucccag

SEQ ID NO: 980210 - RNA, 15 nt, Mycobacterium avium subsp. paratuberculosis
agccgggcggccagc

SEQ ID NO: 980211 - RNA, 16 nt, Mycobacterium avium subsp. paratuberculosis
agccgggcggccaggg

SEQ ID NO: 980212 - RNA, 19 nt, Mycobacterium avium subsp. paratuberculosis
agccggggacggugcagcc

SEQ ID NO: 980213 - RNA, 20 nt, Mycobacterium avium subsp. paratuberculosis
agccggggacggugcagccg

SEQ ID NO: 980214 - RNA, 16 nt, Mycobacterium avium subsp. paratuberculosis
agccggggcagcugcu

SEQ ID NO: 980215 - RNA, 18 nt, Mycobacterium avium subsp. paratuberculosis
agccgggggcggugcagc

SEQ ID NO: 980216 - RNA, 19 nt, Mycobacterium avium subsp. paratuberculosis
agccgggggcggugcagcc

SEQ ID NO: 980217 - RNA, 20 nt, Mycobacterium avium subsp. paratuberculosis
agccgggggcggugcagccg

SEQ ID NO: 980218 - RNA, 21 nt, Mycobacterium avium subsp. paratuberculosis
agccgggggcggugcagccgg

SEQ ID NO: 980219 - RNA, 22 nt, Mycobacterium avium subsp. paratuberculosis
agccgggggucggcuuccagau

SEQ ID NO: 980220 - RNA, 13 nt, Mycobacterium avium subsp. paratuberculosis
agccgggcggcca

SEQ ID NO: 980221 - RNA, 16 nt, Mycobacterium avium subsp. paratuberculosis
agccggggugcccggg

SEQ ID NO: 980222 - RNA, 18 nt, Mycobacterium avium subsp. paratuberculosis
agccgggcggcagcagcu

SEQ ID NO: 980223 - RNA, 13 nt, Mycobacterium avium subsp. paratuberculosis
agccggccaggcc

SEQ ID NO: 980224 - RNA, 19 nt, Mycobacterium avium subsp. paratuberculosis
agccggccaggcccagccc

SEQ ID NO: 980225 - RNA, 14 nt, Mycobacterium avium subsp. paratuberculosis
agccggccagcagc

SEQ ID NO: 980226 - RNA, 15 nt, Mycobacterium avium subsp. paratuberculosis
agccggccagcagcg

SEQ ID NO: 980227 - RNA, 12 nt, Mycobacterium avium subsp. paratuberculosis
agccggccagcg

SEQ ID NO: 980228 - RNA, 23 nt, Mycobacterium avium subsp. paratuberculosis
agccggccgaagcguuccgccgu

SEQ ID NO: 980229 - RNA, 18 nt, Mycobacterium avium subsp. paratuberculosis
agccggccgacgcggccu

SEQ ID NO: 980230 - RNA, 13 nt, Mycobacterium avium subsp. paratuberculosis
agccggccaccuc

SEQ ID NO: 980231 - RNA, 23 nt, Mycobacterium avium subsp. paratuberculosis
agccggccgcugaggaugguggu

SEQ ID NO: 980232 - RNA, 16 nt, Mycobacterium avium subsp. paratuberculosis
agccggccgcgucgcc

SEQ ID NO: 980233 - RNA, 14 nt, Mycobacterium avium subsp. paratuberculosis
agccggccgucagg

SEQ ID NO: 980234 - RNA, 19 nt, Mycobacterium avium subsp. paratuberculosis
agccggcgaacuccacccu

SEQ ID NO: 980235 - RNA, 16 nt, Mycobacterium avium subsp. paratuberculosis
agccggcgcaccgcgu

SEQ ID NO: 980236 - RNA, 23 nt, Mycobacterium avium subsp. paratuberculosis
agccggcgcagguguccagcccu

SEQ ID NO: 980237 - RNA, 15 nt, Mycobacterium avium subsp. paratuberculosis
agccggcgagcgcgc

SEQ ID NO: 980238 - RNA, 23 nt, Mycobacterium avium subsp. paratuberculosis
agccggcucgaaaugccuuggcg

SEQ ID NO: 980239 - RNA, 18 nt, Mycobacterium avium subsp. paratuberculosis
agccggcucuuggcgacc

SEQ ID NO: 980240 - RNA, 17 nt, Mycobacterium avium subsp. paratuberculosis
agccggcgggcgcucga

SEQ ID NO: 980241 - RNA, 16 nt, Mycobacterium avium subsp. paratuberculosis
agccgaucuggcgggc

SEQ ID NO: 980242 - RNA, 15 nt, Mycobacterium avium subsp. paratuberculosis
agccgaugcccagca

SEQ ID NO: 980243 - RNA, 16 nt, Mycobacterium avium subsp. paratuberculosis
agccgaugcccagcag

SEQ ID NO: 980244 - RNA, 17 nt, Mycobacterium avium subsp. paratuberculosis
agccgaugcccagcagc

SEQ ID NO: 980245 - RNA, 21 nt, Mycobacterium avium subsp. paratuberculosis
agccgaggccgauggcgccca

SEQ ID NO: 980246 - RNA, 23 nt, Mycobacterium avium subsp. paratuberculosis
agccgauacaugugccgaugucu

SEQ ID NO: 980247 - RNA, 13 nt, Mycobacterium avium subsp. paratuberculosis
agccgaucgccuc

SEQ ID NO: 980248 - RNA, 22 nt, Mycobacterium avium subsp. paratuberculosis
agccgaucgccuccgucagcgc

SEQ ID NO: 980249 - RNA, 15 nt, Mycobacterium avium subsp. paratuberculosis
agccgaggcgcucgc

SEQ ID NO: 980250 - RNA, 20 nt, Mycobacterium avium subsp. paratuberculosis
agccgaggucgcggcggccg

SEQ ID NO: 980251 - RNA, 21 nt, Mycobacterium avium subsp. paratuberculosis
agccgcacaccgcggcggcgu

SEQ ID NO: 980252 - RNA, 17 nt, Mycobacterium avium subsp. paratuberculosis
agccgcaacacggccuc

SEQ ID NO: 980253 - RNA, 23 nt, Mycobacterium avium subsp. paratuberculosis
agccgcaccagaucgucgggcac

SEQ ID NO: 980254 - RNA, 16 nt, Mycobacterium avium subsp. paratuberculosis
agccgcacuuggccuc

SEQ ID NO: 980255 - RNA, 23 nt, Mycobacterium avium subsp. paratuberculosis
agccgcacgaaccgcucgaacac

SEQ ID NO: 980256 - RNA, 17 nt, Mycobacterium avium subsp. paratuberculosis
agccgcaggugcucgcc

SEQ ID NO: 980257 - RNA, 16 nt, Mycobacterium avium subsp. paratuberculosis
agccgcagcggcggcu

SEQ ID NO: 980258 - RNA, 19 nt, Mycobacterium avium subsp. paratuberculosis
agccgcaucgcaagaaccu

SEQ ID NO: 980259 - RNA, 19 nt, Mycobacterium avium subsp. paratuberculosis
agccgcauguugugcccga

SEQ ID NO: 980260 - RNA, 17 nt, Mycobacterium avium subsp. paratuberculosis
agccgaacgacagcagg

SEQ ID NO: 980261 - RNA, 21 nt, Mycobacterium avium subsp. paratuberculosis
agcccuuggcgaagcguuuca

SEQ ID NO: 980262 - RNA, 18 nt, Mycobacterium avium subsp. paratuberculosis
agccgagacugauggugg

SEQ ID NO: 980263 - RNA, 16 nt, Mycobacterium avium subsp. paratuberculosis
agccgaccgccccgcu

SEQ ID NO: 980264 - RNA, 23 nt, Mycobacterium avium subsp. paratuberculosis
agccgcuuggcgcgccgcaccuc

SEQ ID NO: 980265 - RNA, 17 nt, Mycobacterium avium subsp. paratuberculosis
agccgcuugguggcgcc

SEQ ID NO: 980266 - RNA, 17 nt, Mycobacterium avium subsp. paratuberculosis
agccggaaggccaaggc

SEQ ID NO: 980267 - RNA, 20 nt, Mycobacterium avium subsp. paratuberculosis
agccggaaggccaaggccag

SEQ ID NO: 980268 - RNA, 15 nt, Mycobacterium avium subsp. paratuberculosis
agccggaucggggug

SEQ ID NO: 980269 - RNA, 23 nt, Mycobacterium avium subsp. paratuberculosis
agccggccaacagcagcgccgcg

SEQ ID NO: 980270 - RNA, 11 nt, Mycobacterium avium subsp. paratuberculosis
agccgcggacg

SEQ ID NO: 980271 - RNA, 12 nt, Mycobacterium avium subsp. paratuberculosis
agccgcgguucu

SEQ ID NO: 980272 - RNA, 20 nt, Mycobacterium avium subsp. paratuberculosis
agccgcucgcuauaucgcac

SEQ ID NO: 980273 - RNA, 22 nt, Mycobacterium avium subsp. paratuberculosis
agccgcugcacgcguugcagcg

SEQ ID NO: 980274 - RNA, 21 nt, Mycobacterium avium subsp. paratuberculosis
agccgcugagcuucugcccgg

SEQ ID NO: 980275 - RNA, 21 nt, Mycobacterium avium subsp. paratuberculosis
agccgcugcagcgccgcccgc

SEQ ID NO: 980276 - RNA, 19 nt, Mycobacterium avium subsp. paratuberculosis
agccgcgacagccgcccgg

SEQ ID NO: 980277 - RNA, 14 nt, Mycobacterium avium subsp. paratuberculosis
agccgcgccaccgc

SEQ ID NO: 980278 - RNA, 21 nt, Mycobacterium avium subsp. paratuberculosis
agccgcgccaccgcggggcug

SEQ ID NO: 980279 - RNA, 14 nt, Mycobacterium avium subsp. paratuberculosis
agccgccggccacc

SEQ ID NO: 980280 - RNA, 15 nt, Mycobacterium avium subsp. paratuberculosis
agccgccggccacca

SEQ ID NO: 980281 - RNA, 18 nt, Mycobacterium avium subsp. paratuberculosis
agccgccgggccacgccg

SEQ ID NO: 980282 - RNA, 19 nt, Mycobacterium avium subsp. paratuberculosis
agccgccgggcuuccccaa

SEQ ID NO: 980283 - RNA, 17 nt, Mycobacterium avium subsp. paratuberculosis
agccgccguccccgcgc

SEQ ID NO: 980284 - RNA, 23 nt, Mycobacterium avium subsp. paratuberculosis
agccgcgccgacagaugcggcac

SEQ ID NO: 980285 - RNA, 16 nt, Mycobacterium avium subsp. paratuberculosis
agccgcgccgccgcgu

SEQ ID NO: 980286 - RNA, 21 nt, Mycobacterium avium subsp. paratuberculosis
agccgcgcggccggccacgcu

SEQ ID NO: 980287 - RNA, 14 nt, Mycobacterium avium subsp. paratuberculosis
agcccaccgcgccc

SEQ ID NO: 980288 - RNA, 22 nt, Mycobacterium avium subsp. paratuberculosis
agcccagcgcguugaagcugac

SEQ ID NO: 980289 - RNA, 12 nt, Mycobacterium avium subsp. paratuberculosis
agcccagguaau

SEQ ID NO: 980290 - RNA, 16 nt, Mycobacterium avium subsp. paratuberculosis
agcccagcuuggcgcc

SEQ ID NO: 980291 - RNA, 18 nt, Mycobacterium avium subsp. paratuberculosis
agcccagcuuggcgcccu

SEQ ID NO: 980292 - RNA, 15 nt, Mycobacterium avium subsp. paratuberculosis
agcccaggcccagca

SEQ ID NO: 980293 - RNA, 18 nt, Mycobacterium avium subsp. paratuberculosis
agcccaggcccagcagca

SEQ ID NO: 980294 - RNA, 15 nt, Mycobacterium avium subsp. paratuberculosis
agcccaggcccggca

SEQ ID NO: 980295 - RNA, 14 nt, Mycobacterium avium subsp. paratuberculosis
agcccccaauguca

SEQ ID NO: 980296 - RNA, 16 nt, Mycobacterium avium subsp. paratuberculosis
agcccaugucgccggu

SEQ ID NO: 980297 - RNA, 17 nt, Mycobacterium avium subsp. paratuberculosis
agcccauguccagguac

SEQ ID NO: 980298 - RNA, 12 nt, Mycobacterium avium subsp. paratuberculosis
agcccuccagcu

SEQ ID NO: 980299 - RNA, 19 nt, Mycobacterium avium subsp. paratuberculosis
agcccgucgacgggccacc

SEQ ID NO: 980300 - RNA, 19 nt, Mycobacterium avium subsp. paratuberculosis
agcccgugcgacggcucuu

SEQ ID NO: 980301 - RNA, 15 nt, Mycobacterium avium subsp. paratuberculosis
agcccgucccggccc

SEQ ID NO: 980302 - RNA, 23 nt, Mycobacterium avium subsp. paratuberculosis
agcccgucgggugugauugccag

SEQ ID NO: 980303 - RNA, 17 nt, Mycobacterium avium subsp. paratuberculosis
agcccguugucgagcac

SEQ ID NO: 980304 - RNA, 21 nt, Mycobacterium avium subsp. paratuberculosis
agcccguugucgagcaccgcg

SEQ ID NO: 980305 - RNA, 17 nt, Mycobacterium avium subsp. paratuberculosis
agcccguuguggcggcc

SEQ ID NO: 980306 - RNA, 14 nt, Mycobacterium avium subsp. paratuberculosis
agcccggcuggcag

SEQ ID NO: 980307 - RNA, 17 nt, Mycobacterium avium subsp. paratuberculosis
agcccggccgcggccca

SEQ ID NO: 980308 - RNA, 15 nt, Mycobacterium avium subsp. paratuberculosis
agcccggcccagccg

SEQ ID NO: 980309 - RNA, 21 nt, Mycobacterium avium subsp. paratuberculosis
agcccggucaccaucagcacc

SEQ ID NO: 980310 - RNA, 18 nt, Mycobacterium avium subsp. paratuberculosis
agcccgcggcagccagcc

SEQ ID NO: 980311 - RNA, 19 nt, Mycobacterium avium subsp. paratuberculosis
agcccggaaaaccccaccc

SEQ ID NO: 980312 - RNA, 19 nt, Mycobacterium avium subsp. paratuberculosis
agcccggaaucgucggcca

SEQ ID NO: 980313 - RNA, 21 nt, Mycobacterium avium subsp. paratuberculosis
agcccggaaucgucggccacg

SEQ ID NO: 980314 - RNA, 16 nt, Mycobacterium avium subsp. paratuberculosis
agcccggcagcggggc

SEQ ID NO: 980315 - RNA, 17 nt, Mycobacterium avium subsp. paratuberculosis
agcccggcgacgaagca

SEQ ID NO: 980316 - RNA, 20 nt, Mycobacterium avium subsp. paratuberculosis
agcccggcgacgaagcagcu

SEQ ID NO: 980317 - RNA, 13 nt, Mycobacterium avium subsp. paratuberculosis
agcccgaacagcu

SEQ ID NO: 980318 - RNA, 13 nt, Mycobacterium avium subsp. paratuberculosis
agccccugcacca

SEQ ID NO: 980319 - RNA, 14 nt, Mycobacterium avium subsp. paratuberculosis
agccccucgaccac

SEQ ID NO: 980320 - RNA, 20 nt, Mycobacterium avium subsp. paratuberculosis
agccccucgaccaccucuuc

SEQ ID NO: 980321 - RNA, 21 nt, Mycobacterium avium subsp. paratuberculosis
agccccucgccgggcgucacu

SEQ ID NO: 980322 - RNA, 11 nt, Mycobacterium avium subsp. paratuberculosis
agccccucggg

SEQ ID NO: 980323 - RNA, 18 nt, Mycobacterium avium subsp. paratuberculosis
agccccgggaaccagccc

SEQ ID NO: 980324 - RNA, 19 nt, Mycobacterium avium subsp. paratuberculosis
agccccgggaaccagccca

SEQ ID NO: 980325 - RNA, 14 nt, Mycobacterium avium subsp. paratuberculosis
agccccgccaggcg

SEQ ID NO: 980326 - RNA, 21 nt, Mycobacterium avium subsp. paratuberculosis
agccccgccgggguccgcaac

SEQ ID NO: 980327 - RNA, 19 nt, Mycobacterium avium subsp. paratuberculosis
agcccgccggcggcgauga

SEQ ID NO: 980328 - RNA, 13 nt, Mycobacterium avium subsp. paratuberculosis
agcccgccgggcu

SEQ ID NO: 980329 - RNA, 15 nt, Mycobacterium avium subsp. paratuberculosis
agcccgcccagcgcc

SEQ ID NO: 980330 - RNA, 15 nt, Mycobacterium avium subsp. paratuberculosis
agcccgcucagagcu

SEQ ID NO: 980331 - RNA, 17 nt, Mycobacterium avium subsp. paratuberculosis
agcccgcguccagcagc

SEQ ID NO: 980332 - RNA, 15 nt, Mycobacterium avium subsp. paratuberculosis
agcccgaugcuggcc

SEQ ID NO: 980333 - RNA, 21 nt, Mycobacterium avium subsp. paratuberculosis
agcccgaugcuggccaucgcc

SEQ ID NO: 980334 - RNA, 17 nt, Mycobacterium avium subsp. paratuberculosis
agcccgcaaaucagccg

SEQ ID NO: 980335 - RNA, 19 nt, Mycobacterium avium subsp. paratuberculosis
aguuuuucgggguggugga

SEQ ID NO: 980336 - RNA, 18 nt, Mycobacterium avium subsp. paratuberculosis
aguuugcggugaucccag

SEQ ID NO: 980337 - RNA, 13 nt, Mycobacterium avium subsp. paratuberculosis
aguuucacgcugg

SEQ ID NO: 980338 - RNA, 15 nt, Mycobacterium avium subsp. paratuberculosis
aguugacuccucugc

SEQ ID NO: 980339 - RNA, 15 nt, Mycobacterium avium subsp. paratuberculosis
aguuggcggcgguga

SEQ ID NO: 980340 - RNA, 15 nt, Mycobacterium avium subsp. paratuberculosis
aguugccggucaggc

SEQ ID NO: 980341 - RNA, 16 nt, Mycobacterium avium subsp. paratuberculosis
aguugccggucaggca

SEQ ID NO: 980342 - RNA, 22 nt, Mycobacterium avium subsp. paratuberculosis
aguugccgauggcgguccacca

SEQ ID NO: 980343 - RNA, 23 nt, Mycobacterium avium subsp. paratuberculosis
aguuguagacguagugcagccgc

SEQ ID NO: 980344 - RNA, 20 nt, Mycobacterium avium subsp. paratuberculosis
aguucgaugccgggcauggc

SEQ ID NO: 980345 - RNA, 13 nt, Mycobacterium avium subsp. paratuberculosis
aguucgcccgcag

SEQ ID NO: 980346 - RNA, 18 nt, Mycobacterium avium subsp. paratuberculosis
aguucgcccgcagcacgc

SEQ ID NO: 980347 - RNA, 13 nt, Mycobacterium avium subsp. paratuberculosis
aguucgccgccgc

SEQ ID NO: 980348 - RNA, 20 nt, Mycobacterium avium subsp. paratuberculosis
aguucgccgccgccagcacc

SEQ ID NO: 980349 - RNA, 23 nt, Mycobacterium avium subsp. paratuberculosis
aguuccgacaucagugcgggcau

SEQ ID NO: 980350 - RNA, 18 nt, Mycobacterium avium subsp. paratuberculosis
aguuccggcgguccugcg

SEQ ID NO: 980351 - RNA, 18 nt, Mycobacterium avium subsp. paratuberculosis
aguggccggcguccaggc

SEQ ID NO: 980352 - RNA, 17 nt, Mycobacterium avium subsp. paratuberculosis
agucguccagcgucgac

SEQ ID NO: 980353 - RNA, 18 nt, Mycobacterium avium subsp. paratuberculosis
agucgguuucgaccugcg

SEQ ID NO: 980354 - RNA, 17 nt, Mycobacterium avium subsp. paratuberculosis
agucgucgcgcaccagc

SEQ ID NO: 980355 - RNA, 21 nt, Mycobacterium avium subsp. paratuberculosis
agucgucgcgcaccagcucga

SEQ ID NO: 980356 - RNA, 22 nt, Mycobacterium avium subsp. paratuberculosis
agugaugcuguuaccgucgggc

SEQ ID NO: 980357 - RNA, 22 nt, Mycobacterium avium subsp. paratuberculosis
agugaggccgaggcgagugagg

SEQ ID NO: 980358 - RNA, 14 nt, Mycobacterium avium subsp. paratuberculosis
agugaggccagcac

SEQ ID NO: 980359 - RNA, 13 nt, Mycobacterium avium subsp. paratuberculosis
agugccaccacca

SEQ ID NO: 980360 - RNA, 18 nt, Mycobacterium avium subsp. paratuberculosis
agugccaccaccacggcc

SEQ ID NO: 980361 - RNA, 19 nt, Mycobacterium avium subsp. paratuberculosis
agugccaguaccagcggcc

SEQ ID NO: 980362 - RNA, 19 nt, Mycobacterium avium subsp. paratuberculosis
agugcccgcccagcugcac

SEQ ID NO: 980363 - RNA, 18 nt, Mycobacterium avium subsp. paratuberculosis
agugccgcaggugguggg

SEQ ID NO: 980364 - RNA, 20 nt, Mycobacterium avium subsp. paratuberculosis
agugcggucgguucauccac

SEQ ID NO: 980365 - RNA, 16 nt, Mycobacterium avium subsp. paratuberculosis
agugcggcccacccgg

SEQ ID NO: 980366 - RNA, 14 nt, Mycobacterium avium subsp. paratuberculosis
agugcuucuugaag

SEQ ID NO: 980367 - RNA, 22 nt, Mycobacterium avium subsp. paratuberculosis
agugcuucuugaagaaccggga

SEQ ID NO: 980368 - RNA, 23 nt, Mycobacterium avium subsp. paratuberculosis
agucaugccgcgcucgucgauca

SEQ ID NO: 980369 - RNA, 19 nt, Mycobacterium avium subsp. paratuberculosis
agucaucgagaugccggga

SEQ ID NO: 980370 - RNA, 14 nt, Mycobacterium avium subsp. paratuberculosis
agucccaugggcug

SEQ ID NO: 980371 - RNA, 16 nt, Mycobacterium avium subsp. paratuberculosis
agucccacugcccgua

SEQ ID NO: 980372 - RNA, 14 nt, Mycobacterium avium subsp. paratuberculosis
agucccagaucgua

SEQ ID NO: 980373 - RNA, 18 nt, Mycobacterium avium subsp. paratuberculosis
aguccagucgcgccgagg

SEQ ID NO: 980374 - RNA, 16 nt, Mycobacterium avium subsp. paratuberculosis
aguccagcacagcauc

SEQ ID NO: 980375 - RNA, 13 nt, Mycobacterium avium subsp. paratuberculosis
aguccagccagcc

SEQ ID NO: 980376 - RNA, 14 nt, Mycobacterium avium subsp. paratuberculosis
agucgcagcagcag

SEQ ID NO: 980377 - RNA, 14 nt, Mycobacterium avium subsp. paratuberculosis
agucgagcaccgcg

SEQ ID NO: 980378 - RNA, 17 nt, Mycobacterium avium subsp. paratuberculosis
agucgagcaccgcgacc

SEQ ID NO: 980379 - RNA, 19 nt, Mycobacterium avium subsp. paratuberculosis
agucggcgaucagcuccuc

SEQ ID NO: 980380 - RNA, 14 nt, Mycobacterium avium subsp. paratuberculosis
agucggccugcagc

SEQ ID NO: 980381 - RNA, 15 nt, Mycobacterium avium subsp. paratuberculosis
agucggccugcagcu

SEQ ID NO: 980382 - RNA, 12 nt, Mycobacterium avium subsp. paratuberculosis
agucggccaccg

SEQ ID NO: 980383 - RNA, 13 nt, Mycobacterium avium subsp. paratuberculosis
agucggccaccgc

SEQ ID NO: 980384 - RNA, 20 nt, Mycobacterium avium subsp. paratuberculosis
agucggccacguugccgggu

SEQ ID NO: 980385 - RNA, 13 nt, Mycobacterium avium subsp. paratuberculosis
agucggcccaggc

SEQ ID NO: 980386 - RNA, 13 nt, Mycobacterium avium subsp. paratuberculosis
agucgcucagcgu

SEQ ID NO: 980387 - RNA, 20 nt, Mycobacterium avium subsp. paratuberculosis
agucgggaaaucggacccag

SEQ ID NO: 980388 - RNA, 23 nt, Mycobacterium avium subsp. paratuberculosis
agucgggaaaucggacccagccc

SEQ ID NO: 980389 - RNA, 20 nt, Mycobacterium avium subsp. paratuberculosis
agucgggcaaucggacccag

SEQ ID NO: 980390 - RNA, 17 nt, Mycobacterium avium subsp. paratuberculosis
agucggcgucggccacc

SEQ ID NO: 980391 - RNA, 21 nt, Mycobacterium avium subsp. paratuberculosis
agucccgcgccuggcgcaggg

SEQ ID NO: 980392 - RNA, 15 nt, Mycobacterium avium subsp. paratuberculosis
agucccgcgcggcgc

SEQ ID NO: 980393 - RNA, 21 nt, Mycobacterium avium subsp. paratuberculosis
aguccuccgucgagucggcca

SEQ ID NO: 980394 - RNA, 15 nt, Mycobacterium avium subsp. paratuberculosis
aguccgccgacagcg

SEQ ID NO: 980395 - RNA, 13 nt, Mycobacterium avium subsp. paratuberculosis
aguccgccgccgu

SEQ ID NO: 980396 - RNA, 22 nt, Mycobacterium avium subsp. paratuberculosis
aguccgccggagaccagcagcu

SEQ ID NO: 980397 - RNA, 15 nt, Mycobacterium avium subsp. paratuberculosis
aguccugcagcucgc

SEQ ID NO: 980398 - RNA, 17 nt, Mycobacterium avium subsp. paratuberculosis
aguccucgguggccacc

SEQ ID NO: 980399 - RNA, 21 nt, Mycobacterium avium subsp. paratuberculosis
agucacccggcuggccgcaca

SEQ ID NO: 980400 - RNA, 22 nt, Mycobacterium avium subsp. paratuberculosis
aguauauuugccugacuucuga

SEQ ID NO: 980401 - RNA, 18 nt, Mycobacterium avium subsp. paratuberculosis
aguauccggucagcgcca

SEQ ID NO: 980402 - RNA, 23 nt, Mycobacterium avium subsp. paratuberculosis
aguauggagaaaauccagaacag

SEQ ID NO: 980403 - RNA, 17 nt, Mycobacterium avium subsp. paratuberculosis
aguaucuuguucgccga

SEQ ID NO: 980404 - RNA, 14 nt, Mycobacterium avium subsp. paratuberculosis
aguagcaucgggga

SEQ ID NO: 980405 - RNA, 12 nt, Mycobacterium avium subsp. paratuberculosis
aguagccgccgg

SEQ ID NO: 980406 - RNA, 22 nt, Mycobacterium avium subsp. paratuberculosis
aguagccgguucgucccgcgcg

SEQ ID NO: 980407 - RNA, 15 nt, Mycobacterium avium subsp. paratuberculosis
aguagacgccgccgu

SEQ ID NO: 980408 - RNA, 13 nt, Mycobacterium avium subsp. paratuberculosis
aguagagccgcug

SEQ ID NO: 980409 - RNA, 16 nt, Mycobacterium avium subsp. paratuberculosis
aguagagccgcugcac

SEQ ID NO: 980410 - RNA, 19 nt, Mycobacterium avium subsp. paratuberculosis
aguacucgguguagagcac

SEQ ID NO: 980411 - RNA, 13 nt, Mycobacterium avium subsp. paratuberculosis
agcuggccaccgc

SEQ ID NO: 980412 - RNA, 15 nt, Mycobacterium avium subsp. paratuberculosis
agcuggccgcccacc

SEQ ID NO: 980413 - RNA, 18 nt, Mycobacterium avium subsp. paratuberculosis
aucaacugcaccagcggc

SEQ ID NO: 980414 - RNA, 16 nt, Mycobacterium avium subsp. paratuberculosis
aucaacaggcccagca

SEQ ID NO: 980415 - RNA, 18 nt, Mycobacterium avium subsp. paratuberculosis
aucaacaggcccagcagc

SEQ ID NO: 980416 - RNA, 14 nt, Mycobacterium avium subsp. paratuberculosis
aucaacagccgccc

SEQ ID NO: 980417 - RNA, 18 nt, Mycobacterium avium subsp. paratuberculosis
aucaacaccgccagcacc

SEQ ID NO: 980418 - RNA, 16 nt, Mycobacterium avium subsp. paratuberculosis
auauuucguguucuca

SEQ ID NO: 980419 - RNA, 13 nt, Mycobacterium avium subsp. paratuberculosis
auauggcccucca

SEQ ID NO: 980420 - RNA, 23 nt, Mycobacterium avium subsp. paratuberculosis
auauggcccuccacggugcgcac

SEQ ID NO: 980421 - RNA, 22 nt, Mycobacterium avium subsp. paratuberculosis
auaucccgauuuuuuccgcucu

SEQ ID NO: 980422 - RNA, 22 nt, Mycobacterium avium subsp. paratuberculosis
auagugaacgccucgggccggc

SEQ ID NO: 980423 - RNA, 15 nt, Mycobacterium avium subsp. paratuberculosis
auaguucgccgccgc

SEQ ID NO: 980424 - RNA, 16 nt, Mycobacterium avium subsp. paratuberculosis
auauaggugagaaaag

SEQ ID NO: 980425 - RNA, 17 nt, Mycobacterium avium subsp. paratuberculosis
auaccagugcccgagca

SEQ ID NO: 980426 - RNA, 15 nt, Mycobacterium avium subsp. paratuberculosis
auacccgaccagcac

SEQ ID NO: 980427 - RNA, 18 nt, Mycobacterium avium subsp. paratuberculosis
auaccacugcgcgcccga

SEQ ID NO: 980428 - RNA, 10 nt, Mycobacterium avium subsp. paratuberculosis
auagccgcgc

SEQ ID NO: 980429 - RNA, 20 nt, Mycobacterium avium subsp. paratuberculosis
aucgaauacaccugccgcac

SEQ ID NO: 980430 - RNA, 15 nt, Mycobacterium avium subsp. paratuberculosis
aucgacaugcccggc

SEQ ID NO: 980431 - RNA, 22 nt, Mycobacterium avium subsp. paratuberculosis
aucgacagguucuuggcggccu

SEQ ID NO: 980432 - RNA, 13 nt, Mycobacterium avium subsp. paratuberculosis
aucgacagucccg

SEQ ID NO: 980433 - RNA, 15 nt, Mycobacterium avium subsp. paratuberculosis
aucgacgccaugggc

SEQ ID NO: 980434 - RNA, 19 nt, Mycobacterium avium subsp. paratuberculosis
aucgacgccaugggcccag

SEQ ID NO: 980435 - RNA, 16 nt, Mycobacterium avium subsp. paratuberculosis
auccuuccucgcagaa

SEQ ID NO: 980436 - RNA, 13 nt, Mycobacterium avium subsp. paratuberculosis
aucgccaacgcgc

SEQ ID NO: 980437 - RNA, 22 nt, Mycobacterium avium subsp. paratuberculosis
aucgaucccuuggcggcggcca

SEQ ID NO: 980438 - RNA, 14 nt, Mycobacterium avium subsp. paratuberculosis
aucgaugcccagcg

SEQ ID NO: 980439 - RNA, 14 nt, Mycobacterium avium subsp. paratuberculosis
aucgacuccagcac

SEQ ID NO: 980440 - RNA, 15 nt, Mycobacterium avium subsp. paratuberculosis
aucgacuccagcacc

SEQ ID NO: 980441 - RNA, 16 nt, Mycobacterium avium subsp. paratuberculosis
aucgccaucagcagcg

SEQ ID NO: 980442 - RNA, 18 nt, Mycobacterium avium subsp. paratuberculosis
aucgcccaacaacucgac

SEQ ID NO: 980443 - RNA, 11 nt, Mycobacterium avium subsp. paratuberculosis
aucgccaggcg

SEQ ID NO: 980444 - RNA, 12 nt, Mycobacterium avium subsp. paratuberculosis
aucgccagcacg

SEQ ID NO: 980445 - RNA, 14 nt, Mycobacterium avium subsp. paratuberculosis
aucgccagcccggc

SEQ ID NO: 980446 - RNA, 11 nt, Mycobacterium avium subsp. paratuberculosis
aucgccagccc

SEQ ID NO: 980447 - RNA, 22 nt, Mycobacterium avium subsp. paratuberculosis
aucgccgacggugagcaccgcc

SEQ ID NO: 980448 - RNA, 15 nt, Mycobacterium avium subsp. paratuberculosis
aucgccgcgaacaau

SEQ ID NO: 980449 - RNA, 18 nt, Mycobacterium avium subsp. paratuberculosis
aucgccgcccaucggcag

SEQ ID NO: 980450 - RNA, 16 nt, Mycobacterium avium subsp. paratuberculosis
aucgccgcgcccagca

SEQ ID NO: 980451 - RNA, 18 nt, Mycobacterium avium subsp. paratuberculosis
aucgccgcgcccagcacg

SEQ ID NO: 980452 - RNA, 15 nt, Mycobacterium avium subsp. paratuberculosis
aucgccucggccacc

SEQ ID NO: 980453 - RNA, 17 nt, Mycobacterium avium subsp. paratuberculosis
aucgccggaucgagcac

SEQ ID NO: 980454 - RNA, 22 nt, Mycobacterium avium subsp. paratuberculosis
aucgccgccgccaucuccuccg

SEQ ID NO: 980455 - RNA, 18 nt, Mycobacterium avium subsp. paratuberculosis
aucggcgccggcuccgca

SEQ ID NO: 980456 - RNA, 23 nt, Mycobacterium avium subsp. paratuberculosis
aucggcaggauccggucgaucac

SEQ ID NO: 980457 - RNA, 14 nt, Mycobacterium avium subsp. paratuberculosis
aucgcuugaccacc

SEQ ID NO: 980458 - RNA, 19 nt, Mycobacterium avium subsp. paratuberculosis
aucgcugaugcgcaacagc

SEQ ID NO: 980459 - RNA, 18 nt, Mycobacterium avium subsp. paratuberculosis
aucgcugcgagcccggcc

SEQ ID NO: 980460 - RNA, 22 nt, Mycobacterium avium subsp. paratuberculosis
aucgcgaaguagacgagcucac

SEQ ID NO: 980461 - RNA, 14 nt, Mycobacterium avium subsp. paratuberculosis
aucgucggccacgc

SEQ ID NO: 980462 - RNA, 23 nt, Mycobacterium avium subsp. paratuberculosis
aucgucggcucguguccgaugac

SEQ ID NO: 980463 - RNA, 22 nt, Mycobacterium avium subsp. paratuberculosis
aucggcgucacugcccagccau

SEQ ID NO: 980464 - RNA, 21 nt, Mycobacterium avium subsp. paratuberculosis
aucggcgugaauccucagcac

SEQ ID NO: 980465 - RNA, 23 nt, Mycobacterium avium subsp. paratuberculosis
aucggcggccaccagccggccgg

SEQ ID NO: 980466 - RNA, 20 nt, Mycobacterium avium subsp. paratuberculosis
auccuggccuggucggccgg

SEQ ID NO: 980467 - RNA, 16 nt, Mycobacterium avium subsp. paratuberculosis
auccugcuggccgggc

SEQ ID NO: 980468 - RNA, 21 nt, Mycobacterium avium subsp. paratuberculosis
auccugcccggucugcggccg

SEQ ID NO: 980469 - RNA, 19 nt, Mycobacterium avium subsp. paratuberculosis
auccucgccgcgccagcac

SEQ ID NO: 980470 - RNA, 19 nt, Mycobacterium avium subsp. paratuberculosis
auccucgccgcgggccagc

SEQ ID NO: 980471 - RNA, 16 nt, Mycobacterium avium subsp. paratuberculosis
auccgucgccccgcac

SEQ ID NO: 980472 - RNA, 15 nt, Mycobacterium avium subsp. paratuberculosis
auccgugagggaccu

SEQ ID NO: 980473 - RNA, 22 nt, Mycobacterium avium subsp. paratuberculosis
auccucagcacggccgcggcca

SEQ ID NO: 980474 - RNA, 22 nt, Mycobacterium avium subsp. paratuberculosis
auccgguaccagaucgagcugg

SEQ ID NO: 980475 - RNA, 18 nt, Mycobacterium avium subsp. paratuberculosis
auccggggucagggcgcu

SEQ ID NO: 980476 - RNA, 12 nt, Mycobacterium avium subsp. paratuberculosis
auccgggcggcc

SEQ ID NO: 980477 - RNA, 13 nt, Mycobacterium avium subsp. paratuberculosis
auccgggcggcca

SEQ ID NO: 980478 - RNA, 15 nt, Mycobacterium avium subsp. paratuberculosis
auccgguccagcccg

SEQ ID NO: 980479 - RNA, 14 nt, Mycobacterium avium subsp. paratuberculosis
auccggucgaugaa

SEQ ID NO: 980480 - RNA, 19 nt, Mycobacterium avium subsp. paratuberculosis
auccggugggguuagggcg

SEQ ID NO: 980481 - RNA, 16 nt, Mycobacterium avium subsp. paratuberculosis
auccggcucagaaggc

SEQ ID NO: 980482 - RNA, 16 nt, Mycobacterium avium subsp. paratuberculosis
auccggcuccacagca

SEQ ID NO: 980483 - RNA, 14 nt, Mycobacterium avium subsp. paratuberculosis
aucccuuggcggcg

SEQ ID NO: 980484 - RNA, 21 nt, Mycobacterium avium subsp. paratuberculosis
auccgcaacgugcgccggccu

SEQ ID NO: 980485 - RNA, 19 nt, Mycobacterium avium subsp. paratuberculosis
auccgaucagcagcaccug

SEQ ID NO: 980486 - RNA, 15 nt, Mycobacterium avium subsp. paratuberculosis
auccgcagcaccagg

SEQ ID NO: 980487 - RNA, 20 nt, Mycobacterium avium subsp. paratuberculosis
auccgcgccgccgccagcca

SEQ ID NO: 980488 - RNA, 21 nt, Mycobacterium avium subsp. paratuberculosis
auccgcgccgccgccagccag

SEQ ID NO: 980489 - RNA, 17 nt, Mycobacterium avium subsp. paratuberculosis
auccgcgcggccaccag

SEQ ID NO: 980490 - RNA, 18 nt, Mycobacterium avium subsp. paratuberculosis
auccgcgcggccaccagc

SEQ ID NO: 980491 - RNA, 20 nt, Mycobacterium avium subsp. paratuberculosis
auccgcgcagcgucuugccc

SEQ ID NO: 980492 - RNA, 17 nt, Mycobacterium avium subsp. paratuberculosis
auccgccagaucgccug

SEQ ID NO: 980493 - RNA, 17 nt, Mycobacterium avium subsp. paratuberculosis
aucccgguucccggcac

SEQ ID NO: 980494 - RNA, 21 nt, Mycobacterium avium subsp. paratuberculosis
aucccgguucccggcaccacc

SEQ ID NO: 980495 - RNA, 23 nt, Mycobacterium avium subsp. paratuberculosis
aucccgguucccgugcuggccau

SEQ ID NO: 980496 - RNA, 13 nt, Mycobacterium avium subsp. paratuberculosis
aucccgucgacca

SEQ ID NO: 980497 - RNA, 19 nt, Mycobacterium avium subsp. paratuberculosis
aucccggccaccccgcaga

SEQ ID NO: 980498 - RNA, 18 nt, Mycobacterium avium subsp. paratuberculosis
aucccggccagcacccgc

SEQ ID NO: 980499 - RNA, 17 nt, Mycobacterium avium subsp. paratuberculosis
aucccggagaacaucag

SEQ ID NO: 980500 - RNA, 16 nt, Mycobacterium avium subsp. paratuberculosis
aucccgccggcggcca

SEQ ID NO: 980501 - RNA, 18 nt, Mycobacterium avium subsp. paratuberculosis
aucccgccggcggccacg

SEQ ID NO: 980502 - RNA, 19 nt, Mycobacterium avium subsp. paratuberculosis
aucccgccggcggccacga

SEQ ID NO: 980503 - RNA, 14 nt, Mycobacterium avium subsp. paratuberculosis
aucccgccgggcau

SEQ ID NO: 980504 - RNA, 16 nt, Mycobacterium avium subsp. paratuberculosis
aucccgccgggcaucu

SEQ ID NO: 980505 - RNA, 15 nt, Mycobacterium avium subsp. paratuberculosis
aucccgauccgcgcc

SEQ ID NO: 980506 - RNA, 16 nt, Mycobacterium avium subsp. paratuberculosis
aucccgaccagcugau

SEQ ID NO: 980507 - RNA, 23 nt, Mycobacterium avium subsp. paratuberculosis
aucccgaggaugccgcccaccac

SEQ ID NO: 980508 - RNA, 16 nt, Mycobacterium avium subsp. paratuberculosis
aucccgaugucggcga

SEQ ID NO: 980509 - RNA, 23 nt, Mycobacterium avium subsp. paratuberculosis
aucccgcaauugcgccagcagca

SEQ ID NO: 980510 - RNA, 15 nt, Mycobacterium avium subsp. paratuberculosis
aucccgcagcuucug

SEQ ID NO: 980511 - RNA, 14 nt, Mycobacterium avium subsp. paratuberculosis
auccccgcgguucg

SEQ ID NO: 980512 - RNA, 16 nt, Mycobacterium avium subsp. paratuberculosis
auccccgcguuggcca

SEQ ID NO: 980513 - RNA, 19 nt, Mycobacterium avium subsp. paratuberculosis
auccccuggccgaaggugg

SEQ ID NO: 980514 - RNA, 13 nt, Mycobacterium avium subsp. paratuberculosis
aucccccgcagcu

SEQ ID NO: 980515 - RNA, 16 nt, Mycobacterium avium subsp. paratuberculosis
aucccccgcagcuucu

SEQ ID NO: 980516 - RNA, 13 nt, Mycobacterium avium subsp. paratuberculosis
auccccccgcgcc

SEQ ID NO: 980517 - RNA, 16 nt, Mycobacterium avium subsp. paratuberculosis
auccccagcugggccg

SEQ ID NO: 980518 - RNA, 15 nt, Mycobacterium avium subsp. paratuberculosis
auccaggaacggcac

SEQ ID NO: 980519 - RNA, 18 nt, Mycobacterium avium subsp. paratuberculosis
auccaggaacggcacccg

SEQ ID NO: 980520 - RNA, 19 nt, Mycobacterium avium subsp. paratuberculosis
auccagcccugcuugaccg

SEQ ID NO: 980521 - RNA, 16 nt, Mycobacterium avium subsp. paratuberculosis
auccagccgugggugu

SEQ ID NO: 980522 - RNA, 12 nt, Mycobacterium avium subsp. paratuberculosis
auccagcccugc

SEQ ID NO: 980523 - RNA, 19 nt, Mycobacterium avium subsp. paratuberculosis
auccagcaccgccacgucu

SEQ ID NO: 980524 - RNA, 18 nt, Mycobacterium avium subsp. paratuberculosis
auccagcagcgccucggc

SEQ ID NO: 980525 - RNA, 18 nt, Mycobacterium avium subsp. paratuberculosis
auccaggugaacagcagc

SEQ ID NO: 980526 - RNA, 13 nt, Mycobacterium avium subsp. paratuberculosis
auccaguuccagu

SEQ ID NO: 980527 - RNA, 22 nt, Mycobacterium avium subsp. paratuberculosis
aucccacauucggcgaaccagg

SEQ ID NO: 980528 - RNA, 18 nt, Mycobacterium avium subsp. paratuberculosis
auccauuucggugaauuc

SEQ ID NO: 980529 - RNA, 15 nt, Mycobacterium avium subsp. paratuberculosis
aucccaucggggcua

SEQ ID NO: 980530 - RNA, 15 nt, Mycobacterium avium subsp. paratuberculosis
aucccagacccagca

SEQ ID NO: 980531 - RNA, 14 nt, Mycobacterium avium subsp. paratuberculosis
aucccacccgcaac

SEQ ID NO: 980532 - RNA, 18 nt, Mycobacterium avium subsp. paratuberculosis
auccauucgguuuccccu

SEQ ID NO: 980533 - RNA, 19 nt, Mycobacterium avium subsp. paratuberculosis
auccauucgguuuccccuu

SEQ ID NO: 980534 - RNA, 16 nt, Mycobacterium avium subsp. paratuberculosis
auccacuccagcaccg

SEQ ID NO: 980535 - RNA, 15 nt, Mycobacterium avium subsp. paratuberculosis
auccacucggccacc

SEQ ID NO: 980536 - RNA, 16 nt, Mycobacterium avium subsp. paratuberculosis
auccacucggccacca

SEQ ID NO: 980537 - RNA, 17 nt, Mycobacterium avium subsp. paratuberculosis
auccagaugcccagcag

SEQ ID NO: 980538 - RNA, 16 nt, Mycobacterium avium subsp. paratuberculosis
auccagaugcccagca

SEQ ID NO: 980539 - RNA, 15 nt, Mycobacterium avium subsp. paratuberculosis
auccagaacagccag

SEQ ID NO: 980540 - RNA, 17 nt, Mycobacterium avium subsp. paratuberculosis
aucaugucguugaugcc

SEQ ID NO: 980541 - RNA, 13 nt, Mycobacterium avium subsp. paratuberculosis
aucauguagcgcu

SEQ ID NO: 980542 - RNA, 20 nt, Mycobacterium avium subsp. paratuberculosis
aucauccaggugaacagcag

SEQ ID NO: 980543 - RNA, 16 nt, Mycobacterium avium subsp. paratuberculosis
aucaucccggccaccc

SEQ ID NO: 980544 - RNA, 22 nt, Mycobacterium avium subsp. paratuberculosis
aucaucccggccaccccgcaga

SEQ ID NO: 980545 - RNA, 16 nt, Mycobacterium avium subsp. paratuberculosis
aucaucgcccagcgca

SEQ ID NO: 980546 - RNA, 23 nt, Mycobacterium avium subsp. paratuberculosis
aucaucgcccagcgcagcgccuc

SEQ ID NO: 980547 - RNA, 14 nt, Mycobacterium avium subsp. paratuberculosis
aucagugcgggcau

SEQ ID NO: 980548 - RNA, 16 nt, Mycobacterium avium subsp. paratuberculosis
aucaggugcagcgugg

SEQ ID NO: 980549 - RNA, 19 nt, Mycobacterium avium subsp. paratuberculosis
aucagguccuugcgcgccg

SEQ ID NO: 980550 - RNA, 20 nt, Mycobacterium avium subsp. paratuberculosis
aucagggccgcggccgccgc

SEQ ID NO: 980551 - RNA, 14 nt, Mycobacterium avium subsp. paratuberculosis
aucaggcggccggc

SEQ ID NO: 980552 - RNA, 20 nt, Mycobacterium avium subsp. paratuberculosis
aucaggcggccggcccggcc

SEQ ID NO: 980553 - RNA, 19 nt, Mycobacterium avium subsp. paratuberculosis
aucaggcggucgaacgcgg

SEQ ID NO: 980554 - RNA, 16 nt, Mycobacterium avium subsp. paratuberculosis
aucaggaucugcgcaa

SEQ ID NO: 980555 - RNA, 22 nt, Mycobacterium avium subsp. paratuberculosis
aucaggaucugcgcaagaaggg

SEQ ID NO: 980556 - RNA, 14 nt, Mycobacterium avium subsp. paratuberculosis
aucaggccggccac

SEQ ID NO: 980557 - RNA, 16 nt, Mycobacterium avium subsp. paratuberculosis
augcgccagagcgcga

SEQ ID NO: 980558 - RNA, 16 nt, Mycobacterium avium subsp. paratuberculosis
augcgagccagcugcg

SEQ ID NO: 980559 - RNA, 21 nt, Mycobacterium avium subsp. paratuberculosis
augcgaccacgaccgggucug

SEQ ID NO: 980560 - RNA, 22 nt, Mycobacterium avium subsp. paratuberculosis
augcauucguccauccgcuugc

SEQ ID NO: 980561 - RNA, 18 nt, Mycobacterium avium subsp. paratuberculosis
augcgcgacggccucgcc

SEQ ID NO: 980562 - RNA, 17 nt, Mycobacterium avium subsp. paratuberculosis
augcgcgucauggccgu

SEQ ID NO: 980563 - RNA, 14 nt, Mycobacterium avium subsp. paratuberculosis
augcgcucacccaa

SEQ ID NO: 980564 - RNA, 21 nt, Mycobacterium avium subsp. paratuberculosis
augcgcucaucguguccagca

SEQ ID NO: 980565 - RNA, 13 nt, Mycobacterium avium subsp. paratuberculosis
augcgcuccagca

SEQ ID NO: 980566 - RNA, 23 nt, Mycobacterium avium subsp. paratuberculosis
augcgcguuuugaaauccgggcg

SEQ ID NO: 980567 - RNA, 15 nt, Mycobacterium avium subsp. paratuberculosis
augcggccgucggga

SEQ ID NO: 980568 - RNA, 21 nt, Mycobacterium avium subsp. paratuberculosis
augcggcccagcccggccagc

SEQ ID NO: 980569 - RNA, 16 nt, Mycobacterium avium subsp. paratuberculosis
augcggcccggccacu

SEQ ID NO: 980570 - RNA, 19 nt, Mycobacterium avium subsp. paratuberculosis
augcggugccgggccaggu

SEQ ID NO: 980571 - RNA, 13 nt, Mycobacterium avium subsp. paratuberculosis
augcggggccggc

SEQ ID NO: 980572 - RNA, 13 nt, Mycobacterium avium subsp. paratuberculosis
augcgggccagga

SEQ ID NO: 980573 - RNA, 14 nt, Mycobacterium avium subsp. paratuberculosis
augcggcgcccaca

SEQ ID NO: 980574 - RNA, 17 nt, Mycobacterium avium subsp. paratuberculosis
augcggcgcccacagca

SEQ ID NO: 980575 - RNA, 20 nt, Mycobacterium avium subsp. paratuberculosis
augcguugguguagccgaac

SEQ ID NO: 980576 - RNA, 16 nt, Mycobacterium avium subsp. paratuberculosis
augcguugcgccagca

SEQ ID NO: 980577 - RNA, 18 nt, Mycobacterium avium subsp. paratuberculosis
augcgucgcggcggcgcu

SEQ ID NO: 980578 - RNA, 21 nt, Mycobacterium avium subsp. paratuberculosis
augcgucaacccguuccacau

SEQ ID NO: 980579 - RNA, 14 nt, Mycobacterium avium subsp. paratuberculosis
augcucgucgguca

SEQ ID NO: 980580 - RNA, 16 nt, Mycobacterium avium subsp. paratuberculosis
augcuuccgaucaacg

SEQ ID NO: 980581 - RNA, 17 nt, Mycobacterium avium subsp. paratuberculosis
augcugucgcgggucug

SEQ ID NO: 980582 - RNA, 21 nt, Mycobacterium avium subsp. paratuberculosis
augcugagcgggucggccggc

SEQ ID NO: 980583 - RNA, 22 nt, Mycobacterium avium subsp. paratuberculosis
augcugcaacggcuggcgcagg

SEQ ID NO: 980584 - RNA, 16 nt, Mycobacterium avium subsp. paratuberculosis
augcuggggucggcca

SEQ ID NO: 980585 - RNA, 18 nt, Mycobacterium avium subsp. paratuberculosis
augcuggggucggccagc

SEQ ID NO: 980586 - RNA, 13 nt, Mycobacterium avium subsp. paratuberculosis
augcugccgccgg

SEQ ID NO: 980587 - RNA, 17 nt, Mycobacterium avium subsp. paratuberculosis
auggaaugugccugcgg

SEQ ID NO: 980588 - RNA, 13 nt, Mycobacterium avium subsp. paratuberculosis
auggaaggugcug

SEQ ID NO: 980589 - RNA, 24 nt, Mycobacterium avium subsp. paratuberculosis
auggagaaaauccagaacagccag

SEQ ID NO: 980590 - RNA, 18 nt, Mycobacterium avium subsp. paratuberculosis
auggacaugugagguggc

SEQ ID NO: 980591 - RNA, 20 nt, Mycobacterium avium subsp. paratuberculosis
auggaccggguggugggcga

SEQ ID NO: 980592 - RNA, 22 nt, Mycobacterium avium subsp. paratuberculosis
auggacagggcgacaucggcac

SEQ ID NO: 980593 - RNA, 23 nt, Mycobacterium avium subsp. paratuberculosis
augucguagaacucgccguggaa

SEQ ID NO: 980594 - RNA, 22 nt, Mycobacterium avium subsp. paratuberculosis
augucgguaaggcaggcacuga

SEQ ID NO: 980595 - RNA, 20 nt, Mycobacterium avium subsp. paratuberculosis
augucgguggacagcgcgac

SEQ ID NO: 980596 - RNA, 22 nt, Mycobacterium avium subsp. paratuberculosis
augucggugguguggcaggugg

SEQ ID NO: 980597 - RNA, 21 nt, Mycobacterium avium subsp. paratuberculosis
augucggugugcagcagcucg

SEQ ID NO: 980598 - RNA, 19 nt, Mycobacterium avium subsp. paratuberculosis
augucguccucggucaggc

SEQ ID NO: 980599 - RNA, 22 nt, Mycobacterium avium subsp. paratuberculosis
augucguccucggucaggccgu

SEQ ID NO: 980600 - RNA, 23 nt, Mycobacterium avium subsp. paratuberculosis
augucgucgccgguggccgccgg

SEQ ID NO: 980601 - RNA, 17 nt, Mycobacterium avium subsp. paratuberculosis
augucguccucccggcc

SEQ ID NO: 980602 - RNA, 16 nt, Mycobacterium avium subsp. paratuberculosis
augugccacagguaca

SEQ ID NO: 980603 - RNA, 23 nt, Mycobacterium avium subsp. paratuberculosis
augugccacagguacagggucau

SEQ ID NO: 980604 - RNA, 17 nt, Mycobacterium avium subsp. paratuberculosis
augugguugggccaggc

SEQ ID NO: 980605 - RNA, 15 nt, Mycobacterium avium subsp. paratuberculosis
auguagagcgggaug

SEQ ID NO: 980606 - RNA, 13 nt, Mycobacterium avium subsp. paratuberculosis
auguagccgggcu

SEQ ID NO: 980607 - RNA, 18 nt, Mycobacterium avium subsp. paratuberculosis
augucgcgggcgaaagau

SEQ ID NO: 980608 - RNA, 16 nt, Mycobacterium avium subsp. paratuberculosis
augucgcugccgccgc

SEQ ID NO: 980609 - RNA, 21 nt, Mycobacterium avium subsp. paratuberculosis
augucgcccggcggcaccgag

SEQ ID NO: 980610 - RNA, 20 nt, Mycobacterium avium subsp. paratuberculosis
augucgccgaacgccaccac

SEQ ID NO: 980611 - RNA, 23 nt, Mycobacterium avium subsp. paratuberculosis
augggugcgguugagcaccagcc

SEQ ID NO: 980612 - RNA, 17 nt, Mycobacterium avium subsp. paratuberculosis
augggucucggcgaggc

SEQ ID NO: 980613 - RNA, 15 nt, Mycobacterium avium subsp. paratuberculosis
auggucaggguguag

SEQ ID NO: 980614 - RNA, 21 nt, Mycobacterium avium subsp. paratuberculosis
auggucaccggagagcaacac

SEQ ID NO: 980615 - RNA, 14 nt, Mycobacterium avium subsp. paratuberculosis
auggcuguggauga

SEQ ID NO: 980616 - RNA, 16 nt, Mycobacterium avium subsp. paratuberculosis
auggugggcagccggc

SEQ ID NO: 980617 - RNA, 23 nt, Mycobacterium avium subsp. paratuberculosis
auggugggcguggcgggccaggc

SEQ ID NO: 980618 - RNA, 12 nt, Mycobacterium avium subsp. paratuberculosis
auggugcugccc

SEQ ID NO: 980619 - RNA, 20 nt, Mycobacterium avium subsp. paratuberculosis
augguggccgucggccugcg

SEQ ID NO: 980620 - RNA, 15 nt, Mycobacterium avium subsp. paratuberculosis
augguggcgcugccg

SEQ ID NO: 980621 - RNA, 18 nt, Mycobacterium avium subsp. paratuberculosis
augguggcgcugccgagc

SEQ ID NO: 980622 - RNA, 22 nt, Mycobacterium avium subsp. paratuberculosis
augguggcgcugccgagcaccu

SEQ ID NO: 980623 - RNA, 14 nt, Mycobacterium avium subsp. paratuberculosis
auggugaaggcgaa

SEQ ID NO: 980624 - RNA, 20 nt, Mycobacterium avium subsp. paratuberculosis
auggugaaggcgaacaccag

SEQ ID NO: 980625 - RNA, 11 nt, Mycobacterium avium subsp. paratuberculosis
auggugaaguu

SEQ ID NO: 980626 - RNA, 23 nt, Mycobacterium avium subsp. paratuberculosis
auggugcccaccgggcagccgca

SEQ ID NO: 980627 - RNA, 23 nt, Mycobacterium avium subsp. paratuberculosis
auggugccgccggugaacacgaa

SEQ ID NO: 980628 - RNA, 18 nt, Mycobacterium avium subsp. paratuberculosis
auggcaauacgccucgca

SEQ ID NO: 980629 - RNA, 16 nt, Mycobacterium avium subsp. paratuberculosis
auggcaaggccagcaa

SEQ ID NO: 980630 - RNA, 21 nt, Mycobacterium avium subsp. paratuberculosis
auggccgcgccgccgcccugg

SEQ ID NO: 980631 - RNA, 11 nt, Mycobacterium avium subsp. paratuberculosis
auggccgccgc

SEQ ID NO: 980632 - RNA, 23 nt, Mycobacterium avium subsp. paratuberculosis
auggcgccgaucgcgcgcaggaa

SEQ ID NO: 980633 - RNA, 15 nt, Mycobacterium avium subsp. paratuberculosis
auggcgcccagcccg

SEQ ID NO: 980634 - RNA, 22 nt, Mycobacterium avium subsp. paratuberculosis
auggcgaacaggaugcggguga

SEQ ID NO: 980635 - RNA, 12 nt, Mycobacterium avium subsp. paratuberculosis
auggcgacggcg

SEQ ID NO: 980636 - RNA, 17 nt, Mycobacterium avium subsp. paratuberculosis
auggcgaucagaugcuc

SEQ ID NO: 980637 - RNA, 12 nt, Mycobacterium avium subsp. paratuberculosis
auggcgaucauc

SEQ ID NO: 980638 - RNA, 16 nt, Mycobacterium avium subsp. paratuberculosis
auggcgugccacagca

SEQ ID NO: 980639 - RNA, 17 nt, Mycobacterium avium subsp. paratuberculosis
augcaccucgcccugca

SEQ ID NO: 980640 - RNA, 14 nt, Mycobacterium avium subsp. paratuberculosis
augcagaucaccac

SEQ ID NO: 980641 - RNA, 18 nt, Mycobacterium avium subsp. paratuberculosis
augcaccggugcaccgcg

SEQ ID NO: 980642 - RNA, 13 nt, Mycobacterium avium subsp. paratuberculosis
augauccuggccu

SEQ ID NO: 980643 - RNA, 21 nt, Mycobacterium avium subsp. paratuberculosis
augaugcccuuggcggccacg

SEQ ID NO: 980644 - RNA, 15 nt, Mycobacterium avium subsp. paratuberculosis
augaacggcagcucg

SEQ ID NO: 980645 - RNA, 16 nt, Mycobacterium avium subsp. paratuberculosis
augaacgcggccaggg

SEQ ID NO: 980646 - RNA, 20 nt, Mycobacterium avium subsp. paratuberculosis
augaacuccgacuccagcag

SEQ ID NO: 980647 - RNA, 19 nt, Mycobacterium avium subsp. paratuberculosis
augaaccaggccgcgcugg

SEQ ID NO: 980648 - RNA, 19 nt, Mycobacterium avium subsp. paratuberculosis
augaccuccuugcccagcg

SEQ ID NO: 980649 - RNA, 13 nt, Mycobacterium avium subsp. paratuberculosis
augacccagccca

SEQ ID NO: 980650 - RNA, 17 nt, Mycobacterium avium subsp. paratuberculosis
augacgugcaccaccgc

SEQ ID NO: 980651 - RNA, 12 nt, Mycobacterium avium subsp. paratuberculosis
augacuaauccc

SEQ ID NO: 980652 - RNA, 18 nt, Mycobacterium avium subsp. paratuberculosis
augagcgagaugaucagc

SEQ ID NO: 980653 - RNA, 22 nt, Mycobacterium avium subsp. paratuberculosis
augagcgagaugaucagccgcc

SEQ ID NO: 980654 - RNA, 23 nt, Mycobacterium avium subsp. paratuberculosis
augagccgcagccgggugggcgg

SEQ ID NO: 980655 - RNA, 20 nt, Mycobacterium avium subsp. paratuberculosis
augaaauucaggccacgcag

SEQ ID NO: 980656 - RNA, 19 nt, Mycobacterium avium subsp. paratuberculosis
aucuugucggccuugacca

SEQ ID NO: 980657 - RNA, 15 nt, Mycobacterium avium subsp. paratuberculosis
aucuuggccagcagc

SEQ ID NO: 980658 - RNA, 17 nt, Mycobacterium avium subsp. paratuberculosis
aucuugguguccagcgg

SEQ ID NO: 980659 - RNA, 23 nt, Mycobacterium avium subsp. paratuberculosis
aucuucaugugguugggccaggc

SEQ ID NO: 980660 - RNA, 16 nt, Mycobacterium avium subsp. paratuberculosis
aucuucggcgggaugu

SEQ ID NO: 980661 - RNA, 16 nt, Mycobacterium avium subsp. paratuberculosis
aucuuccuucuugaac

SEQ ID NO: 980662 - RNA, 19 nt, Mycobacterium avium subsp. paratuberculosis
aucuucaguucggccggcu

SEQ ID NO: 980663 - RNA, 20 nt, Mycobacterium avium subsp. paratuberculosis
aucuucacgaagugcccggc

SEQ ID NO: 980664 - RNA, 23 nt, Mycobacterium avium subsp. paratuberculosis
aucugguucaccgccaccagcag

SEQ ID NO: 980665 - RNA, 18 nt, Mycobacterium avium subsp. paratuberculosis
aucugguuccacagcugc

SEQ ID NO: 980666 - RNA, 15 nt, Mycobacterium avium subsp. paratuberculosis
auuccgucuuggcca

SEQ ID NO: 980667 - RNA, 18 nt, Mycobacterium avium subsp. paratuberculosis
auuccgucuuggccaggc

SEQ ID NO: 980668 - RNA, 14 nt, Mycobacterium avium subsp. paratuberculosis
auuccgacgugccg

SEQ ID NO: 980669 - RNA, 20 nt, Mycobacterium avium subsp. paratuberculosis
auuccggggaaccgcccuuc

SEQ ID NO: 980670 - RNA, 18 nt, Mycobacterium avium subsp. paratuberculosis
auuccggcaucggcucgu

SEQ ID NO: 980671 - RNA, 19 nt, Mycobacterium avium subsp. paratuberculosis
auuccggccggccgccggc

SEQ ID NO: 980672 - RNA, 14 nt, Mycobacterium avium subsp. paratuberculosis
auuccccguaguca

SEQ ID NO: 980673 - RNA, 21 nt, Mycobacterium avium subsp. paratuberculosis
auucccgaccccgccagcacc

SEQ ID NO: 980674 - RNA, 14 nt, Mycobacterium avium subsp. paratuberculosis
auucccgccgccgc

SEQ ID NO: 980675 - RNA, 16 nt, Mycobacterium avium subsp. paratuberculosis
auucgccggggcacca

SEQ ID NO: 980676 - RNA, 17 nt, Mycobacterium avium subsp. paratuberculosis
auucgccggggcaccau

SEQ ID NO: 980677 - RNA, 15 nt, Mycobacterium avium subsp. paratuberculosis
auucggaacccugcc

SEQ ID NO: 980678 - RNA, 16 nt, Mycobacterium avium subsp. paratuberculosis
auucggacggcccacg

SEQ ID NO: 980679 - RNA, 22 nt, Mycobacterium avium subsp. paratuberculosis
auucggcuucguaacacccucg

SEQ ID NO: 980680 - RNA, 14 nt, Mycobacterium avium subsp. paratuberculosis
auucgggccgccgc

SEQ ID NO: 980681 - RNA, 22 nt, Mycobacterium avium subsp. paratuberculosis
auucgggccugaccaaggacaa

SEQ ID NO: 980682 - RNA, 13 nt, Mycobacterium avium subsp. paratuberculosis
auucggcuccugc

SEQ ID NO: 980683 - RNA, 15 nt, Mycobacterium avium subsp. paratuberculosis
auuccagaucugucu

SEQ ID NO: 980684 - RNA, 16 nt, Mycobacterium avium subsp. paratuberculosis
auugcuuuuugaccac

SEQ ID NO: 980685 - RNA, 20 nt, Mycobacterium avium subsp. paratuberculosis
auugcuuuuugaccaccggc

SEQ ID NO: 980686 - RNA, 19 nt, Mycobacterium avium subsp. paratuberculosis
auugcggcaccagucgcgc

SEQ ID NO: 980687 - RNA, 15 nt, Mycobacterium avium subsp. paratuberculosis
auugcgccagcagca

SEQ ID NO: 980688 - RNA, 15 nt, Mycobacterium avium subsp. paratuberculosis
auucgguuuccccuu

SEQ ID NO: 980689 - RNA, 20 nt, Mycobacterium avium subsp. paratuberculosis
auucgguuuccccuuuggcg

SEQ ID NO: 980690 - RNA, 14 nt, Mycobacterium avium subsp. paratuberculosis
auucucagacgaaa

SEQ ID NO: 980691 - RNA, 17 nt, Mycobacterium avium subsp. paratuberculosis
auucuucuucagccccu

SEQ ID NO: 980692 - RNA, 15 nt, Mycobacterium avium subsp. paratuberculosis
auuuguuguuuuugg

SEQ ID NO: 980693 - RNA, 15 nt, Mycobacterium avium subsp. paratuberculosis
auuucggccagccgg

SEQ ID NO: 980694 - RNA, 22 nt, Mycobacterium avium subsp. paratuberculosis
auuucccgacuccucacaccuc

SEQ ID NO: 980695 - RNA, 14 nt, Mycobacterium avium subsp. paratuberculosis
auuucgagcacacg

SEQ ID NO: 980696 - RNA, 21 nt, Mycobacterium avium subsp. paratuberculosis
auuuaugaugccaguuuuugg

SEQ ID NO: 980697 - RNA, 23 nt, Mycobacterium avium subsp. paratuberculosis
caaagaucacagcgcccuugagc

SEQ ID NO: 980698 - RNA, 19 nt, Mycobacterium avium subsp. paratuberculosis
caacacccagccgcugaac

SEQ ID NO: 980699 - RNA, 18 nt, Mycobacterium avium subsp. paratuberculosis
caacaccgguccggccgu

SEQ ID NO: 980700 - RNA, 17 nt, Mycobacterium avium subsp. paratuberculosis
caacaccgaaagccgac

SEQ ID NO: 980701 - RNA, 14 nt, Mycobacterium avium subsp. paratuberculosis
caacagcagcagaa

SEQ ID NO: 980702 - RNA, 18 nt, Mycobacterium avium subsp. paratuberculosis
caacagcagcagaaccag

SEQ ID NO: 980703 - RNA, 13 nt, Mycobacterium avium subsp. paratuberculosis
caacagcagcggc

SEQ ID NO: 980704 - RNA, 14 nt, Mycobacterium avium subsp. paratuberculosis
caacagcccgaccg

SEQ ID NO: 980705 - RNA, 22 nt, Mycobacterium avium subsp. paratuberculosis
caacaggucggcgugcagcacg

SEQ ID NO: 980706 - RNA, 13 nt, Mycobacterium avium subsp. paratuberculosis
caacagcgcgccg

SEQ ID NO: 980707 - RNA, 17 nt, Mycobacterium avium subsp. paratuberculosis
caacagugcgcaggcgg

SEQ ID NO: 980708 - RNA, 18 nt, Mycobacterium avium subsp. paratuberculosis
caacagugcgcaggcggc

SEQ ID NO: 980709 - RNA, 21 nt, Mycobacterium avium subsp. paratuberculosis
caacagugcgcaggcggcgcg

SEQ ID NO: 980710 - RNA, 16 nt, Mycobacterium avium subsp. paratuberculosis
caaaccggaccgccgc

SEQ ID NO: 980711 - RNA, 12 nt, Mycobacterium avium subsp. paratuberculosis
caaacugacagg

SEQ ID NO: 980712 - RNA, 22 nt, Mycobacterium avium subsp. paratuberculosis
caaacagguuggcgccgaaggc

SEQ ID NO: 980713 - RNA, 15 nt, Mycobacterium avium subsp. paratuberculosis
caaacacgagcagac

SEQ ID NO: 980714 - RNA, 21 nt, Mycobacterium avium subsp. paratuberculosis
caaacccauugucgccgugcg

SEQ ID NO: 980715 - RNA, 15 nt, Mycobacterium avium subsp. paratuberculosis
caagugaugaccugg

SEQ ID NO: 980716 - RNA, 17 nt, Mycobacterium avium subsp. paratuberculosis
caagugaugaccuggau

SEQ ID NO: 980717 - RNA, 18 nt, Mycobacterium avium subsp. paratuberculosis
caagugaugaccuggaua

SEQ ID NO: 980718 - RNA, 18 nt, Mycobacterium avium subsp. paratuberculosis
caaguccucgguggccac

SEQ ID NO: 980719 - RNA, 13 nt, Mycobacterium avium subsp. paratuberculosis
caaggccagcaac

SEQ ID NO: 980720 - RNA, 13 nt, Mycobacterium avium subsp. paratuberculosis
caagggccaccgg

SEQ ID NO: 980721 - RNA, 19 nt, Mycobacterium avium subsp. paratuberculosis
caauaccguuccgccccug

SEQ ID NO: 980722 - RNA, 16 nt, Mycobacterium avium subsp. paratuberculosis
caauacccgaccagca

SEQ ID NO: 980723 - RNA, 17 nt, Mycobacterium avium subsp. paratuberculosis
caauacccgaccagcac

SEQ ID NO: 980724 - RNA, 21 nt, Mycobacterium avium subsp. paratuberculosis
caagagcaggcuucgcagcag

SEQ ID NO: 980725 - RNA, 22 nt, Mycobacterium avium subsp. paratuberculosis
caagacaauucgcugccccggc

SEQ ID NO: 980726 - RNA, 15 nt, Mycobacterium avium subsp. paratuberculosis
caagauaccggccgg

SEQ ID NO: 980727 - RNA, 14 nt, Mycobacterium avium subsp. paratuberculosis
caagauaggagaca

SEQ ID NO: 980728 - RNA, 22 nt, Mycobacterium avium subsp. paratuberculosis
caacucguccagcgucgcggcc

SEQ ID NO: 980729 - RNA, 16 nt, Mycobacterium avium subsp. paratuberculosis
caagaaguuuccccac

SEQ ID NO: 980730 - RNA, 21 nt, Mycobacterium avium subsp. paratuberculosis
caagaaguuuccccaccaggc

SEQ ID NO: 980731 - RNA, 16 nt, Mycobacterium avium subsp. paratuberculosis
caagaacgaaaagaug

SEQ ID NO: 980732 - RNA, 16 nt, Mycobacterium avium subsp. paratuberculosis
caacucccgcgccgcg

SEQ ID NO: 980733 - RNA, 23 nt, Mycobacterium avium subsp. paratuberculosis
caacucgcgcucccggcgccgcc

SEQ ID NO: 980734 - RNA, 15 nt, Mycobacterium avium subsp. paratuberculosis
caacgcgccgaugcc

SEQ ID NO: 980735 - RNA, 23 nt, Mycobacterium avium subsp. paratuberculosis
caacgccuccgaauccagcgcgc

SEQ ID NO: 980736 - RNA, 14 nt, Mycobacterium avium subsp. paratuberculosis
caacgggcucagca

SEQ ID NO: 980737 - RNA, 13 nt, Mycobacterium avium subsp. paratuberculosis
caacgcggcgccg

SEQ ID NO: 980738 - RNA, 15 nt, Mycobacterium avium subsp. paratuberculosis
caacaucgucaacau

SEQ ID NO: 980739 - RNA, 14 nt, Mycobacterium avium subsp. paratuberculosis
caacgaggcccgga

SEQ ID NO: 980740 - RNA, 17 nt, Mycobacterium avium subsp. paratuberculosis
caacgacccggccaccg

SEQ ID NO: 980741 - RNA, 23 nt, Mycobacterium avium subsp. paratuberculosis
caacgacccgucggggugcgcca

SEQ ID NO: 980742 - RNA, 15 nt, Mycobacterium avium subsp. paratuberculosis
cacuagguccggcgc

SEQ ID NO: 980743 - RNA, 20 nt, Mycobacterium avium subsp. paratuberculosis
cacuagguccggcgcgacca

SEQ ID NO: 980744 - RNA, 21 nt, Mycobacterium avium subsp. paratuberculosis
cacuaccgccucgccagcccc

SEQ ID NO: 980745 - RNA, 16 nt, Mycobacterium avium subsp. paratuberculosis
cacuccagcggcggcc

SEQ ID NO: 980746 - RNA, 18 nt, Mycobacterium avium subsp. paratuberculosis
cacuccaauacggcccgg

SEQ ID NO: 980747 - RNA, 16 nt, Mycobacterium avium subsp. paratuberculosis
cacuccaccaccggcc

SEQ ID NO: 980748 - RNA, 20 nt, Mycobacterium avium subsp. paratuberculosis
cacucaggccacaugggcca

SEQ ID NO: 980749 - RNA, 14 nt, Mycobacterium avium subsp. paratuberculosis
cacucuggcgugac

SEQ ID NO: 980750 - RNA, 17 nt, Mycobacterium avium subsp. paratuberculosis
cacucuggcgugacgcu

SEQ ID NO: 980751 - RNA, 21 nt, Mycobacterium avium subsp. paratuberculosis
cacucgaucagcaccgccacg

SEQ ID NO: 980752 - RNA, 20 nt, Mycobacterium avium subsp. paratuberculosis
cacucgaccuucgagccgcc

SEQ ID NO: 980753 - RNA, 15 nt, Mycobacterium avium subsp. paratuberculosis
cacuccucgaucugg

SEQ ID NO: 980754 - RNA, 17 nt, Mycobacterium avium subsp. paratuberculosis
cacuccucgaucugggc

SEQ ID NO: 980755 - RNA, 14 nt, Mycobacterium avium subsp. paratuberculosis
cacucggcgaugcg

SEQ ID NO: 980756 - RNA, 22 nt, Mycobacterium avium subsp. paratuberculosis
cacuacccgcgauggcacacag

SEQ ID NO: 980757 - RNA, 23 nt, Mycobacterium avium subsp. paratuberculosis
cacguguucgggaucggcgccca

SEQ ID NO: 980758 - RNA, 13 nt, Mycobacterium avium subsp. paratuberculosis
cacguguucucac

SEQ ID NO: 980759 - RNA, 20 nt, Mycobacterium avium subsp. paratuberculosis
cacgugcgcggcguccacca

SEQ ID NO: 980760 - RNA, 21 nt, Mycobacterium avium subsp. paratuberculosis
cacgugcgcguuggucaucac

SEQ ID NO: 980761 - RNA, 19 nt, Mycobacterium avium subsp. paratuberculosis
cacgugcggcgcccuuccc

SEQ ID NO: 980762 - RNA, 14 nt, Mycobacterium avium subsp. paratuberculosis
cacgugcuggcgcu

SEQ ID NO: 980763 - RNA, 19 nt, Mycobacterium avium subsp. paratuberculosis
cacgugcuggcgcuugcgu

SEQ ID NO: 980764 - RNA, 17 nt, Mycobacterium avium subsp. paratuberculosis
cacgucuugcugggugg

SEQ ID NO: 980765 - RNA, 15 nt, Mycobacterium avium subsp. paratuberculosis
cacgugauccaggua

SEQ ID NO: 980766 - RNA, 14 nt, Mycobacterium avium subsp. paratuberculosis
cacgugccccuccu

SEQ ID NO: 980767 - RNA, 16 nt, Mycobacterium avium subsp. paratuberculosis
cacgugcccagcccgc

SEQ ID NO: 980768 - RNA, 15 nt, Mycobacterium avium subsp. paratuberculosis
cacguugagcacgcc

SEQ ID NO: 980769 - RNA, 19 nt, Mycobacterium avium subsp. paratuberculosis
cacguugcgcaucagcgcc

SEQ ID NO: 980770 - RNA, 14 nt, Mycobacterium avium subsp. paratuberculosis
cacguugcccagga

SEQ ID NO: 980771 - RNA, 17 nt, Mycobacterium avium subsp. paratuberculosis
cacguuggcggccagcg

SEQ ID NO: 980772 - RNA, 20 nt, Mycobacterium avium subsp. paratuberculosis
cacgguuggccggcccgccc

SEQ ID NO: 980773 - RNA, 14 nt, Mycobacterium avium subsp. paratuberculosis
cacguacuccugcg

SEQ ID NO: 980774 - RNA, 15 nt, Mycobacterium avium subsp. paratuberculosis
cacguacagcggcgg

SEQ ID NO: 980775 - RNA, 21 nt, Mycobacterium avium subsp. paratuberculosis
cacguccaccagcaccaggcg

SEQ ID NO: 980776 - RNA, 16 nt, Mycobacterium avium subsp. paratuberculosis
cacguccacgccgcgg

SEQ ID NO: 980777 - RNA, 13 nt, Mycobacterium avium subsp. paratuberculosis
cacgucccgcccg

SEQ ID NO: 980778 - RNA, 15 nt, Mycobacterium avium subsp. paratuberculosis
cacgucccgcccggc

SEQ ID NO: 980779 - RNA, 16 nt, Mycobacterium avium subsp. paratuberculosis
cacgucccgcccggcg

SEQ ID NO: 980780 - RNA, 21 nt, Mycobacterium avium subsp. paratuberculosis
cacgucccgcccggcgccggc

SEQ ID NO: 980781 - RNA, 20 nt, Mycobacterium avium subsp. paratuberculosis
cacgucacgggccaggcgcg

SEQ ID NO: 980782 - RNA, 17 nt, Mycobacterium avium subsp. paratuberculosis
cacgucggccgccaggg

SEQ ID NO: 980783 - RNA, 12 nt, Mycobacterium avium subsp. paratuberculosis
cacguccucguc

SEQ ID NO: 980784 - RNA, 14 nt, Mycobacterium avium subsp. paratuberculosis
cacgucgcccagcg

SEQ ID NO: 980785 - RNA, 22 nt, Mycobacterium avium subsp. paratuberculosis
cacguccuugggcuccucgacc

SEQ ID NO: 980786 - RNA, 19 nt, Mycobacterium avium subsp. paratuberculosis
cacgucgaacccgaccccg

SEQ ID NO: 980787 - RNA, 15 nt, Mycobacterium avium subsp. paratuberculosis
cacguccuggacguc

SEQ ID NO: 980788 - RNA, 14 nt, Mycobacterium avium subsp. paratuberculosis
cacguccuggcgcc

SEQ ID NO: 980789 - RNA, 15 nt, Mycobacterium avium subsp. paratuberculosis
cacguccuggcgcca

SEQ ID NO: 980790 - RNA, 20 nt, Mycobacterium avium subsp. paratuberculosis
cacgguguugcgcacccgcg

SEQ ID NO: 980791 - RNA, 15 nt, Mycobacterium avium subsp. paratuberculosis
cacgguggccgccac

SEQ ID NO: 980792 - RNA, 19 nt, Mycobacterium avium subsp. paratuberculosis
cacgguggccgccaccaac

SEQ ID NO: 980793 - RNA, 22 nt, Mycobacterium avium subsp. paratuberculosis
cacgguggcgccggcaucgacc

SEQ ID NO: 980794 - RNA, 23 nt, Mycobacterium avium subsp. paratuberculosis
cacggugccgaguucgaccucgg

SEQ ID NO: 980795 - RNA, 18 nt, Mycobacterium avium subsp. paratuberculosis
cacggugcgcucgugacc

SEQ ID NO: 980796 - RNA, 20 nt, Mycobacterium avium subsp. paratuberculosis
cacgguccccgcgcccgccg

SEQ ID NO: 980797 - RNA, 22 nt, Mycobacterium avium subsp. paratuberculosis
cacggucagcgcgucggcgacc

SEQ ID NO: 980798 - RNA, 17 nt, Mycobacterium avium subsp. paratuberculosis
cacggugcagcagcgcc

SEQ ID NO: 980799 - RNA, 18 nt, Mycobacterium avium subsp. paratuberculosis
cacggugcagcagcgccg

SEQ ID NO: 980800 - RNA, 18 nt, Mycobacterium avium subsp. paratuberculosis
cacggucggcguccagcg

SEQ ID NO: 980801 - RNA, 18 nt, Mycobacterium avium subsp. paratuberculosis
cacggugaacgggccgca

SEQ ID NO: 980802 - RNA, 13 nt, Mycobacterium avium subsp. paratuberculosis
cacggucgccgcg

SEQ ID NO: 980803 - RNA, 18 nt, Mycobacterium avium subsp. paratuberculosis
cacggucggagcccagcg

SEQ ID NO: 980804 - RNA, 14 nt, Mycobacterium avium subsp. paratuberculosis
cacgggcacaccgu

SEQ ID NO: 980805 - RNA, 19 nt, Mycobacterium avium subsp. paratuberculosis
cacgggccauguccccgac

SEQ ID NO: 980806 - RNA, 14 nt, Mycobacterium avium subsp. paratuberculosis
cacgggcccguccg

SEQ ID NO: 980807 - RNA, 22 nt, Mycobacterium avium subsp. paratuberculosis
cacggggcgccgcugcgggcca

SEQ ID NO: 980808 - RNA, 22 nt, Mycobacterium avium subsp. paratuberculosis
cacgggcggcagggccagcacc

SEQ ID NO: 980809 - RNA, 19 nt, Mycobacterium avium subsp. paratuberculosis
cacgggcugaccgccagga

SEQ ID NO: 980810 - RNA, 17 nt, Mycobacterium avium subsp. paratuberculosis
cacggucacagccgcga

SEQ ID NO: 980811 - RNA, 23 nt, Mycobacterium avium subsp. paratuberculosis
cacgauguugaugucgcgcggcu

SEQ ID NO: 980812 - RNA, 22 nt, Mycobacterium avium subsp. paratuberculosis
cacgauggcggcccagaucgcg

SEQ ID NO: 980813 - RNA, 14 nt, Mycobacterium avium subsp. paratuberculosis
cacgcacaccaccg

SEQ ID NO: 980814 - RNA, 18 nt, Mycobacterium avium subsp. paratuberculosis
cacgcaccguccuuggga

SEQ ID NO: 980815 - RNA, 21 nt, Mycobacterium avium subsp. paratuberculosis
cacgcagcggugcagccccgc

SEQ ID NO: 980816 - RNA, 20 nt, Mycobacterium avium subsp. paratuberculosis
cacgcagugccgcaccagca

SEQ ID NO: 980817 - RNA, 21 nt, Mycobacterium avium subsp. paratuberculosis
cacgcagugccgcaccagcac

SEQ ID NO: 980818 - RNA, 22 nt, Mycobacterium avium subsp. paratuberculosis
cacgcaggcguggcccagccgg

SEQ ID NO: 980819 - RNA, 22 nt, Mycobacterium avium subsp. paratuberculosis
cacgaucagggugucgaacagc

SEQ ID NO: 980820 - RNA, 15 nt, Mycobacterium avium subsp. paratuberculosis
cacgaucaccaccac

SEQ ID NO: 980821 - RNA, 13 nt, Mycobacterium avium subsp. paratuberculosis
cacgaucaccaga

SEQ ID NO: 980822 - RNA, 23 nt, Mycobacterium avium subsp. paratuberculosis
cacgaucgcgucggaauacagca

SEQ ID NO: 980823 - RNA, 14 nt, Mycobacterium avium subsp. paratuberculosis
cacgaucgcggcca

SEQ ID NO: 980824 - RNA, 23 nt, Mycobacterium avium subsp. paratuberculosis
cacgaucgcggugacgcgccggc

SEQ ID NO: 980825 - RNA, 16 nt, Mycobacterium avium subsp. paratuberculosis
cacgaucccgccgccc

SEQ ID NO: 980826 - RNA, 17 nt, Mycobacterium avium subsp. paratuberculosis
cacgaucccgccgcccg

SEQ ID NO: 980827 - RNA, 17 nt, Mycobacterium avium subsp. paratuberculosis
cacgauccgcgcggcca

SEQ ID NO: 980828 - RNA, 22 nt, Mycobacterium avium subsp. paratuberculosis
cacgauccgcgcggccaccagc

SEQ ID NO: 980829 - RNA, 14 nt, Mycobacterium avium subsp. paratuberculosis
cacgaugggucagg

SEQ ID NO: 980830 - RNA, 20 nt, Mycobacterium avium subsp. paratuberculosis
cacgaugggucaggucaacc

SEQ ID NO: 980831 - RNA, 16 nt, Mycobacterium avium subsp. paratuberculosis
cacgauggcgcggcgc

SEQ ID NO: 980832 - RNA, 17 nt, Mycobacterium avium subsp. paratuberculosis
cacgauggcgcggcgca

SEQ ID NO: 980833 - RNA, 23 nt, Mycobacterium avium subsp. paratuberculosis
cacgauggcgcggcgcaccgccc

SEQ ID NO: 980834 - RNA, 24 nt, Mycobacterium avium subsp. paratuberculosis
cacgaugcccuuggccagcagugc

SEQ ID NO: 980835 - RNA, 17 nt, Mycobacterium avium subsp. paratuberculosis
cacgaucggcagcgcca

SEQ ID NO: 980836 - RNA, 21 nt, Mycobacterium avium subsp. paratuberculosis
cacgaucgucgccgccaacgc

SEQ ID NO: 980837 - RNA, 16 nt, Mycobacterium avium subsp. paratuberculosis
cacgaucugcaggccg

SEQ ID NO: 980838 - RNA, 18 nt, Mycobacterium avium subsp. paratuberculosis
cacgccaacugguccugc

SEQ ID NO: 980839 - RNA, 14 nt, Mycobacterium avium subsp. paratuberculosis
cacgcccagcgccc

SEQ ID NO: 980840 - RNA, 16 nt, Mycobacterium avium subsp. paratuberculosis
cacgcccagggcgcca

SEQ ID NO: 980841 - RNA, 23 nt, Mycobacterium avium subsp. paratuberculosis
cacgccagcgugacgccgggccg

SEQ ID NO: 980842 - RNA, 22 nt, Mycobacterium avium subsp. paratuberculosis
cacgccaucgccucggccacca

SEQ ID NO: 980843 - RNA, 21 nt, Mycobacterium avium subsp. paratuberculosis
cacgccggguugggcggcggc

SEQ ID NO: 980844 - RNA, 17 nt, Mycobacterium avium subsp. paratuberculosis
cacgccggucagcacca

SEQ ID NO: 980845 - RNA, 18 nt, Mycobacterium avium subsp. paratuberculosis
cacgccggucagcaccau

SEQ ID NO: 980846 - RNA, 22 nt, Mycobacterium avium subsp. paratuberculosis
cacgccgucgacccguuccccg

SEQ ID NO: 980847 - RNA, 23 nt, Mycobacterium avium subsp. paratuberculosis
cacgccgucgugcucggcgagca

SEQ ID NO: 980848 - RNA, 19 nt, Mycobacterium avium subsp. paratuberculosis
cacgccguggcccgcccag

SEQ ID NO: 980849 - RNA, 21 nt, Mycobacterium avium subsp. paratuberculosis
cacgccguggcccgcccagcg

SEQ ID NO: 980850 - RNA, 16 nt, Mycobacterium avium subsp. paratuberculosis
cacgccgcccaggccc

SEQ ID NO: 980851 - RNA, 15 nt, Mycobacterium avium subsp. paratuberculosis
cacgccgcccccgcc

SEQ ID NO: 980852 - RNA, 15 nt, Mycobacterium avium subsp. paratuberculosis
cacgccgccgggaac

SEQ ID NO: 980853 - RNA, 15 nt, Mycobacterium avium subsp. paratuberculosis
cacgccggcacaccg

SEQ ID NO: 980854 - RNA, 20 nt, Mycobacterium avium subsp. paratuberculosis
cacgccggccguucgccggc

SEQ ID NO: 980855 - RNA, 20 nt, Mycobacterium avium subsp. paratuberculosis
cacgccgacgauccgcgccc

SEQ ID NO: 980856 - RNA, 18 nt, Mycobacterium avium subsp. paratuberculosis
cacgccgaccacccccag

SEQ ID NO: 980857 - RNA, 15 nt, Mycobacterium avium subsp. paratuberculosis
cacgccgaccagguc

SEQ ID NO: 980858 - RNA, 17 nt, Mycobacterium avium subsp. paratuberculosis
cacgccgagcaccuggc

SEQ ID NO: 980859 - RNA, 17 nt, Mycobacterium avium subsp. paratuberculosis
cacgccgagcagcaccg

SEQ ID NO: 980860 - RNA, 17 nt, Mycobacterium avium subsp. paratuberculosis
cacgcccuagcgggcca

SEQ ID NO: 980861 - RNA, 23 nt, Mycobacterium avium subsp. paratuberculosis
cacgcccuagcgggccaggaugu

SEQ ID NO: 980862 - RNA, 13 nt, Mycobacterium avium subsp. paratuberculosis
cacgcccugcagg

SEQ ID NO: 980863 - RNA, 19 nt, Mycobacterium avium subsp. paratuberculosis
cacgccccauugccgcgcc

SEQ ID NO: 980864 - RNA, 22 nt, Mycobacterium avium subsp. paratuberculosis
cacgccccauugccgcgccggg

SEQ ID NO: 980865 - RNA, 15 nt, Mycobacterium avium subsp. paratuberculosis
cacgcucgcaggcga

SEQ ID NO: 980866 - RNA, 19 nt, Mycobacterium avium subsp. paratuberculosis
cacgcucggcgagcugcgg

SEQ ID NO: 980867 - RNA, 18 nt, Mycobacterium avium subsp. paratuberculosis
cacgcucggcggcgcgca

SEQ ID NO: 980868 - RNA, 17 nt, Mycobacterium avium subsp. paratuberculosis
cacgcugcgcacccggu

SEQ ID NO: 980869 - RNA, 17 nt, Mycobacterium avium subsp. paratuberculosis
cacgcuggccggcagcg

SEQ ID NO: 980870 - RNA, 24 nt, Mycobacterium avium subsp. paratuberculosis
cacgcuguagggccaccacgccag

SEQ ID NO: 980871 - RNA, 17 nt, Mycobacterium avium subsp. paratuberculosis
cacgcuggcgugacgcu

SEQ ID NO: 980872 - RNA, 21 nt, Mycobacterium avium subsp. paratuberculosis
cacgcuggcgugacgcucgcc

SEQ ID NO: 980873 - RNA, 22 nt, Mycobacterium avium subsp. paratuberculosis
cacgcuggcgugacgcucggcc

SEQ ID NO: 980874 - RNA, 23 nt, Mycobacterium avium subsp. paratuberculosis
cacgcuggcgugacgcucggcgc

SEQ ID NO: 980875 - RNA, 23 nt, Mycobacterium avium subsp. paratuberculosis
cacgcuggcgugacgcucggggc

SEQ ID NO: 980876 - RNA, 21 nt, Mycobacterium avium subsp. paratuberculosis
cacgcuggcguggcacccggg

SEQ ID NO: 980877 - RNA, 21 nt, Mycobacterium avium subsp. paratuberculosis
cacgcuggcguggcgccggcg

SEQ ID NO: 980878 - RNA, 16 nt, Mycobacterium avium subsp. paratuberculosis
cacgcugaagcccacc

SEQ ID NO: 980879 - RNA, 20 nt, Mycobacterium avium subsp. paratuberculosis
cacgccguggcggcgggcca

SEQ ID NO: 980880 - RNA, 18 nt, Mycobacterium avium subsp. paratuberculosis
cacgccguugaccccgac

SEQ ID NO: 980881 - RNA, 16 nt, Mycobacterium avium subsp. paratuberculosis
cacgccuuccacgacc

SEQ ID NO: 980882 - RNA, 14 nt, Mycobacterium avium subsp. paratuberculosis
cacgcgcucagcgc

SEQ ID NO: 980883 - RNA, 14 nt, Mycobacterium avium subsp. paratuberculosis
cacgcggccgcgcc

SEQ ID NO: 980884 - RNA, 13 nt, Mycobacterium avium subsp. paratuberculosis
cacgcggacaggg

SEQ ID NO: 980885 - RNA, 14 nt, Mycobacterium avium subsp. paratuberculosis
cacgcggacagggc

SEQ ID NO: 980886 - RNA, 20 nt, Mycobacterium avium subsp. paratuberculosis
cacgcgagacgagccgccgc

SEQ ID NO: 980887 - RNA, 23 nt, Mycobacterium avium subsp. paratuberculosis
cacgcuguuggaaccggccacca

SEQ ID NO: 980888 - RNA, 15 nt, Mycobacterium avium subsp. paratuberculosis
cacggacagcucacc

SEQ ID NO: 980889 - RNA, 18 nt, Mycobacterium avium subsp. paratuberculosis
cacggcaaugguugcggc

SEQ ID NO: 980890 - RNA, 15 nt, Mycobacterium avium subsp. paratuberculosis
cacggaucgcccacc

SEQ ID NO: 980891 - RNA, 23 nt, Mycobacterium avium subsp. paratuberculosis
cacggcauagauaccggccagca

SEQ ID NO: 980892 - RNA, 22 nt, Mycobacterium avium subsp. paratuberculosis
cacggccaacugcaucgccagc

SEQ ID NO: 980893 - RNA, 17 nt, Mycobacterium avium subsp. paratuberculosis
cacggccaccagcagcg

SEQ ID NO: 980894 - RNA, 23 nt, Mycobacterium avium subsp. paratuberculosis
cacggcguugaccaacgccgccu

SEQ ID NO: 980895 - RNA, 14 nt, Mycobacterium avium subsp. paratuberculosis
cacggcugccgacc

SEQ ID NO: 980896 - RNA, 19 nt, Mycobacterium avium subsp. paratuberculosis
cacggcugcacccucugcc

SEQ ID NO: 980897 - RNA, 11 nt, Mycobacterium avium subsp. paratuberculosis
cacggccagga

SEQ ID NO: 980898 - RNA, 15 nt, Mycobacterium avium subsp. paratuberculosis
cacggccccagccgc

SEQ ID NO: 980899 - RNA, 17 nt, Mycobacterium avium subsp. paratuberculosis
cacggccccagccgccg

SEQ ID NO: 980900 - RNA, 21 nt, Mycobacterium avium subsp. paratuberculosis
cacggccagccagccgcccag

SEQ ID NO: 980901 - RNA, 18 nt, Mycobacterium avium subsp. paratuberculosis
cacggccacugccccggc

SEQ ID NO: 980902 - RNA, 21 nt, Mycobacterium avium subsp. paratuberculosis
cacggccagcaccgccagcgc

SEQ ID NO: 980903 - RNA, 22 nt, Mycobacterium avium subsp. paratuberculosis
cacggccggccggccgagccga

SEQ ID NO: 980904 - RNA, 18 nt, Mycobacterium avium subsp. paratuberculosis
cacggccgcggccagcga

SEQ ID NO: 980905 - RNA, 16 nt, Mycobacterium avium subsp. paratuberculosis
cacggcccgcgccccg

SEQ ID NO: 980906 - RNA, 14 nt, Mycobacterium avium subsp. paratuberculosis
cacggcgccgugcc

SEQ ID NO: 980907 - RNA, 20 nt, Mycobacterium avium subsp. paratuberculosis
cacggcgccgugcgccucga

SEQ ID NO: 980908 - RNA, 21 nt, Mycobacterium avium subsp. paratuberculosis
cacggcgcccagguccaccag

SEQ ID NO: 980909 - RNA, 22 nt, Mycobacterium avium subsp. paratuberculosis
cacggccuugccgaucagcugg

SEQ ID NO: 980910 - RNA, 14 nt, Mycobacterium avium subsp. paratuberculosis
cacggccucgccca

SEQ ID NO: 980911 - RNA, 19 nt, Mycobacterium avium subsp. paratuberculosis
cacggcgaacggccgcgau

SEQ ID NO: 980912 - RNA, 16 nt, Mycobacterium avium subsp. paratuberculosis
cacggcgaauauuucg

SEQ ID NO: 980913 - RNA, 14 nt, Mycobacterium avium subsp. paratuberculosis
cacggcgaccagcg

SEQ ID NO: 980914 - RNA, 18 nt, Mycobacterium avium subsp. paratuberculosis
cacggcgacgaccaccag

SEQ ID NO: 980915 - RNA, 24 nt, Mycobacterium avium subsp. paratuberculosis
cacccggucgaugugcgcgcuggc

SEQ ID NO: 980916 - RNA, 15 nt, Mycobacterium avium subsp. paratuberculosis
cacccgguccggccc

SEQ ID NO: 980917 - RNA, 22 nt, Mycobacterium avium subsp. paratuberculosis
cacccggcuggccgcacaccug

SEQ ID NO: 980918 - RNA, 20 nt, Mycobacterium avium subsp. paratuberculosis
cacccgggccugcggcggcc

SEQ ID NO: 980919 - RNA, 20 nt, Mycobacterium avium subsp. paratuberculosis
cacccgggccuuguugcggc

SEQ ID NO: 980920 - RNA, 23 nt, Mycobacterium avium subsp. paratuberculosis
cacccgggccuuguugcggcgca

SEQ ID NO: 980921 - RNA, 19 nt, Mycobacterium avium subsp. paratuberculosis
cacccggcggggacccgac

SEQ ID NO: 980922 - RNA, 15 nt, Mycobacterium avium subsp. paratuberculosis
cacccggcccaccac

SEQ ID NO: 980923 - RNA, 15 nt, Mycobacterium avium subsp. paratuberculosis
cacccggcccacgcc

SEQ ID NO: 980924 - RNA, 18 nt, Mycobacterium avium subsp. paratuberculosis
cacccggcgcggccgccc

SEQ ID NO: 980925 - RNA, 14 nt, Mycobacterium avium subsp. paratuberculosis
cacccggcggcacc

SEQ ID NO: 980926 - RNA, 21 nt, Mycobacterium avium subsp. paratuberculosis
cacccggacgaugacccagcc

SEQ ID NO: 980927 - RNA, 22 nt, Mycobacterium avium subsp. paratuberculosis
cacccggacgaugacccagccc

SEQ ID NO: 980928 - RNA, 20 nt, Mycobacterium avium subsp. paratuberculosis
cacccggauggucugcagcg

SEQ ID NO: 980929 - RNA, 23 nt, Mycobacterium avium subsp. paratuberculosis
cacccgcaucaacugcaccagcg

SEQ ID NO: 980930 - RNA, 15 nt, Mycobacterium avium subsp. paratuberculosis
cacccgccccgccgc

SEQ ID NO: 980931 - RNA, 18 nt, Mycobacterium avium subsp. paratuberculosis
cacccgccccgccgcggc

SEQ ID NO: 980932 - RNA, 13 nt, Mycobacterium avium subsp. paratuberculosis
cacccgccagccc

SEQ ID NO: 980933 - RNA, 16 nt, Mycobacterium avium subsp. paratuberculosis
cacccgcgccggcaga

SEQ ID NO: 980934 - RNA, 14 nt, Mycobacterium avium subsp. paratuberculosis
cacccgcggccgcu

SEQ ID NO: 980935 - RNA, 17 nt, Mycobacterium avium subsp. paratuberculosis
cacccgcggccgcugcg

SEQ ID NO: 980936 - RNA, 21 nt, Mycobacterium avium subsp. paratuberculosis
cacccgcggccggcccagcgc

SEQ ID NO: 980937 - RNA, 23 nt, Mycobacterium avium subsp. paratuberculosis
cacccgcggccggcccagcgcgc

SEQ ID NO: 980938 - RNA, 12 nt, Mycobacterium avium subsp. paratuberculosis
cacccgcggaac

SEQ ID NO: 980939 - RNA, 13 nt, Mycobacterium avium subsp. paratuberculosis
cacccgcggcgcg

SEQ ID NO: 980940 - RNA, 17 nt, Mycobacterium avium subsp. paratuberculosis
cacccgcucgcgggccc

SEQ ID NO: 980941 - RNA, 23 nt, Mycobacterium avium subsp. paratuberculosis
cacccgcucgcgggcccgcgccg

SEQ ID NO: 980942 - RNA, 22 nt, Mycobacterium avium subsp. paratuberculosis
cacccgcugauccagcagcgcc

SEQ ID NO: 980943 - RNA, 13 nt, Mycobacterium avium subsp. paratuberculosis
cacccgcugcacc

SEQ ID NO: 980944 - RNA, 14 nt, Mycobacterium avium subsp. paratuberculosis
cacccgcugcacca

SEQ ID NO: 980945 - RNA, 21 nt, Mycobacterium avium subsp. paratuberculosis
cacccgcugcaccagcccguc

SEQ ID NO: 980946 - RNA, 16 nt, Mycobacterium avium subsp. paratuberculosis
cacccgcugcucgacc

SEQ ID NO: 980947 - RNA, 14 nt, Mycobacterium avium subsp. paratuberculosis
cacccucggcgucc

SEQ ID NO: 980948 - RNA, 15 nt, Mycobacterium avium subsp. paratuberculosis
cacccugcgccacaa

SEQ ID NO: 980949 - RNA, 14 nt, Mycobacterium avium subsp. paratuberculosis
cacccucaccccgc

SEQ ID NO: 980950 - RNA, 17 nt, Mycobacterium avium subsp. paratuberculosis
cacccgguccggcccgg

SEQ ID NO: 980951 - RNA, 22 nt, Mycobacterium avium subsp. paratuberculosis
cacccgugggccgaccggccgg

SEQ ID NO: 980952 - RNA, 19 nt, Mycobacterium avium subsp. paratuberculosis
caccgaauuguccagcagu

SEQ ID NO: 980953 - RNA, 16 nt, Mycobacterium avium subsp. paratuberculosis
caccgacaccaccggc

SEQ ID NO: 980954 - RNA, 21 nt, Mycobacterium avium subsp. paratuberculosis
caccgaaaagcccgccgccuc

SEQ ID NO: 980955 - RNA, 21 nt, Mycobacterium avium subsp. paratuberculosis
caccgaaaccuugaucggccc

SEQ ID NO: 980956 - RNA, 13 nt, Mycobacterium avium subsp. paratuberculosis
cacccuggcgaac

SEQ ID NO: 980957 - RNA, 18 nt, Mycobacterium avium subsp. paratuberculosis
cacccuggcgaaccgcgg

SEQ ID NO: 980958 - RNA, 17 nt, Mycobacterium avium subsp. paratuberculosis
cacccuuuuccaucugg

SEQ ID NO: 980959 - RNA, 15 nt, Mycobacterium avium subsp. paratuberculosis
cacccuugcgccgcu

SEQ ID NO: 980960 - RNA, 18 nt, Mycobacterium avium subsp. paratuberculosis
caccgaugcgggccagga

SEQ ID NO: 980961 - RNA, 20 nt, Mycobacterium avium subsp. paratuberculosis
caccgcaucgaaccgccgcg

SEQ ID NO: 980962 - RNA, 22 nt, Mycobacterium avium subsp. paratuberculosis
caccgcauagcgggagccggcc

SEQ ID NO: 980963 - RNA, 17 nt, Mycobacterium avium subsp. paratuberculosis
caccgccaccgcccgcu

SEQ ID NO: 980964 - RNA, 17 nt, Mycobacterium avium subsp. paratuberculosis
caccgccaccgcgcaac

SEQ ID NO: 980965 - RNA, 23 nt, Mycobacterium avium subsp. paratuberculosis
caccgccaccgcgcaaccgggcc

SEQ ID NO: 980966 - RNA, 19 nt, Mycobacterium avium subsp. paratuberculosis
caccgccagcagcgccgcu

SEQ ID NO: 980967 - RNA, 13 nt, Mycobacterium avium subsp. paratuberculosis
caccgccagcagc

SEQ ID NO: 980968 - RNA, 14 nt, Mycobacterium avium subsp. paratuberculosis
caccgccagcgccg

SEQ ID NO: 980969 - RNA, 18 nt, Mycobacterium avium subsp. paratuberculosis
caccgccagcgcgccgau

SEQ ID NO: 980970 - RNA, 14 nt, Mycobacterium avium subsp. paratuberculosis
caccgccagcaccg

SEQ ID NO: 980971 - RNA, 16 nt, Mycobacterium avium subsp. paratuberculosis
caccgagugcggcgcg

SEQ ID NO: 980972 - RNA, 23 nt, Mycobacterium avium subsp. paratuberculosis
caccgaggugacgucgcgccgcu

SEQ ID NO: 980973 - RNA, 17 nt, Mycobacterium avium subsp. paratuberculosis
caccgagcugggccggc

SEQ ID NO: 980974 - RNA, 21 nt, Mycobacterium avium subsp. paratuberculosis
caccgagcugggccggcgccg

SEQ ID NO: 980975 - RNA, 14 nt, Mycobacterium avium subsp. paratuberculosis
caccgagccgggca

SEQ ID NO: 980976 - RNA, 17 nt, Mycobacterium avium subsp. paratuberculosis
caccgagcucauggugu

SEQ ID NO: 980977 - RNA, 14 nt, Mycobacterium avium subsp. paratuberculosis
caccgacuccuugg

SEQ ID NO: 980978 - RNA, 16 nt, Mycobacterium avium subsp. paratuberculosis
caccgacugcggcgcu

SEQ ID NO: 980979 - RNA, 22 nt, Mycobacterium avium subsp. paratuberculosis
caccgacgcggcgaccaccacc

SEQ ID NO: 980980 - RNA, 20 nt, Mycobacterium avium subsp. paratuberculosis
caccgacgcgucgcggcggg

SEQ ID NO: 980981 - RNA, 19 nt, Mycobacterium avium subsp. paratuberculosis
caccgacggagccgagcac

SEQ ID NO: 980982 - RNA, 14 nt, Mycobacterium avium subsp. paratuberculosis
caccgacggccgca

SEQ ID NO: 980983 - RNA, 16 nt, Mycobacterium avium subsp. paratuberculosis
caccgacggccgcacc

SEQ ID NO: 980984 - RNA, 14 nt, Mycobacterium avium subsp. paratuberculosis
caccgaccccugca

SEQ ID NO: 980985 - RNA, 15 nt, Mycobacterium avium subsp. paratuberculosis
caccgaccccugcac

SEQ ID NO: 980986 - RNA, 17 nt, Mycobacterium avium subsp. paratuberculosis
caccgacaucgaaugca

SEQ ID NO: 980987 - RNA, 14 nt, Mycobacterium avium subsp. paratuberculosis
caccggaccgccga

SEQ ID NO: 980988 - RNA, 22 nt, Mycobacterium avium subsp. paratuberculosis
caccgcuuugugaggcgcgccg

SEQ ID NO: 980989 - RNA, 15 nt, Mycobacterium avium subsp. paratuberculosis
caccgcgucggcgcu

SEQ ID NO: 980990 - RNA, 21 nt, Mycobacterium avium subsp. paratuberculosis
caccgcgugcgagccgagcac

SEQ ID NO: 980991 - RNA, 17 nt, Mycobacterium avium subsp. paratuberculosis
caccgcguuggccgcca

SEQ ID NO: 980992 - RNA, 18 nt, Mycobacterium avium subsp. paratuberculosis
caccgcguuggccgccac

SEQ ID NO: 980993 - RNA, 20 nt, Mycobacterium avium subsp. paratuberculosis
caccgcggugaccgcccgcu

SEQ ID NO: 980994 - RNA, 22 nt, Mycobacterium avium subsp. paratuberculosis
caccgcguuguccggggugggc

SEQ ID NO: 980995 - RNA, 21 nt, Mycobacterium avium subsp. paratuberculosis
caccggcagccgcagcgacag

SEQ ID NO: 980996 - RNA, 22 nt, Mycobacterium avium subsp. paratuberculosis
caccggcauucguguggcgcac

SEQ ID NO: 980997 - RNA, 19 nt, Mycobacterium avium subsp. paratuberculosis
caccggccagggccgccgc

SEQ ID NO: 980998 - RNA, 21 nt, Mycobacterium avium subsp. paratuberculosis
caccggcacgucggccacgcc

SEQ ID NO: 980999 - RNA, 16 nt, Mycobacterium avium subsp. paratuberculosis
caccggcaccgccagc

SEQ ID NO: 981000 - RNA, 20 nt, Mycobacterium avium subsp. paratuberculosis
caccggauuucgccagugcc

SEQ ID NO: 981001 - RNA, 16 nt, Mycobacterium avium subsp. paratuberculosis
caccggcaaucgggac

SEQ ID NO: 981002 - RNA, 22 nt, Mycobacterium avium subsp. paratuberculosis
caccggcaaucgggacgccacg

SEQ ID NO: 981003 - RNA, 15 nt, Mycobacterium avium subsp. paratuberculosis
caccggaugcucacc

SEQ ID NO: 981004 - RNA, 16 nt, Mycobacterium avium subsp. paratuberculosis
caccggaccggccagc

SEQ ID NO: 981005 - RNA, 20 nt, Mycobacterium avium subsp. paratuberculosis
caccggaccggccagcagcc

SEQ ID NO: 981006 - RNA, 23 nt, Mycobacterium avium subsp. paratuberculosis
caccggaccggccagcagccgcu

SEQ ID NO: 981007 - RNA, 20 nt, Mycobacterium avium subsp. paratuberculosis
caccggacugcuugggcgcc

SEQ ID NO: 981008 - RNA, 13 nt, Mycobacterium avium subsp. paratuberculosis
caccggcggcggc

SEQ ID NO: 981009 - RNA, 19 nt, Mycobacterium avium subsp. paratuberculosis
caccggcguggugggcaga

SEQ ID NO: 981010 - RNA, 23 nt, Mycobacterium avium subsp. paratuberculosis
caccggcguggugggcagaugcc

SEQ ID NO: 981011 - RNA, 20 nt, Mycobacterium avium subsp. paratuberculosis
caccggcggauccucagucc

SEQ ID NO: 981012 - RNA, 13 nt, Mycobacterium avium subsp. paratuberculosis
caccggcgcgccg

SEQ ID NO: 981013 - RNA, 18 nt, Mycobacterium avium subsp. paratuberculosis
caccggcgcguuggcccg

SEQ ID NO: 981014 - RNA, 14 nt, Mycobacterium avium subsp. paratuberculosis
caccggcgccgcca

SEQ ID NO: 981015 - RNA, 15 nt, Mycobacterium avium subsp. paratuberculosis
caccggcgccgccac

SEQ ID NO: 981016 - RNA, 17 nt, Mycobacterium avium subsp. paratuberculosis
caccggcccggcgggca

SEQ ID NO: 981017 - RNA, 15 nt, Mycobacterium avium subsp. paratuberculosis
caccggccggccccg

SEQ ID NO: 981018 - RNA, 20 nt, Mycobacterium avium subsp. paratuberculosis
caccggccggccccggggga

SEQ ID NO: 981019 - RNA, 14 nt, Mycobacterium avium subsp. paratuberculosis
caccggccgggacg

SEQ ID NO: 981020 - RNA, 21 nt, Mycobacterium avium subsp. paratuberculosis
caccggccgguccgcccagac

SEQ ID NO: 981021 - RNA, 23 nt, Mycobacterium avium subsp. paratuberculosis
caccggccgguccgcccagacgc

SEQ ID NO: 981022 - RNA, 17 nt, Mycobacterium avium subsp. paratuberculosis
caccggcgaguccgcgg

SEQ ID NO: 981023 - RNA, 13 nt, Mycobacterium avium subsp. paratuberculosis
caccggcgccccg

SEQ ID NO: 981024 - RNA, 16 nt, Mycobacterium avium subsp. paratuberculosis
caccggcuggugcagc

SEQ ID NO: 981025 - RNA, 20 nt, Mycobacterium avium subsp. paratuberculosis
caccggcuggugcagcagcu

SEQ ID NO: 981026 - RNA, 20 nt, Mycobacterium avium subsp. paratuberculosis
caccggcuggccgagcggcu

SEQ ID NO: 981027 - RNA, 23 nt, Mycobacterium avium subsp. paratuberculosis
caccggcuggccgagcggcugcu

SEQ ID NO: 981028 - RNA, 14 nt, Mycobacterium avium subsp. paratuberculosis
caccggcugcccca

SEQ ID NO: 981029 - RNA, 18 nt, Mycobacterium avium subsp. paratuberculosis
caccggcugcccgacccg

SEQ ID NO: 981030 - RNA, 14 nt, Mycobacterium avium subsp. paratuberculosis
caccgggccgccau

SEQ ID NO: 981031 - RNA, 22 nt, Mycobacterium avium subsp. paratuberculosis
caccgggccgaaggcggcgccg

SEQ ID NO: 981032 - RNA, 19 nt, Mycobacterium avium subsp. paratuberculosis
caccgggcagccgcacacc

SEQ ID NO: 981033 - RNA, 24 nt, Mycobacterium avium subsp. paratuberculosis
caccgggcagccgcacaccgcggc

SEQ ID NO: 981034 - RNA, 16 nt, Mycobacterium avium subsp. paratuberculosis
caccgggaccgucggg

SEQ ID NO: 981035 - RNA, 17 nt, Mycobacterium avium subsp. paratuberculosis
caccgggaccugcugcu

SEQ ID NO: 981036 - RNA, 17 nt, Mycobacterium avium subsp. paratuberculosis
caccgggauccggcgcg

SEQ ID NO: 981037 - RNA, 22 nt, Mycobacterium avium subsp. paratuberculosis
caccgggauccggcgcgccgcg

SEQ ID NO: 981038 - RNA, 19 nt, Mycobacterium avium subsp. paratuberculosis
caccgggaucggcggcggg

SEQ ID NO: 981039 - RNA, 15 nt, Mycobacterium avium subsp. paratuberculosis
caccgggaacagcca

SEQ ID NO: 981040 - RNA, 15 nt, Mycobacterium avium subsp. paratuberculosis
caccgcccgcgcgau

SEQ ID NO: 981041 - RNA, 22 nt, Mycobacterium avium subsp. paratuberculosis
caccgcccggaugccggcgccc

SEQ ID NO: 981042 - RNA, 23 nt, Mycobacterium avium subsp. paratuberculosis
caccgccaucggcaucgcgcgcg

SEQ ID NO: 981043 - RNA, 14 nt, Mycobacterium avium subsp. paratuberculosis
caccgccaggacca

SEQ ID NO: 981044 - RNA, 13 nt, Mycobacterium avium subsp. paratuberculosis
caccgccccgacg

SEQ ID NO: 981045 - RNA, 13 nt, Mycobacterium avium subsp. paratuberculosis
caccgccccgccc

SEQ ID NO: 981046 - RNA, 14 nt, Mycobacterium avium subsp. paratuberculosis
caccgccccgcccu

SEQ ID NO: 981047 - RNA, 14 nt, Mycobacterium avium subsp. paratuberculosis
caccgccccgccgc

SEQ ID NO: 981048 - RNA, 14 nt, Mycobacterium avium subsp. paratuberculosis
caccgccgcggccg

SEQ ID NO: 981049 - RNA, 15 nt, Mycobacterium avium subsp. paratuberculosis
caccgccgcggccgc

SEQ ID NO: 981050 - RNA, 22 nt, Mycobacterium avium subsp. paratuberculosis
caccgccgggcauccgggccgc

SEQ ID NO: 981051 - RNA, 13 nt, Mycobacterium avium subsp. paratuberculosis
caccgccggccca

SEQ ID NO: 981052 - RNA, 16 nt, Mycobacterium avium subsp. paratuberculosis
caccgccggcgccguc

SEQ ID NO: 981053 - RNA, 13 nt, Mycobacterium avium subsp. paratuberculosis
caccgccgucacc

SEQ ID NO: 981054 - RNA, 16 nt, Mycobacterium avium subsp. paratuberculosis
caccgccgucaccgcc

SEQ ID NO: 981055 - RNA, 13 nt, Mycobacterium avium subsp. paratuberculosis
caccgccgucccg

SEQ ID NO: 981056 - RNA, 15 nt, Mycobacterium avium subsp. paratuberculosis
caccgccgucccguc

SEQ ID NO: 981057 - RNA, 16 nt, Mycobacterium avium subsp. paratuberculosis
caccgccgucccgucc

SEQ ID NO: 981058 - RNA, 16 nt, Mycobacterium avium subsp. paratuberculosis
caccgccggggugugc

SEQ ID NO: 981059 - RNA, 22 nt, Mycobacterium avium subsp. paratuberculosis
caccgccguuccgaugaagaac

SEQ ID NO: 981060 - RNA, 20 nt, Mycobacterium avium subsp. paratuberculosis
caccgcgcuuuggaccaggg

SEQ ID NO: 981061 - RNA, 14 nt, Mycobacterium avium subsp. paratuberculosis
caccgcggccaccu

SEQ ID NO: 981062 - RNA, 17 nt, Mycobacterium avium subsp. paratuberculosis
caccgcggccaccuggg

SEQ ID NO: 981063 - RNA, 17 nt, Mycobacterium avium subsp. paratuberculosis
caccgcggauuccagcg

SEQ ID NO: 981064 - RNA, 22 nt, Mycobacterium avium subsp. paratuberculosis
caccgcguagcgccgcccgucc

SEQ ID NO: 981065 - RNA, 13 nt, Mycobacterium avium subsp. paratuberculosis
caccgcguccugc

SEQ ID NO: 981066 - RNA, 23 nt, Mycobacterium avium subsp. paratuberculosis
caccgcgucgaugcgggcccgca

SEQ ID NO: 981067 - RNA, 23 nt, Mycobacterium avium subsp. paratuberculosis
caccgcgucgcagugccggugca

SEQ ID NO: 981068 - RNA, 19 nt, Mycobacterium avium subsp. paratuberculosis
caccgcgguguugagcgcg

SEQ ID NO: 981069 - RNA, 19 nt, Mycobacterium avium subsp. paratuberculosis
caccgcgggccaggcccac

SEQ ID NO: 981070 - RNA, 23 nt, Mycobacterium avium subsp. paratuberculosis
caccgcgggccaggcccaccguc

SEQ ID NO: 981071 - RNA, 20 nt, Mycobacterium avium subsp. paratuberculosis
caccgcggggcugggcgcca

SEQ ID NO: 981072 - RNA, 22 nt, Mycobacterium avium subsp. paratuberculosis
caccgcgggaauggccgcgccg

SEQ ID NO: 981073 - RNA, 23 nt, Mycobacterium avium subsp. paratuberculosis
caccgcggcggugucggcgcccc

SEQ ID NO: 981074 - RNA, 17 nt, Mycobacterium avium subsp. paratuberculosis
caccgcggcgugcgcca

SEQ ID NO: 981075 - RNA, 14 nt, Mycobacterium avium subsp. paratuberculosis
caccgcggcgcgca

SEQ ID NO: 981076 - RNA, 14 nt, Mycobacterium avium subsp. paratuberculosis
caccgccuugcccg

SEQ ID NO: 981077 - RNA, 22 nt, Mycobacterium avium subsp. paratuberculosis
caccgccuucgacggccggccc

SEQ ID NO: 981078 - RNA, 23 nt, Mycobacterium avium subsp. paratuberculosis
caccgccuucgacggccggcccu

SEQ ID NO: 981079 - RNA, 15 nt, Mycobacterium avium subsp. paratuberculosis
caccgcgacccaggc

SEQ ID NO: 981080 - RNA, 16 nt, Mycobacterium avium subsp. paratuberculosis
caccgcgacccaggcc

SEQ ID NO: 981081 - RNA, 17 nt, Mycobacterium avium subsp. paratuberculosis
caccgcgacccggccga

SEQ ID NO: 981082 - RNA, 18 nt, Mycobacterium avium subsp. paratuberculosis
caccgcgaacaucgccag

SEQ ID NO: 981083 - RNA, 20 nt, Mycobacterium avium subsp. paratuberculosis
caccgcgaacaucgccagca

SEQ ID NO: 981084 - RNA, 15 nt, Mycobacterium avium subsp. paratuberculosis
caccgcgaccacgcc

SEQ ID NO: 981085 - RNA, 17 nt, Mycobacterium avium subsp. paratuberculosis
caccgcgaccacgccgc

SEQ ID NO: 981086 - RNA, 19 nt, Mycobacterium avium subsp. paratuberculosis
caccgcgaccacgccgcgg

SEQ ID NO: 981087 - RNA, 14 nt, Mycobacterium avium subsp. paratuberculosis
caccgcgccgucuu

SEQ ID NO: 981088 - RNA, 20 nt, Mycobacterium avium subsp. paratuberculosis
caccgcgccgucuuccgggc

SEQ ID NO: 981089 - RNA, 13 nt, Mycobacterium avium subsp. paratuberculosis
caccgcgccguga

SEQ ID NO: 981090 - RNA, 14 nt, Mycobacterium avium subsp. paratuberculosis
caccgcgcccagcc

SEQ ID NO: 981091 - RNA, 15 nt, Mycobacterium avium subsp. paratuberculosis
caccgcgcccgcccc

SEQ ID NO: 981092 - RNA, 21 nt, Mycobacterium avium subsp. paratuberculosis
caccgcgauggcccgcgcgau

SEQ ID NO: 981093 - RNA, 22 nt, Mycobacterium avium subsp. paratuberculosis
caccgcgcaaccgggccgcacc

SEQ ID NO: 981094 - RNA, 19 nt, Mycobacterium avium subsp. paratuberculosis
caccgcgacgcccaggugc

SEQ ID NO: 981095 - RNA, 23 nt, Mycobacterium avium subsp. paratuberculosis
caccgcgacgcugccggggcgca

SEQ ID NO: 981096 - RNA, 14 nt, Mycobacterium avium subsp. paratuberculosis
caccgcgagcaccg

SEQ ID NO: 981097 - RNA, 17 nt, Mycobacterium avium subsp. paratuberculosis
caccgcgagcagacgca

SEQ ID NO: 981098 - RNA, 20 nt, Mycobacterium avium subsp. paratuberculosis
caccgcgaucaccgagaugg

SEQ ID NO: 981099 - RNA, 16 nt, Mycobacterium avium subsp. paratuberculosis
caccuucaccgcgccg

SEQ ID NO: 981100 - RNA, 14 nt, Mycobacterium avium subsp. paratuberculosis
caccuuguugcggg

SEQ ID NO: 981101 - RNA, 19 nt, Mycobacterium avium subsp. paratuberculosis
caccuuggcggccaccauc

SEQ ID NO: 981102 - RNA, 18 nt, Mycobacterium avium subsp. paratuberculosis
caccuugguggccgcggc

SEQ ID NO: 981103 - RNA, 20 nt, Mycobacterium avium subsp. paratuberculosis
caccuugguggccgcggccg

SEQ ID NO: 981104 - RNA, 20 nt, Mycobacterium avium subsp. paratuberculosis
caccuugucggcgcccagga

SEQ ID NO: 981105 - RNA, 16 nt, Mycobacterium avium subsp. paratuberculosis
caccuuucggccgcgg

SEQ ID NO: 981106 - RNA, 22 nt, Mycobacterium avium subsp. paratuberculosis
caccuugaccaugaguugcggg

SEQ ID NO: 981107 - RNA, 22 nt, Mycobacterium avium subsp. paratuberculosis
caccuugcgcccguagcggcgg

SEQ ID NO: 981108 - RNA, 22 nt, Mycobacterium avium subsp. paratuberculosis
caccuuggacaggcccagcggc

SEQ ID NO: 981109 - RNA, 16 nt, Mycobacterium avium subsp. paratuberculosis
caccuggcgcagcacc

SEQ ID NO: 981110 - RNA, 17 nt, Mycobacterium avium subsp. paratuberculosis
caccuggcgcagcaccg

SEQ ID NO: 981111 - RNA, 15 nt, Mycobacterium avium subsp. paratuberculosis
caccuggcagcaucc

SEQ ID NO: 981112 - RNA, 21 nt, Mycobacterium avium subsp. paratuberculosis
caccugcgugccuugcaccca

SEQ ID NO: 981113 - RNA, 20 nt, Mycobacterium avium subsp. paratuberculosis
caccugcucaccgagcuggg

SEQ ID NO: 981114 - RNA, 22 nt, Mycobacterium avium subsp. paratuberculosis
caccugcggcaggucggccagc

SEQ ID NO: 981115 - RNA, 15 nt, Mycobacterium avium subsp. paratuberculosis
caccugcggcccguc

SEQ ID NO: 981116 - RNA, 15 nt, Mycobacterium avium subsp. paratuberculosis
caccugcggcggcag

SEQ ID NO: 981117 - RNA, 14 nt, Mycobacterium avium subsp. paratuberculosis
caccugcgcgccgu

SEQ ID NO: 981118 - RNA, 17 nt, Mycobacterium avium subsp. paratuberculosis
caccuguacgugucccu

SEQ ID NO: 981119 - RNA, 18 nt, Mycobacterium avium subsp. paratuberculosis
caccuguacgugucccug

SEQ ID NO: 981120 - RNA, 16 nt, Mycobacterium avium subsp. paratuberculosis
caccugguccugcccc

SEQ ID NO: 981121 - RNA, 22 nt, Mycobacterium avium subsp. paratuberculosis
caccuggucggguucgcccucc

SEQ ID NO: 981122 - RNA, 17 nt, Mycobacterium avium subsp. paratuberculosis
caccuggucggucagcu

SEQ ID NO: 981123 - RNA, 18 nt, Mycobacterium avium subsp. paratuberculosis
caccuggugcucgcgcuc

SEQ ID NO: 981124 - RNA, 20 nt, Mycobacterium avium subsp. paratuberculosis
caccugguugaacggcaccc

SEQ ID NO: 981125 - RNA, 21 nt, Mycobacterium avium subsp. paratuberculosis
cacgaaauaaccgcgcggcgc

SEQ ID NO: 981126 - RNA, 22 nt, Mycobacterium avium subsp. paratuberculosis
cacgaaauaaccgcgcggcgcc

SEQ ID NO: 981127 - RNA, 23 nt, Mycobacterium avium subsp. paratuberculosis
cacgaaacugaccuucucccgcg

SEQ ID NO: 981128 - RNA, 22 nt, Mycobacterium avium subsp. paratuberculosis
cacgaacuccuugacccggccc

SEQ ID NO: 981129 - RNA, 14 nt, Mycobacterium avium subsp. paratuberculosis
cacgaacggcgccu

SEQ ID NO: 981130 - RNA, 17 nt, Mycobacterium avium subsp. paratuberculosis
cacgaacaccggcgcga

SEQ ID NO: 981131 - RNA, 16 nt, Mycobacterium avium subsp. paratuberculosis
cacgaauacccuucgg

SEQ ID NO: 981132 - RNA, 18 nt, Mycobacterium avium subsp. paratuberculosis
cacgaagucgaccgcggc

SEQ ID NO: 981133 - RNA, 22 nt, Mycobacterium avium subsp. paratuberculosis
cacgaagaugaucagcgcgccc

SEQ ID NO: 981134 - RNA, 14 nt, Mycobacterium avium subsp. paratuberculosis
cacgaagggcgcca

SEQ ID NO: 981135 - RNA, 20 nt, Mycobacterium avium subsp. paratuberculosis
cacgaagccgaacgacagca

SEQ ID NO: 981136 - RNA, 21 nt, Mycobacterium avium subsp. paratuberculosis
cacgaagccgaacgacagcag

SEQ ID NO: 981137 - RNA, 13 nt, Mycobacterium avium subsp. paratuberculosis
cacgaccacaccc

SEQ ID NO: 981138 - RNA, 14 nt, Mycobacterium avium subsp. paratuberculosis
cacgaccacacccg

SEQ ID NO: 981139 - RNA, 21 nt, Mycobacterium avium subsp. paratuberculosis
cacgagcgaacacgugcagcu

SEQ ID NO: 981140 - RNA, 18 nt, Mycobacterium avium subsp. paratuberculosis
cacgagcacccagaaaca

SEQ ID NO: 981141 - RNA, 23 nt, Mycobacterium avium subsp. paratuberculosis
cacgagcacccagaaacaccauc

SEQ ID NO: 981142 - RNA, 15 nt, Mycobacterium avium subsp. paratuberculosis
cacgacguacccccg

SEQ ID NO: 981143 - RNA, 22 nt, Mycobacterium avium subsp. paratuberculosis
cacgaguaaccggugcgcucca

SEQ ID NO: 981144 - RNA, 17 nt, Mycobacterium avium subsp. paratuberculosis
cacgaggccgggcuggc

SEQ ID NO: 981145 - RNA, 14 nt, Mycobacterium avium subsp. paratuberculosis
cacgacgaacacca

SEQ ID NO: 981146 - RNA, 15 nt, Mycobacterium avium subsp. paratuberculosis
cacgacgaacaccac

SEQ ID NO: 981147 - RNA, 20 nt, Mycobacterium avium subsp. paratuberculosis
cacgacgaacaccaccggca

SEQ ID NO: 981148 - RNA, 14 nt, Mycobacterium avium subsp. paratuberculosis
cacgacgcggcgcg

SEQ ID NO: 981149 - RNA, 17 nt, Mycobacterium avium subsp. paratuberculosis
cacgaccgccagcagca

SEQ ID NO: 981150 - RNA, 18 nt, Mycobacterium avium subsp. paratuberculosis
cacgaccagugcccggcc

SEQ ID NO: 981151 - RNA, 22 nt, Mycobacterium avium subsp. paratuberculosis
cacgaccaugucggcgacccgc

SEQ ID NO: 981152 - RNA, 20 nt, Mycobacterium avium subsp. paratuberculosis
cacgaccuggcgggccagcu

SEQ ID NO: 981153 - RNA, 20 nt, Mycobacterium avium subsp. paratuberculosis
caccucgucgcccggcgucc

SEQ ID NO: 981154 - RNA, 22 nt, Mycobacterium avium subsp. paratuberculosis
caccucgucggcggucaacacg

SEQ ID NO: 981155 - RNA, 14 nt, Mycobacterium avium subsp. paratuberculosis
caccucgucccagc

SEQ ID NO: 981156 - RNA, 16 nt, Mycobacterium avium subsp. paratuberculosis
caccucgucccagcgc

SEQ ID NO: 981157 - RNA, 13 nt, Mycobacterium avium subsp. paratuberculosis
caccugaccgcgg

SEQ ID NO: 981158 - RNA, 13 nt, Mycobacterium avium subsp. paratuberculosis
caccugacgcauc

SEQ ID NO: 981159 - RNA, 24 nt, Mycobacterium avium subsp. paratuberculosis
caccugacgcucggucgccacggc

SEQ ID NO: 981160 - RNA, 15 nt, Mycobacterium avium subsp. paratuberculosis
caccugcagccgguc

SEQ ID NO: 981161 - RNA, 13 nt, Mycobacterium avium subsp. paratuberculosis
caccugcaccugg

SEQ ID NO: 981162 - RNA, 14 nt, Mycobacterium avium subsp. paratuberculosis
caccugcaccuggg

SEQ ID NO: 981163 - RNA, 14 nt, Mycobacterium avium subsp. paratuberculosis
caccucggccagcg

SEQ ID NO: 981164 - RNA, 22 nt, Mycobacterium avium subsp. paratuberculosis
caccucggccagcgccgcgcgc

SEQ ID NO: 981165 - RNA, 13 nt, Mycobacterium avium subsp. paratuberculosis
caccucggcgacc

SEQ ID NO: 981166 - RNA, 14 nt, Mycobacterium avium subsp. paratuberculosis
caccucgcccugca

SEQ ID NO: 981167 - RNA, 15 nt, Mycobacterium avium subsp. paratuberculosis
caccucgccgcaggc

SEQ ID NO: 981168 - RNA, 14 nt, Mycobacterium avium subsp. paratuberculosis
caccucgccggccg

SEQ ID NO: 981169 - RNA, 19 nt, Mycobacterium avium subsp. paratuberculosis
caccucgcgggcgaccugg

SEQ ID NO: 981170 - RNA, 20 nt, Mycobacterium avium subsp. paratuberculosis
caccucgcuacgcgagcugc

SEQ ID NO: 981171 - RNA, 17 nt, Mycobacterium avium subsp. paratuberculosis
caccucgcucagcccgg

SEQ ID NO: 981172 - RNA, 16 nt, Mycobacterium avium subsp. paratuberculosis
caccucgcuggaaacc

SEQ ID NO: 981173 - RNA, 20 nt, Mycobacterium avium subsp. paratuberculosis
caccucggcggcaccgcccg

SEQ ID NO: 981174 - RNA, 23 nt, Mycobacterium avium subsp. paratuberculosis
caccucggcgucggcgcgugcca

SEQ ID NO: 981175 - RNA, 18 nt, Mycobacterium avium subsp. paratuberculosis
caccucggcgaucugcuc

SEQ ID NO: 981176 - RNA, 11 nt, Mycobacterium avium subsp. paratuberculosis
caccuccucgc

SEQ ID NO: 981177 - RNA, 13 nt, Mycobacterium avium subsp. paratuberculosis
caccuccugcacc

SEQ ID NO: 981178 - RNA, 14 nt, Mycobacterium avium subsp. paratuberculosis
caccuccugcaccc

SEQ ID NO: 981179 - RNA, 15 nt, Mycobacterium avium subsp. paratuberculosis
caccuccugcacccg

SEQ ID NO: 981180 - RNA, 16 nt, Mycobacterium avium subsp. paratuberculosis
caccuccugcacccgu

SEQ ID NO: 981181 - RNA, 13 nt, Mycobacterium avium subsp. paratuberculosis
caccuccuccggu

SEQ ID NO: 981182 - RNA, 23 nt, Mycobacterium avium subsp. paratuberculosis
caccuccuuggccaggcgggcca

SEQ ID NO: 981183 - RNA, 21 nt, Mycobacterium avium subsp. paratuberculosis
caccuccuuggguucggcggc

SEQ ID NO: 981184 - RNA, 15 nt, Mycobacterium avium subsp. paratuberculosis
caccucgagcacgcc

SEQ ID NO: 981185 - RNA, 13 nt, Mycobacterium avium subsp. paratuberculosis
caccucgagcuca

SEQ ID NO: 981186 - RNA, 16 nt, Mycobacterium avium subsp. paratuberculosis
caccucgaucagcggc

SEQ ID NO: 981187 - RNA, 15 nt, Mycobacterium avium subsp. paratuberculosis
caccuccgacagccc

SEQ ID NO: 981188 - RNA, 18 nt, Mycobacterium avium subsp. paratuberculosis
caccuccgacagcccccg

SEQ ID NO: 981189 - RNA, 14 nt, Mycobacterium avium subsp. paratuberculosis
caccuccagcccgg

SEQ ID NO: 981190 - RNA, 19 nt, Mycobacterium avium subsp. paratuberculosis
caccuccagauagaggaac

SEQ ID NO: 981191 - RNA, 17 nt, Mycobacterium avium subsp. paratuberculosis
caccucaucgcccagcc

SEQ ID NO: 981192 - RNA, 19 nt, Mycobacterium avium subsp. paratuberculosis
caccgugcgggucgcgcug

SEQ ID NO: 981193 - RNA, 21 nt, Mycobacterium avium subsp. paratuberculosis
caccgucuucggggccgccgu

SEQ ID NO: 981194 - RNA, 21 nt, Mycobacterium avium subsp. paratuberculosis
caccguugucucggcgccguc

SEQ ID NO: 981195 - RNA, 14 nt, Mycobacterium avium subsp. paratuberculosis
caccgguugcgccg

SEQ ID NO: 981196 - RNA, 23 nt, Mycobacterium avium subsp. paratuberculosis
caccgguggugagacccuggaug

SEQ ID NO: 981197 - RNA, 16 nt, Mycobacterium avium subsp. paratuberculosis
caccggugcaccgcgc

SEQ ID NO: 981198 - RNA, 19 nt, Mycobacterium avium subsp. paratuberculosis
caccggugcaccgcgcgca

SEQ ID NO: 981199 - RNA, 15 nt, Mycobacterium avium subsp. paratuberculosis
caccgguccggccgu

SEQ ID NO: 981200 - RNA, 16 nt, Mycobacterium avium subsp. paratuberculosis
caccggugcucuccug

SEQ ID NO: 981201 - RNA, 20 nt, Mycobacterium avium subsp. paratuberculosis
caccggugcucuccugcuug

SEQ ID NO: 981202 - RNA, 22 nt, Mycobacterium avium subsp. paratuberculosis
caccggugcucuccugcuugac

SEQ ID NO: 981203 - RNA, 23 nt, Mycobacterium avium subsp. paratuberculosis
caccggugcucuccugcuugacc

SEQ ID NO: 981204 - RNA, 20 nt, Mycobacterium avium subsp. paratuberculosis
caccggggccggcgggggcg

SEQ ID NO: 981205 - RNA, 14 nt, Mycobacterium avium subsp. paratuberculosis
caccguccacagcc

SEQ ID NO: 981206 - RNA, 18 nt, Mycobacterium avium subsp. paratuberculosis
caccgucgauggacaggg

SEQ ID NO: 981207 - RNA, 22 nt, Mycobacterium avium subsp. paratuberculosis
caccgucugcgccgucaccggc

SEQ ID NO: 981208 - RNA, 13 nt, Mycobacterium avium subsp. paratuberculosis
caccgucaccgcc

SEQ ID NO: 981209 - RNA, 15 nt, Mycobacterium avium subsp. paratuberculosis
caccgucaccgccuc

SEQ ID NO: 981210 - RNA, 14 nt, Mycobacterium avium subsp. paratuberculosis
caccaggccgaaga

SEQ ID NO: 981211 - RNA, 14 nt, Mycobacterium avium subsp. paratuberculosis
caccaggcccaggc

SEQ ID NO: 981212 - RNA, 17 nt, Mycobacterium avium subsp. paratuberculosis
caccaggcgggucaccu

SEQ ID NO: 981213 - RNA, 14 nt, Mycobacterium avium subsp. paratuberculosis
caccaggcgcacca

SEQ ID NO: 981214 - RNA, 12 nt, Mycobacterium avium subsp. paratuberculosis
caccaggcgcca

SEQ ID NO: 981215 - RNA, 20 nt, Mycobacterium avium subsp. paratuberculosis
caccaggcgccacagcagca

SEQ ID NO: 981216 - RNA, 23 nt, Mycobacterium avium subsp. paratuberculosis
caccaggcgccacagcagcacca

SEQ ID NO: 981217 - RNA, 15 nt, Mycobacterium avium subsp. paratuberculosis
caccaggaaggcgac

SEQ ID NO: 981218 - RNA, 14 nt, Mycobacterium avium subsp. paratuberculosis
caccaggcgccguc

SEQ ID NO: 981219 - RNA, 16 nt, Mycobacterium avium subsp. paratuberculosis
caccagggcggugaac

SEQ ID NO: 981220 - RNA, 20 nt, Mycobacterium avium subsp. paratuberculosis
caccagggcguguugcaggc

SEQ ID NO: 981221 - RNA, 17 nt, Mycobacterium avium subsp. paratuberculosis
caccagggccugcagca

SEQ ID NO: 981222 - RNA, 19 nt, Mycobacterium avium subsp. paratuberculosis
caccagggccugcagcacc

SEQ ID NO: 981223 - RNA, 17 nt, Mycobacterium avium subsp. paratuberculosis
caccaggguggccgcca

SEQ ID NO: 981224 - RNA, 14 nt, Mycobacterium avium subsp. paratuberculosis
caccagggugcgca

SEQ ID NO: 981225 - RNA, 23 nt, Mycobacterium avium subsp. paratuberculosis
caccagggugcgcagcgcgucgu

SEQ ID NO: 981226 - RNA, 18 nt, Mycobacterium avium subsp. paratuberculosis
caccagggucucgcgcag

SEQ ID NO: 981227 - RNA, 21 nt, Mycobacterium avium subsp. paratuberculosis
caccagggucuucagcccgcg

SEQ ID NO: 981228 - RNA, 16 nt, Mycobacterium avium subsp. paratuberculosis
caccagggugccccgc

SEQ ID NO: 981229 - RNA, 20 nt, Mycobacterium avium subsp. paratuberculosis
caccagggugccccgcgacc

SEQ ID NO: 981230 - RNA, 17 nt, Mycobacterium avium subsp. paratuberculosis
caccagggugccgccgg

SEQ ID NO: 981231 - RNA, 18 nt, Mycobacterium avium subsp. paratuberculosis
caccaggucgcacaccag

SEQ ID NO: 981232 - RNA, 19 nt, Mycobacterium avium subsp. paratuberculosis
caccagguagauggugauc

SEQ ID NO: 981233 - RNA, 13 nt, Mycobacterium avium subsp. paratuberculosis
caccaucaccugu

SEQ ID NO: 981234 - RNA, 18 nt, Mycobacterium avium subsp. paratuberculosis
caccaguuucacgucggc

SEQ ID NO: 981235 - RNA, 16 nt, Mycobacterium avium subsp. paratuberculosis
caccaguugcaccggc

SEQ ID NO: 981236 - RNA, 20 nt, Mycobacterium avium subsp. paratuberculosis
caccagguugucgccgcgcc

SEQ ID NO: 981237 - RNA, 21 nt, Mycobacterium avium subsp. paratuberculosis
caccagguugucgccgcgcca

SEQ ID NO: 981238 - RNA, 14 nt, Mycobacterium avium subsp. paratuberculosis
caccagguugcgga

SEQ ID NO: 981239 - RNA, 18 nt, Mycobacterium avium subsp. paratuberculosis
caccaguguccgggcgcc

SEQ ID NO: 981240 - RNA, 15 nt, Mycobacterium avium subsp. paratuberculosis
caccagucgcacaac

SEQ ID NO: 981241 - RNA, 21 nt, Mycobacterium avium subsp. paratuberculosis
caccagucggccaucagcacc

SEQ ID NO: 981242 - RNA, 21 nt, Mycobacterium avium subsp. paratuberculosis
caccagccacaccgccgcggc

SEQ ID NO: 981243 - RNA, 13 nt, Mycobacterium avium subsp. paratuberculosis
caccagcauggcg

SEQ ID NO: 981244 - RNA, 16 nt, Mycobacterium avium subsp. paratuberculosis
caccagccggccggcg

SEQ ID NO: 981245 - RNA, 19 nt, Mycobacterium avium subsp. paratuberculosis
caccagcccggccagcggc

SEQ ID NO: 981246 - RNA, 16 nt, Mycobacterium avium subsp. paratuberculosis
caccagccgagaucga

SEQ ID NO: 981247 - RNA, 23 nt, Mycobacterium avium subsp. paratuberculosis
caccagcccgaugccgccgaggg

SEQ ID NO: 981248 - RNA, 10 nt, Mycobacterium avium subsp. paratuberculosis
caccagcagc

SEQ ID NO: 981249 - RNA, 14 nt, Mycobacterium avium subsp. paratuberculosis
caccagcagacccg

SEQ ID NO: 981250 - RNA, 24 nt, Mycobacterium avium subsp. paratuberculosis
caccagcacggcgaccagcgagcc

SEQ ID NO: 981251 - RNA, 18 nt, Mycobacterium avium subsp. paratuberculosis
caccagcacggcggcgcu

SEQ ID NO: 981252 - RNA, 13 nt, Mycobacterium avium subsp. paratuberculosis
caccagcaggccc

SEQ ID NO: 981253 - RNA, 17 nt, Mycobacterium avium subsp. paratuberculosis
caccagcaggccccguu

SEQ ID NO: 981254 - RNA, 22 nt, Mycobacterium avium subsp. paratuberculosis
caccagcagccgcagcgcgcga

SEQ ID NO: 981255 - RNA, 13 nt, Mycobacterium avium subsp. paratuberculosis
caccagcaccacc

SEQ ID NO: 981256 - RNA, 16 nt, Mycobacterium avium subsp. paratuberculosis
caccagcacccagcac

SEQ ID NO: 981257 - RNA, 14 nt, Mycobacterium avium subsp. paratuberculosis
caccagcaccccgc

SEQ ID NO: 981258 - RNA, 21 nt, Mycobacterium avium subsp. paratuberculosis
caccagcgccucggccucguc

SEQ ID NO: 981259 - RNA, 15 nt, Mycobacterium avium subsp. paratuberculosis
caccagcgcccgccc

SEQ ID NO: 981260 - RNA, 12 nt, Mycobacterium avium subsp. paratuberculosis
caccagcgcgca

SEQ ID NO: 981261 - RNA, 23 nt, Mycobacterium avium subsp. paratuberculosis
caccagcgcgcacgcggacacga

SEQ ID NO: 981262 - RNA, 22 nt, Mycobacterium avium subsp. paratuberculosis
caccagcgccugggcguacagc

SEQ ID NO: 981263 - RNA, 15 nt, Mycobacterium avium subsp. paratuberculosis
caccagcgcgcgggu

SEQ ID NO: 981264 - RNA, 17 nt, Mycobacterium avium subsp. paratuberculosis
caccagcgcggacacca

SEQ ID NO: 981265 - RNA, 20 nt, Mycobacterium avium subsp. paratuberculosis
caccagcgcggacaccaggu

SEQ ID NO: 981266 - RNA, 19 nt, Mycobacterium avium subsp. paratuberculosis
caccagcgcggccaccacc

SEQ ID NO: 981267 - RNA, 19 nt, Mycobacterium avium subsp. paratuberculosis
caccagcgcacacagcagc

SEQ ID NO: 981268 - RNA, 13 nt, Mycobacterium avium subsp. paratuberculosis
caccagcugcgga

SEQ ID NO: 981269 - RNA, 20 nt, Mycobacterium avium subsp. paratuberculosis
caccagcuggauggcgccca

SEQ ID NO: 981270 - RNA, 16 nt, Mycobacterium avium subsp. paratuberculosis
caccagcguuccagca

SEQ ID NO: 981271 - RNA, 19 nt, Mycobacterium avium subsp. paratuberculosis
caccagcguuccagcaccc

SEQ ID NO: 981272 - RNA, 22 nt, Mycobacterium avium subsp. paratuberculosis
caccagcguuccagcacccggc

SEQ ID NO: 981273 - RNA, 22 nt, Mycobacterium avium subsp. paratuberculosis
caccagcgugcugccggacacc

SEQ ID NO: 981274 - RNA, 19 nt, Mycobacterium avium subsp. paratuberculosis
caccagcgcuuucgcgcac

SEQ ID NO: 981275 - RNA, 17 nt, Mycobacterium avium subsp. paratuberculosis
caccagcggcugcagca

SEQ ID NO: 981276 - RNA, 17 nt, Mycobacterium avium subsp. paratuberculosis
caccagcggcaccaggu

SEQ ID NO: 981277 - RNA, 15 nt, Mycobacterium avium subsp. paratuberculosis
caccagcggcgccca

SEQ ID NO: 981278 - RNA, 20 nt, Mycobacterium avium subsp. paratuberculosis
caccagcggcaucgccgcca

SEQ ID NO: 981279 - RNA, 14 nt, Mycobacterium avium subsp. paratuberculosis
cacccauccccagg

SEQ ID NO: 981280 - RNA, 13 nt, Mycobacterium avium subsp. paratuberculosis
cacccagccgcug

SEQ ID NO: 981281 - RNA, 16 nt, Mycobacterium avium subsp. paratuberculosis
cacccagaugcccagc

SEQ ID NO: 981282 - RNA, 19 nt, Mycobacterium avium subsp. paratuberculosis
cacccagaugcccagcggc

SEQ ID NO: 981283 - RNA, 20 nt, Mycobacterium avium subsp. paratuberculosis
cacccaggucuuccggaugc

SEQ ID NO: 981284 - RNA, 15 nt, Mycobacterium avium subsp. paratuberculosis
cacccaggugcugcc

SEQ ID NO: 981285 - RNA, 14 nt, Mycobacterium avium subsp. paratuberculosis
cacccaggccaccc

SEQ ID NO: 981286 - RNA, 16 nt, Mycobacterium avium subsp. paratuberculosis
cacccaggccacccgg

SEQ ID NO: 981287 - RNA, 12 nt, Mycobacterium avium subsp. paratuberculosis
caccccacaccg

SEQ ID NO: 981288 - RNA, 16 nt, Mycobacterium avium subsp. paratuberculosis
cacccauucacgcagc

SEQ ID NO: 981289 - RNA, 19 nt, Mycobacterium avium subsp. paratuberculosis
cacccauucacgcagcugg

SEQ ID NO: 981290 - RNA, 16 nt, Mycobacterium avium subsp. paratuberculosis
caccccaccgacagcc

SEQ ID NO: 981291 - RNA, 20 nt, Mycobacterium avium subsp. paratuberculosis
caccccaccgagcagcugca

SEQ ID NO: 981292 - RNA, 14 nt, Mycobacterium avium subsp. paratuberculosis
cacccccagcccgc

SEQ ID NO: 981293 - RNA, 23 nt, Mycobacterium avium subsp. paratuberculosis
cacccgaauugccuugcuccaca

SEQ ID NO: 981294 - RNA, 18 nt, Mycobacterium avium subsp. paratuberculosis
cacccgacacgccgaucg

SEQ ID NO: 981295 - RNA, 16 nt, Mycobacterium avium subsp. paratuberculosis
cacccgaccgacgccc

SEQ ID NO: 981296 - RNA, 14 nt, Mycobacterium avium subsp. paratuberculosis
cacccgacgaagcc

SEQ ID NO: 981297 - RNA, 21 nt, Mycobacterium avium subsp. paratuberculosis
cacccgacgaagccgccgccc

SEQ ID NO: 981298 - RNA, 15 nt, Mycobacterium avium subsp. paratuberculosis
cacccgaugcucccg

SEQ ID NO: 981299 - RNA, 14 nt, Mycobacterium avium subsp. paratuberculosis
cacccgauccacgg

SEQ ID NO: 981300 - RNA, 17 nt, Mycobacterium avium subsp. paratuberculosis
cacccgaugaccggccc

SEQ ID NO: 981301 - RNA, 14 nt, Mycobacterium avium subsp. paratuberculosis
caccccugccgcca

SEQ ID NO: 981302 - RNA, 15 nt, Mycobacterium avium subsp. paratuberculosis
caccccugccgccac

SEQ ID NO: 981303 - RNA, 15 nt, Mycobacterium avium subsp. paratuberculosis
caccccuggcgggua

SEQ ID NO: 981304 - RNA, 19 nt, Mycobacterium avium subsp. paratuberculosis
caccccgugguagacgccg

SEQ ID NO: 981305 - RNA, 18 nt, Mycobacterium avium subsp. paratuberculosis
cacccgcagggcgccggu

SEQ ID NO: 981306 - RNA, 18 nt, Mycobacterium avium subsp. paratuberculosis
cacccgcagcuccagcga

SEQ ID NO: 981307 - RNA, 19 nt, Mycobacterium avium subsp. paratuberculosis
cacccgcaccucgcccggc

SEQ ID NO: 981308 - RNA, 23 nt, Mycobacterium avium subsp. paratuberculosis
cacccgcaccucgcccggcucga

SEQ ID NO: 981309 - RNA, 23 nt, Mycobacterium avium subsp. paratuberculosis
caccccggugccgcagugccggc

SEQ ID NO: 981310 - RNA, 22 nt, Mycobacterium avium subsp. paratuberculosis
caccccguccaggaugagcugg

SEQ ID NO: 981311 - RNA, 23 nt, Mycobacterium avium subsp. paratuberculosis
caccccguccaggaugagcuggg

SEQ ID NO: 981312 - RNA, 21 nt, Mycobacterium avium subsp. paratuberculosis
caccccgucgagcagccgcaa

SEQ ID NO: 981313 - RNA, 20 nt, Mycobacterium avium subsp. paratuberculosis
caccccguugccgccggcgc

SEQ ID NO: 981314 - RNA, 22 nt, Mycobacterium avium subsp. paratuberculosis
caccccguugccgccggcgccc

SEQ ID NO: 981315 - RNA, 15 nt, Mycobacterium avium subsp. paratuberculosis
caccccggcggccgc

SEQ ID NO: 981316 - RNA, 23 nt, Mycobacterium avium subsp. paratuberculosis
caccccgcgagucaccggcucgc

SEQ ID NO: 981317 - RNA, 20 nt, Mycobacterium avium subsp. paratuberculosis
caccccgcgccacgccgccc

SEQ ID NO: 981318 - RNA, 22 nt, Mycobacterium avium subsp. paratuberculosis
caccccggcauagagcuggugg

SEQ ID NO: 981319 - RNA, 14 nt, Mycobacterium avium subsp. paratuberculosis
caccccggccacca

SEQ ID NO: 981320 - RNA, 21 nt, Mycobacterium avium subsp. paratuberculosis
caccccgaugcggugccgggc

SEQ ID NO: 981321 - RNA, 23 nt, Mycobacterium avium subsp. paratuberculosis
caccccgaugcggugccgggcca

SEQ ID NO: 981322 - RNA, 20 nt, Mycobacterium avium subsp. paratuberculosis
caccccgaucaacaccgcca

SEQ ID NO: 981323 - RNA, 22 nt, Mycobacterium avium subsp. paratuberculosis
caccccgaucaacaccgccagc

SEQ ID NO: 981324 - RNA, 23 nt, Mycobacterium avium subsp. paratuberculosis
caccccgaucggggccaggaugc

SEQ ID NO: 981325 - RNA, 13 nt, Mycobacterium avium subsp. paratuberculosis
cacccccgauccg

SEQ ID NO: 981326 - RNA, 16 nt, Mycobacterium avium subsp. paratuberculosis
cacccccucggcgccg

SEQ ID NO: 981327 - RNA, 16 nt, Mycobacterium avium subsp. paratuberculosis
caccccgaacccggcc

SEQ ID NO: 981328 - RNA, 17 nt, Mycobacterium avium subsp. paratuberculosis
caccccgaaccgcccgc

SEQ ID NO: 981329 - RNA, 19 nt, Mycobacterium avium subsp. paratuberculosis
caccccgaaccgcccgccc

SEQ ID NO: 981330 - RNA, 21 nt, Mycobacterium avium subsp. paratuberculosis
cacccagaaacgacaucacga

SEQ ID NO: 981331 - RNA, 22 nt, Mycobacterium avium subsp. paratuberculosis
cacccagacguguggcacccgg

SEQ ID NO: 981332 - RNA, 12 nt, Mycobacterium avium subsp. paratuberculosis
cacccaccggcc

SEQ ID NO: 981333 - RNA, 14 nt, Mycobacterium avium subsp. paratuberculosis
caccaucccgccgc

SEQ ID NO: 981334 - RNA, 16 nt, Mycobacterium avium subsp. paratuberculosis
caccaucccgccgccg

SEQ ID NO: 981335 - RNA, 23 nt, Mycobacterium avium subsp. paratuberculosis
caccauccgcgacgccagcaccu

SEQ ID NO: 981336 - RNA, 16 nt, Mycobacterium avium subsp. paratuberculosis
caccaucaggccggcc

SEQ ID NO: 981337 - RNA, 17 nt, Mycobacterium avium subsp. paratuberculosis
caccaucaggccggccu

SEQ ID NO: 981338 - RNA, 13 nt, Mycobacterium avium subsp. paratuberculosis
caccaucagcacc

SEQ ID NO: 981339 - RNA, 21 nt, Mycobacterium avium subsp. paratuberculosis
caccaucgaguaggcccaguc

SEQ ID NO: 981340 - RNA, 21 nt, Mycobacterium avium subsp. paratuberculosis
caccauccgcgcgagcgcgcu

SEQ ID NO: 981341 - RNA, 14 nt, Mycobacterium avium subsp. paratuberculosis
caccaugccggcgu

SEQ ID NO: 981342 - RNA, 16 nt, Mycobacterium avium subsp. paratuberculosis
caccaugagcagaccg

SEQ ID NO: 981343 - RNA, 21 nt, Mycobacterium avium subsp. paratuberculosis
caccaugaucaggccccaccc

SEQ ID NO: 981344 - RNA, 18 nt, Mycobacterium avium subsp. paratuberculosis
caccaauucgcgcugcca

SEQ ID NO: 981345 - RNA, 17 nt, Mycobacterium avium subsp. paratuberculosis
caccacaguggccgcca

SEQ ID NO: 981346 - RNA, 14 nt, Mycobacterium avium subsp. paratuberculosis
caccacacccagcg

SEQ ID NO: 981347 - RNA, 17 nt, Mycobacterium avium subsp. paratuberculosis
caccacacccagcgcca

SEQ ID NO: 981348 - RNA, 13 nt, Mycobacterium avium subsp. paratuberculosis
caccacacccgcg

SEQ ID NO: 981349 - RNA, 17 nt, Mycobacterium avium subsp. paratuberculosis
caccacacccgcggccg

SEQ ID NO: 981350 - RNA, 22 nt, Mycobacterium avium subsp. paratuberculosis
caccaccacggccgccgaggcg

SEQ ID NO: 981351 - RNA, 16 nt, Mycobacterium avium subsp. paratuberculosis
caccaccacgaacugg

SEQ ID NO: 981352 - RNA, 15 nt, Mycobacterium avium subsp. paratuberculosis
caccaccacgcuggc

SEQ ID NO: 981353 - RNA, 21 nt, Mycobacterium avium subsp. paratuberculosis
caccaccacggagcgcccggc

SEQ ID NO: 981354 - RNA, 13 nt, Mycobacterium avium subsp. paratuberculosis
caccaccacggcc

SEQ ID NO: 981355 - RNA, 14 nt, Mycobacterium avium subsp. paratuberculosis
caccaccacggcca

SEQ ID NO: 981356 - RNA, 13 nt, Mycobacterium avium subsp. paratuberculosis
caccaccaggccg

SEQ ID NO: 981357 - RNA, 16 nt, Mycobacterium avium subsp. paratuberculosis
caccaccagcgggcug

SEQ ID NO: 981358 - RNA, 20 nt, Mycobacterium avium subsp. paratuberculosis
caccaccagcgggcugugcc

SEQ ID NO: 981359 - RNA, 20 nt, Mycobacterium avium subsp. paratuberculosis
caccaccagcguguggcccu

SEQ ID NO: 981360 - RNA, 20 nt, Mycobacterium avium subsp. paratuberculosis
caccacauucccgccgccgc

SEQ ID NO: 981361 - RNA, 21 nt, Mycobacterium avium subsp. paratuberculosis
caccacaucgguugcuccggc

SEQ ID NO: 981362 - RNA, 22 nt, Mycobacterium avium subsp. paratuberculosis
caccacaucgguugcuccggcg

SEQ ID NO: 981363 - RNA, 14 nt, Mycobacterium avium subsp. paratuberculosis
caccaccaccgccg

SEQ ID NO: 981364 - RNA, 16 nt, Mycobacterium avium subsp. paratuberculosis
caccaccaccaguucc

SEQ ID NO: 981365 - RNA, 13 nt, Mycobacterium avium subsp. paratuberculosis
caccaccacccgg

SEQ ID NO: 981366 - RNA, 15 nt, Mycobacterium avium subsp. paratuberculosis
caccaccaccgagcc

SEQ ID NO: 981367 - RNA, 13 nt, Mycobacterium avium subsp. paratuberculosis
caccaccaccgcc

SEQ ID NO: 981368 - RNA, 17 nt, Mycobacterium avium subsp. paratuberculosis
caccaccaacggcucgc

SEQ ID NO: 981369 - RNA, 12 nt, Mycobacterium avium subsp. paratuberculosis
caccaccacacc

SEQ ID NO: 981370 - RNA, 17 nt, Mycobacterium avium subsp. paratuberculosis
caccaccacacccgcgg

SEQ ID NO: 981371 - RNA, 21 nt, Mycobacterium avium subsp. paratuberculosis
caccaccacacccgcggccgc

SEQ ID NO: 981372 - RNA, 17 nt, Mycobacterium avium subsp. paratuberculosis
caccaccgagccggcgu

SEQ ID NO: 981373 - RNA, 15 nt, Mycobacterium avium subsp. paratuberculosis
caccacccgcggccg

SEQ ID NO: 981374 - RNA, 17 nt, Mycobacterium avium subsp. paratuberculosis
caccacccgcggccggc

SEQ ID NO: 981375 - RNA, 11 nt, Mycobacterium avium subsp. paratuberculosis
caccacccggu

SEQ ID NO: 981376 - RNA, 21 nt, Mycobacterium avium subsp. paratuberculosis
caccaccgacagcacccggcc

SEQ ID NO: 981377 - RNA, 17 nt, Mycobacterium avium subsp. paratuberculosis
caccacccaggccaccc

SEQ ID NO: 981378 - RNA, 21 nt, Mycobacterium avium subsp. paratuberculosis
caccacccaggccacccgggc

SEQ ID NO: 981379 - RNA, 14 nt, Mycobacterium avium subsp. paratuberculosis
caccacccagcccu

SEQ ID NO: 981380 - RNA, 13 nt, Mycobacterium avium subsp. paratuberculosis
caccaccaggucu

SEQ ID NO: 981381 - RNA, 22 nt, Mycobacterium avium subsp. paratuberculosis
caccaccagguuggacaccucc

SEQ ID NO: 981382 - RNA, 16 nt, Mycobacterium avium subsp. paratuberculosis
caccaccgcccacagc

SEQ ID NO: 981383 - RNA, 12 nt, Mycobacterium avium subsp. paratuberculosis
caccaccgccgc

SEQ ID NO: 981384 - RNA, 18 nt, Mycobacterium avium subsp. paratuberculosis
caccaccggagcggcggu

SEQ ID NO: 981385 - RNA, 14 nt, Mycobacterium avium subsp. paratuberculosis
caccaccgcggcga

SEQ ID NO: 981386 - RNA, 19 nt, Mycobacterium avium subsp. paratuberculosis
caccaccggcaaccgccac

SEQ ID NO: 981387 - RNA, 21 nt, Mycobacterium avium subsp. paratuberculosis
caccaccggcaaccgccacga

SEQ ID NO: 981388 - RNA, 14 nt, Mycobacterium avium subsp. paratuberculosis
caccaccggugaac

SEQ ID NO: 981389 - RNA, 15 nt, Mycobacterium avium subsp. paratuberculosis
caccaccggccgccc

SEQ ID NO: 981390 - RNA, 17 nt, Mycobacterium avium subsp. paratuberculosis
caccaccggccgcccgg

SEQ ID NO: 981391 - RNA, 23 nt, Mycobacterium avium subsp. paratuberculosis
caccaccgugccgucgcgggcgu

SEQ ID NO: 981392 - RNA, 14 nt, Mycobacterium avium subsp. paratuberculosis
caccaccgugcugg

SEQ ID NO: 981393 - RNA, 20 nt, Mycobacterium avium subsp. paratuberculosis
caccaccgugcuggccacca

SEQ ID NO: 981394 - RNA, 17 nt, Mycobacterium avium subsp. paratuberculosis
caccacuuccagcaccg

SEQ ID NO: 981395 - RNA, 19 nt, Mycobacterium avium subsp. paratuberculosis
caccacuuccagcaccggc

SEQ ID NO: 981396 - RNA, 22 nt, Mycobacterium avium subsp. paratuberculosis
caccagaaccauuugcccagca

SEQ ID NO: 981397 - RNA, 19 nt, Mycobacterium avium subsp. paratuberculosis
caccagauucaccagcgcc

SEQ ID NO: 981398 - RNA, 18 nt, Mycobacterium avium subsp. paratuberculosis
caccagaugccgggcucc

SEQ ID NO: 981399 - RNA, 19 nt, Mycobacterium avium subsp. paratuberculosis
caccagaacacguuucggc

SEQ ID NO: 981400 - RNA, 19 nt, Mycobacterium avium subsp. paratuberculosis
caccacgaaccaggcgccg

SEQ ID NO: 981401 - RNA, 22 nt, Mycobacterium avium subsp. paratuberculosis
caccacgaaccaggcgccggcc

SEQ ID NO: 981402 - RNA, 18 nt, Mycobacterium avium subsp. paratuberculosis
caccaccugguccugccc

SEQ ID NO: 981403 - RNA, 20 nt, Mycobacterium avium subsp. paratuberculosis
caccaccuugguggccgcgg

SEQ ID NO: 981404 - RNA, 15 nt, Mycobacterium avium subsp. paratuberculosis
caccaccugcuucca

SEQ ID NO: 981405 - RNA, 16 nt, Mycobacterium avium subsp. paratuberculosis
caccaccuggccggcc

SEQ ID NO: 981406 - RNA, 22 nt, Mycobacterium avium subsp. paratuberculosis
caccacgacgucgagccagcgg

SEQ ID NO: 981407 - RNA, 19 nt, Mycobacterium avium subsp. paratuberculosis
caccacgacgccgggcgcc

SEQ ID NO: 981408 - RNA, 16 nt, Mycobacterium avium subsp. paratuberculosis
caccacgaacgcgccg

SEQ ID NO: 981409 - RNA, 17 nt, Mycobacterium avium subsp. paratuberculosis
caccacgaccagugccc

SEQ ID NO: 981410 - RNA, 16 nt, Mycobacterium avium subsp. paratuberculosis
caccacgaucagcgcg

SEQ ID NO: 981411 - RNA, 16 nt, Mycobacterium avium subsp. paratuberculosis
caccacguacuccugc

SEQ ID NO: 981412 - RNA, 22 nt, Mycobacterium avium subsp. paratuberculosis
caccacguaggcgaucagcgcg

SEQ ID NO: 981413 - RNA, 23 nt, Mycobacterium avium subsp. paratuberculosis
caccacguaggcgaucagcgcgc

SEQ ID NO: 981414 - RNA, 22 nt, Mycobacterium avium subsp. paratuberculosis
caccacgggucggucggcccgc

SEQ ID NO: 981415 - RNA, 12 nt, Mycobacterium avium subsp. paratuberculosis
caccacggucag

SEQ ID NO: 981416 - RNA, 18 nt, Mycobacterium avium subsp. paratuberculosis
caccacggucgccgcgcc

SEQ ID NO: 981417 - RNA, 18 nt, Mycobacterium avium subsp. paratuberculosis
caccacgguggcgccgcg

SEQ ID NO: 981418 - RNA, 20 nt, Mycobacterium avium subsp. paratuberculosis
caccacgguguagcggcggc

SEQ ID NO: 981419 - RNA, 20 nt, Mycobacterium avium subsp. paratuberculosis
caccacgcuguagggccacc

SEQ ID NO: 981420 - RNA, 12 nt, Mycobacterium avium subsp. paratuberculosis
caccacggcccg

SEQ ID NO: 981421 - RNA, 18 nt, Mycobacterium avium subsp. paratuberculosis
caccacggcccgcgcccc

SEQ ID NO: 981422 - RNA, 22 nt, Mycobacterium avium subsp. paratuberculosis
caccaaaaguguuuccgcugag

SEQ ID NO: 981423 - RNA, 14 nt, Mycobacterium avium subsp. paratuberculosis
caccaacgccacgu

SEQ ID NO: 981424 - RNA, 14 nt, Mycobacterium avium subsp. paratuberculosis
caccaacagcagcg

SEQ ID NO: 981425 - RNA, 13 nt, Mycobacterium avium subsp. paratuberculosis
caccaacagcggc

SEQ ID NO: 981426 - RNA, 17 nt, Mycobacterium avium subsp. paratuberculosis
caccaacagcggcccga

SEQ ID NO: 981427 - RNA, 14 nt, Mycobacterium avium subsp. paratuberculosis
cacaugguccugca

SEQ ID NO: 981428 - RNA, 21 nt, Mycobacterium avium subsp. paratuberculosis
cacaucgcguuagcaaggguu

SEQ ID NO: 981429 - RNA, 15 nt, Mycobacterium avium subsp. paratuberculosis
cacaucccgaaugag

SEQ ID NO: 981430 - RNA, 20 nt, Mycobacterium avium subsp. paratuberculosis
cacaucacgguggccgccac

SEQ ID NO: 981431 - RNA, 21 nt, Mycobacterium avium subsp. paratuberculosis
cacagcagcagcaccaggcug

SEQ ID NO: 981432 - RNA, 21 nt, Mycobacterium avium subsp. paratuberculosis
cacagcgugacccugccguca

SEQ ID NO: 981433 - RNA, 22 nt, Mycobacterium avium subsp. paratuberculosis
cacagcugcuggcugcggcccc

SEQ ID NO: 981434 - RNA, 13 nt, Mycobacterium avium subsp. paratuberculosis
cacagcugcaggc

SEQ ID NO: 981435 - RNA, 23 nt, Mycobacterium avium subsp. paratuberculosis
cacagcucgggcagcgugucccg

SEQ ID NO: 981436 - RNA, 19 nt, Mycobacterium avium subsp. paratuberculosis
cacagcucaccugcgugcc

SEQ ID NO: 981437 - RNA, 14 nt, Mycobacterium avium subsp. paratuberculosis
cacagcgcggcggu

SEQ ID NO: 981438 - RNA, 14 nt, Mycobacterium avium subsp. paratuberculosis
cacagcgccacacc

SEQ ID NO: 981439 - RNA, 19 nt, Mycobacterium avium subsp. paratuberculosis
cacagcgcccuugagcacg

SEQ ID NO: 981440 - RNA, 14 nt, Mycobacterium avium subsp. paratuberculosis
cacagcgccgcguu

SEQ ID NO: 981441 - RNA, 22 nt, Mycobacterium avium subsp. paratuberculosis
cacagcgccucgucgagccggg

SEQ ID NO: 981442 - RNA, 14 nt, Mycobacterium avium subsp. paratuberculosis
cacagccggucaua

SEQ ID NO: 981443 - RNA, 23 nt, Mycobacterium avium subsp. paratuberculosis
cacagccggucauaggccgcgca

SEQ ID NO: 981444 - RNA, 19 nt, Mycobacterium avium subsp. paratuberculosis
cacagccgcuuggcgcgcc

SEQ ID NO: 981445 - RNA, 13 nt, Mycobacterium avium subsp. paratuberculosis
cacagccgcagca

SEQ ID NO: 981446 - RNA, 16 nt, Mycobacterium avium subsp. paratuberculosis
cacagccgcagcagcc

SEQ ID NO: 981447 - RNA, 22 nt, Mycobacterium avium subsp. paratuberculosis
cacagccgcagcagccgcgcca

SEQ ID NO: 981448 - RNA, 17 nt, Mycobacterium avium subsp. paratuberculosis
cacagcagggcaccgac

SEQ ID NO: 981449 - RNA, 17 nt, Mycobacterium avium subsp. paratuberculosis
cacauaacgcucccggu

SEQ ID NO: 981450 - RNA, 14 nt, Mycobacterium avium subsp. paratuberculosis
cacaguggccgcca

SEQ ID NO: 981451 - RNA, 15 nt, Mycobacterium avium subsp. paratuberculosis
cacaguccgcccagc

SEQ ID NO: 981452 - RNA, 14 nt, Mycobacterium avium subsp. paratuberculosis
cacaguaggcggcu

SEQ ID NO: 981453 - RNA, 23 nt, Mycobacterium avium subsp. paratuberculosis
cacaggggcgcguagcucagugg

SEQ ID NO: 981454 - RNA, 15 nt, Mycobacterium avium subsp. paratuberculosis
cacaggucgcccggc

SEQ ID NO: 981455 - RNA, 16 nt, Mycobacterium avium subsp. paratuberculosis
cacaggucgcccggcu

SEQ ID NO: 981456 - RNA, 19 nt, Mycobacterium avium subsp. paratuberculosis
cacaggaacgcgacggugg

SEQ ID NO: 981457 - RNA, 22 nt, Mycobacterium avium subsp. paratuberculosis
cacaggaacgcgucgaccgccg

SEQ ID NO: 981458 - RNA, 18 nt, Mycobacterium avium subsp. paratuberculosis
cacagcuugccggagccc

SEQ ID NO: 981459 - RNA, 20 nt, Mycobacterium avium subsp. paratuberculosis
cacagcuugccggagcccag

SEQ ID NO: 981460 - RNA, 18 nt, Mycobacterium avium subsp. paratuberculosis
cacaagggacaguagcca

SEQ ID NO: 981461 - RNA, 13 nt, Mycobacterium avium subsp. paratuberculosis
cacaccaccagcg

SEQ ID NO: 981462 - RNA, 12 nt, Mycobacterium avium subsp. paratuberculosis
cacaccaccaug

SEQ ID NO: 981463 - RNA, 16 nt, Mycobacterium avium subsp. paratuberculosis
cacacaggaccagcac

SEQ ID NO: 981464 - RNA, 20 nt, Mycobacterium avium subsp. paratuberculosis
cacaauggauccgaucagca

SEQ ID NO: 981465 - RNA, 22 nt, Mycobacterium avium subsp. paratuberculosis
cacaauggauccgaucagcagc

SEQ ID NO: 981466 - RNA, 16 nt, Mycobacterium avium subsp. paratuberculosis
cacaccggggccaggu

SEQ ID NO: 981467 - RNA, 20 nt, Mycobacterium avium subsp. paratuberculosis
cacaccggugcucuccugcu

SEQ ID NO: 981468 - RNA, 16 nt, Mycobacterium avium subsp. paratuberculosis
cacaccggccuucacc

SEQ ID NO: 981469 - RNA, 17 nt, Mycobacterium avium subsp. paratuberculosis
cacaccggccuucacca

SEQ ID NO: 981470 - RNA, 19 nt, Mycobacterium avium subsp. paratuberculosis
cacaccgcggccagcgcgc

SEQ ID NO: 981471 - RNA, 17 nt, Mycobacterium avium subsp. paratuberculosis
cacaccgucgcccgccc

SEQ ID NO: 981472 - RNA, 14 nt, Mycobacterium avium subsp. paratuberculosis
cacaccuuccacca

SEQ ID NO: 981473 - RNA, 13 nt, Mycobacterium avium subsp. paratuberculosis
cacacgcgcgccc

SEQ ID NO: 981474 - RNA, 14 nt, Mycobacterium avium subsp. paratuberculosis
cacaccgccggcca

SEQ ID NO: 981475 - RNA, 13 nt, Mycobacterium avium subsp. paratuberculosis
cacacccucggcc

SEQ ID NO: 981476 - RNA, 16 nt, Mycobacterium avium subsp. paratuberculosis
cacaccgacaccggcc

SEQ ID NO: 981477 - RNA, 16 nt, Mycobacterium avium subsp. paratuberculosis
cacacccgcagcgacc

SEQ ID NO: 981478 - RNA, 14 nt, Mycobacterium avium subsp. paratuberculosis
cacacgcggacagg

SEQ ID NO: 981479 - RNA, 23 nt, Mycobacterium avium subsp. paratuberculosis
cacacgcggacagggcggcgacc

SEQ ID NO: 981480 - RNA, 22 nt, Mycobacterium avium subsp. paratuberculosis
cacacggccucgcccagcgccg

SEQ ID NO: 981481 - RNA, 14 nt, Mycobacterium avium subsp. paratuberculosis
cacacgggcccguc

SEQ ID NO: 981482 - RNA, 16 nt, Mycobacterium avium subsp. paratuberculosis
cacacggggcagaccg

SEQ ID NO: 981483 - RNA, 21 nt, Mycobacterium avium subsp. paratuberculosis
cacacggcaggcggcccgcuc

SEQ ID NO: 981484 - RNA, 13 nt, Mycobacterium avium subsp. paratuberculosis
cacacguccugga

SEQ ID NO: 981485 - RNA, 16 nt, Mycobacterium avium subsp. paratuberculosis
cacacguugagcccgg

SEQ ID NO: 981486 - RNA, 16 nt, Mycobacterium avium subsp. paratuberculosis
cacaacccggacagcg

SEQ ID NO: 981487 - RNA, 15 nt, Mycobacterium avium subsp. paratuberculosis
cacaaacagcgcggc

SEQ ID NO: 981488 - RNA, 21 nt, Mycobacterium avium subsp. paratuberculosis
cacaaaagcgcccgauucccc

SEQ ID NO: 981489 - RNA, 22 nt, Mycobacterium avium subsp. paratuberculosis
caauuucguucguccaaacucc

SEQ ID NO: 981490 - RNA, 17 nt, Mycobacterium avium subsp. paratuberculosis
caauugcgccagcagca

SEQ ID NO: 981491 - RNA, 13 nt, Mycobacterium avium subsp. paratuberculosis
caauugccacagc

SEQ ID NO: 981492 - RNA, 14 nt, Mycobacterium avium subsp. paratuberculosis
caauuccucagccc

SEQ ID NO: 981493 - RNA, 17 nt, Mycobacterium avium subsp. paratuberculosis
cauagcccaucagcacg

SEQ ID NO: 981494 - RNA, 15 nt, Mycobacterium avium subsp. paratuberculosis
cauaggcguacacca

SEQ ID NO: 981495 - RNA, 16 nt, Mycobacterium avium subsp. paratuberculosis
cauaggcguacaccag

SEQ ID NO: 981496 - RNA, 16 nt, Mycobacterium avium subsp. paratuberculosis
cauaggccagcaccag

SEQ ID NO: 981497 - RNA, 18 nt, Mycobacterium avium subsp. paratuberculosis
cauaggccagcaccagcg

SEQ ID NO: 981498 - RNA, 15 nt, Mycobacterium avium subsp. paratuberculosis
cauagcgggagccgg

SEQ ID NO: 981499 - RNA, 15 nt, Mycobacterium avium subsp. paratuberculosis
cauagucgaggggcu

SEQ ID NO: 981500 - RNA, 15 nt, Mycobacterium avium subsp. paratuberculosis
caucacgucccgcuc

SEQ ID NO: 981501 - RNA, 14 nt, Mycobacterium avium subsp. paratuberculosis
caucaccaccgccg

SEQ ID NO: 981502 - RNA, 17 nt, Mycobacterium avium subsp. paratuberculosis
caucacgguggccgcca

SEQ ID NO: 981503 - RNA, 11 nt, Mycobacterium avium subsp. paratuberculosis
caucaccagcg

SEQ ID NO: 981504 - RNA, 13 nt, Mycobacterium avium subsp. paratuberculosis
caucaccagcgcg

SEQ ID NO: 981505 - RNA, 14 nt, Mycobacterium avium subsp. paratuberculosis
caucagcagcgccu

SEQ ID NO: 981506 - RNA, 18 nt, Mycobacterium avium subsp. paratuberculosis
caucagcaccgccucggc

SEQ ID NO: 981507 - RNA, 13 nt, Mycobacterium avium subsp. paratuberculosis
caucagcaccucc

SEQ ID NO: 981508 - RNA, 19 nt, Mycobacterium avium subsp. paratuberculosis
cauauugguucgcucgucu

SEQ ID NO: 981509 - RNA, 15 nt, Mycobacterium avium subsp. paratuberculosis
cauaucgacggcccc

SEQ ID NO: 981510 - RNA, 19 nt, Mycobacterium avium subsp. paratuberculosis
caucguucccugcgcggcg

SEQ ID NO: 981511 - RNA, 16 nt, Mycobacterium avium subsp. paratuberculosis
caucucggugguguca

SEQ ID NO: 981512 - RNA, 16 nt, Mycobacterium avium subsp. paratuberculosis
caucucgucaaccgca

SEQ ID NO: 981513 - RNA, 13 nt, Mycobacterium avium subsp. paratuberculosis
caucuccagccgc

SEQ ID NO: 981514 - RNA, 15 nt, Mycobacterium avium subsp. paratuberculosis
caucuccagccgcgg

SEQ ID NO: 981515 - RNA, 23 nt, Mycobacterium avium subsp. paratuberculosis
caucuccagcuccgcggccagcu

SEQ ID NO: 981516 - RNA, 18 nt, Mycobacterium avium subsp. paratuberculosis
caucguguccagcaugug

SEQ ID NO: 981517 - RNA, 15 nt, Mycobacterium avium subsp. paratuberculosis
caucgugggcgccgu

SEQ ID NO: 981518 - RNA, 13 nt, Mycobacterium avium subsp. paratuberculosis
caucgucuucccc

SEQ ID NO: 981519 - RNA, 14 nt, Mycobacterium avium subsp. paratuberculosis
caucgucucggacc

SEQ ID NO: 981520 - RNA, 18 nt, Mycobacterium avium subsp. paratuberculosis
caucgucauccccuggcc

SEQ ID NO: 981521 - RNA, 13 nt, Mycobacterium avium subsp. paratuberculosis
caucguccccucc

SEQ ID NO: 981522 - RNA, 23 nt, Mycobacterium avium subsp. paratuberculosis
caucggcacguguccgacgccgu

SEQ ID NO: 981523 - RNA, 23 nt, Mycobacterium avium subsp. paratuberculosis
caucggcagcagggugccgccgc

SEQ ID NO: 981524 - RNA, 19 nt, Mycobacterium avium subsp. paratuberculosis
caucgccacccgcaccucg

SEQ ID NO: 981525 - RNA, 18 nt, Mycobacterium avium subsp. paratuberculosis
caucggacaucggcagca

SEQ ID NO: 981526 - RNA, 17 nt, Mycobacterium avium subsp. paratuberculosis
caucgccgucauggugu

SEQ ID NO: 981527 - RNA, 14 nt, Mycobacterium avium subsp. paratuberculosis
caucgccggcgacc

SEQ ID NO: 981528 - RNA, 14 nt, Mycobacterium avium subsp. paratuberculosis
caucgccggcgcgc

SEQ ID NO: 981529 - RNA, 17 nt, Mycobacterium avium subsp. paratuberculosis
caucgccucgaccagca

SEQ ID NO: 981530 - RNA, 18 nt, Mycobacterium avium subsp. paratuberculosis
caucgccucgaccagcac

SEQ ID NO: 981531 - RNA, 20 nt, Mycobacterium avium subsp. paratuberculosis
caucgccucgaccagcaccg

SEQ ID NO: 981532 - RNA, 16 nt, Mycobacterium avium subsp. paratuberculosis
caucgccucggcggcc

SEQ ID NO: 981533 - RNA, 13 nt, Mycobacterium avium subsp. paratuberculosis
caucgccacgccg

SEQ ID NO: 981534 - RNA, 23 nt, Mycobacterium avium subsp. paratuberculosis
caucgccacgccguggcccgccc

SEQ ID NO: 981535 - RNA, 14 nt, Mycobacterium avium subsp. paratuberculosis
caucgccgccgcca

SEQ ID NO: 981536 - RNA, 18 nt, Mycobacterium avium subsp. paratuberculosis
caucgccgaaccguccca

SEQ ID NO: 981537 - RNA, 22 nt, Mycobacterium avium subsp. paratuberculosis
cauccauugggccgcggcgucg

SEQ ID NO: 981538 - RNA, 14 nt, Mycobacterium avium subsp. paratuberculosis
caucccggccaccc

SEQ ID NO: 981539 - RNA, 15 nt, Mycobacterium avium subsp. paratuberculosis
caucccggccacccc

SEQ ID NO: 981540 - RNA, 16 nt, Mycobacterium avium subsp. paratuberculosis
caucccggccaccccg

SEQ ID NO: 981541 - RNA, 24 nt, Mycobacterium avium subsp. paratuberculosis
caucccgguggacgcgauggcgcu

SEQ ID NO: 981542 - RNA, 15 nt, Mycobacterium avium subsp. paratuberculosis
caucccgccgccgaa

SEQ ID NO: 981543 - RNA, 19 nt, Mycobacterium avium subsp. paratuberculosis
caucccgcgccugccuggc

SEQ ID NO: 981544 - RNA, 13 nt, Mycobacterium avium subsp. paratuberculosis
cauccccgugcgg

SEQ ID NO: 981545 - RNA, 17 nt, Mycobacterium avium subsp. paratuberculosis
caucccgauccgcgccg

SEQ ID NO: 981546 - RNA, 14 nt, Mycobacterium avium subsp. paratuberculosis
cauccccaggaugg

SEQ ID NO: 981547 - RNA, 22 nt, Mycobacterium avium subsp. paratuberculosis
caucccccgcagcuucugcagc

SEQ ID NO: 981548 - RNA, 18 nt, Mycobacterium avium subsp. paratuberculosis
cauccccgcguuggccag

SEQ ID NO: 981549 - RNA, 12 nt, Mycobacterium avium subsp. paratuberculosis
cauccggcgccg

SEQ ID NO: 981550 - RNA, 14 nt, Mycobacterium avium subsp. paratuberculosis
cauccggcgccgcg

SEQ ID NO: 981551 - RNA, 15 nt, Mycobacterium avium subsp. paratuberculosis
cauccggccggcgag

SEQ ID NO: 981552 - RNA, 19 nt, Mycobacterium avium subsp. paratuberculosis
cauccggccggcgaggaac

SEQ ID NO: 981553 - RNA, 13 nt, Mycobacterium avium subsp. paratuberculosis
caucccuggugac

SEQ ID NO: 981554 - RNA, 19 nt, Mycobacterium avium subsp. paratuberculosis
caucccuggugaccgacga

SEQ ID NO: 981555 - RNA, 23 nt, Mycobacterium avium subsp. paratuberculosis
caucccugacacgaccgccuguc

SEQ ID NO: 981556 - RNA, 23 nt, Mycobacterium avium subsp. paratuberculosis
cauccgcaacgugcgccggccua

SEQ ID NO: 981557 - RNA, 15 nt, Mycobacterium avium subsp. paratuberculosis
cauccgcagcaccag

SEQ ID NO: 981558 - RNA, 14 nt, Mycobacterium avium subsp. paratuberculosis
caucauguccaggu

SEQ ID NO: 981559 - RNA, 15 nt, Mycobacterium avium subsp. paratuberculosis
caucauguccagguu

SEQ ID NO: 981560 - RNA, 23 nt, Mycobacterium avium subsp. paratuberculosis
caucagcucgucagcgcgggcca

SEQ ID NO: 981561 - RNA, 21 nt, Mycobacterium avium subsp. paratuberculosis
caucagcggagugaccgccag

SEQ ID NO: 981562 - RNA, 18 nt, Mycobacterium avium subsp. paratuberculosis
caucagcggggcguccag

SEQ ID NO: 981563 - RNA, 21 nt, Mycobacterium avium subsp. paratuberculosis
caucagcggggcguccagcga

SEQ ID NO: 981564 - RNA, 17 nt, Mycobacterium avium subsp. paratuberculosis
cauccaggccagcaccu

SEQ ID NO: 981565 - RNA, 17 nt, Mycobacterium avium subsp. paratuberculosis
cauccaggugaacagca

SEQ ID NO: 981566 - RNA, 15 nt, Mycobacterium avium subsp. paratuberculosis
cauccagucggcgcc

SEQ ID NO: 981567 - RNA, 16 nt, Mycobacterium avium subsp. paratuberculosis
cauccagucggcgccg

SEQ ID NO: 981568 - RNA, 18 nt, Mycobacterium avium subsp. paratuberculosis
cauccagcacggccgcca

SEQ ID NO: 981569 - RNA, 17 nt, Mycobacterium avium subsp. paratuberculosis
cauccagaugcccagca

SEQ ID NO: 981570 - RNA, 16 nt, Mycobacterium avium subsp. paratuberculosis
cauccagcgccgccaa

SEQ ID NO: 981571 - RNA, 22 nt, Mycobacterium avium subsp. paratuberculosis
cauuuccggcuauucgggccug

SEQ ID NO: 981572 - RNA, 20 nt, Mycobacterium avium subsp. paratuberculosis
cauucgggccagcgccgagc

SEQ ID NO: 981573 - RNA, 19 nt, Mycobacterium avium subsp. paratuberculosis
cauucggggccaccaggcc

SEQ ID NO: 981574 - RNA, 14 nt, Mycobacterium avium subsp. paratuberculosis
cauucggcgacgcu

SEQ ID NO: 981575 - RNA, 19 nt, Mycobacterium avium subsp. paratuberculosis
cauugcccaucgccacgcc

SEQ ID NO: 981576 - RNA, 17 nt, Mycobacterium avium subsp. paratuberculosis
caugugguugggccagg

SEQ ID NO: 981577 - RNA, 16 nt, Mycobacterium avium subsp. paratuberculosis
cauucagugcgagaaa

SEQ ID NO: 981578 - RNA, 15 nt, Mycobacterium avium subsp. paratuberculosis
cauuccgucuuggcc

SEQ ID NO: 981579 - RNA, 17 nt, Mycobacterium avium subsp. paratuberculosis
caugucgaccucggcca

SEQ ID NO: 981580 - RNA, 20 nt, Mycobacterium avium subsp. paratuberculosis
caugucgacgcugagccgcu

SEQ ID NO: 981581 - RNA, 22 nt, Mycobacterium avium subsp. paratuberculosis
cauguccccgaccaucauggcc

SEQ ID NO: 981582 - RNA, 17 nt, Mycobacterium avium subsp. paratuberculosis
caugucggcgacccgca

SEQ ID NO: 981583 - RNA, 22 nt, Mycobacterium avium subsp. paratuberculosis
caugucaaugccgcagccgauc

SEQ ID NO: 981584 - RNA, 16 nt, Mycobacterium avium subsp. paratuberculosis
cauguacagaccccac

SEQ ID NO: 981585 - RNA, 20 nt, Mycobacterium avium subsp. paratuberculosis
cauguacagaccccacaccu

SEQ ID NO: 981586 - RNA, 18 nt, Mycobacterium avium subsp. paratuberculosis
cauggcgugcugaugcug

SEQ ID NO: 981587 - RNA, 16 nt, Mycobacterium avium subsp. paratuberculosis
cauggcggccagccgg

SEQ ID NO: 981588 - RNA, 18 nt, Mycobacterium avium subsp. paratuberculosis
caugcuggcacuccuugc

SEQ ID NO: 981589 - RNA, 21 nt, Mycobacterium avium subsp. paratuberculosis
caugcugggcuaccagcccca

SEQ ID NO: 981590 - RNA, 14 nt, Mycobacterium avium subsp. paratuberculosis
cauggccagcacca

SEQ ID NO: 981591 - RNA, 17 nt, Mycobacterium avium subsp. paratuberculosis
cauggccagcaccaucc

SEQ ID NO: 981592 - RNA, 11 nt, Mycobacterium avium subsp. paratuberculosis
cauggccagcu

SEQ ID NO: 981593 - RNA, 14 nt, Mycobacterium avium subsp. paratuberculosis
cauggcgcagaaca

SEQ ID NO: 981594 - RNA, 23 nt, Mycobacterium avium subsp. paratuberculosis
cauggccuugaacucggccaggg

SEQ ID NO: 981595 - RNA, 14 nt, Mycobacterium avium subsp. paratuberculosis
caugccgagcaccu

SEQ ID NO: 981596 - RNA, 22 nt, Mycobacterium avium subsp. paratuberculosis
caugccgagcagcaccgcgacc

SEQ ID NO: 981597 - RNA, 13 nt, Mycobacterium avium subsp. paratuberculosis
caugccgagccgc

SEQ ID NO: 981598 - RNA, 16 nt, Mycobacterium avium subsp. paratuberculosis
caugccgaggcacagc

SEQ ID NO: 981599 - RNA, 19 nt, Mycobacterium avium subsp. paratuberculosis
caugccgcccaucaccccg

SEQ ID NO: 981600 - RNA, 22 nt, Mycobacterium avium subsp. paratuberculosis
caugccgccgaccgccgagcgg

SEQ ID NO: 981601 - RNA, 12 nt, Mycobacterium avium subsp. paratuberculosis
caugccgaugcc

SEQ ID NO: 981602 - RNA, 14 nt, Mycobacterium avium subsp. paratuberculosis
caugccggccggca

SEQ ID NO: 981603 - RNA, 15 nt, Mycobacterium avium subsp. paratuberculosis
caugccgcgggccag

SEQ ID NO: 981604 - RNA, 18 nt, Mycobacterium avium subsp. paratuberculosis
caugccgcgggccagcag

SEQ ID NO: 981605 - RNA, 14 nt, Mycobacterium avium subsp. paratuberculosis
caugcucaggauga

SEQ ID NO: 981606 - RNA, 12 nt, Mycobacterium avium subsp. paratuberculosis
caugccgggcca

SEQ ID NO: 981607 - RNA, 15 nt, Mycobacterium avium subsp. paratuberculosis
caugaugcggccaug

SEQ ID NO: 981608 - RNA, 13 nt, Mycobacterium avium subsp. paratuberculosis
caugagcccucca

SEQ ID NO: 981609 - RNA, 22 nt, Mycobacterium avium subsp. paratuberculosis
caugagcccuccagcugguuga

SEQ ID NO: 981610 - RNA, 21 nt, Mycobacterium avium subsp. paratuberculosis
caugaucaggccccacccgca

SEQ ID NO: 981611 - RNA, 20 nt, Mycobacterium avium subsp. paratuberculosis
caugaacuccgacuccagca

SEQ ID NO: 981612 - RNA, 22 nt, Mycobacterium avium subsp. paratuberculosis
caugaacuccgacuccagcagc

SEQ ID NO: 981613 - RNA, 17 nt, Mycobacterium avium subsp. paratuberculosis
caugaacaucggccggg

SEQ ID NO: 981614 - RNA, 15 nt, Mycobacterium avium subsp. paratuberculosis
caugacgaacaugcu

SEQ ID NO: 981615 - RNA, 17 nt, Mycobacterium avium subsp. paratuberculosis
caguucgucgcgcgacu

SEQ ID NO: 981616 - RNA, 16 nt, Mycobacterium avium subsp. paratuberculosis
caguucguccacgcug

SEQ ID NO: 981617 - RNA, 22 nt, Mycobacterium avium subsp. paratuberculosis
caguucggugcacggcgccacc

SEQ ID NO: 981618 - RNA, 16 nt, Mycobacterium avium subsp. paratuberculosis
cagucccguugcggga

SEQ ID NO: 981619 - RNA, 20 nt, Mycobacterium avium subsp. paratuberculosis
caguccgccggagaccagca

SEQ ID NO: 981620 - RNA, 23 nt, Mycobacterium avium subsp. paratuberculosis
caguccgccggagaccagcagcu

SEQ ID NO: 981621 - RNA, 16 nt, Mycobacterium avium subsp. paratuberculosis
caguccggcagcagcg

SEQ ID NO: 981622 - RNA, 14 nt, Mycobacterium avium subsp. paratuberculosis
caguccgcgccggu

SEQ ID NO: 981623 - RNA, 17 nt, Mycobacterium avium subsp. paratuberculosis
caguccgcgccgguccc

SEQ ID NO: 981624 - RNA, 19 nt, Mycobacterium avium subsp. paratuberculosis
caguccggguugggcgccu

SEQ ID NO: 981625 - RNA, 22 nt, Mycobacterium avium subsp. paratuberculosis
caguccggcgaguacccgccgc

SEQ ID NO: 981626 - RNA, 13 nt, Mycobacterium avium subsp. paratuberculosis
caguccggcgccc

SEQ ID NO: 981627 - RNA, 16 nt, Mycobacterium avium subsp. paratuberculosis
caguccggcgccgacc

SEQ ID NO: 981628 - RNA, 15 nt, Mycobacterium avium subsp. paratuberculosis
caguccggcggucag

SEQ ID NO: 981629 - RNA, 20 nt, Mycobacterium avium subsp. paratuberculosis
caguccggcggucagcaccg

SEQ ID NO: 981630 - RNA, 21 nt, Mycobacterium avium subsp. paratuberculosis
caguccggcgugccaccgcug

SEQ ID NO: 981631 - RNA, 21 nt, Mycobacterium avium subsp. paratuberculosis
caguccggacacggccagcgc

SEQ ID NO: 981632 - RNA, 22 nt, Mycobacterium avium subsp. paratuberculosis
caguccggacacggccagcgcc

SEQ ID NO: 981633 - RNA, 23 nt, Mycobacterium avium subsp. paratuberculosis
caguggcugcacgucacgggcca

SEQ ID NO: 981634 - RNA, 22 nt, Mycobacterium avium subsp. paratuberculosis
cagugcgggcucgauguugauc

SEQ ID NO: 981635 - RNA, 13 nt, Mycobacterium avium subsp. paratuberculosis
cagugcgcgccgu

SEQ ID NO: 981636 - RNA, 20 nt, Mycobacterium avium subsp. paratuberculosis
cagugcgucgcccaucacca

SEQ ID NO: 981637 - RNA, 18 nt, Mycobacterium avium subsp. paratuberculosis
cagugccggcgcaccgcg

SEQ ID NO: 981638 - RNA, 16 nt, Mycobacterium avium subsp. paratuberculosis
cagugcccgagcaccu

SEQ ID NO: 981639 - RNA, 15 nt, Mycobacterium avium subsp. paratuberculosis
cagugcccgcccagc

SEQ ID NO: 981640 - RNA, 22 nt, Mycobacterium avium subsp. paratuberculosis
cagugccccguccggcgccagc

SEQ ID NO: 981641 - RNA, 19 nt, Mycobacterium avium subsp. paratuberculosis
cagugccgcaccagcaccc

SEQ ID NO: 981642 - RNA, 13 nt, Mycobacterium avium subsp. paratuberculosis
caguuaccggcgu

SEQ ID NO: 981643 - RNA, 23 nt, Mycobacterium avium subsp. paratuberculosis
caguuccaccaguguccgggcgc

SEQ ID NO: 981644 - RNA, 16 nt, Mycobacterium avium subsp. paratuberculosis
caguuccggagcgcgg

SEQ ID NO: 981645 - RNA, 14 nt, Mycobacterium avium subsp. paratuberculosis
caguuccgacauca

SEQ ID NO: 981646 - RNA, 23 nt, Mycobacterium avium subsp. paratuberculosis
caguuccgacaucagugcgggca

SEQ ID NO: 981647 - RNA, 16 nt, Mycobacterium avium subsp. paratuberculosis
caguucgagcgccgcg

SEQ ID NO: 981648 - RNA, 20 nt, Mycobacterium avium subsp. paratuberculosis
caguucgagcgccgcggcca

SEQ ID NO: 981649 - RNA, 18 nt, Mycobacterium avium subsp. paratuberculosis
caguucgaugccgaugag

SEQ ID NO: 981650 - RNA, 18 nt, Mycobacterium avium subsp. paratuberculosis
caguuccuugauccggcc

SEQ ID NO: 981651 - RNA, 20 nt, Mycobacterium avium subsp. paratuberculosis
caguuccuugauccggccgc

SEQ ID NO: 981652 - RNA, 22 nt, Mycobacterium avium subsp. paratuberculosis
caguuccuugauccggccgcgg

SEQ ID NO: 981653 - RNA, 17 nt, Mycobacterium avium subsp. paratuberculosis
caguuccuugcgcagca

SEQ ID NO: 981654 - RNA, 23 nt, Mycobacterium avium subsp. paratuberculosis
caguucgcguacccgcgcggcgu

SEQ ID NO: 981655 - RNA, 15 nt, Mycobacterium avium subsp. paratuberculosis
cagguucagcccggc

SEQ ID NO: 981656 - RNA, 14 nt, Mycobacterium avium subsp. paratuberculosis
cagguucaucacca

SEQ ID NO: 981657 - RNA, 17 nt, Mycobacterium avium subsp. paratuberculosis
caggugcagcuccuuga

SEQ ID NO: 981658 - RNA, 20 nt, Mycobacterium avium subsp. paratuberculosis
caggugccggcggcgcggca

SEQ ID NO: 981659 - RNA, 20 nt, Mycobacterium avium subsp. paratuberculosis
caggugccggugacggucag

SEQ ID NO: 981660 - RNA, 16 nt, Mycobacterium avium subsp. paratuberculosis
cagguucuccucccag

SEQ ID NO: 981661 - RNA, 23 nt, Mycobacterium avium subsp. paratuberculosis
cagguucgacacgccccgauggu

SEQ ID NO: 981662 - RNA, 15 nt, Mycobacterium avium subsp. paratuberculosis
cagguucgccgccca

SEQ ID NO: 981663 - RNA, 22 nt, Mycobacterium avium subsp. paratuberculosis
cagguuccggaucaaccacacc

SEQ ID NO: 981664 - RNA, 15 nt, Mycobacterium avium subsp. paratuberculosis
cagguucuucugcgc

SEQ ID NO: 981665 - RNA, 17 nt, Mycobacterium avium subsp. paratuberculosis
cagguugaccaccagcg

SEQ ID NO: 981666 - RNA, 19 nt, Mycobacterium avium subsp. paratuberculosis
cagguugaccaggugggcg

SEQ ID NO: 981667 - RNA, 23 nt, Mycobacterium avium subsp. paratuberculosis
cagguuguccagccggugcacca

SEQ ID NO: 981668 - RNA, 23 nt, Mycobacterium avium subsp. paratuberculosis
cagguugucgccgcgccagccgc

SEQ ID NO: 981669 - RNA, 15 nt, Mycobacterium avium subsp. paratuberculosis
caguaggcggcuguc

SEQ ID NO: 981670 - RNA, 19 nt, Mycobacterium avium subsp. paratuberculosis
caguagcgcaccggucagc

SEQ ID NO: 981671 - RNA, 21 nt, Mycobacterium avium subsp. paratuberculosis
caguagcgcaccggucagcgc

SEQ ID NO: 981672 - RNA, 15 nt, Mycobacterium avium subsp. paratuberculosis
caguagccggccagc

SEQ ID NO: 981673 - RNA, 17 nt, Mycobacterium avium subsp. paratuberculosis
caguaugcccgccgcug

SEQ ID NO: 981674 - RNA, 14 nt, Mycobacterium avium subsp. paratuberculosis
cagucccagcacag

SEQ ID NO: 981675 - RNA, 21 nt, Mycobacterium avium subsp. paratuberculosis
cagucccgcguugugcaccaa

SEQ ID NO: 981676 - RNA, 19 nt, Mycobacterium avium subsp. paratuberculosis
caguccagcucccaggacg

SEQ ID NO: 981677 - RNA, 20 nt, Mycobacterium avium subsp. paratuberculosis
caguccagcgaaucgaccgg

SEQ ID NO: 981678 - RNA, 16 nt, Mycobacterium avium subsp. paratuberculosis
caggucgcacaggaug

SEQ ID NO: 981679 - RNA, 18 nt, Mycobacterium avium subsp. paratuberculosis
caggucgauggucugccc

SEQ ID NO: 981680 - RNA, 17 nt, Mycobacterium avium subsp. paratuberculosis
caggucgaggccggcca

SEQ ID NO: 981681 - RNA, 19 nt, Mycobacterium avium subsp. paratuberculosis
caggucgccgcgcagcacc

SEQ ID NO: 981682 - RNA, 17 nt, Mycobacterium avium subsp. paratuberculosis
caggucggccagcgccg

SEQ ID NO: 981683 - RNA, 19 nt, Mycobacterium avium subsp. paratuberculosis
caggucggccagcgccgcc

SEQ ID NO: 981684 - RNA, 20 nt, Mycobacterium avium subsp. paratuberculosis
caggucggccagcgccgccc

SEQ ID NO: 981685 - RNA, 13 nt, Mycobacterium avium subsp. paratuberculosis
caggucggccagc

SEQ ID NO: 981686 - RNA, 19 nt, Mycobacterium avium subsp. paratuberculosis
caggucgcggcgcugcgcc

SEQ ID NO: 981687 - RNA, 21 nt, Mycobacterium avium subsp. paratuberculosis
caggucgcggcgcugcgccgu

SEQ ID NO: 981688 - RNA, 16 nt, Mycobacterium avium subsp. paratuberculosis
cagguccucgcuggcg

SEQ ID NO: 981689 - RNA, 23 nt, Mycobacterium avium subsp. paratuberculosis
cagguccucgcuggcgaucaccu

SEQ ID NO: 981690 - RNA, 23 nt, Mycobacterium avium subsp. paratuberculosis
cagguccggcagcgcgcccaggc

SEQ ID NO: 981691 - RNA, 21 nt, Mycobacterium avium subsp. paratuberculosis
cagguccggaaucaccuugcc

SEQ ID NO: 981692 - RNA, 15 nt, Mycobacterium avium subsp. paratuberculosis
cagguccacaccgug

SEQ ID NO: 981693 - RNA, 17 nt, Mycobacterium avium subsp. paratuberculosis
cagguccgcgguggugg

SEQ ID NO: 981694 - RNA, 13 nt, Mycobacterium avium subsp. paratuberculosis
cagguccuugagg

SEQ ID NO: 981695 - RNA, 16 nt, Mycobacterium avium subsp. paratuberculosis
cagguccuugcccagc

SEQ ID NO: 981696 - RNA, 21 nt, Mycobacterium avium subsp. paratuberculosis
cagguccuugcccagcaguuu

SEQ ID NO: 981697 - RNA, 17 nt, Mycobacterium avium subsp. paratuberculosis
cagguccuugcgcgccg

SEQ ID NO: 981698 - RNA, 23 nt, Mycobacterium avium subsp. paratuberculosis
cagguccuugcgcgccgcgacgu

SEQ ID NO: 981699 - RNA, 17 nt, Mycobacterium avium subsp. paratuberculosis
caggucgaagcccgccg

SEQ ID NO: 981700 - RNA, 23 nt, Mycobacterium avium subsp. paratuberculosis
caggugaucuugcccagccacgc

SEQ ID NO: 981701 - RNA, 19 nt, Mycobacterium avium subsp. paratuberculosis
caggugcagaccggacagc

SEQ ID NO: 981702 - RNA, 15 nt, Mycobacterium avium subsp. paratuberculosis
caggugcaccaccca

SEQ ID NO: 981703 - RNA, 16 nt, Mycobacterium avium subsp. paratuberculosis
caggugcaccacccag

SEQ ID NO: 981704 - RNA, 19 nt, Mycobacterium avium subsp. paratuberculosis
caggugcaccacccaggcc

SEQ ID NO: 981705 - RNA, 20 nt, Mycobacterium avium subsp. paratuberculosis
caggugcaccacccaggcca

SEQ ID NO: 981706 - RNA, 13 nt, Mycobacterium avium subsp. paratuberculosis
caggugcacccga

SEQ ID NO: 981707 - RNA, 17 nt, Mycobacterium avium subsp. paratuberculosis
caggugcacccgaugcu

SEQ ID NO: 981708 - RNA, 13 nt, Mycobacterium avium subsp. paratuberculosis
caggugcacccgc

SEQ ID NO: 981709 - RNA, 20 nt, Mycobacterium avium subsp. paratuberculosis
caggugagccgggugcccgc

SEQ ID NO: 981710 - RNA, 22 nt, Mycobacterium avium subsp. paratuberculosis
caggugagccgggugcccgcgu

SEQ ID NO: 981711 - RNA, 23 nt, Mycobacterium avium subsp. paratuberculosis
caggucuucucguccgcgcuggc

SEQ ID NO: 981712 - RNA, 16 nt, Mycobacterium avium subsp. paratuberculosis
caggugaacagcagcc

SEQ ID NO: 981713 - RNA, 17 nt, Mycobacterium avium subsp. paratuberculosis
caggucgggguccaggc

SEQ ID NO: 981714 - RNA, 18 nt, Mycobacterium avium subsp. paratuberculosis
caggucggucaccgagcu

SEQ ID NO: 981715 - RNA, 22 nt, Mycobacterium avium subsp. paratuberculosis
caggucgggcucgcgcacccgu

SEQ ID NO: 981716 - RNA, 18 nt, Mycobacterium avium subsp. paratuberculosis
caggucggggcccguccc

SEQ ID NO: 981717 - RNA, 16 nt, Mycobacterium avium subsp. paratuberculosis
caggucggcgauggug

SEQ ID NO: 981718 - RNA, 14 nt, Mycobacterium avium subsp. paratuberculosis
caggucggccagcu

SEQ ID NO: 981719 - RNA, 16 nt, Mycobacterium avium subsp. paratuberculosis
caggucggccagcugc

SEQ ID NO: 981720 - RNA, 21 nt, Mycobacterium avium subsp. paratuberculosis
caggucguugccggugccgac

SEQ ID NO: 981721 - RNA, 20 nt, Mycobacterium avium subsp. paratuberculosis
caggucuccguagcccugca

SEQ ID NO: 981722 - RNA, 18 nt, Mycobacterium avium subsp. paratuberculosis
caggucggugcgcggggu

SEQ ID NO: 981723 - RNA, 18 nt, Mycobacterium avium subsp. paratuberculosis
caggucgucgaucagggc

SEQ ID NO: 981724 - RNA, 21 nt, Mycobacterium avium subsp. paratuberculosis
caggucguucauucagcaccu

SEQ ID NO: 981725 - RNA, 16 nt, Mycobacterium avium subsp. paratuberculosis
caggucgucgucgccg

SEQ ID NO: 981726 - RNA, 14 nt, Mycobacterium avium subsp. paratuberculosis
caggucaccgagcg

SEQ ID NO: 981727 - RNA, 22 nt, Mycobacterium avium subsp. paratuberculosis
cagguauucgcgggaggacagc

SEQ ID NO: 981728 - RNA, 23 nt, Mycobacterium avium subsp. paratuberculosis
cagguauucgcgggaggacagcg

SEQ ID NO: 981729 - RNA, 20 nt, Mycobacterium avium subsp. paratuberculosis
cagguauucguugcccugcc

SEQ ID NO: 981730 - RNA, 14 nt, Mycobacterium avium subsp. paratuberculosis
caggucagccaggu

SEQ ID NO: 981731 - RNA, 13 nt, Mycobacterium avium subsp. paratuberculosis
cagguccaccccg

SEQ ID NO: 981732 - RNA, 15 nt, Mycobacterium avium subsp. paratuberculosis
cagguccaccccgcc

SEQ ID NO: 981733 - RNA, 15 nt, Mycobacterium avium subsp. paratuberculosis
cagguccacccgccc

SEQ ID NO: 981734 - RNA, 17 nt, Mycobacterium avium subsp. paratuberculosis
cagguagcgcaucagcu

SEQ ID NO: 981735 - RNA, 20 nt, Mycobacterium avium subsp. paratuberculosis
cagguagcggugcucgaugu

SEQ ID NO: 981736 - RNA, 22 nt, Mycobacterium avium subsp. paratuberculosis
cagguagaggcuguccagcagc

SEQ ID NO: 981737 - RNA, 17 nt, Mycobacterium avium subsp. paratuberculosis
cagguagcgcagcccgg

SEQ ID NO: 981738 - RNA, 18 nt, Mycobacterium avium subsp. paratuberculosis
cagguagcgcagcccggu

SEQ ID NO: 981739 - RNA, 20 nt, Mycobacterium avium subsp. paratuberculosis
cagguaggcgguggcgcaca

SEQ ID NO: 981740 - RNA, 16 nt, Mycobacterium avium subsp. paratuberculosis
cagguagggcacaccg

SEQ ID NO: 981741 - RNA, 14 nt, Mycobacterium avium subsp. paratuberculosis
cagguaggcgcggg

SEQ ID NO: 981742 - RNA, 15 nt, Mycobacterium avium subsp. paratuberculosis
cagguaggcgccgcu

SEQ ID NO: 981743 - RNA, 17 nt, Mycobacterium avium subsp. paratuberculosis
cagguaggcgccgcucg

SEQ ID NO: 981744 - RNA, 17 nt, Mycobacterium avium subsp. paratuberculosis
cagguaguagcgcgccg

SEQ ID NO: 981745 - RNA, 23 nt, Mycobacterium avium subsp. paratuberculosis
cagguaguggugggcgugccggg

SEQ ID NO: 981746 - RNA, 19 nt, Mycobacterium avium subsp. paratuberculosis
cagguaaucgaaggccagg

SEQ ID NO: 981747 - RNA, 20 nt, Mycobacterium avium subsp. paratuberculosis
cagguaaucgaaggccaggu

SEQ ID NO: 981748 - RNA, 18 nt, Mycobacterium avium subsp. paratuberculosis
cagguaccggcgggcgaa

SEQ ID NO: 981749 - RNA, 19 nt, Mycobacterium avium subsp. paratuberculosis
cagguaccgguuccgggcg

SEQ ID NO: 981750 - RNA, 20 nt, Mycobacterium avium subsp. paratuberculosis
cagguaccgguuccgggcga

SEQ ID NO: 981751 - RNA, 15 nt, Mycobacterium avium subsp. paratuberculosis
cagguacgcgacggg

SEQ ID NO: 981752 - RNA, 18 nt, Mycobacterium avium subsp. paratuberculosis
cagguacgcgacgggcau

SEQ ID NO: 981753 - RNA, 22 nt, Mycobacterium avium subsp. paratuberculosis
cagguacgcggcguugccgccg

SEQ ID NO: 981754 - RNA, 16 nt, Mycobacterium avium subsp. paratuberculosis
cagguagaagccgcga

SEQ ID NO: 981755 - RNA, 20 nt, Mycobacterium avium subsp. paratuberculosis
cagguagcaggcgcgcagca

SEQ ID NO: 981756 - RNA, 18 nt, Mycobacterium avium subsp. paratuberculosis
cagguacugaucaccgcg

SEQ ID NO: 981757 - RNA, 23 nt, Mycobacterium avium subsp. paratuberculosis
caggcuggacaccacgucgucgg

SEQ ID NO: 981758 - RNA, 14 nt, Mycobacterium avium subsp. paratuberculosis
caggcuggccagcu

SEQ ID NO: 981759 - RNA, 14 nt, Mycobacterium avium subsp. paratuberculosis
caggcuggccaggc

SEQ ID NO: 981760 - RNA, 19 nt, Mycobacterium avium subsp. paratuberculosis
caggcuggcaugccggaac

SEQ ID NO: 981761 - RNA, 13 nt, Mycobacterium avium subsp. paratuberculosis
caggcugaacacc

SEQ ID NO: 981762 - RNA, 18 nt, Mycobacterium avium subsp. paratuberculosis
caggcugaacaccaccag

SEQ ID NO: 981763 - RNA, 23 nt, Mycobacterium avium subsp. paratuberculosis
caggcugaacaccaccaggccgu

SEQ ID NO: 981764 - RNA, 20 nt, Mycobacterium avium subsp. paratuberculosis
caggcugacgccacgcguca

SEQ ID NO: 981765 - RNA, 14 nt, Mycobacterium avium subsp. paratuberculosis
caggcugacgcgac

SEQ ID NO: 981766 - RNA, 22 nt, Mycobacterium avium subsp. paratuberculosis
caggcugacgcgaccgcgcggc

SEQ ID NO: 981767 - RNA, 20 nt, Mycobacterium avium subsp. paratuberculosis
caggcugccgcugcgccggc

SEQ ID NO: 981768 - RNA, 21 nt, Mycobacterium avium subsp. paratuberculosis
caggcugaucuggaugcggcc

SEQ ID NO: 981769 - RNA, 19 nt, Mycobacterium avium subsp. paratuberculosis
caggcgucggucagcaggc

SEQ ID NO: 981770 - RNA, 19 nt, Mycobacterium avium subsp. paratuberculosis
caggcguccgcaagcaccu

SEQ ID NO: 981771 - RNA, 19 nt, Mycobacterium avium subsp. paratuberculosis
caggcgguggccgaaccgc

SEQ ID NO: 981772 - RNA, 21 nt, Mycobacterium avium subsp. paratuberculosis
caggcgguggccgaaccgcuc

SEQ ID NO: 981773 - RNA, 14 nt, Mycobacterium avium subsp. paratuberculosis
caggcggugguggg

SEQ ID NO: 981774 - RNA, 16 nt, Mycobacterium avium subsp. paratuberculosis
caggcguccagcaccu

SEQ ID NO: 981775 - RNA, 20 nt, Mycobacterium avium subsp. paratuberculosis
caggcuuggcccgccgccgg

SEQ ID NO: 981776 - RNA, 17 nt, Mycobacterium avium subsp. paratuberculosis
caggcgcaacagcaccu

SEQ ID NO: 981777 - RNA, 20 nt, Mycobacterium avium subsp. paratuberculosis
caggcgcaacagcaccucgu

SEQ ID NO: 981778 - RNA, 18 nt, Mycobacterium avium subsp. paratuberculosis
caggcgauggcgucggcc

SEQ ID NO: 981779 - RNA, 19 nt, Mycobacterium avium subsp. paratuberculosis
caggcgauggugccggcca

SEQ ID NO: 981780 - RNA, 23 nt, Mycobacterium avium subsp. paratuberculosis
caggcgauguggguggucagcgc

SEQ ID NO: 981781 - RNA, 11 nt, Mycobacterium avium subsp. paratuberculosis
caggcgcacca

SEQ ID NO: 981782 - RNA, 14 nt, Mycobacterium avium subsp. paratuberculosis
caggcgcaccacca

SEQ ID NO: 981783 - RNA, 17 nt, Mycobacterium avium subsp. paratuberculosis
caggcgcaccaccagcu

SEQ ID NO: 981784 - RNA, 14 nt, Mycobacterium avium subsp. paratuberculosis
caggcgcaccagcu

SEQ ID NO: 981785 - RNA, 18 nt, Mycobacterium avium subsp. paratuberculosis
caggcgcaccgccaccgc

SEQ ID NO: 981786 - RNA, 16 nt, Mycobacterium avium subsp. paratuberculosis
caggcgcagcccgagc

SEQ ID NO: 981787 - RNA, 20 nt, Mycobacterium avium subsp. paratuberculosis
caggcggaucacaucggaca

SEQ ID NO: 981788 - RNA, 13 nt, Mycobacterium avium subsp. paratuberculosis
caggcggaaugca

SEQ ID NO: 981789 - RNA, 14 nt, Mycobacterium avium subsp. paratuberculosis
caggcggacggcga

SEQ ID NO: 981790 - RNA, 17 nt, Mycobacterium avium subsp. paratuberculosis
caggcggcccgcucgau

SEQ ID NO: 981791 - RNA, 18 nt, Mycobacterium avium subsp. paratuberculosis
caggccugguaggccgcc

SEQ ID NO: 981792 - RNA, 20 nt, Mycobacterium avium subsp. paratuberculosis
caggccugguaggccgccuu

SEQ ID NO: 981793 - RNA, 15 nt, Mycobacterium avium subsp. paratuberculosis
caggcgaaucggcgc

SEQ ID NO: 981794 - RNA, 18 nt, Mycobacterium avium subsp. paratuberculosis
caggcgaaucggcgcaca

SEQ ID NO: 981795 - RNA, 13 nt, Mycobacterium avium subsp. paratuberculosis
caggcgaccggcc

SEQ ID NO: 981796 - RNA, 14 nt, Mycobacterium avium subsp. paratuberculosis
caggcgaccggccc

SEQ ID NO: 981797 - RNA, 17 nt, Mycobacterium avium subsp. paratuberculosis
caggccgaacagcagcg

SEQ ID NO: 981798 - RNA, 17 nt, Mycobacterium avium subsp. paratuberculosis
caggcccuugccccacc

SEQ ID NO: 981799 - RNA, 20 nt, Mycobacterium avium subsp. paratuberculosis
caggcccuugccccaccacc

SEQ ID NO: 981800 - RNA, 16 nt, Mycobacterium avium subsp. paratuberculosis
caggcccuccugggug

SEQ ID NO: 981801 - RNA, 17 nt, Mycobacterium avium subsp. paratuberculosis
caggcccucgccgcggu

SEQ ID NO: 981802 - RNA, 17 nt, Mycobacterium avium subsp. paratuberculosis
caggcccucgucggcga

SEQ ID NO: 981803 - RNA, 15 nt, Mycobacterium avium subsp. paratuberculosis
caggcccugccagcg

SEQ ID NO: 981804 - RNA, 20 nt, Mycobacterium avium subsp. paratuberculosis
caggcccgcgccgacggccg

SEQ ID NO: 981805 - RNA, 14 nt, Mycobacterium avium subsp. paratuberculosis
caggaucagcagcc

SEQ ID NO: 981806 - RNA, 14 nt, Mycobacterium avium subsp. paratuberculosis
caggauccgcaccg

SEQ ID NO: 981807 - RNA, 13 nt, Mycobacterium avium subsp. paratuberculosis
caggaugcccggg

SEQ ID NO: 981808 - RNA, 21 nt, Mycobacterium avium subsp. paratuberculosis
caggauccccguccagcccag

SEQ ID NO: 981809 - RNA, 23 nt, Mycobacterium avium subsp. paratuberculosis
caggaucuuugcauacagcaggc

SEQ ID NO: 981810 - RNA, 16 nt, Mycobacterium avium subsp. paratuberculosis
caggaugaccgcccag

SEQ ID NO: 981811 - RNA, 17 nt, Mycobacterium avium subsp. paratuberculosis
caggaugaccgcgucgg

SEQ ID NO: 981812 - RNA, 15 nt, Mycobacterium avium subsp. paratuberculosis
caggaugagcugggc

SEQ ID NO: 981813 - RNA, 14 nt, Mycobacterium avium subsp. paratuberculosis
caggaaccacaccc

SEQ ID NO: 981814 - RNA, 23 nt, Mycobacterium avium subsp. paratuberculosis
caggaaccaccggaaggccaggu

SEQ ID NO: 981815 - RNA, 23 nt, Mycobacterium avium subsp. paratuberculosis
caggaaaggaaggcgcaugccag

SEQ ID NO: 981816 - RNA, 17 nt, Mycobacterium avium subsp. paratuberculosis
caggaugcguucggcca

SEQ ID NO: 981817 - RNA, 14 nt, Mycobacterium avium subsp. paratuberculosis
caggaugcccagca

SEQ ID NO: 981818 - RNA, 20 nt, Mycobacterium avium subsp. paratuberculosis
caggaugcuggggucggcca

SEQ ID NO: 981819 - RNA, 23 nt, Mycobacterium avium subsp. paratuberculosis
caggaugcuggggucggccagcg

SEQ ID NO: 981820 - RNA, 16 nt, Mycobacterium avium subsp. paratuberculosis
caggccaggugcagcu

SEQ ID NO: 981821 - RNA, 15 nt, Mycobacterium avium subsp. paratuberculosis
caggccaugaucgaa

SEQ ID NO: 981822 - RNA, 23 nt, Mycobacterium avium subsp. paratuberculosis
caggcccagcccggccccaccgc

SEQ ID NO: 981823 - RNA, 14 nt, Mycobacterium avium subsp. paratuberculosis
caggcccagcagca

SEQ ID NO: 981824 - RNA, 16 nt, Mycobacterium avium subsp. paratuberculosis
caggcccagcagcacc

SEQ ID NO: 981825 - RNA, 14 nt, Mycobacterium avium subsp. paratuberculosis
caggcccagcagcg

SEQ ID NO: 981826 - RNA, 13 nt, Mycobacterium avium subsp. paratuberculosis
caggcccacccac

SEQ ID NO: 981827 - RNA, 23 nt, Mycobacterium avium subsp. paratuberculosis
caggccauggcgcaccgcggccu

SEQ ID NO: 981828 - RNA, 23 nt, Mycobacterium avium subsp. paratuberculosis
caggccccguucgguggccaccg

SEQ ID NO: 981829 - RNA, 14 nt, Mycobacterium avium subsp. paratuberculosis
caggccccacccgc

SEQ ID NO: 981830 - RNA, 17 nt, Mycobacterium avium subsp. paratuberculosis
caggccccacccgcagu

SEQ ID NO: 981831 - RNA, 11 nt, Mycobacterium avium subsp. paratuberculosis
caggcccaggc

SEQ ID NO: 981832 - RNA, 16 nt, Mycobacterium avium subsp. paratuberculosis
caggcccaggcgaccu

SEQ ID NO: 981833 - RNA, 11 nt, Mycobacterium avium subsp. paratuberculosis
caggcccaccg

SEQ ID NO: 981834 - RNA, 14 nt, Mycobacterium avium subsp. paratuberculosis
caggcccagcgagg

SEQ ID NO: 981835 - RNA, 20 nt, Mycobacterium avium subsp. paratuberculosis
caggccacgcagguccagga

SEQ ID NO: 981836 - RNA, 20 nt, Mycobacterium avium subsp. paratuberculosis
caggccacccgggcgccggc

SEQ ID NO: 981837 - RNA, 20 nt, Mycobacterium avium subsp. paratuberculosis
caggcaugggaucagcagca

SEQ ID NO: 981838 - RNA, 15 nt, Mycobacterium avium subsp. paratuberculosis
caggcauuccaccgc

SEQ ID NO: 981839 - RNA, 20 nt, Mycobacterium avium subsp. paratuberculosis
caggcauuuccagguccggg

SEQ ID NO: 981840 - RNA, 23 nt, Mycobacterium avium subsp. paratuberculosis
cagcuuuccggccgccucgucga

SEQ ID NO: 981841 - RNA, 20 nt, Mycobacterium avium subsp. paratuberculosis
caggaaaaccagcgacgcca

SEQ ID NO: 981842 - RNA, 18 nt, Mycobacterium avium subsp. paratuberculosis
cagcuuggagccgagcac

SEQ ID NO: 981843 - RNA, 18 nt, Mycobacterium avium subsp. paratuberculosis
cagcuugucccagugcuu

SEQ ID NO: 981844 - RNA, 20 nt, Mycobacterium avium subsp. paratuberculosis
cagcugcggguugcgggcca

SEQ ID NO: 981845 - RNA, 17 nt, Mycobacterium avium subsp. paratuberculosis
cagcugggcguacugcu

SEQ ID NO: 981846 - RNA, 14 nt, Mycobacterium avium subsp. paratuberculosis
cagcugggccgcca

SEQ ID NO: 981847 - RNA, 12 nt, Mycobacterium avium subsp. paratuberculosis
cagcugggcagc

SEQ ID NO: 981848 - RNA, 16 nt, Mycobacterium avium subsp. paratuberculosis
cagcugggcagccaga

SEQ ID NO: 981849 - RNA, 13 nt, Mycobacterium avium subsp. paratuberculosis
cagcugggccagc

SEQ ID NO: 981850 - RNA, 18 nt, Mycobacterium avium subsp. paratuberculosis
cagcugggccagcgcggu

SEQ ID NO: 981851 - RNA, 14 nt, Mycobacterium avium subsp. paratuberculosis
cagcugguccggcc

SEQ ID NO: 981852 - RNA, 21 nt, Mycobacterium avium subsp. paratuberculosis
cagcuggguggucaccagcgc

SEQ ID NO: 981853 - RNA, 15 nt, Mycobacterium avium subsp. paratuberculosis
cagcuucggcgccga

SEQ ID NO: 981854 - RNA, 21 nt, Mycobacterium avium subsp. paratuberculosis
cagcuucgugucaccgcccac

SEQ ID NO: 981855 - RNA, 17 nt, Mycobacterium avium subsp. paratuberculosis
cagcucaccggccaggg

SEQ ID NO: 981856 - RNA, 20 nt, Mycobacterium avium subsp. paratuberculosis
cagcucauacagcggcgcgc

SEQ ID NO: 981857 - RNA, 19 nt, Mycobacterium avium subsp. paratuberculosis
cagcucagacugccgagca

SEQ ID NO: 981858 - RNA, 15 nt, Mycobacterium avium subsp. paratuberculosis
cagcucgaucgccgc

SEQ ID NO: 981859 - RNA, 19 nt, Mycobacterium avium subsp. paratuberculosis
cagcucgaucgccgcgccc

SEQ ID NO: 981860 - RNA, 18 nt, Mycobacterium avium subsp. paratuberculosis
cagcucgaucacccaggu

SEQ ID NO: 981861 - RNA, 20 nt, Mycobacterium avium subsp. paratuberculosis
cagcucgacgaccucgccga

SEQ ID NO: 981862 - RNA, 16 nt, Mycobacterium avium subsp. paratuberculosis
cagcucgaggccgcgg

SEQ ID NO: 981863 - RNA, 20 nt, Mycobacterium avium subsp. paratuberculosis
cagcucgaggccgcgggcgu

SEQ ID NO: 981864 - RNA, 23 nt, Mycobacterium avium subsp. paratuberculosis
cagcuccuccugcggugggcgcu

SEQ ID NO: 981865 - RNA, 16 nt, Mycobacterium avium subsp. paratuberculosis
cagcuccucggcccca

SEQ ID NO: 981866 - RNA, 18 nt, Mycobacterium avium subsp. paratuberculosis
cagcuccuugagccgccg

SEQ ID NO: 981867 - RNA, 19 nt, Mycobacterium avium subsp. paratuberculosis
cagcuccuugagccgccgc

SEQ ID NO: 981868 - RNA, 20 nt, Mycobacterium avium subsp. paratuberculosis
cagcuccuugagccgccgcg

SEQ ID NO: 981869 - RNA, 23 nt, Mycobacterium avium subsp. paratuberculosis
cagcucgagcaucacgaacccgu

SEQ ID NO: 981870 - RNA, 14 nt, Mycobacterium avium subsp. paratuberculosis
cagcucgaaccugg

SEQ ID NO: 981871 - RNA, 18 nt, Mycobacterium avium subsp. paratuberculosis
cagcucgaaaagcuucuu

SEQ ID NO: 981872 - RNA, 22 nt, Mycobacterium avium subsp. paratuberculosis
cagcugauucugguucagccgu

SEQ ID NO: 981873 - RNA, 15 nt, Mycobacterium avium subsp. paratuberculosis
cagcugcccgagcgg

SEQ ID NO: 981874 - RNA, 22 nt, Mycobacterium avium subsp. paratuberculosis
cagcugcagcgacugcacccgg

SEQ ID NO: 981875 - RNA, 18 nt, Mycobacterium avium subsp. paratuberculosis
cagcugcacccaccggcc

SEQ ID NO: 981876 - RNA, 11 nt, Mycobacterium avium subsp. paratuberculosis
cagcugcaccg

SEQ ID NO: 981877 - RNA, 17 nt, Mycobacterium avium subsp. paratuberculosis
cagcugcauggacagcg

SEQ ID NO: 981878 - RNA, 23 nt, Mycobacterium avium subsp. paratuberculosis
cagcugcggaaaugcccgcgccc

SEQ ID NO: 981879 - RNA, 14 nt, Mycobacterium avium subsp. paratuberculosis
cagcugcgccgcgu

SEQ ID NO: 981880 - RNA, 13 nt, Mycobacterium avium subsp. paratuberculosis
cagcugcgcgccg

SEQ ID NO: 981881 - RNA, 19 nt, Mycobacterium avium subsp. paratuberculosis
cagcugcgcgggcgcggcc

SEQ ID NO: 981882 - RNA, 22 nt, Mycobacterium avium subsp. paratuberculosis
cagcugcgcgggcgcggccagc

SEQ ID NO: 981883 - RNA, 15 nt, Mycobacterium avium subsp. paratuberculosis
cagcugccgaacugg

SEQ ID NO: 981884 - RNA, 23 nt, Mycobacterium avium subsp. paratuberculosis
cagcugaacacgaacccggcggc

SEQ ID NO: 981885 - RNA, 19 nt, Mycobacterium avium subsp. paratuberculosis
cagcugaacggugcccgcc

SEQ ID NO: 981886 - RNA, 22 nt, Mycobacterium avium subsp. paratuberculosis
cagcugaagguuguucugcucg

SEQ ID NO: 981887 - RNA, 16 nt, Mycobacterium avium subsp. paratuberculosis
cagcugauagcccgcc

SEQ ID NO: 981888 - RNA, 18 nt, Mycobacterium avium subsp. paratuberculosis
cagcugauagcccgccgc

SEQ ID NO: 981889 - RNA, 18 nt, Mycobacterium avium subsp. paratuberculosis
cagcugagcagcccgacc

SEQ ID NO: 981890 - RNA, 20 nt, Mycobacterium avium subsp. paratuberculosis
cagcgguucggcgacgcugg

SEQ ID NO: 981891 - RNA, 18 nt, Mycobacterium avium subsp. paratuberculosis
cagcgucaucacgugcug

SEQ ID NO: 981892 - RNA, 21 nt, Mycobacterium avium subsp. paratuberculosis
cagcgucaggucaccgagcgg

SEQ ID NO: 981893 - RNA, 16 nt, Mycobacterium avium subsp. paratuberculosis
cagcguccacgaugcg

SEQ ID NO: 981894 - RNA, 18 nt, Mycobacterium avium subsp. paratuberculosis
cagcguccaguccggcgu

SEQ ID NO: 981895 - RNA, 18 nt, Mycobacterium avium subsp. paratuberculosis
cagcgucccguccugggc

SEQ ID NO: 981896 - RNA, 22 nt, Mycobacterium avium subsp. paratuberculosis
cagcgucaccaaugcgccggcg

SEQ ID NO: 981897 - RNA, 23 nt, Mycobacterium avium subsp. paratuberculosis
cagcgucacgucgacggccgccg

SEQ ID NO: 981898 - RNA, 17 nt, Mycobacterium avium subsp. paratuberculosis
cagcgggauguagccgg

SEQ ID NO: 981899 - RNA, 13 nt, Mycobacterium avium subsp. paratuberculosis
cagcgggccgacc

SEQ ID NO: 981900 - RNA, 20 nt, Mycobacterium avium subsp. paratuberculosis
cagcgggccgaccuggcggc

SEQ ID NO: 981901 - RNA, 17 nt, Mycobacterium avium subsp. paratuberculosis
cagcgggcccgggcugc

SEQ ID NO: 981902 - RNA, 22 nt, Mycobacterium avium subsp. paratuberculosis
cagcgggcccgggcugcccggg

SEQ ID NO: 981903 - RNA, 20 nt, Mycobacterium avium subsp. paratuberculosis
cagcggugccgcccggaggg

SEQ ID NO: 981904 - RNA, 18 nt, Mycobacterium avium subsp. paratuberculosis
cagcggucacggacaggu

SEQ ID NO: 981905 - RNA, 19 nt, Mycobacterium avium subsp. paratuberculosis
cagcggucauugaugcccc

SEQ ID NO: 981906 - RNA, 19 nt, Mycobacterium avium subsp. paratuberculosis
cagcggguuuggccgcggg

SEQ ID NO: 981907 - RNA, 16 nt, Mycobacterium avium subsp. paratuberculosis
cagcgguaaccacccg

SEQ ID NO: 981908 - RNA, 12 nt, Mycobacterium avium subsp. paratuberculosis
cagcggggcgac

SEQ ID NO: 981909 - RNA, 20 nt, Mycobacterium avium subsp. paratuberculosis
cagcggggcgagcuggccgc

SEQ ID NO: 981910 - RNA, 21 nt, Mycobacterium avium subsp. paratuberculosis
cagcggggcgagcuggccgcc

SEQ ID NO: 981911 - RNA, 22 nt, Mycobacterium avium subsp. paratuberculosis
cagcggggcguccagcgagggg

SEQ ID NO: 981912 - RNA, 13 nt, Mycobacterium avium subsp. paratuberculosis
cagcgggcggcca

SEQ ID NO: 981913 - RNA, 18 nt, Mycobacterium avium subsp. paratuberculosis
cagcgggcggccagccgc

SEQ ID NO: 981914 - RNA, 19 nt, Mycobacterium avium subsp. paratuberculosis
cagcgggcggccagccgcu

SEQ ID NO: 981915 - RNA, 14 nt, Mycobacterium avium subsp. paratuberculosis
cagcgggcggcccc

SEQ ID NO: 981916 - RNA, 20 nt, Mycobacterium avium subsp. paratuberculosis
cagcgggugauggccgccgc

SEQ ID NO: 981917 - RNA, 18 nt, Mycobacterium avium subsp. paratuberculosis
cagcgggucguuggcggc

SEQ ID NO: 981918 - RNA, 21 nt, Mycobacterium avium subsp. paratuberculosis
cagcgggucguuggcggcggu

SEQ ID NO: 981919 - RNA, 17 nt, Mycobacterium avium subsp. paratuberculosis
cagcggggugcccacca

SEQ ID NO: 981920 - RNA, 20 nt, Mycobacterium avium subsp. paratuberculosis
cagcgucuccggcgggcugg

SEQ ID NO: 981921 - RNA, 20 nt, Mycobacterium avium subsp. paratuberculosis
cagcgucucgacggcgccga

SEQ ID NO: 981922 - RNA, 16 nt, Mycobacterium avium subsp. paratuberculosis
cagcgucucgaugacc

SEQ ID NO: 981923 - RNA, 13 nt, Mycobacterium avium subsp. paratuberculosis
cagcgucuugccc

SEQ ID NO: 981924 - RNA, 21 nt, Mycobacterium avium subsp. paratuberculosis
cagcgucuugcccagcggggc

SEQ ID NO: 981925 - RNA, 17 nt, Mycobacterium avium subsp. paratuberculosis
cagcgucugcgccagcu

SEQ ID NO: 981926 - RNA, 22 nt, Mycobacterium avium subsp. paratuberculosis
cagcgucugcgccagcugggug

SEQ ID NO: 981927 - RNA, 16 nt, Mycobacterium avium subsp. paratuberculosis
cagcgucugcgccccg

SEQ ID NO: 981928 - RNA, 19 nt, Mycobacterium avium subsp. paratuberculosis
cagcgucugcgccccggcg

SEQ ID NO: 981929 - RNA, 20 nt, Mycobacterium avium subsp. paratuberculosis
cagcgucugcgccccggcgu

SEQ ID NO: 981930 - RNA, 17 nt, Mycobacterium avium subsp. paratuberculosis
cagcgucugcugcgcca

SEQ ID NO: 981931 - RNA, 20 nt, Mycobacterium avium subsp. paratuberculosis
cagcgucguccaugcccgcc

SEQ ID NO: 981932 - RNA, 23 nt, Mycobacterium avium subsp. paratuberculosis
cagcgucguccaugcccgcccac

SEQ ID NO: 981933 - RNA, 17 nt, Mycobacterium avium subsp. paratuberculosis
cagcgucggcgugcccg

SEQ ID NO: 981934 - RNA, 22 nt, Mycobacterium avium subsp. paratuberculosis
cagcgucgcgccgccaccccag

SEQ ID NO: 981935 - RNA, 14 nt, Mycobacterium avium subsp. paratuberculosis
cagcgucgccagcc

SEQ ID NO: 981936 - RNA, 16 nt, Mycobacterium avium subsp. paratuberculosis
cagcgucgccgccccg

SEQ ID NO: 981937 - RNA, 19 nt, Mycobacterium avium subsp. paratuberculosis
cagcgucgauggaaggugc

SEQ ID NO: 981938 - RNA, 21 nt, Mycobacterium avium subsp. paratuberculosis
cagcgucgauggaaggugcug

SEQ ID NO: 981939 - RNA, 22 nt, Mycobacterium avium subsp. paratuberculosis
cagcgucgaugugggccgcagc

SEQ ID NO: 981940 - RNA, 20 nt, Mycobacterium avium subsp. paratuberculosis
cagcgugccgcgcaccaccu

SEQ ID NO: 981941 - RNA, 13 nt, Mycobacterium avium subsp. paratuberculosis
cagcguggucagc

SEQ ID NO: 981942 - RNA, 17 nt, Mycobacterium avium subsp. paratuberculosis
cagcguggucgcgcagc

SEQ ID NO: 981943 - RNA, 17 nt, Mycobacterium avium subsp. paratuberculosis
cagcguggucuccuggc

SEQ ID NO: 981944 - RNA, 21 nt, Mycobacterium avium subsp. paratuberculosis
cagcguggucuccuggccgcc

SEQ ID NO: 981945 - RNA, 22 nt, Mycobacterium avium subsp. paratuberculosis
cagcguggucuccuggccgccg

SEQ ID NO: 981946 - RNA, 20 nt, Mycobacterium avium subsp. paratuberculosis
cagcguggcgcgccccggcc

SEQ ID NO: 981947 - RNA, 21 nt, Mycobacterium avium subsp. paratuberculosis
cagcguggcgucggcgcgcac

SEQ ID NO: 981948 - RNA, 13 nt, Mycobacterium avium subsp. paratuberculosis
cagcguggccagc

SEQ ID NO: 981949 - RNA, 13 nt, Mycobacterium avium subsp. paratuberculosis
cagcgugaacacc

SEQ ID NO: 981950 - RNA, 13 nt, Mycobacterium avium subsp. paratuberculosis
cagcgugagcuca

SEQ ID NO: 981951 - RNA, 21 nt, Mycobacterium avium subsp. paratuberculosis
cagcgugacgccgggccgccg

SEQ ID NO: 981952 - RNA, 17 nt, Mycobacterium avium subsp. paratuberculosis
cagcguuuccagcgccg

SEQ ID NO: 981953 - RNA, 22 nt, Mycobacterium avium subsp. paratuberculosis
cagcguuuggccugcggcaaca

SEQ ID NO: 981954 - RNA, 24 nt, Mycobacterium avium subsp. paratuberculosis
cagcguuuggccugcggcaacagc

SEQ ID NO: 981955 - RNA, 20 nt, Mycobacterium avium subsp. paratuberculosis
cagcguguuggacgcccgcu

SEQ ID NO: 981956 - RNA, 16 nt, Mycobacterium avium subsp. paratuberculosis
cagcgugucgccgggg

SEQ ID NO: 981957 - RNA, 14 nt, Mycobacterium avium subsp. paratuberculosis
cagcguguggcccu

SEQ ID NO: 981958 - RNA, 15 nt, Mycobacterium avium subsp. paratuberculosis
cagcguggugcgccc

SEQ ID NO: 981959 - RNA, 17 nt, Mycobacterium avium subsp. paratuberculosis
cagcguggugcgcccgu

SEQ ID NO: 981960 - RNA, 22 nt, Mycobacterium avium subsp. paratuberculosis
cagcguuccagcacccggccca

SEQ ID NO: 981961 - RNA, 20 nt, Mycobacterium avium subsp. paratuberculosis
cccauacacgggccguccau

SEQ ID NO: 981962 - RNA, 18 nt, Mycobacterium avium subsp. paratuberculosis
cccaguuguuuccccagc

SEQ ID NO: 981963 - RNA, 21 nt, Mycobacterium avium subsp. paratuberculosis
cccaguuguuuccccagcccg

SEQ ID NO: 981964 - RNA, 21 nt, Mycobacterium avium subsp. paratuberculosis
cccaguuggcgucgucggcgg

SEQ ID NO: 981965 - RNA, 14 nt, Mycobacterium avium subsp. paratuberculosis
cccagugcgcgccg

SEQ ID NO: 981966 - RNA, 18 nt, Mycobacterium avium subsp. paratuberculosis
cccaucaccggaccggcc

SEQ ID NO: 981967 - RNA, 13 nt, Mycobacterium avium subsp. paratuberculosis
cccaucaccagcg

SEQ ID NO: 981968 - RNA, 22 nt, Mycobacterium avium subsp. paratuberculosis
cccauaucgagguaggccaccg

SEQ ID NO: 981969 - RNA, 14 nt, Mycobacterium avium subsp. paratuberculosis
cccauccggcgccg

SEQ ID NO: 981970 - RNA, 16 nt, Mycobacterium avium subsp. paratuberculosis
cccauccaggccagca

SEQ ID NO: 981971 - RNA, 13 nt, Mycobacterium avium subsp. paratuberculosis
cccauccccagga

SEQ ID NO: 981972 - RNA, 12 nt, Mycobacterium avium subsp. paratuberculosis
cccaucgcugcc

SEQ ID NO: 981973 - RNA, 14 nt, Mycobacterium avium subsp. paratuberculosis
cccaucggccagga

SEQ ID NO: 981974 - RNA, 15 nt, Mycobacterium avium subsp. paratuberculosis
cccaucgccacgccg

SEQ ID NO: 981975 - RNA, 16 nt, Mycobacterium avium subsp. paratuberculosis
cccaucgccacgccgu

SEQ ID NO: 981976 - RNA, 15 nt, Mycobacterium avium subsp. paratuberculosis
cccaucucgagcagg

SEQ ID NO: 981977 - RNA, 18 nt, Mycobacterium avium subsp. paratuberculosis
cccaugaacgcgucgccg

SEQ ID NO: 981978 - RNA, 18 nt, Mycobacterium avium subsp. paratuberculosis
cccaucuugaccaggguu

SEQ ID NO: 981979 - RNA, 16 nt, Mycobacterium avium subsp. paratuberculosis
cccagcugggccgcca

SEQ ID NO: 981980 - RNA, 17 nt, Mycobacterium avium subsp. paratuberculosis
cccagcugggccgccag

SEQ ID NO: 981981 - RNA, 20 nt, Mycobacterium avium subsp. paratuberculosis
cccagcugggccgccagccg

SEQ ID NO: 981982 - RNA, 23 nt, Mycobacterium avium subsp. paratuberculosis
cccaggacgguuucugccggccg

SEQ ID NO: 981983 - RNA, 18 nt, Mycobacterium avium subsp. paratuberculosis
cccaggccggcgguggug

SEQ ID NO: 981984 - RNA, 13 nt, Mycobacterium avium subsp. paratuberculosis
cccaggccgcggc

SEQ ID NO: 981985 - RNA, 15 nt, Mycobacterium avium subsp. paratuberculosis
cccaggccgcggcca

SEQ ID NO: 981986 - RNA, 21 nt, Mycobacterium avium subsp. paratuberculosis
cccaggccgcggccaagugcg

SEQ ID NO: 981987 - RNA, 22 nt, Mycobacterium avium subsp. paratuberculosis
cccagccauaccuugucggcgu

SEQ ID NO: 981988 - RNA, 14 nt, Mycobacterium avium subsp. paratuberculosis
cccagccaucugcu

SEQ ID NO: 981989 - RNA, 17 nt, Mycobacterium avium subsp. paratuberculosis
cccagccaucugcugac

SEQ ID NO: 981990 - RNA, 18 nt, Mycobacterium avium subsp. paratuberculosis
cccagccaucugcugacu

SEQ ID NO: 981991 - RNA, 17 nt, Mycobacterium avium subsp. paratuberculosis
cccagcuccucggccag

SEQ ID NO: 981992 - RNA, 12 nt, Mycobacterium avium subsp. paratuberculosis
cccagcugggcc

SEQ ID NO: 981993 - RNA, 17 nt, Mycobacterium avium subsp. paratuberculosis
cccagcucggugaucug

SEQ ID NO: 981994 - RNA, 21 nt, Mycobacterium avium subsp. paratuberculosis
cccagcucggugaucugcacc

SEQ ID NO: 981995 - RNA, 21 nt, Mycobacterium avium subsp. paratuberculosis
cccagccagccgguggcggcc

SEQ ID NO: 981996 - RNA, 16 nt, Mycobacterium avium subsp. paratuberculosis
cccagccaggccgccg

SEQ ID NO: 981997 - RNA, 21 nt, Mycobacterium avium subsp. paratuberculosis
cccagugcaggcaggccccuc

SEQ ID NO: 981998 - RNA, 16 nt, Mycobacterium avium subsp. paratuberculosis
cccagugccaguacca

SEQ ID NO: 981999 - RNA, 14 nt, Mycobacterium avium subsp. paratuberculosis
cccagucgccgccg

SEQ ID NO: 982000 - RNA, 15 nt, Mycobacterium avium subsp. paratuberculosis
cccaguccccgguuc

SEQ ID NO: 982001 - RNA, 16 nt, Mycobacterium avium subsp. paratuberculosis
cccaguccagucgcgc

SEQ ID NO: 982002 - RNA, 18 nt, Mycobacterium avium subsp. paratuberculosis
cccaguccagucgcgccg

SEQ ID NO: 982003 - RNA, 17 nt, Mycobacterium avium subsp. paratuberculosis
cccagguucuccggccc

SEQ ID NO: 982004 - RNA, 18 nt, Mycobacterium avium subsp. paratuberculosis
cccagguucuccggcccg

SEQ ID NO: 982005 - RNA, 21 nt, Mycobacterium avium subsp. paratuberculosis
cccagguucuccggcccgcuc

SEQ ID NO: 982006 - RNA, 19 nt, Mycobacterium avium subsp. paratuberculosis
cccaggcgggccagcucga

SEQ ID NO: 982007 - RNA, 17 nt, Mycobacterium avium subsp. paratuberculosis
ccccauccgcggccacc

SEQ ID NO: 982008 - RNA, 23 nt, Mycobacterium avium subsp. paratuberculosis
ccccaguuggcgucgucggcggc

SEQ ID NO: 982009 - RNA, 23 nt, Mycobacterium avium subsp. paratuberculosis
cccccggcgugagcgagccggca

SEQ ID NO: 982010 - RNA, 20 nt, Mycobacterium avium subsp. paratuberculosis
cccccgggaugccugcccgc

SEQ ID NO: 982011 - RNA, 20 nt, Mycobacterium avium subsp. paratuberculosis
cccccggaccacguccccgg

SEQ ID NO: 982012 - RNA, 22 nt, Mycobacterium avium subsp. paratuberculosis
cccccggaccacguccccgggc

SEQ ID NO: 982013 - RNA, 14 nt, Mycobacterium avium subsp. paratuberculosis
cccccguuggacau

SEQ ID NO: 982014 - RNA, 19 nt, Mycobacterium avium subsp. paratuberculosis
cccccggggccuccagcca

SEQ ID NO: 982015 - RNA, 14 nt, Mycobacterium avium subsp. paratuberculosis
cccccgucgggccg

SEQ ID NO: 982016 - RNA, 16 nt, Mycobacterium avium subsp. paratuberculosis
cccccgucgggccguc

SEQ ID NO: 982017 - RNA, 17 nt, Mycobacterium avium subsp. paratuberculosis
cccccgucgggccgucc

SEQ ID NO: 982018 - RNA, 19 nt, Mycobacterium avium subsp. paratuberculosis
cccccgucgggccguccgc

SEQ ID NO: 982019 - RNA, 23 nt, Mycobacterium avium subsp. paratuberculosis
cccccgucgggccguccgccggc

SEQ ID NO: 982020 - RNA, 15 nt, Mycobacterium avium subsp. paratuberculosis
cccauugccgcgccg

SEQ ID NO: 982021 - RNA, 12 nt, Mycobacterium avium subsp. paratuberculosis
cccauugccgcg

SEQ ID NO: 982022 - RNA, 18 nt, Mycobacterium avium subsp. paratuberculosis
cccauugucgccgugcgg

SEQ ID NO: 982023 - RNA, 17 nt, Mycobacterium avium subsp. paratuberculosis
ccccagcccggauccca

SEQ ID NO: 982024 - RNA, 11 nt, Mycobacterium avium subsp. paratuberculosis
ccccagccggc

SEQ ID NO: 982025 - RNA, 22 nt, Mycobacterium avium subsp. paratuberculosis
ccccagcgcgaccagugcaccu

SEQ ID NO: 982026 - RNA, 16 nt, Mycobacterium avium subsp. paratuberculosis
ccccagcugggccgcc

SEQ ID NO: 982027 - RNA, 13 nt, Mycobacterium avium subsp. paratuberculosis
ccccagcuccucg

SEQ ID NO: 982028 - RNA, 22 nt, Mycobacterium avium subsp. paratuberculosis
ccccaggcccgguugagugcgc

SEQ ID NO: 982029 - RNA, 19 nt, Mycobacterium avium subsp. paratuberculosis
ccccaggcgaugccgccga

SEQ ID NO: 982030 - RNA, 21 nt, Mycobacterium avium subsp. paratuberculosis
ccccuacgggcgcaccgcgcg

SEQ ID NO: 982031 - RNA, 22 nt, Mycobacterium avium subsp. paratuberculosis
ccccuacgggcgcaccgcgcgc

SEQ ID NO: 982032 - RNA, 22 nt, Mycobacterium avium subsp. paratuberculosis
ccccguguuguggucugacccc

SEQ ID NO: 982033 - RNA, 22 nt, Mycobacterium avium subsp. paratuberculosis
ccccguugaucuugaccgucgc

SEQ ID NO: 982034 - RNA, 20 nt, Mycobacterium avium subsp. paratuberculosis
ccccguugucguucuccccg

SEQ ID NO: 982035 - RNA, 18 nt, Mycobacterium avium subsp. paratuberculosis
ccccgggaacgacggugc

SEQ ID NO: 982036 - RNA, 14 nt, Mycobacterium avium subsp. paratuberculosis
ccccgggugggugc

SEQ ID NO: 982037 - RNA, 23 nt, Mycobacterium avium subsp. paratuberculosis
ccccgguagccagcaccgccccg

SEQ ID NO: 982038 - RNA, 12 nt, Mycobacterium avium subsp. paratuberculosis
ccccggugucug

SEQ ID NO: 982039 - RNA, 15 nt, Mycobacterium avium subsp. paratuberculosis
ccccgguucaccagu

SEQ ID NO: 982040 - RNA, 22 nt, Mycobacterium avium subsp. paratuberculosis
ccccgucgaaaccgucuccggc

SEQ ID NO: 982041 - RNA, 13 nt, Mycobacterium avium subsp. paratuberculosis
ccccgucgagcag

SEQ ID NO: 982042 - RNA, 22 nt, Mycobacterium avium subsp. paratuberculosis
ccccgucgagcagccgcaacac

SEQ ID NO: 982043 - RNA, 18 nt, Mycobacterium avium subsp. paratuberculosis
ccccguagucacccggcc

SEQ ID NO: 982044 - RNA, 20 nt, Mycobacterium avium subsp. paratuberculosis
ccccguagucacccggcccc

SEQ ID NO: 982045 - RNA, 21 nt, Mycobacterium avium subsp. paratuberculosis
ccccgggaugccugcccgcgc

SEQ ID NO: 982046 - RNA, 12 nt, Mycobacterium avium subsp. paratuberculosis
ccccgggcccag

SEQ ID NO: 982047 - RNA, 21 nt, Mycobacterium avium subsp. paratuberculosis
ccccgggcccagcaccaccac

SEQ ID NO: 982048 - RNA, 20 nt, Mycobacterium avium subsp. paratuberculosis
ccccgggcgagcgucgccgc

SEQ ID NO: 982049 - RNA, 17 nt, Mycobacterium avium subsp. paratuberculosis
ccccggcugcugcacga

SEQ ID NO: 982050 - RNA, 17 nt, Mycobacterium avium subsp. paratuberculosis
ccccgggggaccagcgc

SEQ ID NO: 982051 - RNA, 23 nt, Mycobacterium avium subsp. paratuberculosis
ccccggcguccaguagccgccgg

SEQ ID NO: 982052 - RNA, 21 nt, Mycobacterium avium subsp. paratuberculosis
ccccggcgcugaagugcagcg

SEQ ID NO: 982053 - RNA, 17 nt, Mycobacterium avium subsp. paratuberculosis
ccccggcggccggcccc

SEQ ID NO: 982054 - RNA, 17 nt, Mycobacterium avium subsp. paratuberculosis
ccccggcgggcucgccg

SEQ ID NO: 982055 - RNA, 18 nt, Mycobacterium avium subsp. paratuberculosis
ccccggccccggccggcg

SEQ ID NO: 982056 - RNA, 22 nt, Mycobacterium avium subsp. paratuberculosis
ccccggauccgucgccccgcac

SEQ ID NO: 982057 - RNA, 22 nt, Mycobacterium avium subsp. paratuberculosis
ccccggaccggagacgguccuc

SEQ ID NO: 982058 - RNA, 14 nt, Mycobacterium avium subsp. paratuberculosis
ccccggacggccga

SEQ ID NO: 982059 - RNA, 15 nt, Mycobacterium avium subsp. paratuberculosis
ccccggagagccggu

SEQ ID NO: 982060 - RNA, 14 nt, Mycobacterium avium subsp. paratuberculosis
ccccggagauccgg

SEQ ID NO: 982061 - RNA, 21 nt, Mycobacterium avium subsp. paratuberculosis
cccccgcgcugcccagcgcgg

SEQ ID NO: 982062 - RNA, 15 nt, Mycobacterium avium subsp. paratuberculosis
ccccgacaccgccag

SEQ ID NO: 982063 - RNA, 17 nt, Mycobacterium avium subsp. paratuberculosis
ccccgaacccggccagc

SEQ ID NO: 982064 - RNA, 13 nt, Mycobacterium avium subsp. paratuberculosis
ccccgaaccgccc

SEQ ID NO: 982065 - RNA, 14 nt, Mycobacterium avium subsp. paratuberculosis
cccaacggcgugca

SEQ ID NO: 982066 - RNA, 18 nt, Mycobacterium avium subsp. paratuberculosis
cccaagccggccaggccc

SEQ ID NO: 982067 - RNA, 21 nt, Mycobacterium avium subsp. paratuberculosis
cccacauucggcgaaccaggc

SEQ ID NO: 982068 - RNA, 16 nt, Mycobacterium avium subsp. paratuberculosis
cccaccaucccgccgc

SEQ ID NO: 982069 - RNA, 17 nt, Mycobacterium avium subsp. paratuberculosis
cccaccaucccgccgcc

SEQ ID NO: 982070 - RNA, 17 nt, Mycobacterium avium subsp. paratuberculosis
cccaccaugagcagacc

SEQ ID NO: 982071 - RNA, 17 nt, Mycobacterium avium subsp. paratuberculosis
cccacccggggccgucc

SEQ ID NO: 982072 - RNA, 16 nt, Mycobacterium avium subsp. paratuberculosis
cccacccgcacgcccg

SEQ ID NO: 982073 - RNA, 18 nt, Mycobacterium avium subsp. paratuberculosis
cccaccgaaucacccacg

SEQ ID NO: 982074 - RNA, 23 nt, Mycobacterium avium subsp. paratuberculosis
cccacagucgcuggguguaaccg

SEQ ID NO: 982075 - RNA, 14 nt, Mycobacterium avium subsp. paratuberculosis
cccacaguccgccc

SEQ ID NO: 982076 - RNA, 18 nt, Mycobacterium avium subsp. paratuberculosis
cccagcacaacgccuccg

SEQ ID NO: 982077 - RNA, 22 nt, Mycobacterium avium subsp. paratuberculosis
cccagauguugaggguccgcgc

SEQ ID NO: 982078 - RNA, 14 nt, Mycobacterium avium subsp. paratuberculosis
cccagaugccgccg

SEQ ID NO: 982079 - RNA, 17 nt, Mycobacterium avium subsp. paratuberculosis
cccagaugccgccgcca

SEQ ID NO: 982080 - RNA, 22 nt, Mycobacterium avium subsp. paratuberculosis
cccagaugcgcgacggccucgc

SEQ ID NO: 982081 - RNA, 18 nt, Mycobacterium avium subsp. paratuberculosis
cccagcaaaaccccgccg

SEQ ID NO: 982082 - RNA, 17 nt, Mycobacterium avium subsp. paratuberculosis
cccagcaaacccagcac

SEQ ID NO: 982083 - RNA, 19 nt, Mycobacterium avium subsp. paratuberculosis
cccagacaggccggccgcu

SEQ ID NO: 982084 - RNA, 18 nt, Mycobacterium avium subsp. paratuberculosis
cccagacccagcaucgcc

SEQ ID NO: 982085 - RNA, 13 nt, Mycobacterium avium subsp. paratuberculosis
cccagaacugggc

SEQ ID NO: 982086 - RNA, 18 nt, Mycobacterium avium subsp. paratuberculosis
cccagaacugggccgccg

SEQ ID NO: 982087 - RNA, 20 nt, Mycobacterium avium subsp. paratuberculosis
cccagaacugggccgccguc

SEQ ID NO: 982088 - RNA, 16 nt, Mycobacterium avium subsp. paratuberculosis
cccagacgcgggcgcc

SEQ ID NO: 982089 - RNA, 20 nt, Mycobacterium avium subsp. paratuberculosis
cccagacgcgggcgcccagc

SEQ ID NO: 982090 - RNA, 21 nt, Mycobacterium avium subsp. paratuberculosis
cccagacuugggcagcaggug

SEQ ID NO: 982091 - RNA, 15 nt, Mycobacterium avium subsp. paratuberculosis
cccagaaacaccauc

SEQ ID NO: 982092 - RNA, 13 nt, Mycobacterium avium subsp. paratuberculosis
cccacuggcggcc

SEQ ID NO: 982093 - RNA, 23 nt, Mycobacterium avium subsp. paratuberculosis
cccacuggcggccggccgcgccc

SEQ ID NO: 982094 - RNA, 21 nt, Mycobacterium avium subsp. paratuberculosis
cccacugguaaccgcccgagc

SEQ ID NO: 982095 - RNA, 21 nt, Mycobacterium avium subsp. paratuberculosis
cccacgacgucugggccgccg

SEQ ID NO: 982096 - RNA, 19 nt, Mycobacterium avium subsp. paratuberculosis
cccacgaacgucaggccgu

SEQ ID NO: 982097 - RNA, 21 nt, Mycobacterium avium subsp. paratuberculosis
cccacgaagaugaucagcgcg

SEQ ID NO: 982098 - RNA, 13 nt, Mycobacterium avium subsp. paratuberculosis
cccaccuggaggc

SEQ ID NO: 982099 - RNA, 22 nt, Mycobacterium avium subsp. paratuberculosis
cccaccuggaggccaacgagcg

SEQ ID NO: 982100 - RNA, 22 nt, Mycobacterium avium subsp. paratuberculosis
cccaccugguuggcccgcacca

SEQ ID NO: 982101 - RNA, 20 nt, Mycobacterium avium subsp. paratuberculosis
cccacucccagccgccggcc

SEQ ID NO: 982102 - RNA, 20 nt, Mycobacterium avium subsp. paratuberculosis
ccauugcgggaagggcccgg

SEQ ID NO: 982103 - RNA, 21 nt, Mycobacterium avium subsp. paratuberculosis
ccauucgucugccaaggugcg

SEQ ID NO: 982104 - RNA, 13 nt, Mycobacterium avium subsp. paratuberculosis
ccauuccgccaga

SEQ ID NO: 982105 - RNA, 19 nt, Mycobacterium avium subsp. paratuberculosis
ccaugucguugacgcuggg

SEQ ID NO: 982106 - RNA, 22 nt, Mycobacterium avium subsp. paratuberculosis
ccauguccccgaccaucauggc

SEQ ID NO: 982107 - RNA, 21 nt, Mycobacterium avium subsp. paratuberculosis
ccaugucgacgcugagccgcu

SEQ ID NO: 982108 - RNA, 20 nt, Mycobacterium avium subsp. paratuberculosis
ccaugucgaugucgacgccg

SEQ ID NO: 982109 - RNA, 15 nt, Mycobacterium avium subsp. paratuberculosis
ccaugucggccaggu

SEQ ID NO: 982110 - RNA, 13 nt, Mycobacterium avium subsp. paratuberculosis
ccauggcgcaccg

SEQ ID NO: 982111 - RNA, 21 nt, Mycobacterium avium subsp. paratuberculosis
ccauguacggauugcggacgc

SEQ ID NO: 982112 - RNA, 23 nt, Mycobacterium avium subsp. paratuberculosis
ccauggucaggguguaggccgcg

SEQ ID NO: 982113 - RNA, 22 nt, Mycobacterium avium subsp. paratuberculosis
ccaugcucuugcgggcggcagc

SEQ ID NO: 982114 - RNA, 12 nt, Mycobacterium avium subsp. paratuberculosis
ccauggccagga

SEQ ID NO: 982115 - RNA, 16 nt, Mycobacterium avium subsp. paratuberculosis
ccauggccaggaacgg

SEQ ID NO: 982116 - RNA, 13 nt, Mycobacterium avium subsp. paratuberculosis
ccauggaguuguc

SEQ ID NO: 982117 - RNA, 10 nt, Mycobacterium avium subsp. paratuberculosis
ccaucuggaa

SEQ ID NO: 982118 - RNA, 20 nt, Mycobacterium avium subsp. paratuberculosis
ccaucugccggcgcuucugc

SEQ ID NO: 982119 - RNA, 22 nt, Mycobacterium avium subsp. paratuberculosis
ccaucuucacgaagugcccggc

SEQ ID NO: 982120 - RNA, 16 nt, Mycobacterium avium subsp. paratuberculosis
ccaucuucaguucggc

SEQ ID NO: 982121 - RNA, 18 nt, Mycobacterium avium subsp. paratuberculosis
ccaugaauucgaacuggg

SEQ ID NO: 982122 - RNA, 15 nt, Mycobacterium avium subsp. paratuberculosis
ccaugaagccguuga

SEQ ID NO: 982123 - RNA, 20 nt, Mycobacterium avium subsp. paratuberculosis
ccaugaacuccgacuccagc

SEQ ID NO: 982124 - RNA, 12 nt, Mycobacterium avium subsp. paratuberculosis
ccaugaucgaaa

SEQ ID NO: 982125 - RNA, 18 nt, Mycobacterium avium subsp. paratuberculosis
ccaugaguugggucacau

SEQ ID NO: 982126 - RNA, 13 nt, Mycobacterium avium subsp. paratuberculosis
ccaugcccagcag

SEQ ID NO: 982127 - RNA, 12 nt, Mycobacterium avium subsp. paratuberculosis
ccaugccgccau

SEQ ID NO: 982128 - RNA, 22 nt, Mycobacterium avium subsp. paratuberculosis
ccaugccggcguccaguucggc

SEQ ID NO: 982129 - RNA, 22 nt, Mycobacterium avium subsp. paratuberculosis
ccaugaugucguuguccagcgu

SEQ ID NO: 982130 - RNA, 12 nt, Mycobacterium avium subsp. paratuberculosis
ccaucgccgcca

SEQ ID NO: 982131 - RNA, 20 nt, Mycobacterium avium subsp. paratuberculosis
ccaucgcugguggugagaau

SEQ ID NO: 982132 - RNA, 22 nt, Mycobacterium avium subsp. paratuberculosis
ccaucgccgccgccaucuccuc

SEQ ID NO: 982133 - RNA, 15 nt, Mycobacterium avium subsp. paratuberculosis
ccaucuccagcuccg

SEQ ID NO: 982134 - RNA, 23 nt, Mycobacterium avium subsp. paratuberculosis
ccauccguucggcucugcagagc

SEQ ID NO: 982135 - RNA, 17 nt, Mycobacterium avium subsp. paratuberculosis
ccauccgggcggccagc

SEQ ID NO: 982136 - RNA, 14 nt, Mycobacterium avium subsp. paratuberculosis
ccaucacgaccucg

SEQ ID NO: 982137 - RNA, 15 nt, Mycobacterium avium subsp. paratuberculosis
ccaucaccggaccgg

SEQ ID NO: 982138 - RNA, 17 nt, Mycobacterium avium subsp. paratuberculosis
ccaucaccuccuuggcc

SEQ ID NO: 982139 - RNA, 21 nt, Mycobacterium avium subsp. paratuberculosis
ccaucaccuccuuggccaggc

SEQ ID NO: 982140 - RNA, 17 nt, Mycobacterium avium subsp. paratuberculosis
ccauccagcgccgcagc

SEQ ID NO: 982141 - RNA, 20 nt, Mycobacterium avium subsp. paratuberculosis
ccaucaccagcgcguagagc

SEQ ID NO: 982142 - RNA, 13 nt, Mycobacterium avium subsp. paratuberculosis
ccaucaccagcgg

SEQ ID NO: 982143 - RNA, 18 nt, Mycobacterium avium subsp. paratuberculosis
ccaucaacccgagcaccg

SEQ ID NO: 982144 - RNA, 17 nt, Mycobacterium avium subsp. paratuberculosis
ccaguucgagcgccgcg

SEQ ID NO: 982145 - RNA, 20 nt, Mycobacterium avium subsp. paratuberculosis
ccaguucgagcgccgcggcc

SEQ ID NO: 982146 - RNA, 15 nt, Mycobacterium avium subsp. paratuberculosis
ccaguuccugcaugc

SEQ ID NO: 982147 - RNA, 19 nt, Mycobacterium avium subsp. paratuberculosis
ccagcuguuuuaggcagcc

SEQ ID NO: 982148 - RNA, 17 nt, Mycobacterium avium subsp. paratuberculosis
ccagcuugaagcccucg

SEQ ID NO: 982149 - RNA, 21 nt, Mycobacterium avium subsp. paratuberculosis
ccagcuguugacgggccgcgg

SEQ ID NO: 982150 - RNA, 23 nt, Mycobacterium avium subsp. paratuberculosis
ccagcuguugacgggccgcggcc

SEQ ID NO: 982151 - RNA, 19 nt, Mycobacterium avium subsp. paratuberculosis
ccagcugucccagugcgug

SEQ ID NO: 982152 - RNA, 14 nt, Mycobacterium avium subsp. paratuberculosis
ccagcugggcagcc

SEQ ID NO: 982153 - RNA, 19 nt, Mycobacterium avium subsp. paratuberculosis
ccagcuggguggucaccag

SEQ ID NO: 982154 - RNA, 21 nt, Mycobacterium avium subsp. paratuberculosis
ccagcuggguggucaccagcg

SEQ ID NO: 982155 - RNA, 15 nt, Mycobacterium avium subsp. paratuberculosis
ccagcugggccagcg

SEQ ID NO: 982156 - RNA, 20 nt, Mycobacterium avium subsp. paratuberculosis
ccagcugggccgccagccgg

SEQ ID NO: 982157 - RNA, 17 nt, Mycobacterium avium subsp. paratuberculosis
ccaggaacgacacgugg

SEQ ID NO: 982158 - RNA, 20 nt, Mycobacterium avium subsp. paratuberculosis
ccaggaacuggucgaacagc

SEQ ID NO: 982159 - RNA, 23 nt, Mycobacterium avium subsp. paratuberculosis
ccaggaacuggucgaacagcgcg

SEQ ID NO: 982160 - RNA, 22 nt, Mycobacterium avium subsp. paratuberculosis
ccaggaagacguaggcggccag

SEQ ID NO: 982161 - RNA, 14 nt, Mycobacterium avium subsp. paratuberculosis
ccaggaaccacacc

SEQ ID NO: 982162 - RNA, 24 nt, Mycobacterium avium subsp. paratuberculosis
ccaggauccccguccagcccagcg

SEQ ID NO: 982163 - RNA, 21 nt, Mycobacterium avium subsp. paratuberculosis
ccaggauccgaugacgcugcc

SEQ ID NO: 982164 - RNA, 23 nt, Mycobacterium avium subsp. paratuberculosis
ccaggaggcacuggcgcugcgcu

SEQ ID NO: 982165 - RNA, 14 nt, Mycobacterium avium subsp. paratuberculosis
ccagcccccgcggg

SEQ ID NO: 982166 - RNA, 21 nt, Mycobacterium avium subsp. paratuberculosis
ccagccccuuguagcccuccg

SEQ ID NO: 982167 - RNA, 15 nt, Mycobacterium avium subsp. paratuberculosis
ccagcccgagcacca

SEQ ID NO: 982168 - RNA, 14 nt, Mycobacterium avium subsp. paratuberculosis
ccagccccucgacc

SEQ ID NO: 982169 - RNA, 18 nt, Mycobacterium avium subsp. paratuberculosis
ccagcggcaucgccgcca

SEQ ID NO: 982170 - RNA, 12 nt, Mycobacterium avium subsp. paratuberculosis
ccagcggcagcg

SEQ ID NO: 982171 - RNA, 17 nt, Mycobacterium avium subsp. paratuberculosis
ccagcggcagcgacagc

SEQ ID NO: 982172 - RNA, 15 nt, Mycobacterium avium subsp. paratuberculosis
ccagcggcagcgcca

SEQ ID NO: 982173 - RNA, 22 nt, Mycobacterium avium subsp. paratuberculosis
ccagcggcagcgccagcgggau

SEQ ID NO: 982174 - RNA, 12 nt, Mycobacterium avium subsp. paratuberculosis
ccagcccgccgu

SEQ ID NO: 982175 - RNA, 13 nt, Mycobacterium avium subsp. paratuberculosis
ccagcccgcgcca

SEQ ID NO: 982176 - RNA, 20 nt, Mycobacterium avium subsp. paratuberculosis
ccagcccgcgccagcucggc

SEQ ID NO: 982177 - RNA, 22 nt, Mycobacterium avium subsp. paratuberculosis
ccagcccgcucagagcugcacc

SEQ ID NO: 982178 - RNA, 22 nt, Mycobacterium avium subsp. paratuberculosis
ccagcgguuuggauggcccgcc

SEQ ID NO: 982179 - RNA, 13 nt, Mycobacterium avium subsp. paratuberculosis
ccagcggcggccc

SEQ ID NO: 982180 - RNA, 14 nt, Mycobacterium avium subsp. paratuberculosis
ccagcggcgcggcc

SEQ ID NO: 982181 - RNA, 14 nt, Mycobacterium avium subsp. paratuberculosis
ccagcggccgcagc

SEQ ID NO: 982182 - RNA, 17 nt, Mycobacterium avium subsp. paratuberculosis
ccagcggccggaacagc

SEQ ID NO: 982183 - RNA, 15 nt, Mycobacterium avium subsp. paratuberculosis
ccagcuccagcagcc

SEQ ID NO: 982184 - RNA, 16 nt, Mycobacterium avium subsp. paratuberculosis
ccagcucagcgcgcac

SEQ ID NO: 982185 - RNA, 20 nt, Mycobacterium avium subsp. paratuberculosis
ccagcucaccggccagggcc

SEQ ID NO: 982186 - RNA, 21 nt, Mycobacterium avium subsp. paratuberculosis
ccagcucccacgacgacuggg

SEQ ID NO: 982187 - RNA, 18 nt, Mycobacterium avium subsp. paratuberculosis
ccagcuccgccacccugc

SEQ ID NO: 982188 - RNA, 21 nt, Mycobacterium avium subsp. paratuberculosis
ccagcuccgggucgaccgccu

SEQ ID NO: 982189 - RNA, 23 nt, Mycobacterium avium subsp. paratuberculosis
ccagcucguugccggcggccagc

SEQ ID NO: 982190 - RNA, 17 nt, Mycobacterium avium subsp. paratuberculosis
ccagcucggugaucacc

SEQ ID NO: 982191 - RNA, 20 nt, Mycobacterium avium subsp. paratuberculosis
ccagcucggugaucugcacc

SEQ ID NO: 982192 - RNA, 18 nt, Mycobacterium avium subsp. paratuberculosis
ccagcgugacgccgggcc

SEQ ID NO: 982193 - RNA, 22 nt, Mycobacterium avium subsp. paratuberculosis
ccagcgugacgccgggccgccg

SEQ ID NO: 982194 - RNA, 23 nt, Mycobacterium avium subsp. paratuberculosis
ccagcgugacgccgggccgccgc

SEQ ID NO: 982195 - RNA, 15 nt, Mycobacterium avium subsp. paratuberculosis
ccagcguggccggca

SEQ ID NO: 982196 - RNA, 15 nt, Mycobacterium avium subsp. paratuberculosis
ccagcguggccagca

SEQ ID NO: 982197 - RNA, 17 nt, Mycobacterium avium subsp. paratuberculosis
ccagcguggccagcacc

SEQ ID NO: 982198 - RNA, 15 nt, Mycobacterium avium subsp. paratuberculosis
ccagcgugccgcgca

SEQ ID NO: 982199 - RNA, 20 nt, Mycobacterium avium subsp. paratuberculosis
ccagcgugccgcgcaccacc

SEQ ID NO: 982200 - RNA, 14 nt, Mycobacterium avium subsp. paratuberculosis
ccagcgugugcgug

SEQ ID NO: 982201 - RNA, 21 nt, Mycobacterium avium subsp. paratuberculosis
ccagcguggcgcgccccggcc

SEQ ID NO: 982202 - RNA, 23 nt, Mycobacterium avium subsp. paratuberculosis
ccagcguggcgcgccccggcccg

SEQ ID NO: 982203 - RNA, 22 nt, Mycobacterium avium subsp. paratuberculosis
ccagcguggucacccgcagccc

SEQ ID NO: 982204 - RNA, 16 nt, Mycobacterium avium subsp. paratuberculosis
ccagcguggugcgccc

SEQ ID NO: 982205 - RNA, 16 nt, Mycobacterium avium subsp. paratuberculosis
ccaggugugcccgccc

SEQ ID NO: 982206 - RNA, 14 nt, Mycobacterium avium subsp. paratuberculosis
ccagguguccggcc

SEQ ID NO: 982207 - RNA, 15 nt, Mycobacterium avium subsp. paratuberculosis
ccaggugggguggug

SEQ ID NO: 982208 - RNA, 16 nt, Mycobacterium avium subsp. paratuberculosis
ccagguucagcccggc

SEQ ID NO: 982209 - RNA, 14 nt, Mycobacterium avium subsp. paratuberculosis
ccagguucaggccc

SEQ ID NO: 982210 - RNA, 19 nt, Mycobacterium avium subsp. paratuberculosis
ccagguucaggcccgcgcc

SEQ ID NO: 982211 - RNA, 13 nt, Mycobacterium avium subsp. paratuberculosis
ccagguuccggug

SEQ ID NO: 982212 - RNA, 14 nt, Mycobacterium avium subsp. paratuberculosis
ccagguucgccgcc

SEQ ID NO: 982213 - RNA, 15 nt, Mycobacterium avium subsp. paratuberculosis
ccagguucgccgccc

SEQ ID NO: 982214 - RNA, 16 nt, Mycobacterium avium subsp. paratuberculosis
ccagguugucgccgcg

SEQ ID NO: 982215 - RNA, 18 nt, Mycobacterium avium subsp. paratuberculosis
ccagguugucgccgcgcc

SEQ ID NO: 982216 - RNA, 22 nt, Mycobacterium avium subsp. paratuberculosis
ccagguugucgccgcgccagcc

SEQ ID NO: 982217 - RNA, 23 nt, Mycobacterium avium subsp. paratuberculosis
ccagguugucgccgcgccagccg

SEQ ID NO: 982218 - RNA, 22 nt, Mycobacterium avium subsp. paratuberculosis
ccagguuggucagcagcagcgc

SEQ ID NO: 982219 - RNA, 23 nt, Mycobacterium avium subsp. paratuberculosis
ccagguuggucucgauggucgcc

SEQ ID NO: 982220 - RNA, 17 nt, Mycobacterium avium subsp. paratuberculosis
ccagguugcgccguccg

SEQ ID NO: 982221 - RNA, 20 nt, Mycobacterium avium subsp. paratuberculosis
ccagguugcgccguccggcc

SEQ ID NO: 982222 - RNA, 19 nt, Mycobacterium avium subsp. paratuberculosis
ccagguucuccggcccgcu

SEQ ID NO: 982223 - RNA, 21 nt, Mycobacterium avium subsp. paratuberculosis
ccagguacugaucaccgcgcu

SEQ ID NO: 982224 - RNA, 23 nt, Mycobacterium avium subsp. paratuberculosis
ccagguagcccaugucgccggug

SEQ ID NO: 982225 - RNA, 14 nt, Mycobacterium avium subsp. paratuberculosis
ccaggugaccggcc

SEQ ID NO: 982226 - RNA, 21 nt, Mycobacterium avium subsp. paratuberculosis
ccaggucuucucguccgcgcu

SEQ ID NO: 982227 - RNA, 15 nt, Mycobacterium avium subsp. paratuberculosis
ccaggugcacccgcg

SEQ ID NO: 982228 - RNA, 17 nt, Mycobacterium avium subsp. paratuberculosis
ccaggugcacccgcggc

SEQ ID NO: 982229 - RNA, 19 nt, Mycobacterium avium subsp. paratuberculosis
ccaggugcacccgcggcgc

SEQ ID NO: 982230 - RNA, 18 nt, Mycobacterium avium subsp. paratuberculosis
ccaggugcacgccgagca

SEQ ID NO: 982231 - RNA, 15 nt, Mycobacterium avium subsp. paratuberculosis
ccagguggcccgacc

SEQ ID NO: 982232 - RNA, 16 nt, Mycobacterium avium subsp. paratuberculosis
ccagguggcgccuccg

SEQ ID NO: 982233 - RNA, 21 nt, Mycobacterium avium subsp. paratuberculosis
ccaggugcugcccuugugguu

SEQ ID NO: 982234 - RNA, 18 nt, Mycobacterium avium subsp. paratuberculosis
ccagggcggcgccggcac

SEQ ID NO: 982235 - RNA, 20 nt, Mycobacterium avium subsp. paratuberculosis
ccagggcgcguccacuccaa

SEQ ID NO: 982236 - RNA, 15 nt, Mycobacterium avium subsp. paratuberculosis
ccagggcgacgccgc

SEQ ID NO: 982237 - RNA, 19 nt, Mycobacterium avium subsp. paratuberculosis
ccaggguucucgcggcggc

SEQ ID NO: 982238 - RNA, 16 nt, Mycobacterium avium subsp. paratuberculosis
ccagggugucccagcg

SEQ ID NO: 982239 - RNA, 22 nt, Mycobacterium avium subsp. paratuberculosis
ccagguacacguagcgguccag

SEQ ID NO: 982240 - RNA, 18 nt, Mycobacterium avium subsp. paratuberculosis
ccaggguuugggcgugcg

SEQ ID NO: 982241 - RNA, 17 nt, Mycobacterium avium subsp. paratuberculosis
ccagggugucgucgcgc

SEQ ID NO: 982242 - RNA, 23 nt, Mycobacterium avium subsp. paratuberculosis
ccagggugucgucgcgcacccag

SEQ ID NO: 982243 - RNA, 22 nt, Mycobacterium avium subsp. paratuberculosis
ccaggcgaacauggcggccagc

SEQ ID NO: 982244 - RNA, 14 nt, Mycobacterium avium subsp. paratuberculosis
ccaggcgcaccagc

SEQ ID NO: 982245 - RNA, 12 nt, Mycobacterium avium subsp. paratuberculosis
ccaggcgccggc

SEQ ID NO: 982246 - RNA, 19 nt, Mycobacterium avium subsp. paratuberculosis
ccaggcgcccagcacccgg

SEQ ID NO: 982247 - RNA, 16 nt, Mycobacterium avium subsp. paratuberculosis
ccaggcgcaccgccac

SEQ ID NO: 982248 - RNA, 18 nt, Mycobacterium avium subsp. paratuberculosis
ccaggcgcaccgccaccg

SEQ ID NO: 982249 - RNA, 14 nt, Mycobacterium avium subsp. paratuberculosis
ccaggcgccacagc

SEQ ID NO: 982250 - RNA, 18 nt, Mycobacterium avium subsp. paratuberculosis
ccaggcagacccccagca

SEQ ID NO: 982251 - RNA, 21 nt, Mycobacterium avium subsp. paratuberculosis
ccaggcagacccccagcagcg

SEQ ID NO: 982252 - RNA, 17 nt, Mycobacterium avium subsp. paratuberculosis
ccaggcagaagcuccac

SEQ ID NO: 982253 - RNA, 22 nt, Mycobacterium avium subsp. paratuberculosis
ccaggcagaagcuccacgccgc

SEQ ID NO: 982254 - RNA, 11 nt, Mycobacterium avium subsp. paratuberculosis
ccaggcaggcg

SEQ ID NO: 982255 - RNA, 18 nt, Mycobacterium avium subsp. paratuberculosis
ccaggccgucgaggcgcu

SEQ ID NO: 982256 - RNA, 16 nt, Mycobacterium avium subsp. paratuberculosis
ccaggccgugguuggc

SEQ ID NO: 982257 - RNA, 16 nt, Mycobacterium avium subsp. paratuberculosis
ccagggcccgcagccg

SEQ ID NO: 982258 - RNA, 12 nt, Mycobacterium avium subsp. paratuberculosis
ccagggcccgcu

SEQ ID NO: 982259 - RNA, 19 nt, Mycobacterium avium subsp. paratuberculosis
ccagggcgaucaccgcggc

SEQ ID NO: 982260 - RNA, 14 nt, Mycobacterium avium subsp. paratuberculosis
ccagggcgaccgcc

SEQ ID NO: 982261 - RNA, 16 nt, Mycobacterium avium subsp. paratuberculosis
ccagggcgaccgccgc

SEQ ID NO: 982262 - RNA, 18 nt, Mycobacterium avium subsp. paratuberculosis
ccagggcgaccgccgcgu

SEQ ID NO: 982263 - RNA, 18 nt, Mycobacterium avium subsp. paratuberculosis
ccagggccgggcgugccc

SEQ ID NO: 982264 - RNA, 22 nt, Mycobacterium avium subsp. paratuberculosis
ccagggccgggcgugcccggcg

SEQ ID NO: 982265 - RNA, 13 nt, Mycobacterium avium subsp. paratuberculosis
ccagggccgccgc

SEQ ID NO: 982266 - RNA, 18 nt, Mycobacterium avium subsp. paratuberculosis
ccagggacaugccgagca

SEQ ID NO: 982267 - RNA, 21 nt, Mycobacterium avium subsp. paratuberculosis
ccagggacaugccgagcagca

SEQ ID NO: 982268 - RNA, 17 nt, Mycobacterium avium subsp. paratuberculosis
ccaggcuuggcccgccg

SEQ ID NO: 982269 - RNA, 20 nt, Mycobacterium avium subsp. paratuberculosis
ccaggcuuggcccgccgccg

SEQ ID NO: 982270 - RNA, 16 nt, Mycobacterium avium subsp. paratuberculosis
ccagggcagccagccc

SEQ ID NO: 982271 - RNA, 19 nt, Mycobacterium avium subsp. paratuberculosis
ccagggcagccagcccgcg

SEQ ID NO: 982272 - RNA, 15 nt, Mycobacterium avium subsp. paratuberculosis
ccagggcagcgccuc

SEQ ID NO: 982273 - RNA, 13 nt, Mycobacterium avium subsp. paratuberculosis
ccagggcagcgcg

SEQ ID NO: 982274 - RNA, 23 nt, Mycobacterium avium subsp. paratuberculosis
ccagaacgacgcgcucagcccca

SEQ ID NO: 982275 - RNA, 17 nt, Mycobacterium avium subsp. paratuberculosis
ccagaacggcggcagcg

SEQ ID NO: 982276 - RNA, 21 nt, Mycobacterium avium subsp. paratuberculosis
ccagaagaucugccggugccg

SEQ ID NO: 982277 - RNA, 23 nt, Mycobacterium avium subsp. paratuberculosis
ccagaagaucugccggugccgcc

SEQ ID NO: 982278 - RNA, 21 nt, Mycobacterium avium subsp. paratuberculosis
ccagaacugguccuccaacgg

SEQ ID NO: 982279 - RNA, 17 nt, Mycobacterium avium subsp. paratuberculosis
ccacgugcacggcgccg

SEQ ID NO: 982280 - RNA, 17 nt, Mycobacterium avium subsp. paratuberculosis
ccacgucgucggacagc

SEQ ID NO: 982281 - RNA, 20 nt, Mycobacterium avium subsp. paratuberculosis
ccacgucgucggacagcagc

SEQ ID NO: 982282 - RNA, 22 nt, Mycobacterium avium subsp. paratuberculosis
ccacgucgcgauagggccggcc

SEQ ID NO: 982283 - RNA, 21 nt, Mycobacterium avium subsp. paratuberculosis
ccacguccgcggugagcaccg

SEQ ID NO: 982284 - RNA, 23 nt, Mycobacterium avium subsp. paratuberculosis
ccacguucagcgacuugccgccg

SEQ ID NO: 982285 - RNA, 17 nt, Mycobacterium avium subsp. paratuberculosis
ccagagcgccggacucg

SEQ ID NO: 982286 - RNA, 19 nt, Mycobacterium avium subsp. paratuberculosis
ccagagcgcgaaaaccagc

SEQ ID NO: 982287 - RNA, 15 nt, Mycobacterium avium subsp. paratuberculosis
ccagaucgacgccga

SEQ ID NO: 982288 - RNA, 15 nt, Mycobacterium avium subsp. paratuberculosis
ccagaucgacgccgc

SEQ ID NO: 982289 - RNA, 22 nt, Mycobacterium avium subsp. paratuberculosis
ccagaucgagcugggcccgcgc

SEQ ID NO: 982290 - RNA, 18 nt, Mycobacterium avium subsp. paratuberculosis
ccagacguccagcgccgc

SEQ ID NO: 982291 - RNA, 17 nt, Mycobacterium avium subsp. paratuberculosis
ccagacugcgcaccgcc

SEQ ID NO: 982292 - RNA, 16 nt, Mycobacterium avium subsp. paratuberculosis
ccagacucacggcggc

SEQ ID NO: 982293 - RNA, 17 nt, Mycobacterium avium subsp. paratuberculosis
ccagacgaacgcggccg

SEQ ID NO: 982294 - RNA, 19 nt, Mycobacterium avium subsp. paratuberculosis
ccagacgaacgcggccgcc

SEQ ID NO: 982295 - RNA, 23 nt, Mycobacterium avium subsp. paratuberculosis
ccagacgauuugggcgguccgcu

SEQ ID NO: 982296 - RNA, 20 nt, Mycobacterium avium subsp. paratuberculosis
ccagacgcgggcgcccagca

SEQ ID NO: 982297 - RNA, 15 nt, Mycobacterium avium subsp. paratuberculosis
ccagacaggccggcc

SEQ ID NO: 982298 - RNA, 13 nt, Mycobacterium avium subsp. paratuberculosis
ccagaugcaggcu

SEQ ID NO: 982299 - RNA, 13 nt, Mycobacterium avium subsp. paratuberculosis
ccagcaaccccgc

SEQ ID NO: 982300 - RNA, 16 nt, Mycobacterium avium subsp. paratuberculosis
ccagcaaccgccgugg

SEQ ID NO: 982301 - RNA, 19 nt, Mycobacterium avium subsp. paratuberculosis
ccagcaaccggaauggcag

SEQ ID NO: 982302 - RNA, 22 nt, Mycobacterium avium subsp. paratuberculosis
ccagcaaccggaauggcagcag

SEQ ID NO: 982303 - RNA, 14 nt, Mycobacterium avium subsp. paratuberculosis
ccagcaacgacccg

SEQ ID NO: 982304 - RNA, 23 nt, Mycobacterium avium subsp. paratuberculosis
ccagaucguagggcucggcgucg

SEQ ID NO: 982305 - RNA, 19 nt, Mycobacterium avium subsp. paratuberculosis
ccagaucguguccgcgccg

SEQ ID NO: 982306 - RNA, 17 nt, Mycobacterium avium subsp. paratuberculosis
ccagaucgccccgcugg

SEQ ID NO: 982307 - RNA, 23 nt, Mycobacterium avium subsp. paratuberculosis
ccagcacgucgggguggccggcc

SEQ ID NO: 982308 - RNA, 19 nt, Mycobacterium avium subsp. paratuberculosis
ccagcacgugaugcagcug

SEQ ID NO: 982309 - RNA, 17 nt, Mycobacterium avium subsp. paratuberculosis
ccagcacgugcccagcc

SEQ ID NO: 982310 - RNA, 15 nt, Mycobacterium avium subsp. paratuberculosis
ccagcacggcggcgc

SEQ ID NO: 982311 - RNA, 15 nt, Mycobacterium avium subsp. paratuberculosis
ccagcacggucccgu

SEQ ID NO: 982312 - RNA, 13 nt, Mycobacterium avium subsp. paratuberculosis
ccagcacccgggc

SEQ ID NO: 982313 - RNA, 15 nt, Mycobacterium avium subsp. paratuberculosis
ccagcacccgggccu

SEQ ID NO: 982314 - RNA, 22 nt, Mycobacterium avium subsp. paratuberculosis
ccagcaccgcaucccccucggc

SEQ ID NO: 982315 - RNA, 15 nt, Mycobacterium avium subsp. paratuberculosis
ccagcaccgccgcgg

SEQ ID NO: 982316 - RNA, 20 nt, Mycobacterium avium subsp. paratuberculosis
ccagcaccgccgcggccgcg

SEQ ID NO: 982317 - RNA, 16 nt, Mycobacterium avium subsp. paratuberculosis
ccagcaccgccggcgc

SEQ ID NO: 982318 - RNA, 16 nt, Mycobacterium avium subsp. paratuberculosis
ccagcaccgcggcgau

SEQ ID NO: 982319 - RNA, 16 nt, Mycobacterium avium subsp. paratuberculosis
ccagcagauacuccuc

SEQ ID NO: 982320 - RNA, 18 nt, Mycobacterium avium subsp. paratuberculosis
ccagcagauagcccagcc

SEQ ID NO: 982321 - RNA, 22 nt, Mycobacterium avium subsp. paratuberculosis
ccagcacaccggaucggcugcg

SEQ ID NO: 982322 - RNA, 18 nt, Mycobacterium avium subsp. paratuberculosis
ccagcaccgccaccggcc

SEQ ID NO: 982323 - RNA, 12 nt, Mycobacterium avium subsp. paratuberculosis
ccagcaccgccc

SEQ ID NO: 982324 - RNA, 14 nt, Mycobacterium avium subsp. paratuberculosis
ccagcaccgccccg

SEQ ID NO: 982325 - RNA, 13 nt, Mycobacterium avium subsp. paratuberculosis
ccagcaccgccgc

SEQ ID NO: 982326 - RNA, 15 nt, Mycobacterium avium subsp. paratuberculosis
ccagcacccggccca

SEQ ID NO: 982327 - RNA, 14 nt, Mycobacterium avium subsp. paratuberculosis
ccagcacccagcac

SEQ ID NO: 982328 - RNA, 12 nt, Mycobacterium avium subsp. paratuberculosis
ccagcaccccgc

SEQ ID NO: 982329 - RNA, 18 nt, Mycobacterium avium subsp. paratuberculosis
ccagcaccccgccgcagc

SEQ ID NO: 982330 - RNA, 9 nt, Mycobacterium avium subsp. paratuberculosis
ccagcagcc

SEQ ID NO: 982331 - RNA, 19 nt, Mycobacterium avium subsp. paratuberculosis
ccagcagccagcccagccg

SEQ ID NO: 982332 - RNA, 15 nt, Mycobacterium avium subsp. paratuberculosis
ccagcagccagcugg

SEQ ID NO: 982333 - RNA, 13 nt, Mycobacterium avium subsp. paratuberculosis
ccagcagcccggg

SEQ ID NO: 982334 - RNA, 14 nt, Mycobacterium avium subsp. paratuberculosis
ccagcagcccgggu

SEQ ID NO: 982335 - RNA, 14 nt, Mycobacterium avium subsp. paratuberculosis
ccagcagccgcagc

SEQ ID NO: 982336 - RNA, 23 nt, Mycobacterium avium subsp. paratuberculosis
ccagcagccgcgcgagcaucacc

SEQ ID NO: 982337 - RNA, 15 nt, Mycobacterium avium subsp. paratuberculosis
ccagcagcgccucgg

SEQ ID NO: 982338 - RNA, 17 nt, Mycobacterium avium subsp. paratuberculosis
ccagcagcgccggcagc

SEQ ID NO: 982339 - RNA, 19 nt, Mycobacterium avium subsp. paratuberculosis
ccagcagcgccagcaccgc

SEQ ID NO: 982340 - RNA, 19 nt, Mycobacterium avium subsp. paratuberculosis
ccagcaugguucguggggu

SEQ ID NO: 982341 - RNA, 22 nt, Mycobacterium avium subsp. paratuberculosis
ccagcaugugcucccagcucag

SEQ ID NO: 982342 - RNA, 20 nt, Mycobacterium avium subsp. paratuberculosis
ccagcauggcgaucaccccg

SEQ ID NO: 982343 - RNA, 15 nt, Mycobacterium avium subsp. paratuberculosis
ccagcaucgccgcgg

SEQ ID NO: 982344 - RNA, 17 nt, Mycobacterium avium subsp. paratuberculosis
ccagcaugaucaccgcc

SEQ ID NO: 982345 - RNA, 14 nt, Mycobacterium avium subsp. paratuberculosis
ccagccagccgccc

SEQ ID NO: 982346 - RNA, 16 nt, Mycobacterium avium subsp. paratuberculosis
ccagccagccgcccag

SEQ ID NO: 982347 - RNA, 16 nt, Mycobacterium avium subsp. paratuberculosis
ccagccagccgcgccg

SEQ ID NO: 982348 - RNA, 15 nt, Mycobacterium avium subsp. paratuberculosis
ccagccagccggugg

SEQ ID NO: 982349 - RNA, 13 nt, Mycobacterium avium subsp. paratuberculosis
ccagccaggccgc

SEQ ID NO: 982350 - RNA, 20 nt, Mycobacterium avium subsp. paratuberculosis
ccagccaggccgccgggccg

SEQ ID NO: 982351 - RNA, 17 nt, Mycobacterium avium subsp. paratuberculosis
ccagccagcguuuggcc

SEQ ID NO: 982352 - RNA, 13 nt, Mycobacterium avium subsp. paratuberculosis
ccagccccagcac

SEQ ID NO: 982353 - RNA, 12 nt, Mycobacterium avium subsp. paratuberculosis
ccagccaguccg

SEQ ID NO: 982354 - RNA, 16 nt, Mycobacterium avium subsp. paratuberculosis
ccagccaggucuugag

SEQ ID NO: 982355 - RNA, 17 nt, Mycobacterium avium subsp. paratuberculosis
ccagccacaccgccgcg

SEQ ID NO: 982356 - RNA, 15 nt, Mycobacterium avium subsp. paratuberculosis
ccagccacuccacca

SEQ ID NO: 982357 - RNA, 14 nt, Mycobacterium avium subsp. paratuberculosis
ccacaucugguugc

SEQ ID NO: 982358 - RNA, 18 nt, Mycobacterium avium subsp. paratuberculosis
ccacaugggccacggcgc

SEQ ID NO: 982359 - RNA, 19 nt, Mycobacterium avium subsp. paratuberculosis
ccacauacgcggcggccug

SEQ ID NO: 982360 - RNA, 23 nt, Mycobacterium avium subsp. paratuberculosis
ccacauuggcgaccgcggccgcg

SEQ ID NO: 982361 - RNA, 15 nt, Mycobacterium avium subsp. paratuberculosis
ccaccaacagcagcg

SEQ ID NO: 982362 - RNA, 20 nt, Mycobacterium avium subsp. paratuberculosis
ccaccaacaucgacgugccg

SEQ ID NO: 982363 - RNA, 19 nt, Mycobacterium avium subsp. paratuberculosis
ccaccaaggucuccgggcu

SEQ ID NO: 982364 - RNA, 13 nt, Mycobacterium avium subsp. paratuberculosis
ccaccaacgccac

SEQ ID NO: 982365 - RNA, 14 nt, Mycobacterium avium subsp. paratuberculosis
ccaccaacggcagc

SEQ ID NO: 982366 - RNA, 21 nt, Mycobacterium avium subsp. paratuberculosis
ccaccacauucccgccgccgc

SEQ ID NO: 982367 - RNA, 17 nt, Mycobacterium avium subsp. paratuberculosis
ccaccaccacggccagg

SEQ ID NO: 982368 - RNA, 12 nt, Mycobacterium avium subsp. paratuberculosis
ccaccacccggc

SEQ ID NO: 982369 - RNA, 13 nt, Mycobacterium avium subsp. paratuberculosis
ccaccaccagcgg

SEQ ID NO: 982370 - RNA, 11 nt, Mycobacterium avium subsp. paratuberculosis
ccaccaccaug

SEQ ID NO: 982371 - RNA, 12 nt, Mycobacterium avium subsp. paratuberculosis
ccaccaccggcu

SEQ ID NO: 982372 - RNA, 13 nt, Mycobacterium avium subsp. paratuberculosis
ccaccaccgccac

SEQ ID NO: 982373 - RNA, 18 nt, Mycobacterium avium subsp. paratuberculosis
ccaccaccgccaccagcg

SEQ ID NO: 982374 - RNA, 21 nt, Mycobacterium avium subsp. paratuberculosis
ccaccaccgagguggcccagc

SEQ ID NO: 982375 - RNA, 19 nt, Mycobacterium avium subsp. paratuberculosis
ccaccauggcuuccgccga

SEQ ID NO: 982376 - RNA, 15 nt, Mycobacterium avium subsp. paratuberculosis
ccaccaugucggcgu

SEQ ID NO: 982377 - RNA, 17 nt, Mycobacterium avium subsp. paratuberculosis
ccaccaugucggcgucg

SEQ ID NO: 982378 - RNA, 15 nt, Mycobacterium avium subsp. paratuberculosis
ccacccacucccagc

SEQ ID NO: 982379 - RNA, 12 nt, Mycobacterium avium subsp. paratuberculosis
ccacccaggugu

SEQ ID NO: 982380 - RNA, 20 nt, Mycobacterium avium subsp. paratuberculosis
ccacccagguguccggcccg

SEQ ID NO: 982381 - RNA, 19 nt, Mycobacterium avium subsp. paratuberculosis
ccaccaucaggccggccug

SEQ ID NO: 982382 - RNA, 15 nt, Mycobacterium avium subsp. paratuberculosis
ccaccaucccgccgc

SEQ ID NO: 982383 - RNA, 23 nt, Mycobacterium avium subsp. paratuberculosis
ccaccaucccgccgccgaacagc

SEQ ID NO: 982384 - RNA, 20 nt, Mycobacterium avium subsp. paratuberculosis
ccaccagugucagggcagcg

SEQ ID NO: 982385 - RNA, 17 nt, Mycobacterium avium subsp. paratuberculosis
ccaccaguuccaccagu

SEQ ID NO: 982386 - RNA, 14 nt, Mycobacterium avium subsp. paratuberculosis
ccaccaggggcagc

SEQ ID NO: 982387 - RNA, 13 nt, Mycobacterium avium subsp. paratuberculosis
ccaccaguaacac

SEQ ID NO: 982388 - RNA, 21 nt, Mycobacterium avium subsp. paratuberculosis
ccaccaggucuccgucggcgc

SEQ ID NO: 982389 - RNA, 23 nt, Mycobacterium avium subsp. paratuberculosis
ccaccagguaggcgaccaugccc

SEQ ID NO: 982390 - RNA, 11 nt, Mycobacterium avium subsp. paratuberculosis
ccaccaggcug

SEQ ID NO: 982391 - RNA, 17 nt, Mycobacterium avium subsp. paratuberculosis
ccaccagggacaugccg

SEQ ID NO: 982392 - RNA, 11 nt, Mycobacterium avium subsp. paratuberculosis
ccaccagcacc

SEQ ID NO: 982393 - RNA, 18 nt, Mycobacterium avium subsp. paratuberculosis
ccaccacgugccccuccu

SEQ ID NO: 982394 - RNA, 19 nt, Mycobacterium avium subsp. paratuberculosis
ccaccacgugccccuccuc

SEQ ID NO: 982395 - RNA, 20 nt, Mycobacterium avium subsp. paratuberculosis
ccaccacgacgacguggugg

SEQ ID NO: 982396 - RNA, 23 nt, Mycobacterium avium subsp. paratuberculosis
ccaccacgacgccgggcgcccgc

SEQ ID NO: 982397 - RNA, 14 nt, Mycobacterium avium subsp. paratuberculosis
ccaccacggcgucg

SEQ ID NO: 982398 - RNA, 22 nt, Mycobacterium avium subsp. paratuberculosis
ccaccacgggucggucggcccg

SEQ ID NO: 982399 - RNA, 23 nt, Mycobacterium avium subsp. paratuberculosis
ccaccacgguggcgccggcaucg

SEQ ID NO: 982400 - RNA, 13 nt, Mycobacterium avium subsp. paratuberculosis
ccaccacggccgc

SEQ ID NO: 982401 - RNA, 14 nt, Mycobacterium avium subsp. paratuberculosis
ccaccacggccgcc

SEQ ID NO: 982402 - RNA, 21 nt, Mycobacterium avium subsp. paratuberculosis
ccaccagcgcacacagcagca

SEQ ID NO: 982403 - RNA, 14 nt, Mycobacterium avium subsp. paratuberculosis
ccaccagccggccg

SEQ ID NO: 982404 - RNA, 16 nt, Mycobacterium avium subsp. paratuberculosis
ccaccagcgcccgccc

SEQ ID NO: 982405 - RNA, 16 nt, Mycobacterium avium subsp. paratuberculosis
ccaccagcggccgucg

SEQ ID NO: 982406 - RNA, 19 nt, Mycobacterium avium subsp. paratuberculosis
ccaccagcgggcugugccg

SEQ ID NO: 982407 - RNA, 19 nt, Mycobacterium avium subsp. paratuberculosis
ccaccagcgcggccaccac

SEQ ID NO: 982408 - RNA, 15 nt, Mycobacterium avium subsp. paratuberculosis
ccaccguguucacca

SEQ ID NO: 982409 - RNA, 19 nt, Mycobacterium avium subsp. paratuberculosis
ccaccguguucaccagcgg

SEQ ID NO: 982410 - RNA, 21 nt, Mycobacterium avium subsp. paratuberculosis
ccaccgugccgucgcgggcgu

SEQ ID NO: 982411 - RNA, 17 nt, Mycobacterium avium subsp. paratuberculosis
ccaccgugcuggccacc

SEQ ID NO: 982412 - RNA, 16 nt, Mycobacterium avium subsp. paratuberculosis
ccaccguggccccagc

SEQ ID NO: 982413 - RNA, 19 nt, Mycobacterium avium subsp. paratuberculosis
ccaccguggccccagccac

SEQ ID NO: 982414 - RNA, 21 nt, Mycobacterium avium subsp. paratuberculosis
ccaccgucgccacgaucacca

SEQ ID NO: 982415 - RNA, 17 nt, Mycobacterium avium subsp. paratuberculosis
ccaccgucuucggggcc

SEQ ID NO: 982416 - RNA, 21 nt, Mycobacterium avium subsp. paratuberculosis
ccaccgucuucggggccgccg

SEQ ID NO: 982417 - RNA, 20 nt, Mycobacterium avium subsp. paratuberculosis
ccaccgagauguaucugcgg

SEQ ID NO: 982418 - RNA, 21 nt, Mycobacterium avium subsp. paratuberculosis
ccaccgagccggcgucgccgc

SEQ ID NO: 982419 - RNA, 17 nt, Mycobacterium avium subsp. paratuberculosis
ccaccgagccggugccg

SEQ ID NO: 982420 - RNA, 18 nt, Mycobacterium avium subsp. paratuberculosis
ccaccgaggccagcagau

SEQ ID NO: 982421 - RNA, 16 nt, Mycobacterium avium subsp. paratuberculosis
ccaccgucaccgccgc

SEQ ID NO: 982422 - RNA, 19 nt, Mycobacterium avium subsp. paratuberculosis
ccaccgacaccaccggccg

SEQ ID NO: 982423 - RNA, 20 nt, Mycobacterium avium subsp. paratuberculosis
ccaccgacaccaccggccgc

SEQ ID NO: 982424 - RNA, 20 nt, Mycobacterium avium subsp. paratuberculosis
ccaccgacagcacccggccc

SEQ ID NO: 982425 - RNA, 15 nt, Mycobacterium avium subsp. paratuberculosis
ccaccgaccccugca

SEQ ID NO: 982426 - RNA, 18 nt, Mycobacterium avium subsp. paratuberculosis
ccacccguuggcaggccc

SEQ ID NO: 982427 - RNA, 12 nt, Mycobacterium avium subsp. paratuberculosis
ccacccucacca

SEQ ID NO: 982428 - RNA, 16 nt, Mycobacterium avium subsp. paratuberculosis
ccaccccgaacccggc

SEQ ID NO: 982429 - RNA, 14 nt, Mycobacterium avium subsp. paratuberculosis
ccaccccgagcagg

SEQ ID NO: 982430 - RNA, 17 nt, Mycobacterium avium subsp. paratuberculosis
ccaccccgaucggggcc

SEQ ID NO: 982431 - RNA, 16 nt, Mycobacterium avium subsp. paratuberculosis
ccaccuugucaccgaa

SEQ ID NO: 982432 - RNA, 18 nt, Mycobacterium avium subsp. paratuberculosis
ccacgaggcugugggcca

SEQ ID NO: 982433 - RNA, 21 nt, Mycobacterium avium subsp. paratuberculosis
ccacgaggcugugggccagca

SEQ ID NO: 982434 - RNA, 16 nt, Mycobacterium avium subsp. paratuberculosis
ccacgaacaccggcgc

SEQ ID NO: 982435 - RNA, 12 nt, Mycobacterium avium subsp. paratuberculosis
ccacgagcccag

SEQ ID NO: 982436 - RNA, 13 nt, Mycobacterium avium subsp. paratuberculosis
ccacgagcccagc

SEQ ID NO: 982437 - RNA, 13 nt, Mycobacterium avium subsp. paratuberculosis
ccacgagccgguc

SEQ ID NO: 982438 - RNA, 20 nt, Mycobacterium avium subsp. paratuberculosis
ccacgaguaaccggugcgcu

SEQ ID NO: 982439 - RNA, 13 nt, Mycobacterium avium subsp. paratuberculosis
ccacgaucaccac

SEQ ID NO: 982440 - RNA, 22 nt, Mycobacterium avium subsp. paratuberculosis
ccacgaucaccaccaccgccgu

SEQ ID NO: 982441 - RNA, 23 nt, Mycobacterium avium subsp. paratuberculosis
ccacgauccgcgcggccaccagc

SEQ ID NO: 982442 - RNA, 17 nt, Mycobacterium avium subsp. paratuberculosis
ccacgaucgcggccagc

SEQ ID NO: 982443 - RNA, 18 nt, Mycobacterium avium subsp. paratuberculosis
ccacgaucgcggccagcg

SEQ ID NO: 982444 - RNA, 16 nt, Mycobacterium avium subsp. paratuberculosis
ccaccucgaucagcgg

SEQ ID NO: 982445 - RNA, 24 nt, Mycobacterium avium subsp. paratuberculosis
ccaccucgcgggcgaccuggugcu

SEQ ID NO: 982446 - RNA, 23 nt, Mycobacterium avium subsp. paratuberculosis
ccaccucggcgacgauggccagg

SEQ ID NO: 982447 - RNA, 16 nt, Mycobacterium avium subsp. paratuberculosis
ccaccucggcgaucug

SEQ ID NO: 982448 - RNA, 22 nt, Mycobacterium avium subsp. paratuberculosis
ccaccucggcggcaccgcccgg

SEQ ID NO: 982449 - RNA, 21 nt, Mycobacterium avium subsp. paratuberculosis
ccaccucgggcauuggcagcu

SEQ ID NO: 982450 - RNA, 15 nt, Mycobacterium avium subsp. paratuberculosis
ccaccucgggccggg

SEQ ID NO: 982451 - RNA, 23 nt, Mycobacterium avium subsp. paratuberculosis
ccaccucgggccgggcgggcacc

SEQ ID NO: 982452 - RNA, 19 nt, Mycobacterium avium subsp. paratuberculosis
ccaccuccccgcggugccg

SEQ ID NO: 982453 - RNA, 20 nt, Mycobacterium avium subsp. paratuberculosis
ccaccuuggacaggcccagc

SEQ ID NO: 982454 - RNA, 15 nt, Mycobacterium avium subsp. paratuberculosis
ccaccuucaccgcgc

SEQ ID NO: 982455 - RNA, 22 nt, Mycobacterium avium subsp. paratuberculosis
ccaccucgguggacgccgcgca

SEQ ID NO: 982456 - RNA, 16 nt, Mycobacterium avium subsp. paratuberculosis
ccacgcccuggccgcc

SEQ ID NO: 982457 - RNA, 23 nt, Mycobacterium avium subsp. paratuberculosis
ccacgcccuggccgccggccgcg

SEQ ID NO: 982458 - RNA, 18 nt, Mycobacterium avium subsp. paratuberculosis
ccacgcccagggcgccag

SEQ ID NO: 982459 - RNA, 14 nt, Mycobacterium avium subsp. paratuberculosis
ccacgcccaccggu

SEQ ID NO: 982460 - RNA, 16 nt, Mycobacterium avium subsp. paratuberculosis
ccacgccccauugccg

SEQ ID NO: 982461 - RNA, 20 nt, Mycobacterium avium subsp. paratuberculosis
ccacgccaugugccggcgcu

SEQ ID NO: 982462 - RNA, 20 nt, Mycobacterium avium subsp. paratuberculosis
ccacgcugagcaaccgccga

SEQ ID NO: 982463 - RNA, 13 nt, Mycobacterium avium subsp. paratuberculosis
ccacgcuggcccc

SEQ ID NO: 982464 - RNA, 16 nt, Mycobacterium avium subsp. paratuberculosis
ccacgcuguagggcca

SEQ ID NO: 982465 - RNA, 17 nt, Mycobacterium avium subsp. paratuberculosis
ccacgcuguagggccac

SEQ ID NO: 982466 - RNA, 18 nt, Mycobacterium avium subsp. paratuberculosis
ccacgcuguagggccacc

SEQ ID NO: 982467 - RNA, 15 nt, Mycobacterium avium subsp. paratuberculosis
ccacggagcgcccgg

SEQ ID NO: 982468 - RNA, 16 nt, Mycobacterium avium subsp. paratuberculosis
ccacggucacagccgc

SEQ ID NO: 982469 - RNA, 22 nt, Mycobacterium avium subsp. paratuberculosis
ccacggucaccccgaguucggc

SEQ ID NO: 982470 - RNA, 21 nt, Mycobacterium avium subsp. paratuberculosis
ccacggucagcgcgucggcga

SEQ ID NO: 982471 - RNA, 21 nt, Mycobacterium avium subsp. paratuberculosis
ccacggucagggccagcaaca

SEQ ID NO: 982472 - RNA, 19 nt, Mycobacterium avium subsp. paratuberculosis
ccacgguccccgcgcccgc

SEQ ID NO: 982473 - RNA, 23 nt, Mycobacterium avium subsp. paratuberculosis
ccacgggucgccgaucucggcca

SEQ ID NO: 982474 - RNA, 18 nt, Mycobacterium avium subsp. paratuberculosis
ccacgguggcguccagcg

SEQ ID NO: 982475 - RNA, 22 nt, Mycobacterium avium subsp. paratuberculosis
ccacgguggugucgucgggccg

SEQ ID NO: 982476 - RNA, 13 nt, Mycobacterium avium subsp. paratuberculosis
ccacggucggcgg

SEQ ID NO: 982477 - RNA, 19 nt, Mycobacterium avium subsp. paratuberculosis
ccacggugaacgggccgca

SEQ ID NO: 982478 - RNA, 17 nt, Mycobacterium avium subsp. paratuberculosis
ccacggugaucucgccg

SEQ ID NO: 982479 - RNA, 23 nt, Mycobacterium avium subsp. paratuberculosis
ccacggcggggucaagcggcaga

SEQ ID NO: 982480 - RNA, 15 nt, Mycobacterium avium subsp. paratuberculosis
ccacgggccaugucc

SEQ ID NO: 982481 - RNA, 15 nt, Mycobacterium avium subsp. paratuberculosis
ccacggggcgccgcu

SEQ ID NO: 982482 - RNA, 15 nt, Mycobacterium avium subsp. paratuberculosis
ccacggcaccgccgc

SEQ ID NO: 982483 - RNA, 13 nt, Mycobacterium avium subsp. paratuberculosis
ccacggccccagc

SEQ ID NO: 982484 - RNA, 15 nt, Mycobacterium avium subsp. paratuberculosis
ccacggccaccgccg

SEQ ID NO: 982485 - RNA, 19 nt, Mycobacterium avium subsp. paratuberculosis
ccacggccagcaccgccag

SEQ ID NO: 982486 - RNA, 13 nt, Mycobacterium avium subsp. paratuberculosis
ccacggccggcaa

SEQ ID NO: 982487 - RNA, 23 nt, Mycobacterium avium subsp. paratuberculosis
ccaauucuucggcgugucgggug

SEQ ID NO: 982488 - RNA, 19 nt, Mycobacterium avium subsp. paratuberculosis
ccaauuacgcugcggcgcc

SEQ ID NO: 982489 - RNA, 16 nt, Mycobacterium avium subsp. paratuberculosis
ccaauggcggccacga

SEQ ID NO: 982490 - RNA, 20 nt, Mycobacterium avium subsp. paratuberculosis
ccacaacagguucgacagcg

SEQ ID NO: 982491 - RNA, 22 nt, Mycobacterium avium subsp. paratuberculosis
ccacacgggugugacauccccg

SEQ ID NO: 982492 - RNA, 16 nt, Mycobacterium avium subsp. paratuberculosis
ccacacccgcacgcug

SEQ ID NO: 982493 - RNA, 13 nt, Mycobacterium avium subsp. paratuberculosis
ccacacccgcggc

SEQ ID NO: 982494 - RNA, 16 nt, Mycobacterium avium subsp. paratuberculosis
ccacacccgcggccgc

SEQ ID NO: 982495 - RNA, 23 nt, Mycobacterium avium subsp. paratuberculosis
ccacacccgcggccgcugcgccc

SEQ ID NO: 982496 - RNA, 15 nt, Mycobacterium avium subsp. paratuberculosis
ccacaccguggagac

SEQ ID NO: 982497 - RNA, 12 nt, Mycobacterium avium subsp. paratuberculosis
ccacaccgccgg

SEQ ID NO: 982498 - RNA, 17 nt, Mycobacterium avium subsp. paratuberculosis
ccacaccgccggccacg

SEQ ID NO: 982499 - RNA, 20 nt, Mycobacterium avium subsp. paratuberculosis
ccacaccgaucagcaugccg

SEQ ID NO: 982500 - RNA, 16 nt, Mycobacterium avium subsp. paratuberculosis
ccacaggccgaacagc

SEQ ID NO: 982501 - RNA, 21 nt, Mycobacterium avium subsp. paratuberculosis
ccacagcuugccggagcccag

SEQ ID NO: 982502 - RNA, 17 nt, Mycobacterium avium subsp. paratuberculosis
ccacaggacguugaggc

SEQ ID NO: 982503 - RNA, 14 nt, Mycobacterium avium subsp. paratuberculosis
ccacagcaguuccg

SEQ ID NO: 982504 - RNA, 14 nt, Mycobacterium avium subsp. paratuberculosis
ccacagcagcacca

SEQ ID NO: 982505 - RNA, 19 nt, Mycobacterium avium subsp. paratuberculosis
ccacagccgcauguugugc

SEQ ID NO: 982506 - RNA, 15 nt, Mycobacterium avium subsp. paratuberculosis
ccacagccggcggcu

SEQ ID NO: 982507 - RNA, 15 nt, Mycobacterium avium subsp. paratuberculosis
ccacagcgguucggc

SEQ ID NO: 982508 - RNA, 22 nt, Mycobacterium avium subsp. paratuberculosis
ccacagcgucaauacgucacgg

SEQ ID NO: 982509 - RNA, 23 nt, Mycobacterium avium subsp. paratuberculosis
ccacagcgucaauacgucacggu

SEQ ID NO: 982510 - RNA, 14 nt, Mycobacterium avium subsp. paratuberculosis
ccacagcgccagca

SEQ ID NO: 982511 - RNA, 19 nt, Mycobacterium avium subsp. paratuberculosis
ccacagcgccagcacggcc

SEQ ID NO: 982512 - RNA, 16 nt, Mycobacterium avium subsp. paratuberculosis
ccacagcugccggccg

SEQ ID NO: 982513 - RNA, 17 nt, Mycobacterium avium subsp. paratuberculosis
ccacagcugccggccgu

SEQ ID NO: 982514 - RNA, 17 nt, Mycobacterium avium subsp. paratuberculosis
ccacagcucgggcagcg

SEQ ID NO: 982515 - RNA, 15 nt, Mycobacterium avium subsp. paratuberculosis
ccaaugaaauucagg

SEQ ID NO: 982516 - RNA, 17 nt, Mycobacterium avium subsp. paratuberculosis
ccaagcguauccggcca

SEQ ID NO: 982517 - RNA, 22 nt, Mycobacterium avium subsp. paratuberculosis
ccaagccgggcggcagcagcug

SEQ ID NO: 982518 - RNA, 16 nt, Mycobacterium avium subsp. paratuberculosis
ccaagaaccaacugag

SEQ ID NO: 982519 - RNA, 19 nt, Mycobacterium avium subsp. paratuberculosis
ccaaggagaaggccgcgcg

SEQ ID NO: 982520 - RNA, 15 nt, Mycobacterium avium subsp. paratuberculosis
ccaaggccagcaacc

SEQ ID NO: 982521 - RNA, 17 nt, Mycobacterium avium subsp. paratuberculosis
ccaaggcaaucaggcgg

SEQ ID NO: 982522 - RNA, 19 nt, Mycobacterium avium subsp. paratuberculosis
ccaacaacuacgagcagca

SEQ ID NO: 982523 - RNA, 12 nt, Mycobacterium avium subsp. paratuberculosis
ccaacagcagca

SEQ ID NO: 982524 - RNA, 12 nt, Mycobacterium avium subsp. paratuberculosis
ccaacccgggcg

SEQ ID NO: 982525 - RNA, 19 nt, Mycobacterium avium subsp. paratuberculosis
ccaacccgaucggcccggc

SEQ ID NO: 982526 - RNA, 14 nt, Mycobacterium avium subsp. paratuberculosis
ccaaccgcccggcg

SEQ ID NO: 982527 - RNA, 13 nt, Mycobacterium avium subsp. paratuberculosis
ccaaccaccgugg

SEQ ID NO: 982528 - RNA, 16 nt, Mycobacterium avium subsp. paratuberculosis
ccaaccaccguggccc

SEQ ID NO: 982529 - RNA, 13 nt, Mycobacterium avium subsp. paratuberculosis
ccaacuccggcgg

SEQ ID NO: 982530 - RNA, 15 nt, Mycobacterium avium subsp. paratuberculosis
ccaacucgaccugcc

SEQ ID NO: 982531 - RNA, 15 nt, Mycobacterium avium subsp. paratuberculosis
ccaacugcagcaacg

SEQ ID NO: 982532 - RNA, 21 nt, Mycobacterium avium subsp. paratuberculosis
ccaacugcaucgccagcacau

SEQ ID NO: 982533 - RNA, 18 nt, Mycobacterium avium subsp. paratuberculosis
ccaacguggguggccccu

SEQ ID NO: 982534 - RNA, 16 nt, Mycobacterium avium subsp. paratuberculosis
ccaacggcagcagcac

SEQ ID NO: 982535 - RNA, 22 nt, Mycobacterium avium subsp. paratuberculosis
ccaacgccucgucgaccgcggc

SEQ ID NO: 982536 - RNA, 23 nt, Mycobacterium avium subsp. paratuberculosis
ccaacgcgaaggugaacgagauc

SEQ ID NO: 982537 - RNA, 21 nt, Mycobacterium avium subsp. paratuberculosis
ccaacgccacguagcagcaga

SEQ ID NO: 982538 - RNA, 19 nt, Mycobacterium avium subsp. paratuberculosis
ccaaaacgggcgaaacaag

SEQ ID NO: 982539 - RNA, 17 nt, Mycobacterium avium subsp. paratuberculosis
ccaaagccuacggcgcc

SEQ ID NO: 982540 - RNA, 19 nt, Mycobacterium avium subsp. paratuberculosis
cgaauuguucggccaccgc

SEQ ID NO: 982541 - RNA, 16 nt, Mycobacterium avium subsp. paratuberculosis
cgaauuguggcggccc

SEQ ID NO: 982542 - RNA, 21 nt, Mycobacterium avium subsp. paratuberculosis
cgacaagggccgggcgcuggc

SEQ ID NO: 982543 - RNA, 23 nt, Mycobacterium avium subsp. paratuberculosis
cgacaacguggugugcaccagcg

SEQ ID NO: 982544 - RNA, 14 nt, Mycobacterium avium subsp. paratuberculosis
cgacaacagcgccg

SEQ ID NO: 982545 - RNA, 15 nt, Mycobacterium avium subsp. paratuberculosis
cgacagcacccaggu

SEQ ID NO: 982546 - RNA, 18 nt, Mycobacterium avium subsp. paratuberculosis
cgacacgggccgcgccga

SEQ ID NO: 982547 - RNA, 18 nt, Mycobacterium avium subsp. paratuberculosis
cgacacguaggccgccug

SEQ ID NO: 982548 - RNA, 21 nt, Mycobacterium avium subsp. paratuberculosis
cgacacguaggccgccugccc

SEQ ID NO: 982549 - RNA, 22 nt, Mycobacterium avium subsp. paratuberculosis
cgacacgucgacacgccggccg

SEQ ID NO: 982550 - RNA, 18 nt, Mycobacterium avium subsp. paratuberculosis
cgacacguggaccgagcg

SEQ ID NO: 982551 - RNA, 15 nt, Mycobacterium avium subsp. paratuberculosis
cgacacgccggccgu

SEQ ID NO: 982552 - RNA, 16 nt, Mycobacterium avium subsp. paratuberculosis
cgacaccaccgcgcgc

SEQ ID NO: 982553 - RNA, 13 nt, Mycobacterium avium subsp. paratuberculosis
cgacaccaccgug

SEQ ID NO: 982554 - RNA, 15 nt, Mycobacterium avium subsp. paratuberculosis
cgacacccagcggcg

SEQ ID NO: 982555 - RNA, 20 nt, Mycobacterium avium subsp. paratuberculosis
cgacacccagcggcgcggcc

SEQ ID NO: 982556 - RNA, 21 nt, Mycobacterium avium subsp. paratuberculosis
cgacacccuucaucagcaccg

SEQ ID NO: 982557 - RNA, 17 nt, Mycobacterium avium subsp. paratuberculosis
cgacaccgcacggccca

SEQ ID NO: 982558 - RNA, 18 nt, Mycobacterium avium subsp. paratuberculosis
cgacaccgcacggcccau

SEQ ID NO: 982559 - RNA, 11 nt, Mycobacterium avium subsp. paratuberculosis
cgacaccgccc

SEQ ID NO: 982560 - RNA, 23 nt, Mycobacterium avium subsp. paratuberculosis
cgaauccuguugguagcccagga

SEQ ID NO: 982561 - RNA, 14 nt, Mycobacterium avium subsp. paratuberculosis
cgaauccgcgggcg

SEQ ID NO: 982562 - RNA, 21 nt, Mycobacterium avium subsp. paratuberculosis
cgaauacccgcccagcaccag

SEQ ID NO: 982563 - RNA, 20 nt, Mycobacterium avium subsp. paratuberculosis
cgaauacccuccgggcggca

SEQ ID NO: 982564 - RNA, 23 nt, Mycobacterium avium subsp. paratuberculosis
cgaauacccuucggccggcagcg

SEQ ID NO: 982565 - RNA, 14 nt, Mycobacterium avium subsp. paratuberculosis
cgaaucgccgagcu

SEQ ID NO: 982566 - RNA, 17 nt, Mycobacterium avium subsp. paratuberculosis
cgaaucguugagcacca

SEQ ID NO: 982567 - RNA, 17 nt, Mycobacterium avium subsp. paratuberculosis
cgaaugcgaugagcucg

SEQ ID NO: 982568 - RNA, 14 nt, Mycobacterium avium subsp. paratuberculosis
cgaauugcgcugca

SEQ ID NO: 982569 - RNA, 15 nt, Mycobacterium avium subsp. paratuberculosis
cgaagugaugcuguu

SEQ ID NO: 982570 - RNA, 18 nt, Mycobacterium avium subsp. paratuberculosis
cgaagugaugcuguuacc

SEQ ID NO: 982571 - RNA, 13 nt, Mycobacterium avium subsp. paratuberculosis
cgaagucgauccc

SEQ ID NO: 982572 - RNA, 17 nt, Mycobacterium avium subsp. paratuberculosis
cgaagucgccgcccggg

SEQ ID NO: 982573 - RNA, 15 nt, Mycobacterium avium subsp. paratuberculosis
cgaaguagucggcgu

SEQ ID NO: 982574 - RNA, 14 nt, Mycobacterium avium subsp. paratuberculosis
cgaaguccugcgcc

SEQ ID NO: 982575 - RNA, 13 nt, Mycobacterium avium subsp. paratuberculosis
cgaagucaucacc

SEQ ID NO: 982576 - RNA, 18 nt, Mycobacterium avium subsp. paratuberculosis
cgaaggucugcagcagcc

SEQ ID NO: 982577 - RNA, 15 nt, Mycobacterium avium subsp. paratuberculosis
cgaaggugcccgcau

SEQ ID NO: 982578 - RNA, 13 nt, Mycobacterium avium subsp. paratuberculosis
cgaaggugaucuu

SEQ ID NO: 982579 - RNA, 18 nt, Mycobacterium avium subsp. paratuberculosis
cgaaggugggcagcgcca

SEQ ID NO: 982580 - RNA, 22 nt, Mycobacterium avium subsp. paratuberculosis
cgaagguguccucgagcugcac

SEQ ID NO: 982581 - RNA, 16 nt, Mycobacterium avium subsp. paratuberculosis
cgaagguggcgccggu

SEQ ID NO: 982582 - RNA, 17 nt, Mycobacterium avium subsp. paratuberculosis
cgaagggaaaggcagca

SEQ ID NO: 982583 - RNA, 21 nt, Mycobacterium avium subsp. paratuberculosis
cgaagggaaaggcagcagcca

SEQ ID NO: 982584 - RNA, 13 nt, Mycobacterium avium subsp. paratuberculosis
cgaagccggcccc

SEQ ID NO: 982585 - RNA, 14 nt, Mycobacterium avium subsp. paratuberculosis
cgaagccggugccc

SEQ ID NO: 982586 - RNA, 15 nt, Mycobacterium avium subsp. paratuberculosis
cgaagcgcagcaccu

SEQ ID NO: 982587 - RNA, 21 nt, Mycobacterium avium subsp. paratuberculosis
cgaagccgccgcccucgguga

SEQ ID NO: 982588 - RNA, 13 nt, Mycobacterium avium subsp. paratuberculosis
cgaagcccgccgu

SEQ ID NO: 982589 - RNA, 11 nt, Mycobacterium avium subsp. paratuberculosis
cgaagccgaag

SEQ ID NO: 982590 - RNA, 21 nt, Mycobacterium avium subsp. paratuberculosis
cgaagcgcgaugcggcucacc

SEQ ID NO: 982591 - RNA, 13 nt, Mycobacterium avium subsp. paratuberculosis
cgaagcgcagcag

SEQ ID NO: 982592 - RNA, 18 nt, Mycobacterium avium subsp. paratuberculosis
cgaagcgggacugcagcg

SEQ ID NO: 982593 - RNA, 19 nt, Mycobacterium avium subsp. paratuberculosis
cgaaggcgugcucgaucgc

SEQ ID NO: 982594 - RNA, 14 nt, Mycobacterium avium subsp. paratuberculosis
cgaaggaggccagc

SEQ ID NO: 982595 - RNA, 21 nt, Mycobacterium avium subsp. paratuberculosis
cgaaggacaauucguuguagc

SEQ ID NO: 982596 - RNA, 20 nt, Mycobacterium avium subsp. paratuberculosis
cgaagcuggcgaacagcaga

SEQ ID NO: 982597 - RNA, 15 nt, Mycobacterium avium subsp. paratuberculosis
cgaagcucaucaccg

SEQ ID NO: 982598 - RNA, 18 nt, Mycobacterium avium subsp. paratuberculosis
cgaagcguuucagcaacc

SEQ ID NO: 982599 - RNA, 15 nt, Mycobacterium avium subsp. paratuberculosis
cgaagcggugcacca

SEQ ID NO: 982600 - RNA, 21 nt, Mycobacterium avium subsp. paratuberculosis
cgaacuacuucgucagcagcg

SEQ ID NO: 982601 - RNA, 13 nt, Mycobacterium avium subsp. paratuberculosis
cgaacucaggcgc

SEQ ID NO: 982602 - RNA, 21 nt, Mycobacterium avium subsp. paratuberculosis
cgaacucauggcgugcucgga

SEQ ID NO: 982603 - RNA, 20 nt, Mycobacterium avium subsp. paratuberculosis
cgaacuccacccugccgacc

SEQ ID NO: 982604 - RNA, 21 nt, Mycobacterium avium subsp. paratuberculosis
cgaacgucacggcgaggaugg

SEQ ID NO: 982605 - RNA, 18 nt, Mycobacterium avium subsp. paratuberculosis
cgaacgucgagcgcggcc

SEQ ID NO: 982606 - RNA, 15 nt, Mycobacterium avium subsp. paratuberculosis
cgaacgugcagcuuc

SEQ ID NO: 982607 - RNA, 16 nt, Mycobacterium avium subsp. paratuberculosis
cgaacgugcagcuucc

SEQ ID NO: 982608 - RNA, 15 nt, Mycobacterium avium subsp. paratuberculosis
cgaacgugcgcggcg

SEQ ID NO: 982609 - RNA, 15 nt, Mycobacterium avium subsp. paratuberculosis
cgaacggcaacggcg

SEQ ID NO: 982610 - RNA, 20 nt, Mycobacterium avium subsp. paratuberculosis
cgaacggguccuugccggcg

SEQ ID NO: 982611 - RNA, 17 nt, Mycobacterium avium subsp. paratuberculosis
cgaacgggugaccggcg

SEQ ID NO: 982612 - RNA, 20 nt, Mycobacterium avium subsp. paratuberculosis
cgaacgggugaccggcggcc

SEQ ID NO: 982613 - RNA, 14 nt, Mycobacterium avium subsp. paratuberculosis
cgaacuucagcgcg

SEQ ID NO: 982614 - RNA, 17 nt, Mycobacterium avium subsp. paratuberculosis
cgaacugcaccagcacg

SEQ ID NO: 982615 - RNA, 17 nt, Mycobacterium avium subsp. paratuberculosis
cgaacugcagccggcca

SEQ ID NO: 982616 - RNA, 17 nt, Mycobacterium avium subsp. paratuberculosis
cgaacugcaucaugucc

SEQ ID NO: 982617 - RNA, 14 nt, Mycobacterium avium subsp. paratuberculosis
cgaacugccggcau

SEQ ID NO: 982618 - RNA, 15 nt, Mycobacterium avium subsp. paratuberculosis
cgaagaaggcgugcg

SEQ ID NO: 982619 - RNA, 15 nt, Mycobacterium avium subsp. paratuberculosis
cgaagacggcgaggu

SEQ ID NO: 982620 - RNA, 20 nt, Mycobacterium avium subsp. paratuberculosis
cgaagacguacggaugcccc

SEQ ID NO: 982621 - RNA, 14 nt, Mycobacterium avium subsp. paratuberculosis
cgaagaucagcgcg

SEQ ID NO: 982622 - RNA, 17 nt, Mycobacterium avium subsp. paratuberculosis
cgaagaugaucagcgcg

SEQ ID NO: 982623 - RNA, 20 nt, Mycobacterium avium subsp. paratuberculosis
cgaagaugaucagcgcgccc

SEQ ID NO: 982624 - RNA, 12 nt, Mycobacterium avium subsp. paratuberculosis
cgaagaugcgcc

SEQ ID NO: 982625 - RNA, 14 nt, Mycobacterium avium subsp. paratuberculosis
cgaagauggccagc

SEQ ID NO: 982626 - RNA, 20 nt, Mycobacterium avium subsp. paratuberculosis
cgaagauggccagcgcggcg

SEQ ID NO: 982627 - RNA, 15 nt, Mycobacterium avium subsp. paratuberculosis
cgaagauggccagga

SEQ ID NO: 982628 - RNA, 18 nt, Mycobacterium avium subsp. paratuberculosis
cgaagcacgaccacaccc

SEQ ID NO: 982629 - RNA, 20 nt, Mycobacterium avium subsp. paratuberculosis
cgaagcacgaccacacccgc

SEQ ID NO: 982630 - RNA, 17 nt, Mycobacterium avium subsp. paratuberculosis
cgaagcagaacuucucc

SEQ ID NO: 982631 - RNA, 19 nt, Mycobacterium avium subsp. paratuberculosis
cgaagcagaacuucuccgc

SEQ ID NO: 982632 - RNA, 19 nt, Mycobacterium avium subsp. paratuberculosis
cgaagcagccuucuuggcg

SEQ ID NO: 982633 - RNA, 10 nt, Mycobacterium avium subsp. paratuberculosis
cgaagcccau

SEQ ID NO: 982634 - RNA, 15 nt, Mycobacterium avium subsp. paratuberculosis
cgacagucccgcguu

SEQ ID NO: 982635 - RNA, 21 nt, Mycobacterium avium subsp. paratuberculosis
cgacaggaggguuuucggggc

SEQ ID NO: 982636 - RNA, 15 nt, Mycobacterium avium subsp. paratuberculosis
cgacagggccagcgc

SEQ ID NO: 982637 - RNA, 20 nt, Mycobacterium avium subsp. paratuberculosis
cgacagggugccgaacagcg

SEQ ID NO: 982638 - RNA, 23 nt, Mycobacterium avium subsp. paratuberculosis
cgacagguagcaggcgcgcagca

SEQ ID NO: 982639 - RNA, 22 nt, Mycobacterium avium subsp. paratuberculosis
cgacagccaaacagguuggcgc

SEQ ID NO: 982640 - RNA, 16 nt, Mycobacterium avium subsp. paratuberculosis
cgacagcccccgcagc

SEQ ID NO: 982641 - RNA, 14 nt, Mycobacterium avium subsp. paratuberculosis
cgacagcccgccca

SEQ ID NO: 982642 - RNA, 15 nt, Mycobacterium avium subsp. paratuberculosis
cgacagccgcaccag

SEQ ID NO: 982643 - RNA, 19 nt, Mycobacterium avium subsp. paratuberculosis
cgacagccggucgcgcauc

SEQ ID NO: 982644 - RNA, 22 nt, Mycobacterium avium subsp. paratuberculosis
cgacaggaaccuggucggggug

SEQ ID NO: 982645 - RNA, 15 nt, Mycobacterium avium subsp. paratuberculosis
cgacaggcagcccgg

SEQ ID NO: 982646 - RNA, 16 nt, Mycobacterium avium subsp. paratuberculosis
cgacagcuccaacagc

SEQ ID NO: 982647 - RNA, 15 nt, Mycobacterium avium subsp. paratuberculosis
cgacagcucgcgcug

SEQ ID NO: 982648 - RNA, 14 nt, Mycobacterium avium subsp. paratuberculosis
cgacagcgccugcc

SEQ ID NO: 982649 - RNA, 15 nt, Mycobacterium avium subsp. paratuberculosis
cgaccaacgggcggc

SEQ ID NO: 982650 - RNA, 16 nt, Mycobacterium avium subsp. paratuberculosis
cgacaucugccgggcg

SEQ ID NO: 982651 - RNA, 20 nt, Mycobacterium avium subsp. paratuberculosis
cgacaugaccaccgcgucgg

SEQ ID NO: 982652 - RNA, 23 nt, Mycobacterium avium subsp. paratuberculosis
cgacaugcccgcggugcagucgg

SEQ ID NO: 982653 - RNA, 22 nt, Mycobacterium avium subsp. paratuberculosis
cgacaugcugggcuaccagccc

SEQ ID NO: 982654 - RNA, 14 nt, Mycobacterium avium subsp. paratuberculosis
cgacaucgccgcgg

SEQ ID NO: 982655 - RNA, 17 nt, Mycobacterium avium subsp. paratuberculosis
cgacaucgccgcggccg

SEQ ID NO: 982656 - RNA, 14 nt, Mycobacterium avium subsp. paratuberculosis
cgacaucgcggcga

SEQ ID NO: 982657 - RNA, 16 nt, Mycobacterium avium subsp. paratuberculosis
cgacaucggccgccuu

SEQ ID NO: 982658 - RNA, 18 nt, Mycobacterium avium subsp. paratuberculosis
cgaccaaugcccugaccc

SEQ ID NO: 982659 - RNA, 14 nt, Mycobacterium avium subsp. paratuberculosis
cgaccacagcgccu

SEQ ID NO: 982660 - RNA, 15 nt, Mycobacterium avium subsp. paratuberculosis
cgaccacccggacga

SEQ ID NO: 982661 - RNA, 19 nt, Mycobacterium avium subsp. paratuberculosis
cgaccaccacggccgcagc

SEQ ID NO: 982662 - RNA, 17 nt, Mycobacterium avium subsp. paratuberculosis
cgaccaccaggagcacc

SEQ ID NO: 982663 - RNA, 14 nt, Mycobacterium avium subsp. paratuberculosis
cgaccaccggccga

SEQ ID NO: 982664 - RNA, 19 nt, Mycobacterium avium subsp. paratuberculosis
cgaccaccuugcgcagcag

SEQ ID NO: 982665 - RNA, 16 nt, Mycobacterium avium subsp. paratuberculosis
cgaccacggccccagc

SEQ ID NO: 982666 - RNA, 16 nt, Mycobacterium avium subsp. paratuberculosis
cgaccacggccggucc

SEQ ID NO: 982667 - RNA, 17 nt, Mycobacterium avium subsp. paratuberculosis
cgaccacguccagcugg

SEQ ID NO: 982668 - RNA, 16 nt, Mycobacterium avium subsp. paratuberculosis
cgaccacgccgcgcuu

SEQ ID NO: 982669 - RNA, 15 nt, Mycobacterium avium subsp. paratuberculosis
cgaccagauugcggc

SEQ ID NO: 982670 - RNA, 17 nt, Mycobacterium avium subsp. paratuberculosis
cgaccagcgcgccgccc

SEQ ID NO: 982671 - RNA, 18 nt, Mycobacterium avium subsp. paratuberculosis
cgaccagcgcgccggcca

SEQ ID NO: 982672 - RNA, 19 nt, Mycobacterium avium subsp. paratuberculosis
cgaccagcgggccgacagc

SEQ ID NO: 982673 - RNA, 18 nt, Mycobacterium avium subsp. paratuberculosis
cgaccagcggucgggugc

SEQ ID NO: 982674 - RNA, 18 nt, Mycobacterium avium subsp. paratuberculosis
cgaccagcggcagcagca

SEQ ID NO: 982675 - RNA, 16 nt, Mycobacterium avium subsp. paratuberculosis
cgaccagcuccuggaa

SEQ ID NO: 982676 - RNA, 20 nt, Mycobacterium avium subsp. paratuberculosis
cgaccagcuguugucccgga

SEQ ID NO: 982677 - RNA, 19 nt, Mycobacterium avium subsp. paratuberculosis
cgaccagcgccgagaccag

SEQ ID NO: 982678 - RNA, 14 nt, Mycobacterium avium subsp. paratuberculosis
cgaccagccggugg

SEQ ID NO: 982679 - RNA, 16 nt, Mycobacterium avium subsp. paratuberculosis
cgaccagcccggccgc

SEQ ID NO: 982680 - RNA, 13 nt, Mycobacterium avium subsp. paratuberculosis
cgacccccgccgc

SEQ ID NO: 982681 - RNA, 15 nt, Mycobacterium avium subsp. paratuberculosis
cgaccccggccagga

SEQ ID NO: 982682 - RNA, 13 nt, Mycobacterium avium subsp. paratuberculosis
cgaccccggcggc

SEQ ID NO: 982683 - RNA, 23 nt, Mycobacterium avium subsp. paratuberculosis
cgaccccggcggcaccgccgcgg

SEQ ID NO: 982684 - RNA, 14 nt, Mycobacterium avium subsp. paratuberculosis
cgaccccgcccacg

SEQ ID NO: 982685 - RNA, 14 nt, Mycobacterium avium subsp. paratuberculosis
cgaccccgcccagc

SEQ ID NO: 982686 - RNA, 15 nt, Mycobacterium avium subsp. paratuberculosis
cgaccccgccggccc

SEQ ID NO: 982687 - RNA, 14 nt, Mycobacterium avium subsp. paratuberculosis
cgaccccuccaacg

SEQ ID NO: 982688 - RNA, 23 nt, Mycobacterium avium subsp. paratuberculosis
cgacccgagagcugcugccgccg

SEQ ID NO: 982689 - RNA, 17 nt, Mycobacterium avium subsp. paratuberculosis
cgacccgauccagacgg

SEQ ID NO: 982690 - RNA, 16 nt, Mycobacterium avium subsp. paratuberculosis
cgacccgcaccaccgc

SEQ ID NO: 982691 - RNA, 18 nt, Mycobacterium avium subsp. paratuberculosis
cgacccgcauccgccggg

SEQ ID NO: 982692 - RNA, 17 nt, Mycobacterium avium subsp. paratuberculosis
cgaccaggaacacggcu

SEQ ID NO: 982693 - RNA, 21 nt, Mycobacterium avium subsp. paratuberculosis
cgaccaggaacacggcucggg

SEQ ID NO: 982694 - RNA, 16 nt, Mycobacterium avium subsp. paratuberculosis
cgaccaggcuuggccc

SEQ ID NO: 982695 - RNA, 18 nt, Mycobacterium avium subsp. paratuberculosis
cgaccaggaugcccagga

SEQ ID NO: 982696 - RNA, 14 nt, Mycobacterium avium subsp. paratuberculosis
cgaccaggcccagc

SEQ ID NO: 982697 - RNA, 17 nt, Mycobacterium avium subsp. paratuberculosis
cgaccaggcccagcgga

SEQ ID NO: 982698 - RNA, 18 nt, Mycobacterium avium subsp. paratuberculosis
cgaccaggguuucaugca

SEQ ID NO: 982699 - RNA, 23 nt, Mycobacterium avium subsp. paratuberculosis
cgaccaggguuucaugcacggcg

SEQ ID NO: 982700 - RNA, 17 nt, Mycobacterium avium subsp. paratuberculosis
cgaccagguaggcgccc

SEQ ID NO: 982701 - RNA, 20 nt, Mycobacterium avium subsp. paratuberculosis
cgaccagguccgguucgacc

SEQ ID NO: 982702 - RNA, 20 nt, Mycobacterium avium subsp. paratuberculosis
cgaccaguaggccagcaucu

SEQ ID NO: 982703 - RNA, 15 nt, Mycobacterium avium subsp. paratuberculosis
cgaccaucagcgccc

SEQ ID NO: 982704 - RNA, 19 nt, Mycobacterium avium subsp. paratuberculosis
cgaccaucugccggcgcuu

SEQ ID NO: 982705 - RNA, 14 nt, Mycobacterium avium subsp. paratuberculosis
cgaccaugcccagc

SEQ ID NO: 982706 - RNA, 18 nt, Mycobacterium avium subsp. paratuberculosis
cgaccuucuuguccagga

SEQ ID NO: 982707 - RNA, 18 nt, Mycobacterium avium subsp. paratuberculosis
cgaccuugacccaggccc

SEQ ID NO: 982708 - RNA, 21 nt, Mycobacterium avium subsp. paratuberculosis
cgaccuugacccaggcccggg

SEQ ID NO: 982709 - RNA, 16 nt, Mycobacterium avium subsp. paratuberculosis
cgaccuuuugcccggc

SEQ ID NO: 982710 - RNA, 15 nt, Mycobacterium avium subsp. paratuberculosis
cgacgaacaccaccg

SEQ ID NO: 982711 - RNA, 20 nt, Mycobacterium avium subsp. paratuberculosis
cgacgaacgcggcggaggcc

SEQ ID NO: 982712 - RNA, 13 nt, Mycobacterium avium subsp. paratuberculosis
cgacgaacgcggu

SEQ ID NO: 982713 - RNA, 17 nt, Mycobacterium avium subsp. paratuberculosis
cgacgaagaaggacgcc

SEQ ID NO: 982714 - RNA, 23 nt, Mycobacterium avium subsp. paratuberculosis
cgacgaagauggcgugccacagc

SEQ ID NO: 982715 - RNA, 18 nt, Mycobacterium avium subsp. paratuberculosis
cgacgaccaccaggagca

SEQ ID NO: 982716 - RNA, 13 nt, Mycobacterium avium subsp. paratuberculosis
cgacgacgccagc

SEQ ID NO: 982717 - RNA, 19 nt, Mycobacterium avium subsp. paratuberculosis
cgacgacggcgaacgucga

SEQ ID NO: 982718 - RNA, 18 nt, Mycobacterium avium subsp. paratuberculosis
cgacgaagccggugccca

SEQ ID NO: 982719 - RNA, 14 nt, Mycobacterium avium subsp. paratuberculosis
cgacgacaccgugu

SEQ ID NO: 982720 - RNA, 21 nt, Mycobacterium avium subsp. paratuberculosis
cgacgacguugcgggccaggu

SEQ ID NO: 982721 - RNA, 17 nt, Mycobacterium avium subsp. paratuberculosis
cgacgacgucgacgacc

SEQ ID NO: 982722 - RNA, 14 nt, Mycobacterium avium subsp. paratuberculosis
cgacgagcgggccg

SEQ ID NO: 982723 - RNA, 13 nt, Mycobacterium avium subsp. paratuberculosis
cgacgagcccgcc

SEQ ID NO: 982724 - RNA, 16 nt, Mycobacterium avium subsp. paratuberculosis
cgacgagcccgcgccc

SEQ ID NO: 982725 - RNA, 17 nt, Mycobacterium avium subsp. paratuberculosis
cgacgagaucagcacca

SEQ ID NO: 982726 - RNA, 23 nt, Mycobacterium avium subsp. paratuberculosis
cgacgauguuggcgacgacggcg

SEQ ID NO: 982727 - RNA, 17 nt, Mycobacterium avium subsp. paratuberculosis
cgacgcaccacgagcag

SEQ ID NO: 982728 - RNA, 21 nt, Mycobacterium avium subsp. paratuberculosis
cgacgaucagcagccgggccu

SEQ ID NO: 982729 - RNA, 14 nt, Mycobacterium avium subsp. paratuberculosis
cgacgagccgggcc

SEQ ID NO: 982730 - RNA, 16 nt, Mycobacterium avium subsp. paratuberculosis
cgacgaggcgggcgau

SEQ ID NO: 982731 - RNA, 22 nt, Mycobacterium avium subsp. paratuberculosis
cgacgagguugucccgggcgaa

SEQ ID NO: 982732 - RNA, 20 nt, Mycobacterium avium subsp. paratuberculosis
cgacgauggcccggaccgcc

SEQ ID NO: 982733 - RNA, 17 nt, Mycobacterium avium subsp. paratuberculosis
cgacgaugucgacccgc

SEQ ID NO: 982734 - RNA, 15 nt, Mycobacterium avium subsp. paratuberculosis
cgacgaugcggggcg

SEQ ID NO: 982735 - RNA, 18 nt, Mycobacterium avium subsp. paratuberculosis
cgacgaucccggcgagca

SEQ ID NO: 982736 - RNA, 21 nt, Mycobacterium avium subsp. paratuberculosis
cgacgaucccggcgagcacgc

SEQ ID NO: 982737 - RNA, 16 nt, Mycobacterium avium subsp. paratuberculosis
cgacgauccgcgccgc

SEQ ID NO: 982738 - RNA, 19 nt, Mycobacterium avium subsp. paratuberculosis
cgacgauccgggccggucg

SEQ ID NO: 982739 - RNA, 22 nt, Mycobacterium avium subsp. paratuberculosis
cgacgaucgcgccggccgccgc

SEQ ID NO: 982740 - RNA, 17 nt, Mycobacterium avium subsp. paratuberculosis
cgacgaugaagacccgc

SEQ ID NO: 982741 - RNA, 15 nt, Mycobacterium avium subsp. paratuberculosis
cgacgccgcugggcg

SEQ ID NO: 982742 - RNA, 18 nt, Mycobacterium avium subsp. paratuberculosis
cgacgccggccaccaaca

SEQ ID NO: 982743 - RNA, 22 nt, Mycobacterium avium subsp. paratuberculosis
cgacgccggccaccaacagguc

SEQ ID NO: 982744 - RNA, 16 nt, Mycobacterium avium subsp. paratuberculosis
cgacgccgcugccggg

SEQ ID NO: 982745 - RNA, 17 nt, Mycobacterium avium subsp. paratuberculosis
cgacgccgcugccgggg

SEQ ID NO: 982746 - RNA, 18 nt, Mycobacterium avium subsp. paratuberculosis
cgacgccgaagaucagcg

SEQ ID NO: 982747 - RNA, 22 nt, Mycobacterium avium subsp. paratuberculosis
cgacgccgacaccagcgcgcac

SEQ ID NO: 982748 - RNA, 16 nt, Mycobacterium avium subsp. paratuberculosis
cgacgccgacggcaau

SEQ ID NO: 982749 - RNA, 22 nt, Mycobacterium avium subsp. paratuberculosis
cgacgccaacaacuacgagcag

SEQ ID NO: 982750 - RNA, 12 nt, Mycobacterium avium subsp. paratuberculosis
cgacgccagcgg

SEQ ID NO: 982751 - RNA, 16 nt, Mycobacterium avium subsp. paratuberculosis
cgacgccagcggcagc

SEQ ID NO: 982752 - RNA, 18 nt, Mycobacterium avium subsp. paratuberculosis
cgacgccagcggcagcgc

SEQ ID NO: 982753 - RNA, 19 nt, Mycobacterium avium subsp. paratuberculosis
cgacgccagcggcagcgcc

SEQ ID NO: 982754 - RNA, 18 nt, Mycobacterium avium subsp. paratuberculosis
cgacgcccaggugcaccc

SEQ ID NO: 982755 - RNA, 12 nt, Mycobacterium avium subsp. paratuberculosis
cgacgcccggcu

SEQ ID NO: 982756 - RNA, 15 nt, Mycobacterium avium subsp. paratuberculosis
cgacgcccugccaca

SEQ ID NO: 982757 - RNA, 21 nt, Mycobacterium avium subsp. paratuberculosis
cgacgcccugccacagcgaca

SEQ ID NO: 982758 - RNA, 20 nt, Mycobacterium avium subsp. paratuberculosis
cgacgcccuuggcgcccagc

SEQ ID NO: 982759 - RNA, 18 nt, Mycobacterium avium subsp. paratuberculosis
cgaccgucagcagggccu

SEQ ID NO: 982760 - RNA, 18 nt, Mycobacterium avium subsp. paratuberculosis
cgaccgucgggacggcca

SEQ ID NO: 982761 - RNA, 19 nt, Mycobacterium avium subsp. paratuberculosis
cgaccgucgggacggccag

SEQ ID NO: 982762 - RNA, 20 nt, Mycobacterium avium subsp. paratuberculosis
cgaccgucgggacggccagc

SEQ ID NO: 982763 - RNA, 18 nt, Mycobacterium avium subsp. paratuberculosis
cgaccgugaggcccggcg

SEQ ID NO: 982764 - RNA, 20 nt, Mycobacterium avium subsp. paratuberculosis
cgaccgugaggcccggcgug

SEQ ID NO: 982765 - RNA, 21 nt, Mycobacterium avium subsp. paratuberculosis
cgaccgguccgccgccggcgg

SEQ ID NO: 982766 - RNA, 20 nt, Mycobacterium avium subsp. paratuberculosis
cgaccgggucugccacgccc

SEQ ID NO: 982767 - RNA, 13 nt, Mycobacterium avium subsp. paratuberculosis
cgaccggggcgcc

SEQ ID NO: 982768 - RNA, 21 nt, Mycobacterium avium subsp. paratuberculosis
cgaccggguuggcgcgcacca

SEQ ID NO: 982769 - RNA, 14 nt, Mycobacterium avium subsp. paratuberculosis
cgaccggcucagcc

SEQ ID NO: 982770 - RNA, 18 nt, Mycobacterium avium subsp. paratuberculosis
cgaccggcucucagccgg

SEQ ID NO: 982771 - RNA, 17 nt, Mycobacterium avium subsp. paratuberculosis
cgaccucggcggccagc

SEQ ID NO: 982772 - RNA, 23 nt, Mycobacterium avium subsp. paratuberculosis
cgaccugggcggccaccgcgccc

SEQ ID NO: 982773 - RNA, 13 nt, Mycobacterium avium subsp. paratuberculosis
cgaccugcccggg

SEQ ID NO: 982774 - RNA, 21 nt, Mycobacterium avium subsp. paratuberculosis
cgaccugcgggcccaccgcgc

SEQ ID NO: 982775 - RNA, 15 nt, Mycobacterium avium subsp. paratuberculosis
cgaccgucuucuuca

SEQ ID NO: 982776 - RNA, 14 nt, Mycobacterium avium subsp. paratuberculosis
cgaccuccacccgc

SEQ ID NO: 982777 - RNA, 17 nt, Mycobacterium avium subsp. paratuberculosis
cgaccuccucgaccccg

SEQ ID NO: 982778 - RNA, 14 nt, Mycobacterium avium subsp. paratuberculosis
cgaccucgcgcguc

SEQ ID NO: 982779 - RNA, 15 nt, Mycobacterium avium subsp. paratuberculosis
cgaccucggccagcg

SEQ ID NO: 982780 - RNA, 17 nt, Mycobacterium avium subsp. paratuberculosis
cgacccgguagcgcagc

SEQ ID NO: 982781 - RNA, 18 nt, Mycobacterium avium subsp. paratuberculosis
cgacccugcguccggccc

SEQ ID NO: 982782 - RNA, 13 nt, Mycobacterium avium subsp. paratuberculosis
cgaccgacccggc

SEQ ID NO: 982783 - RNA, 18 nt, Mycobacterium avium subsp. paratuberculosis
cgacccggaugauguucu

SEQ ID NO: 982784 - RNA, 19 nt, Mycobacterium avium subsp. paratuberculosis
cgacccggaugauguucuc

SEQ ID NO: 982785 - RNA, 18 nt, Mycobacterium avium subsp. paratuberculosis
cgacccgcggcgccgcgg

SEQ ID NO: 982786 - RNA, 19 nt, Mycobacterium avium subsp. paratuberculosis
cgacccgcggcgccgcggc

SEQ ID NO: 982787 - RNA, 18 nt, Mycobacterium avium subsp. paratuberculosis
cgacccggcucuccaucu

SEQ ID NO: 982788 - RNA, 17 nt, Mycobacterium avium subsp. paratuberculosis
cgacccgggccgccacg

SEQ ID NO: 982789 - RNA, 13 nt, Mycobacterium avium subsp. paratuberculosis
cgacccgggccgc

SEQ ID NO: 982790 - RNA, 16 nt, Mycobacterium avium subsp. paratuberculosis
cgacccguuccccggc

SEQ ID NO: 982791 - RNA, 16 nt, Mycobacterium avium subsp. paratuberculosis
cgacccguuccggcga

SEQ ID NO: 982792 - RNA, 15 nt, Mycobacterium avium subsp. paratuberculosis
cgaccgcgcaccggc

SEQ ID NO: 982793 - RNA, 17 nt, Mycobacterium avium subsp. paratuberculosis
cgaccgcgacggcgccc

SEQ ID NO: 982794 - RNA, 21 nt, Mycobacterium avium subsp. paratuberculosis
cgaccgccucggauuccgcgg

SEQ ID NO: 982795 - RNA, 13 nt, Mycobacterium avium subsp. paratuberculosis
cgaccgccggugg

SEQ ID NO: 982796 - RNA, 15 nt, Mycobacterium avium subsp. paratuberculosis
cgaccgccagcagca

SEQ ID NO: 982797 - RNA, 15 nt, Mycobacterium avium subsp. paratuberculosis
cgaccgccgcggccg

SEQ ID NO: 982798 - RNA, 19 nt, Mycobacterium avium subsp. paratuberculosis
cgaccgccgcggccgccuu

SEQ ID NO: 982799 - RNA, 12 nt, Mycobacterium avium subsp. paratuberculosis
cgaccgcccggg

SEQ ID NO: 982800 - RNA, 15 nt, Mycobacterium avium subsp. paratuberculosis
cgaccgccaccaccc

SEQ ID NO: 982801 - RNA, 18 nt, Mycobacterium avium subsp. paratuberculosis
cgaccgccaccacccggc

SEQ ID NO: 982802 - RNA, 22 nt, Mycobacterium avium subsp. paratuberculosis
cgaccgccaccucgagcucacc

SEQ ID NO: 982803 - RNA, 19 nt, Mycobacterium avium subsp. paratuberculosis
cgaccggcaccagcagcca

SEQ ID NO: 982804 - RNA, 19 nt, Mycobacterium avium subsp. paratuberculosis
cgaccggcagcaccggccg

SEQ ID NO: 982805 - RNA, 15 nt, Mycobacterium avium subsp. paratuberculosis
cgaccggccccaacg

SEQ ID NO: 982806 - RNA, 22 nt, Mycobacterium avium subsp. paratuberculosis
cgaccggccccaacggcgugca

SEQ ID NO: 982807 - RNA, 20 nt, Mycobacterium avium subsp. paratuberculosis
cgaccgcggcuccggccgcg

SEQ ID NO: 982808 - RNA, 15 nt, Mycobacterium avium subsp. paratuberculosis
cgaaccccagcuccg

SEQ ID NO: 982809 - RNA, 20 nt, Mycobacterium avium subsp. paratuberculosis
cgaaccaguucgccaccacg

SEQ ID NO: 982810 - RNA, 22 nt, Mycobacterium avium subsp. paratuberculosis
cgaaccaguucgccaccacggu

SEQ ID NO: 982811 - RNA, 19 nt, Mycobacterium avium subsp. paratuberculosis
cgaacccgagcaccccggc

SEQ ID NO: 982812 - RNA, 15 nt, Mycobacterium avium subsp. paratuberculosis
cgaacccgccgcggc

SEQ ID NO: 982813 - RNA, 19 nt, Mycobacterium avium subsp. paratuberculosis
cgaacccggcggccccggu

SEQ ID NO: 982814 - RNA, 23 nt, Mycobacterium avium subsp. paratuberculosis
cgaaccgaucaccggcagcagcg

SEQ ID NO: 982815 - RNA, 18 nt, Mycobacterium avium subsp. paratuberculosis
cgaaccgggccaggauga

SEQ ID NO: 982816 - RNA, 18 nt, Mycobacterium avium subsp. paratuberculosis
cgaaccgggcgcgcagau

SEQ ID NO: 982817 - RNA, 13 nt, Mycobacterium avium subsp. paratuberculosis
cgaaccgccgcgc

SEQ ID NO: 982818 - RNA, 16 nt, Mycobacterium avium subsp. paratuberculosis
cgaaccgcgagcgcgc

SEQ ID NO: 982819 - RNA, 21 nt, Mycobacterium avium subsp. paratuberculosis
cgaaccgcggcggcagcagcc

SEQ ID NO: 982820 - RNA, 22 nt, Mycobacterium avium subsp. paratuberculosis
cgaaccgcggcggcagcagccc

SEQ ID NO: 982821 - RNA, 14 nt, Mycobacterium avium subsp. paratuberculosis
cgaaccgcucgaac

SEQ ID NO: 982822 - RNA, 22 nt, Mycobacterium avium subsp. paratuberculosis
cgaaccgcucgucgggaacgcc

SEQ ID NO: 982823 - RNA, 14 nt, Mycobacterium avium subsp. paratuberculosis
cgaacgacagcagg

SEQ ID NO: 982824 - RNA, 16 nt, Mycobacterium avium subsp. paratuberculosis
cgaaccuggcugccug

SEQ ID NO: 982825 - RNA, 13 nt, Mycobacterium avium subsp. paratuberculosis
cgaacgccaccac

SEQ ID NO: 982826 - RNA, 14 nt, Mycobacterium avium subsp. paratuberculosis
cgaacgccaccacc

SEQ ID NO: 982827 - RNA, 18 nt, Mycobacterium avium subsp. paratuberculosis
cgaacgccaccuucaccg

SEQ ID NO: 982828 - RNA, 19 nt, Mycobacterium avium subsp. paratuberculosis
cgaacgauggugugcagca

SEQ ID NO: 982829 - RNA, 20 nt, Mycobacterium avium subsp. paratuberculosis
cgaacgcaccaccgcgguga

SEQ ID NO: 982830 - RNA, 15 nt, Mycobacterium avium subsp. paratuberculosis
cgaacgccagcgccg

SEQ ID NO: 982831 - RNA, 17 nt, Mycobacterium avium subsp. paratuberculosis
cgaacggaccgggcggg

SEQ ID NO: 982832 - RNA, 16 nt, Mycobacterium avium subsp. paratuberculosis
cgaacgcugccaggcg

SEQ ID NO: 982833 - RNA, 17 nt, Mycobacterium avium subsp. paratuberculosis
cgaacgcggcgaagcag

SEQ ID NO: 982834 - RNA, 12 nt, Mycobacterium avium subsp. paratuberculosis
cgaacgcgguga

SEQ ID NO: 982835 - RNA, 19 nt, Mycobacterium avium subsp. paratuberculosis
cgaacgccucguuggccag

SEQ ID NO: 982836 - RNA, 23 nt, Mycobacterium avium subsp. paratuberculosis
cgaacgcgaccugcaucucgacc

SEQ ID NO: 982837 - RNA, 19 nt, Mycobacterium avium subsp. paratuberculosis
cgaacgccgaggugcaaca

SEQ ID NO: 982838 - RNA, 14 nt, Mycobacterium avium subsp. paratuberculosis
cgaacgccuccgcc

SEQ ID NO: 982839 - RNA, 17 nt, Mycobacterium avium subsp. paratuberculosis
cgaacaucgccagcaac

SEQ ID NO: 982840 - RNA, 16 nt, Mycobacterium avium subsp. paratuberculosis
cgaacaucacccggcg

SEQ ID NO: 982841 - RNA, 14 nt, Mycobacterium avium subsp. paratuberculosis
cgaaccagcaugcg

SEQ ID NO: 982842 - RNA, 19 nt, Mycobacterium avium subsp. paratuberculosis
cgaaccagcaugcgccaga

SEQ ID NO: 982843 - RNA, 13 nt, Mycobacterium avium subsp. paratuberculosis
cgaaccagcgccc

SEQ ID NO: 982844 - RNA, 16 nt, Mycobacterium avium subsp. paratuberculosis
cgaaccagggcagcca

SEQ ID NO: 982845 - RNA, 18 nt, Mycobacterium avium subsp. paratuberculosis
cgaaccagggcagccagc

SEQ ID NO: 982846 - RNA, 22 nt, Mycobacterium avium subsp. paratuberculosis
cgaacagggugacgauccacag

SEQ ID NO: 982847 - RNA, 23 nt, Mycobacterium avium subsp. paratuberculosis
cgaacagggugacgauccacagc

SEQ ID NO: 982848 - RNA, 13 nt, Mycobacterium avium subsp. paratuberculosis
cgaacagcucgac

SEQ ID NO: 982849 - RNA, 21 nt, Mycobacterium avium subsp. paratuberculosis
cgaacaggaugcagccggcca

SEQ ID NO: 982850 - RNA, 21 nt, Mycobacterium avium subsp. paratuberculosis
cgaacaggcccugcugcagcg

SEQ ID NO: 982851 - RNA, 14 nt, Mycobacterium avium subsp. paratuberculosis
cgaacagcgcggcc

SEQ ID NO: 982852 - RNA, 13 nt, Mycobacterium avium subsp. paratuberculosis
cgaacagccgacc

SEQ ID NO: 982853 - RNA, 20 nt, Mycobacterium avium subsp. paratuberculosis
cgaacacggccgccuccagc

SEQ ID NO: 982854 - RNA, 20 nt, Mycobacterium avium subsp. paratuberculosis
cgaacacgggcggcagggcc

SEQ ID NO: 982855 - RNA, 18 nt, Mycobacterium avium subsp. paratuberculosis
cgaacacguacagcggcg

SEQ ID NO: 982856 - RNA, 21 nt, Mycobacterium avium subsp. paratuberculosis
cgaacagccgggccagcagcu

SEQ ID NO: 982857 - RNA, 17 nt, Mycobacterium avium subsp. paratuberculosis
cgaacagcagcgaaccc

SEQ ID NO: 982858 - RNA, 20 nt, Mycobacterium avium subsp. paratuberculosis
cgaaaggacgggcgugacag

SEQ ID NO: 982859 - RNA, 20 nt, Mycobacterium avium subsp. paratuberculosis
cgaaagcacccgacacgccg

SEQ ID NO: 982860 - RNA, 14 nt, Mycobacterium avium subsp. paratuberculosis
cgaaacgcccggcu

SEQ ID NO: 982861 - RNA, 16 nt, Mycobacterium avium subsp. paratuberculosis
cgaaacccaggaacac

SEQ ID NO: 982862 - RNA, 17 nt, Mycobacterium avium subsp. paratuberculosis
cgaaacccaggaacacg

SEQ ID NO: 982863 - RNA, 20 nt, Mycobacterium avium subsp. paratuberculosis
cgaaacugaccuucucccgc

SEQ ID NO: 982864 - RNA, 20 nt, Mycobacterium avium subsp. paratuberculosis
cgaaacggugcccgcagcau

SEQ ID NO: 982865 - RNA, 21 nt, Mycobacterium avium subsp. paratuberculosis
cgaaacggcugcugcgcggca

SEQ ID NO: 982866 - RNA, 18 nt, Mycobacterium avium subsp. paratuberculosis
cgaaauaaccgcgcggcg

SEQ ID NO: 982867 - RNA, 20 nt, Mycobacterium avium subsp. paratuberculosis
cgaacaccaccggcaaccgc

SEQ ID NO: 982868 - RNA, 20 nt, Mycobacterium avium subsp. paratuberculosis
cgaacaccacguagccgacc

SEQ ID NO: 982869 - RNA, 21 nt, Mycobacterium avium subsp. paratuberculosis
cgaacaccgucaucguguggg

SEQ ID NO: 982870 - RNA, 13 nt, Mycobacterium avium subsp. paratuberculosis
cgaacacccggcu

SEQ ID NO: 982871 - RNA, 18 nt, Mycobacterium avium subsp. paratuberculosis
cgaacaccggcagcgcca

SEQ ID NO: 982872 - RNA, 12 nt, Mycobacterium avium subsp. paratuberculosis
cgaacaccagcc

SEQ ID NO: 982873 - RNA, 14 nt, Mycobacterium avium subsp. paratuberculosis
cgaacaacagggcc

SEQ ID NO: 982874 - RNA, 18 nt, Mycobacterium avium subsp. paratuberculosis
ccuuuuccggcgacaccg

SEQ ID NO: 982875 - RNA, 14 nt, Mycobacterium avium subsp. paratuberculosis
ccuuuuccaucugg

SEQ ID NO: 982876 - RNA, 18 nt, Mycobacterium avium subsp. paratuberculosis
cgaaaaacgcgacggccc

SEQ ID NO: 982877 - RNA, 15 nt, Mycobacterium avium subsp. paratuberculosis
cgaaaaccagcaccg

SEQ ID NO: 982878 - RNA, 14 nt, Mycobacterium avium subsp. paratuberculosis
cgaaaccaacaccc

SEQ ID NO: 982879 - RNA, 23 nt, Mycobacterium avium subsp. paratuberculosis
ccuuuccgcgcggcgggcccgca

SEQ ID NO: 982880 - RNA, 18 nt, Mycobacterium avium subsp. paratuberculosis
ccuugcugagccggcccu

SEQ ID NO: 982881 - RNA, 15 nt, Mycobacterium avium subsp. paratuberculosis
ccuugcugaucccca

SEQ ID NO: 982882 - RNA, 18 nt, Mycobacterium avium subsp. paratuberculosis
ccuugcuggcggccuucu

SEQ ID NO: 982883 - RNA, 17 nt, Mycobacterium avium subsp. paratuberculosis
ccuuggacaccugcagu

SEQ ID NO: 982884 - RNA, 19 nt, Mycobacterium avium subsp. paratuberculosis
ccuuggacaggcccagcgg

SEQ ID NO: 982885 - RNA, 19 nt, Mycobacterium avium subsp. paratuberculosis
ccuuggacgaaacccggcg

SEQ ID NO: 982886 - RNA, 20 nt, Mycobacterium avium subsp. paratuberculosis
ccuugcuccacacuggcucu

SEQ ID NO: 982887 - RNA, 14 nt, Mycobacterium avium subsp. paratuberculosis
ccuugcggccggcg

SEQ ID NO: 982888 - RNA, 15 nt, Mycobacterium avium subsp. paratuberculosis
ccuugcggccggcgg

SEQ ID NO: 982889 - RNA, 18 nt, Mycobacterium avium subsp. paratuberculosis
ccuugcgcagccggcagc

SEQ ID NO: 982890 - RNA, 17 nt, Mycobacterium avium subsp. paratuberculosis
ccuugccgaugccggcg

SEQ ID NO: 982891 - RNA, 16 nt, Mycobacterium avium subsp. paratuberculosis
ccuugcgccccggcgg

SEQ ID NO: 982892 - RNA, 15 nt, Mycobacterium avium subsp. paratuberculosis
ccuugcgcagcagca

SEQ ID NO: 982893 - RNA, 20 nt, Mycobacterium avium subsp. paratuberculosis
ccuugccgaucagcgucagc

SEQ ID NO: 982894 - RNA, 17 nt, Mycobacterium avium subsp. paratuberculosis
ccuugccgaucagcugg

SEQ ID NO: 982895 - RNA, 13 nt, Mycobacterium avium subsp. paratuberculosis
ccuugcccggcuc

SEQ ID NO: 982896 - RNA, 15 nt, Mycobacterium avium subsp. paratuberculosis
ccuugauccggccgc

SEQ ID NO: 982897 - RNA, 16 nt, Mycobacterium avium subsp. paratuberculosis
ccuugauccgggcgcc

SEQ ID NO: 982898 - RNA, 22 nt, Mycobacterium avium subsp. paratuberculosis
ccuugacgucggguccgaccag

SEQ ID NO: 982899 - RNA, 17 nt, Mycobacterium avium subsp. paratuberculosis
ccuugacuaccgcgccc

SEQ ID NO: 982900 - RNA, 13 nt, Mycobacterium avium subsp. paratuberculosis
ccuugagcaccgc

SEQ ID NO: 982901 - RNA, 12 nt, Mycobacterium avium subsp. paratuberculosis
ccuugagccgcc

SEQ ID NO: 982902 - RNA, 13 nt, Mycobacterium avium subsp. paratuberculosis
ccuugagccgccg

SEQ ID NO: 982903 - RNA, 20 nt, Mycobacterium avium subsp. paratuberculosis
ccuugcagcccgcguccagc

SEQ ID NO: 982904 - RNA, 15 nt, Mycobacterium avium subsp. paratuberculosis
ccuugcagcacaccg

SEQ ID NO: 982905 - RNA, 14 nt, Mycobacterium avium subsp. paratuberculosis
ccuugcccaggugc

SEQ ID NO: 982906 - RNA, 14 nt, Mycobacterium avium subsp. paratuberculosis
ccuugccccaccac

SEQ ID NO: 982907 - RNA, 17 nt, Mycobacterium avium subsp. paratuberculosis
ccuuggcggccaccauc

SEQ ID NO: 982908 - RNA, 13 nt, Mycobacterium avium subsp. paratuberculosis
ccuuggccugcuu

SEQ ID NO: 982909 - RNA, 14 nt, Mycobacterium avium subsp. paratuberculosis
ccuuggcgcccagc

SEQ ID NO: 982910 - RNA, 12 nt, Mycobacterium avium subsp. paratuberculosis
ccuuggccgcag

SEQ ID NO: 982911 - RNA, 22 nt, Mycobacterium avium subsp. paratuberculosis
ccuuggccgcaggcggccagca

SEQ ID NO: 982912 - RNA, 15 nt, Mycobacterium avium subsp. paratuberculosis
ccuuggcccgcgccc

SEQ ID NO: 982913 - RNA, 16 nt, Mycobacterium avium subsp. paratuberculosis
ccuuggccaggcgggc

SEQ ID NO: 982914 - RNA, 12 nt, Mycobacterium avium subsp. paratuberculosis
ccuugggccggu

SEQ ID NO: 982915 - RNA, 17 nt, Mycobacterium avium subsp. paratuberculosis
ccuuggucacaaagccc

SEQ ID NO: 982916 - RNA, 21 nt, Mycobacterium avium subsp. paratuberculosis
ccuugguagaugcguuccagg

SEQ ID NO: 982917 - RNA, 20 nt, Mycobacterium avium subsp. paratuberculosis
ccuuggugaugggcagcgcc

SEQ ID NO: 982918 - RNA, 18 nt, Mycobacterium avium subsp. paratuberculosis
ccuugguggccgcggccg

SEQ ID NO: 982919 - RNA, 21 nt, Mycobacterium avium subsp. paratuberculosis
ccuugguggccgcggccgccu

SEQ ID NO: 982920 - RNA, 13 nt, Mycobacterium avium subsp. paratuberculosis
ccuucgaugcccu

SEQ ID NO: 982921 - RNA, 16 nt, Mycobacterium avium subsp. paratuberculosis
ccuucgacggccggcc

SEQ ID NO: 982922 - RNA, 17 nt, Mycobacterium avium subsp. paratuberculosis
ccuucgacggccggccc

SEQ ID NO: 982923 - RNA, 22 nt, Mycobacterium avium subsp. paratuberculosis
ccuucgacggccggcccugcac

SEQ ID NO: 982924 - RNA, 15 nt, Mycobacterium avium subsp. paratuberculosis
ccuucgaguuuggcc

SEQ ID NO: 982925 - RNA, 14 nt, Mycobacterium avium subsp. paratuberculosis
ccuucgagccgccg

SEQ ID NO: 982926 - RNA, 17 nt, Mycobacterium avium subsp. paratuberculosis
ccuucgagccgccgccg

SEQ ID NO: 982927 - RNA, 15 nt, Mycobacterium avium subsp. paratuberculosis
ccuucggagacgugg

SEQ ID NO: 982928 - RNA, 19 nt, Mycobacterium avium subsp. paratuberculosis
ccuucggagacguggcggc

SEQ ID NO: 982929 - RNA, 18 nt, Mycobacterium avium subsp. paratuberculosis
ccuucgcggugugcggca

SEQ ID NO: 982930 - RNA, 12 nt, Mycobacterium avium subsp. paratuberculosis
ccuucggcgcca

SEQ ID NO: 982931 - RNA, 14 nt, Mycobacterium avium subsp. paratuberculosis
ccuuccaccaccgc

SEQ ID NO: 982932 - RNA, 15 nt, Mycobacterium avium subsp. paratuberculosis
ccuuccacgaccugg

SEQ ID NO: 982933 - RNA, 18 nt, Mycobacterium avium subsp. paratuberculosis
ccuuccacgaccuggcgg

SEQ ID NO: 982934 - RNA, 16 nt, Mycobacterium avium subsp. paratuberculosis
ccuuccugcgcgugcu

SEQ ID NO: 982935 - RNA, 15 nt, Mycobacterium avium subsp. paratuberculosis
ccuuccccggcggcc

SEQ ID NO: 982936 - RNA, 11 nt, Mycobacterium avium subsp. paratuberculosis
ccuucuuggcc

SEQ ID NO: 982937 - RNA, 12 nt, Mycobacterium avium subsp. paratuberculosis
ccuucuuggccg

SEQ ID NO: 982938 - RNA, 21 nt, Mycobacterium avium subsp. paratuberculosis
ccuucuuggccggagccuucu

SEQ ID NO: 982939 - RNA, 22 nt, Mycobacterium avium subsp. paratuberculosis
ccuucuuggccggagccuucuu

SEQ ID NO: 982940 - RNA, 22 nt, Mycobacterium avium subsp. paratuberculosis
ccuucuuggcggcggccuucuu

SEQ ID NO: 982941 - RNA, 21 nt, Mycobacterium avium subsp. paratuberculosis
ccuucuuggcgggcgccuucu

SEQ ID NO: 982942 - RNA, 17 nt, Mycobacterium avium subsp. paratuberculosis
ccuucuugaccgcagcc

SEQ ID NO: 982943 - RNA, 20 nt, Mycobacterium avium subsp. paratuberculosis
ccuucuugaccgcagccuuc

SEQ ID NO: 982944 - RNA, 12 nt, Mycobacterium avium subsp. paratuberculosis
ccuucuucgccg

SEQ ID NO: 982945 - RNA, 17 nt, Mycobacterium avium subsp. paratuberculosis
ccuucuucgccgcagcc

SEQ ID NO: 982946 - RNA, 20 nt, Mycobacterium avium subsp. paratuberculosis
ccuucuucgccgcagccuuc

SEQ ID NO: 982947 - RNA, 22 nt, Mycobacterium avium subsp. paratuberculosis
ccuucuucgccgcagccuucuu

SEQ ID NO: 982948 - RNA, 21 nt, Mycobacterium avium subsp. paratuberculosis
ccuugaaccggcuggacaccc

SEQ ID NO: 982949 - RNA, 15 nt, Mycobacterium avium subsp. paratuberculosis
ccuugaacggcacca

SEQ ID NO: 982950 - RNA, 23 nt, Mycobacterium avium subsp. paratuberculosis
ccuugacggccugggcgaccacg

SEQ ID NO: 982951 - RNA, 22 nt, Mycobacterium avium subsp. paratuberculosis
ccuugacccgcaaggccgccag

SEQ ID NO: 982952 - RNA, 19 nt, Mycobacterium avium subsp. paratuberculosis
ccuucuggaagccuggcac

SEQ ID NO: 982953 - RNA, 16 nt, Mycobacterium avium subsp. paratuberculosis
ccuucugcgucggcuu

SEQ ID NO: 982954 - RNA, 18 nt, Mycobacterium avium subsp. paratuberculosis
ccuucugcgcgccgucgg

SEQ ID NO: 982955 - RNA, 18 nt, Mycobacterium avium subsp. paratuberculosis
ccuucucggacgcccguc

SEQ ID NO: 982956 - RNA, 21 nt, Mycobacterium avium subsp. paratuberculosis
ccuucucgggcaaucacauug

SEQ ID NO: 982957 - RNA, 18 nt, Mycobacterium avium subsp. paratuberculosis
ccuucucccgcggcagcc

SEQ ID NO: 982958 - RNA, 22 nt, Mycobacterium avium subsp. paratuberculosis
cgcaugaugcccaggcccacca

SEQ ID NO: 982959 - RNA, 19 nt, Mycobacterium avium subsp. paratuberculosis
cgcaucggcgacgccgccg

SEQ ID NO: 982960 - RNA, 18 nt, Mycobacterium avium subsp. paratuberculosis
cgcaucgacugcgacacc

SEQ ID NO: 982961 - RNA, 19 nt, Mycobacterium avium subsp. paratuberculosis
cgcaucgccgagagcgucu

SEQ ID NO: 982962 - RNA, 14 nt, Mycobacterium avium subsp. paratuberculosis
cgcaucgccgaggg

SEQ ID NO: 982963 - RNA, 17 nt, Mycobacterium avium subsp. paratuberculosis
cgcaucgccggcgcgcu

SEQ ID NO: 982964 - RNA, 13 nt, Mycobacterium avium subsp. paratuberculosis
cgcaucgccucgg

SEQ ID NO: 982965 - RNA, 22 nt, Mycobacterium avium subsp. paratuberculosis
cgcaucgccucggcggccgccc

SEQ ID NO: 982966 - RNA, 21 nt, Mycobacterium avium subsp. paratuberculosis
cgcaucaugcguuugccgucg

SEQ ID NO: 982967 - RNA, 15 nt, Mycobacterium avium subsp. paratuberculosis
cgcaucagggccagc

SEQ ID NO: 982968 - RNA, 16 nt, Mycobacterium avium subsp. paratuberculosis
cgcaucagggccagcc

SEQ ID NO: 982969 - RNA, 22 nt, Mycobacterium avium subsp. paratuberculosis
cgcaucagcaccuccggcagcg

SEQ ID NO: 982970 - RNA, 13 nt, Mycobacterium avium subsp. paratuberculosis
cgcaucagcgcca

SEQ ID NO: 982971 - RNA, 18 nt, Mycobacterium avium subsp. paratuberculosis
cgcaucagcgccaccagc

SEQ ID NO: 982972 - RNA, 23 nt, Mycobacterium avium subsp. paratuberculosis
cgcauagaugcuuuggcuaaaca

SEQ ID NO: 982973 - RNA, 19 nt, Mycobacterium avium subsp. paratuberculosis
cgcaguucgaccggcacca

SEQ ID NO: 982974 - RNA, 21 nt, Mycobacterium avium subsp. paratuberculosis
cgcaguucgaccggcaccagc

SEQ ID NO: 982975 - RNA, 17 nt, Mycobacterium avium subsp. paratuberculosis
cgcagcgucuugcccag

SEQ ID NO: 982976 - RNA, 16 nt, Mycobacterium avium subsp. paratuberculosis
cgcagcugcagcuccu

SEQ ID NO: 982977 - RNA, 17 nt, Mycobacterium avium subsp. paratuberculosis
cgcagcucgucgugggu

SEQ ID NO: 982978 - RNA, 17 nt, Mycobacterium avium subsp. paratuberculosis
cgcaggcacucgcgcag

SEQ ID NO: 982979 - RNA, 13 nt, Mycobacterium avium subsp. paratuberculosis
cgcaggcagcagc

SEQ ID NO: 982980 - RNA, 14 nt, Mycobacterium avium subsp. paratuberculosis
cgcagcucccccgg

SEQ ID NO: 982981 - RNA, 23 nt, Mycobacterium avium subsp. paratuberculosis
cgcagcucccccggcgugagcga

SEQ ID NO: 982982 - RNA, 22 nt, Mycobacterium avium subsp. paratuberculosis
cgcagcucgaucacccaggucu

SEQ ID NO: 982983 - RNA, 19 nt, Mycobacterium avium subsp. paratuberculosis
cgcagcucgcccagcaccg

SEQ ID NO: 982984 - RNA, 21 nt, Mycobacterium avium subsp. paratuberculosis
cgcagcucgcccagcaccguc

SEQ ID NO: 982985 - RNA, 17 nt, Mycobacterium avium subsp. paratuberculosis
cgcagcucgcgcagccg

SEQ ID NO: 982986 - RNA, 18 nt, Mycobacterium avium subsp. paratuberculosis
cgcagcucgcgcagccgg

SEQ ID NO: 982987 - RNA, 16 nt, Mycobacterium avium subsp. paratuberculosis
cgcagcucgcgcagcu

SEQ ID NO: 982988 - RNA, 19 nt, Mycobacterium avium subsp. paratuberculosis
cgcagcucgcgcagcuggc

SEQ ID NO: 982989 - RNA, 20 nt, Mycobacterium avium subsp. paratuberculosis
cgcagcaccuccgacagccc

SEQ ID NO: 982990 - RNA, 19 nt, Mycobacterium avium subsp. paratuberculosis
cgcagcaccauccgcgcga

SEQ ID NO: 982991 - RNA, 16 nt, Mycobacterium avium subsp. paratuberculosis
cgcagcaacuccaccu

SEQ ID NO: 982992 - RNA, 20 nt, Mycobacterium avium subsp. paratuberculosis
cgcagaucgagaucagggcg

SEQ ID NO: 982993 - RNA, 16 nt, Mycobacterium avium subsp. paratuberculosis
cgcagauggucgggac

SEQ ID NO: 982994 - RNA, 14 nt, Mycobacterium avium subsp. paratuberculosis
cgcagaucgcgcau

SEQ ID NO: 982995 - RNA, 15 nt, Mycobacterium avium subsp. paratuberculosis
cgcagaugaccggcc

SEQ ID NO: 982996 - RNA, 17 nt, Mycobacterium avium subsp. paratuberculosis
cgcagugcccgcccagc

SEQ ID NO: 982997 - RNA, 17 nt, Mycobacterium avium subsp. paratuberculosis
cgcagugccgcaccagc

SEQ ID NO: 982998 - RNA, 17 nt, Mycobacterium avium subsp. paratuberculosis
cgcaggucgggccggcc

SEQ ID NO: 982999 - RNA, 21 nt, Mycobacterium avium subsp. paratuberculosis
cgcagguagccgccguagccg

SEQ ID NO: 983000 - RNA, 18 nt, Mycobacterium avium subsp. paratuberculosis
cgcagguccacccgcccc

SEQ ID NO: 983001 - RNA, 19 nt, Mycobacterium avium subsp. paratuberculosis
cgcagguccacccgccccg

SEQ ID NO: 983002 - RNA, 21 nt, Mycobacterium avium subsp. paratuberculosis
cgcagguccacccgccccgcc

SEQ ID NO: 983003 - RNA, 16 nt, Mycobacterium avium subsp. paratuberculosis
cgcagguccggcagcg

SEQ ID NO: 983004 - RNA, 13 nt, Mycobacterium avium subsp. paratuberculosis
cgcaggucgaugg

SEQ ID NO: 983005 - RNA, 16 nt, Mycobacterium avium subsp. paratuberculosis
cgcagggcgaacggcg

SEQ ID NO: 983006 - RNA, 18 nt, Mycobacterium avium subsp. paratuberculosis
cgcagggcgaacggcgga

SEQ ID NO: 983007 - RNA, 13 nt, Mycobacterium avium subsp. paratuberculosis
cgcaggcgaaggu

SEQ ID NO: 983008 - RNA, 15 nt, Mycobacterium avium subsp. paratuberculosis
cgcaggccgucgccg

SEQ ID NO: 983009 - RNA, 18 nt, Mycobacterium avium subsp. paratuberculosis
cgcaggccucuacucagc

SEQ ID NO: 983010 - RNA, 12 nt, Mycobacterium avium subsp. paratuberculosis
cgcaggccgccc

SEQ ID NO: 983011 - RNA, 16 nt, Mycobacterium avium subsp. paratuberculosis
cgcaggccgcccggcc

SEQ ID NO: 983012 - RNA, 21 nt, Mycobacterium avium subsp. paratuberculosis
cgcaggccgcccggcccaaga

SEQ ID NO: 983013 - RNA, 22 nt, Mycobacterium avium subsp. paratuberculosis
cgcaggcauuuccagguccggg

SEQ ID NO: 983014 - RNA, 13 nt, Mycobacterium avium subsp. paratuberculosis
cgcaggcgagccg

SEQ ID NO: 983015 - RNA, 16 nt, Mycobacterium avium subsp. paratuberculosis
cgcauucggccgccac

SEQ ID NO: 983016 - RNA, 19 nt, Mycobacterium avium subsp. paratuberculosis
cgcauucggccgccaccga

SEQ ID NO: 983017 - RNA, 19 nt, Mycobacterium avium subsp. paratuberculosis
cgcauuugccgacaugcug

SEQ ID NO: 983018 - RNA, 19 nt, Mycobacterium avium subsp. paratuberculosis
cgcauguccggggugagca

SEQ ID NO: 983019 - RNA, 16 nt, Mycobacterium avium subsp. paratuberculosis
cgcaugucgaccucgg

SEQ ID NO: 983020 - RNA, 23 nt, Mycobacterium avium subsp. paratuberculosis
cgcauguuggugaucagccccgc

SEQ ID NO: 983021 - RNA, 23 nt, Mycobacterium avium subsp. paratuberculosis
cgcauggugcggguguccgagcg

SEQ ID NO: 983022 - RNA, 15 nt, Mycobacterium avium subsp. paratuberculosis
cgcauggccuugaga

SEQ ID NO: 983023 - RNA, 20 nt, Mycobacterium avium subsp. paratuberculosis
cgccaaccaggucgcggcgc

SEQ ID NO: 983024 - RNA, 21 nt, Mycobacterium avium subsp. paratuberculosis
cgccaaccaggucgcggcgcu

SEQ ID NO: 983025 - RNA, 22 nt, Mycobacterium avium subsp. paratuberculosis
cgccaacgaggcacggcccgcu

SEQ ID NO: 983026 - RNA, 14 nt, Mycobacterium avium subsp. paratuberculosis
cgccacccgcaccu

SEQ ID NO: 983027 - RNA, 22 nt, Mycobacterium avium subsp. paratuberculosis
cgccacccugcgcaccgcggau

SEQ ID NO: 983028 - RNA, 12 nt, Mycobacterium avium subsp. paratuberculosis
cgccaccgcgau

SEQ ID NO: 983029 - RNA, 21 nt, Mycobacterium avium subsp. paratuberculosis
cgccacgcacaccgcgcgcag

SEQ ID NO: 983030 - RNA, 17 nt, Mycobacterium avium subsp. paratuberculosis
cgccaccgagucgcgcg

SEQ ID NO: 983031 - RNA, 14 nt, Mycobacterium avium subsp. paratuberculosis
cgccaccgaugcgg

SEQ ID NO: 983032 - RNA, 18 nt, Mycobacterium avium subsp. paratuberculosis
cgccaauccggcgggccu

SEQ ID NO: 983033 - RNA, 20 nt, Mycobacterium avium subsp. paratuberculosis
cgccaauccggcgggccucg

SEQ ID NO: 983034 - RNA, 13 nt, Mycobacterium avium subsp. paratuberculosis
cgccacgcggcgc

SEQ ID NO: 983035 - RNA, 15 nt, Mycobacterium avium subsp. paratuberculosis
cgccacuucuccacg

SEQ ID NO: 983036 - RNA, 16 nt, Mycobacterium avium subsp. paratuberculosis
cgccacggccagcacc

SEQ ID NO: 983037 - RNA, 16 nt, Mycobacterium avium subsp. paratuberculosis
cgccacggccggcagc

SEQ ID NO: 983038 - RNA, 14 nt, Mycobacterium avium subsp. paratuberculosis
cgccacugccgccg

SEQ ID NO: 983039 - RNA, 15 nt, Mycobacterium avium subsp. paratuberculosis
cgccacugccgccgc

SEQ ID NO: 983040 - RNA, 18 nt, Mycobacterium avium subsp. paratuberculosis
cgccacugccgccgccca

SEQ ID NO: 983041 - RNA, 20 nt, Mycobacterium avium subsp. paratuberculosis
cgccacugccgccgcccagg

SEQ ID NO: 983042 - RNA, 12 nt, Mycobacterium avium subsp. paratuberculosis
cgccacggccac

SEQ ID NO: 983043 - RNA, 17 nt, Mycobacterium avium subsp. paratuberculosis
cgccacggccaccgccg

SEQ ID NO: 983044 - RNA, 18 nt, Mycobacterium avium subsp. paratuberculosis
cgccagacucacggcggc

SEQ ID NO: 983045 - RNA, 22 nt, Mycobacterium avium subsp. paratuberculosis
cgccagacugaugcccucgccg

SEQ ID NO: 983046 - RNA, 22 nt, Mycobacterium avium subsp. paratuberculosis
cgcaaccgggccgcacccccuc

SEQ ID NO: 983047 - RNA, 20 nt, Mycobacterium avium subsp. paratuberculosis
cgcaaaacggugcggccucg

SEQ ID NO: 983048 - RNA, 13 nt, Mycobacterium avium subsp. paratuberculosis
cgcaacagcgagu

SEQ ID NO: 983049 - RNA, 13 nt, Mycobacterium avium subsp. paratuberculosis
cgcaagcaccggc

SEQ ID NO: 983050 - RNA, 20 nt, Mycobacterium avium subsp. paratuberculosis
cgcaagcaccggcuggccga

SEQ ID NO: 983051 - RNA, 14 nt, Mycobacterium avium subsp. paratuberculosis
cgcaaggccgccag

SEQ ID NO: 983052 - RNA, 12 nt, Mycobacterium avium subsp. paratuberculosis
cgcacaccacca

SEQ ID NO: 983053 - RNA, 15 nt, Mycobacterium avium subsp. paratuberculosis
cgcacaacgaggccc

SEQ ID NO: 983054 - RNA, 18 nt, Mycobacterium avium subsp. paratuberculosis
cgcaauugcgccagcagc

SEQ ID NO: 983055 - RNA, 20 nt, Mycobacterium avium subsp. paratuberculosis
cgcaaugccgccgcgacgau

SEQ ID NO: 983056 - RNA, 16 nt, Mycobacterium avium subsp. paratuberculosis
cgcaaucggcgccggc

SEQ ID NO: 983057 - RNA, 21 nt, Mycobacterium avium subsp. paratuberculosis
cgcacuagguccggcgcgacc

SEQ ID NO: 983058 - RNA, 17 nt, Mycobacterium avium subsp. paratuberculosis
cgcagaagcuaacgcca

SEQ ID NO: 983059 - RNA, 19 nt, Mycobacterium avium subsp. paratuberculosis
cgcagaagcuaacgccagc

SEQ ID NO: 983060 - RNA, 17 nt, Mycobacterium avium subsp. paratuberculosis
cgcacgucccgcccggc

SEQ ID NO: 983061 - RNA, 15 nt, Mycobacterium avium subsp. paratuberculosis
cgcacgucaccgcgc

SEQ ID NO: 983062 - RNA, 15 nt, Mycobacterium avium subsp. paratuberculosis
cgcacgucggccgcc

SEQ ID NO: 983063 - RNA, 20 nt, Mycobacterium avium subsp. paratuberculosis
cgcacgugcgcgccgaccgc

SEQ ID NO: 983064 - RNA, 14 nt, Mycobacterium avium subsp. paratuberculosis
cgcacgugucccgu

SEQ ID NO: 983065 - RNA, 16 nt, Mycobacterium avium subsp. paratuberculosis
cgcacguagcccagcg

SEQ ID NO: 983066 - RNA, 20 nt, Mycobacterium avium subsp. paratuberculosis
cgcacggugcagcagcgccg

SEQ ID NO: 983067 - RNA, 22 nt, Mycobacterium avium subsp. paratuberculosis
cgcacggugcagcagcgccgcg

SEQ ID NO: 983068 - RNA, 14 nt, Mycobacterium avium subsp. paratuberculosis
cgcagaucccgccg

SEQ ID NO: 983069 - RNA, 21 nt, Mycobacterium avium subsp. paratuberculosis
cgcagaucccgccggcggcca

SEQ ID NO: 983070 - RNA, 21 nt, Mycobacterium avium subsp. paratuberculosis
cgcagauagccguacacggcg

SEQ ID NO: 983071 - RNA, 13 nt, Mycobacterium avium subsp. paratuberculosis
cgcaccgcggcgu

SEQ ID NO: 983072 - RNA, 13 nt, Mycobacterium avium subsp. paratuberculosis
cgcaccgcggagc

SEQ ID NO: 983073 - RNA, 15 nt, Mycobacterium avium subsp. paratuberculosis
cgcaccgccgggcau

SEQ ID NO: 983074 - RNA, 14 nt, Mycobacterium avium subsp. paratuberculosis
cgcaccgcgcgcca

SEQ ID NO: 983075 - RNA, 16 nt, Mycobacterium avium subsp. paratuberculosis
cgcaccggccggcccc

SEQ ID NO: 983076 - RNA, 16 nt, Mycobacterium avium subsp. paratuberculosis
cgcaccggcgccgcca

SEQ ID NO: 983077 - RNA, 19 nt, Mycobacterium avium subsp. paratuberculosis
cgcaccgcauagcgggagc

SEQ ID NO: 983078 - RNA, 14 nt, Mycobacterium avium subsp. paratuberculosis
cgcaccgagccugg

SEQ ID NO: 983079 - RNA, 14 nt, Mycobacterium avium subsp. paratuberculosis
cgcaccgccaccgc

SEQ ID NO: 983080 - RNA, 16 nt, Mycobacterium avium subsp. paratuberculosis
cgcaccgccagcaccg

SEQ ID NO: 983081 - RNA, 13 nt, Mycobacterium avium subsp. paratuberculosis
cgcaccaccgccc

SEQ ID NO: 983082 - RNA, 17 nt, Mycobacterium avium subsp. paratuberculosis
cgcaccacccagcccuu

SEQ ID NO: 983083 - RNA, 21 nt, Mycobacterium avium subsp. paratuberculosis
cgcaccacccagcccuuggcg

SEQ ID NO: 983084 - RNA, 22 nt, Mycobacterium avium subsp. paratuberculosis
cgcaccacccagcccuuggcga

SEQ ID NO: 983085 - RNA, 22 nt, Mycobacterium avium subsp. paratuberculosis
cgcaccaccucggcgaucugcu

SEQ ID NO: 983086 - RNA, 16 nt, Mycobacterium avium subsp. paratuberculosis
cgcacgaugccgcgcu

SEQ ID NO: 983087 - RNA, 21 nt, Mycobacterium avium subsp. paratuberculosis
cgcacgaugccgcgcucgaac

SEQ ID NO: 983088 - RNA, 15 nt, Mycobacterium avium subsp. paratuberculosis
cgcaccgggaccagc

SEQ ID NO: 983089 - RNA, 20 nt, Mycobacterium avium subsp. paratuberculosis
cgcaccguguagccgaccga

SEQ ID NO: 983090 - RNA, 16 nt, Mycobacterium avium subsp. paratuberculosis
cgauuucccgacuccu

SEQ ID NO: 983091 - RNA, 18 nt, Mycobacterium avium subsp. paratuberculosis
cgauuucccgacuccuca

SEQ ID NO: 983092 - RNA, 13 nt, Mycobacterium avium subsp. paratuberculosis
cgaugugcgcgcu

SEQ ID NO: 983093 - RNA, 21 nt, Mycobacterium avium subsp. paratuberculosis
cgauuccggccggccgccggc

SEQ ID NO: 983094 - RNA, 17 nt, Mycobacterium avium subsp. paratuberculosis
cgaucaaaucccgcagc

SEQ ID NO: 983095 - RNA, 17 nt, Mycobacterium avium subsp. paratuberculosis
cgaucaacaggcccagc

SEQ ID NO: 983096 - RNA, 14 nt, Mycobacterium avium subsp. paratuberculosis
cgaucacaccacca

SEQ ID NO: 983097 - RNA, 16 nt, Mycobacterium avium subsp. paratuberculosis
cgaucacaccaccacg

SEQ ID NO: 983098 - RNA, 12 nt, Mycobacterium avium subsp. paratuberculosis
cgaucaccgccg

SEQ ID NO: 983099 - RNA, 20 nt, Mycobacterium avium subsp. paratuberculosis
cgaucacgacgcgaccgagg

SEQ ID NO: 983100 - RNA, 13 nt, Mycobacterium avium subsp. paratuberculosis
cgaucaccggcuu

SEQ ID NO: 983101 - RNA, 17 nt, Mycobacterium avium subsp. paratuberculosis
cgaucaccaggcccagg

SEQ ID NO: 983102 - RNA, 17 nt, Mycobacterium avium subsp. paratuberculosis
cgaucacccaggucuuc

SEQ ID NO: 983103 - RNA, 15 nt, Mycobacterium avium subsp. paratuberculosis
cgaucaccaccaccg

SEQ ID NO: 983104 - RNA, 18 nt, Mycobacterium avium subsp. paratuberculosis
cgaugccgaccaacaccc

SEQ ID NO: 983105 - RNA, 23 nt, Mycobacterium avium subsp. paratuberculosis
cgaugccgccgagggccagcagc

SEQ ID NO: 983106 - RNA, 23 nt, Mycobacterium avium subsp. paratuberculosis
cgaugccggcgauccgcgcggcg

SEQ ID NO: 983107 - RNA, 14 nt, Mycobacterium avium subsp. paratuberculosis
cgaugccgcgcagg

SEQ ID NO: 983108 - RNA, 16 nt, Mycobacterium avium subsp. paratuberculosis
cgaugccgcugaucaa

SEQ ID NO: 983109 - RNA, 16 nt, Mycobacterium avium subsp. paratuberculosis
cgaugccgugcugggc

SEQ ID NO: 983110 - RNA, 14 nt, Mycobacterium avium subsp. paratuberculosis
cgaugcgacaccgc

SEQ ID NO: 983111 - RNA, 15 nt, Mycobacterium avium subsp. paratuberculosis
cgaugcgaucgauga

SEQ ID NO: 983112 - RNA, 17 nt, Mycobacterium avium subsp. paratuberculosis
cgaugucgguggcgcgc

SEQ ID NO: 983113 - RNA, 15 nt, Mycobacterium avium subsp. paratuberculosis
cgaugucgggcaccu

SEQ ID NO: 983114 - RNA, 16 nt, Mycobacterium avium subsp. paratuberculosis
cgaugucgacccgcgg

SEQ ID NO: 983115 - RNA, 14 nt, Mycobacterium avium subsp. paratuberculosis
cgaugggcucgagc

SEQ ID NO: 983116 - RNA, 21 nt, Mycobacterium avium subsp. paratuberculosis
cgaugggugaucgcggcccgc

SEQ ID NO: 983117 - RNA, 13 nt, Mycobacterium avium subsp. paratuberculosis
cgauguccgccgg

SEQ ID NO: 983118 - RNA, 14 nt, Mycobacterium avium subsp. paratuberculosis
cgauggucagcugc

SEQ ID NO: 983119 - RNA, 15 nt, Mycobacterium avium subsp. paratuberculosis
cgauggucagcugcc

SEQ ID NO: 983120 - RNA, 18 nt, Mycobacterium avium subsp. paratuberculosis
cgauggugacggugccgc

SEQ ID NO: 983121 - RNA, 15 nt, Mycobacterium avium subsp. paratuberculosis
cgauggacagcagcc

SEQ ID NO: 983122 - RNA, 17 nt, Mycobacterium avium subsp. paratuberculosis
cgauggacaggcacucg

SEQ ID NO: 983123 - RNA, 14 nt, Mycobacterium avium subsp. paratuberculosis
cgauggagaccucu

SEQ ID NO: 983124 - RNA, 18 nt, Mycobacterium avium subsp. paratuberculosis
cgauggagaccucuucga

SEQ ID NO: 983125 - RNA, 14 nt, Mycobacterium avium subsp. paratuberculosis
cgauggaguagcug

SEQ ID NO: 983126 - RNA, 18 nt, Mycobacterium avium subsp. paratuberculosis
cgauggcgggcgcgccgg

SEQ ID NO: 983127 - RNA, 19 nt, Mycobacterium avium subsp. paratuberculosis
cgauggcgguccaccacca

SEQ ID NO: 983128 - RNA, 16 nt, Mycobacterium avium subsp. paratuberculosis
cgauagcuugagcccc

SEQ ID NO: 983129 - RNA, 20 nt, Mycobacterium avium subsp. paratuberculosis
cgaguucggcggcccgcuug

SEQ ID NO: 983130 - RNA, 19 nt, Mycobacterium avium subsp. paratuberculosis
cgaguuugcggugauccca

SEQ ID NO: 983131 - RNA, 14 nt, Mycobacterium avium subsp. paratuberculosis
cgaguuuggccagc

SEQ ID NO: 983132 - RNA, 19 nt, Mycobacterium avium subsp. paratuberculosis
cgaguuccucgugcgugcg

SEQ ID NO: 983133 - RNA, 14 nt, Mycobacterium avium subsp. paratuberculosis
cgaguuccugcgac

SEQ ID NO: 983134 - RNA, 20 nt, Mycobacterium avium subsp. paratuberculosis
cgaguucgaccuccacccgc

SEQ ID NO: 983135 - RNA, 19 nt, Mycobacterium avium subsp. paratuberculosis
cgagucaccggcucgcggg

SEQ ID NO: 983136 - RNA, 17 nt, Mycobacterium avium subsp. paratuberculosis
cgaguccggccaggucg

SEQ ID NO: 983137 - RNA, 18 nt, Mycobacterium avium subsp. paratuberculosis
cgaguccagccagccgcg

SEQ ID NO: 983138 - RNA, 18 nt, Mycobacterium avium subsp. paratuberculosis
cgagucaucgccacccgc

SEQ ID NO: 983139 - RNA, 16 nt, Mycobacterium avium subsp. paratuberculosis
cgagucccgcgcggcg

SEQ ID NO: 983140 - RNA, 15 nt, Mycobacterium avium subsp. paratuberculosis
cgagugccggcagcc

SEQ ID NO: 983141 - RNA, 18 nt, Mycobacterium avium subsp. paratuberculosis
cgagugccggcagcccgg

SEQ ID NO: 983142 - RNA, 16 nt, Mycobacterium avium subsp. paratuberculosis
cgagugccggccagcu

SEQ ID NO: 983143 - RNA, 22 nt, Mycobacterium avium subsp. paratuberculosis
cgagugccggccagcucgccgc

SEQ ID NO: 983144 - RNA, 14 nt, Mycobacterium avium subsp. paratuberculosis
cgagugcucgaugg

SEQ ID NO: 983145 - RNA, 19 nt, Mycobacterium avium subsp. paratuberculosis
cgagugcucgauggccagc

SEQ ID NO: 983146 - RNA, 15 nt, Mycobacterium avium subsp. paratuberculosis
cgagucgucgcgcac

SEQ ID NO: 983147 - RNA, 15 nt, Mycobacterium avium subsp. paratuberculosis
cgagucggugaccac

SEQ ID NO: 983148 - RNA, 20 nt, Mycobacterium avium subsp. paratuberculosis
cgagucguacuucgcccccg

SEQ ID NO: 983149 - RNA, 20 nt, Mycobacterium avium subsp. paratuberculosis
cgagucguagaggggccgga

SEQ ID NO: 983150 - RNA, 22 nt, Mycobacterium avium subsp. paratuberculosis
cgagucguagaggggccggacg

SEQ ID NO: 983151 - RNA, 14 nt, Mycobacterium avium subsp. paratuberculosis
cgagucgagcaccg

SEQ ID NO: 983152 - RNA, 16 nt, Mycobacterium avium subsp. paratuberculosis
cgagucgagcaccgcg

SEQ ID NO: 983153 - RNA, 20 nt, Mycobacterium avium subsp. paratuberculosis
cgagucgaagccguccaggc

SEQ ID NO: 983154 - RNA, 14 nt, Mycobacterium avium subsp. paratuberculosis
cgagucgaugaccu

SEQ ID NO: 983155 - RNA, 16 nt, Mycobacterium avium subsp. paratuberculosis
cgagggccuccaccac

SEQ ID NO: 983156 - RNA, 17 nt, Mycobacterium avium subsp. paratuberculosis
cgagggccuccaccacc

SEQ ID NO: 983157 - RNA, 12 nt, Mycobacterium avium subsp. paratuberculosis
cgagggccaccg

SEQ ID NO: 983158 - RNA, 14 nt, Mycobacterium avium subsp. paratuberculosis
cgagggccaccggc

SEQ ID NO: 983159 - RNA, 14 nt, Mycobacterium avium subsp. paratuberculosis
cgagggccagcagc

SEQ ID NO: 983160 - RNA, 18 nt, Mycobacterium avium subsp. paratuberculosis
cgaggggcagcagcgccc

SEQ ID NO: 983161 - RNA, 14 nt, Mycobacterium avium subsp. paratuberculosis
cgagggcggcggcu

SEQ ID NO: 983162 - RNA, 21 nt, Mycobacterium avium subsp. paratuberculosis
cgagggucgccaggccaccgc

SEQ ID NO: 983163 - RNA, 17 nt, Mycobacterium avium subsp. paratuberculosis
cgaggucauaucgacgg

SEQ ID NO: 983164 - RNA, 20 nt, Mycobacterium avium subsp. paratuberculosis
cgaggucauaucgacggccc

SEQ ID NO: 983165 - RNA, 20 nt, Mycobacterium avium subsp. paratuberculosis
cgaggucaucgagccgagca

SEQ ID NO: 983166 - RNA, 17 nt, Mycobacterium avium subsp. paratuberculosis
cgagguagucggccucc

SEQ ID NO: 983167 - RNA, 17 nt, Mycobacterium avium subsp. paratuberculosis
cgagguggcccagccgc

SEQ ID NO: 983168 - RNA, 16 nt, Mycobacterium avium subsp. paratuberculosis
cgaggugugaggaguc

SEQ ID NO: 983169 - RNA, 22 nt, Mycobacterium avium subsp. paratuberculosis
cgaggugugaggagucgggcaa

SEQ ID NO: 983170 - RNA, 24 nt, Mycobacterium avium subsp. paratuberculosis
cgagguugaaucgccuacugcgcc

SEQ ID NO: 983171 - RNA, 22 nt, Mycobacterium avium subsp. paratuberculosis
cgaggugaucgcgaacgcgccg

SEQ ID NO: 983172 - RNA, 17 nt, Mycobacterium avium subsp. paratuberculosis
cgaggugcacgcccaga

SEQ ID NO: 983173 - RNA, 18 nt, Mycobacterium avium subsp. paratuberculosis
cgaggugcacgcccagac

SEQ ID NO: 983174 - RNA, 21 nt, Mycobacterium avium subsp. paratuberculosis
cgaggugaagucguccagcgu

SEQ ID NO: 983175 - RNA, 16 nt, Mycobacterium avium subsp. paratuberculosis
cgaggucgucgagggc

SEQ ID NO: 983176 - RNA, 18 nt, Mycobacterium avium subsp. paratuberculosis
cgaggucgucgagggcca

SEQ ID NO: 983177 - RNA, 23 nt, Mycobacterium avium subsp. paratuberculosis
cgagguccuugcggaaccgcugc

SEQ ID NO: 983178 - RNA, 23 nt, Mycobacterium avium subsp. paratuberculosis
cgaggucgcggcggccggcgccg

SEQ ID NO: 983179 - RNA, 16 nt, Mycobacterium avium subsp. paratuberculosis
cgaggucuucgguccc

SEQ ID NO: 983180 - RNA, 15 nt, Mycobacterium avium subsp. paratuberculosis
cgagccuggcgcgca

SEQ ID NO: 983181 - RNA, 20 nt, Mycobacterium avium subsp. paratuberculosis
cgagccuggugauccucguc

SEQ ID NO: 983182 - RNA, 19 nt, Mycobacterium avium subsp. paratuberculosis
cgagccggugccgaggcag

SEQ ID NO: 983183 - RNA, 22 nt, Mycobacterium avium subsp. paratuberculosis
cgagccggugguuuugcggccc

SEQ ID NO: 983184 - RNA, 16 nt, Mycobacterium avium subsp. paratuberculosis
cgagccgguuggacau

SEQ ID NO: 983185 - RNA, 16 nt, Mycobacterium avium subsp. paratuberculosis
cgagccgggcagcgcg

SEQ ID NO: 983186 - RNA, 17 nt, Mycobacterium avium subsp. paratuberculosis
cgagccgggcagcgcga

SEQ ID NO: 983187 - RNA, 18 nt, Mycobacterium avium subsp. paratuberculosis
cgagccgggcggccagcg

SEQ ID NO: 983188 - RNA, 15 nt, Mycobacterium avium subsp. paratuberculosis
cgagccgggucaucc

SEQ ID NO: 983189 - RNA, 14 nt, Mycobacterium avium subsp. paratuberculosis
cgagccggcccggg

SEQ ID NO: 983190 - RNA, 18 nt, Mycobacterium avium subsp. paratuberculosis
cgagccgcucccgcagcg

SEQ ID NO: 983191 - RNA, 20 nt, Mycobacterium avium subsp. paratuberculosis
cgagccgcucgcgcaccggg

SEQ ID NO: 983192 - RNA, 17 nt, Mycobacterium avium subsp. paratuberculosis
cgagccggcacgcgcgc

SEQ ID NO: 983193 - RNA, 19 nt, Mycobacterium avium subsp. paratuberculosis
cgagccggcacggccggcc

SEQ ID NO: 983194 - RNA, 13 nt, Mycobacterium avium subsp. paratuberculosis
cgagccgccgccg

SEQ ID NO: 983195 - RNA, 16 nt, Mycobacterium avium subsp. paratuberculosis
cgagccgccgccggcg

SEQ ID NO: 983196 - RNA, 14 nt, Mycobacterium avium subsp. paratuberculosis
cgagccgcccaggc

SEQ ID NO: 983197 - RNA, 22 nt, Mycobacterium avium subsp. paratuberculosis
cgagccgacagucgcgggcggg

SEQ ID NO: 983198 - RNA, 15 nt, Mycobacterium avium subsp. paratuberculosis
cgagccgcaccgccu

SEQ ID NO: 983199 - RNA, 16 nt, Mycobacterium avium subsp. paratuberculosis
cgagccgcaccgccuc

SEQ ID NO: 983200 - RNA, 13 nt, Mycobacterium avium subsp. paratuberculosis
cgagcgagcgcac

SEQ ID NO: 983201 - RNA, 16 nt, Mycobacterium avium subsp. paratuberculosis
cgagcgagcgcaccag

SEQ ID NO: 983202 - RNA, 13 nt, Mycobacterium avium subsp. paratuberculosis
cgagcgcagcagg

SEQ ID NO: 983203 - RNA, 14 nt, Mycobacterium avium subsp. paratuberculosis
cgagcgcaccgccc

SEQ ID NO: 983204 - RNA, 15 nt, Mycobacterium avium subsp. paratuberculosis
cgagcgcaccgccca

SEQ ID NO: 983205 - RNA, 15 nt, Mycobacterium avium subsp. paratuberculosis
cgagcgccgcggcca

SEQ ID NO: 983206 - RNA, 19 nt, Mycobacterium avium subsp. paratuberculosis
cgagcgccgcggccaccgg

SEQ ID NO: 983207 - RNA, 13 nt, Mycobacterium avium subsp. paratuberculosis
cgagcgccggacg

SEQ ID NO: 983208 - RNA, 15 nt, Mycobacterium avium subsp. paratuberculosis
cgagcgccggacgcu

SEQ ID NO: 983209 - RNA, 14 nt, Mycobacterium avium subsp. paratuberculosis
cgagcgcccgggcg

SEQ ID NO: 983210 - RNA, 15 nt, Mycobacterium avium subsp. paratuberculosis
cgagcgcccgggcgu

SEQ ID NO: 983211 - RNA, 15 nt, Mycobacterium avium subsp. paratuberculosis
cgagcgcgccgccgc

SEQ ID NO: 983212 - RNA, 21 nt, Mycobacterium avium subsp. paratuberculosis
cgagcgcgccgagguggcccg

SEQ ID NO: 983213 - RNA, 17 nt, Mycobacterium avium subsp. paratuberculosis
cgagcucaacagcauug

SEQ ID NO: 983214 - RNA, 18 nt, Mycobacterium avium subsp. paratuberculosis
cgagcgugggggccaugu

SEQ ID NO: 983215 - RNA, 21 nt, Mycobacterium avium subsp. paratuberculosis
cgagcucggccaccagcgccc

SEQ ID NO: 983216 - RNA, 18 nt, Mycobacterium avium subsp. paratuberculosis
cgagcucgaagcccaggg

SEQ ID NO: 983217 - RNA, 17 nt, Mycobacterium avium subsp. paratuberculosis
cgagcuccagcuaggag

SEQ ID NO: 983218 - RNA, 18 nt, Mycobacterium avium subsp. paratuberculosis
cgagcuccucggccagcg

SEQ ID NO: 983219 - RNA, 15 nt, Mycobacterium avium subsp. paratuberculosis
cgagcucaccgccga

SEQ ID NO: 983220 - RNA, 20 nt, Mycobacterium avium subsp. paratuberculosis
cgagcugcgggugcucagcc

SEQ ID NO: 983221 - RNA, 15 nt, Mycobacterium avium subsp. paratuberculosis
cgagcugcacgggcg

SEQ ID NO: 983222 - RNA, 19 nt, Mycobacterium avium subsp. paratuberculosis
cgagcugccggcggccgcc

SEQ ID NO: 983223 - RNA, 23 nt, Mycobacterium avium subsp. paratuberculosis
cgagcucguucucggcgaacagc

SEQ ID NO: 983224 - RNA, 11 nt, Mycobacterium avium subsp. paratuberculosis
cgagcgggccu

SEQ ID NO: 983225 - RNA, 13 nt, Mycobacterium avium subsp. paratuberculosis
cgagcgggcgggc

SEQ ID NO: 983226 - RNA, 12 nt, Mycobacterium avium subsp. paratuberculosis
cgagcgugcccg

SEQ ID NO: 983227 - RNA, 21 nt, Mycobacterium avium subsp. paratuberculosis
cgagcgugcccgcgcccaccu

SEQ ID NO: 983228 - RNA, 20 nt, Mycobacterium avium subsp. paratuberculosis
cgagcgucgugcgggcuccg

SEQ ID NO: 983229 - RNA, 21 nt, Mycobacterium avium subsp. paratuberculosis
cgagcgugaaguuaguuucac

SEQ ID NO: 983230 - RNA, 22 nt, Mycobacterium avium subsp. paratuberculosis
cgagcggcgacuccagcagcgc

SEQ ID NO: 983231 - RNA, 13 nt, Mycobacterium avium subsp. paratuberculosis
cgagcggcgcugc

SEQ ID NO: 983232 - RNA, 15 nt, Mycobacterium avium subsp. paratuberculosis
cgagcggcgcugcag

SEQ ID NO: 983233 - RNA, 20 nt, Mycobacterium avium subsp. paratuberculosis
cgagcggcgcugcagcagcc

SEQ ID NO: 983234 - RNA, 21 nt, Mycobacterium avium subsp. paratuberculosis
cgagcggcgcugcagcagccc

SEQ ID NO: 983235 - RNA, 17 nt, Mycobacterium avium subsp. paratuberculosis
cgagcgcuucgggagca

SEQ ID NO: 983236 - RNA, 18 nt, Mycobacterium avium subsp. paratuberculosis
cgagcgcgugcacgaacg

SEQ ID NO: 983237 - RNA, 20 nt, Mycobacterium avium subsp. paratuberculosis
cgagcgcgucgaccagccgc

SEQ ID NO: 983238 - RNA, 15 nt, Mycobacterium avium subsp. paratuberculosis
cgagcgcuaccgcgc

SEQ ID NO: 983239 - RNA, 19 nt, Mycobacterium avium subsp. paratuberculosis
cgagcgcgcugaucgccgc

SEQ ID NO: 983240 - RNA, 19 nt, Mycobacterium avium subsp. paratuberculosis
cgagcuggccgcccaccac

SEQ ID NO: 983241 - RNA, 15 nt, Mycobacterium avium subsp. paratuberculosis
cgagcugggccggcg

SEQ ID NO: 983242 - RNA, 18 nt, Mycobacterium avium subsp. paratuberculosis
cgagcuugccuugcgccc

SEQ ID NO: 983243 - RNA, 14 nt, Mycobacterium avium subsp. paratuberculosis
cgagcuuggcgggc

SEQ ID NO: 983244 - RNA, 21 nt, Mycobacterium avium subsp. paratuberculosis
cgagcuugggccggugcagca

SEQ ID NO: 983245 - RNA, 16 nt, Mycobacterium avium subsp. paratuberculosis
cgaggaacccgaccgc

SEQ ID NO: 983246 - RNA, 16 nt, Mycobacterium avium subsp. paratuberculosis
cgaggaaccggcagcc

SEQ ID NO: 983247 - RNA, 20 nt, Mycobacterium avium subsp. paratuberculosis
cgaggaaccggcagccggcg

SEQ ID NO: 983248 - RNA, 17 nt, Mycobacterium avium subsp. paratuberculosis
cgaggaccggcgccggc

SEQ ID NO: 983249 - RNA, 17 nt, Mycobacterium avium subsp. paratuberculosis
cgaggagaccuccugcu

SEQ ID NO: 983250 - RNA, 19 nt, Mycobacterium avium subsp. paratuberculosis
cgaggaaguccggcgcgcc

SEQ ID NO: 983251 - RNA, 18 nt, Mycobacterium avium subsp. paratuberculosis
cgaggaacuugcgccggg

SEQ ID NO: 983252 - RNA, 20 nt, Mycobacterium avium subsp. paratuberculosis
cgaggaacuugcgccgggug

SEQ ID NO: 983253 - RNA, 22 nt, Mycobacterium avium subsp. paratuberculosis
cgaggaauugcgcuacggcaga

SEQ ID NO: 983254 - RNA, 17 nt, Mycobacterium avium subsp. paratuberculosis
cgaggaucugggcggcg

SEQ ID NO: 983255 - RNA, 19 nt, Mycobacterium avium subsp. paratuberculosis
cgaggaucugggcggcggg

SEQ ID NO: 983256 - RNA, 22 nt, Mycobacterium avium subsp. paratuberculosis
cgaggaucuugaucgcgaagac

SEQ ID NO: 983257 - RNA, 23 nt, Mycobacterium avium subsp. paratuberculosis
cgaggaucucccggguggccucc

SEQ ID NO: 983258 - RNA, 21 nt, Mycobacterium avium subsp. paratuberculosis
cgaggaucgcgaugucgacgg

SEQ ID NO: 983259 - RNA, 22 nt, Mycobacterium avium subsp. paratuberculosis
cgaggagauuuuguuuggagag

SEQ ID NO: 983260 - RNA, 21 nt, Mycobacterium avium subsp. paratuberculosis
cgaggagacgucggccggguc

SEQ ID NO: 983261 - RNA, 18 nt, Mycobacterium avium subsp. paratuberculosis
cgaggcugugggccagca

SEQ ID NO: 983262 - RNA, 14 nt, Mycobacterium avium subsp. paratuberculosis
cgaggcgugcagcc

SEQ ID NO: 983263 - RNA, 15 nt, Mycobacterium avium subsp. paratuberculosis
cgaggcgugcagccc

SEQ ID NO: 983264 - RNA, 19 nt, Mycobacterium avium subsp. paratuberculosis
cgaggcgugcagcccgcau

SEQ ID NO: 983265 - RNA, 17 nt, Mycobacterium avium subsp. paratuberculosis
cgaggcgugccgcuggg

SEQ ID NO: 983266 - RNA, 20 nt, Mycobacterium avium subsp. paratuberculosis
cgaggcggccagcggcagcg

SEQ ID NO: 983267 - RNA, 13 nt, Mycobacterium avium subsp. paratuberculosis
cgaggcgcuccug

SEQ ID NO: 983268 - RNA, 13 nt, Mycobacterium avium subsp. paratuberculosis
cgaggccagcgcg

SEQ ID NO: 983269 - RNA, 14 nt, Mycobacterium avium subsp. paratuberculosis
cgaggccagcgcga

SEQ ID NO: 983270 - RNA, 13 nt, Mycobacterium avium subsp. paratuberculosis
cgaggccagcacg

SEQ ID NO: 983271 - RNA, 19 nt, Mycobacterium avium subsp. paratuberculosis
cgaggccagggcccgcagc

SEQ ID NO: 983272 - RNA, 15 nt, Mycobacterium avium subsp. paratuberculosis
cgaggccgggcuggc

SEQ ID NO: 983273 - RNA, 17 nt, Mycobacterium avium subsp. paratuberculosis
cgaggccgcgccgugcg

SEQ ID NO: 983274 - RNA, 22 nt, Mycobacterium avium subsp. paratuberculosis
cgaggccgcgggcguucaucac

SEQ ID NO: 983275 - RNA, 17 nt, Mycobacterium avium subsp. paratuberculosis
cgaggccgcugacaagc

SEQ ID NO: 983276 - RNA, 17 nt, Mycobacterium avium subsp. paratuberculosis
cgaggcccggacggcca

SEQ ID NO: 983277 - RNA, 21 nt, Mycobacterium avium subsp. paratuberculosis
cgaggcccucgacaccggugg

SEQ ID NO: 983278 - RNA, 17 nt, Mycobacterium avium subsp. paratuberculosis
cgaggccgaaccgcagc

SEQ ID NO: 983279 - RNA, 20 nt, Mycobacterium avium subsp. paratuberculosis
cgaggauggggucgcgggcg

SEQ ID NO: 983280 - RNA, 22 nt, Mycobacterium avium subsp. paratuberculosis
cgaggauggggucgcgggcgcc

SEQ ID NO: 983281 - RNA, 15 nt, Mycobacterium avium subsp. paratuberculosis
cgacguuggccagca

SEQ ID NO: 983282 - RNA, 19 nt, Mycobacterium avium subsp. paratuberculosis
cgacguuggccagcaccgc

SEQ ID NO: 983283 - RNA, 22 nt, Mycobacterium avium subsp. paratuberculosis
cgacgucugggccgccgagcag

SEQ ID NO: 983284 - RNA, 20 nt, Mycobacterium avium subsp. paratuberculosis
cgacgucugguuggccggcg

SEQ ID NO: 983285 - RNA, 14 nt, Mycobacterium avium subsp. paratuberculosis
cgacgucgucgacc

SEQ ID NO: 983286 - RNA, 16 nt, Mycobacterium avium subsp. paratuberculosis
cgacgucgucguccuc

SEQ ID NO: 983287 - RNA, 23 nt, Mycobacterium avium subsp. paratuberculosis
cgacgucgugggcgauccgcagg

SEQ ID NO: 983288 - RNA, 12 nt, Mycobacterium avium subsp. paratuberculosis
cgacgugcagcg

SEQ ID NO: 983289 - RNA, 14 nt, Mycobacterium avium subsp. paratuberculosis
cgacgugcagcgcc

SEQ ID NO: 983290 - RNA, 19 nt, Mycobacterium avium subsp. paratuberculosis
cgacgugcccuuccccggc

SEQ ID NO: 983291 - RNA, 23 nt, Mycobacterium avium subsp. paratuberculosis
cgacgugcccuuccccggcggcc

SEQ ID NO: 983292 - RNA, 15 nt, Mycobacterium avium subsp. paratuberculosis
cgacguucgccgcca

SEQ ID NO: 983293 - RNA, 18 nt, Mycobacterium avium subsp. paratuberculosis
cgacguucgccgccagca

SEQ ID NO: 983294 - RNA, 14 nt, Mycobacterium avium subsp. paratuberculosis
cgacucgcaggugc

SEQ ID NO: 983295 - RNA, 17 nt, Mycobacterium avium subsp. paratuberculosis
cgacuccugguccucga

SEQ ID NO: 983296 - RNA, 14 nt, Mycobacterium avium subsp. paratuberculosis
cgacucgaccccgc

SEQ ID NO: 983297 - RNA, 16 nt, Mycobacterium avium subsp. paratuberculosis
cgacucgaccccgccc

SEQ ID NO: 983298 - RNA, 17 nt, Mycobacterium avium subsp. paratuberculosis
cgacucgaccccgccca

SEQ ID NO: 983299 - RNA, 15 nt, Mycobacterium avium subsp. paratuberculosis
cgacuccagcaccgg

SEQ ID NO: 983300 - RNA, 15 nt, Mycobacterium avium subsp. paratuberculosis
cgacuccccgcccgg

SEQ ID NO: 983301 - RNA, 16 nt, Mycobacterium avium subsp. paratuberculosis
cgacuuucaaguccuc

SEQ ID NO: 983302 - RNA, 22 nt, Mycobacterium avium subsp. paratuberculosis
cgacuuggccagcagccgcgac

SEQ ID NO: 983303 - RNA, 16 nt, Mycobacterium avium subsp. paratuberculosis
cgacuugccgccgcac

SEQ ID NO: 983304 - RNA, 20 nt, Mycobacterium avium subsp. paratuberculosis
cgacuucuucgccggcgcuu

SEQ ID NO: 983305 - RNA, 19 nt, Mycobacterium avium subsp. paratuberculosis
cgacuugaccagcagcugg

SEQ ID NO: 983306 - RNA, 22 nt, Mycobacterium avium subsp. paratuberculosis
cgacugcaggaacaaccgcagc

SEQ ID NO: 983307 - RNA, 22 nt, Mycobacterium avium subsp. paratuberculosis
cgacugcacccgaacggaccgg

SEQ ID NO: 983308 - RNA, 23 nt, Mycobacterium avium subsp. paratuberculosis
cgacugcacccgggucaggucga

SEQ ID NO: 983309 - RNA, 16 nt, Mycobacterium avium subsp. paratuberculosis
cgacugcgugcugggc

SEQ ID NO: 983310 - RNA, 16 nt, Mycobacterium avium subsp. paratuberculosis
cgacugucggcucgcc

SEQ ID NO: 983311 - RNA, 15 nt, Mycobacterium avium subsp. paratuberculosis
cgacgcggcgcgcga

SEQ ID NO: 983312 - RNA, 16 nt, Mycobacterium avium subsp. paratuberculosis
cgacgcggcgcgcgau

SEQ ID NO: 983313 - RNA, 21 nt, Mycobacterium avium subsp. paratuberculosis
cgacgcggucugcggugcgcc

SEQ ID NO: 983314 - RNA, 23 nt, Mycobacterium avium subsp. paratuberculosis
cgacgcggugagcgcgccggccc

SEQ ID NO: 983315 - RNA, 12 nt, Mycobacterium avium subsp. paratuberculosis
cgacgcgcugcg

SEQ ID NO: 983316 - RNA, 21 nt, Mycobacterium avium subsp. paratuberculosis
cgacgcgcugcgcgccgcccu

SEQ ID NO: 983317 - RNA, 22 nt, Mycobacterium avium subsp. paratuberculosis
cgacgcgcggucgucuucuugg

SEQ ID NO: 983318 - RNA, 23 nt, Mycobacterium avium subsp. paratuberculosis
cgacgcgcggucgucuucuuggc

SEQ ID NO: 983319 - RNA, 18 nt, Mycobacterium avium subsp. paratuberculosis
cgacgcgccgucggccca

SEQ ID NO: 983320 - RNA, 15 nt, Mycobacterium avium subsp. paratuberculosis
cgacgcgaccggccc

SEQ ID NO: 983321 - RNA, 20 nt, Mycobacterium avium subsp. paratuberculosis
cgacgccgucacggaucgcc

SEQ ID NO: 983322 - RNA, 18 nt, Mycobacterium avium subsp. paratuberculosis
cgacgccgucauccccau

SEQ ID NO: 983323 - RNA, 22 nt, Mycobacterium avium subsp. paratuberculosis
cgacgccgucgaugacgcgcuu

SEQ ID NO: 983324 - RNA, 16 nt, Mycobacterium avium subsp. paratuberculosis
cgacgccgggcagcgc

SEQ ID NO: 983325 - RNA, 12 nt, Mycobacterium avium subsp. paratuberculosis
cgacgccgggcu

SEQ ID NO: 983326 - RNA, 19 nt, Mycobacterium avium subsp. paratuberculosis
cgacggagccgagcaccag

SEQ ID NO: 983327 - RNA, 16 nt, Mycobacterium avium subsp. paratuberculosis
cgacggaucggccgcg

SEQ ID NO: 983328 - RNA, 19 nt, Mycobacterium avium subsp. paratuberculosis
cgacgcugaacagcagcag

SEQ ID NO: 983329 - RNA, 15 nt, Mycobacterium avium subsp. paratuberculosis
cgacgcugagcaccc

SEQ ID NO: 983330 - RNA, 14 nt, Mycobacterium avium subsp. paratuberculosis
cgacgcugagcgcc

SEQ ID NO: 983331 - RNA, 20 nt, Mycobacterium avium subsp. paratuberculosis
cgacgcugagcgccaggcca

SEQ ID NO: 983332 - RNA, 18 nt, Mycobacterium avium subsp. paratuberculosis
cgacgcugccggggcgca

SEQ ID NO: 983333 - RNA, 14 nt, Mycobacterium avium subsp. paratuberculosis
cgacggcacccggc

SEQ ID NO: 983334 - RNA, 18 nt, Mycobacterium avium subsp. paratuberculosis
cgacggcaauacggggca

SEQ ID NO: 983335 - RNA, 18 nt, Mycobacterium avium subsp. paratuberculosis
cgacggcaauccggcccc

SEQ ID NO: 983336 - RNA, 13 nt, Mycobacterium avium subsp. paratuberculosis
cgacggcagcgcg

SEQ ID NO: 983337 - RNA, 21 nt, Mycobacterium avium subsp. paratuberculosis
cgacggccaccgcgacgcugc

SEQ ID NO: 983338 - RNA, 13 nt, Mycobacterium avium subsp. paratuberculosis
cgacgucgcgcag

SEQ ID NO: 983339 - RNA, 14 nt, Mycobacterium avium subsp. paratuberculosis
cgacguccugguug

SEQ ID NO: 983340 - RNA, 16 nt, Mycobacterium avium subsp. paratuberculosis
cgacgucgacgcgggc

SEQ ID NO: 983341 - RNA, 18 nt, Mycobacterium avium subsp. paratuberculosis
cgacgucgacggcagcgc

SEQ ID NO: 983342 - RNA, 19 nt, Mycobacterium avium subsp. paratuberculosis
cgacgucgacggcagcgcu

SEQ ID NO: 983343 - RNA, 20 nt, Mycobacterium avium subsp. paratuberculosis
cgacgucgagaaaggccagc

SEQ ID NO: 983344 - RNA, 24 nt, Mycobacterium avium subsp. paratuberculosis
cgacguccucgacgaucagcacgu

SEQ ID NO: 983345 - RNA, 14 nt, Mycobacterium avium subsp. paratuberculosis
cgacguaggacagc

SEQ ID NO: 983346 - RNA, 15 nt, Mycobacterium avium subsp. paratuberculosis
cgacguaggacagca

SEQ ID NO: 983347 - RNA, 15 nt, Mycobacterium avium subsp. paratuberculosis
cgacgucaacaccgu

SEQ ID NO: 983348 - RNA, 17 nt, Mycobacterium avium subsp. paratuberculosis
cgacgucaacaccgugg

SEQ ID NO: 983349 - RNA, 19 nt, Mycobacterium avium subsp. paratuberculosis
cgacgguguaggacgccgu

SEQ ID NO: 983350 - RNA, 18 nt, Mycobacterium avium subsp. paratuberculosis
cgacggucuucccgccgc

SEQ ID NO: 983351 - RNA, 23 nt, Mycobacterium avium subsp. paratuberculosis
cgacggugaugucgccggcggcg

SEQ ID NO: 983352 - RNA, 21 nt, Mycobacterium avium subsp. paratuberculosis
cgacggugcgugccagcagcu

SEQ ID NO: 983353 - RNA, 19 nt, Mycobacterium avium subsp. paratuberculosis
cgacgguggcccccaccac

SEQ ID NO: 983354 - RNA, 22 nt, Mycobacterium avium subsp. paratuberculosis
cgacgguggccucggcgcugcc

SEQ ID NO: 983355 - RNA, 21 nt, Mycobacterium avium subsp. paratuberculosis
cgacgguggcgaagcacgacc

SEQ ID NO: 983356 - RNA, 18 nt, Mycobacterium avium subsp. paratuberculosis
cgacgguggcgggccgcc

SEQ ID NO: 983357 - RNA, 17 nt, Mycobacterium avium subsp. paratuberculosis
cgacgguuugcccggcg

SEQ ID NO: 983358 - RNA, 21 nt, Mycobacterium avium subsp. paratuberculosis
cgacggugaccucgucgggcg

SEQ ID NO: 983359 - RNA, 17 nt, Mycobacterium avium subsp. paratuberculosis
cgacggugaucaggguc

SEQ ID NO: 983360 - RNA, 21 nt, Mycobacterium avium subsp. paratuberculosis
cgacguacagcgagccgucga

SEQ ID NO: 983361 - RNA, 14 nt, Mycobacterium avium subsp. paratuberculosis
cgacguacccccgc

SEQ ID NO: 983362 - RNA, 20 nt, Mycobacterium avium subsp. paratuberculosis
cgacggccggcgucacucug

SEQ ID NO: 983363 - RNA, 12 nt, Mycobacterium avium subsp. paratuberculosis
cgacggccggcg

SEQ ID NO: 983364 - RNA, 13 nt, Mycobacterium avium subsp. paratuberculosis
cgacggcgccgcc

SEQ ID NO: 983365 - RNA, 13 nt, Mycobacterium avium subsp. paratuberculosis
cgacggcgccggu

SEQ ID NO: 983366 - RNA, 20 nt, Mycobacterium avium subsp. paratuberculosis
cgacggcggggugcgcggcg

SEQ ID NO: 983367 - RNA, 12 nt, Mycobacterium avium subsp. paratuberculosis
cgacgggcaccc

SEQ ID NO: 983368 - RNA, 15 nt, Mycobacterium avium subsp. paratuberculosis
cgacgggccaccagc

SEQ ID NO: 983369 - RNA, 20 nt, Mycobacterium avium subsp. paratuberculosis
cgacgggcgugccggcggcg

SEQ ID NO: 983370 - RNA, 18 nt, Mycobacterium avium subsp. paratuberculosis
cgacggcguggaacacgc

SEQ ID NO: 983371 - RNA, 15 nt, Mycobacterium avium subsp. paratuberculosis
cgacggcguugcugg

SEQ ID NO: 983372 - RNA, 18 nt, Mycobacterium avium subsp. paratuberculosis
cgacggcguccgggcgcu

SEQ ID NO: 983373 - RNA, 17 nt, Mycobacterium avium subsp. paratuberculosis
cgacggcgucggcgagc

SEQ ID NO: 983374 - RNA, 21 nt, Mycobacterium avium subsp. paratuberculosis
cgacggcgucggcggccugcu

SEQ ID NO: 983375 - RNA, 17 nt, Mycobacterium avium subsp. paratuberculosis
cgagaaaggccagcacg

SEQ ID NO: 983376 - RNA, 18 nt, Mycobacterium avium subsp. paratuberculosis
cgagacacccucgcgcag

SEQ ID NO: 983377 - RNA, 16 nt, Mycobacterium avium subsp. paratuberculosis
cgagacguggucgggc

SEQ ID NO: 983378 - RNA, 21 nt, Mycobacterium avium subsp. paratuberculosis
cgagaccucccggcgccacgc

SEQ ID NO: 983379 - RNA, 20 nt, Mycobacterium avium subsp. paratuberculosis
cgagaccggcacggugcaca

SEQ ID NO: 983380 - RNA, 20 nt, Mycobacterium avium subsp. paratuberculosis
cgagaccaugucggccaggu

SEQ ID NO: 983381 - RNA, 20 nt, Mycobacterium avium subsp. paratuberculosis
cgagauggggugaugcgucc

SEQ ID NO: 983382 - RNA, 13 nt, Mycobacterium avium subsp. paratuberculosis
cgagauggacagc

SEQ ID NO: 983383 - RNA, 13 nt, Mycobacterium avium subsp. paratuberculosis
cgagauggcaaca

SEQ ID NO: 983384 - RNA, 18 nt, Mycobacterium avium subsp. paratuberculosis
cgagauggccaccaucag

SEQ ID NO: 983385 - RNA, 19 nt, Mycobacterium avium subsp. paratuberculosis
cgagauggcgaucagaugc

SEQ ID NO: 983386 - RNA, 22 nt, Mycobacterium avium subsp. paratuberculosis
cgagaucccugcgcucagcacg

SEQ ID NO: 983387 - RNA, 22 nt, Mycobacterium avium subsp. paratuberculosis
cgagaucggggccuugacuccc

SEQ ID NO: 983388 - RNA, 14 nt, Mycobacterium avium subsp. paratuberculosis
cgagaucagcaccg

SEQ ID NO: 983389 - RNA, 21 nt, Mycobacterium avium subsp. paratuberculosis
cgagagcucuugcgccccaga

SEQ ID NO: 983390 - RNA, 14 nt, Mycobacterium avium subsp. paratuberculosis
cgagagcugcugcc

SEQ ID NO: 983391 - RNA, 15 nt, Mycobacterium avium subsp. paratuberculosis
cgagaguuugcccuc

SEQ ID NO: 983392 - RNA, 20 nt, Mycobacterium avium subsp. paratuberculosis
cgagaguccgccgccgggcc

SEQ ID NO: 983393 - RNA, 12 nt, Mycobacterium avium subsp. paratuberculosis
cgagcaucaccg

SEQ ID NO: 983394 - RNA, 13 nt, Mycobacterium avium subsp. paratuberculosis
cgagcaucacgaa

SEQ ID NO: 983395 - RNA, 14 nt, Mycobacterium avium subsp. paratuberculosis
cgagcaucagcugc

SEQ ID NO: 983396 - RNA, 17 nt, Mycobacterium avium subsp. paratuberculosis
cgagcaguagacgccgc

SEQ ID NO: 983397 - RNA, 20 nt, Mycobacterium avium subsp. paratuberculosis
cgagcagguucuccucccag

SEQ ID NO: 983398 - RNA, 20 nt, Mycobacterium avium subsp. paratuberculosis
cgagcaggcggaucggcccg

SEQ ID NO: 983399 - RNA, 16 nt, Mycobacterium avium subsp. paratuberculosis
cgagcauccggugccg

SEQ ID NO: 983400 - RNA, 16 nt, Mycobacterium avium subsp. paratuberculosis
cgagcaucgccgagcg

SEQ ID NO: 983401 - RNA, 19 nt, Mycobacterium avium subsp. paratuberculosis
cgagcaucuccagccggcg

SEQ ID NO: 983402 - RNA, 19 nt, Mycobacterium avium subsp. paratuberculosis
cgagccauaaaccggccgg

SEQ ID NO: 983403 - RNA, 21 nt, Mycobacterium avium subsp. paratuberculosis
cgagccauaaaccggccggcg

SEQ ID NO: 983404 - RNA, 15 nt, Mycobacterium avium subsp. paratuberculosis
cgagccaccacugcg

SEQ ID NO: 983405 - RNA, 14 nt, Mycobacterium avium subsp. paratuberculosis
cgagcccaccgcgc

SEQ ID NO: 983406 - RNA, 12 nt, Mycobacterium avium subsp. paratuberculosis
cgagcccagccg

SEQ ID NO: 983407 - RNA, 13 nt, Mycobacterium avium subsp. paratuberculosis
cgagcccagccgu

SEQ ID NO: 983408 - RNA, 18 nt, Mycobacterium avium subsp. paratuberculosis
cgagcccgacggcagcac

SEQ ID NO: 983409 - RNA, 12 nt, Mycobacterium avium subsp. paratuberculosis
cgagcccgccgg

SEQ ID NO: 983410 - RNA, 22 nt, Mycobacterium avium subsp. paratuberculosis
cgagccgagcacgcagccgcgc

SEQ ID NO: 983411 - RNA, 18 nt, Mycobacterium avium subsp. paratuberculosis
cgagccgaugcccagcag

SEQ ID NO: 983412 - RNA, 22 nt, Mycobacterium avium subsp. paratuberculosis
cgagccgauugucgcugcgagg

SEQ ID NO: 983413 - RNA, 14 nt, Mycobacterium avium subsp. paratuberculosis
cgagcccgccggcg

SEQ ID NO: 983414 - RNA, 13 nt, Mycobacterium avium subsp. paratuberculosis
cgagcccgcgccc

SEQ ID NO: 983415 - RNA, 15 nt, Mycobacterium avium subsp. paratuberculosis
cgagcccggccaguc

SEQ ID NO: 983416 - RNA, 17 nt, Mycobacterium avium subsp. paratuberculosis
cgagcagcaccacccgc

SEQ ID NO: 983417 - RNA, 22 nt, Mycobacterium avium subsp. paratuberculosis
cgagcagacgcgaaagcacccg

SEQ ID NO: 983418 - RNA, 13 nt, Mycobacterium avium subsp. paratuberculosis
cgagcagacacaa

SEQ ID NO: 983419 - RNA, 21 nt, Mycobacterium avium subsp. paratuberculosis
cgagcagacacaaaagcgccc

SEQ ID NO: 983420 - RNA, 16 nt, Mycobacterium avium subsp. paratuberculosis
cgagcagacccgccgc

SEQ ID NO: 983421 - RNA, 13 nt, Mycobacterium avium subsp. paratuberculosis
cgagcagcagcgc

SEQ ID NO: 983422 - RNA, 19 nt, Mycobacterium avium subsp. paratuberculosis
cgagcagcagcgcggugcc

SEQ ID NO: 983423 - RNA, 17 nt, Mycobacterium avium subsp. paratuberculosis
cgagcagccgcaacacg

SEQ ID NO: 983424 - RNA, 17 nt, Mycobacterium avium subsp. paratuberculosis
cgagcagccgcgccggg

SEQ ID NO: 983425 - RNA, 14 nt, Mycobacterium avium subsp. paratuberculosis
cgagcagccgggcc

SEQ ID NO: 983426 - RNA, 16 nt, Mycobacterium avium subsp. paratuberculosis
cgagcagcgcgaugcc

SEQ ID NO: 983427 - RNA, 14 nt, Mycobacterium avium subsp. paratuberculosis
cgagcagcgcgcgc

SEQ ID NO: 983428 - RNA, 18 nt, Mycobacterium avium subsp. paratuberculosis
cgagcagcggggugagca

SEQ ID NO: 983429 - RNA, 21 nt, Mycobacterium avium subsp. paratuberculosis
cgagcagcggggugagcaccg

SEQ ID NO: 983430 - RNA, 17 nt, Mycobacterium avium subsp. paratuberculosis
cgagcagcucagccgcc

SEQ ID NO: 983431 - RNA, 19 nt, Mycobacterium avium subsp. paratuberculosis
cgagcagcucggcggccug

SEQ ID NO: 983432 - RNA, 16 nt, Mycobacterium avium subsp. paratuberculosis
cgagcaggaacagaca

SEQ ID NO: 983433 - RNA, 17 nt, Mycobacterium avium subsp. paratuberculosis
cgagcaggccgaggcca

SEQ ID NO: 983434 - RNA, 13 nt, Mycobacterium avium subsp. paratuberculosis
cgagcaacagccc

SEQ ID NO: 983435 - RNA, 17 nt, Mycobacterium avium subsp. paratuberculosis
cgagcaacggccgcagc

SEQ ID NO: 983436 - RNA, 16 nt, Mycobacterium avium subsp. paratuberculosis
cgagcacucgcgggac

SEQ ID NO: 983437 - RNA, 16 nt, Mycobacterium avium subsp. paratuberculosis
cgagcacgcggccgcg

SEQ ID NO: 983438 - RNA, 18 nt, Mycobacterium avium subsp. paratuberculosis
cgagcaccggcggcagcg

SEQ ID NO: 983439 - RNA, 13 nt, Mycobacterium avium subsp. paratuberculosis
cgagcaccgggcg

SEQ ID NO: 983440 - RNA, 14 nt, Mycobacterium avium subsp. paratuberculosis
cgagcaccgggcgu

SEQ ID NO: 983441 - RNA, 13 nt, Mycobacterium avium subsp. paratuberculosis
cgagcaccgugcc

SEQ ID NO: 983442 - RNA, 23 nt, Mycobacterium avium subsp. paratuberculosis
cgagcaccgugccgucggcgucg

SEQ ID NO: 983443 - RNA, 17 nt, Mycobacterium avium subsp. paratuberculosis
cgagcacccggcgggga

SEQ ID NO: 983444 - RNA, 14 nt, Mycobacterium avium subsp. paratuberculosis
cgagcaccgcgacc

SEQ ID NO: 983445 - RNA, 14 nt, Mycobacterium avium subsp. paratuberculosis
cgagcacagcggcg

SEQ ID NO: 983446 - RNA, 15 nt, Mycobacterium avium subsp. paratuberculosis
cgagcacaggaacgc

SEQ ID NO: 983447 - RNA, 14 nt, Mycobacterium avium subsp. paratuberculosis
cgagcaccagcgga

SEQ ID NO: 983448 - RNA, 14 nt, Mycobacterium avium subsp. paratuberculosis
cgagcaccaggcgc

SEQ ID NO: 983449 - RNA, 12 nt, Mycobacterium avium subsp. paratuberculosis
cgagcaccacca

SEQ ID NO: 983450 - RNA, 14 nt, Mycobacterium avium subsp. paratuberculosis
cgagcaccggcagc

SEQ ID NO: 983451 - RNA, 18 nt, Mycobacterium avium subsp. paratuberculosis
cgagcaccggcagcaccg

SEQ ID NO: 983452 - RNA, 21 nt, Mycobacterium avium subsp. paratuberculosis
cgagcaccggcagccgcagcg

SEQ ID NO: 983453 - RNA, 22 nt, Mycobacterium avium subsp. paratuberculosis
ccuggaugucacgguccagguc

SEQ ID NO: 983454 - RNA, 18 nt, Mycobacterium avium subsp. paratuberculosis
ccuggcacgacgccgccg

SEQ ID NO: 983455 - RNA, 15 nt, Mycobacterium avium subsp. paratuberculosis
ccuggcggcgacccg

SEQ ID NO: 983456 - RNA, 16 nt, Mycobacterium avium subsp. paratuberculosis
ccuggcggcgacccgg

SEQ ID NO: 983457 - RNA, 19 nt, Mycobacterium avium subsp. paratuberculosis
ccuggccaacucgaccugc

SEQ ID NO: 983458 - RNA, 19 nt, Mycobacterium avium subsp. paratuberculosis
ccuggcggaaggccgcgcg

SEQ ID NO: 983459 - RNA, 15 nt, Mycobacterium avium subsp. paratuberculosis
ccuggccaccagcag

SEQ ID NO: 983460 - RNA, 17 nt, Mycobacterium avium subsp. paratuberculosis
ccuggcaggugagccgg

SEQ ID NO: 983461 - RNA, 14 nt, Mycobacterium avium subsp. paratuberculosis
ccuggcgggccagc

SEQ ID NO: 983462 - RNA, 18 nt, Mycobacterium avium subsp. paratuberculosis
ccuggcggguacagccgc

SEQ ID NO: 983463 - RNA, 16 nt, Mycobacterium avium subsp. paratuberculosis
ccuggcgguggcccgg

SEQ ID NO: 983464 - RNA, 18 nt, Mycobacterium avium subsp. paratuberculosis
ccugggccuccggcggca

SEQ ID NO: 983465 - RNA, 23 nt, Mycobacterium avium subsp. paratuberculosis
ccugggccagaucgacccccacc

SEQ ID NO: 983466 - RNA, 14 nt, Mycobacterium avium subsp. paratuberculosis
ccugcggugggcgc

SEQ ID NO: 983467 - RNA, 18 nt, Mycobacterium avium subsp. paratuberculosis
ccugcgguucgggcccca

SEQ ID NO: 983468 - RNA, 19 nt, Mycobacterium avium subsp. paratuberculosis
ccugcucgucggggcagcc

SEQ ID NO: 983469 - RNA, 14 nt, Mycobacterium avium subsp. paratuberculosis
ccugcucaccgagc

SEQ ID NO: 983470 - RNA, 18 nt, Mycobacterium avium subsp. paratuberculosis
ccugcucgcuugccagcc

SEQ ID NO: 983471 - RNA, 20 nt, Mycobacterium avium subsp. paratuberculosis
ccugcucgcuugccagccgg

SEQ ID NO: 983472 - RNA, 22 nt, Mycobacterium avium subsp. paratuberculosis
ccuggacgaguggucggccgcc

SEQ ID NO: 983473 - RNA, 19 nt, Mycobacterium avium subsp. paratuberculosis
ccuggacgguuucaccgcc

SEQ ID NO: 983474 - RNA, 16 nt, Mycobacterium avium subsp. paratuberculosis
ccuggagcggguccgc

SEQ ID NO: 983475 - RNA, 19 nt, Mycobacterium avium subsp. paratuberculosis
ccuggagcggguccgcccc

SEQ ID NO: 983476 - RNA, 14 nt, Mycobacterium avium subsp. paratuberculosis
ccuggauauccagc

SEQ ID NO: 983477 - RNA, 21 nt, Mycobacterium avium subsp. paratuberculosis
ccuggaucgcgccuugggcca

SEQ ID NO: 983478 - RNA, 14 nt, Mycobacterium avium subsp. paratuberculosis
ccuggaucagccag

SEQ ID NO: 983479 - RNA, 14 nt, Mycobacterium avium subsp. paratuberculosis
ccuggaugccgccc

SEQ ID NO: 983480 - RNA, 20 nt, Mycobacterium avium subsp. paratuberculosis
ccugguacgcgccgucgucg

SEQ ID NO: 983481 - RNA, 16 nt, Mycobacterium avium subsp. paratuberculosis
ccugguaccccagcaa

SEQ ID NO: 983482 - RNA, 20 nt, Mycobacterium avium subsp. paratuberculosis
ccugguaccccagcaaaacc

SEQ ID NO: 983483 - RNA, 14 nt, Mycobacterium avium subsp. paratuberculosis
ccuggguuccggug

SEQ ID NO: 983484 - RNA, 14 nt, Mycobacterium avium subsp. paratuberculosis
ccugggugaucuug

SEQ ID NO: 983485 - RNA, 21 nt, Mycobacterium avium subsp. paratuberculosis
ccugggggucggugaccagcc

SEQ ID NO: 983486 - RNA, 14 nt, Mycobacterium avium subsp. paratuberculosis
ccugggcgucgucg

SEQ ID NO: 983487 - RNA, 16 nt, Mycobacterium avium subsp. paratuberculosis
ccugggcggcggcggg

SEQ ID NO: 983488 - RNA, 21 nt, Mycobacterium avium subsp. paratuberculosis
ccugggcggccaccgcgcccc

SEQ ID NO: 983489 - RNA, 14 nt, Mycobacterium avium subsp. paratuberculosis
ccugguaggccgcc

SEQ ID NO: 983490 - RNA, 17 nt, Mycobacterium avium subsp. paratuberculosis
ccugguagggguccucc

SEQ ID NO: 983491 - RNA, 15 nt, Mycobacterium avium subsp. paratuberculosis
ccugugcgccccacg

SEQ ID NO: 983492 - RNA, 17 nt, Mycobacterium avium subsp. paratuberculosis
ccugcccgcgcaggccc

SEQ ID NO: 983493 - RNA, 21 nt, Mycobacterium avium subsp. paratuberculosis
ccugcccggcccccugcucag

SEQ ID NO: 983494 - RNA, 21 nt, Mycobacterium avium subsp. paratuberculosis
ccugcccggucugcggccgcg

SEQ ID NO: 983495 - RNA, 13 nt, Mycobacterium avium subsp. paratuberculosis
ccugcccggcggu

SEQ ID NO: 983496 - RNA, 17 nt, Mycobacterium avium subsp. paratuberculosis
ccugccgcacaccgucu

SEQ ID NO: 983497 - RNA, 20 nt, Mycobacterium avium subsp. paratuberculosis
ccugcagguucugcacgugg

SEQ ID NO: 983498 - RNA, 18 nt, Mycobacterium avium subsp. paratuberculosis
ccugcaggucgcgguggg

SEQ ID NO: 983499 - RNA, 21 nt, Mycobacterium avium subsp. paratuberculosis
ccugcaggucgcggugggcgc

SEQ ID NO: 983500 - RNA, 21 nt, Mycobacterium avium subsp. paratuberculosis
ccugcagcaccgaaccggcgg

SEQ ID NO: 983501 - RNA, 13 nt, Mycobacterium avium subsp. paratuberculosis
ccugcagcaccag

SEQ ID NO: 983502 - RNA, 19 nt, Mycobacterium avium subsp. paratuberculosis
ccugcacgcgcgggucguc

SEQ ID NO: 983503 - RNA, 15 nt, Mycobacterium avium subsp. paratuberculosis
ccugcaccuggguga

SEQ ID NO: 983504 - RNA, 13 nt, Mycobacterium avium subsp. paratuberculosis
ccugcaccuugcc

SEQ ID NO: 983505 - RNA, 22 nt, Mycobacterium avium subsp. paratuberculosis
ccugcacgaagucgaccgcggc

SEQ ID NO: 983506 - RNA, 19 nt, Mycobacterium avium subsp. paratuberculosis
ccugcaccgacugcggcgc

SEQ ID NO: 983507 - RNA, 21 nt, Mycobacterium avium subsp. paratuberculosis
ccugcaccgaguugaacgcgu

SEQ ID NO: 983508 - RNA, 15 nt, Mycobacterium avium subsp. paratuberculosis
ccugcacccagccgu

SEQ ID NO: 983509 - RNA, 13 nt, Mycobacterium avium subsp. paratuberculosis
ccugcaccaccac

SEQ ID NO: 983510 - RNA, 23 nt, Mycobacterium avium subsp. paratuberculosis
ccugcaccaccacacccagcgcc

SEQ ID NO: 983511 - RNA, 14 nt, Mycobacterium avium subsp. paratuberculosis
ccugcgccagcagc

SEQ ID NO: 983512 - RNA, 23 nt, Mycobacterium avium subsp. paratuberculosis
ccugcgaauacccgcccagcacc

SEQ ID NO: 983513 - RNA, 22 nt, Mycobacterium avium subsp. paratuberculosis
ccugccguucggccagcgccgc

SEQ ID NO: 983514 - RNA, 20 nt, Mycobacterium avium subsp. paratuberculosis
ccugccgucaccggccaucc

SEQ ID NO: 983515 - RNA, 15 nt, Mycobacterium avium subsp. paratuberculosis
ccugccggccgccgc

SEQ ID NO: 983516 - RNA, 17 nt, Mycobacterium avium subsp. paratuberculosis
ccugccggaugccgcgc

SEQ ID NO: 983517 - RNA, 18 nt, Mycobacterium avium subsp. paratuberculosis
ccugcggcucgucggcga

SEQ ID NO: 983518 - RNA, 14 nt, Mycobacterium avium subsp. paratuberculosis
ccugcggccccugc

SEQ ID NO: 983519 - RNA, 23 nt, Mycobacterium avium subsp. paratuberculosis
ccugcggggugucgacccagguc

SEQ ID NO: 983520 - RNA, 13 nt, Mycobacterium avium subsp. paratuberculosis
ccugcgggcccac

SEQ ID NO: 983521 - RNA, 18 nt, Mycobacterium avium subsp. paratuberculosis
ccugcgggcccaccgcgc

SEQ ID NO: 983522 - RNA, 16 nt, Mycobacterium avium subsp. paratuberculosis
ccugcgcuaccaggcg

SEQ ID NO: 983523 - RNA, 15 nt, Mycobacterium avium subsp. paratuberculosis
ccugcgcgucgucgc

SEQ ID NO: 983524 - RNA, 14 nt, Mycobacterium avium subsp. paratuberculosis
ccugcgcgugcuug

SEQ ID NO: 983525 - RNA, 14 nt, Mycobacterium avium subsp. paratuberculosis
ccugcgcgaaaggc

SEQ ID NO: 983526 - RNA, 12 nt, Mycobacterium avium subsp. paratuberculosis
ccugcgccgccg

SEQ ID NO: 983527 - RNA, 23 nt, Mycobacterium avium subsp. paratuberculosis
ccugcggcaggucggccagcgcc

SEQ ID NO: 983528 - RNA, 23 nt, Mycobacterium avium subsp. paratuberculosis
ccugcggcaacagcaccagcacc

SEQ ID NO: 983529 - RNA, 24 nt, Mycobacterium avium subsp. paratuberculosis
ccugcggcaacagcaccagcacca

SEQ ID NO: 983530 - RNA, 16 nt, Mycobacterium avium subsp. paratuberculosis
ccugaacggccgcgca

SEQ ID NO: 983531 - RNA, 16 nt, Mycobacterium avium subsp. paratuberculosis
ccugaaccagcucgug

SEQ ID NO: 983532 - RNA, 21 nt, Mycobacterium avium subsp. paratuberculosis
ccucuucggggguggccagcu

SEQ ID NO: 983533 - RNA, 17 nt, Mycobacterium avium subsp. paratuberculosis
ccucgucggcgagcagc

SEQ ID NO: 983534 - RNA, 19 nt, Mycobacterium avium subsp. paratuberculosis
ccucgucuuccgcggcggc

SEQ ID NO: 983535 - RNA, 19 nt, Mycobacterium avium subsp. paratuberculosis
ccucguggucccaggacca

SEQ ID NO: 983536 - RNA, 22 nt, Mycobacterium avium subsp. paratuberculosis
ccucguggaaaucgagcgcgcu

SEQ ID NO: 983537 - RNA, 21 nt, Mycobacterium avium subsp. paratuberculosis
ccucgaagcagccuucuuggc

SEQ ID NO: 983538 - RNA, 16 nt, Mycobacterium avium subsp. paratuberculosis
ccucgaacaggcuggc

SEQ ID NO: 983539 - RNA, 20 nt, Mycobacterium avium subsp. paratuberculosis
ccucgaagucgccggccucc

SEQ ID NO: 983540 - RNA, 13 nt, Mycobacterium avium subsp. paratuberculosis
ccucgaagcugga

SEQ ID NO: 983541 - RNA, 18 nt, Mycobacterium avium subsp. paratuberculosis
ccucgaaguagagccgcu

SEQ ID NO: 983542 - RNA, 14 nt, Mycobacterium avium subsp. paratuberculosis
ccucgaagggcgcc

SEQ ID NO: 983543 - RNA, 16 nt, Mycobacterium avium subsp. paratuberculosis
ccucgacacgggccgc

SEQ ID NO: 983544 - RNA, 12 nt, Mycobacterium avium subsp. paratuberculosis
ccucgaccaccu

SEQ ID NO: 983545 - RNA, 17 nt, Mycobacterium avium subsp. paratuberculosis
ccucgaccagcaccgca

SEQ ID NO: 983546 - RNA, 19 nt, Mycobacterium avium subsp. paratuberculosis
ccucgaccagcaccgcauc

SEQ ID NO: 983547 - RNA, 22 nt, Mycobacterium avium subsp. paratuberculosis
ccucgaccaggcuuggcccgcc

SEQ ID NO: 983548 - RNA, 20 nt, Mycobacterium avium subsp. paratuberculosis
ccucgacguccaggccggcg

SEQ ID NO: 983549 - RNA, 17 nt, Mycobacterium avium subsp. paratuberculosis
ccucgacguaggccaga

SEQ ID NO: 983550 - RNA, 20 nt, Mycobacterium avium subsp. paratuberculosis
ccucgacggcgaagccggcg

SEQ ID NO: 983551 - RNA, 15 nt, Mycobacterium avium subsp. paratuberculosis
ccucgacgccgcgca

SEQ ID NO: 983552 - RNA, 18 nt, Mycobacterium avium subsp. paratuberculosis
ccucgacgaacgcggcgg

SEQ ID NO: 983553 - RNA, 22 nt, Mycobacterium avium subsp. paratuberculosis
ccucgcggcggcgucggcgucc

SEQ ID NO: 983554 - RNA, 14 nt, Mycobacterium avium subsp. paratuberculosis
ccucgcggcagccu

SEQ ID NO: 983555 - RNA, 16 nt, Mycobacterium avium subsp. paratuberculosis
ccucgcggaacugcuc

SEQ ID NO: 983556 - RNA, 17 nt, Mycobacterium avium subsp. paratuberculosis
ccucgcgcggggcggcc

SEQ ID NO: 983557 - RNA, 20 nt, Mycobacterium avium subsp. paratuberculosis
ccucgcgcggggcggccgcc

SEQ ID NO: 983558 - RNA, 21 nt, Mycobacterium avium subsp. paratuberculosis
ccucgcgcggggcggccgccg

SEQ ID NO: 983559 - RNA, 12 nt, Mycobacterium avium subsp. paratuberculosis
ccucgcgcguca

SEQ ID NO: 983560 - RNA, 14 nt, Mycobacterium avium subsp. paratuberculosis
ccucgcgccgccac

SEQ ID NO: 983561 - RNA, 20 nt, Mycobacterium avium subsp. paratuberculosis
ccucgcgcucuugggcggcc

SEQ ID NO: 983562 - RNA, 15 nt, Mycobacterium avium subsp. paratuberculosis
ccucgcgcaucagca

SEQ ID NO: 983563 - RNA, 14 nt, Mycobacterium avium subsp. paratuberculosis
ccucgcgcagcccc

SEQ ID NO: 983564 - RNA, 14 nt, Mycobacterium avium subsp. paratuberculosis
ccucgcgcagcgcg

SEQ ID NO: 983565 - RNA, 15 nt, Mycobacterium avium subsp. paratuberculosis
ccucgcgcagggcca

SEQ ID NO: 983566 - RNA, 19 nt, Mycobacterium avium subsp. paratuberculosis
ccucgcgcaccggcugccc

SEQ ID NO: 983567 - RNA, 21 nt, Mycobacterium avium subsp. paratuberculosis
ccucgcgcaccggcugcccca

SEQ ID NO: 983568 - RNA, 16 nt, Mycobacterium avium subsp. paratuberculosis
ccucgucgggcgccag

SEQ ID NO: 983569 - RNA, 20 nt, Mycobacterium avium subsp. paratuberculosis
ccucgucgggcgccagcccg

SEQ ID NO: 983570 - RNA, 23 nt, Mycobacterium avium subsp. paratuberculosis
ccucgucggggaacuccugcagg

SEQ ID NO: 983571 - RNA, 14 nt, Mycobacterium avium subsp. paratuberculosis
ccucgucgguccag

SEQ ID NO: 983572 - RNA, 15 nt, Mycobacterium avium subsp. paratuberculosis
ccucgucgguccagg

SEQ ID NO: 983573 - RNA, 18 nt, Mycobacterium avium subsp. paratuberculosis
ccucggugaucucaccgg

SEQ ID NO: 983574 - RNA, 19 nt, Mycobacterium avium subsp. paratuberculosis
ccucgguggacgccgcgca

SEQ ID NO: 983575 - RNA, 15 nt, Mycobacterium avium subsp. paratuberculosis
ccucggugagcagcu

SEQ ID NO: 983576 - RNA, 15 nt, Mycobacterium avium subsp. paratuberculosis
ccucggucagcucgg

SEQ ID NO: 983577 - RNA, 23 nt, Mycobacterium avium subsp. paratuberculosis
ccucggugaagccgcggacggcg

SEQ ID NO: 983578 - RNA, 16 nt, Mycobacterium avium subsp. paratuberculosis
ccucggucucguccag

SEQ ID NO: 983579 - RNA, 21 nt, Mycobacterium avium subsp. paratuberculosis
ccucgggccgggcgggcaccc

SEQ ID NO: 983580 - RNA, 15 nt, Mycobacterium avium subsp. paratuberculosis
ccucggggcucacca

SEQ ID NO: 983581 - RNA, 19 nt, Mycobacterium avium subsp. paratuberculosis
ccucgggguagccggcccg

SEQ ID NO: 983582 - RNA, 22 nt, Mycobacterium avium subsp. paratuberculosis
ccucgggguagccggcccgcag

SEQ ID NO: 983583 - RNA, 16 nt, Mycobacterium avium subsp. paratuberculosis
ccucggggucggccgg

SEQ ID NO: 983584 - RNA, 22 nt, Mycobacterium avium subsp. paratuberculosis
ccucgcgggugcuggucagcau

SEQ ID NO: 983585 - RNA, 21 nt, Mycobacterium avium subsp. paratuberculosis
ccucgcgguugcggguggcgg

SEQ ID NO: 983586 - RNA, 15 nt, Mycobacterium avium subsp. paratuberculosis
ccucgcuacgcgagc

SEQ ID NO: 983587 - RNA, 13 nt, Mycobacterium avium subsp. paratuberculosis
ccucggcggccag

SEQ ID NO: 983588 - RNA, 13 nt, Mycobacterium avium subsp. paratuberculosis
ccucgggccggca

SEQ ID NO: 983589 - RNA, 16 nt, Mycobacterium avium subsp. paratuberculosis
ccucgggccggcagcc

SEQ ID NO: 983590 - RNA, 23 nt, Mycobacterium avium subsp. paratuberculosis
ccucggcguccgcggcggagggg

SEQ ID NO: 983591 - RNA, 16 nt, Mycobacterium avium subsp. paratuberculosis
ccucggcguggcaggc

SEQ ID NO: 983592 - RNA, 18 nt, Mycobacterium avium subsp. paratuberculosis
ccucggcguggcaggcga

SEQ ID NO: 983593 - RNA, 14 nt, Mycobacterium avium subsp. paratuberculosis
ccucggcggccgcc

SEQ ID NO: 983594 - RNA, 18 nt, Mycobacterium avium subsp. paratuberculosis
ccucggcggcggcgcgcc

SEQ ID NO: 983595 - RNA, 19 nt, Mycobacterium avium subsp. paratuberculosis
ccucggcggcggcgcgccg

SEQ ID NO: 983596 - RNA, 20 nt, Mycobacterium avium subsp. paratuberculosis
ccucggcguagaggugcagc

SEQ ID NO: 983597 - RNA, 21 nt, Mycobacterium avium subsp. paratuberculosis
ccucggcguagaggugcagcg

SEQ ID NO: 983598 - RNA, 20 nt, Mycobacterium avium subsp. paratuberculosis
ccucaucgcccagccggcgg

SEQ ID NO: 983599 - RNA, 17 nt, Mycobacterium avium subsp. paratuberculosis
ccucaucgucgacccgg

SEQ ID NO: 983600 - RNA, 19 nt, Mycobacterium avium subsp. paratuberculosis
ccucaucgucgacccggcc

SEQ ID NO: 983601 - RNA, 20 nt, Mycobacterium avium subsp. paratuberculosis
ccuaccggguggccagcacc

SEQ ID NO: 983602 - RNA, 17 nt, Mycobacterium avium subsp. paratuberculosis
ccuccaacggcaccacc

SEQ ID NO: 983603 - RNA, 22 nt, Mycobacterium avium subsp. paratuberculosis
ccuccaacggcaccaccacggu

SEQ ID NO: 983604 - RNA, 22 nt, Mycobacterium avium subsp. paratuberculosis
ccuccaaagcggcuaagccggc

SEQ ID NO: 983605 - RNA, 21 nt, Mycobacterium avium subsp. paratuberculosis
ccuccacggugcgcaccgaca

SEQ ID NO: 983606 - RNA, 23 nt, Mycobacterium avium subsp. paratuberculosis
ccuccaccggcaaucgggacgcc

SEQ ID NO: 983607 - RNA, 12 nt, Mycobacterium avium subsp. paratuberculosis
ccuccaccacca

SEQ ID NO: 983608 - RNA, 19 nt, Mycobacterium avium subsp. paratuberculosis
ccuccagccgccgguccag

SEQ ID NO: 983609 - RNA, 24 nt, Mycobacterium avium subsp. paratuberculosis
ccuccagccgcgcggccgccuccg

SEQ ID NO: 983610 - RNA, 17 nt, Mycobacterium avium subsp. paratuberculosis
ccuccagccgcuccucg

SEQ ID NO: 983611 - RNA, 11 nt, Mycobacterium avium subsp. paratuberculosis
ccuccagcacg

SEQ ID NO: 983612 - RNA, 21 nt, Mycobacterium avium subsp. paratuberculosis
ccuccaggcugaaucccuccg

SEQ ID NO: 983613 - RNA, 23 nt, Mycobacterium avium subsp. paratuberculosis
ccuccagcuguugacgggccgcg

SEQ ID NO: 983614 - RNA, 21 nt, Mycobacterium avium subsp. paratuberculosis
ccuccucuucgcugccgccgc

SEQ ID NO: 983615 - RNA, 19 nt, Mycobacterium avium subsp. paratuberculosis
ccuccucgcgccgccacgc

SEQ ID NO: 983616 - RNA, 14 nt, Mycobacterium avium subsp. paratuberculosis
ccuccucggccagc

SEQ ID NO: 983617 - RNA, 15 nt, Mycobacterium avium subsp. paratuberculosis
ccuccucggccagcc

SEQ ID NO: 983618 - RNA, 20 nt, Mycobacterium avium subsp. paratuberculosis
ccuccugcuggcgcugccag

SEQ ID NO: 983619 - RNA, 23 nt, Mycobacterium avium subsp. paratuberculosis
ccuccugcuggcguucgccgagg

SEQ ID NO: 983620 - RNA, 23 nt, Mycobacterium avium subsp. paratuberculosis
ccuccugggugagcggcgcgucc

SEQ ID NO: 983621 - RNA, 15 nt, Mycobacterium avium subsp. paratuberculosis
ccuccuuggccaggc

SEQ ID NO: 983622 - RNA, 13 nt, Mycobacterium avium subsp. paratuberculosis
ccuccuccucgcu

SEQ ID NO: 983623 - RNA, 17 nt, Mycobacterium avium subsp. paratuberculosis
ccuccucgaccccgaag

SEQ ID NO: 983624 - RNA, 15 nt, Mycobacterium avium subsp. paratuberculosis
ccuccgugccgaugg

SEQ ID NO: 983625 - RNA, 18 nt, Mycobacterium avium subsp. paratuberculosis
ccuccgugcuggccgggu

SEQ ID NO: 983626 - RNA, 16 nt, Mycobacterium avium subsp. paratuberculosis
ccuccgucagcgccgc

SEQ ID NO: 983627 - RNA, 18 nt, Mycobacterium avium subsp. paratuberculosis
ccuccgucagcgccgccc

SEQ ID NO: 983628 - RNA, 18 nt, Mycobacterium avium subsp. paratuberculosis
ccuccgguuugcgccggc

SEQ ID NO: 983629 - RNA, 20 nt, Mycobacterium avium subsp. paratuberculosis
ccuccgguuugcgccggcuc

SEQ ID NO: 983630 - RNA, 22 nt, Mycobacterium avium subsp. paratuberculosis
ccuccgguuugcgccggcucca

SEQ ID NO: 983631 - RNA, 21 nt, Mycobacterium avium subsp. paratuberculosis
ccuccggcaguacgcgccggc

SEQ ID NO: 983632 - RNA, 23 nt, Mycobacterium avium subsp. paratuberculosis
ccuccggcaguacgcgccggccu

SEQ ID NO: 983633 - RNA, 23 nt, Mycobacterium avium subsp. paratuberculosis
ccuccgggaaggcggccgcgaau

SEQ ID NO: 983634 - RNA, 13 nt, Mycobacterium avium subsp. paratuberculosis
ccuccgaauccag

SEQ ID NO: 983635 - RNA, 14 nt, Mycobacterium avium subsp. paratuberculosis
ccuccgacagccgc

SEQ ID NO: 983636 - RNA, 16 nt, Mycobacterium avium subsp. paratuberculosis
ccuccgaccagccggu

SEQ ID NO: 983637 - RNA, 14 nt, Mycobacterium avium subsp. paratuberculosis
ccuccgacccgucc

SEQ ID NO: 983638 - RNA, 14 nt, Mycobacterium avium subsp. paratuberculosis
ccuccgccgccccg

SEQ ID NO: 983639 - RNA, 12 nt, Mycobacterium avium subsp. paratuberculosis
ccucccagcccu

SEQ ID NO: 983640 - RNA, 13 nt, Mycobacterium avium subsp. paratuberculosis
ccuccccauccgc

SEQ ID NO: 983641 - RNA, 15 nt, Mycobacterium avium subsp. paratuberculosis
ccuccccggccagca

SEQ ID NO: 983642 - RNA, 21 nt, Mycobacterium avium subsp. paratuberculosis
ccucccggcgccacgccgcga

SEQ ID NO: 983643 - RNA, 15 nt, Mycobacterium avium subsp. paratuberculosis
ccguuccagccggcc

SEQ ID NO: 983644 - RNA, 21 nt, Mycobacterium avium subsp. paratuberculosis
ccguucaggucgaucagcggu

SEQ ID NO: 983645 - RNA, 14 nt, Mycobacterium avium subsp. paratuberculosis
ccguguuccaggua

SEQ ID NO: 983646 - RNA, 12 nt, Mycobacterium avium subsp. paratuberculosis
ccgugucggcgg

SEQ ID NO: 983647 - RNA, 23 nt, Mycobacterium avium subsp. paratuberculosis
ccguguagccgaccgacccggcc

SEQ ID NO: 983648 - RNA, 13 nt, Mycobacterium avium subsp. paratuberculosis
ccguggugucgga

SEQ ID NO: 983649 - RNA, 14 nt, Mycobacterium avium subsp. paratuberculosis
ccgugucggcgggc

SEQ ID NO: 983650 - RNA, 17 nt, Mycobacterium avium subsp. paratuberculosis
ccguguucaccagcggg

SEQ ID NO: 983651 - RNA, 22 nt, Mycobacterium avium subsp. paratuberculosis
ccgugcgcggcgaccaccucgg

SEQ ID NO: 983652 - RNA, 20 nt, Mycobacterium avium subsp. paratuberculosis
ccgugcugccggccggcagc

SEQ ID NO: 983653 - RNA, 21 nt, Mycobacterium avium subsp. paratuberculosis
ccgugcggagaucgugcugug

SEQ ID NO: 983654 - RNA, 20 nt, Mycobacterium avium subsp. paratuberculosis
ccgugcggcguucggugccc

SEQ ID NO: 983655 - RNA, 22 nt, Mycobacterium avium subsp. paratuberculosis
ccgugcggggccucgucgccgc

SEQ ID NO: 983656 - RNA, 15 nt, Mycobacterium avium subsp. paratuberculosis
ccgugcgguccacca

SEQ ID NO: 983657 - RNA, 15 nt, Mycobacterium avium subsp. paratuberculosis
ccgugguccagccgg

SEQ ID NO: 983658 - RNA, 21 nt, Mycobacterium avium subsp. paratuberculosis
ccguggucggugcccugugag

SEQ ID NO: 983659 - RNA, 14 nt, Mycobacterium avium subsp. paratuberculosis
ccguggugacccgg

SEQ ID NO: 983660 - RNA, 11 nt, Mycobacterium avium subsp. paratuberculosis
ccguggcaggc

SEQ ID NO: 983661 - RNA, 16 nt, Mycobacterium avium subsp. paratuberculosis
ccgugggugucggcga

SEQ ID NO: 983662 - RNA, 16 nt, Mycobacterium avium subsp. paratuberculosis
ccguggacggcgagcg

SEQ ID NO: 983663 - RNA, 18 nt, Mycobacterium avium subsp. paratuberculosis
ccgucuuguuggucagcc

SEQ ID NO: 983664 - RNA, 17 nt, Mycobacterium avium subsp. paratuberculosis
ccgucuucuucagccgc

SEQ ID NO: 983665 - RNA, 17 nt, Mycobacterium avium subsp. paratuberculosis
ccgucuuggccaggccc

SEQ ID NO: 983666 - RNA, 15 nt, Mycobacterium avium subsp. paratuberculosis
ccgugaaccggcguu

SEQ ID NO: 983667 - RNA, 15 nt, Mycobacterium avium subsp. paratuberculosis
ccgugccccagguag

SEQ ID NO: 983668 - RNA, 16 nt, Mycobacterium avium subsp. paratuberculosis
ccgugccccaggucgg

SEQ ID NO: 983669 - RNA, 16 nt, Mycobacterium avium subsp. paratuberculosis
ccgugcccgagccgau

SEQ ID NO: 983670 - RNA, 15 nt, Mycobacterium avium subsp. paratuberculosis
ccgugaggcccggcg

SEQ ID NO: 983671 - RNA, 17 nt, Mycobacterium avium subsp. paratuberculosis
ccgugaggcccggcgug

SEQ ID NO: 983672 - RNA, 14 nt, Mycobacterium avium subsp. paratuberculosis
ccgugcccaccagc

SEQ ID NO: 983673 - RNA, 19 nt, Mycobacterium avium subsp. paratuberculosis
ccgugcccaccagccggcc

SEQ ID NO: 983674 - RNA, 14 nt, Mycobacterium avium subsp. paratuberculosis
ccgugcgccagcga

SEQ ID NO: 983675 - RNA, 12 nt, Mycobacterium avium subsp. paratuberculosis
ccgugccgucgc

SEQ ID NO: 983676 - RNA, 16 nt, Mycobacterium avium subsp. paratuberculosis
ccgugccgucgcgggc

SEQ ID NO: 983677 - RNA, 17 nt, Mycobacterium avium subsp. paratuberculosis
ccuacaggugccggcgg

SEQ ID NO: 983678 - RNA, 16 nt, Mycobacterium avium subsp. paratuberculosis
ccguuuucggcgcgca

SEQ ID NO: 983679 - RNA, 19 nt, Mycobacterium avium subsp. paratuberculosis
ccguucgccggccagcacg

SEQ ID NO: 983680 - RNA, 15 nt, Mycobacterium avium subsp. paratuberculosis
ccguugauugcgccc

SEQ ID NO: 983681 - RNA, 18 nt, Mycobacterium avium subsp. paratuberculosis
ccguuggcaggcccggua

SEQ ID NO: 983682 - RNA, 17 nt, Mycobacterium avium subsp. paratuberculosis
ccguugcgggucggcgu

SEQ ID NO: 983683 - RNA, 17 nt, Mycobacterium avium subsp. paratuberculosis
ccguugcggugacgaug

SEQ ID NO: 983684 - RNA, 13 nt, Mycobacterium avium subsp. paratuberculosis
ccguugcgcccca

SEQ ID NO: 983685 - RNA, 17 nt, Mycobacterium avium subsp. paratuberculosis
ccguugcgccccacggu

SEQ ID NO: 983686 - RNA, 15 nt, Mycobacterium avium subsp. paratuberculosis
ccgguuugucggcgc

SEQ ID NO: 983687 - RNA, 16 nt, Mycobacterium avium subsp. paratuberculosis
ccggugcagcaccucg

SEQ ID NO: 983688 - RNA, 16 nt, Mycobacterium avium subsp. paratuberculosis
ccgguuugcgccggcu

SEQ ID NO: 983689 - RNA, 20 nt, Mycobacterium avium subsp. paratuberculosis
ccggugccacggucaggcgc

SEQ ID NO: 983690 - RNA, 13 nt, Mycobacterium avium subsp. paratuberculosis
ccggugccgcagu

SEQ ID NO: 983691 - RNA, 22 nt, Mycobacterium avium subsp. paratuberculosis
ccggugagcggauuggucgggc

SEQ ID NO: 983692 - RNA, 18 nt, Mycobacterium avium subsp. paratuberculosis
ccggugagcgugucgcgc

SEQ ID NO: 983693 - RNA, 22 nt, Mycobacterium avium subsp. paratuberculosis
ccggugaugaacgcgccgucgu

SEQ ID NO: 983694 - RNA, 18 nt, Mycobacterium avium subsp. paratuberculosis
ccggugaugacgucgccc

SEQ ID NO: 983695 - RNA, 16 nt, Mycobacterium avium subsp. paratuberculosis
ccggugaugccggcau

SEQ ID NO: 983696 - RNA, 16 nt, Mycobacterium avium subsp. paratuberculosis
ccggugaucgcggcgc

SEQ ID NO: 983697 - RNA, 15 nt, Mycobacterium avium subsp. paratuberculosis
ccguagcccugcagg

SEQ ID NO: 983698 - RNA, 21 nt, Mycobacterium avium subsp. paratuberculosis
ccguagaucucgcgccgcgca

SEQ ID NO: 983699 - RNA, 20 nt, Mycobacterium avium subsp. paratuberculosis
ccguacuucucgaagaaggc

SEQ ID NO: 983700 - RNA, 18 nt, Mycobacterium avium subsp. paratuberculosis
ccguacgcgccggccagc

SEQ ID NO: 983701 - RNA, 13 nt, Mycobacterium avium subsp. paratuberculosis
ccguacggcccga

SEQ ID NO: 983702 - RNA, 17 nt, Mycobacterium avium subsp. paratuberculosis
ccguacucgugggccac

SEQ ID NO: 983703 - RNA, 22 nt, Mycobacterium avium subsp. paratuberculosis
ccguaggacaggaacgggccgg

SEQ ID NO: 983704 - RNA, 18 nt, Mycobacterium avium subsp. paratuberculosis
ccguagucacccggcccc

SEQ ID NO: 983705 - RNA, 20 nt, Mycobacterium avium subsp. paratuberculosis
ccguagucacccggcccccg

SEQ ID NO: 983706 - RNA, 16 nt, Mycobacterium avium subsp. paratuberculosis
ccgucuccucgaccag

SEQ ID NO: 983707 - RNA, 14 nt, Mycobacterium avium subsp. paratuberculosis
ccgucucgacccgg

SEQ ID NO: 983708 - RNA, 17 nt, Mycobacterium avium subsp. paratuberculosis
ccgucucgacccgggcc

SEQ ID NO: 983709 - RNA, 14 nt, Mycobacterium avium subsp. paratuberculosis
ccgucucaggaauu

SEQ ID NO: 983710 - RNA, 22 nt, Mycobacterium avium subsp. paratuberculosis
ccgucuagcggcguguuguagu

SEQ ID NO: 983711 - RNA, 15 nt, Mycobacterium avium subsp. paratuberculosis
ccgucguugccgugg

SEQ ID NO: 983712 - RNA, 17 nt, Mycobacterium avium subsp. paratuberculosis
ccgucuucggggccgcc

SEQ ID NO: 983713 - RNA, 14 nt, Mycobacterium avium subsp. paratuberculosis
ccgucgucagccgg

SEQ ID NO: 983714 - RNA, 15 nt, Mycobacterium avium subsp. paratuberculosis
ccgucgguggccggu

SEQ ID NO: 983715 - RNA, 14 nt, Mycobacterium avium subsp. paratuberculosis
ccgucggugggggc

SEQ ID NO: 983716 - RNA, 21 nt, Mycobacterium avium subsp. paratuberculosis
ccgucggugggggccaggcgg

SEQ ID NO: 983717 - RNA, 15 nt, Mycobacterium avium subsp. paratuberculosis
ccgucgguguccagg

SEQ ID NO: 983718 - RNA, 22 nt, Mycobacterium avium subsp. paratuberculosis
ccgucguccuugagcccccacc

SEQ ID NO: 983719 - RNA, 16 nt, Mycobacterium avium subsp. paratuberculosis
ccgucgucgagcacca

SEQ ID NO: 983720 - RNA, 18 nt, Mycobacterium avium subsp. paratuberculosis
ccgucgucgaugcgcagc

SEQ ID NO: 983721 - RNA, 22 nt, Mycobacterium avium subsp. paratuberculosis
ccgucgucguccgcaaccgccg

SEQ ID NO: 983722 - RNA, 20 nt, Mycobacterium avium subsp. paratuberculosis
ccgucguggguauccgccgc

SEQ ID NO: 983723 - RNA, 20 nt, Mycobacterium avium subsp. paratuberculosis
ccgucguugacgcccuccug

SEQ ID NO: 983724 - RNA, 22 nt, Mycobacterium avium subsp. paratuberculosis
ccgucguugacgcccuccuggc

SEQ ID NO: 983725 - RNA, 12 nt, Mycobacterium avium subsp. paratuberculosis
ccgucggcggcc

SEQ ID NO: 983726 - RNA, 13 nt, Mycobacterium avium subsp. paratuberculosis
ccgucggccgccg

SEQ ID NO: 983727 - RNA, 17 nt, Mycobacterium avium subsp. paratuberculosis
ccgucggcuuccuccuc

SEQ ID NO: 983728 - RNA, 20 nt, Mycobacterium avium subsp. paratuberculosis
ccgucgggaauggggcccgg

SEQ ID NO: 983729 - RNA, 14 nt, Mycobacterium avium subsp. paratuberculosis
ccgucggggcccgg

SEQ ID NO: 983730 - RNA, 16 nt, Mycobacterium avium subsp. paratuberculosis
ccgucggggcccggcc

SEQ ID NO: 983731 - RNA, 15 nt, Mycobacterium avium subsp. paratuberculosis
ccgucggggucgcgc

SEQ ID NO: 983732 - RNA, 16 nt, Mycobacterium avium subsp. paratuberculosis
ccgucggggugcgcca

SEQ ID NO: 983733 - RNA, 18 nt, Mycobacterium avium subsp. paratuberculosis
ccgucggggugcgccagg

SEQ ID NO: 983734 - RNA, 21 nt, Mycobacterium avium subsp. paratuberculosis
ccgucggucccgacgcggcgc

SEQ ID NO: 983735 - RNA, 13 nt, Mycobacterium avium subsp. paratuberculosis
ccgucggucgggc

SEQ ID NO: 983736 - RNA, 22 nt, Mycobacterium avium subsp. paratuberculosis
ccgucggucgggcagugcacga

SEQ ID NO: 983737 - RNA, 14 nt, Mycobacterium avium subsp. paratuberculosis
ccgucggccuccag

SEQ ID NO: 983738 - RNA, 13 nt, Mycobacterium avium subsp. paratuberculosis
ccgucggccagca

SEQ ID NO: 983739 - RNA, 14 nt, Mycobacterium avium subsp. paratuberculosis
ccgucggcccgcca

SEQ ID NO: 983740 - RNA, 17 nt, Mycobacterium avium subsp. paratuberculosis
ccgucggcgaucgccgg

SEQ ID NO: 983741 - RNA, 15 nt, Mycobacterium avium subsp. paratuberculosis
ccgucggcgcccggc

SEQ ID NO: 983742 - RNA, 15 nt, Mycobacterium avium subsp. paratuberculosis
ccgucggcgccgccg

SEQ ID NO: 983743 - RNA, 17 nt, Mycobacterium avium subsp. paratuberculosis
ccgucgcggacccuggc

SEQ ID NO: 983744 - RNA, 23 nt, Mycobacterium avium subsp. paratuberculosis
ccgucgcggcgaucgcgagcagg

SEQ ID NO: 983745 - RNA, 19 nt, Mycobacterium avium subsp. paratuberculosis
ccgucgaucaccugcgggc

SEQ ID NO: 983746 - RNA, 17 nt, Mycobacterium avium subsp. paratuberculosis
ccgucgaucgcccgcuc

SEQ ID NO: 983747 - RNA, 19 nt, Mycobacterium avium subsp. paratuberculosis
ccgucgagguucaugugga

SEQ ID NO: 983748 - RNA, 14 nt, Mycobacterium avium subsp. paratuberculosis
ccgucgagucggcc

SEQ ID NO: 983749 - RNA, 17 nt, Mycobacterium avium subsp. paratuberculosis
ccgucagcgccgcccgc

SEQ ID NO: 983750 - RNA, 23 nt, Mycobacterium avium subsp. paratuberculosis
ccgucaggccugguaggccgccu

SEQ ID NO: 983751 - RNA, 21 nt, Mycobacterium avium subsp. paratuberculosis
ccgucgacccguuccccggcc

SEQ ID NO: 983752 - RNA, 16 nt, Mycobacterium avium subsp. paratuberculosis
ccgucgaccuccucga

SEQ ID NO: 983753 - RNA, 18 nt, Mycobacterium avium subsp. paratuberculosis
ccgucgaccuccucgacc

SEQ ID NO: 983754 - RNA, 22 nt, Mycobacterium avium subsp. paratuberculosis
ccgucgacgaucugcacacggg

SEQ ID NO: 983755 - RNA, 12 nt, Mycobacterium avium subsp. paratuberculosis
ccgucgaccagc

SEQ ID NO: 983756 - RNA, 21 nt, Mycobacterium avium subsp. paratuberculosis
ccgucgaccaggacgucggcc

SEQ ID NO: 983757 - RNA, 14 nt, Mycobacterium avium subsp. paratuberculosis
ccgucgaaaaaccc

SEQ ID NO: 983758 - RNA, 15 nt, Mycobacterium avium subsp. paratuberculosis
ccguccuugggaagc

SEQ ID NO: 983759 - RNA, 19 nt, Mycobacterium avium subsp. paratuberculosis
ccguccuuguaggugaucg

SEQ ID NO: 983760 - RNA, 19 nt, Mycobacterium avium subsp. paratuberculosis
ccggucgacgauggcccgg

SEQ ID NO: 983761 - RNA, 22 nt, Mycobacterium avium subsp. paratuberculosis
ccggucgacgcggggcggcggc

SEQ ID NO: 983762 - RNA, 19 nt, Mycobacterium avium subsp. paratuberculosis
ccgguccgugcacggccaa

SEQ ID NO: 983763 - RNA, 15 nt, Mycobacterium avium subsp. paratuberculosis
ccgguccuccccgcu

SEQ ID NO: 983764 - RNA, 13 nt, Mycobacterium avium subsp. paratuberculosis
ccgguccuggcca

SEQ ID NO: 983765 - RNA, 21 nt, Mycobacterium avium subsp. paratuberculosis
ccggucgaugaucuggcgguc

SEQ ID NO: 983766 - RNA, 17 nt, Mycobacterium avium subsp. paratuberculosis
ccggucgaugucggcga

SEQ ID NO: 983767 - RNA, 20 nt, Mycobacterium avium subsp. paratuberculosis
ccggucgaacgccagcgccg

SEQ ID NO: 983768 - RNA, 21 nt, Mycobacterium avium subsp. paratuberculosis
ccggucuucucggccaggcuc

SEQ ID NO: 983769 - RNA, 18 nt, Mycobacterium avium subsp. paratuberculosis
ccggugaaaccggcgccg

SEQ ID NO: 983770 - RNA, 21 nt, Mycobacterium avium subsp. paratuberculosis
ccggucuuggacagcagcagc

SEQ ID NO: 983771 - RNA, 22 nt, Mycobacterium avium subsp. paratuberculosis
ccggucuuggacagcagcagcu

SEQ ID NO: 983772 - RNA, 19 nt, Mycobacterium avium subsp. paratuberculosis
ccggucuuguagucgacca

SEQ ID NO: 983773 - RNA, 21 nt, Mycobacterium avium subsp. paratuberculosis
ccggucuuguagucgaccacc

SEQ ID NO: 983774 - RNA, 22 nt, Mycobacterium avium subsp. paratuberculosis
ccggugaagaucagcgcgucgg

SEQ ID NO: 983775 - RNA, 20 nt, Mycobacterium avium subsp. paratuberculosis
ccggugaagaucgcccgccg

SEQ ID NO: 983776 - RNA, 18 nt, Mycobacterium avium subsp. paratuberculosis
ccgguaggcgcaccgccg

SEQ ID NO: 983777 - RNA, 17 nt, Mycobacterium avium subsp. paratuberculosis
ccgguaggccggccgca

SEQ ID NO: 983778 - RNA, 21 nt, Mycobacterium avium subsp. paratuberculosis
ccgguaggcggccagcgcccg

SEQ ID NO: 983779 - RNA, 13 nt, Mycobacterium avium subsp. paratuberculosis
ccgguagggccgg

SEQ ID NO: 983780 - RNA, 18 nt, Mycobacterium avium subsp. paratuberculosis
ccggucaacgccgcgcgc

SEQ ID NO: 983781 - RNA, 19 nt, Mycobacterium avium subsp. paratuberculosis
ccggucacggcgucggcgu

SEQ ID NO: 983782 - RNA, 11 nt, Mycobacterium avium subsp. paratuberculosis
ccggucagcac

SEQ ID NO: 983783 - RNA, 15 nt, Mycobacterium avium subsp. paratuberculosis
ccggucagcaccgcg

SEQ ID NO: 983784 - RNA, 19 nt, Mycobacterium avium subsp. paratuberculosis
ccgguccggcggcaccacc

SEQ ID NO: 983785 - RNA, 22 nt, Mycobacterium avium subsp. paratuberculosis
ccgguccggcggcaccacccgc

SEQ ID NO: 983786 - RNA, 12 nt, Mycobacterium avium subsp. paratuberculosis
ccgguccgggcu

SEQ ID NO: 983787 - RNA, 12 nt, Mycobacterium avium subsp. paratuberculosis
ccgguccggguc

SEQ ID NO: 983788 - RNA, 23 nt, Mycobacterium avium subsp. paratuberculosis
ccggguguugcggcagggccacc

SEQ ID NO: 983789 - RNA, 20 nt, Mycobacterium avium subsp. paratuberculosis
ccggguguuggagccguccg

SEQ ID NO: 983790 - RNA, 14 nt, Mycobacterium avium subsp. paratuberculosis
ccggguguuggcgc

SEQ ID NO: 983791 - RNA, 14 nt, Mycobacterium avium subsp. paratuberculosis
ccgggugugggcgc

SEQ ID NO: 983792 - RNA, 19 nt, Mycobacterium avium subsp. paratuberculosis
ccgggucaguucgcggcgc

SEQ ID NO: 983793 - RNA, 20 nt, Mycobacterium avium subsp. paratuberculosis
ccgggucaguucgcggcgca

SEQ ID NO: 983794 - RNA, 22 nt, Mycobacterium avium subsp. paratuberculosis
ccgggucagcaccaccaacagc

SEQ ID NO: 983795 - RNA, 22 nt, Mycobacterium avium subsp. paratuberculosis
ccgggucacgugcacccacgcc

SEQ ID NO: 983796 - RNA, 14 nt, Mycobacterium avium subsp. paratuberculosis
ccggguuggcgcgc

SEQ ID NO: 983797 - RNA, 18 nt, Mycobacterium avium subsp. paratuberculosis
ccggguuguagcaggcgg

SEQ ID NO: 983798 - RNA, 16 nt, Mycobacterium avium subsp. paratuberculosis
ccggguacaccgacuu

SEQ ID NO: 983799 - RNA, 15 nt, Mycobacterium avium subsp. paratuberculosis
ccggguagggcagcc

SEQ ID NO: 983800 - RNA, 18 nt, Mycobacterium avium subsp. paratuberculosis
ccggguagggcagccaca

SEQ ID NO: 983801 - RNA, 23 nt, Mycobacterium avium subsp. paratuberculosis
ccggggcgggcagcaccagcggc

SEQ ID NO: 983802 - RNA, 16 nt, Mycobacterium avium subsp. paratuberculosis
ccggggcgucggacgc

SEQ ID NO: 983803 - RNA, 17 nt, Mycobacterium avium subsp. paratuberculosis
ccggggcgucggacgcc

SEQ ID NO: 983804 - RNA, 16 nt, Mycobacterium avium subsp. paratuberculosis
ccggggcgcagauggg

SEQ ID NO: 983805 - RNA, 15 nt, Mycobacterium avium subsp. paratuberculosis
ccggggcgccccgcu

SEQ ID NO: 983806 - RNA, 20 nt, Mycobacterium avium subsp. paratuberculosis
ccggggccggcgggggcgcg

SEQ ID NO: 983807 - RNA, 19 nt, Mycobacterium avium subsp. paratuberculosis
ccggggccggugcguccgc

SEQ ID NO: 983808 - RNA, 19 nt, Mycobacterium avium subsp. paratuberculosis
ccggggccuucuuggcggc

SEQ ID NO: 983809 - RNA, 12 nt, Mycobacterium avium subsp. paratuberculosis
ccggggccagca

SEQ ID NO: 983810 - RNA, 14 nt, Mycobacterium avium subsp. paratuberculosis
ccggggccagcacc

SEQ ID NO: 983811 - RNA, 21 nt, Mycobacterium avium subsp. paratuberculosis
ccggggccagcacgcccccgc

SEQ ID NO: 983812 - RNA, 12 nt, Mycobacterium avium subsp. paratuberculosis
ccggggccaggu

SEQ ID NO: 983813 - RNA, 14 nt, Mycobacterium avium subsp. paratuberculosis
ccgggagaaccuca

SEQ ID NO: 983814 - RNA, 16 nt, Mycobacterium avium subsp. paratuberculosis
ccgggacgacggcgcc

SEQ ID NO: 983815 - RNA, 20 nt, Mycobacterium avium subsp. paratuberculosis
ccgggacgacggcgccgccc

SEQ ID NO: 983816 - RNA, 21 nt, Mycobacterium avium subsp. paratuberculosis
ccgggacgacggcgccgcccg

SEQ ID NO: 983817 - RNA, 16 nt, Mycobacterium avium subsp. paratuberculosis
ccgggauagagcaccg

SEQ ID NO: 983818 - RNA, 18 nt, Mycobacterium avium subsp. paratuberculosis
ccgggauagagcaccgcg

SEQ ID NO: 983819 - RNA, 13 nt, Mycobacterium avium subsp. paratuberculosis
ccgggauagccgg

SEQ ID NO: 983820 - RNA, 16 nt, Mycobacterium avium subsp. paratuberculosis
ccgggcauccgcccgu

SEQ ID NO: 983821 - RNA, 17 nt, Mycobacterium avium subsp. paratuberculosis
ccgggcauccgggccgc

SEQ ID NO: 983822 - RNA, 18 nt, Mycobacterium avium subsp. paratuberculosis
ccgggcauccgggccgcc

SEQ ID NO: 983823 - RNA, 12 nt, Mycobacterium avium subsp. paratuberculosis
ccgggccacgcc

SEQ ID NO: 983824 - RNA, 23 nt, Mycobacterium avium subsp. paratuberculosis
ccgggccagcaacagcagcggca

SEQ ID NO: 983825 - RNA, 18 nt, Mycobacterium avium subsp. paratuberculosis
ccgggccagcaggaucug

SEQ ID NO: 983826 - RNA, 16 nt, Mycobacterium avium subsp. paratuberculosis
ccgggccagccggccc

SEQ ID NO: 983827 - RNA, 15 nt, Mycobacterium avium subsp. paratuberculosis
ccgggccaggaccgg

SEQ ID NO: 983828 - RNA, 22 nt, Mycobacterium avium subsp. paratuberculosis
ccgggccaggaugaccgcccag

SEQ ID NO: 983829 - RNA, 16 nt, Mycobacterium avium subsp. paratuberculosis
ccgggccaggcgcgcg

SEQ ID NO: 983830 - RNA, 16 nt, Mycobacterium avium subsp. paratuberculosis
ccgggccaggucccag

SEQ ID NO: 983831 - RNA, 20 nt, Mycobacterium avium subsp. paratuberculosis
ccgggccaggucccaggcgu

SEQ ID NO: 983832 - RNA, 22 nt, Mycobacterium avium subsp. paratuberculosis
ccgggccaggucgaagcgcagc

SEQ ID NO: 983833 - RNA, 13 nt, Mycobacterium avium subsp. paratuberculosis
ccgggaacagcca

SEQ ID NO: 983834 - RNA, 19 nt, Mycobacterium avium subsp. paratuberculosis
ccgggacagguagcgcagc

SEQ ID NO: 983835 - RNA, 17 nt, Mycobacterium avium subsp. paratuberculosis
ccgggacaucgucgcgc

SEQ ID NO: 983836 - RNA, 19 nt, Mycobacterium avium subsp. paratuberculosis
ccgggaaguuggccuccca

SEQ ID NO: 983837 - RNA, 20 nt, Mycobacterium avium subsp. paratuberculosis
ccgggaaucgagggcgcgca

SEQ ID NO: 983838 - RNA, 13 nt, Mycobacterium avium subsp. paratuberculosis
ccgggaagcgaag

SEQ ID NO: 983839 - RNA, 16 nt, Mycobacterium avium subsp. paratuberculosis
ccggcuuggccacgau

SEQ ID NO: 983840 - RNA, 19 nt, Mycobacterium avium subsp. paratuberculosis
ccggggacggugcagccgg

SEQ ID NO: 983841 - RNA, 22 nt, Mycobacterium avium subsp. paratuberculosis
ccggggcaccacguccaccagc

SEQ ID NO: 983842 - RNA, 23 nt, Mycobacterium avium subsp. paratuberculosis
ccggggcaccacguccaccagca

SEQ ID NO: 983843 - RNA, 21 nt, Mycobacterium avium subsp. paratuberculosis
ccggggccaacuccggcggca

SEQ ID NO: 983844 - RNA, 12 nt, Mycobacterium avium subsp. paratuberculosis
ccggggacccgc

SEQ ID NO: 983845 - RNA, 14 nt, Mycobacterium avium subsp. paratuberculosis
ccggggaacaccgg

SEQ ID NO: 983846 - RNA, 12 nt, Mycobacterium avium subsp. paratuberculosis
ccgggcuucccc

SEQ ID NO: 983847 - RNA, 15 nt, Mycobacterium avium subsp. paratuberculosis
ccgggcugccguaga

SEQ ID NO: 983848 - RNA, 20 nt, Mycobacterium avium subsp. paratuberculosis
ccgggcugcacgcugcgcac

SEQ ID NO: 983849 - RNA, 16 nt, Mycobacterium avium subsp. paratuberculosis
ccgggcugucgggcag

SEQ ID NO: 983850 - RNA, 14 nt, Mycobacterium avium subsp. paratuberculosis
ccgggcuggccguc

SEQ ID NO: 983851 - RNA, 14 nt, Mycobacterium avium subsp. paratuberculosis
ccgggcugacccgg

SEQ ID NO: 983852 - RNA, 16 nt, Mycobacterium avium subsp. paratuberculosis
ccgggcucgagcaccg

SEQ ID NO: 983853 - RNA, 21 nt, Mycobacterium avium subsp. paratuberculosis
ccgggcucgaguuuggccagc

SEQ ID NO: 983854 - RNA, 18 nt, Mycobacterium avium subsp. paratuberculosis
ccgggcggugaccacgcc

SEQ ID NO: 983855 - RNA, 13 nt, Mycobacterium avium subsp. paratuberculosis
ccgggcgggccgc

SEQ ID NO: 983856 - RNA, 22 nt, Mycobacterium avium subsp. paratuberculosis
ccgggcgggccgcagcaccacc

SEQ ID NO: 983857 - RNA, 16 nt, Mycobacterium avium subsp. paratuberculosis
ccgggcggcgccgaac

SEQ ID NO: 983858 - RNA, 22 nt, Mycobacterium avium subsp. paratuberculosis
ccgggcguagugcagcugcagc

SEQ ID NO: 983859 - RNA, 18 nt, Mycobacterium avium subsp. paratuberculosis
ccgggcgugcccggcgca

SEQ ID NO: 983860 - RNA, 20 nt, Mycobacterium avium subsp. paratuberculosis
ccgggcgugcccggcgcaca

SEQ ID NO: 983861 - RNA, 18 nt, Mycobacterium avium subsp. paratuberculosis
ccgggcguugcccgccgc

SEQ ID NO: 983862 - RNA, 19 nt, Mycobacterium avium subsp. paratuberculosis
ccgggcguugcccgccgcg

SEQ ID NO: 983863 - RNA, 20 nt, Mycobacterium avium subsp. paratuberculosis
ccgggcccggucgucgccgg

SEQ ID NO: 983864 - RNA, 14 nt, Mycobacterium avium subsp. paratuberculosis
ccgggcggcccgcc

SEQ ID NO: 983865 - RNA, 17 nt, Mycobacterium avium subsp. paratuberculosis
ccgggcggcccgggugg

SEQ ID NO: 983866 - RNA, 23 nt, Mycobacterium avium subsp. paratuberculosis
ccgggccgagcgcgccgccgccg

SEQ ID NO: 983867 - RNA, 16 nt, Mycobacterium avium subsp. paratuberculosis
ccgggcccgcugcagc

SEQ ID NO: 983868 - RNA, 16 nt, Mycobacterium avium subsp. paratuberculosis
ccgggcccagcaccac

SEQ ID NO: 983869 - RNA, 14 nt, Mycobacterium avium subsp. paratuberculosis
ccgggcccgcccgc

SEQ ID NO: 983870 - RNA, 21 nt, Mycobacterium avium subsp. paratuberculosis
ccgggcccgcccgcagcggcg

SEQ ID NO: 983871 - RNA, 16 nt, Mycobacterium avium subsp. paratuberculosis
ccggcguagcagucgg

SEQ ID NO: 983872 - RNA, 15 nt, Mycobacterium avium subsp. paratuberculosis
ccggcguccaggcgc

SEQ ID NO: 983873 - RNA, 19 nt, Mycobacterium avium subsp. paratuberculosis
ccggcguccaguucggcca

SEQ ID NO: 983874 - RNA, 16 nt, Mycobacterium avium subsp. paratuberculosis
ccggcggugucggugc

SEQ ID NO: 983875 - RNA, 22 nt, Mycobacterium avium subsp. paratuberculosis
ccggcgguggugccgccgucga

SEQ ID NO: 983876 - RNA, 17 nt, Mycobacterium avium subsp. paratuberculosis
ccggcggucgcugcagc

SEQ ID NO: 983877 - RNA, 18 nt, Mycobacterium avium subsp. paratuberculosis
ccggcggugauccgcccg

SEQ ID NO: 983878 - RNA, 20 nt, Mycobacterium avium subsp. paratuberculosis
ccggcggugauccgcccggc

SEQ ID NO: 983879 - RNA, 21 nt, Mycobacterium avium subsp. paratuberculosis
ccggcggugauccgcccggcc

SEQ ID NO: 983880 - RNA, 22 nt, Mycobacterium avium subsp. paratuberculosis
ccggcggugauccgcccggccc

SEQ ID NO: 983881 - RNA, 23 nt, Mycobacterium avium subsp. paratuberculosis
ccggcggcgguuuuggucggcac

SEQ ID NO: 983882 - RNA, 17 nt, Mycobacterium avium subsp. paratuberculosis
ccggcggcugggcagcc

SEQ ID NO: 983883 - RNA, 17 nt, Mycobacterium avium subsp. paratuberculosis
ccggcggcgcugcccca

SEQ ID NO: 983884 - RNA, 20 nt, Mycobacterium avium subsp. paratuberculosis
ccggcggcgcugccccagcc

SEQ ID NO: 983885 - RNA, 16 nt, Mycobacterium avium subsp. paratuberculosis
ccggcggcggccagcg

SEQ ID NO: 983886 - RNA, 17 nt, Mycobacterium avium subsp. paratuberculosis
ccggcggcggccagcga

SEQ ID NO: 983887 - RNA, 16 nt, Mycobacterium avium subsp. paratuberculosis
ccggcggucaggccgu

SEQ ID NO: 983888 - RNA, 17 nt, Mycobacterium avium subsp. paratuberculosis
ccggcgggggcgcgucc

SEQ ID NO: 983889 - RNA, 17 nt, Mycobacterium avium subsp. paratuberculosis
ccggcggggcgucgccc

SEQ ID NO: 983890 - RNA, 19 nt, Mycobacterium avium subsp. paratuberculosis
ccggcgggcucgccggccc

SEQ ID NO: 983891 - RNA, 18 nt, Mycobacterium avium subsp. paratuberculosis
ccggcgggcgccggucgg

SEQ ID NO: 983892 - RNA, 13 nt, Mycobacterium avium subsp. paratuberculosis
ccggcgggcggcg

SEQ ID NO: 983893 - RNA, 21 nt, Mycobacterium avium subsp. paratuberculosis
ccggccaucaugcccaccauc

SEQ ID NO: 983894 - RNA, 12 nt, Mycobacterium avium subsp. paratuberculosis
ccggccauccgc

SEQ ID NO: 983895 - RNA, 15 nt, Mycobacterium avium subsp. paratuberculosis
ccggccaugaccaug

SEQ ID NO: 983896 - RNA, 21 nt, Mycobacterium avium subsp. paratuberculosis
ccggcggcagugcgccguccc

SEQ ID NO: 983897 - RNA, 22 nt, Mycobacterium avium subsp. paratuberculosis
ccggcggcagugcgccgucccg

SEQ ID NO: 983898 - RNA, 14 nt, Mycobacterium avium subsp. paratuberculosis
ccggcggccacgau

SEQ ID NO: 983899 - RNA, 14 nt, Mycobacterium avium subsp. paratuberculosis
ccggcggccggccc

SEQ ID NO: 983900 - RNA, 16 nt, Mycobacterium avium subsp. paratuberculosis
ccggcggccggccccg

SEQ ID NO: 983901 - RNA, 14 nt, Mycobacterium avium subsp. paratuberculosis
ccggcggccgccgc

SEQ ID NO: 983902 - RNA, 16 nt, Mycobacterium avium subsp. paratuberculosis
ccggcggccgccgccc

SEQ ID NO: 983903 - RNA, 14 nt, Mycobacterium avium subsp. paratuberculosis
ccggcggccgcgac

SEQ ID NO: 983904 - RNA, 14 nt, Mycobacterium avium subsp. paratuberculosis
ccggcggccgccau

SEQ ID NO: 983905 - RNA, 15 nt, Mycobacterium avium subsp. paratuberculosis
ccggcggccagcauc

SEQ ID NO: 983906 - RNA, 13 nt, Mycobacterium avium subsp. paratuberculosis
ccggcggccagcg

SEQ ID NO: 983907 - RNA, 12 nt, Mycobacterium avium subsp. paratuberculosis
ccggcggccccg

SEQ ID NO: 983908 - RNA, 13 nt, Mycobacterium avium subsp. paratuberculosis
ccggccaaggcaa

SEQ ID NO: 983909 - RNA, 12 nt, Mycobacterium avium subsp. paratuberculosis
ccggccaccacg

SEQ ID NO: 983910 - RNA, 12 nt, Mycobacterium avium subsp. paratuberculosis
ccggccaccagg

SEQ ID NO: 983911 - RNA, 15 nt, Mycobacterium avium subsp. paratuberculosis
ccggccaccagcggc

SEQ ID NO: 983912 - RNA, 17 nt, Mycobacterium avium subsp. paratuberculosis
ccggccaccagcggccg

SEQ ID NO: 983913 - RNA, 23 nt, Mycobacterium avium subsp. paratuberculosis
ccggccaccagggucucgcgcag

SEQ ID NO: 983914 - RNA, 15 nt, Mycobacterium avium subsp. paratuberculosis
ccggccagcggcauc

SEQ ID NO: 983915 - RNA, 22 nt, Mycobacterium avium subsp. paratuberculosis
ccggccagcggcaucccuuccu

SEQ ID NO: 983916 - RNA, 16 nt, Mycobacterium avium subsp. paratuberculosis
ccggccagcggccagc

SEQ ID NO: 983917 - RNA, 20 nt, Mycobacterium avium subsp. paratuberculosis
ccggccagcggccagcccgc

SEQ ID NO: 983918 - RNA, 18 nt, Mycobacterium avium subsp. paratuberculosis
ccggccagcggcuuggcc

SEQ ID NO: 983919 - RNA, 23 nt, Mycobacterium avium subsp. paratuberculosis
ccggccagcgucgcgccgccacc

SEQ ID NO: 983920 - RNA, 15 nt, Mycobacterium avium subsp. paratuberculosis
ccggccaccgcccca

SEQ ID NO: 983921 - RNA, 17 nt, Mycobacterium avium subsp. paratuberculosis
ccggccaccgccccagc

SEQ ID NO: 983922 - RNA, 14 nt, Mycobacterium avium subsp. paratuberculosis
ccggccaccgccgc

SEQ ID NO: 983923 - RNA, 14 nt, Mycobacterium avium subsp. paratuberculosis
ccggccaccggcgc

SEQ ID NO: 983924 - RNA, 18 nt, Mycobacterium avium subsp. paratuberculosis
ccggccaccucgucccag

SEQ ID NO: 983925 - RNA, 22 nt, Mycobacterium avium subsp. paratuberculosis
ccggccaggaucuugucggcgg

SEQ ID NO: 983926 - RNA, 16 nt, Mycobacterium avium subsp. paratuberculosis
ccggccaggcacagca

SEQ ID NO: 983927 - RNA, 12 nt, Mycobacterium avium subsp. paratuberculosis
ccggccaggccg

SEQ ID NO: 983928 - RNA, 15 nt, Mycobacterium avium subsp. paratuberculosis
ccggccagggccgcc

SEQ ID NO: 983929 - RNA, 16 nt, Mycobacterium avium subsp. paratuberculosis
ccggccagggccgccg

SEQ ID NO: 983930 - RNA, 18 nt, Mycobacterium avium subsp. paratuberculosis
ccggccaguucccgggcg

SEQ ID NO: 983931 - RNA, 20 nt, Mycobacterium avium subsp. paratuberculosis
ccggccaguucccgggcgaa

SEQ ID NO: 983932 - RNA, 21 nt, Mycobacterium avium subsp. paratuberculosis
ccggccagguugaccaccagc

SEQ ID NO: 983933 - RNA, 17 nt, Mycobacterium avium subsp. paratuberculosis
ccggccaguccggcagc

SEQ ID NO: 983934 - RNA, 20 nt, Mycobacterium avium subsp. paratuberculosis
ccggccaguccggcagcagc

SEQ ID NO: 983935 - RNA, 20 nt, Mycobacterium avium subsp. paratuberculosis
ccggccaggucgccgcgcag

SEQ ID NO: 983936 - RNA, 15 nt, Mycobacterium avium subsp. paratuberculosis
ccggccagggugccg

SEQ ID NO: 983937 - RNA, 19 nt, Mycobacterium avium subsp. paratuberculosis
ccggcuaauucgggccgcc

SEQ ID NO: 983938 - RNA, 19 nt, Mycobacterium avium subsp. paratuberculosis
ccggcguggggacccccuc

SEQ ID NO: 983939 - RNA, 16 nt, Mycobacterium avium subsp. paratuberculosis
ccggcuacucggacgc

SEQ ID NO: 983940 - RNA, 17 nt, Mycobacterium avium subsp. paratuberculosis
ccggcuagacgcgcagc

SEQ ID NO: 983941 - RNA, 15 nt, Mycobacterium avium subsp. paratuberculosis
ccggcucagaaggcg

SEQ ID NO: 983942 - RNA, 21 nt, Mycobacterium avium subsp. paratuberculosis
ccggcuccaccgcgccggcgg

SEQ ID NO: 983943 - RNA, 18 nt, Mycobacterium avium subsp. paratuberculosis
ccggcucgaaguggcagc

SEQ ID NO: 983944 - RNA, 21 nt, Mycobacterium avium subsp. paratuberculosis
ccggcucgaccucaccccgcu

SEQ ID NO: 983945 - RNA, 19 nt, Mycobacterium avium subsp. paratuberculosis
ccggcgugcacaggccgcc

SEQ ID NO: 983946 - RNA, 18 nt, Mycobacterium avium subsp. paratuberculosis
ccggcgugcagcacgccc

SEQ ID NO: 983947 - RNA, 16 nt, Mycobacterium avium subsp. paratuberculosis
ccggcgugcuccagca

SEQ ID NO: 983948 - RNA, 15 nt, Mycobacterium avium subsp. paratuberculosis
ccggcgugggccgca

SEQ ID NO: 983949 - RNA, 19 nt, Mycobacterium avium subsp. paratuberculosis
ccggcgucgggaccgucgc

SEQ ID NO: 983950 - RNA, 21 nt, Mycobacterium avium subsp. paratuberculosis
ccggcgucgggaccgucgcgc

SEQ ID NO: 983951 - RNA, 22 nt, Mycobacterium avium subsp. paratuberculosis
ccggcgucgggaccgucgcgca

SEQ ID NO: 983952 - RNA, 20 nt, Mycobacterium avium subsp. paratuberculosis
ccggcgucgucgucgcagug

SEQ ID NO: 983953 - RNA, 23 nt, Mycobacterium avium subsp. paratuberculosis
ccggcgucgucgucgcagugccc

SEQ ID NO: 983954 - RNA, 18 nt, Mycobacterium avium subsp. paratuberculosis
ccggcgucucagucggcc

SEQ ID NO: 983955 - RNA, 19 nt, Mycobacterium avium subsp. paratuberculosis
ccggcgucucagucggcca

SEQ ID NO: 983956 - RNA, 21 nt, Mycobacterium avium subsp. paratuberculosis
ccggcgucucagucggccacc

SEQ ID NO: 983957 - RNA, 22 nt, Mycobacterium avium subsp. paratuberculosis
ccggcgucgaugaugccggcgg

SEQ ID NO: 983958 - RNA, 13 nt, Mycobacterium avium subsp. paratuberculosis
ccggcuucucggc

SEQ ID NO: 983959 - RNA, 23 nt, Mycobacterium avium subsp. paratuberculosis
ccggcuugaucucgaccuucuug

SEQ ID NO: 983960 - RNA, 14 nt, Mycobacterium avium subsp. paratuberculosis
ccggcuggucggcc

SEQ ID NO: 983961 - RNA, 19 nt, Mycobacterium avium subsp. paratuberculosis
ccggcuggucggccuggcc

SEQ ID NO: 983962 - RNA, 18 nt, Mycobacterium avium subsp. paratuberculosis
ccggcuggugcagcagcu

SEQ ID NO: 983963 - RNA, 15 nt, Mycobacterium avium subsp. paratuberculosis
ccggcugagcgucgg

SEQ ID NO: 983964 - RNA, 15 nt, Mycobacterium avium subsp. paratuberculosis
ccggcugaacgccag

SEQ ID NO: 983965 - RNA, 19 nt, Mycobacterium avium subsp. paratuberculosis
ccggcugaacgccagcagc

SEQ ID NO: 983966 - RNA, 12 nt, Mycobacterium avium subsp. paratuberculosis
ccggcucgccgg

SEQ ID NO: 983967 - RNA, 18 nt, Mycobacterium avium subsp. paratuberculosis
ccggcucgccggcgcgca

SEQ ID NO: 983968 - RNA, 20 nt, Mycobacterium avium subsp. paratuberculosis
ccggcucgggaacggucagc

SEQ ID NO: 983969 - RNA, 21 nt, Mycobacterium avium subsp. paratuberculosis
ccggcucgggaacggucagcc

SEQ ID NO: 983970 - RNA, 16 nt, Mycobacterium avium subsp. paratuberculosis
ccggcucggucuccuc

SEQ ID NO: 983971 - RNA, 20 nt, Mycobacterium avium subsp. paratuberculosis
ccggcucggucuccuccagg

SEQ ID NO: 983972 - RNA, 17 nt, Mycobacterium avium subsp. paratuberculosis
ccggcucggugccgcgg

SEQ ID NO: 983973 - RNA, 22 nt, Mycobacterium avium subsp. paratuberculosis
ccggcucguagcuggugcgcag

SEQ ID NO: 983974 - RNA, 16 nt, Mycobacterium avium subsp. paratuberculosis
ccggcugcugcacgac

SEQ ID NO: 983975 - RNA, 16 nt, Mycobacterium avium subsp. paratuberculosis
ccggcugcgcagcgca

SEQ ID NO: 983976 - RNA, 14 nt, Mycobacterium avium subsp. paratuberculosis
ccggcugcccgacc

SEQ ID NO: 983977 - RNA, 16 nt, Mycobacterium avium subsp. paratuberculosis
ccggcugcccgacccg

SEQ ID NO: 983978 - RNA, 18 nt, Mycobacterium avium subsp. paratuberculosis
ccggcugcccgacccgca

SEQ ID NO: 983979 - RNA, 23 nt, Mycobacterium avium subsp. paratuberculosis
ccggcugcccgacccgcaccacc

SEQ ID NO: 983980 - RNA, 18 nt, Mycobacterium avium subsp. paratuberculosis
ccggacugcuugggcgcc

SEQ ID NO: 983981 - RNA, 18 nt, Mycobacterium avium subsp. paratuberculosis
ccggacuugaugcugccc

SEQ ID NO: 983982 - RNA, 16 nt, Mycobacterium avium subsp. paratuberculosis
ccggagaccgccgugg

SEQ ID NO: 983983 - RNA, 22 nt, Mycobacterium avium subsp. paratuberculosis
ccggacuauacacgccuggaca

SEQ ID NO: 983984 - RNA, 21 nt, Mycobacterium avium subsp. paratuberculosis
ccggagaucccguaggucgcc

SEQ ID NO: 983985 - RNA, 18 nt, Mycobacterium avium subsp. paratuberculosis
ccggaauugaagcccugc

SEQ ID NO: 983986 - RNA, 20 nt, Mycobacterium avium subsp. paratuberculosis
ccggaauggcaaggccagca

SEQ ID NO: 983987 - RNA, 20 nt, Mycobacterium avium subsp. paratuberculosis
ccggaaucgauuggugcgca

SEQ ID NO: 983988 - RNA, 15 nt, Mycobacterium avium subsp. paratuberculosis
ccggaaucgucggcc

SEQ ID NO: 983989 - RNA, 14 nt, Mycobacterium avium subsp. paratuberculosis
ccggacaccaccgc

SEQ ID NO: 983990 - RNA, 19 nt, Mycobacterium avium subsp. paratuberculosis
ccggacaccggcacgucgg

SEQ ID NO: 983991 - RNA, 15 nt, Mycobacterium avium subsp. paratuberculosis
ccggacaccuggagu

SEQ ID NO: 983992 - RNA, 18 nt, Mycobacterium avium subsp. paratuberculosis
ccggacagcggccccccg

SEQ ID NO: 983993 - RNA, 17 nt, Mycobacterium avium subsp. paratuberculosis
ccggacagcgggccgac

SEQ ID NO: 983994 - RNA, 18 nt, Mycobacterium avium subsp. paratuberculosis
ccggacagcgggccgacc

SEQ ID NO: 983995 - RNA, 20 nt, Mycobacterium avium subsp. paratuberculosis
ccggacagcgggccgacccg

SEQ ID NO: 983996 - RNA, 21 nt, Mycobacterium avium subsp. paratuberculosis
ccggacagcgggccgacccgg

SEQ ID NO: 983997 - RNA, 20 nt, Mycobacterium avium subsp. paratuberculosis
ccggacagcuggcggucgcu

SEQ ID NO: 983998 - RNA, 18 nt, Mycobacterium avium subsp. paratuberculosis
ccggacagccggggcagc

SEQ ID NO: 983999 - RNA, 20 nt, Mycobacterium avium subsp. paratuberculosis
ccggacagcgcgacgcacgc

SEQ ID NO: 984000 - RNA, 15 nt, Mycobacterium avium subsp. paratuberculosis
ccggacaggucgggc

SEQ ID NO: 984001 - RNA, 22 nt, Mycobacterium avium subsp. paratuberculosis
ccggacauccauugggccgcgg

SEQ ID NO: 984002 - RNA, 17 nt, Mycobacterium avium subsp. paratuberculosis
ccggacggagccgugcc

SEQ ID NO: 984003 - RNA, 20 nt, Mycobacterium avium subsp. paratuberculosis
ccggacgggucgaccgccgc

SEQ ID NO: 984004 - RNA, 11 nt, Mycobacterium avium subsp. paratuberculosis
ccggacgugau

SEQ ID NO: 984005 - RNA, 17 nt, Mycobacterium avium subsp. paratuberculosis
ccgcuuguucgggccca

SEQ ID NO: 984006 - RNA, 22 nt, Mycobacterium avium subsp. paratuberculosis
ccggaacagcuggucccacagc

SEQ ID NO: 984007 - RNA, 17 nt, Mycobacterium avium subsp. paratuberculosis
ccggaacacaacgccuu

SEQ ID NO: 984008 - RNA, 18 nt, Mycobacterium avium subsp. paratuberculosis
ccggaagaucagcaggcu

SEQ ID NO: 984009 - RNA, 19 nt, Mycobacterium avium subsp. paratuberculosis
ccggaagaucagcaggcug

SEQ ID NO: 984010 - RNA, 18 nt, Mycobacterium avium subsp. paratuberculosis
ccggcaugggcggcaagc

SEQ ID NO: 984011 - RNA, 22 nt, Mycobacterium avium subsp. paratuberculosis
ccggccaacagcagcgccgcgg

SEQ ID NO: 984012 - RNA, 14 nt, Mycobacterium avium subsp. paratuberculosis
ccggcaggccgccc

SEQ ID NO: 984013 - RNA, 15 nt, Mycobacterium avium subsp. paratuberculosis
ccggcaggccgcccg

SEQ ID NO: 984014 - RNA, 21 nt, Mycobacterium avium subsp. paratuberculosis
ccggcaggccgcggccgucgu

SEQ ID NO: 984015 - RNA, 17 nt, Mycobacterium avium subsp. paratuberculosis
ccggcaggcucagcagc

SEQ ID NO: 984016 - RNA, 17 nt, Mycobacterium avium subsp. paratuberculosis
ccggcagcggugccgcc

SEQ ID NO: 984017 - RNA, 18 nt, Mycobacterium avium subsp. paratuberculosis
ccggcagcggugccgccc

SEQ ID NO: 984018 - RNA, 18 nt, Mycobacterium avium subsp. paratuberculosis
ccggcagcugcccgucgg

SEQ ID NO: 984019 - RNA, 16 nt, Mycobacterium avium subsp. paratuberculosis
ccggcacucgccucgg

SEQ ID NO: 984020 - RNA, 22 nt, Mycobacterium avium subsp. paratuberculosis
ccggcacgucgagcuccucggc

SEQ ID NO: 984021 - RNA, 20 nt, Mycobacterium avium subsp. paratuberculosis
ccggcacggugcacacgccg

SEQ ID NO: 984022 - RNA, 14 nt, Mycobacterium avium subsp. paratuberculosis
ccggcacgucggcc

SEQ ID NO: 984023 - RNA, 18 nt, Mycobacterium avium subsp. paratuberculosis
ccggcacuaccgccucgc

SEQ ID NO: 984024 - RNA, 18 nt, Mycobacterium avium subsp. paratuberculosis
ccggcagaucgcggcccg

SEQ ID NO: 984025 - RNA, 20 nt, Mycobacterium avium subsp. paratuberculosis
ccggcagcaaccggcggcug

SEQ ID NO: 984026 - RNA, 14 nt, Mycobacterium avium subsp. paratuberculosis
ccggcagcaccggc

SEQ ID NO: 984027 - RNA, 15 nt, Mycobacterium avium subsp. paratuberculosis
ccggcagcagcgagu

SEQ ID NO: 984028 - RNA, 14 nt, Mycobacterium avium subsp. paratuberculosis
ccggcagccgcagc

SEQ ID NO: 984029 - RNA, 17 nt, Mycobacterium avium subsp. paratuberculosis
ccggcagccgcagcgac

SEQ ID NO: 984030 - RNA, 14 nt, Mycobacterium avium subsp. paratuberculosis
ccggcagccggcgc

SEQ ID NO: 984031 - RNA, 11 nt, Mycobacterium avium subsp. paratuberculosis
ccggcagcgcc

SEQ ID NO: 984032 - RNA, 17 nt, Mycobacterium avium subsp. paratuberculosis
ccggcagcgccaccagc

SEQ ID NO: 984033 - RNA, 20 nt, Mycobacterium avium subsp. paratuberculosis
ccggcagcgccaccagcucc

SEQ ID NO: 984034 - RNA, 20 nt, Mycobacterium avium subsp. paratuberculosis
ccggcagcaggugcaccacc

SEQ ID NO: 984035 - RNA, 21 nt, Mycobacterium avium subsp. paratuberculosis
ccggcagcaucgggacgccug

SEQ ID NO: 984036 - RNA, 18 nt, Mycobacterium avium subsp. paratuberculosis
ccggauagccgucggcgg

SEQ ID NO: 984037 - RNA, 15 nt, Mycobacterium avium subsp. paratuberculosis
ccggcaaccgccacg

SEQ ID NO: 984038 - RNA, 18 nt, Mycobacterium avium subsp. paratuberculosis
ccggcaacgacccgucgg

SEQ ID NO: 984039 - RNA, 17 nt, Mycobacterium avium subsp. paratuberculosis
ccggcaacuggccgccc

SEQ ID NO: 984040 - RNA, 18 nt, Mycobacterium avium subsp. paratuberculosis
ccggcaaggugccguccg

SEQ ID NO: 984041 - RNA, 11 nt, Mycobacterium avium subsp. paratuberculosis
ccggcaccgcc

SEQ ID NO: 984042 - RNA, 21 nt, Mycobacterium avium subsp. paratuberculosis
ccggcaccgccagccaccaca

SEQ ID NO: 984043 - RNA, 15 nt, Mycobacterium avium subsp. paratuberculosis
ccggcacccgccagc

SEQ ID NO: 984044 - RNA, 23 nt, Mycobacterium avium subsp. paratuberculosis
ccggcaccgcccccgcggcggcc

SEQ ID NO: 984045 - RNA, 16 nt, Mycobacterium avium subsp. paratuberculosis
ccgcguucggcggcgc

SEQ ID NO: 984046 - RNA, 23 nt, Mycobacterium avium subsp. paratuberculosis
ccgcguccugcaggcaggccggc

SEQ ID NO: 984047 - RNA, 14 nt, Mycobacterium avium subsp. paratuberculosis
ccgcgucgaccagc

SEQ ID NO: 984048 - RNA, 19 nt, Mycobacterium avium subsp. paratuberculosis
ccgcgucgacgccgcugcc

SEQ ID NO: 984049 - RNA, 14 nt, Mycobacterium avium subsp. paratuberculosis
ccgcguuggccgcc

SEQ ID NO: 984050 - RNA, 15 nt, Mycobacterium avium subsp. paratuberculosis
ccgcguugucggcga

SEQ ID NO: 984051 - RNA, 15 nt, Mycobacterium avium subsp. paratuberculosis
ccgcguugucggcgu

SEQ ID NO: 984052 - RNA, 18 nt, Mycobacterium avium subsp. paratuberculosis
ccgcguugucggcguccu

SEQ ID NO: 984053 - RNA, 14 nt, Mycobacterium avium subsp. paratuberculosis
ccgcggggccggcg

SEQ ID NO: 984054 - RNA, 14 nt, Mycobacterium avium subsp. paratuberculosis
ccgcguaggccagg

SEQ ID NO: 984055 - RNA, 15 nt, Mycobacterium avium subsp. paratuberculosis
ccgcgucagcagcgc

SEQ ID NO: 984056 - RNA, 23 nt, Mycobacterium avium subsp. paratuberculosis
ccgcggucagacgaugggccgcc

SEQ ID NO: 984057 - RNA, 20 nt, Mycobacterium avium subsp. paratuberculosis
ccgcggguggcgccacagcc

SEQ ID NO: 984058 - RNA, 22 nt, Mycobacterium avium subsp. paratuberculosis
ccgcggguggcgccacagccgg

SEQ ID NO: 984059 - RNA, 23 nt, Mycobacterium avium subsp. paratuberculosis
ccgcgggugacgaucaccgcugc

SEQ ID NO: 984060 - RNA, 23 nt, Mycobacterium avium subsp. paratuberculosis
ccgcgggugaggggcgcgcgccg

SEQ ID NO: 984061 - RNA, 18 nt, Mycobacterium avium subsp. paratuberculosis
ccgcgggucgcggcccac

SEQ ID NO: 984062 - RNA, 22 nt, Mycobacterium avium subsp. paratuberculosis
ccgcgccgguguucggcgccag

SEQ ID NO: 984063 - RNA, 22 nt, Mycobacterium avium subsp. paratuberculosis
ccgcgccgggguguccagcggg

SEQ ID NO: 984064 - RNA, 21 nt, Mycobacterium avium subsp. paratuberculosis
ccgcgccggucccgcggcggc

SEQ ID NO: 984065 - RNA, 15 nt, Mycobacterium avium subsp. paratuberculosis
ccgcgccgguccggc

SEQ ID NO: 984066 - RNA, 16 nt, Mycobacterium avium subsp. paratuberculosis
ccgcgccggcggcggc

SEQ ID NO: 984067 - RNA, 15 nt, Mycobacterium avium subsp. paratuberculosis
ccgcgccgggcacca

SEQ ID NO: 984068 - RNA, 16 nt, Mycobacterium avium subsp. paratuberculosis
ccgcgccgggcaccac

SEQ ID NO: 984069 - RNA, 12 nt, Mycobacterium avium subsp. paratuberculosis
ccgcgccggccu

SEQ ID NO: 984070 - RNA, 12 nt, Mycobacterium avium subsp. paratuberculosis
ccgcgccgucgu

SEQ ID NO: 984071 - RNA, 22 nt, Mycobacterium avium subsp. paratuberculosis
ccgcgccgucgucgucggccgg

SEQ ID NO: 984072 - RNA, 21 nt, Mycobacterium avium subsp. paratuberculosis
ccgcgccgucuuccgggccac

SEQ ID NO: 984073 - RNA, 12 nt, Mycobacterium avium subsp. paratuberculosis
ccgcgccgugcg

SEQ ID NO: 984074 - RNA, 16 nt, Mycobacterium avium subsp. paratuberculosis
ccgcgccgugcgccag

SEQ ID NO: 984075 - RNA, 21 nt, Mycobacterium avium subsp. paratuberculosis
ccgcggcgcggcccggcccgc

SEQ ID NO: 984076 - RNA, 21 nt, Mycobacterium avium subsp. paratuberculosis
ccgcggcgccguugaccggcc

SEQ ID NO: 984077 - RNA, 21 nt, Mycobacterium avium subsp. paratuberculosis
ccgcggcgcgaugaucgccgg

SEQ ID NO: 984078 - RNA, 18 nt, Mycobacterium avium subsp. paratuberculosis
ccgcggcggcacccaggu

SEQ ID NO: 984079 - RNA, 14 nt, Mycobacterium avium subsp. paratuberculosis
ccgcggcgccgcca

SEQ ID NO: 984080 - RNA, 14 nt, Mycobacterium avium subsp. paratuberculosis
ccgcgccuggcgca

SEQ ID NO: 984081 - RNA, 20 nt, Mycobacterium avium subsp. paratuberculosis
ccgcgccuucgacccggugg

SEQ ID NO: 984082 - RNA, 14 nt, Mycobacterium avium subsp. paratuberculosis
ccgcgccuucuugc

SEQ ID NO: 984083 - RNA, 14 nt, Mycobacterium avium subsp. paratuberculosis
ccgcggcgucggga

SEQ ID NO: 984084 - RNA, 17 nt, Mycobacterium avium subsp. paratuberculosis
ccgcggcggugucggcg

SEQ ID NO: 984085 - RNA, 21 nt, Mycobacterium avium subsp. paratuberculosis
ccgcggcgcuugaccucgccg

SEQ ID NO: 984086 - RNA, 14 nt, Mycobacterium avium subsp. paratuberculosis
ccgcggcggcgccg

SEQ ID NO: 984087 - RNA, 21 nt, Mycobacterium avium subsp. paratuberculosis
ccgcggcggcggcccguccgc

SEQ ID NO: 984088 - RNA, 20 nt, Mycobacterium avium subsp. paratuberculosis
ccgcggcggcgugccgcccg

SEQ ID NO: 984089 - RNA, 21 nt, Mycobacterium avium subsp. paratuberculosis
ccgcggcggcgugccgcccgg

SEQ ID NO: 984090 - RNA, 21 nt, Mycobacterium avium subsp. paratuberculosis
ccgcgggaauuggcaccggac

SEQ ID NO: 984091 - RNA, 13 nt, Mycobacterium avium subsp. paratuberculosis
ccgcggcgucccg

SEQ ID NO: 984092 - RNA, 13 nt, Mycobacterium avium subsp. paratuberculosis
ccgcggcuccggc

SEQ ID NO: 984093 - RNA, 16 nt, Mycobacterium avium subsp. paratuberculosis
ccgcggcuccggccgc

SEQ ID NO: 984094 - RNA, 22 nt, Mycobacterium avium subsp. paratuberculosis
ccgcgggcguucaucaccuggu

SEQ ID NO: 984095 - RNA, 20 nt, Mycobacterium avium subsp. paratuberculosis
ccgcgggcgccguaggccgc

SEQ ID NO: 984096 - RNA, 11 nt, Mycobacterium avium subsp. paratuberculosis
ccgcgggccgg

SEQ ID NO: 984097 - RNA, 17 nt, Mycobacterium avium subsp. paratuberculosis
ccgcgggccagcagccg

SEQ ID NO: 984098 - RNA, 18 nt, Mycobacterium avium subsp. paratuberculosis
ccgcgggccagcagccgg

SEQ ID NO: 984099 - RNA, 13 nt, Mycobacterium avium subsp. paratuberculosis
ccgcgggccagcc

SEQ ID NO: 984100 - RNA, 14 nt, Mycobacterium avium subsp. paratuberculosis
ccgcuuggccgggc

SEQ ID NO: 984101 - RNA, 20 nt, Mycobacterium avium subsp. paratuberculosis
ccgcuggccgaggccuccag

SEQ ID NO: 984102 - RNA, 13 nt, Mycobacterium avium subsp. paratuberculosis
ccgcuggccgccg

SEQ ID NO: 984103 - RNA, 14 nt, Mycobacterium avium subsp. paratuberculosis
ccgcuggccgccgc

SEQ ID NO: 984104 - RNA, 20 nt, Mycobacterium avium subsp. paratuberculosis
ccgcuggcguagaucugcac

SEQ ID NO: 984105 - RNA, 21 nt, Mycobacterium avium subsp. paratuberculosis
ccgcugaaauccggggucagg

SEQ ID NO: 984106 - RNA, 16 nt, Mycobacterium avium subsp. paratuberculosis
ccgcugaacgggcagc

SEQ ID NO: 984107 - RNA, 19 nt, Mycobacterium avium subsp. paratuberculosis
ccgcugcagccgguccggc

SEQ ID NO: 984108 - RNA, 22 nt, Mycobacterium avium subsp. paratuberculosis
ccgcugcagcgccgaggccagc

SEQ ID NO: 984109 - RNA, 19 nt, Mycobacterium avium subsp. paratuberculosis
ccgcugcagcgccgcccgc

SEQ ID NO: 984110 - RNA, 19 nt, Mycobacterium avium subsp. paratuberculosis
ccgcugcagcugcucgucc

SEQ ID NO: 984111 - RNA, 14 nt, Mycobacterium avium subsp. paratuberculosis
ccgcugcauccgca

SEQ ID NO: 984112 - RNA, 12 nt, Mycobacterium avium subsp. paratuberculosis
ccgcugcccgcc

SEQ ID NO: 984113 - RNA, 21 nt, Mycobacterium avium subsp. paratuberculosis
ccgcugcccgccgcguacagc

SEQ ID NO: 984114 - RNA, 15 nt, Mycobacterium avium subsp. paratuberculosis
ccgcugcccggcgcu

SEQ ID NO: 984115 - RNA, 22 nt, Mycobacterium avium subsp. paratuberculosis
ccgcugcccggcgcuaaagccg

SEQ ID NO: 984116 - RNA, 13 nt, Mycobacterium avium subsp. paratuberculosis
ccgcugcccgggc

SEQ ID NO: 984117 - RNA, 14 nt, Mycobacterium avium subsp. paratuberculosis
ccgcugcccgggca

SEQ ID NO: 984118 - RNA, 15 nt, Mycobacterium avium subsp. paratuberculosis
ccgcucaccugcggc

SEQ ID NO: 984119 - RNA, 17 nt, Mycobacterium avium subsp. paratuberculosis
ccgcucgucggccagcg

SEQ ID NO: 984120 - RNA, 22 nt, Mycobacterium avium subsp. paratuberculosis
ccgcucagcgauugcggccgcc

SEQ ID NO: 984121 - RNA, 20 nt, Mycobacterium avium subsp. paratuberculosis
ccgcucagcgggcggccagc

SEQ ID NO: 984122 - RNA, 18 nt, Mycobacterium avium subsp. paratuberculosis
ccgcucggggaucccgaa

SEQ ID NO: 984123 - RNA, 23 nt, Mycobacterium avium subsp. paratuberculosis
ccgcucguaacgccacggcggcc

SEQ ID NO: 984124 - RNA, 22 nt, Mycobacterium avium subsp. paratuberculosis
ccgcucguaguuggggccggcc

SEQ ID NO: 984125 - RNA, 12 nt, Mycobacterium avium subsp. paratuberculosis
ccgccucaccga

SEQ ID NO: 984126 - RNA, 19 nt, Mycobacterium avium subsp. paratuberculosis
ccgccucacgcagggccaa

SEQ ID NO: 984127 - RNA, 22 nt, Mycobacterium avium subsp. paratuberculosis
ccgccucaugccagacgcgcac

SEQ ID NO: 984128 - RNA, 17 nt, Mycobacterium avium subsp. paratuberculosis
ccgccguuucagcagcg

SEQ ID NO: 984129 - RNA, 16 nt, Mycobacterium avium subsp. paratuberculosis
ccgccguugcggccca

SEQ ID NO: 984130 - RNA, 23 nt, Mycobacterium avium subsp. paratuberculosis
ccgccguugaccggugcgcccgc

SEQ ID NO: 984131 - RNA, 15 nt, Mycobacterium avium subsp. paratuberculosis
ccgccugagcccgcc

SEQ ID NO: 984132 - RNA, 18 nt, Mycobacterium avium subsp. paratuberculosis
ccgccuccagcacgucgg

SEQ ID NO: 984133 - RNA, 15 nt, Mycobacterium avium subsp. paratuberculosis
ccgccuccgaccagc

SEQ ID NO: 984134 - RNA, 16 nt, Mycobacterium avium subsp. paratuberculosis
ccgccuccgaccagcc

SEQ ID NO: 984135 - RNA, 18 nt, Mycobacterium avium subsp. paratuberculosis
ccgccuccgaccagccgg

SEQ ID NO: 984136 - RNA, 19 nt, Mycobacterium avium subsp. paratuberculosis
ccgccuccgguuugcgccg

SEQ ID NO: 984137 - RNA, 18 nt, Mycobacterium avium subsp. paratuberculosis
ccgccucgaagucgccgg

SEQ ID NO: 984138 - RNA, 21 nt, Mycobacterium avium subsp. paratuberculosis
ccgccucgaagucgccggccu

SEQ ID NO: 984139 - RNA, 23 nt, Mycobacterium avium subsp. paratuberculosis
ccgccucgaagucgccggccucc

SEQ ID NO: 984140 - RNA, 14 nt, Mycobacterium avium subsp. paratuberculosis
ccgccucgccagcc

SEQ ID NO: 984141 - RNA, 15 nt, Mycobacterium avium subsp. paratuberculosis
ccgccucgccagccc

SEQ ID NO: 984142 - RNA, 22 nt, Mycobacterium avium subsp. paratuberculosis
ccgccgguggagauggccagca

SEQ ID NO: 984143 - RNA, 19 nt, Mycobacterium avium subsp. paratuberculosis
ccgccggugccgacgauga

SEQ ID NO: 984144 - RNA, 21 nt, Mycobacterium avium subsp. paratuberculosis
ccgccggggugugcagcggga

SEQ ID NO: 984145 - RNA, 16 nt, Mycobacterium avium subsp. paratuberculosis
ccgccggguccuugcg

SEQ ID NO: 984146 - RNA, 16 nt, Mycobacterium avium subsp. paratuberculosis
ccgccggguggccgcc

SEQ ID NO: 984147 - RNA, 18 nt, Mycobacterium avium subsp. paratuberculosis
ccgccgggcuuccccaac

SEQ ID NO: 984148 - RNA, 19 nt, Mycobacterium avium subsp. paratuberculosis
ccgccgggcuuccccaacc

SEQ ID NO: 984149 - RNA, 21 nt, Mycobacterium avium subsp. paratuberculosis
ccgccggggacccgcaccgga

SEQ ID NO: 984150 - RNA, 13 nt, Mycobacterium avium subsp. paratuberculosis
ccgccggggcccc

SEQ ID NO: 984151 - RNA, 15 nt, Mycobacterium avium subsp. paratuberculosis
ccgccggggccccaa

SEQ ID NO: 984152 - RNA, 19 nt, Mycobacterium avium subsp. paratuberculosis
ccgccggggccccaacccc

SEQ ID NO: 984153 - RNA, 14 nt, Mycobacterium avium subsp. paratuberculosis
ccgccggggccggc

SEQ ID NO: 984154 - RNA, 13 nt, Mycobacterium avium subsp. paratuberculosis
ccgccggggcgca

SEQ ID NO: 984155 - RNA, 18 nt, Mycobacterium avium subsp. paratuberculosis
ccgccgggcgccacccgc

SEQ ID NO: 984156 - RNA, 19 nt, Mycobacterium avium subsp. paratuberculosis
ccgccgggcggcguccucg

SEQ ID NO: 984157 - RNA, 22 nt, Mycobacterium avium subsp. paratuberculosis
ccgccgggcggcguccucgacc

SEQ ID NO: 984158 - RNA, 13 nt, Mycobacterium avium subsp. paratuberculosis
ccgccgggccgga

SEQ ID NO: 984159 - RNA, 16 nt, Mycobacterium avium subsp. paratuberculosis
ccgccggcuggcgggc

SEQ ID NO: 984160 - RNA, 21 nt, Mycobacterium avium subsp. paratuberculosis
ccgccgggaucggcggggcgc

SEQ ID NO: 984161 - RNA, 21 nt, Mycobacterium avium subsp. paratuberculosis
ccgccgugcgccccgcccugc

SEQ ID NO: 984162 - RNA, 20 nt, Mycobacterium avium subsp. paratuberculosis
ccgccgucuucccagugccg

SEQ ID NO: 984163 - RNA, 16 nt, Mycobacterium avium subsp. paratuberculosis
ccgccggugucggcga

SEQ ID NO: 984164 - RNA, 15 nt, Mycobacterium avium subsp. paratuberculosis
ccgccguccccgcgc

SEQ ID NO: 984165 - RNA, 21 nt, Mycobacterium avium subsp. paratuberculosis
ccgccguccccgcgcggcucg

SEQ ID NO: 984166 - RNA, 12 nt, Mycobacterium avium subsp. paratuberculosis
ccgccgucccgu

SEQ ID NO: 984167 - RNA, 22 nt, Mycobacterium avium subsp. paratuberculosis
ccgccguccugagguauucguc

SEQ ID NO: 984168 - RNA, 20 nt, Mycobacterium avium subsp. paratuberculosis
ccgccgucaucggcggaagc

SEQ ID NO: 984169 - RNA, 13 nt, Mycobacterium avium subsp. paratuberculosis
ccgccguagccgg

SEQ ID NO: 984170 - RNA, 16 nt, Mycobacterium avium subsp. paratuberculosis
ccgccguagcgccggc

SEQ ID NO: 984171 - RNA, 19 nt, Mycobacterium avium subsp. paratuberculosis
ccgccgguugaucacccgg

SEQ ID NO: 984172 - RNA, 20 nt, Mycobacterium avium subsp. paratuberculosis
ccgccuucacgaccggcagc

SEQ ID NO: 984173 - RNA, 18 nt, Mycobacterium avium subsp. paratuberculosis
ccgccuucgacggccggc

SEQ ID NO: 984174 - RNA, 20 nt, Mycobacterium avium subsp. paratuberculosis
ccgccuucgacggccggccc

SEQ ID NO: 984175 - RNA, 15 nt, Mycobacterium avium subsp. paratuberculosis
ccgccugcccgggcg

SEQ ID NO: 984176 - RNA, 19 nt, Mycobacterium avium subsp. paratuberculosis
ccgccuucuugcgcggcgc

SEQ ID NO: 984177 - RNA, 18 nt, Mycobacterium avium subsp. paratuberculosis
ccgccuugaucuuggccu

SEQ ID NO: 984178 - RNA, 17 nt, Mycobacterium avium subsp. paratuberculosis
ccgccuugcccggcucg

SEQ ID NO: 984179 - RNA, 20 nt, Mycobacterium avium subsp. paratuberculosis
ccgccuuggccacgucgaag

SEQ ID NO: 984180 - RNA, 14 nt, Mycobacterium avium subsp. paratuberculosis
ccgccuugggccgg

SEQ ID NO: 984181 - RNA, 22 nt, Mycobacterium avium subsp. paratuberculosis
ccgccuuggugauccggggcac

SEQ ID NO: 984182 - RNA, 12 nt, Mycobacterium avium subsp. paratuberculosis
ccgcgagcugcc

SEQ ID NO: 984183 - RNA, 15 nt, Mycobacterium avium subsp. paratuberculosis
ccgcgcaaccgggcc

SEQ ID NO: 984184 - RNA, 17 nt, Mycobacterium avium subsp. paratuberculosis
ccgcgcaaccgggccgc

SEQ ID NO: 984185 - RNA, 19 nt, Mycobacterium avium subsp. paratuberculosis
ccgcgcaaccgggccgcac

SEQ ID NO: 984186 - RNA, 23 nt, Mycobacterium avium subsp. paratuberculosis
ccgcgcaauacccgaccagcacc

SEQ ID NO: 984187 - RNA, 21 nt, Mycobacterium avium subsp. paratuberculosis
ccgcgcaaucaaaaaccccgc

SEQ ID NO: 984188 - RNA, 20 nt, Mycobacterium avium subsp. paratuberculosis
ccgcgaggaaucgcggcagg

SEQ ID NO: 984189 - RNA, 21 nt, Mycobacterium avium subsp. paratuberculosis
ccgcgagccgcccaggcgggc

SEQ ID NO: 984190 - RNA, 22 nt, Mycobacterium avium subsp. paratuberculosis
ccgcgacggcgagccgggccgg

SEQ ID NO: 984191 - RNA, 20 nt, Mycobacterium avium subsp. paratuberculosis
ccgcgacgggcugucccggc

SEQ ID NO: 984192 - RNA, 23 nt, Mycobacterium avium subsp. paratuberculosis
ccgcgacgggcugucccggccgc

SEQ ID NO: 984193 - RNA, 23 nt, Mycobacterium avium subsp. paratuberculosis
ccgcgacggugagcaacaccggc

SEQ ID NO: 984194 - RNA, 16 nt, Mycobacterium avium subsp. paratuberculosis
ccgcgacugucggcuc

SEQ ID NO: 984195 - RNA, 19 nt, Mycobacterium avium subsp. paratuberculosis
ccgcgccgaccagcgcguu

SEQ ID NO: 984196 - RNA, 14 nt, Mycobacterium avium subsp. paratuberculosis
ccgcgccgcccggc

SEQ ID NO: 984197 - RNA, 20 nt, Mycobacterium avium subsp. paratuberculosis
ccgcgccgccgcccuggccc

SEQ ID NO: 984198 - RNA, 21 nt, Mycobacterium avium subsp. paratuberculosis
ccgcgccgaccucgucggcgg

SEQ ID NO: 984199 - RNA, 15 nt, Mycobacterium avium subsp. paratuberculosis
ccgcgcccuucuucg

SEQ ID NO: 984200 - RNA, 19 nt, Mycobacterium avium subsp. paratuberculosis
ccgcgccgaacgcaccacc

SEQ ID NO: 984201 - RNA, 21 nt, Mycobacterium avium subsp. paratuberculosis
ccgcgccgacagaugcggcac

SEQ ID NO: 984202 - RNA, 17 nt, Mycobacterium avium subsp. paratuberculosis
ccgcgcccggcuucgcc

SEQ ID NO: 984203 - RNA, 18 nt, Mycobacterium avium subsp. paratuberculosis
ccgcgcccggcuucgccg

SEQ ID NO: 984204 - RNA, 11 nt, Mycobacterium avium subsp. paratuberculosis
ccgcgcccguc

SEQ ID NO: 984205 - RNA, 15 nt, Mycobacterium avium subsp. paratuberculosis
ccgcgcccgccgcgu

SEQ ID NO: 984206 - RNA, 16 nt, Mycobacterium avium subsp. paratuberculosis
ccgcgcccgccggccc

SEQ ID NO: 984207 - RNA, 13 nt, Mycobacterium avium subsp. paratuberculosis
ccgcgcccgccgc

SEQ ID NO: 984208 - RNA, 17 nt, Mycobacterium avium subsp. paratuberculosis
ccgcgcccccugggaca

SEQ ID NO: 984209 - RNA, 13 nt, Mycobacterium avium subsp. paratuberculosis
ccgcgccccggcc

SEQ ID NO: 984210 - RNA, 17 nt, Mycobacterium avium subsp. paratuberculosis
ccgcgccccggcgcagc

SEQ ID NO: 984211 - RNA, 17 nt, Mycobacterium avium subsp. paratuberculosis
ccgcgccccggcgcgcc

SEQ ID NO: 984212 - RNA, 12 nt, Mycobacterium avium subsp. paratuberculosis
ccgcgcccaggg

SEQ ID NO: 984213 - RNA, 13 nt, Mycobacterium avium subsp. paratuberculosis
ccgcgcccagccc

SEQ ID NO: 984214 - RNA, 14 nt, Mycobacterium avium subsp. paratuberculosis
ccgcgcccagcccc

SEQ ID NO: 984215 - RNA, 18 nt, Mycobacterium avium subsp. paratuberculosis
ccgcgcagcggggcgcgc

SEQ ID NO: 984216 - RNA, 20 nt, Mycobacterium avium subsp. paratuberculosis
ccgcgcagcucggggucggc

SEQ ID NO: 984217 - RNA, 22 nt, Mycobacterium avium subsp. paratuberculosis
ccgcgcagcucggggucggcgu

SEQ ID NO: 984218 - RNA, 22 nt, Mycobacterium avium subsp. paratuberculosis
ccgcgcagcagcguuccgucgg

SEQ ID NO: 984219 - RNA, 20 nt, Mycobacterium avium subsp. paratuberculosis
ccgcgcacucgaacggcccg

SEQ ID NO: 984220 - RNA, 18 nt, Mycobacterium avium subsp. paratuberculosis
ccgcgcagaucgccagca

SEQ ID NO: 984221 - RNA, 20 nt, Mycobacterium avium subsp. paratuberculosis
ccgcgcagaucgccagcacc

SEQ ID NO: 984222 - RNA, 14 nt, Mycobacterium avium subsp. paratuberculosis
ccgcgcacccggcc

SEQ ID NO: 984223 - RNA, 22 nt, Mycobacterium avium subsp. paratuberculosis
ccgcgcaccccgaaccgcccgc

SEQ ID NO: 984224 - RNA, 15 nt, Mycobacterium avium subsp. paratuberculosis
ccgcccaucgaccgg

SEQ ID NO: 984225 - RNA, 15 nt, Mycobacterium avium subsp. paratuberculosis
ccgcccaucggcagc

SEQ ID NO: 984226 - RNA, 14 nt, Mycobacterium avium subsp. paratuberculosis
ccgcccagucgccg

SEQ ID NO: 984227 - RNA, 18 nt, Mycobacterium avium subsp. paratuberculosis
ccgcccaucaccccgaag

SEQ ID NO: 984228 - RNA, 22 nt, Mycobacterium avium subsp. paratuberculosis
ccgcccaucagcaggaccaggc

SEQ ID NO: 984229 - RNA, 16 nt, Mycobacterium avium subsp. paratuberculosis
ccgcccaggacccgua

SEQ ID NO: 984230 - RNA, 18 nt, Mycobacterium avium subsp. paratuberculosis
ccgcccaggcgggccagc

SEQ ID NO: 984231 - RNA, 17 nt, Mycobacterium avium subsp. paratuberculosis
ccgcccagcgccacggu

SEQ ID NO: 984232 - RNA, 16 nt, Mycobacterium avium subsp. paratuberculosis
ccgcccagcggccccg

SEQ ID NO: 984233 - RNA, 12 nt, Mycobacterium avium subsp. paratuberculosis
ccgcccagcggu

SEQ ID NO: 984234 - RNA, 15 nt, Mycobacterium avium subsp. paratuberculosis
ccgcccccgccgcga

SEQ ID NO: 984235 - RNA, 13 nt, Mycobacterium avium subsp. paratuberculosis
ccgcccccgcggc

SEQ ID NO: 984236 - RNA, 16 nt, Mycobacterium avium subsp. paratuberculosis
ccgcccccgcggcggc

SEQ ID NO: 984237 - RNA, 23 nt, Mycobacterium avium subsp. paratuberculosis
ccgccccgaucggauccgccugc

SEQ ID NO: 984238 - RNA, 13 nt, Mycobacterium avium subsp. paratuberculosis
ccgccccgcccgg

SEQ ID NO: 984239 - RNA, 14 nt, Mycobacterium avium subsp. paratuberculosis
ccgccccgcccggc

SEQ ID NO: 984240 - RNA, 23 nt, Mycobacterium avium subsp. paratuberculosis
ccgccccgccgcgccgggcgccc

SEQ ID NO: 984241 - RNA, 23 nt, Mycobacterium avium subsp. paratuberculosis
ccgccccgcgcgaucaggccggc

SEQ ID NO: 984242 - RNA, 21 nt, Mycobacterium avium subsp. paratuberculosis
ccgccccgcugccggaccucg

SEQ ID NO: 984243 - RNA, 22 nt, Mycobacterium avium subsp. paratuberculosis
ccgccauggcggcauccccagc

SEQ ID NO: 984244 - RNA, 20 nt, Mycobacterium avium subsp. paratuberculosis
ccgccauguacagaccccac

SEQ ID NO: 984245 - RNA, 21 nt, Mycobacterium avium subsp. paratuberculosis
ccgcagugccggcgcaccgcg

SEQ ID NO: 984246 - RNA, 22 nt, Mycobacterium avium subsp. paratuberculosis
ccgcagugcgucagaaccgggg

SEQ ID NO: 984247 - RNA, 21 nt, Mycobacterium avium subsp. paratuberculosis
ccgcauacaccuugucggcga

SEQ ID NO: 984248 - RNA, 23 nt, Mycobacterium avium subsp. paratuberculosis
ccgcauagcgggagccggccagg

SEQ ID NO: 984249 - RNA, 18 nt, Mycobacterium avium subsp. paratuberculosis
ccgccaucgccucguccc

SEQ ID NO: 984250 - RNA, 19 nt, Mycobacterium avium subsp. paratuberculosis
ccgccccggucaccccggc

SEQ ID NO: 984251 - RNA, 14 nt, Mycobacterium avium subsp. paratuberculosis
ccgccccggccgcg

SEQ ID NO: 984252 - RNA, 16 nt, Mycobacterium avium subsp. paratuberculosis
ccgccccggccgcgca

SEQ ID NO: 984253 - RNA, 22 nt, Mycobacterium avium subsp. paratuberculosis
ccgccccgacgaucgcgccggc

SEQ ID NO: 984254 - RNA, 18 nt, Mycobacterium avium subsp. paratuberculosis
ccgccccgagaucccagc

SEQ ID NO: 984255 - RNA, 14 nt, Mycobacterium avium subsp. paratuberculosis
ccgcccgaucccgu

SEQ ID NO: 984256 - RNA, 19 nt, Mycobacterium avium subsp. paratuberculosis
ccgcccgagaguccgccgc

SEQ ID NO: 984257 - RNA, 13 nt, Mycobacterium avium subsp. paratuberculosis
ccgccccuccagg

SEQ ID NO: 984258 - RNA, 14 nt, Mycobacterium avium subsp. paratuberculosis
ccgccccuccaggc

SEQ ID NO: 984259 - RNA, 19 nt, Mycobacterium avium subsp. paratuberculosis
ccgcccgucggggcccggc

SEQ ID NO: 984260 - RNA, 15 nt, Mycobacterium avium subsp. paratuberculosis
ccgcccguccagcgc

SEQ ID NO: 984261 - RNA, 23 nt, Mycobacterium avium subsp. paratuberculosis
ccgcccguccagcgcaugccacu

SEQ ID NO: 984262 - RNA, 18 nt, Mycobacterium avium subsp. paratuberculosis
ccgcccgggugcaggccc

SEQ ID NO: 984263 - RNA, 20 nt, Mycobacterium avium subsp. paratuberculosis
ccgcccgggugugggcgccg

SEQ ID NO: 984264 - RNA, 23 nt, Mycobacterium avium subsp. paratuberculosis
ccgcccgggccguaucggccccg

SEQ ID NO: 984265 - RNA, 13 nt, Mycobacterium avium subsp. paratuberculosis
ccgcccgggcggc

SEQ ID NO: 984266 - RNA, 18 nt, Mycobacterium avium subsp. paratuberculosis
ccgcccgggcggcccgca

SEQ ID NO: 984267 - RNA, 20 nt, Mycobacterium avium subsp. paratuberculosis
ccgcccgggccgcgcccagu

SEQ ID NO: 984268 - RNA, 20 nt, Mycobacterium avium subsp. paratuberculosis
ccgccgaagcggcgcacgca

SEQ ID NO: 984269 - RNA, 14 nt, Mycobacterium avium subsp. paratuberculosis
ccgccgaagcccga

SEQ ID NO: 984270 - RNA, 12 nt, Mycobacterium avium subsp. paratuberculosis
ccgcccuggccc

SEQ ID NO: 984271 - RNA, 16 nt, Mycobacterium avium subsp. paratuberculosis
ccgcccugcccgucgg

SEQ ID NO: 984272 - RNA, 23 nt, Mycobacterium avium subsp. paratuberculosis
ccgcccugcccgucgggcgcggc

SEQ ID NO: 984273 - RNA, 18 nt, Mycobacterium avium subsp. paratuberculosis
ccgcccguccgggccggc

SEQ ID NO: 984274 - RNA, 12 nt, Mycobacterium avium subsp. paratuberculosis
ccgcccucaggc

SEQ ID NO: 984275 - RNA, 15 nt, Mycobacterium avium subsp. paratuberculosis
ccgcccucgcccucg

SEQ ID NO: 984276 - RNA, 15 nt, Mycobacterium avium subsp. paratuberculosis
ccgcccucgccgaac

SEQ ID NO: 984277 - RNA, 19 nt, Mycobacterium avium subsp. paratuberculosis
ccgcccucgcugccgcccc

SEQ ID NO: 984278 - RNA, 20 nt, Mycobacterium avium subsp. paratuberculosis
ccgcccucgcugccgccccc

SEQ ID NO: 984279 - RNA, 19 nt, Mycobacterium avium subsp. paratuberculosis
ccgccgagauccaccgcgc

SEQ ID NO: 984280 - RNA, 22 nt, Mycobacterium avium subsp. paratuberculosis
ccgccgagauccaccgcgcggc

SEQ ID NO: 984281 - RNA, 15 nt, Mycobacterium avium subsp. paratuberculosis
ccgccgacuccccgc

SEQ ID NO: 984282 - RNA, 16 nt, Mycobacterium avium subsp. paratuberculosis
ccgccgacgacggcga

SEQ ID NO: 984283 - RNA, 15 nt, Mycobacterium avium subsp. paratuberculosis
ccgccgacgcccagg

SEQ ID NO: 984284 - RNA, 19 nt, Mycobacterium avium subsp. paratuberculosis
ccgccgacggcugcccggc

SEQ ID NO: 984285 - RNA, 22 nt, Mycobacterium avium subsp. paratuberculosis
ccgccgacggcugcccggcccg

SEQ ID NO: 984286 - RNA, 14 nt, Mycobacterium avium subsp. paratuberculosis
ccgccgaccgccga

SEQ ID NO: 984287 - RNA, 19 nt, Mycobacterium avium subsp. paratuberculosis
ccgccgaccgguccgccgc

SEQ ID NO: 984288 - RNA, 18 nt, Mycobacterium avium subsp. paratuberculosis
ccgccgcauaccgcccgc

SEQ ID NO: 984289 - RNA, 14 nt, Mycobacterium avium subsp. paratuberculosis
ccgccgcagcagcc

SEQ ID NO: 984290 - RNA, 18 nt, Mycobacterium avium subsp. paratuberculosis
ccgccgcagcccaggccc

SEQ ID NO: 984291 - RNA, 15 nt, Mycobacterium avium subsp. paratuberculosis
ccgccgcagcggcgc

SEQ ID NO: 984292 - RNA, 19 nt, Mycobacterium avium subsp. paratuberculosis
ccgccgcagcggcgccgca

SEQ ID NO: 984293 - RNA, 20 nt, Mycobacterium avium subsp. paratuberculosis
ccgccgauucaaccccgcgc

SEQ ID NO: 984294 - RNA, 16 nt, Mycobacterium avium subsp. paratuberculosis
ccgccgcacccagcgg

SEQ ID NO: 984295 - RNA, 14 nt, Mycobacterium avium subsp. paratuberculosis
ccgccgcaccggcc

SEQ ID NO: 984296 - RNA, 18 nt, Mycobacterium avium subsp. paratuberculosis
ccgccgcaccggccggcc

SEQ ID NO: 984297 - RNA, 21 nt, Mycobacterium avium subsp. paratuberculosis
ccgccgcaccucgccggccgc

SEQ ID NO: 984298 - RNA, 18 nt, Mycobacterium avium subsp. paratuberculosis
ccgccgccaucuccuccg

SEQ ID NO: 984299 - RNA, 17 nt, Mycobacterium avium subsp. paratuberculosis
ccgccgacuccccgccc

SEQ ID NO: 984300 - RNA, 17 nt, Mycobacterium avium subsp. paratuberculosis
ccgccgcgacggccgcc

SEQ ID NO: 984301 - RNA, 18 nt, Mycobacterium avium subsp. paratuberculosis
ccgccgcgacggccgccg

SEQ ID NO: 984302 - RNA, 19 nt, Mycobacterium avium subsp. paratuberculosis
ccgccgcgagccgcccagg

SEQ ID NO: 984303 - RNA, 15 nt, Mycobacterium avium subsp. paratuberculosis
ccgccgcggcgagcc

SEQ ID NO: 984304 - RNA, 14 nt, Mycobacterium avium subsp. paratuberculosis
ccgccgcggcgccc

SEQ ID NO: 984305 - RNA, 16 nt, Mycobacterium avium subsp. paratuberculosis
ccgccgcggcggccug

SEQ ID NO: 984306 - RNA, 22 nt, Mycobacterium avium subsp. paratuberculosis
ccgccgcggcggccugcuugac

SEQ ID NO: 984307 - RNA, 23 nt, Mycobacterium avium subsp. paratuberculosis
ccgccgcggcgguggccugcccg

SEQ ID NO: 984308 - RNA, 18 nt, Mycobacterium avium subsp. paratuberculosis
ccgccgcguacaccggcu

SEQ ID NO: 984309 - RNA, 15 nt, Mycobacterium avium subsp. paratuberculosis
ccgccgcgucagcgg

SEQ ID NO: 984310 - RNA, 21 nt, Mycobacterium avium subsp. paratuberculosis
ccgccgcgucggucagcgcca

SEQ ID NO: 984311 - RNA, 19 nt, Mycobacterium avium subsp. paratuberculosis
ccgccgcuagucgcccagc

SEQ ID NO: 984312 - RNA, 13 nt, Mycobacterium avium subsp. paratuberculosis
ccgccgcggccgc

SEQ ID NO: 984313 - RNA, 14 nt, Mycobacterium avium subsp. paratuberculosis
ccgccgcggccgcc

SEQ ID NO: 984314 - RNA, 17 nt, Mycobacterium avium subsp. paratuberculosis
ccgccgcggacauucug

SEQ ID NO: 984315 - RNA, 12 nt, Mycobacterium avium subsp. paratuberculosis
ccgccgcggagc

SEQ ID NO: 984316 - RNA, 16 nt, Mycobacterium avium subsp. paratuberculosis
ccgccgcgcaccgcgc

SEQ ID NO: 984317 - RNA, 15 nt, Mycobacterium avium subsp. paratuberculosis
ccgccgcgcaggccg

SEQ ID NO: 984318 - RNA, 20 nt, Mycobacterium avium subsp. paratuberculosis
ccgccgcgaucagggcccac

SEQ ID NO: 984319 - RNA, 22 nt, Mycobacterium avium subsp. paratuberculosis
ccgccgcgaucuugccgccgcg

SEQ ID NO: 984320 - RNA, 20 nt, Mycobacterium avium subsp. paratuberculosis
ccgccggaucgugucccggc

SEQ ID NO: 984321 - RNA, 21 nt, Mycobacterium avium subsp. paratuberculosis
ccgccggagccgaucgccucc

SEQ ID NO: 984322 - RNA, 22 nt, Mycobacterium avium subsp. paratuberculosis
ccgccggagccgaucgccuccg

SEQ ID NO: 984323 - RNA, 13 nt, Mycobacterium avium subsp. paratuberculosis
ccgccggcccagg

SEQ ID NO: 984324 - RNA, 13 nt, Mycobacterium avium subsp. paratuberculosis
ccgccggccagcu

SEQ ID NO: 984325 - RNA, 15 nt, Mycobacterium avium subsp. paratuberculosis
ccgccggccagcucc

SEQ ID NO: 984326 - RNA, 19 nt, Mycobacterium avium subsp. paratuberculosis
ccgccgggcauccgggccg

SEQ ID NO: 984327 - RNA, 15 nt, Mycobacterium avium subsp. paratuberculosis
ccgccgggccacgcc

SEQ ID NO: 984328 - RNA, 12 nt, Mycobacterium avium subsp. paratuberculosis
ccgccgggccag

SEQ ID NO: 984329 - RNA, 21 nt, Mycobacterium avium subsp. paratuberculosis
ccgccggcggccaaucccacc

SEQ ID NO: 984330 - RNA, 15 nt, Mycobacterium avium subsp. paratuberculosis
ccgccggcggccacg

SEQ ID NO: 984331 - RNA, 18 nt, Mycobacterium avium subsp. paratuberculosis
ccgccggcgcuggcgcgc

SEQ ID NO: 984332 - RNA, 19 nt, Mycobacterium avium subsp. paratuberculosis
ccgccggcgcuggcgcgcc

SEQ ID NO: 984333 - RNA, 12 nt, Mycobacterium avium subsp. paratuberculosis
ccgccggccucg

SEQ ID NO: 984334 - RNA, 16 nt, Mycobacterium avium subsp. paratuberculosis
ccgccggcccagcucc

SEQ ID NO: 984335 - RNA, 13 nt, Mycobacterium avium subsp. paratuberculosis
ccgccggcccggc

SEQ ID NO: 984336 - RNA, 19 nt, Mycobacterium avium subsp. paratuberculosis
ccgaccuugacccaggccc

SEQ ID NO: 984337 - RNA, 18 nt, Mycobacterium avium subsp. paratuberculosis
ccgacgaagccgccgccc

SEQ ID NO: 984338 - RNA, 18 nt, Mycobacterium avium subsp. paratuberculosis
ccgacgaaaucgucgggc

SEQ ID NO: 984339 - RNA, 17 nt, Mycobacterium avium subsp. paratuberculosis
ccgacgaucgcgccggc

SEQ ID NO: 984340 - RNA, 20 nt, Mycobacterium avium subsp. paratuberculosis
ccgacgaugaacagucggcc

SEQ ID NO: 984341 - RNA, 21 nt, Mycobacterium avium subsp. paratuberculosis
ccgacgauccgggccggucgg

SEQ ID NO: 984342 - RNA, 19 nt, Mycobacterium avium subsp. paratuberculosis
ccgacgagaucagcaccag

SEQ ID NO: 984343 - RNA, 20 nt, Mycobacterium avium subsp. paratuberculosis
ccgacgagaucagcaccagg

SEQ ID NO: 984344 - RNA, 22 nt, Mycobacterium avium subsp. paratuberculosis
ccgacgacgacgucgacgaccc

SEQ ID NO: 984345 - RNA, 15 nt, Mycobacterium avium subsp. paratuberculosis
ccgacgucugguugg

SEQ ID NO: 984346 - RNA, 22 nt, Mycobacterium avium subsp. paratuberculosis
ccgacgucugguuggccggcgg

SEQ ID NO: 984347 - RNA, 23 nt, Mycobacterium avium subsp. paratuberculosis
ccgacgcgcugcgcgccgcccuc

SEQ ID NO: 984348 - RNA, 14 nt, Mycobacterium avium subsp. paratuberculosis
ccgacgucgaccag

SEQ ID NO: 984349 - RNA, 16 nt, Mycobacterium avium subsp. paratuberculosis
ccgacgucgaccaggu

SEQ ID NO: 984350 - RNA, 22 nt, Mycobacterium avium subsp. paratuberculosis
ccgacgcggcgaccaccaccgc

SEQ ID NO: 984351 - RNA, 23 nt, Mycobacterium avium subsp. paratuberculosis
ccgacgcggcgcgacaccgcggc

SEQ ID NO: 984352 - RNA, 15 nt, Mycobacterium avium subsp. paratuberculosis
ccgacgcgccgucgg

SEQ ID NO: 984353 - RNA, 17 nt, Mycobacterium avium subsp. paratuberculosis
ccgacgcgccgucggcc

SEQ ID NO: 984354 - RNA, 19 nt, Mycobacterium avium subsp. paratuberculosis
ccgacgcgccgucggccca

SEQ ID NO: 984355 - RNA, 21 nt, Mycobacterium avium subsp. paratuberculosis
ccgacgcgacggucgugcugg

SEQ ID NO: 984356 - RNA, 22 nt, Mycobacterium avium subsp. paratuberculosis
ccgacgccggccaccaacaggu

SEQ ID NO: 984357 - RNA, 13 nt, Mycobacterium avium subsp. paratuberculosis
ccgacgccgucga

SEQ ID NO: 984358 - RNA, 21 nt, Mycobacterium avium subsp. paratuberculosis
ccgacgaugcggggcggcggg

SEQ ID NO: 984359 - RNA, 13 nt, Mycobacterium avium subsp. paratuberculosis
ccgacgccacguc

SEQ ID NO: 984360 - RNA, 14 nt, Mycobacterium avium subsp. paratuberculosis
ccgacgcccaggcu

SEQ ID NO: 984361 - RNA, 19 nt, Mycobacterium avium subsp. paratuberculosis
ccgacgcccaggcucagga

SEQ ID NO: 984362 - RNA, 14 nt, Mycobacterium avium subsp. paratuberculosis
ccgacgccgacacc

SEQ ID NO: 984363 - RNA, 14 nt, Mycobacterium avium subsp. paratuberculosis
ccgacuccccgccc

SEQ ID NO: 984364 - RNA, 16 nt, Mycobacterium avium subsp. paratuberculosis
ccgacuccccgcccgg

SEQ ID NO: 984365 - RNA, 21 nt, Mycobacterium avium subsp. paratuberculosis
ccgacgugucgucgucgccgc

SEQ ID NO: 984366 - RNA, 22 nt, Mycobacterium avium subsp. paratuberculosis
ccgacgugucgucgucgccgcc

SEQ ID NO: 984367 - RNA, 14 nt, Mycobacterium avium subsp. paratuberculosis
ccgagaagggccgc

SEQ ID NO: 984368 - RNA, 16 nt, Mycobacterium avium subsp. paratuberculosis
ccgagaagggccgccg

SEQ ID NO: 984369 - RNA, 21 nt, Mycobacterium avium subsp. paratuberculosis
ccgagcacaccgucgcccgcc

SEQ ID NO: 984370 - RNA, 22 nt, Mycobacterium avium subsp. paratuberculosis
ccgagcacaccgucgcccgccc

SEQ ID NO: 984371 - RNA, 13 nt, Mycobacterium avium subsp. paratuberculosis
ccgagcaccaggc

SEQ ID NO: 984372 - RNA, 16 nt, Mycobacterium avium subsp. paratuberculosis
ccgagcaccccggcgg

SEQ ID NO: 984373 - RNA, 18 nt, Mycobacterium avium subsp. paratuberculosis
ccgagcaccccggcggcc

SEQ ID NO: 984374 - RNA, 20 nt, Mycobacterium avium subsp. paratuberculosis
ccgagcaccccggcggccgc

SEQ ID NO: 984375 - RNA, 22 nt, Mycobacterium avium subsp. paratuberculosis
ccgagcaccugaacggccgcgc

SEQ ID NO: 984376 - RNA, 14 nt, Mycobacterium avium subsp. paratuberculosis
ccgagcaccuggcc

SEQ ID NO: 984377 - RNA, 20 nt, Mycobacterium avium subsp. paratuberculosis
ccgagcacgaacgcggccgc

SEQ ID NO: 984378 - RNA, 10 nt, Mycobacterium avium subsp. paratuberculosis
ccgagcaccu

SEQ ID NO: 984379 - RNA, 12 nt, Mycobacterium avium subsp. paratuberculosis
ccgagcaccucc

SEQ ID NO: 984380 - RNA, 20 nt, Mycobacterium avium subsp. paratuberculosis
ccgagcccguucagugacca

SEQ ID NO: 984381 - RNA, 17 nt, Mycobacterium avium subsp. paratuberculosis
ccgagcccugcgccagc

SEQ ID NO: 984382 - RNA, 20 nt, Mycobacterium avium subsp. paratuberculosis
ccgagcccugcgccagcagc

SEQ ID NO: 984383 - RNA, 21 nt, Mycobacterium avium subsp. paratuberculosis
ccgagcccugcgccagcagca

SEQ ID NO: 984384 - RNA, 20 nt, Mycobacterium avium subsp. paratuberculosis
ccgagcccuuugcgcugccc

SEQ ID NO: 984385 - RNA, 20 nt, Mycobacterium avium subsp. paratuberculosis
ccgagccgaugcccagcagc

SEQ ID NO: 984386 - RNA, 21 nt, Mycobacterium avium subsp. paratuberculosis
ccgagccgaugcccagcagcg

SEQ ID NO: 984387 - RNA, 16 nt, Mycobacterium avium subsp. paratuberculosis
ccgagccgcacaacau

SEQ ID NO: 984388 - RNA, 18 nt, Mycobacterium avium subsp. paratuberculosis
ccgagauggccaccauca

SEQ ID NO: 984389 - RNA, 20 nt, Mycobacterium avium subsp. paratuberculosis
ccgagauuggacgacaccac

SEQ ID NO: 984390 - RNA, 19 nt, Mycobacterium avium subsp. paratuberculosis
ccgagacugaugguggcgc

SEQ ID NO: 984391 - RNA, 23 nt, Mycobacterium avium subsp. paratuberculosis
ccgagacgugguggugcggacgg

SEQ ID NO: 984392 - RNA, 16 nt, Mycobacterium avium subsp. paratuberculosis
ccgaucaacggcagcg

SEQ ID NO: 984393 - RNA, 20 nt, Mycobacterium avium subsp. paratuberculosis
ccgaguuccugcgaccgccg

SEQ ID NO: 984394 - RNA, 22 nt, Mycobacterium avium subsp. paratuberculosis
ccgaguuccugcgaccgccgcc

SEQ ID NO: 984395 - RNA, 19 nt, Mycobacterium avium subsp. paratuberculosis
ccgaguuugcggugauccc

SEQ ID NO: 984396 - RNA, 17 nt, Mycobacterium avium subsp. paratuberculosis
ccgaucagugccgcgcc

SEQ ID NO: 984397 - RNA, 22 nt, Mycobacterium avium subsp. paratuberculosis
ccgaucagcggcgggcccagca

SEQ ID NO: 984398 - RNA, 14 nt, Mycobacterium avium subsp. paratuberculosis
ccgaucaggcugga

SEQ ID NO: 984399 - RNA, 17 nt, Mycobacterium avium subsp. paratuberculosis
ccgaucaccugacagac

SEQ ID NO: 984400 - RNA, 13 nt, Mycobacterium avium subsp. paratuberculosis
ccgaucacgcgga

SEQ ID NO: 984401 - RNA, 23 nt, Mycobacterium avium subsp. paratuberculosis
ccgaucgcgucgacgauggcguc

SEQ ID NO: 984402 - RNA, 15 nt, Mycobacterium avium subsp. paratuberculosis
ccgaucggcccggcc

SEQ ID NO: 984403 - RNA, 19 nt, Mycobacterium avium subsp. paratuberculosis
ccgaucggcacccgcaaca

SEQ ID NO: 984404 - RNA, 23 nt, Mycobacterium avium subsp. paratuberculosis
ccgaucggcacgucgagcaguug

SEQ ID NO: 984405 - RNA, 18 nt, Mycobacterium avium subsp. paratuberculosis
ccgaucggggcgcagccc

SEQ ID NO: 984406 - RNA, 22 nt, Mycobacterium avium subsp. paratuberculosis
ccgaucggggcgcagcccggcg

SEQ ID NO: 984407 - RNA, 19 nt, Mycobacterium avium subsp. paratuberculosis
ccgaucgugacgccguccg

SEQ ID NO: 984408 - RNA, 19 nt, Mycobacterium avium subsp. paratuberculosis
ccgaucuccaccgagugcg

SEQ ID NO: 984409 - RNA, 16 nt, Mycobacterium avium subsp. paratuberculosis
ccgagcucgggcgcga

SEQ ID NO: 984410 - RNA, 16 nt, Mycobacterium avium subsp. paratuberculosis
ccgagcgagcgcacca

SEQ ID NO: 984411 - RNA, 18 nt, Mycobacterium avium subsp. paratuberculosis
ccgagcucggccaccagc

SEQ ID NO: 984412 - RNA, 19 nt, Mycobacterium avium subsp. paratuberculosis
ccgagcucggccaccagcg

SEQ ID NO: 984413 - RNA, 15 nt, Mycobacterium avium subsp. paratuberculosis
ccgagcugggccggc

SEQ ID NO: 984414 - RNA, 19 nt, Mycobacterium avium subsp. paratuberculosis
ccgagcugggccggcgccg

SEQ ID NO: 984415 - RNA, 19 nt, Mycobacterium avium subsp. paratuberculosis
ccgagccgcuugguggcgc

SEQ ID NO: 984416 - RNA, 14 nt, Mycobacterium avium subsp. paratuberculosis
ccgagccggcggcg

SEQ ID NO: 984417 - RNA, 15 nt, Mycobacterium avium subsp. paratuberculosis
ccgagccgggcagcg

SEQ ID NO: 984418 - RNA, 14 nt, Mycobacterium avium subsp. paratuberculosis
ccgagccgggcggc

SEQ ID NO: 984419 - RNA, 16 nt, Mycobacterium avium subsp. paratuberculosis
ccgagccgacccgggc

SEQ ID NO: 984420 - RNA, 15 nt, Mycobacterium avium subsp. paratuberculosis
ccgagccgcgcgccg

SEQ ID NO: 984421 - RNA, 20 nt, Mycobacterium avium subsp. paratuberculosis
ccgagccgguccgaccagcg

SEQ ID NO: 984422 - RNA, 21 nt, Mycobacterium avium subsp. paratuberculosis
ccgagccgguccgaccagcgg

SEQ ID NO: 984423 - RNA, 18 nt, Mycobacterium avium subsp. paratuberculosis
ccgagccguaggccaggu

SEQ ID NO: 984424 - RNA, 15 nt, Mycobacterium avium subsp. paratuberculosis
ccgagccgucgucgc

SEQ ID NO: 984425 - RNA, 20 nt, Mycobacterium avium subsp. paratuberculosis
ccgaggaagacgucgaaccc

SEQ ID NO: 984426 - RNA, 21 nt, Mycobacterium avium subsp. paratuberculosis
ccgagcuugggccggugcagc

SEQ ID NO: 984427 - RNA, 22 nt, Mycobacterium avium subsp. paratuberculosis
ccgagcuugggccggugcagca

SEQ ID NO: 984428 - RNA, 18 nt, Mycobacterium avium subsp. paratuberculosis
ccgagcugaucgcggccg

SEQ ID NO: 984429 - RNA, 21 nt, Mycobacterium avium subsp. paratuberculosis
ccgaggcgguuccgguggcgc

SEQ ID NO: 984430 - RNA, 12 nt, Mycobacterium avium subsp. paratuberculosis
ccgaggcgugcc

SEQ ID NO: 984431 - RNA, 19 nt, Mycobacterium avium subsp. paratuberculosis
ccgagggugccggccaccg

SEQ ID NO: 984432 - RNA, 22 nt, Mycobacterium avium subsp. paratuberculosis
ccgaggguuggcgugucgguga

SEQ ID NO: 984433 - RNA, 15 nt, Mycobacterium avium subsp. paratuberculosis
ccgagguagccgcgc

SEQ ID NO: 984434 - RNA, 16 nt, Mycobacterium avium subsp. paratuberculosis
ccgagguagggccggg

SEQ ID NO: 984435 - RNA, 16 nt, Mycobacterium avium subsp. paratuberculosis
ccgaggcugucggagg

SEQ ID NO: 984436 - RNA, 15 nt, Mycobacterium avium subsp. paratuberculosis
ccgagggccagcagc

SEQ ID NO: 984437 - RNA, 16 nt, Mycobacterium avium subsp. paratuberculosis
ccgagggcccgggcag

SEQ ID NO: 984438 - RNA, 17 nt, Mycobacterium avium subsp. paratuberculosis
ccgcaacagccggcccg

SEQ ID NO: 984439 - RNA, 20 nt, Mycobacterium avium subsp. paratuberculosis
ccgcaacaccacgucggugc

SEQ ID NO: 984440 - RNA, 15 nt, Mycobacterium avium subsp. paratuberculosis
ccgcaacuccacaac

SEQ ID NO: 984441 - RNA, 17 nt, Mycobacterium avium subsp. paratuberculosis
ccgcaacuccacaacca

SEQ ID NO: 984442 - RNA, 22 nt, Mycobacterium avium subsp. paratuberculosis
ccgcaacuguucgcggcuggcc

SEQ ID NO: 984443 - RNA, 17 nt, Mycobacterium avium subsp. paratuberculosis
ccgcaaccuucuuggcc

SEQ ID NO: 984444 - RNA, 21 nt, Mycobacterium avium subsp. paratuberculosis
ccgcaacgcgcgcgacggcgc

SEQ ID NO: 984445 - RNA, 17 nt, Mycobacterium avium subsp. paratuberculosis
ccgcaacgggccgcagc

SEQ ID NO: 984446 - RNA, 21 nt, Mycobacterium avium subsp. paratuberculosis
ccgauuucauauugguucgcu

SEQ ID NO: 984447 - RNA, 16 nt, Mycobacterium avium subsp. paratuberculosis
ccgauuucggccagcc

SEQ ID NO: 984448 - RNA, 16 nt, Mycobacterium avium subsp. paratuberculosis
ccgauuucccgacucc

SEQ ID NO: 984449 - RNA, 20 nt, Mycobacterium avium subsp. paratuberculosis
ccgauuucccgacuccucac

SEQ ID NO: 984450 - RNA, 13 nt, Mycobacterium avium subsp. paratuberculosis
ccgauuccgucgg

SEQ ID NO: 984451 - RNA, 16 nt, Mycobacterium avium subsp. paratuberculosis
ccgauugcggcgcagg

SEQ ID NO: 984452 - RNA, 20 nt, Mycobacterium avium subsp. paratuberculosis
ccgauugcccgacuccucac

SEQ ID NO: 984453 - RNA, 15 nt, Mycobacterium avium subsp. paratuberculosis
ccgaugccggccugg

SEQ ID NO: 984454 - RNA, 19 nt, Mycobacterium avium subsp. paratuberculosis
ccgauggugaagccgugca

SEQ ID NO: 984455 - RNA, 21 nt, Mycobacterium avium subsp. paratuberculosis
ccgauggugacggugccgccg

SEQ ID NO: 984456 - RNA, 14 nt, Mycobacterium avium subsp. paratuberculosis
ccgauguggcgggc

SEQ ID NO: 984457 - RNA, 19 nt, Mycobacterium avium subsp. paratuberculosis
ccgauguggcgggcguccu

SEQ ID NO: 984458 - RNA, 19 nt, Mycobacterium avium subsp. paratuberculosis
ccgauguacugggccgucg

SEQ ID NO: 984459 - RNA, 22 nt, Mycobacterium avium subsp. paratuberculosis
ccgauguacugggccgucgccc

SEQ ID NO: 984460 - RNA, 22 nt, Mycobacterium avium subsp. paratuberculosis
ccgaugaugaaaccggccagca

SEQ ID NO: 984461 - RNA, 14 nt, Mycobacterium avium subsp. paratuberculosis
ccgaugcccagcag

SEQ ID NO: 984462 - RNA, 20 nt, Mycobacterium avium subsp. paratuberculosis
ccgaugcaguuauccacaau

SEQ ID NO: 984463 - RNA, 19 nt, Mycobacterium avium subsp. paratuberculosis
ccgaugccgaacgucacca

SEQ ID NO: 984464 - RNA, 11 nt, Mycobacterium avium subsp. paratuberculosis
ccgaugacgag

SEQ ID NO: 984465 - RNA, 19 nt, Mycobacterium avium subsp. paratuberculosis
ccgaucuuggcgagcugac

SEQ ID NO: 984466 - RNA, 21 nt, Mycobacterium avium subsp. paratuberculosis
ccgaucucgcggucgaagggu

SEQ ID NO: 984467 - RNA, 19 nt, Mycobacterium avium subsp. paratuberculosis
ccgaucucguagcccaccu

SEQ ID NO: 984468 - RNA, 13 nt, Mycobacterium avium subsp. paratuberculosis
ccgcagcaccacc

SEQ ID NO: 984469 - RNA, 16 nt, Mycobacterium avium subsp. paratuberculosis
ccgcagcaccaccucg

SEQ ID NO: 984470 - RNA, 15 nt, Mycobacterium avium subsp. paratuberculosis
ccgcagcagccgcgc

SEQ ID NO: 984471 - RNA, 23 nt, Mycobacterium avium subsp. paratuberculosis
ccgcacggucgcggugucggcgu

SEQ ID NO: 984472 - RNA, 16 nt, Mycobacterium avium subsp. paratuberculosis
ccgcacgucccgcccg

SEQ ID NO: 984473 - RNA, 16 nt, Mycobacterium avium subsp. paratuberculosis
ccgcacgugcgcgccg

SEQ ID NO: 984474 - RNA, 21 nt, Mycobacterium avium subsp. paratuberculosis
ccgcacgugcgcgccgaccgc

SEQ ID NO: 984475 - RNA, 13 nt, Mycobacterium avium subsp. paratuberculosis
ccgcacccgccgc

SEQ ID NO: 984476 - RNA, 16 nt, Mycobacterium avium subsp. paratuberculosis
ccgcacugcacggccu

SEQ ID NO: 984477 - RNA, 18 nt, Mycobacterium avium subsp. paratuberculosis
ccgcacugcacggccucg

SEQ ID NO: 984478 - RNA, 19 nt, Mycobacterium avium subsp. paratuberculosis
ccgcacugcacggccucgg

SEQ ID NO: 984479 - RNA, 16 nt, Mycobacterium avium subsp. paratuberculosis
ccgcaccacccagccc

SEQ ID NO: 984480 - RNA, 17 nt, Mycobacterium avium subsp. paratuberculosis
ccgcaccacccagcccu

SEQ ID NO: 984481 - RNA, 15 nt, Mycobacterium avium subsp. paratuberculosis
ccgcaccagcacccc

SEQ ID NO: 984482 - RNA, 18 nt, Mycobacterium avium subsp. paratuberculosis
ccgcaccagcaccccgcc

SEQ ID NO: 984483 - RNA, 20 nt, Mycobacterium avium subsp. paratuberculosis
ccgcaccagcaccccgccgc

SEQ ID NO: 984484 - RNA, 22 nt, Mycobacterium avium subsp. paratuberculosis
ccgcaccagcaccccgccgcag

SEQ ID NO: 984485 - RNA, 13 nt, Mycobacterium avium subsp. paratuberculosis
ccgcaccagcagg

SEQ ID NO: 984486 - RNA, 23 nt, Mycobacterium avium subsp. paratuberculosis
ccgcaccagcagguccauggccu

SEQ ID NO: 984487 - RNA, 12 nt, Mycobacterium avium subsp. paratuberculosis
ccgcacccagcg

SEQ ID NO: 984488 - RNA, 13 nt, Mycobacterium avium subsp. paratuberculosis
ccgcacccagcgg

SEQ ID NO: 984489 - RNA, 12 nt, Mycobacterium avium subsp. paratuberculosis
ccgcaccccacc

SEQ ID NO: 984490 - RNA, 17 nt, Mycobacterium avium subsp. paratuberculosis
ccgcaagugcggucagc

SEQ ID NO: 984491 - RNA, 21 nt, Mycobacterium avium subsp. paratuberculosis
ccgcaagugcggucagcuccc

SEQ ID NO: 984492 - RNA, 15 nt, Mycobacterium avium subsp. paratuberculosis
ccgcagccgcuggcc

SEQ ID NO: 984493 - RNA, 22 nt, Mycobacterium avium subsp. paratuberculosis
ccgcagcucgcccagcaccguc

SEQ ID NO: 984494 - RNA, 23 nt, Mycobacterium avium subsp. paratuberculosis
ccgcagcucgcccagcaccgucu

SEQ ID NO: 984495 - RNA, 21 nt, Mycobacterium avium subsp. paratuberculosis
ccgcagcugaucggggcccac

SEQ ID NO: 984496 - RNA, 16 nt, Mycobacterium avium subsp. paratuberculosis
ccgcagccagcgcagc

SEQ ID NO: 984497 - RNA, 14 nt, Mycobacterium avium subsp. paratuberculosis
ccgcagcccaggcc

SEQ ID NO: 984498 - RNA, 23 nt, Mycobacterium avium subsp. paratuberculosis
ccgcagcccaggcccagcagcac

SEQ ID NO: 984499 - RNA, 23 nt, Mycobacterium avium subsp. paratuberculosis
ccgcagucguucggccagcacca

SEQ ID NO: 984500 - RNA, 15 nt, Mycobacterium avium subsp. paratuberculosis
ccgcagucuuguuga

SEQ ID NO: 984501 - RNA, 20 nt, Mycobacterium avium subsp. paratuberculosis
ccgcagucuuguugaccuuc

SEQ ID NO: 984502 - RNA, 17 nt, Mycobacterium avium subsp. paratuberculosis
ccgcaggugcagcuccu

SEQ ID NO: 984503 - RNA, 18 nt, Mycobacterium avium subsp. paratuberculosis
ccgcaggugcagcuccuu

SEQ ID NO: 984504 - RNA, 20 nt, Mycobacterium avium subsp. paratuberculosis
ccgcaggugcucgccggcgc

SEQ ID NO: 984505 - RNA, 11 nt, Mycobacterium avium subsp. paratuberculosis
ccgcagguggu

SEQ ID NO: 984506 - RNA, 20 nt, Mycobacterium avium subsp. paratuberculosis
ccgcagguggugggcgugca

SEQ ID NO: 984507 - RNA, 13 nt, Mycobacterium avium subsp. paratuberculosis
ccgcaggccgucg

SEQ ID NO: 984508 - RNA, 10 nt, Mycobacterium avium subsp. paratuberculosis
ccgcaggcga

SEQ ID NO: 984509 - RNA, 17 nt, Mycobacterium avium subsp. paratuberculosis
ccgcaggcggccagcac

SEQ ID NO: 984510 - RNA, 20 nt, Mycobacterium avium subsp. paratuberculosis
ccgcaggaaagcgucacagu

SEQ ID NO: 984511 - RNA, 17 nt, Mycobacterium avium subsp. paratuberculosis
ccgcaggagaucggcgc

SEQ ID NO: 984512 - RNA, 13 nt, Mycobacterium avium subsp. paratuberculosis
ccgaaacccgcug

SEQ ID NO: 984513 - RNA, 18 nt, Mycobacterium avium subsp. paratuberculosis
ccgaacagccgggcggcc

SEQ ID NO: 984514 - RNA, 20 nt, Mycobacterium avium subsp. paratuberculosis
ccgaaguugucggguucucg

SEQ ID NO: 984515 - RNA, 18 nt, Mycobacterium avium subsp. paratuberculosis
ccgaaguuggcgucgggc

SEQ ID NO: 984516 - RNA, 21 nt, Mycobacterium avium subsp. paratuberculosis
ccgaagaucaccgcgucggcc

SEQ ID NO: 984517 - RNA, 20 nt, Mycobacterium avium subsp. paratuberculosis
ccgaagauggccagcgcggc

SEQ ID NO: 984518 - RNA, 16 nt, Mycobacterium avium subsp. paratuberculosis
ccgaagauggccagga

SEQ ID NO: 984519 - RNA, 16 nt, Mycobacterium avium subsp. paratuberculosis
ccgaacaucgccucgg

SEQ ID NO: 984520 - RNA, 15 nt, Mycobacterium avium subsp. paratuberculosis
ccgaacagcgccagg

SEQ ID NO: 984521 - RNA, 18 nt, Mycobacterium avium subsp. paratuberculosis
ccgaacagcgccagggug

SEQ ID NO: 984522 - RNA, 17 nt, Mycobacterium avium subsp. paratuberculosis
ccgaagaccgggccgau

SEQ ID NO: 984523 - RNA, 22 nt, Mycobacterium avium subsp. paratuberculosis
ccgaagacgaugaaaccccagc

SEQ ID NO: 984524 - RNA, 17 nt, Mycobacterium avium subsp. paratuberculosis
ccgaagaacucagccga

SEQ ID NO: 984525 - RNA, 20 nt, Mycobacterium avium subsp. paratuberculosis
ccgaaccgaucaccggcagc

SEQ ID NO: 984526 - RNA, 19 nt, Mycobacterium avium subsp. paratuberculosis
ccgaaccgccccgcgcgau

SEQ ID NO: 984527 - RNA, 14 nt, Mycobacterium avium subsp. paratuberculosis
cccuuccccggcgg

SEQ ID NO: 984528 - RNA, 17 nt, Mycobacterium avium subsp. paratuberculosis
cccuucaucagcaccgc

SEQ ID NO: 984529 - RNA, 18 nt, Mycobacterium avium subsp. paratuberculosis
cccuucgaugucgccggc

SEQ ID NO: 984530 - RNA, 14 nt, Mycobacterium avium subsp. paratuberculosis
cccuucggccggca

SEQ ID NO: 984531 - RNA, 13 nt, Mycobacterium avium subsp. paratuberculosis
cccuucaccucgg

SEQ ID NO: 984532 - RNA, 22 nt, Mycobacterium avium subsp. paratuberculosis
cccuggucgaagauggccaggu

SEQ ID NO: 984533 - RNA, 17 nt, Mycobacterium avium subsp. paratuberculosis
cccuggugcaacaccga

SEQ ID NO: 984534 - RNA, 15 nt, Mycobacterium avium subsp. paratuberculosis
cccugguaggccugg

SEQ ID NO: 984535 - RNA, 16 nt, Mycobacterium avium subsp. paratuberculosis
cccugguaggccugga

SEQ ID NO: 984536 - RNA, 19 nt, Mycobacterium avium subsp. paratuberculosis
cccugggggucggugacca

SEQ ID NO: 984537 - RNA, 19 nt, Mycobacterium avium subsp. paratuberculosis
cccugggacagcgagaagu

SEQ ID NO: 984538 - RNA, 21 nt, Mycobacterium avium subsp. paratuberculosis
cccugggaggaagugcacgcc

SEQ ID NO: 984539 - RNA, 15 nt, Mycobacterium avium subsp. paratuberculosis
cccuguucgccgucg

SEQ ID NO: 984540 - RNA, 14 nt, Mycobacterium avium subsp. paratuberculosis
cccuguucgcgccg

SEQ ID NO: 984541 - RNA, 18 nt, Mycobacterium avium subsp. paratuberculosis
cccugguugauccagcgg

SEQ ID NO: 984542 - RNA, 12 nt, Mycobacterium avium subsp. paratuberculosis
cccugccagggg

SEQ ID NO: 984543 - RNA, 12 nt, Mycobacterium avium subsp. paratuberculosis
cccugcgcaccg

SEQ ID NO: 984544 - RNA, 13 nt, Mycobacterium avium subsp. paratuberculosis
cccugcgcaccgc

SEQ ID NO: 984545 - RNA, 19 nt, Mycobacterium avium subsp. paratuberculosis
cccugcgccagcagcagcg

SEQ ID NO: 984546 - RNA, 22 nt, Mycobacterium avium subsp. paratuberculosis
cccugcgccagcagcagcgcgg

SEQ ID NO: 984547 - RNA, 21 nt, Mycobacterium avium subsp. paratuberculosis
cccugcgaauacccgcccagc

SEQ ID NO: 984548 - RNA, 14 nt, Mycobacterium avium subsp. paratuberculosis
cccugcgagcccgg

SEQ ID NO: 984549 - RNA, 15 nt, Mycobacterium avium subsp. paratuberculosis
cccugccgucaccgg

SEQ ID NO: 984550 - RNA, 18 nt, Mycobacterium avium subsp. paratuberculosis
cccugcgcgcccugcugg

SEQ ID NO: 984551 - RNA, 20 nt, Mycobacterium avium subsp. paratuberculosis
cccugcgcggcgaugcgcuc

SEQ ID NO: 984552 - RNA, 22 nt, Mycobacterium avium subsp. paratuberculosis
cccugcgcggcgaugcgcucca

SEQ ID NO: 984553 - RNA, 15 nt, Mycobacterium avium subsp. paratuberculosis
cccugcuugaacagc

SEQ ID NO: 984554 - RNA, 17 nt, Mycobacterium avium subsp. paratuberculosis
cccugcucgcuguggcg

SEQ ID NO: 984555 - RNA, 15 nt, Mycobacterium avium subsp. paratuberculosis
cccugcucggccagc

SEQ ID NO: 984556 - RNA, 16 nt, Mycobacterium avium subsp. paratuberculosis
cccugcucagcggcca

SEQ ID NO: 984557 - RNA, 18 nt, Mycobacterium avium subsp. paratuberculosis
cccuggaugaucucgaug

SEQ ID NO: 984558 - RNA, 12 nt, Mycobacterium avium subsp. paratuberculosis
cccuggcauccg

SEQ ID NO: 984559 - RNA, 13 nt, Mycobacterium avium subsp. paratuberculosis
cccuggccgcguu

SEQ ID NO: 984560 - RNA, 19 nt, Mycobacterium avium subsp. paratuberculosis
cccuggccccagaaccgcu

SEQ ID NO: 984561 - RNA, 12 nt, Mycobacterium avium subsp. paratuberculosis
cccuggccagca

SEQ ID NO: 984562 - RNA, 17 nt, Mycobacterium avium subsp. paratuberculosis
cccuggccagcaccgcg

SEQ ID NO: 984563 - RNA, 23 nt, Mycobacterium avium subsp. paratuberculosis
cccucuucgaucaggcgcagccc

SEQ ID NO: 984564 - RNA, 22 nt, Mycobacterium avium subsp. paratuberculosis
cccugcacccagccgugcccca

SEQ ID NO: 984565 - RNA, 23 nt, Mycobacterium avium subsp. paratuberculosis
cccugcacgaucucggcggucuu

SEQ ID NO: 984566 - RNA, 17 nt, Mycobacterium avium subsp. paratuberculosis
cccugcacuaccccguc

SEQ ID NO: 984567 - RNA, 19 nt, Mycobacterium avium subsp. paratuberculosis
cccucggggcugcgcggcu

SEQ ID NO: 984568 - RNA, 18 nt, Mycobacterium avium subsp. paratuberculosis
cccucgggguagccggcc

SEQ ID NO: 984569 - RNA, 19 nt, Mycobacterium avium subsp. paratuberculosis
cccucgggguagccggccc

SEQ ID NO: 984570 - RNA, 22 nt, Mycobacterium avium subsp. paratuberculosis
cccucgucgaugacguccacca

SEQ ID NO: 984571 - RNA, 19 nt, Mycobacterium avium subsp. paratuberculosis
cccucgugcguagcggccc

SEQ ID NO: 984572 - RNA, 21 nt, Mycobacterium avium subsp. paratuberculosis
cccucgucgcuaccucaccac

SEQ ID NO: 984573 - RNA, 16 nt, Mycobacterium avium subsp. paratuberculosis
cccucgucggcgagca

SEQ ID NO: 984574 - RNA, 17 nt, Mycobacterium avium subsp. paratuberculosis
cccucggugcucuugac

SEQ ID NO: 984575 - RNA, 16 nt, Mycobacterium avium subsp. paratuberculosis
cccucguagcggccgc

SEQ ID NO: 984576 - RNA, 20 nt, Mycobacterium avium subsp. paratuberculosis
cccucguagcggccgcacgc

SEQ ID NO: 984577 - RNA, 19 nt, Mycobacterium avium subsp. paratuberculosis
cccucguccaggugcaccc

SEQ ID NO: 984578 - RNA, 16 nt, Mycobacterium avium subsp. paratuberculosis
cguacaggucgcacag

SEQ ID NO: 984579 - RNA, 23 nt, Mycobacterium avium subsp. paratuberculosis
cguaccgaggaugaccgcggcga

SEQ ID NO: 984580 - RNA, 13 nt, Mycobacterium avium subsp. paratuberculosis
cguaccagcgcca

SEQ ID NO: 984581 - RNA, 17 nt, Mycobacterium avium subsp. paratuberculosis
cguaccagcgcucgacg

SEQ ID NO: 984582 - RNA, 22 nt, Mycobacterium avium subsp. paratuberculosis
cguaccagcugcccaccagcag

SEQ ID NO: 984583 - RNA, 20 nt, Mycobacterium avium subsp. paratuberculosis
cguacgggaugaucagcagg

SEQ ID NO: 984584 - RNA, 18 nt, Mycobacterium avium subsp. paratuberculosis
cguacgggcgcagcgccg

SEQ ID NO: 984585 - RNA, 13 nt, Mycobacterium avium subsp. paratuberculosis
cguacucgcacag

SEQ ID NO: 984586 - RNA, 15 nt, Mycobacterium avium subsp. paratuberculosis
cguaccgcuuggccc

SEQ ID NO: 984587 - RNA, 13 nt, Mycobacterium avium subsp. paratuberculosis
cguaccugcccca

SEQ ID NO: 984588 - RNA, 16 nt, Mycobacterium avium subsp. paratuberculosis
cguaauugaucguguu

SEQ ID NO: 984589 - RNA, 12 nt, Mycobacterium avium subsp. paratuberculosis
cguacagcagcc

SEQ ID NO: 984590 - RNA, 20 nt, Mycobacterium avium subsp. paratuberculosis
cguacagcgagccgucgacc

SEQ ID NO: 984591 - RNA, 15 nt, Mycobacterium avium subsp. paratuberculosis
cguacacgaugcccu

SEQ ID NO: 984592 - RNA, 16 nt, Mycobacterium avium subsp. paratuberculosis
cgguugaacaggcugc

SEQ ID NO: 984593 - RNA, 12 nt, Mycobacterium avium subsp. paratuberculosis
cgguugagcacc

SEQ ID NO: 984594 - RNA, 19 nt, Mycobacterium avium subsp. paratuberculosis
cgguugagcaccagcccgg

SEQ ID NO: 984595 - RNA, 19 nt, Mycobacterium avium subsp. paratuberculosis
cgguucgggaaccuggccg

SEQ ID NO: 984596 - RNA, 22 nt, Mycobacterium avium subsp. paratuberculosis
cgguucggaguccaccggcgga

SEQ ID NO: 984597 - RNA, 15 nt, Mycobacterium avium subsp. paratuberculosis
cgguucggcgacgcu

SEQ ID NO: 984598 - RNA, 13 nt, Mycobacterium avium subsp. paratuberculosis
cgguucuuguccu

SEQ ID NO: 984599 - RNA, 18 nt, Mycobacterium avium subsp. paratuberculosis
cgguucgaucuccucggc

SEQ ID NO: 984600 - RNA, 21 nt, Mycobacterium avium subsp. paratuberculosis
cgguuccugcgcuaccaggcg

SEQ ID NO: 984601 - RNA, 20 nt, Mycobacterium avium subsp. paratuberculosis
cgguucgaagcgcagcgucu

SEQ ID NO: 984602 - RNA, 21 nt, Mycobacterium avium subsp. paratuberculosis
cgguuccaaccaccguggccc

SEQ ID NO: 984603 - RNA, 18 nt, Mycobacterium avium subsp. paratuberculosis
cgguuccggcgugcagca

SEQ ID NO: 984604 - RNA, 20 nt, Mycobacterium avium subsp. paratuberculosis
cgguuccgggcgaccccggc

SEQ ID NO: 984605 - RNA, 20 nt, Mycobacterium avium subsp. paratuberculosis
cguaagugucguggcgugcc

SEQ ID NO: 984606 - RNA, 21 nt, Mycobacterium avium subsp. paratuberculosis
cggugguugggguuggaaggg

SEQ ID NO: 984607 - RNA, 11 nt, Mycobacterium avium subsp. paratuberculosis
cgguggugugg

SEQ ID NO: 984608 - RNA, 21 nt, Mycobacterium avium subsp. paratuberculosis
cggugguguggaucuccagca

SEQ ID NO: 984609 - RNA, 16 nt, Mycobacterium avium subsp. paratuberculosis
cggugguguggcaggu

SEQ ID NO: 984610 - RNA, 23 nt, Mycobacterium avium subsp. paratuberculosis
cggugguuuugcggcccugcagg

SEQ ID NO: 984611 - RNA, 14 nt, Mycobacterium avium subsp. paratuberculosis
cgguguagucgcug

SEQ ID NO: 984612 - RNA, 15 nt, Mycobacterium avium subsp. paratuberculosis
cgguguagucggcga

SEQ ID NO: 984613 - RNA, 17 nt, Mycobacterium avium subsp. paratuberculosis
cgguggcguccagcggg

SEQ ID NO: 984614 - RNA, 17 nt, Mycobacterium avium subsp. paratuberculosis
cgguggcggcggcgacg

SEQ ID NO: 984615 - RNA, 15 nt, Mycobacterium avium subsp. paratuberculosis
cgguggugcaccggu

SEQ ID NO: 984616 - RNA, 14 nt, Mycobacterium avium subsp. paratuberculosis
cgguucacgcggcu

SEQ ID NO: 984617 - RNA, 22 nt, Mycobacterium avium subsp. paratuberculosis
cgguucacgcggcuggcccggc

SEQ ID NO: 984618 - RNA, 22 nt, Mycobacterium avium subsp. paratuberculosis
cgguguucggcgccagccgcac

SEQ ID NO: 984619 - RNA, 20 nt, Mycobacterium avium subsp. paratuberculosis
cgguguugccgacggcgccg

SEQ ID NO: 984620 - RNA, 17 nt, Mycobacterium avium subsp. paratuberculosis
cgguguuuggccgcgca

SEQ ID NO: 984621 - RNA, 15 nt, Mycobacterium avium subsp. paratuberculosis
cggugugcugaccca

SEQ ID NO: 984622 - RNA, 19 nt, Mycobacterium avium subsp. paratuberculosis
cggugugcugacccagcgc

SEQ ID NO: 984623 - RNA, 13 nt, Mycobacterium avium subsp. paratuberculosis
cgguguugagcgc

SEQ ID NO: 984624 - RNA, 21 nt, Mycobacterium avium subsp. paratuberculosis
cggugcgguaggugccggccg

SEQ ID NO: 984625 - RNA, 13 nt, Mycobacterium avium subsp. paratuberculosis
cggugcggccgcg

SEQ ID NO: 984626 - RNA, 17 nt, Mycobacterium avium subsp. paratuberculosis
cggugcggccgcgcagc

SEQ ID NO: 984627 - RNA, 16 nt, Mycobacterium avium subsp. paratuberculosis
cggugcggcggugacg

SEQ ID NO: 984628 - RNA, 19 nt, Mycobacterium avium subsp. paratuberculosis
cggugcgugccagcagcuc

SEQ ID NO: 984629 - RNA, 17 nt, Mycobacterium avium subsp. paratuberculosis
cggugcggucgcgcagc

SEQ ID NO: 984630 - RNA, 13 nt, Mycobacterium avium subsp. paratuberculosis
cggugcgcggcga

SEQ ID NO: 984631 - RNA, 14 nt, Mycobacterium avium subsp. paratuberculosis
cggugcgcgcgcgc

SEQ ID NO: 984632 - RNA, 23 nt, Mycobacterium avium subsp. paratuberculosis
cggugcgccgacagcugagcagc

SEQ ID NO: 984633 - RNA, 13 nt, Mycobacterium avium subsp. paratuberculosis
cggugcgcagcac

SEQ ID NO: 984634 - RNA, 21 nt, Mycobacterium avium subsp. paratuberculosis
cggugcgccagcgugaacagc

SEQ ID NO: 984635 - RNA, 14 nt, Mycobacterium avium subsp. paratuberculosis
cggugcgcccaggu

SEQ ID NO: 984636 - RNA, 16 nt, Mycobacterium avium subsp. paratuberculosis
cggugcucccccggac

SEQ ID NO: 984637 - RNA, 21 nt, Mycobacterium avium subsp. paratuberculosis
cggugcucgauguaccaggcc

SEQ ID NO: 984638 - RNA, 21 nt, Mycobacterium avium subsp. paratuberculosis
cggugcucucgucgucggcgg

SEQ ID NO: 984639 - RNA, 20 nt, Mycobacterium avium subsp. paratuberculosis
cggugcucuugacggccgcg

SEQ ID NO: 984640 - RNA, 16 nt, Mycobacterium avium subsp. paratuberculosis
cgguggccucgcgcaa

SEQ ID NO: 984641 - RNA, 16 nt, Mycobacterium avium subsp. paratuberculosis
cgguggccugcccggc

SEQ ID NO: 984642 - RNA, 18 nt, Mycobacterium avium subsp. paratuberculosis
cgguggccuuggccacca

SEQ ID NO: 984643 - RNA, 21 nt, Mycobacterium avium subsp. paratuberculosis
cgguggccuuggccaccacgc

SEQ ID NO: 984644 - RNA, 18 nt, Mycobacterium avium subsp. paratuberculosis
cgguggcgaacugcacca

SEQ ID NO: 984645 - RNA, 21 nt, Mycobacterium avium subsp. paratuberculosis
cgguggcgaacugcaccagca

SEQ ID NO: 984646 - RNA, 15 nt, Mycobacterium avium subsp. paratuberculosis
cgguggcggugccgc

SEQ ID NO: 984647 - RNA, 16 nt, Mycobacterium avium subsp. paratuberculosis
cgguggcgguggccac

SEQ ID NO: 984648 - RNA, 19 nt, Mycobacterium avium subsp. paratuberculosis
cgguggcggucagggucag

SEQ ID NO: 984649 - RNA, 16 nt, Mycobacterium avium subsp. paratuberculosis
cgguggcgcacaaccc

SEQ ID NO: 984650 - RNA, 14 nt, Mycobacterium avium subsp. paratuberculosis
cgguggcgcgcagu

SEQ ID NO: 984651 - RNA, 19 nt, Mycobacterium avium subsp. paratuberculosis
cgguggcgccgcgcagcca

SEQ ID NO: 984652 - RNA, 23 nt, Mycobacterium avium subsp. paratuberculosis
cggucagacgaugggccgcccgc

SEQ ID NO: 984653 - RNA, 18 nt, Mycobacterium avium subsp. paratuberculosis
cggucagcgcguccaggu

SEQ ID NO: 984654 - RNA, 15 nt, Mycobacterium avium subsp. paratuberculosis
cggucagcggccagc

SEQ ID NO: 984655 - RNA, 15 nt, Mycobacterium avium subsp. paratuberculosis
cggucagcgcgccgu

SEQ ID NO: 984656 - RNA, 17 nt, Mycobacterium avium subsp. paratuberculosis
cggucugcgccagcucc

SEQ ID NO: 984657 - RNA, 17 nt, Mycobacterium avium subsp. paratuberculosis
cggucugaucgcccagc

SEQ ID NO: 984658 - RNA, 22 nt, Mycobacterium avium subsp. paratuberculosis
cggucugcaccgggaugacaac

SEQ ID NO: 984659 - RNA, 21 nt, Mycobacterium avium subsp. paratuberculosis
cggucugcggugcgcccaggu

SEQ ID NO: 984660 - RNA, 14 nt, Mycobacterium avium subsp. paratuberculosis
cggucugagcccgg

SEQ ID NO: 984661 - RNA, 17 nt, Mycobacterium avium subsp. paratuberculosis
cggucucuucgacccgg

SEQ ID NO: 984662 - RNA, 18 nt, Mycobacterium avium subsp. paratuberculosis
cggucagcggcaacacgc

SEQ ID NO: 984663 - RNA, 16 nt, Mycobacterium avium subsp. paratuberculosis
cggucagcgucgccgc

SEQ ID NO: 984664 - RNA, 18 nt, Mycobacterium avium subsp. paratuberculosis
cggucagcgucgccgccc

SEQ ID NO: 984665 - RNA, 21 nt, Mycobacterium avium subsp. paratuberculosis
cggucagcgucgccgccccga

SEQ ID NO: 984666 - RNA, 15 nt, Mycobacterium avium subsp. paratuberculosis
cggucagcguggcgu

SEQ ID NO: 984667 - RNA, 13 nt, Mycobacterium avium subsp. paratuberculosis
cggucagcucccg

SEQ ID NO: 984668 - RNA, 17 nt, Mycobacterium avium subsp. paratuberculosis
cggucagcucgaaggug

SEQ ID NO: 984669 - RNA, 23 nt, Mycobacterium avium subsp. paratuberculosis
cggucagcucgaucgccgcgccc

SEQ ID NO: 984670 - RNA, 16 nt, Mycobacterium avium subsp. paratuberculosis
cggucagcucgcgccc

SEQ ID NO: 984671 - RNA, 17 nt, Mycobacterium avium subsp. paratuberculosis
cggucucggcggcgccc

SEQ ID NO: 984672 - RNA, 21 nt, Mycobacterium avium subsp. paratuberculosis
cggucucggcggcgcccagga

SEQ ID NO: 984673 - RNA, 23 nt, Mycobacterium avium subsp. paratuberculosis
cggucuuguagucgaccacccgc

SEQ ID NO: 984674 - RNA, 17 nt, Mycobacterium avium subsp. paratuberculosis
cggucuuggacagcagc

SEQ ID NO: 984675 - RNA, 17 nt, Mycobacterium avium subsp. paratuberculosis
cggucuucccgccgccg

SEQ ID NO: 984676 - RNA, 18 nt, Mycobacterium avium subsp. paratuberculosis
cggucuucucggccaggc

SEQ ID NO: 984677 - RNA, 14 nt, Mycobacterium avium subsp. paratuberculosis
cggucuucuuggcc

SEQ ID NO: 984678 - RNA, 15 nt, Mycobacterium avium subsp. paratuberculosis
cggugaaccgcugac

SEQ ID NO: 984679 - RNA, 13 nt, Mycobacterium avium subsp. paratuberculosis
cggugaagccgac

SEQ ID NO: 984680 - RNA, 19 nt, Mycobacterium avium subsp. paratuberculosis
cggugaagucggugcccag

SEQ ID NO: 984681 - RNA, 17 nt, Mycobacterium avium subsp. paratuberculosis
cggugaacgggccgcac

SEQ ID NO: 984682 - RNA, 23 nt, Mycobacterium avium subsp. paratuberculosis
cggugaacgucgauccccgcagc

SEQ ID NO: 984683 - RNA, 21 nt, Mycobacterium avium subsp. paratuberculosis
cggugaacuccgggcccacca

SEQ ID NO: 984684 - RNA, 22 nt, Mycobacterium avium subsp. paratuberculosis
cggugaacuccgggcccaccag

SEQ ID NO: 984685 - RNA, 19 nt, Mycobacterium avium subsp. paratuberculosis
cggugaacucguccaugcu

SEQ ID NO: 984686 - RNA, 17 nt, Mycobacterium avium subsp. paratuberculosis
cggugaggacaccacga

SEQ ID NO: 984687 - RNA, 13 nt, Mycobacterium avium subsp. paratuberculosis
cggugagcgcgcc

SEQ ID NO: 984688 - RNA, 22 nt, Mycobacterium avium subsp. paratuberculosis
cggugaaugucguagcggucgg

SEQ ID NO: 984689 - RNA, 15 nt, Mycobacterium avium subsp. paratuberculosis
cggugagcacgaccg

SEQ ID NO: 984690 - RNA, 22 nt, Mycobacterium avium subsp. paratuberculosis
cggugaucccaggaacgcgccc

SEQ ID NO: 984691 - RNA, 15 nt, Mycobacterium avium subsp. paratuberculosis
cggugaucgcggcgc

SEQ ID NO: 984692 - RNA, 16 nt, Mycobacterium avium subsp. paratuberculosis
cggugaucgcggcgcu

SEQ ID NO: 984693 - RNA, 16 nt, Mycobacterium avium subsp. paratuberculosis
cggugaguucaucgac

SEQ ID NO: 984694 - RNA, 13 nt, Mycobacterium avium subsp. paratuberculosis
cggugaucacccg

SEQ ID NO: 984695 - RNA, 14 nt, Mycobacterium avium subsp. paratuberculosis
cggugaucagcagc

SEQ ID NO: 984696 - RNA, 15 nt, Mycobacterium avium subsp. paratuberculosis
cggugaucagcagca

SEQ ID NO: 984697 - RNA, 13 nt, Mycobacterium avium subsp. paratuberculosis
cggugcgagccgc

SEQ ID NO: 984698 - RNA, 14 nt, Mycobacterium avium subsp. paratuberculosis
cggugccgcggcgg

SEQ ID NO: 984699 - RNA, 23 nt, Mycobacterium avium subsp. paratuberculosis
cggugccguugaucagggcggcg

SEQ ID NO: 984700 - RNA, 22 nt, Mycobacterium avium subsp. paratuberculosis
cggugccguccucggccgccac

SEQ ID NO: 984701 - RNA, 13 nt, Mycobacterium avium subsp. paratuberculosis
cggugccggccca

SEQ ID NO: 984702 - RNA, 17 nt, Mycobacterium avium subsp. paratuberculosis
cggugccgccguccaug

SEQ ID NO: 984703 - RNA, 19 nt, Mycobacterium avium subsp. paratuberculosis
cggugaucucaccggcggc

SEQ ID NO: 984704 - RNA, 19 nt, Mycobacterium avium subsp. paratuberculosis
cggggacgacggcggggau

SEQ ID NO: 984705 - RNA, 20 nt, Mycobacterium avium subsp. paratuberculosis
cggggaugguuuccacugcc

SEQ ID NO: 984706 - RNA, 20 nt, Mycobacterium avium subsp. paratuberculosis
cggggaucgcgcagccgcgg

SEQ ID NO: 984707 - RNA, 19 nt, Mycobacterium avium subsp. paratuberculosis
cggggcacgcgcgcccggc

SEQ ID NO: 984708 - RNA, 12 nt, Mycobacterium avium subsp. paratuberculosis
cggggcagaccg

SEQ ID NO: 984709 - RNA, 13 nt, Mycobacterium avium subsp. paratuberculosis
cggggcagcagca

SEQ ID NO: 984710 - RNA, 16 nt, Mycobacterium avium subsp. paratuberculosis
cggggccuccaccagc

SEQ ID NO: 984711 - RNA, 17 nt, Mycobacterium avium subsp. paratuberculosis
cggggccuccaccagcg

SEQ ID NO: 984712 - RNA, 21 nt, Mycobacterium avium subsp. paratuberculosis
cggggccuccagccagcgcgc

SEQ ID NO: 984713 - RNA, 23 nt, Mycobacterium avium subsp. paratuberculosis
cggggccggcgcggugggcggcg

SEQ ID NO: 984714 - RNA, 20 nt, Mycobacterium avium subsp. paratuberculosis
cggggccggcggcggccagc

SEQ ID NO: 984715 - RNA, 21 nt, Mycobacterium avium subsp. paratuberculosis
cggggccggcgugcugggcca

SEQ ID NO: 984716 - RNA, 15 nt, Mycobacterium avium subsp. paratuberculosis
cggggcuacaaaacc

SEQ ID NO: 984717 - RNA, 22 nt, Mycobacterium avium subsp. paratuberculosis
cggggcuacaaaaccaagaccg

SEQ ID NO: 984718 - RNA, 12 nt, Mycobacterium avium subsp. paratuberculosis
cggggcucacca

SEQ ID NO: 984719 - RNA, 20 nt, Mycobacterium avium subsp. paratuberculosis
cggggccggugcguccgccg

SEQ ID NO: 984720 - RNA, 20 nt, Mycobacterium avium subsp. paratuberculosis
cggggccaacuccggcggca

SEQ ID NO: 984721 - RNA, 23 nt, Mycobacterium avium subsp. paratuberculosis
cggggccaacuccggcggcagcc

SEQ ID NO: 984722 - RNA, 14 nt, Mycobacterium avium subsp. paratuberculosis
cggggccaccaggc

SEQ ID NO: 984723 - RNA, 16 nt, Mycobacterium avium subsp. paratuberculosis
cggggccaccaggcgc

SEQ ID NO: 984724 - RNA, 19 nt, Mycobacterium avium subsp. paratuberculosis
cggggcaccacguccacca

SEQ ID NO: 984725 - RNA, 19 nt, Mycobacterium avium subsp. paratuberculosis
cggggcccguccccaccac

SEQ ID NO: 984726 - RNA, 21 nt, Mycobacterium avium subsp. paratuberculosis
cggggcccguccccaccaccg

SEQ ID NO: 984727 - RNA, 13 nt, Mycobacterium avium subsp. paratuberculosis
cggggcccuccgc

SEQ ID NO: 984728 - RNA, 21 nt, Mycobacterium avium subsp. paratuberculosis
cgggcucgucgugauggcgaa

SEQ ID NO: 984729 - RNA, 20 nt, Mycobacterium avium subsp. paratuberculosis
cgggcucgucguugcgcagc

SEQ ID NO: 984730 - RNA, 20 nt, Mycobacterium avium subsp. paratuberculosis
cgggcugaccucgcgcaccg

SEQ ID NO: 984731 - RNA, 20 nt, Mycobacterium avium subsp. paratuberculosis
cgggcugagcugugccgcgg

SEQ ID NO: 984732 - RNA, 13 nt, Mycobacterium avium subsp. paratuberculosis
cgggccagcagcc

SEQ ID NO: 984733 - RNA, 16 nt, Mycobacterium avium subsp. paratuberculosis
cgggccagcagccggg

SEQ ID NO: 984734 - RNA, 13 nt, Mycobacterium avium subsp. paratuberculosis
cgggccaccacca

SEQ ID NO: 984735 - RNA, 17 nt, Mycobacterium avium subsp. paratuberculosis
cgggccaccaccacggc

SEQ ID NO: 984736 - RNA, 13 nt, Mycobacterium avium subsp. paratuberculosis
cgggccacacacu

SEQ ID NO: 984737 - RNA, 19 nt, Mycobacterium avium subsp. paratuberculosis
cgggcauuggcagcucggg

SEQ ID NO: 984738 - RNA, 22 nt, Mycobacterium avium subsp. paratuberculosis
cgggcauuggcagcucgggcag

SEQ ID NO: 984739 - RNA, 23 nt, Mycobacterium avium subsp. paratuberculosis
cgggcauuggcagcucgggcagc

SEQ ID NO: 984740 - RNA, 16 nt, Mycobacterium avium subsp. paratuberculosis
cgggcaugccggccgg

SEQ ID NO: 984741 - RNA, 15 nt, Mycobacterium avium subsp. paratuberculosis
cgggcaugccgucgg

SEQ ID NO: 984742 - RNA, 22 nt, Mycobacterium avium subsp. paratuberculosis
cgggcaugaaccaggccgcgcu

SEQ ID NO: 984743 - RNA, 21 nt, Mycobacterium avium subsp. paratuberculosis
cgggcugggcgggguuguaga

SEQ ID NO: 984744 - RNA, 19 nt, Mycobacterium avium subsp. paratuberculosis
cggggaauuccggcgcgau

SEQ ID NO: 984745 - RNA, 21 nt, Mycobacterium avium subsp. paratuberculosis
cggggaacuccugcaggauca

SEQ ID NO: 984746 - RNA, 21 nt, Mycobacterium avium subsp. paratuberculosis
cggggaagaucucggccagga

SEQ ID NO: 984747 - RNA, 14 nt, Mycobacterium avium subsp. paratuberculosis
cgggcuggccgucg

SEQ ID NO: 984748 - RNA, 18 nt, Mycobacterium avium subsp. paratuberculosis
cgggcuggccgucggcga

SEQ ID NO: 984749 - RNA, 17 nt, Mycobacterium avium subsp. paratuberculosis
cgggcugcugcacgucg

SEQ ID NO: 984750 - RNA, 14 nt, Mycobacterium avium subsp. paratuberculosis
cgggcugcgcagca

SEQ ID NO: 984751 - RNA, 19 nt, Mycobacterium avium subsp. paratuberculosis
cgggcugcgcuugcggcgc

SEQ ID NO: 984752 - RNA, 22 nt, Mycobacterium avium subsp. paratuberculosis
cgggcugcgcuugcggcgcagc

SEQ ID NO: 984753 - RNA, 14 nt, Mycobacterium avium subsp. paratuberculosis
cgggcugcagcagc

SEQ ID NO: 984754 - RNA, 19 nt, Mycobacterium avium subsp. paratuberculosis
cgggguugaagucuucggc

SEQ ID NO: 984755 - RNA, 18 nt, Mycobacterium avium subsp. paratuberculosis
cgggguugacccggccgg

SEQ ID NO: 984756 - RNA, 19 nt, Mycobacterium avium subsp. paratuberculosis
cgggguuccgucgaacagc

SEQ ID NO: 984757 - RNA, 16 nt, Mycobacterium avium subsp. paratuberculosis
cggggugugcaggccg

SEQ ID NO: 984758 - RNA, 19 nt, Mycobacterium avium subsp. paratuberculosis
cggggugugcucggcggcg

SEQ ID NO: 984759 - RNA, 21 nt, Mycobacterium avium subsp. paratuberculosis
cggggugugcucggcggcgca

SEQ ID NO: 984760 - RNA, 23 nt, Mycobacterium avium subsp. paratuberculosis
cggggcuucgaacgcccgcacca

SEQ ID NO: 984761 - RNA, 20 nt, Mycobacterium avium subsp. paratuberculosis
cggggcucgacaggcagccc

SEQ ID NO: 984762 - RNA, 15 nt, Mycobacterium avium subsp. paratuberculosis
cggggcugcccaggu

SEQ ID NO: 984763 - RNA, 18 nt, Mycobacterium avium subsp. paratuberculosis
cggggcugcgggccaggc

SEQ ID NO: 984764 - RNA, 22 nt, Mycobacterium avium subsp. paratuberculosis
cgggguugguuucgguccaggu

SEQ ID NO: 984765 - RNA, 14 nt, Mycobacterium avium subsp. paratuberculosis
cgggucagaccgcg

SEQ ID NO: 984766 - RNA, 19 nt, Mycobacterium avium subsp. paratuberculosis
cggguaagugucguggggc

SEQ ID NO: 984767 - RNA, 15 nt, Mycobacterium avium subsp. paratuberculosis
cggguacagccgcag

SEQ ID NO: 984768 - RNA, 18 nt, Mycobacterium avium subsp. paratuberculosis
cgggucauccagccgugg

SEQ ID NO: 984769 - RNA, 15 nt, Mycobacterium avium subsp. paratuberculosis
cggguccagccgcgg

SEQ ID NO: 984770 - RNA, 22 nt, Mycobacterium avium subsp. paratuberculosis
cgggucagcagcgucugcgcca

SEQ ID NO: 984771 - RNA, 16 nt, Mycobacterium avium subsp. paratuberculosis
cgggugaccgacagca

SEQ ID NO: 984772 - RNA, 23 nt, Mycobacterium avium subsp. paratuberculosis
cgggugaccgccuuggcgcgcuc

SEQ ID NO: 984773 - RNA, 22 nt, Mycobacterium avium subsp. paratuberculosis
cgggugaccggcgcgcagcauc

SEQ ID NO: 984774 - RNA, 14 nt, Mycobacterium avium subsp. paratuberculosis
cgggugaggccagg

SEQ ID NO: 984775 - RNA, 15 nt, Mycobacterium avium subsp. paratuberculosis
cgggugaggccaggc

SEQ ID NO: 984776 - RNA, 15 nt, Mycobacterium avium subsp. paratuberculosis
cgggugagacggcca

SEQ ID NO: 984777 - RNA, 16 nt, Mycobacterium avium subsp. paratuberculosis
cgggucucgcccaccu

SEQ ID NO: 984778 - RNA, 19 nt, Mycobacterium avium subsp. paratuberculosis
cgggucuagaucuccaggc

SEQ ID NO: 984779 - RNA, 14 nt, Mycobacterium avium subsp. paratuberculosis
cgggucccagaugc

SEQ ID NO: 984780 - RNA, 14 nt, Mycobacterium avium subsp. paratuberculosis
cgggucccagugcc

SEQ ID NO: 984781 - RNA, 14 nt, Mycobacterium avium subsp. paratuberculosis
cgggucggcgagca

SEQ ID NO: 984782 - RNA, 18 nt, Mycobacterium avium subsp. paratuberculosis
cgggucgggaccgaugcc

SEQ ID NO: 984783 - RNA, 18 nt, Mycobacterium avium subsp. paratuberculosis
cgggucggugggcagcuc

SEQ ID NO: 984784 - RNA, 23 nt, Mycobacterium avium subsp. paratuberculosis
cgggucgguggugaucgcggcgg

SEQ ID NO: 984785 - RNA, 15 nt, Mycobacterium avium subsp. paratuberculosis
cgggucguagagcgc

SEQ ID NO: 984786 - RNA, 21 nt, Mycobacterium avium subsp. paratuberculosis
cgggucgugcaucggcgccug

SEQ ID NO: 984787 - RNA, 16 nt, Mycobacterium avium subsp. paratuberculosis
cgggugcggcacggca

SEQ ID NO: 984788 - RNA, 13 nt, Mycobacterium avium subsp. paratuberculosis
cgggugcggcgcu

SEQ ID NO: 984789 - RNA, 18 nt, Mycobacterium avium subsp. paratuberculosis
cgggugcgcgucgcggug

SEQ ID NO: 984790 - RNA, 23 nt, Mycobacterium avium subsp. paratuberculosis
cgggugcgggccagcagccgcgc

SEQ ID NO: 984791 - RNA, 16 nt, Mycobacterium avium subsp. paratuberculosis
cgggugcgggugcggc

SEQ ID NO: 984792 - RNA, 20 nt, Mycobacterium avium subsp. paratuberculosis
cgggugcguccagaccggcc

SEQ ID NO: 984793 - RNA, 11 nt, Mycobacterium avium subsp. paratuberculosis
cggguggacgc

SEQ ID NO: 984794 - RNA, 17 nt, Mycobacterium avium subsp. paratuberculosis
cggguggcaggaagcga

SEQ ID NO: 984795 - RNA, 17 nt, Mycobacterium avium subsp. paratuberculosis
cgggugauaccggccca

SEQ ID NO: 984796 - RNA, 17 nt, Mycobacterium avium subsp. paratuberculosis
cgggugauccagcccug

SEQ ID NO: 984797 - RNA, 11 nt, Mycobacterium avium subsp. paratuberculosis
cgggugaucuu

SEQ ID NO: 984798 - RNA, 20 nt, Mycobacterium avium subsp. paratuberculosis
cgggugaguaguccagcacc

SEQ ID NO: 984799 - RNA, 17 nt, Mycobacterium avium subsp. paratuberculosis
cgguaccgccggccagg

SEQ ID NO: 984800 - RNA, 18 nt, Mycobacterium avium subsp. paratuberculosis
cgguaccgccggccaggc

SEQ ID NO: 984801 - RNA, 20 nt, Mycobacterium avium subsp. paratuberculosis
cgguacgcgcaauccugccc

SEQ ID NO: 984802 - RNA, 23 nt, Mycobacterium avium subsp. paratuberculosis
cgguacagcgccgcggccagccg

SEQ ID NO: 984803 - RNA, 20 nt, Mycobacterium avium subsp. paratuberculosis
cgguacaucccgccgggcau

SEQ ID NO: 984804 - RNA, 21 nt, Mycobacterium avium subsp. paratuberculosis
cgguacaucccgccgggcauc

SEQ ID NO: 984805 - RNA, 19 nt, Mycobacterium avium subsp. paratuberculosis
cgguaccagggcagcgccu

SEQ ID NO: 984806 - RNA, 16 nt, Mycobacterium avium subsp. paratuberculosis
cgguagaugucggguc

SEQ ID NO: 984807 - RNA, 15 nt, Mycobacterium avium subsp. paratuberculosis
cgguagccagcaccg

SEQ ID NO: 984808 - RNA, 16 nt, Mycobacterium avium subsp. paratuberculosis
cgguagcgcagcacca

SEQ ID NO: 984809 - RNA, 19 nt, Mycobacterium avium subsp. paratuberculosis
cgguaggcgcaccgccggg

SEQ ID NO: 984810 - RNA, 16 nt, Mycobacterium avium subsp. paratuberculosis
cgguaggcggccagcg

SEQ ID NO: 984811 - RNA, 17 nt, Mycobacterium avium subsp. paratuberculosis
cgguagcggcagauggu

SEQ ID NO: 984812 - RNA, 21 nt, Mycobacterium avium subsp. paratuberculosis
cgguaugcccgggccgucauc

SEQ ID NO: 984813 - RNA, 22 nt, Mycobacterium avium subsp. paratuberculosis
cgguauucgucaccccaccagu

SEQ ID NO: 984814 - RNA, 15 nt, Mycobacterium avium subsp. paratuberculosis
cgguagggucgggug

SEQ ID NO: 984815 - RNA, 18 nt, Mycobacterium avium subsp. paratuberculosis
cgguaggccgccgcgacc

SEQ ID NO: 984816 - RNA, 14 nt, Mycobacterium avium subsp. paratuberculosis
cgguaggccugcgu

SEQ ID NO: 984817 - RNA, 18 nt, Mycobacterium avium subsp. paratuberculosis
cgguagggccggucaccg

SEQ ID NO: 984818 - RNA, 21 nt, Mycobacterium avium subsp. paratuberculosis
cgguaggugucgaugaacgca

SEQ ID NO: 984819 - RNA, 16 nt, Mycobacterium avium subsp. paratuberculosis
cgguaucgggucaccg

SEQ ID NO: 984820 - RNA, 23 nt, Mycobacterium avium subsp. paratuberculosis
cgguauccauccgccagaucgcc

SEQ ID NO: 984821 - RNA, 14 nt, Mycobacterium avium subsp. paratuberculosis
cggguuuguccggc

SEQ ID NO: 984822 - RNA, 15 nt, Mycobacterium avium subsp. paratuberculosis
cggguuggucggcgc

SEQ ID NO: 984823 - RNA, 15 nt, Mycobacterium avium subsp. paratuberculosis
cggguuugaggccca

SEQ ID NO: 984824 - RNA, 20 nt, Mycobacterium avium subsp. paratuberculosis
cggguuccgguuggccaggu

SEQ ID NO: 984825 - RNA, 14 nt, Mycobacterium avium subsp. paratuberculosis
cggguuggccaggg

SEQ ID NO: 984826 - RNA, 17 nt, Mycobacterium avium subsp. paratuberculosis
cggguuggcgcgcacca

SEQ ID NO: 984827 - RNA, 17 nt, Mycobacterium avium subsp. paratuberculosis
cggguugggcgccagca

SEQ ID NO: 984828 - RNA, 21 nt, Mycobacterium avium subsp. paratuberculosis
cggguugggcgccagcagcac

SEQ ID NO: 984829 - RNA, 22 nt, Mycobacterium avium subsp. paratuberculosis
cggguugggcgccagcagcacc

SEQ ID NO: 984830 - RNA, 15 nt, Mycobacterium avium subsp. paratuberculosis
cggguuggggccgcg

SEQ ID NO: 984831 - RNA, 14 nt, Mycobacterium avium subsp. paratuberculosis
cggguugccgucga

SEQ ID NO: 984832 - RNA, 20 nt, Mycobacterium avium subsp. paratuberculosis
cggguugcgaaagcccaggc

SEQ ID NO: 984833 - RNA, 22 nt, Mycobacterium avium subsp. paratuberculosis
cggguugcgaaagcccaggccc

SEQ ID NO: 984834 - RNA, 22 nt, Mycobacterium avium subsp. paratuberculosis
cggguugagcaggucagccagg

SEQ ID NO: 984835 - RNA, 16 nt, Mycobacterium avium subsp. paratuberculosis
cggguucgcccucccc

SEQ ID NO: 984836 - RNA, 16 nt, Mycobacterium avium subsp. paratuberculosis
cggguucgcgcagcca

SEQ ID NO: 984837 - RNA, 18 nt, Mycobacterium avium subsp. paratuberculosis
cgggugucgacgccgggc

SEQ ID NO: 984838 - RNA, 15 nt, Mycobacterium avium subsp. paratuberculosis
cggguguugcgcagc

SEQ ID NO: 984839 - RNA, 18 nt, Mycobacterium avium subsp. paratuberculosis
cgggugggcagccccagc

SEQ ID NO: 984840 - RNA, 13 nt, Mycobacterium avium subsp. paratuberculosis
cgggugggcggca

SEQ ID NO: 984841 - RNA, 17 nt, Mycobacterium avium subsp. paratuberculosis
cgggugggcggcacacc

SEQ ID NO: 984842 - RNA, 23 nt, Mycobacterium avium subsp. paratuberculosis
cggguggggaucaggaugacgcc

SEQ ID NO: 984843 - RNA, 16 nt, Mycobacterium avium subsp. paratuberculosis
cgggugguccacccag

SEQ ID NO: 984844 - RNA, 17 nt, Mycobacterium avium subsp. paratuberculosis
cggguggccuucaucac

SEQ ID NO: 984845 - RNA, 18 nt, Mycobacterium avium subsp. paratuberculosis
cggguggccagcaccagc

SEQ ID NO: 984846 - RNA, 19 nt, Mycobacterium avium subsp. paratuberculosis
cggguggccagcaccagcc

SEQ ID NO: 984847 - RNA, 16 nt, Mycobacterium avium subsp. paratuberculosis
cggguggcccgcccgg

SEQ ID NO: 984848 - RNA, 14 nt, Mycobacterium avium subsp. paratuberculosis
cggguggccggggc

SEQ ID NO: 984849 - RNA, 16 nt, Mycobacterium avium subsp. paratuberculosis
cggguggccgggucgc

SEQ ID NO: 984850 - RNA, 19 nt, Mycobacterium avium subsp. paratuberculosis
cgggaacgacggugcgccc

SEQ ID NO: 984851 - RNA, 21 nt, Mycobacterium avium subsp. paratuberculosis
cgggaacgaucggcuccagcg

SEQ ID NO: 984852 - RNA, 15 nt, Mycobacterium avium subsp. paratuberculosis
cgggaaaucggaccc

SEQ ID NO: 984853 - RNA, 23 nt, Mycobacterium avium subsp. paratuberculosis
cgggaaaugcugcacccaccggc

SEQ ID NO: 984854 - RNA, 14 nt, Mycobacterium avium subsp. paratuberculosis
cgggaacagccagg

SEQ ID NO: 984855 - RNA, 17 nt, Mycobacterium avium subsp. paratuberculosis
cgggaacagcgacgccc

SEQ ID NO: 984856 - RNA, 21 nt, Mycobacterium avium subsp. paratuberculosis
cgggacaccgcuggccgaggc

SEQ ID NO: 984857 - RNA, 15 nt, Mycobacterium avium subsp. paratuberculosis
cgggaaugucggcgu

SEQ ID NO: 984858 - RNA, 15 nt, Mycobacterium avium subsp. paratuberculosis
cgggaccagcgccuc

SEQ ID NO: 984859 - RNA, 13 nt, Mycobacterium avium subsp. paratuberculosis
cgggaccagcgcg

SEQ ID NO: 984860 - RNA, 20 nt, Mycobacterium avium subsp. paratuberculosis
cgggacagguagcgcagccc

SEQ ID NO: 984861 - RNA, 14 nt, Mycobacterium avium subsp. paratuberculosis
cgggacccgcgacc

SEQ ID NO: 984862 - RNA, 16 nt, Mycobacterium avium subsp. paratuberculosis
cgggaccacccgcagc

SEQ ID NO: 984863 - RNA, 16 nt, Mycobacterium avium subsp. paratuberculosis
cgggagagcgcgggca

SEQ ID NO: 984864 - RNA, 19 nt, Mycobacterium avium subsp. paratuberculosis
cgggagcgcuggucggcga

SEQ ID NO: 984865 - RNA, 16 nt, Mycobacterium avium subsp. paratuberculosis
cgggagccggccaggu

SEQ ID NO: 984866 - RNA, 14 nt, Mycobacterium avium subsp. paratuberculosis
cgggagcaaggucg

SEQ ID NO: 984867 - RNA, 15 nt, Mycobacterium avium subsp. paratuberculosis
cgggacggccagcag

SEQ ID NO: 984868 - RNA, 19 nt, Mycobacterium avium subsp. paratuberculosis
cgggacggguugcaggcca

SEQ ID NO: 984869 - RNA, 14 nt, Mycobacterium avium subsp. paratuberculosis
cgggacgucggcgc

SEQ ID NO: 984870 - RNA, 18 nt, Mycobacterium avium subsp. paratuberculosis
cgggacgucggcgcgcuc

SEQ ID NO: 984871 - RNA, 16 nt, Mycobacterium avium subsp. paratuberculosis
cgggacguggcucagc

SEQ ID NO: 984872 - RNA, 16 nt, Mycobacterium avium subsp. paratuberculosis
cgggaccgggcccggc

SEQ ID NO: 984873 - RNA, 14 nt, Mycobacterium avium subsp. paratuberculosis
cgggacgacggcgc

SEQ ID NO: 984874 - RNA, 19 nt, Mycobacterium avium subsp. paratuberculosis
cgggacgacggcgccgccc

SEQ ID NO: 984875 - RNA, 23 nt, Mycobacterium avium subsp. paratuberculosis
cgggacgaggggcagcagcgccc

SEQ ID NO: 984876 - RNA, 18 nt, Mycobacterium avium subsp. paratuberculosis
cgggaccgucgcgcagcc

SEQ ID NO: 984877 - RNA, 13 nt, Mycobacterium avium subsp. paratuberculosis
cggcuuggccacc

SEQ ID NO: 984878 - RNA, 14 nt, Mycobacterium avium subsp. paratuberculosis
cggcuuggccacca

SEQ ID NO: 984879 - RNA, 14 nt, Mycobacterium avium subsp. paratuberculosis
cggcuugccgccgc

SEQ ID NO: 984880 - RNA, 15 nt, Mycobacterium avium subsp. paratuberculosis
cggcuugaccggcuc

SEQ ID NO: 984881 - RNA, 18 nt, Mycobacterium avium subsp. paratuberculosis
cggcuugagcgccagcgc

SEQ ID NO: 984882 - RNA, 14 nt, Mycobacterium avium subsp. paratuberculosis
cggcuugccccggu

SEQ ID NO: 984883 - RNA, 21 nt, Mycobacterium avium subsp. paratuberculosis
cgggaaaguuguagcgcagca

SEQ ID NO: 984884 - RNA, 20 nt, Mycobacterium avium subsp. paratuberculosis
cgggaaacccucgacgccgg

SEQ ID NO: 984885 - RNA, 21 nt, Mycobacterium avium subsp. paratuberculosis
cgggaaaccggaugaugcccu

SEQ ID NO: 984886 - RNA, 20 nt, Mycobacterium avium subsp. paratuberculosis
cggcuuggccgugcaggggg

SEQ ID NO: 984887 - RNA, 15 nt, Mycobacterium avium subsp. paratuberculosis
cggcuucgucggguu

SEQ ID NO: 984888 - RNA, 22 nt, Mycobacterium avium subsp. paratuberculosis
cggcuggcccggcgcggcggcg

SEQ ID NO: 984889 - RNA, 15 nt, Mycobacterium avium subsp. paratuberculosis
cggcugcgggccagc

SEQ ID NO: 984890 - RNA, 16 nt, Mycobacterium avium subsp. paratuberculosis
cggcugcgggccagcg

SEQ ID NO: 984891 - RNA, 21 nt, Mycobacterium avium subsp. paratuberculosis
cggcugcugcagcgcccgggc

SEQ ID NO: 984892 - RNA, 16 nt, Mycobacterium avium subsp. paratuberculosis
cgggauacccaugauc

SEQ ID NO: 984893 - RNA, 14 nt, Mycobacterium avium subsp. paratuberculosis
cgggauagagcacc

SEQ ID NO: 984894 - RNA, 15 nt, Mycobacterium avium subsp. paratuberculosis
cgggauagagcaccg

SEQ ID NO: 984895 - RNA, 15 nt, Mycobacterium avium subsp. paratuberculosis
cgggagugcggccca

SEQ ID NO: 984896 - RNA, 17 nt, Mycobacterium avium subsp. paratuberculosis
cgggagucgggcccgcc

SEQ ID NO: 984897 - RNA, 13 nt, Mycobacterium avium subsp. paratuberculosis
cgggaggcccagu

SEQ ID NO: 984898 - RNA, 15 nt, Mycobacterium avium subsp. paratuberculosis
cgggauccaggaauu

SEQ ID NO: 984899 - RNA, 16 nt, Mycobacterium avium subsp. paratuberculosis
cgggaucccgcagccg

SEQ ID NO: 984900 - RNA, 18 nt, Mycobacterium avium subsp. paratuberculosis
cgggaucgaucccgucgg

SEQ ID NO: 984901 - RNA, 18 nt, Mycobacterium avium subsp. paratuberculosis
cgggaucgcggcggucag

SEQ ID NO: 984902 - RNA, 22 nt, Mycobacterium avium subsp. paratuberculosis
cgggaucggaccgcaccaccac

SEQ ID NO: 984903 - RNA, 17 nt, Mycobacterium avium subsp. paratuberculosis
cgggaucggcgcgucgg

SEQ ID NO: 984904 - RNA, 15 nt, Mycobacterium avium subsp. paratuberculosis
cgggaucggcggggc

SEQ ID NO: 984905 - RNA, 17 nt, Mycobacterium avium subsp. paratuberculosis
cgggaucgucgccgggc

SEQ ID NO: 984906 - RNA, 15 nt, Mycobacterium avium subsp. paratuberculosis
cgggaucugcgccgc

SEQ ID NO: 984907 - RNA, 18 nt, Mycobacterium avium subsp. paratuberculosis
cgggaucugcgccgccuc

SEQ ID NO: 984908 - RNA, 18 nt, Mycobacterium avium subsp. paratuberculosis
cgggaugacaccgcggac

SEQ ID NO: 984909 - RNA, 23 nt, Mycobacterium avium subsp. paratuberculosis
cgggaugacaccgcggaccaccg

SEQ ID NO: 984910 - RNA, 16 nt, Mycobacterium avium subsp. paratuberculosis
cgggaugccgagcagc

SEQ ID NO: 984911 - RNA, 22 nt, Mycobacterium avium subsp. paratuberculosis
cgggaugccugcccgcgcaggc

SEQ ID NO: 984912 - RNA, 21 nt, Mycobacterium avium subsp. paratuberculosis
cgggauguacuugaugacgca

SEQ ID NO: 984913 - RNA, 14 nt, Mycobacterium avium subsp. paratuberculosis
cgggauggacagga

SEQ ID NO: 984914 - RNA, 14 nt, Mycobacterium avium subsp. paratuberculosis
cgggauggagccgc

SEQ ID NO: 984915 - RNA, 20 nt, Mycobacterium avium subsp. paratuberculosis
cgggaugucgugggcgugcc

SEQ ID NO: 984916 - RNA, 21 nt, Mycobacterium avium subsp. paratuberculosis
cgggauguggcaucaccgccu

SEQ ID NO: 984917 - RNA, 12 nt, Mycobacterium avium subsp. paratuberculosis
cgggcaagggca

SEQ ID NO: 984918 - RNA, 19 nt, Mycobacterium avium subsp. paratuberculosis
cgggcaaccacagcggcgc

SEQ ID NO: 984919 - RNA, 16 nt, Mycobacterium avium subsp. paratuberculosis
cgggcaacgcgccggc

SEQ ID NO: 984920 - RNA, 21 nt, Mycobacterium avium subsp. paratuberculosis
cgggcagauggucgccgacgg

SEQ ID NO: 984921 - RNA, 20 nt, Mycobacterium avium subsp. paratuberculosis
cgggcaaucggacccagccc

SEQ ID NO: 984922 - RNA, 14 nt, Mycobacterium avium subsp. paratuberculosis
cgggcacgucgcgc

SEQ ID NO: 984923 - RNA, 19 nt, Mycobacterium avium subsp. paratuberculosis
cgggcacgucgcgcggggu

SEQ ID NO: 984924 - RNA, 15 nt, Mycobacterium avium subsp. paratuberculosis
cgggcaucggcuggu

SEQ ID NO: 984925 - RNA, 13 nt, Mycobacterium avium subsp. paratuberculosis
cgggcagcgccuc

SEQ ID NO: 984926 - RNA, 20 nt, Mycobacterium avium subsp. paratuberculosis
cgggcagcgcgacaccggac

SEQ ID NO: 984927 - RNA, 20 nt, Mycobacterium avium subsp. paratuberculosis
cgggcagcgcgcgagacacc

SEQ ID NO: 984928 - RNA, 23 nt, Mycobacterium avium subsp. paratuberculosis
cgggcauccggcucagaaggcgu

SEQ ID NO: 984929 - RNA, 16 nt, Mycobacterium avium subsp. paratuberculosis
cgggcagcagcaccag

SEQ ID NO: 984930 - RNA, 17 nt, Mycobacterium avium subsp. paratuberculosis
cgggcagcagcaccagc

SEQ ID NO: 984931 - RNA, 20 nt, Mycobacterium avium subsp. paratuberculosis
cgggcagcagcaccagcgcc

SEQ ID NO: 984932 - RNA, 17 nt, Mycobacterium avium subsp. paratuberculosis
cgggcagcccgccgacc

SEQ ID NO: 984933 - RNA, 20 nt, Mycobacterium avium subsp. paratuberculosis
cgggcagcccgccgaccacc

SEQ ID NO: 984934 - RNA, 13 nt, Mycobacterium avium subsp. paratuberculosis
cgggcagccggcg

SEQ ID NO: 984935 - RNA, 14 nt, Mycobacterium avium subsp. paratuberculosis
cgggcagccggcgc

SEQ ID NO: 984936 - RNA, 21 nt, Mycobacterium avium subsp. paratuberculosis
cgggcagccggcgcccgcagg

SEQ ID NO: 984937 - RNA, 23 nt, Mycobacterium avium subsp. paratuberculosis
cggcgucaggaccucgaagcagc

SEQ ID NO: 984938 - RNA, 21 nt, Mycobacterium avium subsp. paratuberculosis
cggcgucacgcuggcgugacg

SEQ ID NO: 984939 - RNA, 14 nt, Mycobacterium avium subsp. paratuberculosis
cggcgucacugccc

SEQ ID NO: 984940 - RNA, 22 nt, Mycobacterium avium subsp. paratuberculosis
cggcgucccggguaccucugcg

SEQ ID NO: 984941 - RNA, 19 nt, Mycobacterium avium subsp. paratuberculosis
cggcguccagcgccgccac

SEQ ID NO: 984942 - RNA, 18 nt, Mycobacterium avium subsp. paratuberculosis
cggcguccaggcgcaccg

SEQ ID NO: 984943 - RNA, 23 nt, Mycobacterium avium subsp. paratuberculosis
cggcguccaguagccgccgggcg

SEQ ID NO: 984944 - RNA, 19 nt, Mycobacterium avium subsp. paratuberculosis
cggcguccaguugcggcac

SEQ ID NO: 984945 - RNA, 20 nt, Mycobacterium avium subsp. paratuberculosis
cggcgucgaguucgccgucg

SEQ ID NO: 984946 - RNA, 20 nt, Mycobacterium avium subsp. paratuberculosis
cggcgucgaugaccucgcgc

SEQ ID NO: 984947 - RNA, 16 nt, Mycobacterium avium subsp. paratuberculosis
cggcguccugcagcag

SEQ ID NO: 984948 - RNA, 15 nt, Mycobacterium avium subsp. paratuberculosis
cggcguccgcggccg

SEQ ID NO: 984949 - RNA, 14 nt, Mycobacterium avium subsp. paratuberculosis
cggcgucgaagcgc

SEQ ID NO: 984950 - RNA, 13 nt, Mycobacterium avium subsp. paratuberculosis
cggcggugucggc

SEQ ID NO: 984951 - RNA, 15 nt, Mycobacterium avium subsp. paratuberculosis
cggcggugucggcgc

SEQ ID NO: 984952 - RNA, 15 nt, Mycobacterium avium subsp. paratuberculosis
cggcggugucggugc

SEQ ID NO: 984953 - RNA, 20 nt, Mycobacterium avium subsp. paratuberculosis
cggcggugguccgcgcgacc

SEQ ID NO: 984954 - RNA, 19 nt, Mycobacterium avium subsp. paratuberculosis
cggcgguucgaagcgcagc

SEQ ID NO: 984955 - RNA, 18 nt, Mycobacterium avium subsp. paratuberculosis
cggcgguucggcgggccu

SEQ ID NO: 984956 - RNA, 18 nt, Mycobacterium avium subsp. paratuberculosis
cggcguauucgucgucgg

SEQ ID NO: 984957 - RNA, 21 nt, Mycobacterium avium subsp. paratuberculosis
cggcguaucaacugagcgccc

SEQ ID NO: 984958 - RNA, 22 nt, Mycobacterium avium subsp. paratuberculosis
cggcguaucaacugagcgcccg

SEQ ID NO: 984959 - RNA, 16 nt, Mycobacterium avium subsp. paratuberculosis
cggcggugaucgccgg

SEQ ID NO: 984960 - RNA, 23 nt, Mycobacterium avium subsp. paratuberculosis
cggcggugaucucgucggcggcg

SEQ ID NO: 984961 - RNA, 24 nt, Mycobacterium avium subsp. paratuberculosis
cggcggugaccggaucggccagca

SEQ ID NO: 984962 - RNA, 16 nt, Mycobacterium avium subsp. paratuberculosis
cggcggugcgcagccg

SEQ ID NO: 984963 - RNA, 19 nt, Mycobacterium avium subsp. paratuberculosis
cggcggugcgcagccgcug

SEQ ID NO: 984964 - RNA, 22 nt, Mycobacterium avium subsp. paratuberculosis
cggcggugcagggucagcagca

SEQ ID NO: 984965 - RNA, 22 nt, Mycobacterium avium subsp. paratuberculosis
cggcggugccguccucggccgc

SEQ ID NO: 984966 - RNA, 14 nt, Mycobacterium avium subsp. paratuberculosis
cggcggugcgggug

SEQ ID NO: 984967 - RNA, 18 nt, Mycobacterium avium subsp. paratuberculosis
cggcggugcgucgggcgc

SEQ ID NO: 984968 - RNA, 23 nt, Mycobacterium avium subsp. paratuberculosis
cggcggugggcucggccaucccg

SEQ ID NO: 984969 - RNA, 15 nt, Mycobacterium avium subsp. paratuberculosis
cggcggugggcuggg

SEQ ID NO: 984970 - RNA, 17 nt, Mycobacterium avium subsp. paratuberculosis
cggcggaacggucgggg

SEQ ID NO: 984971 - RNA, 22 nt, Mycobacterium avium subsp. paratuberculosis
cggcggaacggucggggcggcg

SEQ ID NO: 984972 - RNA, 19 nt, Mycobacterium avium subsp. paratuberculosis
cggcggcaaaacgcugggc

SEQ ID NO: 984973 - RNA, 18 nt, Mycobacterium avium subsp. paratuberculosis
cggcgcuucugcgccggu

SEQ ID NO: 984974 - RNA, 15 nt, Mycobacterium avium subsp. paratuberculosis
cggcgcuugaccucg

SEQ ID NO: 984975 - RNA, 22 nt, Mycobacterium avium subsp. paratuberculosis
cggcgcuugacgaacgccacca

SEQ ID NO: 984976 - RNA, 13 nt, Mycobacterium avium subsp. paratuberculosis
cggcgcuuuccac

SEQ ID NO: 984977 - RNA, 18 nt, Mycobacterium avium subsp. paratuberculosis
cggcgcuggccagcgcga

SEQ ID NO: 984978 - RNA, 16 nt, Mycobacterium avium subsp. paratuberculosis
cggcgcuggucggcgg

SEQ ID NO: 984979 - RNA, 21 nt, Mycobacterium avium subsp. paratuberculosis
cggcgcuggucggcgggcagc

SEQ ID NO: 984980 - RNA, 16 nt, Mycobacterium avium subsp. paratuberculosis
cggcggcaccgcggcu

SEQ ID NO: 984981 - RNA, 22 nt, Mycobacterium avium subsp. paratuberculosis
cggcggcagauagaucagcagg

SEQ ID NO: 984982 - RNA, 16 nt, Mycobacterium avium subsp. paratuberculosis
cggcggcagcacccgc

SEQ ID NO: 984983 - RNA, 20 nt, Mycobacterium avium subsp. paratuberculosis
cggcggcacgguuggccggc

SEQ ID NO: 984984 - RNA, 12 nt, Mycobacterium avium subsp. paratuberculosis
cggcggcaccca

SEQ ID NO: 984985 - RNA, 13 nt, Mycobacterium avium subsp. paratuberculosis
cggcggcacccag

SEQ ID NO: 984986 - RNA, 14 nt, Mycobacterium avium subsp. paratuberculosis
cggcggcaccaccc

SEQ ID NO: 984987 - RNA, 15 nt, Mycobacterium avium subsp. paratuberculosis
cggcggcaccacccg

SEQ ID NO: 984988 - RNA, 16 nt, Mycobacterium avium subsp. paratuberculosis
cggcggguucugauac

SEQ ID NO: 984989 - RNA, 21 nt, Mycobacterium avium subsp. paratuberculosis
cggcggguuggucccgaucac

SEQ ID NO: 984990 - RNA, 21 nt, Mycobacterium avium subsp. paratuberculosis
cggcgggucugugaccacggu

SEQ ID NO: 984991 - RNA, 17 nt, Mycobacterium avium subsp. paratuberculosis
cggcgggugcgacggca

SEQ ID NO: 984992 - RNA, 16 nt, Mycobacterium avium subsp. paratuberculosis
cggcgggugcgggcgc

SEQ ID NO: 984993 - RNA, 17 nt, Mycobacterium avium subsp. paratuberculosis
cggcgggucacucgacc

SEQ ID NO: 984994 - RNA, 23 nt, Mycobacterium avium subsp. paratuberculosis
cggcgggucagcacccgcagccg

SEQ ID NO: 984995 - RNA, 16 nt, Mycobacterium avium subsp. paratuberculosis
cggcgggucagcagcg

SEQ ID NO: 984996 - RNA, 19 nt, Mycobacterium avium subsp. paratuberculosis
cggcggggggagaggcgcg

SEQ ID NO: 984997 - RNA, 20 nt, Mycobacterium avium subsp. paratuberculosis
cggcggggggagaggcgcgg

SEQ ID NO: 984998 - RNA, 23 nt, Mycobacterium avium subsp. paratuberculosis
cggcggggggagaggcgcggcgc

SEQ ID NO: 984999 - RNA, 14 nt, Mycobacterium avium subsp. paratuberculosis
cggcgggggcgggc

SEQ ID NO: 985000 - RNA, 14 nt, Mycobacterium avium subsp. paratuberculosis
cggcgggggucgga

SEQ ID NO: 985001 - RNA, 17 nt, Mycobacterium avium subsp. paratuberculosis
cggcgggguccacgcag

SEQ ID NO: 985002 - RNA, 19 nt, Mycobacterium avium subsp. paratuberculosis
cggcgggguccacgcagug

SEQ ID NO: 985003 - RNA, 20 nt, Mycobacterium avium subsp. paratuberculosis
cggcggcauaguccagcucg

SEQ ID NO: 985004 - RNA, 21 nt, Mycobacterium avium subsp. paratuberculosis
cggcggcagcgacucgggcag

SEQ ID NO: 985005 - RNA, 23 nt, Mycobacterium avium subsp. paratuberculosis
cggcggcagcgcggcguucagca

SEQ ID NO: 985006 - RNA, 17 nt, Mycobacterium avium subsp. paratuberculosis
cggcggaaccgggccgc

SEQ ID NO: 985007 - RNA, 19 nt, Mycobacterium avium subsp. paratuberculosis
cggcggcagucgcagcagc

SEQ ID NO: 985008 - RNA, 19 nt, Mycobacterium avium subsp. paratuberculosis
cggcggggaaggugcgggc

SEQ ID NO: 985009 - RNA, 16 nt, Mycobacterium avium subsp. paratuberculosis
cggcgggggcgcgucc

SEQ ID NO: 985010 - RNA, 24 nt, Mycobacterium avium subsp. paratuberculosis
cggcgucguaaugcgucaugccgg

SEQ ID NO: 985011 - RNA, 23 nt, Mycobacterium avium subsp. paratuberculosis
cggcgucgggaccgucgcgcagc

SEQ ID NO: 985012 - RNA, 14 nt, Mycobacterium avium subsp. paratuberculosis
cggcgucgggcggg

SEQ ID NO: 985013 - RNA, 17 nt, Mycobacterium avium subsp. paratuberculosis
cggcgucgucgccgugg

SEQ ID NO: 985014 - RNA, 15 nt, Mycobacterium avium subsp. paratuberculosis
cggcgucgugaccga

SEQ ID NO: 985015 - RNA, 20 nt, Mycobacterium avium subsp. paratuberculosis
cggcgucguugagcaggcug

SEQ ID NO: 985016 - RNA, 20 nt, Mycobacterium avium subsp. paratuberculosis
cggcgucucagucggccacc

SEQ ID NO: 985017 - RNA, 16 nt, Mycobacterium avium subsp. paratuberculosis
cggcgucucggcgucu

SEQ ID NO: 985018 - RNA, 18 nt, Mycobacterium avium subsp. paratuberculosis
cggcgucgaccgccccgc

SEQ ID NO: 985019 - RNA, 18 nt, Mycobacterium avium subsp. paratuberculosis
cggcgucggcgucgggcg

SEQ ID NO: 985020 - RNA, 22 nt, Mycobacterium avium subsp. paratuberculosis
cggcgucgcggcgcacccgggc

SEQ ID NO: 985021 - RNA, 21 nt, Mycobacterium avium subsp. paratuberculosis
cggcgucggagaugcgggcca

SEQ ID NO: 985022 - RNA, 18 nt, Mycobacterium avium subsp. paratuberculosis
cggcgucggccaccgcgc

SEQ ID NO: 985023 - RNA, 20 nt, Mycobacterium avium subsp. paratuberculosis
cggcgucggccaccgcgccu

SEQ ID NO: 985024 - RNA, 21 nt, Mycobacterium avium subsp. paratuberculosis
cggcgucggccgggcugccca

SEQ ID NO: 985025 - RNA, 18 nt, Mycobacterium avium subsp. paratuberculosis
cggcgucuggccggagcg

SEQ ID NO: 985026 - RNA, 23 nt, Mycobacterium avium subsp. paratuberculosis
cggcgugaauccucagcacggcc

SEQ ID NO: 985027 - RNA, 14 nt, Mycobacterium avium subsp. paratuberculosis
cggcguuguggcca

SEQ ID NO: 985028 - RNA, 17 nt, Mycobacterium avium subsp. paratuberculosis
cggcguuguggccaccg

SEQ ID NO: 985029 - RNA, 19 nt, Mycobacterium avium subsp. paratuberculosis
cggcgugaugacggcggcg

SEQ ID NO: 985030 - RNA, 18 nt, Mycobacterium avium subsp. paratuberculosis
cggcguucggugcccggg

SEQ ID NO: 985031 - RNA, 14 nt, Mycobacterium avium subsp. paratuberculosis
cggcgugcacaggc

SEQ ID NO: 985032 - RNA, 21 nt, Mycobacterium avium subsp. paratuberculosis
cggcguugagccggcgcaccg

SEQ ID NO: 985033 - RNA, 15 nt, Mycobacterium avium subsp. paratuberculosis
cggcguuggccgccg

SEQ ID NO: 985034 - RNA, 14 nt, Mycobacterium avium subsp. paratuberculosis
cggcguugcuggcg

SEQ ID NO: 985035 - RNA, 18 nt, Mycobacterium avium subsp. paratuberculosis
cggcuccgcaugcccggg

SEQ ID NO: 985036 - RNA, 20 nt, Mycobacterium avium subsp. paratuberculosis
cggcuccgcaugcccgggcg

SEQ ID NO: 985037 - RNA, 19 nt, Mycobacterium avium subsp. paratuberculosis
cggcuccgaucuccuggug

SEQ ID NO: 985038 - RNA, 16 nt, Mycobacterium avium subsp. paratuberculosis
cggcuccagcgcccgc

SEQ ID NO: 985039 - RNA, 20 nt, Mycobacterium avium subsp. paratuberculosis
cggcuccagcgcccgccgca

SEQ ID NO: 985040 - RNA, 22 nt, Mycobacterium avium subsp. paratuberculosis
cggcucgcgggcgaugcggccc

SEQ ID NO: 985041 - RNA, 20 nt, Mycobacterium avium subsp. paratuberculosis
cggcucgcgggugcggcgcu

SEQ ID NO: 985042 - RNA, 12 nt, Mycobacterium avium subsp. paratuberculosis
cggcucgggggc

SEQ ID NO: 985043 - RNA, 16 nt, Mycobacterium avium subsp. paratuberculosis
cggcucggccggccgg

SEQ ID NO: 985044 - RNA, 15 nt, Mycobacterium avium subsp. paratuberculosis
cggcucggccuucgg

SEQ ID NO: 985045 - RNA, 15 nt, Mycobacterium avium subsp. paratuberculosis
cggcucggcgcccca

SEQ ID NO: 985046 - RNA, 15 nt, Mycobacterium avium subsp. paratuberculosis
cggcugaucagccgg

SEQ ID NO: 985047 - RNA, 22 nt, Mycobacterium avium subsp. paratuberculosis
cggcugaccgagcggcgcugca

SEQ ID NO: 985048 - RNA, 15 nt, Mycobacterium avium subsp. paratuberculosis
cggcugaccggcggu

SEQ ID NO: 985049 - RNA, 15 nt, Mycobacterium avium subsp. paratuberculosis
cggcugaacgccagc

SEQ ID NO: 985050 - RNA, 14 nt, Mycobacterium avium subsp. paratuberculosis
cggcucguggaacg

SEQ ID NO: 985051 - RNA, 21 nt, Mycobacterium avium subsp. paratuberculosis
cggcucguguccgaugacgag

SEQ ID NO: 985052 - RNA, 16 nt, Mycobacterium avium subsp. paratuberculosis
cggcucuucgcggcgg

SEQ ID NO: 985053 - RNA, 20 nt, Mycobacterium avium subsp. paratuberculosis
cggcucuucggcgccgagcg

SEQ ID NO: 985054 - RNA, 17 nt, Mycobacterium avium subsp. paratuberculosis
cggcucguccagcccgg

SEQ ID NO: 985055 - RNA, 19 nt, Mycobacterium avium subsp. paratuberculosis
cggcucggucaagccggcc

SEQ ID NO: 985056 - RNA, 22 nt, Mycobacterium avium subsp. paratuberculosis
cggcucggucaagccggccagc

SEQ ID NO: 985057 - RNA, 17 nt, Mycobacterium avium subsp. paratuberculosis
cggcucggucuccucca

SEQ ID NO: 985058 - RNA, 23 nt, Mycobacterium avium subsp. paratuberculosis
cggcgacacccagcggcgcggcc

SEQ ID NO: 985059 - RNA, 16 nt, Mycobacterium avium subsp. paratuberculosis
cggcgaaugccugacg

SEQ ID NO: 985060 - RNA, 21 nt, Mycobacterium avium subsp. paratuberculosis
cggcgacaugcgcagcgccca

SEQ ID NO: 985061 - RNA, 21 nt, Mycobacterium avium subsp. paratuberculosis
cggcgacauuggccgcgcgca

SEQ ID NO: 985062 - RNA, 17 nt, Mycobacterium avium subsp. paratuberculosis
cggcgaccaccucggcg

SEQ ID NO: 985063 - RNA, 15 nt, Mycobacterium avium subsp. paratuberculosis
cggcgaccacgaaca

SEQ ID NO: 985064 - RNA, 23 nt, Mycobacterium avium subsp. paratuberculosis
cggcgaccacgaacaccggcgcg

SEQ ID NO: 985065 - RNA, 22 nt, Mycobacterium avium subsp. paratuberculosis
cggcgaccgccuugucggcgau

SEQ ID NO: 985066 - RNA, 19 nt, Mycobacterium avium subsp. paratuberculosis
cggcgaccgcgcgcggcgc

SEQ ID NO: 985067 - RNA, 17 nt, Mycobacterium avium subsp. paratuberculosis
cggcgaccgcccggggc

SEQ ID NO: 985068 - RNA, 18 nt, Mycobacterium avium subsp. paratuberculosis
cggcgaccgcccggggcg

SEQ ID NO: 985069 - RNA, 15 nt, Mycobacterium avium subsp. paratuberculosis
cggcgaccagccccu

SEQ ID NO: 985070 - RNA, 16 nt, Mycobacterium avium subsp. paratuberculosis
cggcgaccagccccuc

SEQ ID NO: 985071 - RNA, 16 nt, Mycobacterium avium subsp. paratuberculosis
cggcgaccagcgacgg

SEQ ID NO: 985072 - RNA, 17 nt, Mycobacterium avium subsp. paratuberculosis
cggcgaccagcgagccc

SEQ ID NO: 985073 - RNA, 20 nt, Mycobacterium avium subsp. paratuberculosis
cggcgaccagcgagcccagc

SEQ ID NO: 985074 - RNA, 15 nt, Mycobacterium avium subsp. paratuberculosis
cggcgaacuccaccc

SEQ ID NO: 985075 - RNA, 17 nt, Mycobacterium avium subsp. paratuberculosis
cggcgaacuccacccug

SEQ ID NO: 985076 - RNA, 17 nt, Mycobacterium avium subsp. paratuberculosis
cggcgaacucgcggcgg

SEQ ID NO: 985077 - RNA, 16 nt, Mycobacterium avium subsp. paratuberculosis
cggcgaagccggcccc

SEQ ID NO: 985078 - RNA, 17 nt, Mycobacterium avium subsp. paratuberculosis
cggcgaagccggccccg

SEQ ID NO: 985079 - RNA, 19 nt, Mycobacterium avium subsp. paratuberculosis
cggcgaagccggccccgcc

SEQ ID NO: 985080 - RNA, 17 nt, Mycobacterium avium subsp. paratuberculosis
cggcgaaggcgcgcagg

SEQ ID NO: 985081 - RNA, 18 nt, Mycobacterium avium subsp. paratuberculosis
cggcgaagacgucggcgc

SEQ ID NO: 985082 - RNA, 21 nt, Mycobacterium avium subsp. paratuberculosis
cggcgaagucaucaccgggga

SEQ ID NO: 985083 - RNA, 19 nt, Mycobacterium avium subsp. paratuberculosis
cggcgaacaccucgggauc

SEQ ID NO: 985084 - RNA, 16 nt, Mycobacterium avium subsp. paratuberculosis
cggcgaacagugcacu

SEQ ID NO: 985085 - RNA, 20 nt, Mycobacterium avium subsp. paratuberculosis
cggcgaaccgccgcacccag

SEQ ID NO: 985086 - RNA, 22 nt, Mycobacterium avium subsp. paratuberculosis
cggcgaaccgggacagccgcgc

SEQ ID NO: 985087 - RNA, 21 nt, Mycobacterium avium subsp. paratuberculosis
cggcgaacgcgcggucgucgc

SEQ ID NO: 985088 - RNA, 16 nt, Mycobacterium avium subsp. paratuberculosis
cggcgaacggccaguc

SEQ ID NO: 985089 - RNA, 15 nt, Mycobacterium avium subsp. paratuberculosis
cggcccauggcgaac

SEQ ID NO: 985090 - RNA, 20 nt, Mycobacterium avium subsp. paratuberculosis
cggccccaacggcgugcagc

SEQ ID NO: 985091 - RNA, 15 nt, Mycobacterium avium subsp. paratuberculosis
cggccccaccgccgc

SEQ ID NO: 985092 - RNA, 21 nt, Mycobacterium avium subsp. paratuberculosis
cggccuugcgcaccggagccu

SEQ ID NO: 985093 - RNA, 21 nt, Mycobacterium avium subsp. paratuberculosis
cggccuugcgggccggagccu

SEQ ID NO: 985094 - RNA, 16 nt, Mycobacterium avium subsp. paratuberculosis
cggccuuggccaccgc

SEQ ID NO: 985095 - RNA, 20 nt, Mycobacterium avium subsp. paratuberculosis
cggccuuggccaccgccugc

SEQ ID NO: 985096 - RNA, 16 nt, Mycobacterium avium subsp. paratuberculosis
cggccuuggcccgcgc

SEQ ID NO: 985097 - RNA, 12 nt, Mycobacterium avium subsp. paratuberculosis
cggccccagccg

SEQ ID NO: 985098 - RNA, 16 nt, Mycobacterium avium subsp. paratuberculosis
cggccccagccgccgc

SEQ ID NO: 985099 - RNA, 21 nt, Mycobacterium avium subsp. paratuberculosis
cggcgaaaacgccugcgccgc

SEQ ID NO: 985100 - RNA, 20 nt, Mycobacterium avium subsp. paratuberculosis
cggcgaaacacagcagcacg

SEQ ID NO: 985101 - RNA, 15 nt, Mycobacterium avium subsp. paratuberculosis
cggccaucagcaccg

SEQ ID NO: 985102 - RNA, 17 nt, Mycobacterium avium subsp. paratuberculosis
cggccaucagccgccgu

SEQ ID NO: 985103 - RNA, 14 nt, Mycobacterium avium subsp. paratuberculosis
cggccauccgggcg

SEQ ID NO: 985104 - RNA, 15 nt, Mycobacterium avium subsp. paratuberculosis
cggccaucgccgcgg

SEQ ID NO: 985105 - RNA, 14 nt, Mycobacterium avium subsp. paratuberculosis
cggccaugccgcgc

SEQ ID NO: 985106 - RNA, 21 nt, Mycobacterium avium subsp. paratuberculosis
cggcccaguggaucggcccga

SEQ ID NO: 985107 - RNA, 20 nt, Mycobacterium avium subsp. paratuberculosis
cggcccagguucuccggccc

SEQ ID NO: 985108 - RNA, 21 nt, Mycobacterium avium subsp. paratuberculosis
cggcccagguucuccggcccg

SEQ ID NO: 985109 - RNA, 23 nt, Mycobacterium avium subsp. paratuberculosis
cggcccagguucuccggcccgcu

SEQ ID NO: 985110 - RNA, 16 nt, Mycobacterium avium subsp. paratuberculosis
cggcccaucaccagcg

SEQ ID NO: 985111 - RNA, 22 nt, Mycobacterium avium subsp. paratuberculosis
cggcccaucaccggaccggcca

SEQ ID NO: 985112 - RNA, 21 nt, Mycobacterium avium subsp. paratuberculosis
cggcccagcuccacgcguagc

SEQ ID NO: 985113 - RNA, 16 nt, Mycobacterium avium subsp. paratuberculosis
cggcccagcgcgcggc

SEQ ID NO: 985114 - RNA, 18 nt, Mycobacterium avium subsp. paratuberculosis
cggcccagcgcgcggcgg

SEQ ID NO: 985115 - RNA, 18 nt, Mycobacterium avium subsp. paratuberculosis
cggccauggugccgccgu

SEQ ID NO: 985116 - RNA, 19 nt, Mycobacterium avium subsp. paratuberculosis
cggcgaccgugcccaccag

SEQ ID NO: 985117 - RNA, 18 nt, Mycobacterium avium subsp. paratuberculosis
cggcgaccucuaacgucu

SEQ ID NO: 985118 - RNA, 23 nt, Mycobacterium avium subsp. paratuberculosis
cggcgaccuguuuggccagccag

SEQ ID NO: 985119 - RNA, 15 nt, Mycobacterium avium subsp. paratuberculosis
cggcgacgaagcagc

SEQ ID NO: 985120 - RNA, 16 nt, Mycobacterium avium subsp. paratuberculosis
cggcgacgaccaccag

SEQ ID NO: 985121 - RNA, 18 nt, Mycobacterium avium subsp. paratuberculosis
cggcgacgaccaccagga

SEQ ID NO: 985122 - RNA, 12 nt, Mycobacterium avium subsp. paratuberculosis
cggcgacggcga

SEQ ID NO: 985123 - RNA, 14 nt, Mycobacterium avium subsp. paratuberculosis
cggcgacggcgacg

SEQ ID NO: 985124 - RNA, 13 nt, Mycobacterium avium subsp. paratuberculosis
cggcgacggcgcu

SEQ ID NO: 985125 - RNA, 21 nt, Mycobacterium avium subsp. paratuberculosis
cggcgacggcguccgggcgcu

SEQ ID NO: 985126 - RNA, 18 nt, Mycobacterium avium subsp. paratuberculosis
cggcgacggcgucggcgg

SEQ ID NO: 985127 - RNA, 18 nt, Mycobacterium avium subsp. paratuberculosis
cggcgacgguggcgccca

SEQ ID NO: 985128 - RNA, 20 nt, Mycobacterium avium subsp. paratuberculosis
cggcgacgguggcgcccagc

SEQ ID NO: 985129 - RNA, 18 nt, Mycobacterium avium subsp. paratuberculosis
cggcgacgguguccgcgg

SEQ ID NO: 985130 - RNA, 19 nt, Mycobacterium avium subsp. paratuberculosis
cggcgacgucgacggcagc

SEQ ID NO: 985131 - RNA, 23 nt, Mycobacterium avium subsp. paratuberculosis
cggcgacgucgccggccugcccg

SEQ ID NO: 985132 - RNA, 23 nt, Mycobacterium avium subsp. paratuberculosis
cggcgacgugccggcggcaggug

SEQ ID NO: 985133 - RNA, 23 nt, Mycobacterium avium subsp. paratuberculosis
cggcgacuccagcagcgccagca

SEQ ID NO: 985134 - RNA, 15 nt, Mycobacterium avium subsp. paratuberculosis
cggcgacgccgucgg

SEQ ID NO: 985135 - RNA, 16 nt, Mycobacterium avium subsp. paratuberculosis
cggcgacgccgucggg

SEQ ID NO: 985136 - RNA, 17 nt, Mycobacterium avium subsp. paratuberculosis
cggcgacggccagcgcg

SEQ ID NO: 985137 - RNA, 14 nt, Mycobacterium avium subsp. paratuberculosis
cggcgaggccaggc

SEQ ID NO: 985138 - RNA, 19 nt, Mycobacterium avium subsp. paratuberculosis
cggcgagcgcuucgggagc

SEQ ID NO: 985139 - RNA, 15 nt, Mycobacterium avium subsp. paratuberculosis
cggcgagcggcaccu

SEQ ID NO: 985140 - RNA, 13 nt, Mycobacterium avium subsp. paratuberculosis
cggcgagcggccc

SEQ ID NO: 985141 - RNA, 19 nt, Mycobacterium avium subsp. paratuberculosis
cggcgagcuuggcgggcgu

SEQ ID NO: 985142 - RNA, 16 nt, Mycobacterium avium subsp. paratuberculosis
cggcgagcgcgcugau

SEQ ID NO: 985143 - RNA, 22 nt, Mycobacterium avium subsp. paratuberculosis
cggcgagcgcgcugaucgccgc

SEQ ID NO: 985144 - RNA, 16 nt, Mycobacterium avium subsp. paratuberculosis
cggcgagcgacgccac

SEQ ID NO: 985145 - RNA, 15 nt, Mycobacterium avium subsp. paratuberculosis
cggcgagcgaggcca

SEQ ID NO: 985146 - RNA, 18 nt, Mycobacterium avium subsp. paratuberculosis
cggcgagccgggccgggu

SEQ ID NO: 985147 - RNA, 21 nt, Mycobacterium avium subsp. paratuberculosis
cggcgagcagcagcgcggugc

SEQ ID NO: 985148 - RNA, 16 nt, Mycobacterium avium subsp. paratuberculosis
cggcgagcagccgcgc

SEQ ID NO: 985149 - RNA, 22 nt, Mycobacterium avium subsp. paratuberculosis
cggcgagaucccugcgcucagc

SEQ ID NO: 985150 - RNA, 17 nt, Mycobacterium avium subsp. paratuberculosis
cggcgagcaaggcgagc

SEQ ID NO: 985151 - RNA, 20 nt, Mycobacterium avium subsp. paratuberculosis
cggcgaucucgucgcgcagc

SEQ ID NO: 985152 - RNA, 21 nt, Mycobacterium avium subsp. paratuberculosis
cggcgaucuuugcggccgugg

SEQ ID NO: 985153 - RNA, 15 nt, Mycobacterium avium subsp. paratuberculosis
cggcgaugaccgccu

SEQ ID NO: 985154 - RNA, 15 nt, Mycobacterium avium subsp. paratuberculosis
cggcgaugcgcucca

SEQ ID NO: 985155 - RNA, 14 nt, Mycobacterium avium subsp. paratuberculosis
cggcgaugcgcgcc

SEQ ID NO: 985156 - RNA, 20 nt, Mycobacterium avium subsp. paratuberculosis
cggcgaugcgcgccuccgac

SEQ ID NO: 985157 - RNA, 21 nt, Mycobacterium avium subsp. paratuberculosis
cggcgaugccuuccucggcgc

SEQ ID NO: 985158 - RNA, 15 nt, Mycobacterium avium subsp. paratuberculosis
cggcgaugcgcacca

SEQ ID NO: 985159 - RNA, 15 nt, Mycobacterium avium subsp. paratuberculosis
cggcgaugccggaaa

SEQ ID NO: 985160 - RNA, 16 nt, Mycobacterium avium subsp. paratuberculosis
cggcgaugcagaucac

SEQ ID NO: 985161 - RNA, 21 nt, Mycobacterium avium subsp. paratuberculosis
cggcgaugcccgugaucgcca

SEQ ID NO: 985162 - RNA, 20 nt, Mycobacterium avium subsp. paratuberculosis
cggcgauggcggcgugcagu

SEQ ID NO: 985163 - RNA, 23 nt, Mycobacterium avium subsp. paratuberculosis
cggcgauggugaugugcggcgcg

SEQ ID NO: 985164 - RNA, 19 nt, Mycobacterium avium subsp. paratuberculosis
cggcgaugguggcgcugcc

SEQ ID NO: 985165 - RNA, 23 nt, Mycobacterium avium subsp. paratuberculosis
cggcgauggacguccagcggccc

SEQ ID NO: 985166 - RNA, 22 nt, Mycobacterium avium subsp. paratuberculosis
cggcgauaggcggccagcuccc

SEQ ID NO: 985167 - RNA, 18 nt, Mycobacterium avium subsp. paratuberculosis
cggcgauacccgggagca

SEQ ID NO: 985168 - RNA, 19 nt, Mycobacterium avium subsp. paratuberculosis
cggcgaggcggucggcgga

SEQ ID NO: 985169 - RNA, 17 nt, Mycobacterium avium subsp. paratuberculosis
cggcgagucccggcgca

SEQ ID NO: 985170 - RNA, 18 nt, Mycobacterium avium subsp. paratuberculosis
cggcgaguccgcggaggc

SEQ ID NO: 985171 - RNA, 14 nt, Mycobacterium avium subsp. paratuberculosis
cggcgagugcaccu

SEQ ID NO: 985172 - RNA, 21 nt, Mycobacterium avium subsp. paratuberculosis
cggcgaguucgaugacgucgc

SEQ ID NO: 985173 - RNA, 18 nt, Mycobacterium avium subsp. paratuberculosis
cggcgaguucggcggccc

SEQ ID NO: 985174 - RNA, 21 nt, Mycobacterium avium subsp. paratuberculosis
cggcgaguucggcggcccgcu

SEQ ID NO: 985175 - RNA, 18 nt, Mycobacterium avium subsp. paratuberculosis
cggcgaucucggucaccg

SEQ ID NO: 985176 - RNA, 15 nt, Mycobacterium avium subsp. paratuberculosis
cggcgaucucguccc

SEQ ID NO: 985177 - RNA, 20 nt, Mycobacterium avium subsp. paratuberculosis
cggcgauccacgccuccggc

SEQ ID NO: 985178 - RNA, 14 nt, Mycobacterium avium subsp. paratuberculosis
cggcgaucgccagc

SEQ ID NO: 985179 - RNA, 15 nt, Mycobacterium avium subsp. paratuberculosis
cggcgaucgccagca

SEQ ID NO: 985180 - RNA, 15 nt, Mycobacterium avium subsp. paratuberculosis
cggcgaucggccgcu

SEQ ID NO: 985181 - RNA, 17 nt, Mycobacterium avium subsp. paratuberculosis
cggcgaucgggucaccg

SEQ ID NO: 985182 - RNA, 15 nt, Mycobacterium avium subsp. paratuberculosis
cggcgaucgccgugg

SEQ ID NO: 985183 - RNA, 14 nt, Mycobacterium avium subsp. paratuberculosis
cggcgaucgcgagc

SEQ ID NO: 985184 - RNA, 18 nt, Mycobacterium avium subsp. paratuberculosis
cggcgaucgcgagcaggg

SEQ ID NO: 985185 - RNA, 14 nt, Mycobacterium avium subsp. paratuberculosis
cggcgaucgcgcgc

SEQ ID NO: 985186 - RNA, 22 nt, Mycobacterium avium subsp. paratuberculosis
cggcgaucgagggggucaucag

SEQ ID NO: 985187 - RNA, 18 nt, Mycobacterium avium subsp. paratuberculosis
cggcgaucaccgcguucu

SEQ ID NO: 985188 - RNA, 20 nt, Mycobacterium avium subsp. paratuberculosis
cggcgaucaccgggacaccg

SEQ ID NO: 985189 - RNA, 21 nt, Mycobacterium avium subsp. paratuberculosis
cggcgaucaccgggacaccgc

SEQ ID NO: 985190 - RNA, 16 nt, Mycobacterium avium subsp. paratuberculosis
cggcgauccgcgcggc

SEQ ID NO: 985191 - RNA, 14 nt, Mycobacterium avium subsp. paratuberculosis
cggcgauccggccg

SEQ ID NO: 985192 - RNA, 14 nt, Mycobacterium avium subsp. paratuberculosis
cggcgauccgggca

SEQ ID NO: 985193 - RNA, 21 nt, Mycobacterium avium subsp. paratuberculosis
cggcgauccgggcacgcagcg

SEQ ID NO: 985194 - RNA, 17 nt, Mycobacterium avium subsp. paratuberculosis
cggcgaucagcagcacc

SEQ ID NO: 985195 - RNA, 15 nt, Mycobacterium avium subsp. paratuberculosis
cggcgaucagcuccu

SEQ ID NO: 985196 - RNA, 18 nt, Mycobacterium avium subsp. paratuberculosis
cggcgcggucgcaggccg

SEQ ID NO: 985197 - RNA, 21 nt, Mycobacterium avium subsp. paratuberculosis
cggcgcggucgcaggccgccc

SEQ ID NO: 985198 - RNA, 14 nt, Mycobacterium avium subsp. paratuberculosis
cggcgcggugcgcc

SEQ ID NO: 985199 - RNA, 19 nt, Mycobacterium avium subsp. paratuberculosis
cggcgcgguggcgugcagc

SEQ ID NO: 985200 - RNA, 15 nt, Mycobacterium avium subsp. paratuberculosis
cggcgcgggcgcccu

SEQ ID NO: 985201 - RNA, 18 nt, Mycobacterium avium subsp. paratuberculosis
cggcgcgugcgccgcggc

SEQ ID NO: 985202 - RNA, 21 nt, Mycobacterium avium subsp. paratuberculosis
cggcgcugcccgcgaucgcca

SEQ ID NO: 985203 - RNA, 15 nt, Mycobacterium avium subsp. paratuberculosis
cggcgcugccgccgg

SEQ ID NO: 985204 - RNA, 19 nt, Mycobacterium avium subsp. paratuberculosis
cggcgcugccgccggccuc

SEQ ID NO: 985205 - RNA, 15 nt, Mycobacterium avium subsp. paratuberculosis
cggcgcugccggcgc

SEQ ID NO: 985206 - RNA, 16 nt, Mycobacterium avium subsp. paratuberculosis
cggcgcugccggcgca

SEQ ID NO: 985207 - RNA, 19 nt, Mycobacterium avium subsp. paratuberculosis
cggcgcugccggcgcaccc

SEQ ID NO: 985208 - RNA, 13 nt, Mycobacterium avium subsp. paratuberculosis
cggcgcgucgucc

SEQ ID NO: 985209 - RNA, 23 nt, Mycobacterium avium subsp. paratuberculosis
cggcgcgucguccgacaccaccu

SEQ ID NO: 985210 - RNA, 12 nt, Mycobacterium avium subsp. paratuberculosis
cggcgcgcgccg

SEQ ID NO: 985211 - RNA, 15 nt, Mycobacterium avium subsp. paratuberculosis
cggcgcgcgccgcag

SEQ ID NO: 985212 - RNA, 16 nt, Mycobacterium avium subsp. paratuberculosis
cggcgcgcgccgcagc

SEQ ID NO: 985213 - RNA, 20 nt, Mycobacterium avium subsp. paratuberculosis
cggcgcgccugcgcggcggc

SEQ ID NO: 985214 - RNA, 12 nt, Mycobacterium avium subsp. paratuberculosis
cggcgcgccggc

SEQ ID NO: 985215 - RNA, 15 nt, Mycobacterium avium subsp. paratuberculosis
cggcgcgccggccgg

SEQ ID NO: 985216 - RNA, 13 nt, Mycobacterium avium subsp. paratuberculosis
cggcgcgccggcg

SEQ ID NO: 985217 - RNA, 14 nt, Mycobacterium avium subsp. paratuberculosis
cggcgcgccggcga

SEQ ID NO: 985218 - RNA, 13 nt, Mycobacterium avium subsp. paratuberculosis
cggcgcgccgggc

SEQ ID NO: 985219 - RNA, 16 nt, Mycobacterium avium subsp. paratuberculosis
cggcgcgccgggcagc

SEQ ID NO: 985220 - RNA, 16 nt, Mycobacterium avium subsp. paratuberculosis
cggcgcgcaccgcggg

SEQ ID NO: 985221 - RNA, 17 nt, Mycobacterium avium subsp. paratuberculosis
cggcgcgcaccgcgggc

SEQ ID NO: 985222 - RNA, 14 nt, Mycobacterium avium subsp. paratuberculosis
cggcgcgccacccg

SEQ ID NO: 985223 - RNA, 19 nt, Mycobacterium avium subsp. paratuberculosis
cggcgcgcagcucgcgcag

SEQ ID NO: 985224 - RNA, 19 nt, Mycobacterium avium subsp. paratuberculosis
cggcgcgcaggcgcgcggc

SEQ ID NO: 985225 - RNA, 20 nt, Mycobacterium avium subsp. paratuberculosis
cggcgcgcaggcgcgcggcc

SEQ ID NO: 985226 - RNA, 14 nt, Mycobacterium avium subsp. paratuberculosis
cggcgcgcaggcug

SEQ ID NO: 985227 - RNA, 17 nt, Mycobacterium avium subsp. paratuberculosis
cggcgcgcaggcuggca

SEQ ID NO: 985228 - RNA, 19 nt, Mycobacterium avium subsp. paratuberculosis
cggcgcgaccagcggcagc

SEQ ID NO: 985229 - RNA, 20 nt, Mycobacterium avium subsp. paratuberculosis
cggcgcgaccagcggcagca

SEQ ID NO: 985230 - RNA, 19 nt, Mycobacterium avium subsp. paratuberculosis
cggcgcgaaccgggccagg

SEQ ID NO: 985231 - RNA, 21 nt, Mycobacterium avium subsp. paratuberculosis
cggcgcgaaccgggccaggau

SEQ ID NO: 985232 - RNA, 22 nt, Mycobacterium avium subsp. paratuberculosis
cggcgcgaaccgggccaggaug

SEQ ID NO: 985233 - RNA, 18 nt, Mycobacterium avium subsp. paratuberculosis
cggcgcgaagucgagcag

SEQ ID NO: 985234 - RNA, 23 nt, Mycobacterium avium subsp. paratuberculosis
cggcgcgaagucgagcagguucu

SEQ ID NO: 985235 - RNA, 17 nt, Mycobacterium avium subsp. paratuberculosis
cggcgcgcacggcagcc

SEQ ID NO: 985236 - RNA, 15 nt, Mycobacterium avium subsp. paratuberculosis
cggcgcgcagcaauu

SEQ ID NO: 985237 - RNA, 13 nt, Mycobacterium avium subsp. paratuberculosis
cggcgcgcagccc

SEQ ID NO: 985238 - RNA, 16 nt, Mycobacterium avium subsp. paratuberculosis
cggcgcgcagccggcc

SEQ ID NO: 985239 - RNA, 21 nt, Mycobacterium avium subsp. paratuberculosis
cggcgcgaugaucgccggcgc

SEQ ID NO: 985240 - RNA, 17 nt, Mycobacterium avium subsp. paratuberculosis
cggcgccugauccgcgg

SEQ ID NO: 985241 - RNA, 15 nt, Mycobacterium avium subsp. paratuberculosis
cggcgccucgaugcg

SEQ ID NO: 985242 - RNA, 21 nt, Mycobacterium avium subsp. paratuberculosis
cggcgccucggcgccucggcg

SEQ ID NO: 985243 - RNA, 19 nt, Mycobacterium avium subsp. paratuberculosis
cggcgccgugccgcgcggc

SEQ ID NO: 985244 - RNA, 18 nt, Mycobacterium avium subsp. paratuberculosis
cggcgccggugccgcagc

SEQ ID NO: 985245 - RNA, 12 nt, Mycobacterium avium subsp. paratuberculosis
cggcgccgucgc

SEQ ID NO: 985246 - RNA, 17 nt, Mycobacterium avium subsp. paratuberculosis
cggcgccggcgcgcaac

SEQ ID NO: 985247 - RNA, 20 nt, Mycobacterium avium subsp. paratuberculosis
cggcgccggucagcggcaac

SEQ ID NO: 985248 - RNA, 13 nt, Mycobacterium avium subsp. paratuberculosis
cggcgccggggcu

SEQ ID NO: 985249 - RNA, 18 nt, Mycobacterium avium subsp. paratuberculosis
cggcgccgggcggcccgc

SEQ ID NO: 985250 - RNA, 13 nt, Mycobacterium avium subsp. paratuberculosis
cggcgccggcgcg

SEQ ID NO: 985251 - RNA, 21 nt, Mycobacterium avium subsp. paratuberculosis
cggcgccggcggucagcucag

SEQ ID NO: 985252 - RNA, 14 nt, Mycobacterium avium subsp. paratuberculosis
cggcgccggccgcc

SEQ ID NO: 985253 - RNA, 16 nt, Mycobacterium avium subsp. paratuberculosis
cggcgccggccgccgg

SEQ ID NO: 985254 - RNA, 13 nt, Mycobacterium avium subsp. paratuberculosis
cggcgccggccgg

SEQ ID NO: 985255 - RNA, 19 nt, Mycobacterium avium subsp. paratuberculosis
cggcgccggccgggcugcg

SEQ ID NO: 985256 - RNA, 22 nt, Mycobacterium avium subsp. paratuberculosis
cggcgccggaugccagcagguc

SEQ ID NO: 985257 - RNA, 21 nt, Mycobacterium avium subsp. paratuberculosis
cggcgccgcguaccagcgcca

SEQ ID NO: 985258 - RNA, 20 nt, Mycobacterium avium subsp. paratuberculosis
cggcgccggaggccagcucg

SEQ ID NO: 985259 - RNA, 22 nt, Mycobacterium avium subsp. paratuberculosis
cggcgccggaucggcccccggg

SEQ ID NO: 985260 - RNA, 16 nt, Mycobacterium avium subsp. paratuberculosis
cggcgccggacggccc

SEQ ID NO: 985261 - RNA, 14 nt, Mycobacterium avium subsp. paratuberculosis
cggcgccgcgggcg

SEQ ID NO: 985262 - RNA, 14 nt, Mycobacterium avium subsp. paratuberculosis
cggcgccgcggggc

SEQ ID NO: 985263 - RNA, 15 nt, Mycobacterium avium subsp. paratuberculosis
cggcgccgcggggcg

SEQ ID NO: 985264 - RNA, 12 nt, Mycobacterium avium subsp. paratuberculosis
cggcgccgcggg

SEQ ID NO: 985265 - RNA, 14 nt, Mycobacterium avium subsp. paratuberculosis
cggcgccgcggccc

SEQ ID NO: 985266 - RNA, 20 nt, Mycobacterium avium subsp. paratuberculosis
cggcgccgcggcccugcagc

SEQ ID NO: 985267 - RNA, 15 nt, Mycobacterium avium subsp. paratuberculosis
cggcgccgcgacccc

SEQ ID NO: 985268 - RNA, 18 nt, Mycobacterium avium subsp. paratuberculosis
cggcgcagguguccagcc

SEQ ID NO: 985269 - RNA, 21 nt, Mycobacterium avium subsp. paratuberculosis
cggcgcagguuguccagccgg

SEQ ID NO: 985270 - RNA, 20 nt, Mycobacterium avium subsp. paratuberculosis
cggcgcagggcggccggcca

SEQ ID NO: 985271 - RNA, 23 nt, Mycobacterium avium subsp. paratuberculosis
cggcgcagggcggccggccaguc

SEQ ID NO: 985272 - RNA, 16 nt, Mycobacterium avium subsp. paratuberculosis
cggcgcaggcgcgcac

SEQ ID NO: 985273 - RNA, 21 nt, Mycobacterium avium subsp. paratuberculosis
cggcgccacgacugcgcggcc

SEQ ID NO: 985274 - RNA, 22 nt, Mycobacterium avium subsp. paratuberculosis
cggcgccacgccgcgauccggg

SEQ ID NO: 985275 - RNA, 12 nt, Mycobacterium avium subsp. paratuberculosis
cggcgccacccc

SEQ ID NO: 985276 - RNA, 22 nt, Mycobacterium avium subsp. paratuberculosis
cggcgcacgcagugccgcacca

SEQ ID NO: 985277 - RNA, 14 nt, Mycobacterium avium subsp. paratuberculosis
cggcgcaccgcccg

SEQ ID NO: 985278 - RNA, 15 nt, Mycobacterium avium subsp. paratuberculosis
cggcgcagcgccgcg

SEQ ID NO: 985279 - RNA, 19 nt, Mycobacterium avium subsp. paratuberculosis
cggcgcagcgccgcgccga

SEQ ID NO: 985280 - RNA, 18 nt, Mycobacterium avium subsp. paratuberculosis
cggcgcagcucgcgcagc

SEQ ID NO: 985281 - RNA, 21 nt, Mycobacterium avium subsp. paratuberculosis
cggcgcagcacggccacugcc

SEQ ID NO: 985282 - RNA, 20 nt, Mycobacterium avium subsp. paratuberculosis
cggcgcacaucguggcgacg

SEQ ID NO: 985283 - RNA, 16 nt, Mycobacterium avium subsp. paratuberculosis
cggcgcacccgcacga

SEQ ID NO: 985284 - RNA, 13 nt, Mycobacterium avium subsp. paratuberculosis
cggcgcacccggg

SEQ ID NO: 985285 - RNA, 14 nt, Mycobacterium avium subsp. paratuberculosis
cggcgcacccgggc

SEQ ID NO: 985286 - RNA, 22 nt, Mycobacterium avium subsp. paratuberculosis
cggcgcaccuggcgcagcaccg

SEQ ID NO: 985287 - RNA, 13 nt, Mycobacterium avium subsp. paratuberculosis
cggcgccgcgcgc

SEQ ID NO: 985288 - RNA, 14 nt, Mycobacterium avium subsp. paratuberculosis
cggcgccgcgcgcc

SEQ ID NO: 985289 - RNA, 17 nt, Mycobacterium avium subsp. paratuberculosis
cggcgccgcgcgccagc

SEQ ID NO: 985290 - RNA, 22 nt, Mycobacterium avium subsp. paratuberculosis
cggcgccgccggucgcccccuc

SEQ ID NO: 985291 - RNA, 13 nt, Mycobacterium avium subsp. paratuberculosis
cggcgccgcccgg

SEQ ID NO: 985292 - RNA, 14 nt, Mycobacterium avium subsp. paratuberculosis
cggcgccgcccggc

SEQ ID NO: 985293 - RNA, 15 nt, Mycobacterium avium subsp. paratuberculosis
cggcgccgcccgggc

SEQ ID NO: 985294 - RNA, 13 nt, Mycobacterium avium subsp. paratuberculosis
cggcgccgacggg

SEQ ID NO: 985295 - RNA, 18 nt, Mycobacterium avium subsp. paratuberculosis
cggcgccgaccucggcca

SEQ ID NO: 985296 - RNA, 23 nt, Mycobacterium avium subsp. paratuberculosis
cggcgccgacgacgucgcgcagg

SEQ ID NO: 985297 - RNA, 19 nt, Mycobacterium avium subsp. paratuberculosis
cggcgccgaagcccgcagc

SEQ ID NO: 985298 - RNA, 22 nt, Mycobacterium avium subsp. paratuberculosis
cggcgccgaagcccgcagcgaa

SEQ ID NO: 985299 - RNA, 22 nt, Mycobacterium avium subsp. paratuberculosis
cggcgcccaggauucucagcag

SEQ ID NO: 985300 - RNA, 16 nt, Mycobacterium avium subsp. paratuberculosis
cggcgccgaugcagca

SEQ ID NO: 985301 - RNA, 18 nt, Mycobacterium avium subsp. paratuberculosis
cggcgccgauuccgucgg

SEQ ID NO: 985302 - RNA, 16 nt, Mycobacterium avium subsp. paratuberculosis
cggcgcccugcgcgcc

SEQ ID NO: 985303 - RNA, 21 nt, Mycobacterium avium subsp. paratuberculosis
cggcgcccucgccggcggcgc

SEQ ID NO: 985304 - RNA, 16 nt, Mycobacterium avium subsp. paratuberculosis
cggcgcccugcaccca

SEQ ID NO: 985305 - RNA, 17 nt, Mycobacterium avium subsp. paratuberculosis
cggcgcccugcacccag

SEQ ID NO: 985306 - RNA, 16 nt, Mycobacterium avium subsp. paratuberculosis
cggcgcccuucccggu

SEQ ID NO: 985307 - RNA, 20 nt, Mycobacterium avium subsp. paratuberculosis
cggcgccgaaccgggugacg

SEQ ID NO: 985308 - RNA, 16 nt, Mycobacterium avium subsp. paratuberculosis
cggcgcccggcgcgcc

SEQ ID NO: 985309 - RNA, 18 nt, Mycobacterium avium subsp. paratuberculosis
cggcgcccggcccagccg

SEQ ID NO: 985310 - RNA, 14 nt, Mycobacterium avium subsp. paratuberculosis
cggcgcccggccgg

SEQ ID NO: 985311 - RNA, 18 nt, Mycobacterium avium subsp. paratuberculosis
cggcgcccggccggugcu

SEQ ID NO: 985312 - RNA, 17 nt, Mycobacterium avium subsp. paratuberculosis
cggcgcccgcggccucc

SEQ ID NO: 985313 - RNA, 16 nt, Mycobacterium avium subsp. paratuberculosis
cggcgcccgcuccggc

SEQ ID NO: 985314 - RNA, 18 nt, Mycobacterium avium subsp. paratuberculosis
cggcgcccgcuccggcgg

SEQ ID NO: 985315 - RNA, 21 nt, Mycobacterium avium subsp. paratuberculosis
cggcgcccgcaggccgcgagc

SEQ ID NO: 985316 - RNA, 23 nt, Mycobacterium avium subsp. paratuberculosis
cggcgcccgccccgacgugcagc

SEQ ID NO: 985317 - RNA, 18 nt, Mycobacterium avium subsp. paratuberculosis
cggcgccccccugcucgc

SEQ ID NO: 985318 - RNA, 15 nt, Mycobacterium avium subsp. paratuberculosis
cggcgcccacggcca

SEQ ID NO: 985319 - RNA, 16 nt, Mycobacterium avium subsp. paratuberculosis
cggcgccaggccggcg

SEQ ID NO: 985320 - RNA, 16 nt, Mycobacterium avium subsp. paratuberculosis
cggccaacaacgccaa

SEQ ID NO: 985321 - RNA, 22 nt, Mycobacterium avium subsp. paratuberculosis
cggccaacagcagcgccgcggc

SEQ ID NO: 985322 - RNA, 14 nt, Mycobacterium avium subsp. paratuberculosis
cggccaaccgcccg

SEQ ID NO: 985323 - RNA, 22 nt, Mycobacterium avium subsp. paratuberculosis
cggccaacgggaagagcggcgu

SEQ ID NO: 985324 - RNA, 18 nt, Mycobacterium avium subsp. paratuberculosis
cggccaacugcaucgcca

SEQ ID NO: 985325 - RNA, 20 nt, Mycobacterium avium subsp. paratuberculosis
cggccaacugcaucgccagc

SEQ ID NO: 985326 - RNA, 12 nt, Mycobacterium avium subsp. paratuberculosis
cggccaccaccg

SEQ ID NO: 985327 - RNA, 12 nt, Mycobacterium avium subsp. paratuberculosis
cggccaccacca

SEQ ID NO: 985328 - RNA, 16 nt, Mycobacterium avium subsp. paratuberculosis
cggccaccaccacggc

SEQ ID NO: 985329 - RNA, 18 nt, Mycobacterium avium subsp. paratuberculosis
cggccaccaccacggcca

SEQ ID NO: 985330 - RNA, 15 nt, Mycobacterium avium subsp. paratuberculosis
cggccacaccggggc

SEQ ID NO: 985331 - RNA, 17 nt, Mycobacterium avium subsp. paratuberculosis
cggccaaucgcugugcg

SEQ ID NO: 985332 - RNA, 15 nt, Mycobacterium avium subsp. paratuberculosis
cggcauggcgaugac

SEQ ID NO: 985333 - RNA, 18 nt, Mycobacterium avium subsp. paratuberculosis
cggcauggcuggcggcaa

SEQ ID NO: 985334 - RNA, 21 nt, Mycobacterium avium subsp. paratuberculosis
cggcaugaccggccagcaugg

SEQ ID NO: 985335 - RNA, 15 nt, Mycobacterium avium subsp. paratuberculosis
cggcaugccgcccgg

SEQ ID NO: 985336 - RNA, 22 nt, Mycobacterium avium subsp. paratuberculosis
cggcagcggggcgaacccggcg

SEQ ID NO: 985337 - RNA, 17 nt, Mycobacterium avium subsp. paratuberculosis
cggcagcgucgccagcc

SEQ ID NO: 985338 - RNA, 23 nt, Mycobacterium avium subsp. paratuberculosis
cggccacucgcguccccgcgccg

SEQ ID NO: 985339 - RNA, 13 nt, Mycobacterium avium subsp. paratuberculosis
cggccacugcccc

SEQ ID NO: 985340 - RNA, 16 nt, Mycobacterium avium subsp. paratuberculosis
cggccacugccccggc

SEQ ID NO: 985341 - RNA, 18 nt, Mycobacterium avium subsp. paratuberculosis
cggccacugccccggcga

SEQ ID NO: 985342 - RNA, 15 nt, Mycobacterium avium subsp. paratuberculosis
cggccagauagauga

SEQ ID NO: 985343 - RNA, 15 nt, Mycobacterium avium subsp. paratuberculosis
cggccagaucggcca

SEQ ID NO: 985344 - RNA, 18 nt, Mycobacterium avium subsp. paratuberculosis
cggccaccuugcgcgggu

SEQ ID NO: 985345 - RNA, 23 nt, Mycobacterium avium subsp. paratuberculosis
cggccaccuugucggcgcccagg

SEQ ID NO: 985346 - RNA, 16 nt, Mycobacterium avium subsp. paratuberculosis
cggccacgacgcgcca

SEQ ID NO: 985347 - RNA, 23 nt, Mycobacterium avium subsp. paratuberculosis
cggccacgcaggcguccagggcc

SEQ ID NO: 985348 - RNA, 14 nt, Mycobacterium avium subsp. paratuberculosis
cggccacgccgggc

SEQ ID NO: 985349 - RNA, 18 nt, Mycobacterium avium subsp. paratuberculosis
cggccaccugggcggggc

SEQ ID NO: 985350 - RNA, 21 nt, Mycobacterium avium subsp. paratuberculosis
cggccaccccggugaccuccc

SEQ ID NO: 985351 - RNA, 14 nt, Mycobacterium avium subsp. paratuberculosis
cggccaccagcgcg

SEQ ID NO: 985352 - RNA, 12 nt, Mycobacterium avium subsp. paratuberculosis
cggccaccgccg

SEQ ID NO: 985353 - RNA, 18 nt, Mycobacterium avium subsp. paratuberculosis
cggccaccgcgccccggc

SEQ ID NO: 985354 - RNA, 14 nt, Mycobacterium avium subsp. paratuberculosis
cggccaccgcgccg

SEQ ID NO: 985355 - RNA, 15 nt, Mycobacterium avium subsp. paratuberculosis
cggccaccgcgcggc

SEQ ID NO: 985356 - RNA, 15 nt, Mycobacterium avium subsp. paratuberculosis
cggccaccgcgcggu

SEQ ID NO: 985357 - RNA, 17 nt, Mycobacterium avium subsp. paratuberculosis
cggccaccgcggccagc

SEQ ID NO: 985358 - RNA, 14 nt, Mycobacterium avium subsp. paratuberculosis
cggccaccggcgcg

SEQ ID NO: 985359 - RNA, 21 nt, Mycobacterium avium subsp. paratuberculosis
cggccaccaucuccgcggcgc

SEQ ID NO: 985360 - RNA, 15 nt, Mycobacterium avium subsp. paratuberculosis
cggccaccagggcga

SEQ ID NO: 985361 - RNA, 18 nt, Mycobacterium avium subsp. paratuberculosis
cggccaccagggcgaccg

SEQ ID NO: 985362 - RNA, 23 nt, Mycobacterium avium subsp. paratuberculosis
cggccaccagggucucgcgcagc

SEQ ID NO: 985363 - RNA, 17 nt, Mycobacterium avium subsp. paratuberculosis
cggccaccagcgcccgc

SEQ ID NO: 985364 - RNA, 17 nt, Mycobacterium avium subsp. paratuberculosis
cggccaccaccgccacg

SEQ ID NO: 985365 - RNA, 19 nt, Mycobacterium avium subsp. paratuberculosis
cggccaccaccgccacggc

SEQ ID NO: 985366 - RNA, 12 nt, Mycobacterium avium subsp. paratuberculosis
cggccaccaccu

SEQ ID NO: 985367 - RNA, 13 nt, Mycobacterium avium subsp. paratuberculosis
cggccaccaccuc

SEQ ID NO: 985368 - RNA, 17 nt, Mycobacterium avium subsp. paratuberculosis
cggccaccacggcaccg

SEQ ID NO: 985369 - RNA, 14 nt, Mycobacterium avium subsp. paratuberculosis
cggccaccagccgg

SEQ ID NO: 985370 - RNA, 18 nt, Mycobacterium avium subsp. paratuberculosis
cggccaccagccggccgg

SEQ ID NO: 985371 - RNA, 15 nt, Mycobacterium avium subsp. paratuberculosis
cggccaccagcgccc

SEQ ID NO: 985372 - RNA, 15 nt, Mycobacterium avium subsp. paratuberculosis
cggccagggcggcgc

SEQ ID NO: 985373 - RNA, 19 nt, Mycobacterium avium subsp. paratuberculosis
cggccagggcggcgccggc

SEQ ID NO: 985374 - RNA, 12 nt, Mycobacterium avium subsp. paratuberculosis
cggccagggccg

SEQ ID NO: 985375 - RNA, 15 nt, Mycobacterium avium subsp. paratuberculosis
cggccagggccgccg

SEQ ID NO: 985376 - RNA, 16 nt, Mycobacterium avium subsp. paratuberculosis
cggccagggccgccgc

SEQ ID NO: 985377 - RNA, 21 nt, Mycobacterium avium subsp. paratuberculosis
cggccagggccgccgcauacc

SEQ ID NO: 985378 - RNA, 14 nt, Mycobacterium avium subsp. paratuberculosis
cggccaggcgccca

SEQ ID NO: 985379 - RNA, 14 nt, Mycobacterium avium subsp. paratuberculosis
cggccaggcccagc

SEQ ID NO: 985380 - RNA, 16 nt, Mycobacterium avium subsp. paratuberculosis
cggccaggcccagccc

SEQ ID NO: 985381 - RNA, 19 nt, Mycobacterium avium subsp. paratuberculosis
cggccaggaucucgcgggc

SEQ ID NO: 985382 - RNA, 21 nt, Mycobacterium avium subsp. paratuberculosis
cggccaggaucucgcgggccc

SEQ ID NO: 985383 - RNA, 18 nt, Mycobacterium avium subsp. paratuberculosis
cggccagcggcuuggccg

SEQ ID NO: 985384 - RNA, 17 nt, Mycobacterium avium subsp. paratuberculosis
cggccagcgggcggccc

SEQ ID NO: 985385 - RNA, 16 nt, Mycobacterium avium subsp. paratuberculosis
cggccagcgcggcggc

SEQ ID NO: 985386 - RNA, 15 nt, Mycobacterium avium subsp. paratuberculosis
cggccagcgcggcgg

SEQ ID NO: 985387 - RNA, 16 nt, Mycobacterium avium subsp. paratuberculosis
cggccagcacacccuc

SEQ ID NO: 985388 - RNA, 15 nt, Mycobacterium avium subsp. paratuberculosis
cggccagcaccacca

SEQ ID NO: 985389 - RNA, 15 nt, Mycobacterium avium subsp. paratuberculosis
cggccagcacggcca

SEQ ID NO: 985390 - RNA, 14 nt, Mycobacterium avium subsp. paratuberculosis
cggccagcacggcg

SEQ ID NO: 985391 - RNA, 11 nt, Mycobacterium avium subsp. paratuberculosis
cggccagcagc

SEQ ID NO: 985392 - RNA, 12 nt, Mycobacterium avium subsp. paratuberculosis
cggccagcagca

SEQ ID NO: 985393 - RNA, 14 nt, Mycobacterium avium subsp. paratuberculosis
cggccagcacccgc

SEQ ID NO: 985394 - RNA, 22 nt, Mycobacterium avium subsp. paratuberculosis
cggccagcgcgcgggcgcgcgc

SEQ ID NO: 985395 - RNA, 20 nt, Mycobacterium avium subsp. paratuberculosis
cggccagcugauagccgccc

SEQ ID NO: 985396 - RNA, 18 nt, Mycobacterium avium subsp. paratuberculosis
cggccagcgucgcgccgc

SEQ ID NO: 985397 - RNA, 21 nt, Mycobacterium avium subsp. paratuberculosis
cggccagcgucgcgccgccac

SEQ ID NO: 985398 - RNA, 20 nt, Mycobacterium avium subsp. paratuberculosis
cggccagcgucuccggcggg

SEQ ID NO: 985399 - RNA, 17 nt, Mycobacterium avium subsp. paratuberculosis
cggccagcguggcgcgc

SEQ ID NO: 985400 - RNA, 20 nt, Mycobacterium avium subsp. paratuberculosis
cggccagcguggcgcgcccc

SEQ ID NO: 985401 - RNA, 23 nt, Mycobacterium avium subsp. paratuberculosis
cggccagcguggcgcgccccggc

SEQ ID NO: 985402 - RNA, 16 nt, Mycobacterium avium subsp. paratuberculosis
cggccagcguguugcu

SEQ ID NO: 985403 - RNA, 21 nt, Mycobacterium avium subsp. paratuberculosis
cggccagcucaccggccaggg

SEQ ID NO: 985404 - RNA, 14 nt, Mycobacterium avium subsp. paratuberculosis
cggccagcucccgg

SEQ ID NO: 985405 - RNA, 18 nt, Mycobacterium avium subsp. paratuberculosis
cggccagcucgccgccga

SEQ ID NO: 985406 - RNA, 13 nt, Mycobacterium avium subsp. paratuberculosis
cggaucagcaccg

SEQ ID NO: 985407 - RNA, 16 nt, Mycobacterium avium subsp. paratuberculosis
cggauacccgcggccu

SEQ ID NO: 985408 - RNA, 14 nt, Mycobacterium avium subsp. paratuberculosis
cggcaaccugggcg

SEQ ID NO: 985409 - RNA, 22 nt, Mycobacterium avium subsp. paratuberculosis
cggauccaccaauucgcgcugc

SEQ ID NO: 985410 - RNA, 16 nt, Mycobacterium avium subsp. paratuberculosis
cggaucaguaccggcg

SEQ ID NO: 985411 - RNA, 18 nt, Mycobacterium avium subsp. paratuberculosis
cggauccccgcgcugggc

SEQ ID NO: 985412 - RNA, 21 nt, Mycobacterium avium subsp. paratuberculosis
cggcaauccggccccgcugcc

SEQ ID NO: 985413 - RNA, 16 nt, Mycobacterium avium subsp. paratuberculosis
cggcaacuggccgccc

SEQ ID NO: 985414 - RNA, 15 nt, Mycobacterium avium subsp. paratuberculosis
cggcaaguccggguc

SEQ ID NO: 985415 - RNA, 18 nt, Mycobacterium avium subsp. paratuberculosis
cggcaaguccggguccua

SEQ ID NO: 985416 - RNA, 19 nt, Mycobacterium avium subsp. paratuberculosis
cggcacgguuggccggccc

SEQ ID NO: 985417 - RNA, 23 nt, Mycobacterium avium subsp. paratuberculosis
cggcacgguuggccggcccgccc

SEQ ID NO: 985418 - RNA, 15 nt, Mycobacterium avium subsp. paratuberculosis
cggcacgucgagcag

SEQ ID NO: 985419 - RNA, 22 nt, Mycobacterium avium subsp. paratuberculosis
cggcacgucgagcuccucggcc

SEQ ID NO: 985420 - RNA, 16 nt, Mycobacterium avium subsp. paratuberculosis
cggcacguugcccagg

SEQ ID NO: 985421 - RNA, 19 nt, Mycobacterium avium subsp. paratuberculosis
cggcaccgugccgcgcggc

SEQ ID NO: 985422 - RNA, 14 nt, Mycobacterium avium subsp. paratuberculosis
cggcaccuccagcc

SEQ ID NO: 985423 - RNA, 13 nt, Mycobacterium avium subsp. paratuberculosis
cggcacgcgcgcc

SEQ ID NO: 985424 - RNA, 17 nt, Mycobacterium avium subsp. paratuberculosis
cggcacgcgcgccggag

SEQ ID NO: 985425 - RNA, 14 nt, Mycobacterium avium subsp. paratuberculosis
cggcaccgcggcgg

SEQ ID NO: 985426 - RNA, 22 nt, Mycobacterium avium subsp. paratuberculosis
cggcaccgcggucugcgccagc

SEQ ID NO: 985427 - RNA, 13 nt, Mycobacterium avium subsp. paratuberculosis
cggcaccgcgagc

SEQ ID NO: 985428 - RNA, 16 nt, Mycobacterium avium subsp. paratuberculosis
cggcaccgccggcggc

SEQ ID NO: 985429 - RNA, 18 nt, Mycobacterium avium subsp. paratuberculosis
cggcaccgccggcggccu

SEQ ID NO: 985430 - RNA, 14 nt, Mycobacterium avium subsp. paratuberculosis
cggcaccgccgcgg

SEQ ID NO: 985431 - RNA, 14 nt, Mycobacterium avium subsp. paratuberculosis
cggcacaccgcgcg

SEQ ID NO: 985432 - RNA, 13 nt, Mycobacterium avium subsp. paratuberculosis
cggcacacgcgga

SEQ ID NO: 985433 - RNA, 23 nt, Mycobacterium avium subsp. paratuberculosis
cggcaauugaauucgaccacggc

SEQ ID NO: 985434 - RNA, 17 nt, Mycobacterium avium subsp. paratuberculosis
cggcagcaggugcacca

SEQ ID NO: 985435 - RNA, 20 nt, Mycobacterium avium subsp. paratuberculosis
cggcagcaggugcaccaccc

SEQ ID NO: 985436 - RNA, 18 nt, Mycobacterium avium subsp. paratuberculosis
cggcagcagcugcgucgg

SEQ ID NO: 985437 - RNA, 16 nt, Mycobacterium avium subsp. paratuberculosis
cggcagaucgcggccc

SEQ ID NO: 985438 - RNA, 14 nt, Mycobacterium avium subsp. paratuberculosis
cggcagccgcagcg

SEQ ID NO: 985439 - RNA, 13 nt, Mycobacterium avium subsp. paratuberculosis
cggcagcccggag

SEQ ID NO: 985440 - RNA, 21 nt, Mycobacterium avium subsp. paratuberculosis
cggcagccacggcagcugcag

SEQ ID NO: 985441 - RNA, 17 nt, Mycobacterium avium subsp. paratuberculosis
cggcagccagccuggcg

SEQ ID NO: 985442 - RNA, 21 nt, Mycobacterium avium subsp. paratuberculosis
cggcagcaaccggcggcuggg

SEQ ID NO: 985443 - RNA, 12 nt, Mycobacterium avium subsp. paratuberculosis
cggcagcagcac

SEQ ID NO: 985444 - RNA, 14 nt, Mycobacterium avium subsp. paratuberculosis
cggcagcagcacca

SEQ ID NO: 985445 - RNA, 14 nt, Mycobacterium avium subsp. paratuberculosis
cggcagcaccgccg

SEQ ID NO: 985446 - RNA, 21 nt, Mycobacterium avium subsp. paratuberculosis
cggcagcacaccuuccaccac

SEQ ID NO: 985447 - RNA, 23 nt, Mycobacterium avium subsp. paratuberculosis
cggcagcacaccuuccaccaccg

SEQ ID NO: 985448 - RNA, 14 nt, Mycobacterium avium subsp. paratuberculosis
cggcacgucggcca

SEQ ID NO: 985449 - RNA, 15 nt, Mycobacterium avium subsp. paratuberculosis
cggcacuaccgccuc

SEQ ID NO: 985450 - RNA, 22 nt, Mycobacterium avium subsp. paratuberculosis
cggcacuaccgccucgccagcc

SEQ ID NO: 985451 - RNA, 18 nt, Mycobacterium avium subsp. paratuberculosis
cgcugccggggugcagca

SEQ ID NO: 985452 - RNA, 14 nt, Mycobacterium avium subsp. paratuberculosis
cgcugccggggcgc

SEQ ID NO: 985453 - RNA, 17 nt, Mycobacterium avium subsp. paratuberculosis
cgcugccggggcgcagc

SEQ ID NO: 985454 - RNA, 16 nt, Mycobacterium avium subsp. paratuberculosis
cgcugccguccggcgg

SEQ ID NO: 985455 - RNA, 14 nt, Mycobacterium avium subsp. paratuberculosis
cgcugccggcccga

SEQ ID NO: 985456 - RNA, 13 nt, Mycobacterium avium subsp. paratuberculosis
cgcugccggccgg

SEQ ID NO: 985457 - RNA, 15 nt, Mycobacterium avium subsp. paratuberculosis
cgcugccgcgcgccg

SEQ ID NO: 985458 - RNA, 14 nt, Mycobacterium avium subsp. paratuberculosis
cgcugccgcgcccc

SEQ ID NO: 985459 - RNA, 16 nt, Mycobacterium avium subsp. paratuberculosis
cgcugccgccgccgcu

SEQ ID NO: 985460 - RNA, 16 nt, Mycobacterium avium subsp. paratuberculosis
cgcugccgccgccggc

SEQ ID NO: 985461 - RNA, 21 nt, Mycobacterium avium subsp. paratuberculosis
cgcuuccagcaccacccgguc

SEQ ID NO: 985462 - RNA, 14 nt, Mycobacterium avium subsp. paratuberculosis
cgcuucccacccgg

SEQ ID NO: 985463 - RNA, 16 nt, Mycobacterium avium subsp. paratuberculosis
cgcuugaccagcaaca

SEQ ID NO: 985464 - RNA, 22 nt, Mycobacterium avium subsp. paratuberculosis
cgcuugaccucgccgagcagcc

SEQ ID NO: 985465 - RNA, 19 nt, Mycobacterium avium subsp. paratuberculosis
cgcuugcggcgcagccagc

SEQ ID NO: 985466 - RNA, 17 nt, Mycobacterium avium subsp. paratuberculosis
cgcuugcguucccagcc

SEQ ID NO: 985467 - RNA, 21 nt, Mycobacterium avium subsp. paratuberculosis
cgcuugcguucccagcccggc

SEQ ID NO: 985468 - RNA, 22 nt, Mycobacterium avium subsp. paratuberculosis
cgcuugcguucccagcccggcc

SEQ ID NO: 985469 - RNA, 14 nt, Mycobacterium avium subsp. paratuberculosis
cgcuucggccagcg

SEQ ID NO: 985470 - RNA, 21 nt, Mycobacterium avium subsp. paratuberculosis
cgcuucguggacgaacgcggc

SEQ ID NO: 985471 - RNA, 17 nt, Mycobacterium avium subsp. paratuberculosis
cgcuuuggaccagggcg

SEQ ID NO: 985472 - RNA, 19 nt, Mycobacterium avium subsp. paratuberculosis
cgcuuugaucagcucgccg

SEQ ID NO: 985473 - RNA, 23 nt, Mycobacterium avium subsp. paratuberculosis
cgcuuucgccgggcgucacgcca

SEQ ID NO: 985474 - RNA, 17 nt, Mycobacterium avium subsp. paratuberculosis
cgcuuucgcgcacgcca

SEQ ID NO: 985475 - RNA, 21 nt, Mycobacterium avium subsp. paratuberculosis
cgcuuucgcgcacgccaucgc

SEQ ID NO: 985476 - RNA, 15 nt, Mycobacterium avium subsp. paratuberculosis
cgcuugucgcagacc

SEQ ID NO: 985477 - RNA, 22 nt, Mycobacterium avium subsp. paratuberculosis
cggaacagcuggucccacagcg

SEQ ID NO: 985478 - RNA, 21 nt, Mycobacterium avium subsp. paratuberculosis
cggaacagccggcucagggug

SEQ ID NO: 985479 - RNA, 14 nt, Mycobacterium avium subsp. paratuberculosis
cggaaccgacaccu

SEQ ID NO: 985480 - RNA, 23 nt, Mycobacterium avium subsp. paratuberculosis
cggaaucacuuccgcggcaaggc

SEQ ID NO: 985481 - RNA, 19 nt, Mycobacterium avium subsp. paratuberculosis
cggaaucgcccgggccagg

SEQ ID NO: 985482 - RNA, 20 nt, Mycobacterium avium subsp. paratuberculosis
cggaaucgcccgggccaggu

SEQ ID NO: 985483 - RNA, 22 nt, Mycobacterium avium subsp. paratuberculosis
cggaaguucucgccgugcagca

SEQ ID NO: 985484 - RNA, 14 nt, Mycobacterium avium subsp. paratuberculosis
cggaauacagcagc

SEQ ID NO: 985485 - RNA, 15 nt, Mycobacterium avium subsp. paratuberculosis
cggaauacagcagcu

SEQ ID NO: 985486 - RNA, 14 nt, Mycobacterium avium subsp. paratuberculosis
cggaagccccaggc

SEQ ID NO: 985487 - RNA, 20 nt, Mycobacterium avium subsp. paratuberculosis
cggaagaucagcaggcuggc

SEQ ID NO: 985488 - RNA, 16 nt, Mycobacterium avium subsp. paratuberculosis
cggaaggccgcgcggg

SEQ ID NO: 985489 - RNA, 19 nt, Mycobacterium avium subsp. paratuberculosis
cggaaggccaaggccagca

SEQ ID NO: 985490 - RNA, 13 nt, Mycobacterium avium subsp. paratuberculosis
cggaaggccagcu

SEQ ID NO: 985491 - RNA, 20 nt, Mycobacterium avium subsp. paratuberculosis
cggaagcgguugagccacaa

SEQ ID NO: 985492 - RNA, 13 nt, Mycobacterium avium subsp. paratuberculosis
cggagaccagcag

SEQ ID NO: 985493 - RNA, 17 nt, Mycobacterium avium subsp. paratuberculosis
cggagaccaggucggcc

SEQ ID NO: 985494 - RNA, 15 nt, Mycobacterium avium subsp. paratuberculosis
cggagacgaccaggu

SEQ ID NO: 985495 - RNA, 23 nt, Mycobacterium avium subsp. paratuberculosis
cggagacgacucuuccaggacaa

SEQ ID NO: 985496 - RNA, 22 nt, Mycobacterium avium subsp. paratuberculosis
cggagacguugccgcacaccgc

SEQ ID NO: 985497 - RNA, 15 nt, Mycobacterium avium subsp. paratuberculosis
cggacuugaugcugc

SEQ ID NO: 985498 - RNA, 20 nt, Mycobacterium avium subsp. paratuberculosis
cggacuugaugcugcccggc

SEQ ID NO: 985499 - RNA, 22 nt, Mycobacterium avium subsp. paratuberculosis
cggagaaaccgucggcccgcca

SEQ ID NO: 985500 - RNA, 21 nt, Mycobacterium avium subsp. paratuberculosis
cggacuauacacgccuggaca

SEQ ID NO: 985501 - RNA, 19 nt, Mycobacterium avium subsp. paratuberculosis
cggacgugaucgcgguggc

SEQ ID NO: 985502 - RNA, 16 nt, Mycobacterium avium subsp. paratuberculosis
cggacgggaccacccg

SEQ ID NO: 985503 - RNA, 17 nt, Mycobacterium avium subsp. paratuberculosis
cggacgggaccacccgc

SEQ ID NO: 985504 - RNA, 15 nt, Mycobacterium avium subsp. paratuberculosis
cggacugcuugggcg

SEQ ID NO: 985505 - RNA, 18 nt, Mycobacterium avium subsp. paratuberculosis
cggacuggcugagcagca

SEQ ID NO: 985506 - RNA, 22 nt, Mycobacterium avium subsp. paratuberculosis
cggaggccugcgcggccgcguc

SEQ ID NO: 985507 - RNA, 19 nt, Mycobacterium avium subsp. paratuberculosis
cggaggguauucgugugcu

SEQ ID NO: 985508 - RNA, 15 nt, Mycobacterium avium subsp. paratuberculosis
cggaggugccgcgcg

SEQ ID NO: 985509 - RNA, 18 nt, Mycobacterium avium subsp. paratuberculosis
cggaggugccgcgcggca

SEQ ID NO: 985510 - RNA, 18 nt, Mycobacterium avium subsp. paratuberculosis
cggaggucagcggcccga

SEQ ID NO: 985511 - RNA, 21 nt, Mycobacterium avium subsp. paratuberculosis
cggaggucagcggcccgauca

SEQ ID NO: 985512 - RNA, 22 nt, Mycobacterium avium subsp. paratuberculosis
cggaggucagcggcccgaucac

SEQ ID NO: 985513 - RNA, 14 nt, Mycobacterium avium subsp. paratuberculosis
cggaguccggcucg

SEQ ID NO: 985514 - RNA, 22 nt, Mycobacterium avium subsp. paratuberculosis
cggaguaggcgccgccgcgcag

SEQ ID NO: 985515 - RNA, 18 nt, Mycobacterium avium subsp. paratuberculosis
cggaguaguccagcaccg

SEQ ID NO: 985516 - RNA, 14 nt, Mycobacterium avium subsp. paratuberculosis
cggaguccaccggc

SEQ ID NO: 985517 - RNA, 19 nt, Mycobacterium avium subsp. paratuberculosis
cggaguucgcccgcagcac

SEQ ID NO: 985518 - RNA, 17 nt, Mycobacterium avium subsp. paratuberculosis
cggagugaccgccagca

SEQ ID NO: 985519 - RNA, 20 nt, Mycobacterium avium subsp. paratuberculosis
cggagugaccgccagcaccg

SEQ ID NO: 985520 - RNA, 22 nt, Mycobacterium avium subsp. paratuberculosis
cggagugaccgccagcaccgcg

SEQ ID NO: 985521 - RNA, 20 nt, Mycobacterium avium subsp. paratuberculosis
cggagucgcuguuggcgacg

SEQ ID NO: 985522 - RNA, 15 nt, Mycobacterium avium subsp. paratuberculosis
cggagucgucggcgc

SEQ ID NO: 985523 - RNA, 23 nt, Mycobacterium avium subsp. paratuberculosis
cggaauugaagcccugcucggug

SEQ ID NO: 985524 - RNA, 17 nt, Mycobacterium avium subsp. paratuberculosis
cggaauggcaaggccag

SEQ ID NO: 985525 - RNA, 19 nt, Mycobacterium avium subsp. paratuberculosis
cggaauggcaaggccagca

SEQ ID NO: 985526 - RNA, 21 nt, Mycobacterium avium subsp. paratuberculosis
cggaauggcaaggccagcaac

SEQ ID NO: 985527 - RNA, 15 nt, Mycobacterium avium subsp. paratuberculosis
cggaauggcagcagc

SEQ ID NO: 985528 - RNA, 16 nt, Mycobacterium avium subsp. paratuberculosis
cggaauggcagcagcc

SEQ ID NO: 985529 - RNA, 17 nt, Mycobacterium avium subsp. paratuberculosis
cggaauggcagcagccg

SEQ ID NO: 985530 - RNA, 15 nt, Mycobacterium avium subsp. paratuberculosis
cggaaugaacgcggc

SEQ ID NO: 985531 - RNA, 18 nt, Mycobacterium avium subsp. paratuberculosis
cggaaugaacugccgcgg

SEQ ID NO: 985532 - RNA, 16 nt, Mycobacterium avium subsp. paratuberculosis
cggacagggcggcgac

SEQ ID NO: 985533 - RNA, 18 nt, Mycobacterium avium subsp. paratuberculosis
cggacagcucgccggccg

SEQ ID NO: 985534 - RNA, 15 nt, Mycobacterium avium subsp. paratuberculosis
cggacaucggcagca

SEQ ID NO: 985535 - RNA, 16 nt, Mycobacterium avium subsp. paratuberculosis
cggacaucggcagcag

SEQ ID NO: 985536 - RNA, 13 nt, Mycobacterium avium subsp. paratuberculosis
cggacacccgcgc

SEQ ID NO: 985537 - RNA, 20 nt, Mycobacterium avium subsp. paratuberculosis
cggacaccgaaccgccccgc

SEQ ID NO: 985538 - RNA, 14 nt, Mycobacterium avium subsp. paratuberculosis
cggacaccaccgcg

SEQ ID NO: 985539 - RNA, 13 nt, Mycobacterium avium subsp. paratuberculosis
cggacaccccggc

SEQ ID NO: 985540 - RNA, 18 nt, Mycobacterium avium subsp. paratuberculosis
cggacacggccagcgccg

SEQ ID NO: 985541 - RNA, 21 nt, Mycobacterium avium subsp. paratuberculosis
cggacacggccagcgccguca

SEQ ID NO: 985542 - RNA, 21 nt, Mycobacterium avium subsp. paratuberculosis
cggaccugggugcgccacugc

SEQ ID NO: 985543 - RNA, 19 nt, Mycobacterium avium subsp. paratuberculosis
cggaccuuggugucggcga

SEQ ID NO: 985544 - RNA, 16 nt, Mycobacterium avium subsp. paratuberculosis
cggacgaugcgcaccc

SEQ ID NO: 985545 - RNA, 23 nt, Mycobacterium avium subsp. paratuberculosis
cggacgaugcgcacccccggggc

SEQ ID NO: 985546 - RNA, 19 nt, Mycobacterium avium subsp. paratuberculosis
cggacgccggcagccgcuc

SEQ ID NO: 985547 - RNA, 16 nt, Mycobacterium avium subsp. paratuberculosis
cggacgcggccagcgc

SEQ ID NO: 985548 - RNA, 17 nt, Mycobacterium avium subsp. paratuberculosis
cggacgcggcggacgau

SEQ ID NO: 985549 - RNA, 18 nt, Mycobacterium avium subsp. paratuberculosis
cggaccacguccccgggc

SEQ ID NO: 985550 - RNA, 16 nt, Mycobacterium avium subsp. paratuberculosis
cggaccacccaggugg

SEQ ID NO: 985551 - RNA, 22 nt, Mycobacterium avium subsp. paratuberculosis
cggaccaggguggccccagccc

SEQ ID NO: 985552 - RNA, 20 nt, Mycobacterium avium subsp. paratuberculosis
cggaccaucuacgaccucga

SEQ ID NO: 985553 - RNA, 13 nt, Mycobacterium avium subsp. paratuberculosis
cggacccagcccg

SEQ ID NO: 985554 - RNA, 21 nt, Mycobacterium avium subsp. paratuberculosis
cggacccagcccggcgacgaa

SEQ ID NO: 985555 - RNA, 14 nt, Mycobacterium avium subsp. paratuberculosis
cggaccccacagcg

SEQ ID NO: 985556 - RNA, 17 nt, Mycobacterium avium subsp. paratuberculosis
cggaccccacagcgcgc

SEQ ID NO: 985557 - RNA, 14 nt, Mycobacterium avium subsp. paratuberculosis
cggaccccgaugcg

SEQ ID NO: 985558 - RNA, 18 nt, Mycobacterium avium subsp. paratuberculosis
cggaccggcucguagcug

SEQ ID NO: 985559 - RNA, 14 nt, Mycobacterium avium subsp. paratuberculosis
cggaccgggcgggc

SEQ ID NO: 985560 - RNA, 20 nt, Mycobacterium avium subsp. paratuberculosis
cggaccgggcgggcugcggg

SEQ ID NO: 985561 - RNA, 20 nt, Mycobacterium avium subsp. paratuberculosis
cggaccgggugaccggcgcg

SEQ ID NO: 985562 - RNA, 21 nt, Mycobacterium avium subsp. paratuberculosis
cggaccgccgcggcgcccggc

SEQ ID NO: 985563 - RNA, 21 nt, Mycobacterium avium subsp. paratuberculosis
cggaccgcgcgggccagcgcc

SEQ ID NO: 985564 - RNA, 16 nt, Mycobacterium avium subsp. paratuberculosis
cggaccgcggucgggu

SEQ ID NO: 985565 - RNA, 12 nt, Mycobacterium avium subsp. paratuberculosis
cgcuccuccucg

SEQ ID NO: 985566 - RNA, 13 nt, Mycobacterium avium subsp. paratuberculosis
cgcuccuccucgc

SEQ ID NO: 985567 - RNA, 15 nt, Mycobacterium avium subsp. paratuberculosis
cgcuccugaaucggu

SEQ ID NO: 985568 - RNA, 21 nt, Mycobacterium avium subsp. paratuberculosis
cgcuccugcaggccgagccgc

SEQ ID NO: 985569 - RNA, 17 nt, Mycobacterium avium subsp. paratuberculosis
cgcuccggcggacccag

SEQ ID NO: 985570 - RNA, 16 nt, Mycobacterium avium subsp. paratuberculosis
cgcuccggcccgagca

SEQ ID NO: 985571 - RNA, 22 nt, Mycobacterium avium subsp. paratuberculosis
cgcucgacgaguuccucgugcg

SEQ ID NO: 985572 - RNA, 17 nt, Mycobacterium avium subsp. paratuberculosis
cgcucgaacacccggcu

SEQ ID NO: 985573 - RNA, 13 nt, Mycobacterium avium subsp. paratuberculosis
cgcucgaccccuc

SEQ ID NO: 985574 - RNA, 15 nt, Mycobacterium avium subsp. paratuberculosis
cgcucgacggccggc

SEQ ID NO: 985575 - RNA, 16 nt, Mycobacterium avium subsp. paratuberculosis
cgcucgacggccggcg

SEQ ID NO: 985576 - RNA, 17 nt, Mycobacterium avium subsp. paratuberculosis
cgcucgcacaacccgcc

SEQ ID NO: 985577 - RNA, 20 nt, Mycobacterium avium subsp. paratuberculosis
cgcucgcacaacccgcccgg

SEQ ID NO: 985578 - RNA, 15 nt, Mycobacterium avium subsp. paratuberculosis
cgcucgcaccagcgc

SEQ ID NO: 985579 - RNA, 21 nt, Mycobacterium avium subsp. paratuberculosis
cgcucgcccagcgcggcggcc

SEQ ID NO: 985580 - RNA, 14 nt, Mycobacterium avium subsp. paratuberculosis
cgcucgccgcgggu

SEQ ID NO: 985581 - RNA, 22 nt, Mycobacterium avium subsp. paratuberculosis
cgcucgccggcggccgccacgc

SEQ ID NO: 985582 - RNA, 14 nt, Mycobacterium avium subsp. paratuberculosis
cgcucaugcccgcc

SEQ ID NO: 985583 - RNA, 16 nt, Mycobacterium avium subsp. paratuberculosis
cgcucaugcccgccac

SEQ ID NO: 985584 - RNA, 22 nt, Mycobacterium avium subsp. paratuberculosis
cgcuccagaugcggugguggga

SEQ ID NO: 985585 - RNA, 16 nt, Mycobacterium avium subsp. paratuberculosis
cgcuccaccgcguccu

SEQ ID NO: 985586 - RNA, 21 nt, Mycobacterium avium subsp. paratuberculosis
cgcuccacaucugccggcaga

SEQ ID NO: 985587 - RNA, 22 nt, Mycobacterium avium subsp. paratuberculosis
cgcuccaccagguucgcgcagc

SEQ ID NO: 985588 - RNA, 14 nt, Mycobacterium avium subsp. paratuberculosis
cgcucccggcgccg

SEQ ID NO: 985589 - RNA, 19 nt, Mycobacterium avium subsp. paratuberculosis
cgcucccgguagagcggca

SEQ ID NO: 985590 - RNA, 18 nt, Mycobacterium avium subsp. paratuberculosis
cgcuccauggcggcgacc

SEQ ID NO: 985591 - RNA, 16 nt, Mycobacterium avium subsp. paratuberculosis
cgcuccaugaaccggu

SEQ ID NO: 985592 - RNA, 13 nt, Mycobacterium avium subsp. paratuberculosis
cgcuccagccacu

SEQ ID NO: 985593 - RNA, 12 nt, Mycobacterium avium subsp. paratuberculosis
cgcuccagcagg

SEQ ID NO: 985594 - RNA, 14 nt, Mycobacterium avium subsp. paratuberculosis
cgcuccagcggcca

SEQ ID NO: 985595 - RNA, 17 nt, Mycobacterium avium subsp. paratuberculosis
cgcuccagcggccacac

SEQ ID NO: 985596 - RNA, 13 nt, Mycobacterium avium subsp. paratuberculosis
cgcugcagcaugg

SEQ ID NO: 985597 - RNA, 20 nt, Mycobacterium avium subsp. paratuberculosis
cgcugcagccgguccggcgg

SEQ ID NO: 985598 - RNA, 18 nt, Mycobacterium avium subsp. paratuberculosis
cgcugcagcgccgcccgc

SEQ ID NO: 985599 - RNA, 14 nt, Mycobacterium avium subsp. paratuberculosis
cgcugcagcggcgg

SEQ ID NO: 985600 - RNA, 21 nt, Mycobacterium avium subsp. paratuberculosis
cgcugcaggcccggguagcgc

SEQ ID NO: 985601 - RNA, 18 nt, Mycobacterium avium subsp. paratuberculosis
cgcugcaguagccggcca

SEQ ID NO: 985602 - RNA, 19 nt, Mycobacterium avium subsp. paratuberculosis
cgcugcauagucggcccga

SEQ ID NO: 985603 - RNA, 15 nt, Mycobacterium avium subsp. paratuberculosis
cgcugcauccgcagc

SEQ ID NO: 985604 - RNA, 20 nt, Mycobacterium avium subsp. paratuberculosis
cgcugcauccgcagcaccag

SEQ ID NO: 985605 - RNA, 13 nt, Mycobacterium avium subsp. paratuberculosis
cgcugcagcagcc

SEQ ID NO: 985606 - RNA, 19 nt, Mycobacterium avium subsp. paratuberculosis
cgcugcaaccgguccgccg

SEQ ID NO: 985607 - RNA, 14 nt, Mycobacterium avium subsp. paratuberculosis
cgcugcaccagccc

SEQ ID NO: 985608 - RNA, 19 nt, Mycobacterium avium subsp. paratuberculosis
cgcugcaccagcccgucgg

SEQ ID NO: 985609 - RNA, 15 nt, Mycobacterium avium subsp. paratuberculosis
cgcugagcgggacgc

SEQ ID NO: 985610 - RNA, 19 nt, Mycobacterium avium subsp. paratuberculosis
cgcugagcaauucggugac

SEQ ID NO: 985611 - RNA, 15 nt, Mycobacterium avium subsp. paratuberculosis
cgcugagcacccgcc

SEQ ID NO: 985612 - RNA, 15 nt, Mycobacterium avium subsp. paratuberculosis
cgcugagcaaccgcc

SEQ ID NO: 985613 - RNA, 18 nt, Mycobacterium avium subsp. paratuberculosis
cgcugagccgcucgucga

SEQ ID NO: 985614 - RNA, 17 nt, Mycobacterium avium subsp. paratuberculosis
cgcugagcgccaggcca

SEQ ID NO: 985615 - RNA, 18 nt, Mycobacterium avium subsp. paratuberculosis
cgcugacgaugauccugg

SEQ ID NO: 985616 - RNA, 21 nt, Mycobacterium avium subsp. paratuberculosis
cgcugacgaugauccuggccu

SEQ ID NO: 985617 - RNA, 20 nt, Mycobacterium avium subsp. paratuberculosis
cgcugacgaugcggccggcg

SEQ ID NO: 985618 - RNA, 21 nt, Mycobacterium avium subsp. paratuberculosis
cgcugacgaugcggccggcgg

SEQ ID NO: 985619 - RNA, 15 nt, Mycobacterium avium subsp. paratuberculosis
cgcugaacagcagca

SEQ ID NO: 985620 - RNA, 18 nt, Mycobacterium avium subsp. paratuberculosis
cgcugaacagcccgagca

SEQ ID NO: 985621 - RNA, 19 nt, Mycobacterium avium subsp. paratuberculosis
cgcugaccugugcgcccca

SEQ ID NO: 985622 - RNA, 23 nt, Mycobacterium avium subsp. paratuberculosis
cgcucgccgaucuggcgcagcgu

SEQ ID NO: 985623 - RNA, 22 nt, Mycobacterium avium subsp. paratuberculosis
cgcucgcgggcccgcgccgcgu

SEQ ID NO: 985624 - RNA, 21 nt, Mycobacterium avium subsp. paratuberculosis
cgcucgcgguugggccgccgg

SEQ ID NO: 985625 - RNA, 22 nt, Mycobacterium avium subsp. paratuberculosis
cgcucgcgguugggccgccggc

SEQ ID NO: 985626 - RNA, 21 nt, Mycobacterium avium subsp. paratuberculosis
cgcucgcgguugggccggcgc

SEQ ID NO: 985627 - RNA, 17 nt, Mycobacterium avium subsp. paratuberculosis
cgcucgcguggccuggg

SEQ ID NO: 985628 - RNA, 14 nt, Mycobacterium avium subsp. paratuberculosis
cgcucggccagcag

SEQ ID NO: 985629 - RNA, 15 nt, Mycobacterium avium subsp. paratuberculosis
cgcucggccagcagu

SEQ ID NO: 985630 - RNA, 18 nt, Mycobacterium avium subsp. paratuberculosis
cgcucggccagcgcgccg

SEQ ID NO: 985631 - RNA, 13 nt, Mycobacterium avium subsp. paratuberculosis
cgcucggcccgcu

SEQ ID NO: 985632 - RNA, 22 nt, Mycobacterium avium subsp. paratuberculosis
cgcucggcgaccgccggugggg

SEQ ID NO: 985633 - RNA, 15 nt, Mycobacterium avium subsp. paratuberculosis
cgcucggcgagcugc

SEQ ID NO: 985634 - RNA, 15 nt, Mycobacterium avium subsp. paratuberculosis
cgcucggcgccggcc

SEQ ID NO: 985635 - RNA, 16 nt, Mycobacterium avium subsp. paratuberculosis
cgcucggcgccggccg

SEQ ID NO: 985636 - RNA, 17 nt, Mycobacterium avium subsp. paratuberculosis
cgcucggcgccggccgu

SEQ ID NO: 985637 - RNA, 15 nt, Mycobacterium avium subsp. paratuberculosis
cgcucggcgcgucgu

SEQ ID NO: 985638 - RNA, 16 nt, Mycobacterium avium subsp. paratuberculosis
cgcguuccagcacgcc

SEQ ID NO: 985639 - RNA, 16 nt, Mycobacterium avium subsp. paratuberculosis
cgcguugaaagccgcg

SEQ ID NO: 985640 - RNA, 19 nt, Mycobacterium avium subsp. paratuberculosis
cgcguugaaaguccuugcu

SEQ ID NO: 985641 - RNA, 23 nt, Mycobacterium avium subsp. paratuberculosis
cgcguucggacaccucggccagc

SEQ ID NO: 985642 - RNA, 16 nt, Mycobacterium avium subsp. paratuberculosis
cgcguucgggcccggc

SEQ ID NO: 985643 - RNA, 23 nt, Mycobacterium avium subsp. paratuberculosis
cgcguucgggcccggccgccagc

SEQ ID NO: 985644 - RNA, 24 nt, Mycobacterium avium subsp. paratuberculosis
cgcguucgggcccggccgccagca

SEQ ID NO: 985645 - RNA, 14 nt, Mycobacterium avium subsp. paratuberculosis
cgcguugcggcgca

SEQ ID NO: 985646 - RNA, 22 nt, Mycobacterium avium subsp. paratuberculosis
cgcguuggccagcgccuccagc

SEQ ID NO: 985647 - RNA, 16 nt, Mycobacterium avium subsp. paratuberculosis
cgcguuguccagcagc

SEQ ID NO: 985648 - RNA, 19 nt, Mycobacterium avium subsp. paratuberculosis
cgcguuguccagcagcgcc

SEQ ID NO: 985649 - RNA, 17 nt, Mycobacterium avium subsp. paratuberculosis
cgcuaaucgccgcgcgu

SEQ ID NO: 985650 - RNA, 18 nt, Mycobacterium avium subsp. paratuberculosis
cgcguugucgaccaccag

SEQ ID NO: 985651 - RNA, 21 nt, Mycobacterium avium subsp. paratuberculosis
cgcucaucaggcggccggccc

SEQ ID NO: 985652 - RNA, 21 nt, Mycobacterium avium subsp. paratuberculosis
cgcucaggucggccgcggccg

SEQ ID NO: 985653 - RNA, 22 nt, Mycobacterium avium subsp. paratuberculosis
cgcucaguccagcucccaggac

SEQ ID NO: 985654 - RNA, 12 nt, Mycobacterium avium subsp. paratuberculosis
cgcucacccggc

SEQ ID NO: 985655 - RNA, 15 nt, Mycobacterium avium subsp. paratuberculosis
cgcucacccggccca

SEQ ID NO: 985656 - RNA, 21 nt, Mycobacterium avium subsp. paratuberculosis
cgcucaccgcggggugcccgg

SEQ ID NO: 985657 - RNA, 19 nt, Mycobacterium avium subsp. paratuberculosis
cgcuagguuuggccagcac

SEQ ID NO: 985658 - RNA, 20 nt, Mycobacterium avium subsp. paratuberculosis
cgcuagguuuggccagcacc

SEQ ID NO: 985659 - RNA, 21 nt, Mycobacterium avium subsp. paratuberculosis
cgcuagguuuggccagcaccg

SEQ ID NO: 985660 - RNA, 15 nt, Mycobacterium avium subsp. paratuberculosis
cgcgguggucagcgg

SEQ ID NO: 985661 - RNA, 20 nt, Mycobacterium avium subsp. paratuberculosis
cgcgguggucagcggcgcca

SEQ ID NO: 985662 - RNA, 23 nt, Mycobacterium avium subsp. paratuberculosis
cgcgguggucagcggcgccaccg

SEQ ID NO: 985663 - RNA, 12 nt, Mycobacterium avium subsp. paratuberculosis
cgcggugguggg

SEQ ID NO: 985664 - RNA, 18 nt, Mycobacterium avium subsp. paratuberculosis
cgcgguguacagcgcgcc

SEQ ID NO: 985665 - RNA, 23 nt, Mycobacterium avium subsp. paratuberculosis
cgcgguggcggugcggucgcgca

SEQ ID NO: 985666 - RNA, 20 nt, Mycobacterium avium subsp. paratuberculosis
cgcggugggcgcgggccgcg

SEQ ID NO: 985667 - RNA, 12 nt, Mycobacterium avium subsp. paratuberculosis
cgcguacccgcg

SEQ ID NO: 985668 - RNA, 13 nt, Mycobacterium avium subsp. paratuberculosis
cgcguacagcagc

SEQ ID NO: 985669 - RNA, 14 nt, Mycobacterium avium subsp. paratuberculosis
cgcguacagccagc

SEQ ID NO: 985670 - RNA, 15 nt, Mycobacterium avium subsp. paratuberculosis
cgcguacagcggguc

SEQ ID NO: 985671 - RNA, 16 nt, Mycobacterium avium subsp. paratuberculosis
cgcguagaaccagugc

SEQ ID NO: 985672 - RNA, 16 nt, Mycobacterium avium subsp. paratuberculosis
cgcguagagcaucagg

SEQ ID NO: 985673 - RNA, 14 nt, Mycobacterium avium subsp. paratuberculosis
cgcgggcggggcgc

SEQ ID NO: 985674 - RNA, 16 nt, Mycobacterium avium subsp. paratuberculosis
cgcgggcggucgcgca

SEQ ID NO: 985675 - RNA, 17 nt, Mycobacterium avium subsp. paratuberculosis
cgcgggcggucgcgcag

SEQ ID NO: 985676 - RNA, 19 nt, Mycobacterium avium subsp. paratuberculosis
cgcgggcgucgggcagcag

SEQ ID NO: 985677 - RNA, 16 nt, Mycobacterium avium subsp. paratuberculosis
cgcgggcugcagggcc

SEQ ID NO: 985678 - RNA, 18 nt, Mycobacterium avium subsp. paratuberculosis
cgcggugcucggcgcgcg

SEQ ID NO: 985679 - RNA, 20 nt, Mycobacterium avium subsp. paratuberculosis
cgcgguggcgaacugcacca

SEQ ID NO: 985680 - RNA, 22 nt, Mycobacterium avium subsp. paratuberculosis
cgcgguggcgaacugcaccagc

SEQ ID NO: 985681 - RNA, 16 nt, Mycobacterium avium subsp. paratuberculosis
cgcgguggcgcccgcg

SEQ ID NO: 985682 - RNA, 15 nt, Mycobacterium avium subsp. paratuberculosis
cgcgguggcgccgcg

SEQ ID NO: 985683 - RNA, 21 nt, Mycobacterium avium subsp. paratuberculosis
cgcggugcccagccaggccgc

SEQ ID NO: 985684 - RNA, 16 nt, Mycobacterium avium subsp. paratuberculosis
cgcggugcccagccgc

SEQ ID NO: 985685 - RNA, 18 nt, Mycobacterium avium subsp. paratuberculosis
cgcggugcgccagcgccg

SEQ ID NO: 985686 - RNA, 13 nt, Mycobacterium avium subsp. paratuberculosis
cgcggugcggccc

SEQ ID NO: 985687 - RNA, 16 nt, Mycobacterium avium subsp. paratuberculosis
cgcggugcggcccgcg

SEQ ID NO: 985688 - RNA, 20 nt, Mycobacterium avium subsp. paratuberculosis
cgcgucacgcuggcgugacg

SEQ ID NO: 985689 - RNA, 18 nt, Mycobacterium avium subsp. paratuberculosis
cgcgucggccagcgcgcg

SEQ ID NO: 985690 - RNA, 16 nt, Mycobacterium avium subsp. paratuberculosis
cgcgucggcccccagc

SEQ ID NO: 985691 - RNA, 19 nt, Mycobacterium avium subsp. paratuberculosis
cgcgucggcgaccgcgcgc

SEQ ID NO: 985692 - RNA, 20 nt, Mycobacterium avium subsp. paratuberculosis
cgcgucggcgcuggccagcg

SEQ ID NO: 985693 - RNA, 13 nt, Mycobacterium avium subsp. paratuberculosis
cgcguagcgccgc

SEQ ID NO: 985694 - RNA, 15 nt, Mycobacterium avium subsp. paratuberculosis
cgcguagcgccgccc

SEQ ID NO: 985695 - RNA, 20 nt, Mycobacterium avium subsp. paratuberculosis
cgcguagcucgccgcggcca

SEQ ID NO: 985696 - RNA, 23 nt, Mycobacterium avium subsp. paratuberculosis
cgcguagggcagggucgcggagc

SEQ ID NO: 985697 - RNA, 23 nt, Mycobacterium avium subsp. paratuberculosis
cgcguagucggcgucggccaccg

SEQ ID NO: 985698 - RNA, 16 nt, Mycobacterium avium subsp. paratuberculosis
cgcgugugcccgccuc

SEQ ID NO: 985699 - RNA, 21 nt, Mycobacterium avium subsp. paratuberculosis
cgcguggucccacaccaccac

SEQ ID NO: 985700 - RNA, 20 nt, Mycobacterium avium subsp. paratuberculosis
cgcguggggcgucgccgccc

SEQ ID NO: 985701 - RNA, 19 nt, Mycobacterium avium subsp. paratuberculosis
cgcgucuuggacgcccgcg

SEQ ID NO: 985702 - RNA, 17 nt, Mycobacterium avium subsp. paratuberculosis
cgcgugacaagccggcg

SEQ ID NO: 985703 - RNA, 18 nt, Mycobacterium avium subsp. paratuberculosis
cgcgugacaggggcagca

SEQ ID NO: 985704 - RNA, 21 nt, Mycobacterium avium subsp. paratuberculosis
cgcgugacaggggcagcagca

SEQ ID NO: 985705 - RNA, 20 nt, Mycobacterium avium subsp. paratuberculosis
cgcgucguugucgucgccgg

SEQ ID NO: 985706 - RNA, 19 nt, Mycobacterium avium subsp. paratuberculosis
cgcgucgugcggccggcgc

SEQ ID NO: 985707 - RNA, 17 nt, Mycobacterium avium subsp. paratuberculosis
cgcgucguguccgggcc

SEQ ID NO: 985708 - RNA, 16 nt, Mycobacterium avium subsp. paratuberculosis
cgcgucguccucuucg

SEQ ID NO: 985709 - RNA, 15 nt, Mycobacterium avium subsp. paratuberculosis
cgcgucgucgcccga

SEQ ID NO: 985710 - RNA, 22 nt, Mycobacterium avium subsp. paratuberculosis
cgcgucgucggcgggcugcagc

SEQ ID NO: 985711 - RNA, 14 nt, Mycobacterium avium subsp. paratuberculosis
cgcgucguagccgg

SEQ ID NO: 985712 - RNA, 22 nt, Mycobacterium avium subsp. paratuberculosis
cgcgucguagucgcucggcggc

SEQ ID NO: 985713 - RNA, 21 nt, Mycobacterium avium subsp. paratuberculosis
cgcgucgggcucggccgccga

SEQ ID NO: 985714 - RNA, 15 nt, Mycobacterium avium subsp. paratuberculosis
cgcgucggucagcgg

SEQ ID NO: 985715 - RNA, 19 nt, Mycobacterium avium subsp. paratuberculosis
cgcggaaacuccuggcccc

SEQ ID NO: 985716 - RNA, 20 nt, Mycobacterium avium subsp. paratuberculosis
cgcgcuugcgaccgccgcua

SEQ ID NO: 985717 - RNA, 21 nt, Mycobacterium avium subsp. paratuberculosis
cgcgcuugcgaucgccgcgca

SEQ ID NO: 985718 - RNA, 20 nt, Mycobacterium avium subsp. paratuberculosis
cgcggaaccggccggggcgc

SEQ ID NO: 985719 - RNA, 11 nt, Mycobacterium avium subsp. paratuberculosis
cgcggaaugcu

SEQ ID NO: 985720 - RNA, 15 nt, Mycobacterium avium subsp. paratuberculosis
cgcggaaugcucgac

SEQ ID NO: 985721 - RNA, 17 nt, Mycobacterium avium subsp. paratuberculosis
cgcggacagcucgccgg

SEQ ID NO: 985722 - RNA, 19 nt, Mycobacterium avium subsp. paratuberculosis
cgcggacagcugcgcgggc

SEQ ID NO: 985723 - RNA, 16 nt, Mycobacterium avium subsp. paratuberculosis
cgcggacagggcggcg

SEQ ID NO: 985724 - RNA, 13 nt, Mycobacterium avium subsp. paratuberculosis
cgcgcuggcgcag

SEQ ID NO: 985725 - RNA, 19 nt, Mycobacterium avium subsp. paratuberculosis
cgcgcugcuugacccgcuc

SEQ ID NO: 985726 - RNA, 22 nt, Mycobacterium avium subsp. paratuberculosis
cgcggacccgacggucgggccc

SEQ ID NO: 985727 - RNA, 23 nt, Mycobacterium avium subsp. paratuberculosis
cgcggacccuggccagcaccgcg

SEQ ID NO: 985728 - RNA, 23 nt, Mycobacterium avium subsp. paratuberculosis
cgcggagaugcuggugacgccgc

SEQ ID NO: 985729 - RNA, 23 nt, Mycobacterium avium subsp. paratuberculosis
cgcggagaugguggucaccacca

SEQ ID NO: 985730 - RNA, 15 nt, Mycobacterium avium subsp. paratuberculosis
cgcggagccggccgc

SEQ ID NO: 985731 - RNA, 17 nt, Mycobacterium avium subsp. paratuberculosis
cgcggaguaggcgccgc

SEQ ID NO: 985732 - RNA, 19 nt, Mycobacterium avium subsp. paratuberculosis
cgcggacggguugggcgcc

SEQ ID NO: 985733 - RNA, 22 nt, Mycobacterium avium subsp. paratuberculosis
cgcggagaucaccccuggcggg

SEQ ID NO: 985734 - RNA, 21 nt, Mycobacterium avium subsp. paratuberculosis
cgcggcaaggcguuccaucug

SEQ ID NO: 985735 - RNA, 21 nt, Mycobacterium avium subsp. paratuberculosis
cgcggauacgcccggccaccu

SEQ ID NO: 985736 - RNA, 17 nt, Mycobacterium avium subsp. paratuberculosis
cgcggcacgcugcgcca

SEQ ID NO: 985737 - RNA, 19 nt, Mycobacterium avium subsp. paratuberculosis
cgcggcgacgguggcgggc

SEQ ID NO: 985738 - RNA, 15 nt, Mycobacterium avium subsp. paratuberculosis
cgcggcgacacccag

SEQ ID NO: 985739 - RNA, 15 nt, Mycobacterium avium subsp. paratuberculosis
cgcggcgacccgcuu

SEQ ID NO: 985740 - RNA, 15 nt, Mycobacterium avium subsp. paratuberculosis
cgcggcgaacaacgc

SEQ ID NO: 985741 - RNA, 16 nt, Mycobacterium avium subsp. paratuberculosis
cgcggcgaagcaggcc

SEQ ID NO: 985742 - RNA, 18 nt, Mycobacterium avium subsp. paratuberculosis
cgcggcgaaggccagcga

SEQ ID NO: 985743 - RNA, 17 nt, Mycobacterium avium subsp. paratuberculosis
cgcggcgaauccgagca

SEQ ID NO: 985744 - RNA, 21 nt, Mycobacterium avium subsp. paratuberculosis
cgcggcgaaucgguccggcga

SEQ ID NO: 985745 - RNA, 21 nt, Mycobacterium avium subsp. paratuberculosis
cgcggcggcccgucgccacca

SEQ ID NO: 985746 - RNA, 22 nt, Mycobacterium avium subsp. paratuberculosis
cgcggcggcccgucgccaccac

SEQ ID NO: 985747 - RNA, 19 nt, Mycobacterium avium subsp. paratuberculosis
cgcggcggauguccuggug

SEQ ID NO: 985748 - RNA, 16 nt, Mycobacterium avium subsp. paratuberculosis
cgcggcggcaaccagc

SEQ ID NO: 985749 - RNA, 18 nt, Mycobacterium avium subsp. paratuberculosis
cgcggcggaggucagcgg

SEQ ID NO: 985750 - RNA, 23 nt, Mycobacterium avium subsp. paratuberculosis
cgcggcggaggucagcggcccga

SEQ ID NO: 985751 - RNA, 18 nt, Mycobacterium avium subsp. paratuberculosis
cgcggcggauccagcacc

SEQ ID NO: 985752 - RNA, 19 nt, Mycobacterium avium subsp. paratuberculosis
cgcggcggcggcccguccg

SEQ ID NO: 985753 - RNA, 23 nt, Mycobacterium avium subsp. paratuberculosis
cgcggcggcggcccguccgcccc

SEQ ID NO: 985754 - RNA, 22 nt, Mycobacterium avium subsp. paratuberculosis
cgcggcggccggccagcgcgcg

SEQ ID NO: 985755 - RNA, 14 nt, Mycobacterium avium subsp. paratuberculosis
cgcggcggccggcg

SEQ ID NO: 985756 - RNA, 12 nt, Mycobacterium avium subsp. paratuberculosis
cgcggcggccug

SEQ ID NO: 985757 - RNA, 16 nt, Mycobacterium avium subsp. paratuberculosis
cgcggcggccugcuug

SEQ ID NO: 985758 - RNA, 15 nt, Mycobacterium avium subsp. paratuberculosis
cgcggccagcgcccg

SEQ ID NO: 985759 - RNA, 12 nt, Mycobacterium avium subsp. paratuberculosis
cgcggccaccgg

SEQ ID NO: 985760 - RNA, 17 nt, Mycobacterium avium subsp. paratuberculosis
cgcggccaccuccagcc

SEQ ID NO: 985761 - RNA, 20 nt, Mycobacterium avium subsp. paratuberculosis
cgcggccaccuccagcccgg

SEQ ID NO: 985762 - RNA, 23 nt, Mycobacterium avium subsp. paratuberculosis
cgcggccacgcccuggccgccgg

SEQ ID NO: 985763 - RNA, 12 nt, Mycobacterium avium subsp. paratuberculosis
cgcggccaccgc

SEQ ID NO: 985764 - RNA, 22 nt, Mycobacterium avium subsp. paratuberculosis
cgcggcaccuucaccgaccagc

SEQ ID NO: 985765 - RNA, 20 nt, Mycobacterium avium subsp. paratuberculosis
cgcggccaccacgacgccgg

SEQ ID NO: 985766 - RNA, 23 nt, Mycobacterium avium subsp. paratuberculosis
cgcggccuugcgagccggagccu

SEQ ID NO: 985767 - RNA, 23 nt, Mycobacterium avium subsp. paratuberculosis
cgcggccuugcgcaccggagccu

SEQ ID NO: 985768 - RNA, 19 nt, Mycobacterium avium subsp. paratuberculosis
cgcggccuugcgggccgga

SEQ ID NO: 985769 - RNA, 23 nt, Mycobacterium avium subsp. paratuberculosis
cgcggccuugcgggccggagccu

SEQ ID NO: 985770 - RNA, 19 nt, Mycobacterium avium subsp. paratuberculosis
cgcggccuucuuggccgga

SEQ ID NO: 985771 - RNA, 23 nt, Mycobacterium avium subsp. paratuberculosis
cgcggccuucuuggccggagccu

SEQ ID NO: 985772 - RNA, 13 nt, Mycobacterium avium subsp. paratuberculosis
cgcggccugcggg

SEQ ID NO: 985773 - RNA, 17 nt, Mycobacterium avium subsp. paratuberculosis
cgcggccugcgggcgcc

SEQ ID NO: 985774 - RNA, 23 nt, Mycobacterium avium subsp. paratuberculosis
cgcggccagcgcgcgggcguccu

SEQ ID NO: 985775 - RNA, 16 nt, Mycobacterium avium subsp. paratuberculosis
cgcggccagcgggccg

SEQ ID NO: 985776 - RNA, 21 nt, Mycobacterium avium subsp. paratuberculosis
cgcggccagcgugaacaccgc

SEQ ID NO: 985777 - RNA, 13 nt, Mycobacterium avium subsp. paratuberculosis
cgcggccagcucc

SEQ ID NO: 985778 - RNA, 22 nt, Mycobacterium avium subsp. paratuberculosis
cgcggccagcuccgggucgacc

SEQ ID NO: 985779 - RNA, 15 nt, Mycobacterium avium subsp. paratuberculosis
cgcggccagcucggu

SEQ ID NO: 985780 - RNA, 20 nt, Mycobacterium avium subsp. paratuberculosis
cgcggccagcugcgacagca

SEQ ID NO: 985781 - RNA, 16 nt, Mycobacterium avium subsp. paratuberculosis
cgcggcguucuccagc

SEQ ID NO: 985782 - RNA, 13 nt, Mycobacterium avium subsp. paratuberculosis
cgcggcguugccc

SEQ ID NO: 985783 - RNA, 17 nt, Mycobacterium avium subsp. paratuberculosis
cgcggcguugccgccgg

SEQ ID NO: 985784 - RNA, 18 nt, Mycobacterium avium subsp. paratuberculosis
cgcggcguucagcagcgc

SEQ ID NO: 985785 - RNA, 15 nt, Mycobacterium avium subsp. paratuberculosis
cgcggcgucggccgg

SEQ ID NO: 985786 - RNA, 22 nt, Mycobacterium avium subsp. paratuberculosis
cgcggcgucggccgggcugccc

SEQ ID NO: 985787 - RNA, 15 nt, Mycobacterium avium subsp. paratuberculosis
cgcggcguaggcggc

SEQ ID NO: 985788 - RNA, 19 nt, Mycobacterium avium subsp. paratuberculosis
cgcggcguaggugggcagc

SEQ ID NO: 985789 - RNA, 23 nt, Mycobacterium avium subsp. paratuberculosis
cgcggcgucaucccccgcagcuu

SEQ ID NO: 985790 - RNA, 20 nt, Mycobacterium avium subsp. paratuberculosis
cgcggcgucccggguaccuc

SEQ ID NO: 985791 - RNA, 16 nt, Mycobacterium avium subsp. paratuberculosis
cgcggcggugcgcagc

SEQ ID NO: 985792 - RNA, 18 nt, Mycobacterium avium subsp. paratuberculosis
cgcggcggugcgcagccg

SEQ ID NO: 985793 - RNA, 17 nt, Mycobacterium avium subsp. paratuberculosis
cgcggcggugcucgcgc

SEQ ID NO: 985794 - RNA, 19 nt, Mycobacterium avium subsp. paratuberculosis
cgcggcgguggccugcccg

SEQ ID NO: 985795 - RNA, 19 nt, Mycobacterium avium subsp. paratuberculosis
cgcggcggugucggugccc

SEQ ID NO: 985796 - RNA, 12 nt, Mycobacterium avium subsp. paratuberculosis
cgcggcgggcgu

SEQ ID NO: 985797 - RNA, 12 nt, Mycobacterium avium subsp. paratuberculosis
cgcggcgggcgc

SEQ ID NO: 985798 - RNA, 15 nt, Mycobacterium avium subsp. paratuberculosis
cgcggcgggcccgca

SEQ ID NO: 985799 - RNA, 20 nt, Mycobacterium avium subsp. paratuberculosis
cgcggcgggcgagccgaagc

SEQ ID NO: 985800 - RNA, 20 nt, Mycobacterium avium subsp. paratuberculosis
cgcggcgggaaaccaccugc

SEQ ID NO: 985801 - RNA, 22 nt, Mycobacterium avium subsp. paratuberculosis
cgcggcgggaaaccaccugccg

SEQ ID NO: 985802 - RNA, 12 nt, Mycobacterium avium subsp. paratuberculosis
cgcggcgggccc

SEQ ID NO: 985803 - RNA, 22 nt, Mycobacterium avium subsp. paratuberculosis
cgcggcggcggcgcgggcgccc

SEQ ID NO: 985804 - RNA, 15 nt, Mycobacterium avium subsp. paratuberculosis
cgcggcggcggugcu

SEQ ID NO: 985805 - RNA, 21 nt, Mycobacterium avium subsp. paratuberculosis
cgcggcggcgucgaccgcccc

SEQ ID NO: 985806 - RNA, 18 nt, Mycobacterium avium subsp. paratuberculosis
cgcggcggcgugccgccc

SEQ ID NO: 985807 - RNA, 20 nt, Mycobacterium avium subsp. paratuberculosis
cgcggcggcgugccgcccgg

SEQ ID NO: 985808 - RNA, 22 nt, Mycobacterium avium subsp. paratuberculosis
cgcgggagagcgcgggcaccgu

SEQ ID NO: 985809 - RNA, 21 nt, Mycobacterium avium subsp. paratuberculosis
cgcgggcgcauaccagcgcug

SEQ ID NO: 985810 - RNA, 12 nt, Mycobacterium avium subsp. paratuberculosis
cgcgggcgccca

SEQ ID NO: 985811 - RNA, 14 nt, Mycobacterium avium subsp. paratuberculosis
cgcgggaucggccg

SEQ ID NO: 985812 - RNA, 15 nt, Mycobacterium avium subsp. paratuberculosis
cgcgggaucggccgg

SEQ ID NO: 985813 - RNA, 17 nt, Mycobacterium avium subsp. paratuberculosis
cgcgggaucggccggcg

SEQ ID NO: 985814 - RNA, 12 nt, Mycobacterium avium subsp. paratuberculosis
cgcgggcgcgcc

SEQ ID NO: 985815 - RNA, 14 nt, Mycobacterium avium subsp. paratuberculosis
cgcgggcgcggcca

SEQ ID NO: 985816 - RNA, 19 nt, Mycobacterium avium subsp. paratuberculosis
cgcgggcgcgcgccgcccc

SEQ ID NO: 985817 - RNA, 14 nt, Mycobacterium avium subsp. paratuberculosis
cgcgggaagccgcc

SEQ ID NO: 985818 - RNA, 18 nt, Mycobacterium avium subsp. paratuberculosis
cgcgggaagccgccgccc

SEQ ID NO: 985819 - RNA, 23 nt, Mycobacterium avium subsp. paratuberculosis
cgcggcuucauaugacgccggcc

SEQ ID NO: 985820 - RNA, 13 nt, Mycobacterium avium subsp. paratuberculosis
cgcggcggcggcc

SEQ ID NO: 985821 - RNA, 22 nt, Mycobacterium avium subsp. paratuberculosis
cgcgggaccgggcccggcgcca

SEQ ID NO: 985822 - RNA, 15 nt, Mycobacterium avium subsp. paratuberculosis
cgcgggacggcggcg

SEQ ID NO: 985823 - RNA, 18 nt, Mycobacterium avium subsp. paratuberculosis
cgcgggaaucccacccgc

SEQ ID NO: 985824 - RNA, 23 nt, Mycobacterium avium subsp. paratuberculosis
cgcgggaauuggcaccggaccgc

SEQ ID NO: 985825 - RNA, 17 nt, Mycobacterium avium subsp. paratuberculosis
cgcgggacacggcggcg

SEQ ID NO: 985826 - RNA, 20 nt, Mycobacterium avium subsp. paratuberculosis
cgcgcucaaccgcccagcgg

SEQ ID NO: 985827 - RNA, 22 nt, Mycobacterium avium subsp. paratuberculosis
cgcgcucaccgcggggugcccg

SEQ ID NO: 985828 - RNA, 13 nt, Mycobacterium avium subsp. paratuberculosis
cgcgcucagcccc

SEQ ID NO: 985829 - RNA, 14 nt, Mycobacterium avium subsp. paratuberculosis
cgcgcucagcgcgg

SEQ ID NO: 985830 - RNA, 12 nt, Mycobacterium avium subsp. paratuberculosis
cgcgcucccggc

SEQ ID NO: 985831 - RNA, 23 nt, Mycobacterium avium subsp. paratuberculosis
cgcgcucgacgaugucgacgccc

SEQ ID NO: 985832 - RNA, 17 nt, Mycobacterium avium subsp. paratuberculosis
cgcgcguuguccagcag

SEQ ID NO: 985833 - RNA, 22 nt, Mycobacterium avium subsp. paratuberculosis
cgcgcguuguccagcagcgccg

SEQ ID NO: 985834 - RNA, 22 nt, Mycobacterium avium subsp. paratuberculosis
cgcgcgucgggggugccgcucc

SEQ ID NO: 985835 - RNA, 17 nt, Mycobacterium avium subsp. paratuberculosis
cgcgcuaggacgcgggc

SEQ ID NO: 985836 - RNA, 21 nt, Mycobacterium avium subsp. paratuberculosis
cgcgcggggugucgcggcugc

SEQ ID NO: 985837 - RNA, 23 nt, Mycobacterium avium subsp. paratuberculosis
cgcgcugaacgcggugggcacca

SEQ ID NO: 985838 - RNA, 21 nt, Mycobacterium avium subsp. paratuberculosis
cgcgcuccugccagcggcgca

SEQ ID NO: 985839 - RNA, 20 nt, Mycobacterium avium subsp. paratuberculosis
cgcgcugcagcauccaggug

SEQ ID NO: 985840 - RNA, 13 nt, Mycobacterium avium subsp. paratuberculosis
cgcgcugccggcc

SEQ ID NO: 985841 - RNA, 15 nt, Mycobacterium avium subsp. paratuberculosis
cgcgcugccgacgau

SEQ ID NO: 985842 - RNA, 13 nt, Mycobacterium avium subsp. paratuberculosis
cgcgcugccgcgc

SEQ ID NO: 985843 - RNA, 17 nt, Mycobacterium avium subsp. paratuberculosis
cgcgcugccgcgccccg

SEQ ID NO: 985844 - RNA, 22 nt, Mycobacterium avium subsp. paratuberculosis
cgcgcucggucagcaccggggc

SEQ ID NO: 985845 - RNA, 16 nt, Mycobacterium avium subsp. paratuberculosis
cgcgcucgcaccagcg

SEQ ID NO: 985846 - RNA, 16 nt, Mycobacterium avium subsp. paratuberculosis
cgcgcggccuccagcc

SEQ ID NO: 985847 - RNA, 18 nt, Mycobacterium avium subsp. paratuberculosis
cgcgcggccuccagccgc

SEQ ID NO: 985848 - RNA, 14 nt, Mycobacterium avium subsp. paratuberculosis
cgcgcggccggcca

SEQ ID NO: 985849 - RNA, 15 nt, Mycobacterium avium subsp. paratuberculosis
cgcgcggccagcccc

SEQ ID NO: 985850 - RNA, 15 nt, Mycobacterium avium subsp. paratuberculosis
cgcgcggccgccagg

SEQ ID NO: 985851 - RNA, 16 nt, Mycobacterium avium subsp. paratuberculosis
cgcgcggccaccgcgc

SEQ ID NO: 985852 - RNA, 14 nt, Mycobacterium avium subsp. paratuberculosis
cgcgcggccagccc

SEQ ID NO: 985853 - RNA, 23 nt, Mycobacterium avium subsp. paratuberculosis
cgcgcggauuucucagcggcgcu

SEQ ID NO: 985854 - RNA, 19 nt, Mycobacterium avium subsp. paratuberculosis
cgcgcgcuggugcgggcca

SEQ ID NO: 985855 - RNA, 12 nt, Mycobacterium avium subsp. paratuberculosis
cgcgcgcugacc

SEQ ID NO: 985856 - RNA, 14 nt, Mycobacterium avium subsp. paratuberculosis
cgcgcgcugccgcg

SEQ ID NO: 985857 - RNA, 17 nt, Mycobacterium avium subsp. paratuberculosis
cgcgcgcugccgcgccc

SEQ ID NO: 985858 - RNA, 12 nt, Mycobacterium avium subsp. paratuberculosis
cgcgcgcgggcc

SEQ ID NO: 985859 - RNA, 13 nt, Mycobacterium avium subsp. paratuberculosis
cgcgcgcgggcca

SEQ ID NO: 985860 - RNA, 11 nt, Mycobacterium avium subsp. paratuberculosis
cgcgcggcgcg

SEQ ID NO: 985861 - RNA, 11 nt, Mycobacterium avium subsp. paratuberculosis
cgcgcggcggg

SEQ ID NO: 985862 - RNA, 12 nt, Mycobacterium avium subsp. paratuberculosis
cgcgcggcggcc

SEQ ID NO: 985863 - RNA, 22 nt, Mycobacterium avium subsp. paratuberculosis
cgcgcggcggccaccgcgccgu

SEQ ID NO: 985864 - RNA, 13 nt, Mycobacterium avium subsp. paratuberculosis
cgcgcggcgccca

SEQ ID NO: 985865 - RNA, 12 nt, Mycobacterium avium subsp. paratuberculosis
cgcgcggggccg

SEQ ID NO: 985866 - RNA, 14 nt, Mycobacterium avium subsp. paratuberculosis
cgcgcggggccggc

SEQ ID NO: 985867 - RNA, 15 nt, Mycobacterium avium subsp. paratuberculosis
cgcgcggggccggcg

SEQ ID NO: 985868 - RNA, 16 nt, Mycobacterium avium subsp. paratuberculosis
cgcgcggggccggcgc

SEQ ID NO: 985869 - RNA, 16 nt, Mycobacterium avium subsp. paratuberculosis
cgcgcgggcgcgcgcc

SEQ ID NO: 985870 - RNA, 20 nt, Mycobacterium avium subsp. paratuberculosis
cgcgcgggcgcgcgccgccc

SEQ ID NO: 985871 - RNA, 16 nt, Mycobacterium avium subsp. paratuberculosis
cgcgcgggccagcgcc

SEQ ID NO: 985872 - RNA, 17 nt, Mycobacterium avium subsp. paratuberculosis
cgcgcgggccagcgccu

SEQ ID NO: 985873 - RNA, 22 nt, Mycobacterium avium subsp. paratuberculosis
cgcgcgguguuuggccgcgcag

SEQ ID NO: 985874 - RNA, 23 nt, Mycobacterium avium subsp. paratuberculosis
cgcgcgguguuuggccgcgcagc

SEQ ID NO: 985875 - RNA, 15 nt, Mycobacterium avium subsp. paratuberculosis
cgcgcguagcgcagc

SEQ ID NO: 985876 - RNA, 19 nt, Mycobacterium avium subsp. paratuberculosis
cgcgcguauuccagcgcca

SEQ ID NO: 985877 - RNA, 14 nt, Mycobacterium avium subsp. paratuberculosis
cgcgcgggagcgcu

SEQ ID NO: 985878 - RNA, 17 nt, Mycobacterium avium subsp. paratuberculosis
cgcgcgggucgagcagc

SEQ ID NO: 985879 - RNA, 17 nt, Mycobacterium avium subsp. paratuberculosis
cgcgcggggcggccgcc

SEQ ID NO: 985880 - RNA, 19 nt, Mycobacterium avium subsp. paratuberculosis
cgcgcggggcggccgccgg

SEQ ID NO: 985881 - RNA, 22 nt, Mycobacterium avium subsp. paratuberculosis
cgcgcggggcggccgccgggcc

SEQ ID NO: 985882 - RNA, 20 nt, Mycobacterium avium subsp. paratuberculosis
cgcgcgaucgguagcaggac

SEQ ID NO: 985883 - RNA, 22 nt, Mycobacterium avium subsp. paratuberculosis
cgcgcgaucgguguccagccgc

SEQ ID NO: 985884 - RNA, 13 nt, Mycobacterium avium subsp. paratuberculosis
cgcgcgccgcagc

SEQ ID NO: 985885 - RNA, 13 nt, Mycobacterium avium subsp. paratuberculosis
cgcgcgccccggu

SEQ ID NO: 985886 - RNA, 14 nt, Mycobacterium avium subsp. paratuberculosis
cgcgcgccgccccc

SEQ ID NO: 985887 - RNA, 13 nt, Mycobacterium avium subsp. paratuberculosis
cgcgcgccggcca

SEQ ID NO: 985888 - RNA, 12 nt, Mycobacterium avium subsp. paratuberculosis
cgcgccugccug

SEQ ID NO: 985889 - RNA, 18 nt, Mycobacterium avium subsp. paratuberculosis
cgcgccuucuugcugccc

SEQ ID NO: 985890 - RNA, 20 nt, Mycobacterium avium subsp. paratuberculosis
cgcgcgaccaguaccgggcc

SEQ ID NO: 985891 - RNA, 21 nt, Mycobacterium avium subsp. paratuberculosis
cgcgcgaccaguaccgggccu

SEQ ID NO: 985892 - RNA, 17 nt, Mycobacterium avium subsp. paratuberculosis
cgcgcgaccaucagccc

SEQ ID NO: 985893 - RNA, 13 nt, Mycobacterium avium subsp. paratuberculosis
cgcgcgacgccgu

SEQ ID NO: 985894 - RNA, 23 nt, Mycobacterium avium subsp. paratuberculosis
cgcgcgagaguaucgccacgccg

SEQ ID NO: 985895 - RNA, 13 nt, Mycobacterium avium subsp. paratuberculosis
cgcgcgagcgcgc

SEQ ID NO: 985896 - RNA, 14 nt, Mycobacterium avium subsp. paratuberculosis
cgcgcgagcgcgcu

SEQ ID NO: 985897 - RNA, 16 nt, Mycobacterium avium subsp. paratuberculosis
cgcgcgaacgcaacag

SEQ ID NO: 985898 - RNA, 20 nt, Mycobacterium avium subsp. paratuberculosis
cgcgcgacaucaccgcgggc

SEQ ID NO: 985899 - RNA, 23 nt, Mycobacterium avium subsp. paratuberculosis
cgcgcgacaucaccgcgggcgcg

SEQ ID NO: 985900 - RNA, 20 nt, Mycobacterium avium subsp. paratuberculosis
cgccagcaacgacccggcca

SEQ ID NO: 985901 - RNA, 14 nt, Mycobacterium avium subsp. paratuberculosis
cgccagcaccaccg

SEQ ID NO: 985902 - RNA, 15 nt, Mycobacterium avium subsp. paratuberculosis
cgccagaugcgccgc

SEQ ID NO: 985903 - RNA, 19 nt, Mycobacterium avium subsp. paratuberculosis
cgccagaugcgccgcggau

SEQ ID NO: 985904 - RNA, 13 nt, Mycobacterium avium subsp. paratuberculosis
cgccagaucgcca

SEQ ID NO: 985905 - RNA, 19 nt, Mycobacterium avium subsp. paratuberculosis
cgcgccucgguucugcagc

SEQ ID NO: 985906 - RNA, 23 nt, Mycobacterium avium subsp. paratuberculosis
cgcgccguugguggucugccaga

SEQ ID NO: 985907 - RNA, 20 nt, Mycobacterium avium subsp. paratuberculosis
cgcgccgugcgccagcgacc

SEQ ID NO: 985908 - RNA, 18 nt, Mycobacterium avium subsp. paratuberculosis
cgcgccgucuuccgggcc

SEQ ID NO: 985909 - RNA, 20 nt, Mycobacterium avium subsp. paratuberculosis
cgcgccgguguucggcgcca

SEQ ID NO: 985910 - RNA, 22 nt, Mycobacterium avium subsp. paratuberculosis
cgcgccgguguucggcgccagc

SEQ ID NO: 985911 - RNA, 16 nt, Mycobacterium avium subsp. paratuberculosis
cgcgccguagcggccc

SEQ ID NO: 985912 - RNA, 20 nt, Mycobacterium avium subsp. paratuberculosis
cgcgccguagcggcccaggu

SEQ ID NO: 985913 - RNA, 17 nt, Mycobacterium avium subsp. paratuberculosis
cgcgccgucccagccgg

SEQ ID NO: 985914 - RNA, 21 nt, Mycobacterium avium subsp. paratuberculosis
cgcgccgucggacuccuccug

SEQ ID NO: 985915 - RNA, 18 nt, Mycobacterium avium subsp. paratuberculosis
cgcgccgucggcgaugcg

SEQ ID NO: 985916 - RNA, 14 nt, Mycobacterium avium subsp. paratuberculosis
cgcgccgucggcgu

SEQ ID NO: 985917 - RNA, 21 nt, Mycobacterium avium subsp. paratuberculosis
cgcgccgggcgcccgagccgc

SEQ ID NO: 985918 - RNA, 17 nt, Mycobacterium avium subsp. paratuberculosis
cgcgccgguagagcgcc

SEQ ID NO: 985919 - RNA, 22 nt, Mycobacterium avium subsp. paratuberculosis
cgcgccgggaucacacgcgcgc

SEQ ID NO: 985920 - RNA, 23 nt, Mycobacterium avium subsp. paratuberculosis
cgcgccgggaucacacgcgcgcc

SEQ ID NO: 985921 - RNA, 13 nt, Mycobacterium avium subsp. paratuberculosis
cgcgccgggcagc

SEQ ID NO: 985922 - RNA, 19 nt, Mycobacterium avium subsp. paratuberculosis
cgccagcaccaccgucacc

SEQ ID NO: 985923 - RNA, 15 nt, Mycobacterium avium subsp. paratuberculosis
cgucuugcagccggg

SEQ ID NO: 985924 - RNA, 22 nt, Mycobacterium avium subsp. paratuberculosis
cgucuuggacgcccgcgacccg

SEQ ID NO: 985925 - RNA, 18 nt, Mycobacterium avium subsp. paratuberculosis
cgucuuggccaggcccug

SEQ ID NO: 985926 - RNA, 14 nt, Mycobacterium avium subsp. paratuberculosis
cgugaaacauggcg

SEQ ID NO: 985927 - RNA, 16 nt, Mycobacterium avium subsp. paratuberculosis
cgucuugaccgcccgg

SEQ ID NO: 985928 - RNA, 16 nt, Mycobacterium avium subsp. paratuberculosis
cgucuugcccagcggg

SEQ ID NO: 985929 - RNA, 13 nt, Mycobacterium avium subsp. paratuberculosis
cgucuucuuggcc

SEQ ID NO: 985930 - RNA, 19 nt, Mycobacterium avium subsp. paratuberculosis
cgucuugaucucggcggcg

SEQ ID NO: 985931 - RNA, 15 nt, Mycobacterium avium subsp. paratuberculosis
cgucuuccgcggcgg

SEQ ID NO: 985932 - RNA, 18 nt, Mycobacterium avium subsp. paratuberculosis
cgucuuccgggccaccgu

SEQ ID NO: 985933 - RNA, 19 nt, Mycobacterium avium subsp. paratuberculosis
cgucugguuggccggcggg

SEQ ID NO: 985934 - RNA, 13 nt, Mycobacterium avium subsp. paratuberculosis
cgucuggcagccg

SEQ ID NO: 985935 - RNA, 18 nt, Mycobacterium avium subsp. paratuberculosis
cgucuggcagccggccgg

SEQ ID NO: 985936 - RNA, 20 nt, Mycobacterium avium subsp. paratuberculosis
cgucuggcagccggccggca

SEQ ID NO: 985937 - RNA, 21 nt, Mycobacterium avium subsp. paratuberculosis
cgucuggcagccggccggcag

SEQ ID NO: 985938 - RNA, 16 nt, Mycobacterium avium subsp. paratuberculosis
cgucugcucggcggcu

SEQ ID NO: 985939 - RNA, 11 nt, Mycobacterium avium subsp. paratuberculosis
cgucugcucgc

SEQ ID NO: 985940 - RNA, 15 nt, Mycobacterium avium subsp. paratuberculosis
cgucugcucgccggc

SEQ ID NO: 985941 - RNA, 13 nt, Mycobacterium avium subsp. paratuberculosis
cgucugcucgcca

SEQ ID NO: 985942 - RNA, 15 nt, Mycobacterium avium subsp. paratuberculosis
cgucugcgccccggc

SEQ ID NO: 985943 - RNA, 18 nt, Mycobacterium avium subsp. paratuberculosis
cgucugcggcucggcgcu

SEQ ID NO: 985944 - RNA, 21 nt, Mycobacterium avium subsp. paratuberculosis
cgucucgacccgggccagcag

SEQ ID NO: 985945 - RNA, 15 nt, Mycobacterium avium subsp. paratuberculosis
cgucucggccgcggu

SEQ ID NO: 985946 - RNA, 19 nt, Mycobacterium avium subsp. paratuberculosis
cgucucggcgucucggcgu

SEQ ID NO: 985947 - RNA, 20 nt, Mycobacterium avium subsp. paratuberculosis
cgucucggugucggacuugu

SEQ ID NO: 985948 - RNA, 14 nt, Mycobacterium avium subsp. paratuberculosis
cgucgugcgcgggc

SEQ ID NO: 985949 - RNA, 21 nt, Mycobacterium avium subsp. paratuberculosis
cgucgugcucggcgagcaccg

SEQ ID NO: 985950 - RNA, 14 nt, Mycobacterium avium subsp. paratuberculosis
cgucgucuuggccu

SEQ ID NO: 985951 - RNA, 16 nt, Mycobacterium avium subsp. paratuberculosis
cgucgugcacgccgug

SEQ ID NO: 985952 - RNA, 14 nt, Mycobacterium avium subsp. paratuberculosis
cgucgucgagccgc

SEQ ID NO: 985953 - RNA, 15 nt, Mycobacterium avium subsp. paratuberculosis
cgucgucgagcgcuc

SEQ ID NO: 985954 - RNA, 20 nt, Mycobacterium avium subsp. paratuberculosis
cgucgucgaugaacaucgcc

SEQ ID NO: 985955 - RNA, 14 nt, Mycobacterium avium subsp. paratuberculosis
cgucgucgcggcgc

SEQ ID NO: 985956 - RNA, 14 nt, Mycobacterium avium subsp. paratuberculosis
cgucgucgcugcag

SEQ ID NO: 985957 - RNA, 15 nt, Mycobacterium avium subsp. paratuberculosis
cgucguccuccuccu

SEQ ID NO: 985958 - RNA, 22 nt, Mycobacterium avium subsp. paratuberculosis
cgucguccuugagcccccaccu

SEQ ID NO: 985959 - RNA, 17 nt, Mycobacterium avium subsp. paratuberculosis
cgucgucccgucggcgc

SEQ ID NO: 985960 - RNA, 20 nt, Mycobacterium avium subsp. paratuberculosis
cgucguccgcaaccgccggc

SEQ ID NO: 985961 - RNA, 18 nt, Mycobacterium avium subsp. paratuberculosis
cgucguccggcgcgcagc

SEQ ID NO: 985962 - RNA, 14 nt, Mycobacterium avium subsp. paratuberculosis
cgucgucggccugc

SEQ ID NO: 985963 - RNA, 12 nt, Mycobacterium avium subsp. paratuberculosis
cgucgucggcga

SEQ ID NO: 985964 - RNA, 18 nt, Mycobacterium avium subsp. paratuberculosis
cgucuaagucgaugccgc

SEQ ID NO: 985965 - RNA, 15 nt, Mycobacterium avium subsp. paratuberculosis
cgucguuggcgccgu

SEQ ID NO: 985966 - RNA, 19 nt, Mycobacterium avium subsp. paratuberculosis
cgucguuguuggcggcggu

SEQ ID NO: 985967 - RNA, 23 nt, Mycobacterium avium subsp. paratuberculosis
cgucguucuccauccgggcggcc

SEQ ID NO: 985968 - RNA, 21 nt, Mycobacterium avium subsp. paratuberculosis
cgucguugaacgcgcgggugc

SEQ ID NO: 985969 - RNA, 22 nt, Mycobacterium avium subsp. paratuberculosis
cgucucagucggccaccgcgau

SEQ ID NO: 985970 - RNA, 14 nt, Mycobacterium avium subsp. paratuberculosis
cgucuccuggggca

SEQ ID NO: 985971 - RNA, 21 nt, Mycobacterium avium subsp. paratuberculosis
cgucuccuggggcagaucguc

SEQ ID NO: 985972 - RNA, 16 nt, Mycobacterium avium subsp. paratuberculosis
cgucucgacggcgccg

SEQ ID NO: 985973 - RNA, 18 nt, Mycobacterium avium subsp. paratuberculosis
cgucggcguagggcagcc

SEQ ID NO: 985974 - RNA, 19 nt, Mycobacterium avium subsp. paratuberculosis
cgucggcguagggcagccc

SEQ ID NO: 985975 - RNA, 21 nt, Mycobacterium avium subsp. paratuberculosis
cgucggcggucgccagcgcca

SEQ ID NO: 985976 - RNA, 19 nt, Mycobacterium avium subsp. paratuberculosis
cgucggcggucuuggcggc

SEQ ID NO: 985977 - RNA, 19 nt, Mycobacterium avium subsp. paratuberculosis
cgucggcgggcugcagcga

SEQ ID NO: 985978 - RNA, 18 nt, Mycobacterium avium subsp. paratuberculosis
cgucggcggccugcucgc

SEQ ID NO: 985979 - RNA, 11 nt, Mycobacterium avium subsp. paratuberculosis
cgucggcggcc

SEQ ID NO: 985980 - RNA, 20 nt, Mycobacterium avium subsp. paratuberculosis
cgucggcgcuggccagcgcg

SEQ ID NO: 985981 - RNA, 18 nt, Mycobacterium avium subsp. paratuberculosis
cgucggggucgcgccggu

SEQ ID NO: 985982 - RNA, 14 nt, Mycobacterium avium subsp. paratuberculosis
cgucggggucgucg

SEQ ID NO: 985983 - RNA, 16 nt, Mycobacterium avium subsp. paratuberculosis
cgucgggguggccggc

SEQ ID NO: 985984 - RNA, 20 nt, Mycobacterium avium subsp. paratuberculosis
cgucgggguggggacgacgc

SEQ ID NO: 985985 - RNA, 17 nt, Mycobacterium avium subsp. paratuberculosis
cgucggguccgaccagc

SEQ ID NO: 985986 - RNA, 19 nt, Mycobacterium avium subsp. paratuberculosis
cgucggguccgaccagcac

SEQ ID NO: 985987 - RNA, 23 nt, Mycobacterium avium subsp. paratuberculosis
cgucggguccgaccagcacccgg

SEQ ID NO: 985988 - RNA, 17 nt, Mycobacterium avium subsp. paratuberculosis
cgucgggcgcggcggca

SEQ ID NO: 985989 - RNA, 13 nt, Mycobacterium avium subsp. paratuberculosis
cgucgggcucgcc

SEQ ID NO: 985990 - RNA, 16 nt, Mycobacterium avium subsp. paratuberculosis
cgucgggccgcagcac

SEQ ID NO: 985991 - RNA, 11 nt, Mycobacterium avium subsp. paratuberculosis
cgucgggccgg

SEQ ID NO: 985992 - RNA, 19 nt, Mycobacterium avium subsp. paratuberculosis
cgucgggccggaucagcag

SEQ ID NO: 985993 - RNA, 14 nt, Mycobacterium avium subsp. paratuberculosis
cgucgggccggggg

SEQ ID NO: 985994 - RNA, 22 nt, Mycobacterium avium subsp. paratuberculosis
cgucgggccgggggcggcggcg

SEQ ID NO: 985995 - RNA, 12 nt, Mycobacterium avium subsp. paratuberculosis
cgucgggcaccu

SEQ ID NO: 985996 - RNA, 13 nt, Mycobacterium avium subsp. paratuberculosis
cgucgggcaccuc

SEQ ID NO: 985997 - RNA, 16 nt, Mycobacterium avium subsp. paratuberculosis
cgucgggcaccagcac

SEQ ID NO: 985998 - RNA, 14 nt, Mycobacterium avium subsp. paratuberculosis
cgucgggacgcggc

SEQ ID NO: 985999 - RNA, 17 nt, Mycobacterium avium subsp. paratuberculosis
cgucgggacggccagca

SEQ ID NO: 986000 - RNA, 17 nt, Mycobacterium avium subsp. paratuberculosis
cgucguacagcagcccc

SEQ ID NO: 986001 - RNA, 15 nt, Mycobacterium avium subsp. paratuberculosis
cgucguagacgcugc

SEQ ID NO: 986002 - RNA, 18 nt, Mycobacterium avium subsp. paratuberculosis
cgucguagccggcacgca

SEQ ID NO: 986003 - RNA, 16 nt, Mycobacterium avium subsp. paratuberculosis
cgucggugcgcgccgc

SEQ ID NO: 986004 - RNA, 21 nt, Mycobacterium avium subsp. paratuberculosis
cgucgguggcgguggggccga

SEQ ID NO: 986005 - RNA, 23 nt, Mycobacterium avium subsp. paratuberculosis
cgucggugggccgccgcggcggc

SEQ ID NO: 986006 - RNA, 17 nt, Mycobacterium avium subsp. paratuberculosis
cgucgucagccgggcca

SEQ ID NO: 986007 - RNA, 17 nt, Mycobacterium avium subsp. paratuberculosis
cgucguccacgcccagc

SEQ ID NO: 986008 - RNA, 19 nt, Mycobacterium avium subsp. paratuberculosis
cgucguccagcuucucggc

SEQ ID NO: 986009 - RNA, 21 nt, Mycobacterium avium subsp. paratuberculosis
cgucgguggggugaggcaccc

SEQ ID NO: 986010 - RNA, 15 nt, Mycobacterium avium subsp. paratuberculosis
cgucggugguccagu

SEQ ID NO: 986011 - RNA, 21 nt, Mycobacterium avium subsp. paratuberculosis
cgucggugucccgcgcccgcg

SEQ ID NO: 986012 - RNA, 19 nt, Mycobacterium avium subsp. paratuberculosis
cgucggugaaauagcgcag

SEQ ID NO: 986013 - RNA, 14 nt, Mycobacterium avium subsp. paratuberculosis
cgucggugacgccc

SEQ ID NO: 986014 - RNA, 23 nt, Mycobacterium avium subsp. paratuberculosis
cgucggugacgcccuuguccucg

SEQ ID NO: 986015 - RNA, 18 nt, Mycobacterium avium subsp. paratuberculosis
cgucggugaugucgguga

SEQ ID NO: 986016 - RNA, 15 nt, Mycobacterium avium subsp. paratuberculosis
cgucggucacccggu

SEQ ID NO: 986017 - RNA, 17 nt, Mycobacterium avium subsp. paratuberculosis
cgucggucacggacagc

SEQ ID NO: 986018 - RNA, 20 nt, Mycobacterium avium subsp. paratuberculosis
cgucggucagcaggcgccgc

SEQ ID NO: 986019 - RNA, 19 nt, Mycobacterium avium subsp. paratuberculosis
cgucggucccgacgcggcg

SEQ ID NO: 986020 - RNA, 20 nt, Mycobacterium avium subsp. paratuberculosis
cgucggucccgacgcggcgc

SEQ ID NO: 986021 - RNA, 13 nt, Mycobacterium avium subsp. paratuberculosis
cgucggucggcag

SEQ ID NO: 986022 - RNA, 19 nt, Mycobacterium avium subsp. paratuberculosis
cgugacgccgcugcgugcc

SEQ ID NO: 986023 - RNA, 16 nt, Mycobacterium avium subsp. paratuberculosis
cgugacgccgggccgc

SEQ ID NO: 986024 - RNA, 17 nt, Mycobacterium avium subsp. paratuberculosis
cgugacgccgggccgcc

SEQ ID NO: 986025 - RNA, 18 nt, Mycobacterium avium subsp. paratuberculosis
cgugacgcucggcgccgc

SEQ ID NO: 986026 - RNA, 17 nt, Mycobacterium avium subsp. paratuberculosis
cgugacaggggcagcag

SEQ ID NO: 986027 - RNA, 18 nt, Mycobacterium avium subsp. paratuberculosis
cgugacaggggcagcagc

SEQ ID NO: 986028 - RNA, 21 nt, Mycobacterium avium subsp. paratuberculosis
cgugaaccggcguugcauuuc

SEQ ID NO: 986029 - RNA, 18 nt, Mycobacterium avium subsp. paratuberculosis
cgugaguguugaagccgc

SEQ ID NO: 986030 - RNA, 21 nt, Mycobacterium avium subsp. paratuberculosis
cgugaugccgggcaaccacag

SEQ ID NO: 986031 - RNA, 14 nt, Mycobacterium avium subsp. paratuberculosis
cgugaugcagcagg

SEQ ID NO: 986032 - RNA, 16 nt, Mycobacterium avium subsp. paratuberculosis
cgugauccggaaugcg

SEQ ID NO: 986033 - RNA, 16 nt, Mycobacterium avium subsp. paratuberculosis
cgugaucgccaccacc

SEQ ID NO: 986034 - RNA, 18 nt, Mycobacterium avium subsp. paratuberculosis
cgugaucgccaccaccag

SEQ ID NO: 986035 - RNA, 20 nt, Mycobacterium avium subsp. paratuberculosis
cgugaucgccaccaccagcg

SEQ ID NO: 986036 - RNA, 17 nt, Mycobacterium avium subsp. paratuberculosis
cgugaugguccagcacc

SEQ ID NO: 986037 - RNA, 21 nt, Mycobacterium avium subsp. paratuberculosis
cgugauguacagcgacagcag

SEQ ID NO: 986038 - RNA, 16 nt, Mycobacterium avium subsp. paratuberculosis
cgugcagaacagcacg

SEQ ID NO: 986039 - RNA, 15 nt, Mycobacterium avium subsp. paratuberculosis
cgugcaccugcagcc

SEQ ID NO: 986040 - RNA, 24 nt, Mycobacterium avium subsp. paratuberculosis
cgugcaccuuggucagcucccggc

SEQ ID NO: 986041 - RNA, 22 nt, Mycobacterium avium subsp. paratuberculosis
cgugcacgaacgcggccagcgg

SEQ ID NO: 986042 - RNA, 22 nt, Mycobacterium avium subsp. paratuberculosis
cgugcacgccguggcggcgggc

SEQ ID NO: 986043 - RNA, 17 nt, Mycobacterium avium subsp. paratuberculosis
cgugcacacccgcagcg

SEQ ID NO: 986044 - RNA, 21 nt, Mycobacterium avium subsp. paratuberculosis
cgugcacacccgcagcgaccg

SEQ ID NO: 986045 - RNA, 17 nt, Mycobacterium avium subsp. paratuberculosis
cgugcacaggccgccgc

SEQ ID NO: 986046 - RNA, 19 nt, Mycobacterium avium subsp. paratuberculosis
cgugcacaggccgccgcau

SEQ ID NO: 986047 - RNA, 15 nt, Mycobacterium avium subsp. paratuberculosis
cgugcauccagccgu

SEQ ID NO: 986048 - RNA, 23 nt, Mycobacterium avium subsp. paratuberculosis
cgugcaucggcgccugcgagcac

SEQ ID NO: 986049 - RNA, 15 nt, Mycobacterium avium subsp. paratuberculosis
cgugcaucgggcgcu

SEQ ID NO: 986050 - RNA, 14 nt, Mycobacterium avium subsp. paratuberculosis
cgugcagucccaga

SEQ ID NO: 986051 - RNA, 23 nt, Mycobacterium avium subsp. paratuberculosis
cgugcaggugcggcaccuccagc

SEQ ID NO: 986052 - RNA, 17 nt, Mycobacterium avium subsp. paratuberculosis
cgugcagcgccagcacc

SEQ ID NO: 986053 - RNA, 18 nt, Mycobacterium avium subsp. paratuberculosis
cgugcagcgccagcaccg

SEQ ID NO: 986054 - RNA, 12 nt, Mycobacterium avium subsp. paratuberculosis
cgugcagcgccc

SEQ ID NO: 986055 - RNA, 14 nt, Mycobacterium avium subsp. paratuberculosis
cgugcagcaccgcc

SEQ ID NO: 986056 - RNA, 17 nt, Mycobacterium avium subsp. paratuberculosis
cgugcagcaccgccagc

SEQ ID NO: 986057 - RNA, 15 nt, Mycobacterium avium subsp. paratuberculosis
cgugcagcacgccgc

SEQ ID NO: 986058 - RNA, 13 nt, Mycobacterium avium subsp. paratuberculosis
cgugcagcccgca

SEQ ID NO: 986059 - RNA, 13 nt, Mycobacterium avium subsp. paratuberculosis
cgugcagccgcaa

SEQ ID NO: 986060 - RNA, 17 nt, Mycobacterium avium subsp. paratuberculosis
cgugcagccggcggcgc

SEQ ID NO: 986061 - RNA, 22 nt, Mycobacterium avium subsp. paratuberculosis
cgugcagccgggccugcagcaa

SEQ ID NO: 986062 - RNA, 15 nt, Mycobacterium avium subsp. paratuberculosis
cgugcagccgggcgg

SEQ ID NO: 986063 - RNA, 15 nt, Mycobacterium avium subsp. paratuberculosis
cgugcagcgcggcga

SEQ ID NO: 986064 - RNA, 19 nt, Mycobacterium avium subsp. paratuberculosis
cgugccccuccucggucag

SEQ ID NO: 986065 - RNA, 15 nt, Mycobacterium avium subsp. paratuberculosis
cgugccggcgcugcc

SEQ ID NO: 986066 - RNA, 15 nt, Mycobacterium avium subsp. paratuberculosis
cgugccggcggcagg

SEQ ID NO: 986067 - RNA, 18 nt, Mycobacterium avium subsp. paratuberculosis
cgugccggcucggcggcu

SEQ ID NO: 986068 - RNA, 15 nt, Mycobacterium avium subsp. paratuberculosis
cgugccguugacgaa

SEQ ID NO: 986069 - RNA, 15 nt, Mycobacterium avium subsp. paratuberculosis
cgugccgcugggagc

SEQ ID NO: 986070 - RNA, 16 nt, Mycobacterium avium subsp. paratuberculosis
cgugccguccggccgg

SEQ ID NO: 986071 - RNA, 13 nt, Mycobacterium avium subsp. paratuberculosis
cgugccgaccagc

SEQ ID NO: 986072 - RNA, 16 nt, Mycobacterium avium subsp. paratuberculosis
cgugccgauggccacc

SEQ ID NO: 986073 - RNA, 20 nt, Mycobacterium avium subsp. paratuberculosis
cgugccggaccgcgcgggcc

SEQ ID NO: 986074 - RNA, 17 nt, Mycobacterium avium subsp. paratuberculosis
cgugccggcccggcggg

SEQ ID NO: 986075 - RNA, 23 nt, Mycobacterium avium subsp. paratuberculosis
cgugccgcacccgauccacggcg

SEQ ID NO: 986076 - RNA, 13 nt, Mycobacterium avium subsp. paratuberculosis
cgugccagcagcu

SEQ ID NO: 986077 - RNA, 14 nt, Mycobacterium avium subsp. paratuberculosis
cgugccagggcagc

SEQ ID NO: 986078 - RNA, 15 nt, Mycobacterium avium subsp. paratuberculosis
cgugccacaggccga

SEQ ID NO: 986079 - RNA, 13 nt, Mycobacterium avium subsp. paratuberculosis
cgugcccggccca

SEQ ID NO: 986080 - RNA, 14 nt, Mycobacterium avium subsp. paratuberculosis
cgugcccggcgccc

SEQ ID NO: 986081 - RNA, 14 nt, Mycobacterium avium subsp. paratuberculosis
cgugcccuuccccg

SEQ ID NO: 986082 - RNA, 16 nt, Mycobacterium avium subsp. paratuberculosis
cgugcccuuccccggc

SEQ ID NO: 986083 - RNA, 19 nt, Mycobacterium avium subsp. paratuberculosis
cgugcccuuccccggcggc

SEQ ID NO: 986084 - RNA, 18 nt, Mycobacterium avium subsp. paratuberculosis
cgugcccgccgaccagga

SEQ ID NO: 986085 - RNA, 20 nt, Mycobacterium avium subsp. paratuberculosis
cgugcccgcgcccaccugga

SEQ ID NO: 986086 - RNA, 17 nt, Mycobacterium avium subsp. paratuberculosis
cgugccccaggucgggg

SEQ ID NO: 986087 - RNA, 13 nt, Mycobacterium avium subsp. paratuberculosis
cgugcccagcccg

SEQ ID NO: 986088 - RNA, 20 nt, Mycobacterium avium subsp. paratuberculosis
cgugcccagcccgcgcgagc

SEQ ID NO: 986089 - RNA, 18 nt, Mycobacterium avium subsp. paratuberculosis
cgucgcagugcccgccca

SEQ ID NO: 986090 - RNA, 22 nt, Mycobacterium avium subsp. paratuberculosis
cgucgcacuagguccggcgcga

SEQ ID NO: 986091 - RNA, 18 nt, Mycobacterium avium subsp. paratuberculosis
cgucgcagaucccgccgg

SEQ ID NO: 986092 - RNA, 14 nt, Mycobacterium avium subsp. paratuberculosis
cgucgcacaaccgg

SEQ ID NO: 986093 - RNA, 15 nt, Mycobacterium avium subsp. paratuberculosis
cgucgcacagcgccg

SEQ ID NO: 986094 - RNA, 14 nt, Mycobacterium avium subsp. paratuberculosis
cgucgccaccaccg

SEQ ID NO: 986095 - RNA, 15 nt, Mycobacterium avium subsp. paratuberculosis
cgucgccaccagacc

SEQ ID NO: 986096 - RNA, 21 nt, Mycobacterium avium subsp. paratuberculosis
cgucgccaccgagucgcgcga

SEQ ID NO: 986097 - RNA, 14 nt, Mycobacterium avium subsp. paratuberculosis
cgucgccaccgaug

SEQ ID NO: 986098 - RNA, 16 nt, Mycobacterium avium subsp. paratuberculosis
cgucgccaccgaugcg

SEQ ID NO: 986099 - RNA, 21 nt, Mycobacterium avium subsp. paratuberculosis
cgucgccaccgaugcgggcca

SEQ ID NO: 986100 - RNA, 20 nt, Mycobacterium avium subsp. paratuberculosis
cgucgccacgaucaccacca

SEQ ID NO: 986101 - RNA, 22 nt, Mycobacterium avium subsp. paratuberculosis
cgucgccacgaucaccaccacc

SEQ ID NO: 986102 - RNA, 21 nt, Mycobacterium avium subsp. paratuberculosis
cgucgaugugggccgcagcag

SEQ ID NO: 986103 - RNA, 15 nt, Mycobacterium avium subsp. paratuberculosis
cgucgaugucggcgg

SEQ ID NO: 986104 - RNA, 14 nt, Mycobacterium avium subsp. paratuberculosis
cgucgaugucgucg

SEQ ID NO: 986105 - RNA, 15 nt, Mycobacterium avium subsp. paratuberculosis
cgucgaugcgggccc

SEQ ID NO: 986106 - RNA, 19 nt, Mycobacterium avium subsp. paratuberculosis
cgucgauggaaggugcuga

SEQ ID NO: 986107 - RNA, 18 nt, Mycobacterium avium subsp. paratuberculosis
cgucgaugcgcagcagcg

SEQ ID NO: 986108 - RNA, 15 nt, Mycobacterium avium subsp. paratuberculosis
cgucgaugccggcca

SEQ ID NO: 986109 - RNA, 13 nt, Mycobacterium avium subsp. paratuberculosis
cgucgccagccgc

SEQ ID NO: 986110 - RNA, 14 nt, Mycobacterium avium subsp. paratuberculosis
cgucgccagccgcc

SEQ ID NO: 986111 - RNA, 14 nt, Mycobacterium avium subsp. paratuberculosis
cgucgcccaccgug

SEQ ID NO: 986112 - RNA, 13 nt, Mycobacterium avium subsp. paratuberculosis
cgucgcccagcgu

SEQ ID NO: 986113 - RNA, 14 nt, Mycobacterium avium subsp. paratuberculosis
cgucgcccagcgug

SEQ ID NO: 986114 - RNA, 18 nt, Mycobacterium avium subsp. paratuberculosis
cgucgcccggcguccagu

SEQ ID NO: 986115 - RNA, 16 nt, Mycobacterium avium subsp. paratuberculosis
cgucgccgaccagcag

SEQ ID NO: 986116 - RNA, 17 nt, Mycobacterium avium subsp. paratuberculosis
cgucgccgaccagccga

SEQ ID NO: 986117 - RNA, 22 nt, Mycobacterium avium subsp. paratuberculosis
cgucgccgaccagccgaggcgc

SEQ ID NO: 986118 - RNA, 19 nt, Mycobacterium avium subsp. paratuberculosis
cgucgcaucagcucggcag

SEQ ID NO: 986119 - RNA, 19 nt, Mycobacterium avium subsp. paratuberculosis
cgucgcccaucaccagcag

SEQ ID NO: 986120 - RNA, 14 nt, Mycobacterium avium subsp. paratuberculosis
cgucgccgccgggc

SEQ ID NO: 986121 - RNA, 23 nt, Mycobacterium avium subsp. paratuberculosis
cgucgccgccgcaauacaccgcg

SEQ ID NO: 986122 - RNA, 12 nt, Mycobacterium avium subsp. paratuberculosis
cgucgccgcccc

SEQ ID NO: 986123 - RNA, 13 nt, Mycobacterium avium subsp. paratuberculosis
cgucgccgccccg

SEQ ID NO: 986124 - RNA, 16 nt, Mycobacterium avium subsp. paratuberculosis
cgucgccgacgggccc

SEQ ID NO: 986125 - RNA, 16 nt, Mycobacterium avium subsp. paratuberculosis
cgucgccgagccgcgc

SEQ ID NO: 986126 - RNA, 22 nt, Mycobacterium avium subsp. paratuberculosis
cgucgccgauguaguccagccc

SEQ ID NO: 986127 - RNA, 17 nt, Mycobacterium avium subsp. paratuberculosis
cgucgaguucgcggcgc

SEQ ID NO: 986128 - RNA, 18 nt, Mycobacterium avium subsp. paratuberculosis
cgucgaguucgcggcgca

SEQ ID NO: 986129 - RNA, 22 nt, Mycobacterium avium subsp. paratuberculosis
cgucgaguucgcggcgcagcac

SEQ ID NO: 986130 - RNA, 19 nt, Mycobacterium avium subsp. paratuberculosis
cgucgagguugaaucgccu

SEQ ID NO: 986131 - RNA, 20 nt, Mycobacterium avium subsp. paratuberculosis
cgucgaucucggugagccgc

SEQ ID NO: 986132 - RNA, 19 nt, Mycobacterium avium subsp. paratuberculosis
cgucgauccccgcagcucc

SEQ ID NO: 986133 - RNA, 17 nt, Mycobacterium avium subsp. paratuberculosis
cgucgaucagcgcgccg

SEQ ID NO: 986134 - RNA, 21 nt, Mycobacterium avium subsp. paratuberculosis
cgucgagcggcuugccgccgc

SEQ ID NO: 986135 - RNA, 16 nt, Mycobacterium avium subsp. paratuberculosis
cgucgagcgucacgcc

SEQ ID NO: 986136 - RNA, 18 nt, Mycobacterium avium subsp. paratuberculosis
cgucgagcgucacgccgc

SEQ ID NO: 986137 - RNA, 22 nt, Mycobacterium avium subsp. paratuberculosis
cgucgagcgucacgccgcgccc

SEQ ID NO: 986138 - RNA, 14 nt, Mycobacterium avium subsp. paratuberculosis
cgucgagcuccucg

SEQ ID NO: 986139 - RNA, 14 nt, Mycobacterium avium subsp. paratuberculosis
cgucgagcgcgucg

SEQ ID NO: 986140 - RNA, 22 nt, Mycobacterium avium subsp. paratuberculosis
cgucgaggccgaaccgcagccg

SEQ ID NO: 986141 - RNA, 18 nt, Mycobacterium avium subsp. paratuberculosis
cgucgaggcgcugcagca

SEQ ID NO: 986142 - RNA, 19 nt, Mycobacterium avium subsp. paratuberculosis
cgucgaggcgcugcagcau

SEQ ID NO: 986143 - RNA, 20 nt, Mycobacterium avium subsp. paratuberculosis
cgucgagggccaccggcucc

SEQ ID NO: 986144 - RNA, 15 nt, Mycobacterium avium subsp. paratuberculosis
cgucgagggcgccgu

SEQ ID NO: 986145 - RNA, 17 nt, Mycobacterium avium subsp. paratuberculosis
cgucgaggucggacgcc

SEQ ID NO: 986146 - RNA, 19 nt, Mycobacterium avium subsp. paratuberculosis
cgucgaggucggacgccuc

SEQ ID NO: 986147 - RNA, 20 nt, Mycobacterium avium subsp. paratuberculosis
cgucgaggucgucgggcgcc

SEQ ID NO: 986148 - RNA, 12 nt, Mycobacterium avium subsp. paratuberculosis
cgucgagguguu

SEQ ID NO: 986149 - RNA, 14 nt, Mycobacterium avium subsp. paratuberculosis
cgucgagcaccucc

SEQ ID NO: 986150 - RNA, 18 nt, Mycobacterium avium subsp. paratuberculosis
cgucgacgcgcugcuuga

SEQ ID NO: 986151 - RNA, 18 nt, Mycobacterium avium subsp. paratuberculosis
cgucgagcauccggcgca

SEQ ID NO: 986152 - RNA, 14 nt, Mycobacterium avium subsp. paratuberculosis
cgucgagccggccg

SEQ ID NO: 986153 - RNA, 15 nt, Mycobacterium avium subsp. paratuberculosis
cgucgagccgggccc

SEQ ID NO: 986154 - RNA, 19 nt, Mycobacterium avium subsp. paratuberculosis
cgucgagccagcgggccga

SEQ ID NO: 986155 - RNA, 14 nt, Mycobacterium avium subsp. paratuberculosis
cgucgagcgcggcc

SEQ ID NO: 986156 - RNA, 18 nt, Mycobacterium avium subsp. paratuberculosis
cgucgacgucgagggcgc

SEQ ID NO: 986157 - RNA, 18 nt, Mycobacterium avium subsp. paratuberculosis
cgucgacgugcgcggcgu

SEQ ID NO: 986158 - RNA, 22 nt, Mycobacterium avium subsp. paratuberculosis
cgucgacgcggugacaugcccg

SEQ ID NO: 986159 - RNA, 21 nt, Mycobacterium avium subsp. paratuberculosis
cgucgacgcccugccacagcg

SEQ ID NO: 986160 - RNA, 13 nt, Mycobacterium avium subsp. paratuberculosis
cgucgaccgcccc

SEQ ID NO: 986161 - RNA, 18 nt, Mycobacterium avium subsp. paratuberculosis
cgucgaccuugcagcccg

SEQ ID NO: 986162 - RNA, 14 nt, Mycobacterium avium subsp. paratuberculosis
cgucgaccuccucg

SEQ ID NO: 986163 - RNA, 18 nt, Mycobacterium avium subsp. paratuberculosis
cgucgaccccgccggccc

SEQ ID NO: 986164 - RNA, 15 nt, Mycobacterium avium subsp. paratuberculosis
cgucgccggcggggc

SEQ ID NO: 986165 - RNA, 17 nt, Mycobacterium avium subsp. paratuberculosis
cgucgccggccgccagc

SEQ ID NO: 986166 - RNA, 14 nt, Mycobacterium avium subsp. paratuberculosis
cgucgccggccgcg

SEQ ID NO: 986167 - RNA, 15 nt, Mycobacterium avium subsp. paratuberculosis
cgucgccggccgcgg

SEQ ID NO: 986168 - RNA, 16 nt, Mycobacterium avium subsp. paratuberculosis
cgucgccggugagcac

SEQ ID NO: 986169 - RNA, 15 nt, Mycobacterium avium subsp. paratuberculosis
cgucgccucgcccuc

SEQ ID NO: 986170 - RNA, 17 nt, Mycobacterium avium subsp. paratuberculosis
cgucgcgcagguaggug

SEQ ID NO: 986171 - RNA, 21 nt, Mycobacterium avium subsp. paratuberculosis
cgucgcgcaaacugacaggcg

SEQ ID NO: 986172 - RNA, 23 nt, Mycobacterium avium subsp. paratuberculosis
cgucgcgccgauguacugggccg

SEQ ID NO: 986173 - RNA, 21 nt, Mycobacterium avium subsp. paratuberculosis
cgucgcgccgccaccccaggc

SEQ ID NO: 986174 - RNA, 13 nt, Mycobacterium avium subsp. paratuberculosis
cgucgcgccgccg

SEQ ID NO: 986175 - RNA, 15 nt, Mycobacterium avium subsp. paratuberculosis
cgucgcgcaccaccu

SEQ ID NO: 986176 - RNA, 14 nt, Mycobacterium avium subsp. paratuberculosis
cgucgcgcaccagc

SEQ ID NO: 986177 - RNA, 17 nt, Mycobacterium avium subsp. paratuberculosis
cgucgcgcacccagccg

SEQ ID NO: 986178 - RNA, 18 nt, Mycobacterium avium subsp. paratuberculosis
cgucgcgcacccagccgc

SEQ ID NO: 986179 - RNA, 16 nt, Mycobacterium avium subsp. paratuberculosis
cgucgcuaccucacca

SEQ ID NO: 986180 - RNA, 18 nt, Mycobacterium avium subsp. paratuberculosis
cgucgcggcgcacccggg

SEQ ID NO: 986181 - RNA, 23 nt, Mycobacterium avium subsp. paratuberculosis
cgucgcggcgcuaaagccaccag

SEQ ID NO: 986182 - RNA, 12 nt, Mycobacterium avium subsp. paratuberculosis
cgucgcggcggc

SEQ ID NO: 986183 - RNA, 15 nt, Mycobacterium avium subsp. paratuberculosis
cgucgcggcggcgcu

SEQ ID NO: 986184 - RNA, 23 nt, Mycobacterium avium subsp. paratuberculosis
cgucgcggcggugcgcagccgcu

SEQ ID NO: 986185 - RNA, 18 nt, Mycobacterium avium subsp. paratuberculosis
cgucgcgggaaucccacc

SEQ ID NO: 986186 - RNA, 18 nt, Mycobacterium avium subsp. paratuberculosis
cgucgcgggcccgggcca

SEQ ID NO: 986187 - RNA, 14 nt, Mycobacterium avium subsp. paratuberculosis
cgucgcgggcgccg

SEQ ID NO: 986188 - RNA, 18 nt, Mycobacterium avium subsp. paratuberculosis
cgucgcgggugaccggcg

SEQ ID NO: 986189 - RNA, 20 nt, Mycobacterium avium subsp. paratuberculosis
cgucgcgggugaccggcgcc

SEQ ID NO: 986190 - RNA, 21 nt, Mycobacterium avium subsp. paratuberculosis
cgucgcgguccacgccggcga

SEQ ID NO: 986191 - RNA, 15 nt, Mycobacterium avium subsp. paratuberculosis
cgucgcgcugccggc

SEQ ID NO: 986192 - RNA, 15 nt, Mycobacterium avium subsp. paratuberculosis
cgucgcgcagcagcg

SEQ ID NO: 986193 - RNA, 17 nt, Mycobacterium avium subsp. paratuberculosis
cgucgcgcugccggccc

SEQ ID NO: 986194 - RNA, 24 nt, Mycobacterium avium subsp. paratuberculosis
cgucgcggaggaugccggccagcu

SEQ ID NO: 986195 - RNA, 15 nt, Mycobacterium avium subsp. paratuberculosis
cgucgcggcccugga

SEQ ID NO: 986196 - RNA, 16 nt, Mycobacterium avium subsp. paratuberculosis
cgucggaauacagcag

SEQ ID NO: 986197 - RNA, 16 nt, Mycobacterium avium subsp. paratuberculosis
cgucggacaccagcau

SEQ ID NO: 986198 - RNA, 13 nt, Mycobacterium avium subsp. paratuberculosis
cgucggacagcag

SEQ ID NO: 986199 - RNA, 20 nt, Mycobacterium avium subsp. paratuberculosis
cgucggagaucaccggcacc

SEQ ID NO: 986200 - RNA, 15 nt, Mycobacterium avium subsp. paratuberculosis
cgucgcugucggcga

SEQ ID NO: 986201 - RNA, 14 nt, Mycobacterium avium subsp. paratuberculosis
cgucggcaccagcg

SEQ ID NO: 986202 - RNA, 17 nt, Mycobacterium avium subsp. paratuberculosis
cgucggcaccagcggca

SEQ ID NO: 986203 - RNA, 13 nt, Mycobacterium avium subsp. paratuberculosis
cgucggccagcag

SEQ ID NO: 986204 - RNA, 14 nt, Mycobacterium avium subsp. paratuberculosis
cgucggccaacgga

SEQ ID NO: 986205 - RNA, 15 nt, Mycobacterium avium subsp. paratuberculosis
cgucggccagcagcg

SEQ ID NO: 986206 - RNA, 14 nt, Mycobacterium avium subsp. paratuberculosis
cgucggccagcgcg

SEQ ID NO: 986207 - RNA, 17 nt, Mycobacterium avium subsp. paratuberculosis
cgucggcccgccaaaac

SEQ ID NO: 986208 - RNA, 17 nt, Mycobacterium avium subsp. paratuberculosis
cgucggccucggcggcc

SEQ ID NO: 986209 - RNA, 24 nt, Mycobacterium avium subsp. paratuberculosis
cgucggccugcacgucggcgcgca

SEQ ID NO: 986210 - RNA, 16 nt, Mycobacterium avium subsp. paratuberculosis
cgucggccgcacaaca

SEQ ID NO: 986211 - RNA, 13 nt, Mycobacterium avium subsp. paratuberculosis
cgucggccgccag

SEQ ID NO: 986212 - RNA, 15 nt, Mycobacterium avium subsp. paratuberculosis
cgucggccgggggcg

SEQ ID NO: 986213 - RNA, 17 nt, Mycobacterium avium subsp. paratuberculosis
cgucggccgggggcgcg

SEQ ID NO: 986214 - RNA, 19 nt, Mycobacterium avium subsp. paratuberculosis
cgucggccgucggcgccgc

SEQ ID NO: 986215 - RNA, 13 nt, Mycobacterium avium subsp. paratuberculosis
cgucggcgcggcc

SEQ ID NO: 986216 - RNA, 13 nt, Mycobacterium avium subsp. paratuberculosis
cgucggcgcgcag

SEQ ID NO: 986217 - RNA, 18 nt, Mycobacterium avium subsp. paratuberculosis
cgucggcgcgggccagca

SEQ ID NO: 986218 - RNA, 21 nt, Mycobacterium avium subsp. paratuberculosis
cgucggcgcgggccagcagca

SEQ ID NO: 986219 - RNA, 13 nt, Mycobacterium avium subsp. paratuberculosis
cgucggcgccgcc

SEQ ID NO: 986220 - RNA, 14 nt, Mycobacterium avium subsp. paratuberculosis
cgucggcgccgccg

SEQ ID NO: 986221 - RNA, 18 nt, Mycobacterium avium subsp. paratuberculosis
cgucggcgccggcgcgca

SEQ ID NO: 986222 - RNA, 13 nt, Mycobacterium avium subsp. paratuberculosis
cgucggcgagcag

SEQ ID NO: 986223 - RNA, 14 nt, Mycobacterium avium subsp. paratuberculosis
cgucggcgaaggug

SEQ ID NO: 986224 - RNA, 23 nt, Mycobacterium avium subsp. paratuberculosis
cgucggcgaguucgaccuccacc

SEQ ID NO: 986225 - RNA, 16 nt, Mycobacterium avium subsp. paratuberculosis
cgucggcgaucgccag

SEQ ID NO: 986226 - RNA, 21 nt, Mycobacterium avium subsp. paratuberculosis
cgucggcgauggcggcgugca

SEQ ID NO: 986227 - RNA, 11 nt, Mycobacterium avium subsp. paratuberculosis
cguccucccgg

SEQ ID NO: 986228 - RNA, 12 nt, Mycobacterium avium subsp. paratuberculosis
cguccucccggc

SEQ ID NO: 986229 - RNA, 15 nt, Mycobacterium avium subsp. paratuberculosis
cguccucccggccga

SEQ ID NO: 986230 - RNA, 14 nt, Mycobacterium avium subsp. paratuberculosis
cguccuccuccucg

SEQ ID NO: 986231 - RNA, 18 nt, Mycobacterium avium subsp. paratuberculosis
cguccuccucguccgcgg

SEQ ID NO: 986232 - RNA, 14 nt, Mycobacterium avium subsp. paratuberculosis
cguccucggucagg

SEQ ID NO: 986233 - RNA, 20 nt, Mycobacterium avium subsp. paratuberculosis
cguccucgaucaccgacagc

SEQ ID NO: 986234 - RNA, 17 nt, Mycobacterium avium subsp. paratuberculosis
cguccucgaccacccgc

SEQ ID NO: 986235 - RNA, 19 nt, Mycobacterium avium subsp. paratuberculosis
cguccucgaugccgaccga

SEQ ID NO: 986236 - RNA, 23 nt, Mycobacterium avium subsp. paratuberculosis
cguccucgaugccgaccgacagc

SEQ ID NO: 986237 - RNA, 14 nt, Mycobacterium avium subsp. paratuberculosis
cguccucgcccggg

SEQ ID NO: 986238 - RNA, 23 nt, Mycobacterium avium subsp. paratuberculosis
cguccugccaguugucgaucucc

SEQ ID NO: 986239 - RNA, 18 nt, Mycobacterium avium subsp. paratuberculosis
cguccugcagcagccgga

SEQ ID NO: 986240 - RNA, 15 nt, Mycobacterium avium subsp. paratuberculosis
cguccugcagcgccg

SEQ ID NO: 986241 - RNA, 23 nt, Mycobacterium avium subsp. paratuberculosis
cguccugcaggcaggccggcagc

SEQ ID NO: 986242 - RNA, 23 nt, Mycobacterium avium subsp. paratuberculosis
cguccucguucuggcccgccauc

SEQ ID NO: 986243 - RNA, 15 nt, Mycobacterium avium subsp. paratuberculosis
cgucgaaggccugga

SEQ ID NO: 986244 - RNA, 14 nt, Mycobacterium avium subsp. paratuberculosis
cgucgaccaccacg

SEQ ID NO: 986245 - RNA, 19 nt, Mycobacterium avium subsp. paratuberculosis
cgucgaccaccgccggccc

SEQ ID NO: 986246 - RNA, 14 nt, Mycobacterium avium subsp. paratuberculosis
cgucgaccagccgg

SEQ ID NO: 986247 - RNA, 13 nt, Mycobacterium avium subsp. paratuberculosis
cgucgacaccccg

SEQ ID NO: 986248 - RNA, 19 nt, Mycobacterium avium subsp. paratuberculosis
cguccuugacccggccgca

SEQ ID NO: 986249 - RNA, 23 nt, Mycobacterium avium subsp. paratuberculosis
cguccuugacccggccgcacacc

SEQ ID NO: 986250 - RNA, 13 nt, Mycobacterium avium subsp. paratuberculosis
cguccuugacgaa

SEQ ID NO: 986251 - RNA, 20 nt, Mycobacterium avium subsp. paratuberculosis
cguccuugagcccccaccug

SEQ ID NO: 986252 - RNA, 19 nt, Mycobacterium avium subsp. paratuberculosis
cguccuuggccgccagcac

SEQ ID NO: 986253 - RNA, 18 nt, Mycobacterium avium subsp. paratuberculosis
cgucgaacucgggcccga

SEQ ID NO: 986254 - RNA, 18 nt, Mycobacterium avium subsp. paratuberculosis
cgucgaacugcagccggc

SEQ ID NO: 986255 - RNA, 16 nt, Mycobacterium avium subsp. paratuberculosis
cgucgaacccgacccc

SEQ ID NO: 986256 - RNA, 22 nt, Mycobacterium avium subsp. paratuberculosis
cgucgaacacguugcgcaucag

SEQ ID NO: 986257 - RNA, 19 nt, Mycobacterium avium subsp. paratuberculosis
cgucgaacagccgggccgc

SEQ ID NO: 986258 - RNA, 18 nt, Mycobacterium avium subsp. paratuberculosis
cguccgcaaccgccggca

SEQ ID NO: 986259 - RNA, 19 nt, Mycobacterium avium subsp. paratuberculosis
cguccgcaaccgccggcag

SEQ ID NO: 986260 - RNA, 21 nt, Mycobacterium avium subsp. paratuberculosis
cguccgcaaccgccggcagcg

SEQ ID NO: 986261 - RNA, 20 nt, Mycobacterium avium subsp. paratuberculosis
cguccgagaagggccgccgc

SEQ ID NO: 986262 - RNA, 22 nt, Mycobacterium avium subsp. paratuberculosis
cguccgagaagggccgccgcug

SEQ ID NO: 986263 - RNA, 19 nt, Mycobacterium avium subsp. paratuberculosis
cguccgauaccagccgcgg

SEQ ID NO: 986264 - RNA, 23 nt, Mycobacterium avium subsp. paratuberculosis
cguccgauaccagccgcggacgg

SEQ ID NO: 986265 - RNA, 15 nt, Mycobacterium avium subsp. paratuberculosis
cguccgacagcgccu

SEQ ID NO: 986266 - RNA, 19 nt, Mycobacterium avium subsp. paratuberculosis
cguccgacagcgccugccc

SEQ ID NO: 986267 - RNA, 14 nt, Mycobacterium avium subsp. paratuberculosis
cguccgcggccgcg

SEQ ID NO: 986268 - RNA, 15 nt, Mycobacterium avium subsp. paratuberculosis
cguccgcggccgcgg

SEQ ID NO: 986269 - RNA, 18 nt, Mycobacterium avium subsp. paratuberculosis
cguccgcgcgagaguauc

SEQ ID NO: 986270 - RNA, 20 nt, Mycobacterium avium subsp. paratuberculosis
cguccgcgacgcugagcgcc

SEQ ID NO: 986271 - RNA, 24 nt, Mycobacterium avium subsp. paratuberculosis
cguccgcgacgcugagcgccaggc

SEQ ID NO: 986272 - RNA, 12 nt, Mycobacterium avium subsp. paratuberculosis
cguccggcggca

SEQ ID NO: 986273 - RNA, 20 nt, Mycobacterium avium subsp. paratuberculosis
cguccggaggugccggccgg

SEQ ID NO: 986274 - RNA, 22 nt, Mycobacterium avium subsp. paratuberculosis
cguccggauagccgucggcgga

SEQ ID NO: 986275 - RNA, 21 nt, Mycobacterium avium subsp. paratuberculosis
cguccgcgucggcgccggcca

SEQ ID NO: 986276 - RNA, 14 nt, Mycobacterium avium subsp. paratuberculosis
cguccgcggcggcg

SEQ ID NO: 986277 - RNA, 13 nt, Mycobacterium avium subsp. paratuberculosis
cguccgcggcgga

SEQ ID NO: 986278 - RNA, 15 nt, Mycobacterium avium subsp. paratuberculosis
cguccgcggugagca

SEQ ID NO: 986279 - RNA, 21 nt, Mycobacterium avium subsp. paratuberculosis
cguccgcgguuucaccgugcg

SEQ ID NO: 986280 - RNA, 20 nt, Mycobacterium avium subsp. paratuberculosis
cguccgugccguccggccgg

SEQ ID NO: 986281 - RNA, 19 nt, Mycobacterium avium subsp. paratuberculosis
cguccgugcugccggccgg

SEQ ID NO: 986282 - RNA, 23 nt, Mycobacterium avium subsp. paratuberculosis
cguccgugcugccggccggcagc

SEQ ID NO: 986283 - RNA, 17 nt, Mycobacterium avium subsp. paratuberculosis
cguccgguucggcggca

SEQ ID NO: 986284 - RNA, 20 nt, Mycobacterium avium subsp. paratuberculosis
cguccgguaggugaucgccu

SEQ ID NO: 986285 - RNA, 21 nt, Mycobacterium avium subsp. paratuberculosis
cguccgguaggugaucgccuc

SEQ ID NO: 986286 - RNA, 15 nt, Mycobacterium avium subsp. paratuberculosis
cguccgggccgccuc

SEQ ID NO: 986287 - RNA, 16 nt, Mycobacterium avium subsp. paratuberculosis
cguccgggucgcacag

SEQ ID NO: 986288 - RNA, 20 nt, Mycobacterium avium subsp. paratuberculosis
cguccgggcguagugcagcu

SEQ ID NO: 986289 - RNA, 21 nt, Mycobacterium avium subsp. paratuberculosis
cguccgggcguagugcagcug

SEQ ID NO: 986290 - RNA, 20 nt, Mycobacterium avium subsp. paratuberculosis
cguccaucguccucgcgccg

SEQ ID NO: 986291 - RNA, 22 nt, Mycobacterium avium subsp. paratuberculosis
cgucccacacgggugugacauc

SEQ ID NO: 986292 - RNA, 17 nt, Mycobacterium avium subsp. paratuberculosis
cguccagugacgccugc

SEQ ID NO: 986293 - RNA, 22 nt, Mycobacterium avium subsp. paratuberculosis
cguccagugacgccugcggccc

SEQ ID NO: 986294 - RNA, 20 nt, Mycobacterium avium subsp. paratuberculosis
cguccagugcaugccggccu

SEQ ID NO: 986295 - RNA, 16 nt, Mycobacterium avium subsp. paratuberculosis
cguccaguccggcgug

SEQ ID NO: 986296 - RNA, 14 nt, Mycobacterium avium subsp. paratuberculosis
cguccaguagccgc

SEQ ID NO: 986297 - RNA, 18 nt, Mycobacterium avium subsp. paratuberculosis
cguccaguagccgccggg

SEQ ID NO: 986298 - RNA, 16 nt, Mycobacterium avium subsp. paratuberculosis
cguccaggucgcccuc

SEQ ID NO: 986299 - RNA, 21 nt, Mycobacterium avium subsp. paratuberculosis
cguccaugcucuugcgggcgg

SEQ ID NO: 986300 - RNA, 11 nt, Mycobacterium avium subsp. paratuberculosis
cgucccagccg

SEQ ID NO: 986301 - RNA, 14 nt, Mycobacterium avium subsp. paratuberculosis
cguccccaccaccg

SEQ ID NO: 986302 - RNA, 19 nt, Mycobacterium avium subsp. paratuberculosis
cgucccaggguugccgcac

SEQ ID NO: 986303 - RNA, 13 nt, Mycobacterium avium subsp. paratuberculosis
cguccccuccccg

SEQ ID NO: 986304 - RNA, 15 nt, Mycobacterium avium subsp. paratuberculosis
cgucccgcgcggggg

SEQ ID NO: 986305 - RNA, 19 nt, Mycobacterium avium subsp. paratuberculosis
cgucccggcgucucggcgu

SEQ ID NO: 986306 - RNA, 19 nt, Mycobacterium avium subsp. paratuberculosis
cgucccggcccauggcgaa

SEQ ID NO: 986307 - RNA, 21 nt, Mycobacterium avium subsp. paratuberculosis
cguccagaccggccggggcgg

SEQ ID NO: 986308 - RNA, 16 nt, Mycobacterium avium subsp. paratuberculosis
cguccacgaccccggc

SEQ ID NO: 986309 - RNA, 17 nt, Mycobacterium avium subsp. paratuberculosis
cguccacgaccccggcg

SEQ ID NO: 986310 - RNA, 14 nt, Mycobacterium avium subsp. paratuberculosis
cguccacgcccagc

SEQ ID NO: 986311 - RNA, 18 nt, Mycobacterium avium subsp. paratuberculosis
cguccacgcccagcgccc

SEQ ID NO: 986312 - RNA, 16 nt, Mycobacterium avium subsp. paratuberculosis
cguccagcugcgcgcc

SEQ ID NO: 986313 - RNA, 21 nt, Mycobacterium avium subsp. paratuberculosis
cguccagcugcgcgccggcgg

SEQ ID NO: 986314 - RNA, 23 nt, Mycobacterium avium subsp. paratuberculosis
cguccagcugcgcgccggcggcc

SEQ ID NO: 986315 - RNA, 19 nt, Mycobacterium avium subsp. paratuberculosis
cguccagcucagcgcgcac

SEQ ID NO: 986316 - RNA, 14 nt, Mycobacterium avium subsp. paratuberculosis
cguccagcuccgcc

SEQ ID NO: 986317 - RNA, 17 nt, Mycobacterium avium subsp. paratuberculosis
cguccaggccggcgccg

SEQ ID NO: 986318 - RNA, 19 nt, Mycobacterium avium subsp. paratuberculosis
cguccaggaugagcugggc

SEQ ID NO: 986319 - RNA, 22 nt, Mycobacterium avium subsp. paratuberculosis
cguccaggaugagcugggcggc

SEQ ID NO: 986320 - RNA, 15 nt, Mycobacterium avium subsp. paratuberculosis
cguccagggccaccg

SEQ ID NO: 986321 - RNA, 16 nt, Mycobacterium avium subsp. paratuberculosis
cguccagggccaccgc

SEQ ID NO: 986322 - RNA, 17 nt, Mycobacterium avium subsp. paratuberculosis
cguccagggccaccgcg

SEQ ID NO: 986323 - RNA, 19 nt, Mycobacterium avium subsp. paratuberculosis
cguccaggcgcaccgccac

SEQ ID NO: 986324 - RNA, 22 nt, Mycobacterium avium subsp. paratuberculosis
cguccaggcgcaccgccaccgc

SEQ ID NO: 986325 - RNA, 12 nt, Mycobacterium avium subsp. paratuberculosis
cguccagcagca

SEQ ID NO: 986326 - RNA, 14 nt, Mycobacterium avium subsp. paratuberculosis
cguccagcgcgucg

SEQ ID NO: 986327 - RNA, 13 nt, Mycobacterium avium subsp. paratuberculosis
cguccagcgccgc

SEQ ID NO: 986328 - RNA, 16 nt, Mycobacterium avium subsp. paratuberculosis
cguccagcgccgccau

SEQ ID NO: 986329 - RNA, 17 nt, Mycobacterium avium subsp. paratuberculosis
cguccagcgccgccauc

SEQ ID NO: 986330 - RNA, 19 nt, Mycobacterium avium subsp. paratuberculosis
cguuggugcgcaccagcag

SEQ ID NO: 986331 - RNA, 16 nt, Mycobacterium avium subsp. paratuberculosis
cguugguugcggcccc

SEQ ID NO: 986332 - RNA, 23 nt, Mycobacterium avium subsp. paratuberculosis
cguugguugcggccccgccagca

SEQ ID NO: 986333 - RNA, 17 nt, Mycobacterium avium subsp. paratuberculosis
cguugggcaacgcggca

SEQ ID NO: 986334 - RNA, 16 nt, Mycobacterium avium subsp. paratuberculosis
cguuggucaccaucag

SEQ ID NO: 986335 - RNA, 16 nt, Mycobacterium avium subsp. paratuberculosis
cguuuccagcgccggc

SEQ ID NO: 986336 - RNA, 18 nt, Mycobacterium avium subsp. paratuberculosis
cguucgcuuucgccgggc

SEQ ID NO: 986337 - RNA, 19 nt, Mycobacterium avium subsp. paratuberculosis
cguucgcgcacggcgcgca

SEQ ID NO: 986338 - RNA, 19 nt, Mycobacterium avium subsp. paratuberculosis
cguucgcguugagcgucgc

SEQ ID NO: 986339 - RNA, 15 nt, Mycobacterium avium subsp. paratuberculosis
cguucggccgcagcg

SEQ ID NO: 986340 - RNA, 17 nt, Mycobacterium avium subsp. paratuberculosis
cguugaaaguccuugcu

SEQ ID NO: 986341 - RNA, 15 nt, Mycobacterium avium subsp. paratuberculosis
cguuggacuccaccg

SEQ ID NO: 986342 - RNA, 16 nt, Mycobacterium avium subsp. paratuberculosis
cguuggacuccaccgc

SEQ ID NO: 986343 - RNA, 17 nt, Mycobacterium avium subsp. paratuberculosis
cguuggagccgaccagc

SEQ ID NO: 986344 - RNA, 22 nt, Mycobacterium avium subsp. paratuberculosis
cguuggaggugaucgccagccc

SEQ ID NO: 986345 - RNA, 14 nt, Mycobacterium avium subsp. paratuberculosis
cguuggccuccucg

SEQ ID NO: 986346 - RNA, 14 nt, Mycobacterium avium subsp. paratuberculosis
cguuggccggcucc

SEQ ID NO: 986347 - RNA, 21 nt, Mycobacterium avium subsp. paratuberculosis
cguuuuugugggugguccagg

SEQ ID NO: 986348 - RNA, 23 nt, Mycobacterium avium subsp. paratuberculosis
cuaacgccagcugggcagccaga

SEQ ID NO: 986349 - RNA, 19 nt, Mycobacterium avium subsp. paratuberculosis
cguuccagccggcccgcau

SEQ ID NO: 986350 - RNA, 12 nt, Mycobacterium avium subsp. paratuberculosis
cguuccagccgu

SEQ ID NO: 986351 - RNA, 13 nt, Mycobacterium avium subsp. paratuberculosis
cguuccagcacgc

SEQ ID NO: 986352 - RNA, 15 nt, Mycobacterium avium subsp. paratuberculosis
cguucccagcccggc

SEQ ID NO: 986353 - RNA, 16 nt, Mycobacterium avium subsp. paratuberculosis
cguucccugcgcggcg

SEQ ID NO: 986354 - RNA, 21 nt, Mycobacterium avium subsp. paratuberculosis
cguucccugcgcggcgaugcg

SEQ ID NO: 986355 - RNA, 13 nt, Mycobacterium avium subsp. paratuberculosis
cguucccgggccc

SEQ ID NO: 986356 - RNA, 19 nt, Mycobacterium avium subsp. paratuberculosis
cguucgccggccagcacgc

SEQ ID NO: 986357 - RNA, 18 nt, Mycobacterium avium subsp. paratuberculosis
cguucgccggcguagacc

SEQ ID NO: 986358 - RNA, 16 nt, Mycobacterium avium subsp. paratuberculosis
cguucgccgacagcag

SEQ ID NO: 986359 - RNA, 13 nt, Mycobacterium avium subsp. paratuberculosis
cguucgccgccag

SEQ ID NO: 986360 - RNA, 14 nt, Mycobacterium avium subsp. paratuberculosis
cguucaccucuucg

SEQ ID NO: 986361 - RNA, 19 nt, Mycobacterium avium subsp. paratuberculosis
cguucaccaccggagcggc

SEQ ID NO: 986362 - RNA, 12 nt, Mycobacterium avium subsp. paratuberculosis
cguucagcagcg

SEQ ID NO: 986363 - RNA, 19 nt, Mycobacterium avium subsp. paratuberculosis
cguuccagcacccggccca

SEQ ID NO: 986364 - RNA, 18 nt, Mycobacterium avium subsp. paratuberculosis
cguucagcugcagccggc

SEQ ID NO: 986365 - RNA, 15 nt, Mycobacterium avium subsp. paratuberculosis
cguucaagccgccga

SEQ ID NO: 986366 - RNA, 18 nt, Mycobacterium avium subsp. paratuberculosis
cguuauuugugcgcuggc

SEQ ID NO: 986367 - RNA, 15 nt, Mycobacterium avium subsp. paratuberculosis
cguuacgguagcacu

SEQ ID NO: 986368 - RNA, 13 nt, Mycobacterium avium subsp. paratuberculosis
cguguucaacgcg

SEQ ID NO: 986369 - RNA, 14 nt, Mycobacterium avium subsp. paratuberculosis
cguguucucacggc

SEQ ID NO: 986370 - RNA, 21 nt, Mycobacterium avium subsp. paratuberculosis
cguguucucacggcgaauauu

SEQ ID NO: 986371 - RNA, 21 nt, Mycobacterium avium subsp. paratuberculosis
cguguuguagucagacccugu

SEQ ID NO: 986372 - RNA, 17 nt, Mycobacterium avium subsp. paratuberculosis
cgugucacuacccgcga

SEQ ID NO: 986373 - RNA, 19 nt, Mycobacterium avium subsp. paratuberculosis
cgugguugcguucgccggc

SEQ ID NO: 986374 - RNA, 19 nt, Mycobacterium avium subsp. paratuberculosis
cgugucggggucggcgccg

SEQ ID NO: 986375 - RNA, 16 nt, Mycobacterium avium subsp. paratuberculosis
cgugucggugauggcc

SEQ ID NO: 986376 - RNA, 19 nt, Mycobacterium avium subsp. paratuberculosis
cgugucccggcgcccuucg

SEQ ID NO: 986377 - RNA, 19 nt, Mycobacterium avium subsp. paratuberculosis
cguguccgaugacgagcag

SEQ ID NO: 986378 - RNA, 14 nt, Mycobacterium avium subsp. paratuberculosis
cgugugccagcccg

SEQ ID NO: 986379 - RNA, 19 nt, Mycobacterium avium subsp. paratuberculosis
cgugugggaaaagacgcac

SEQ ID NO: 986380 - RNA, 22 nt, Mycobacterium avium subsp. paratuberculosis
cgugugggcgcccgcggcgcgc

SEQ ID NO: 986381 - RNA, 12 nt, Mycobacterium avium subsp. paratuberculosis
cgugcuccagca

SEQ ID NO: 986382 - RNA, 13 nt, Mycobacterium avium subsp. paratuberculosis
cgugcucgagcau

SEQ ID NO: 986383 - RNA, 15 nt, Mycobacterium avium subsp. paratuberculosis
cgugcguagcggccc

SEQ ID NO: 986384 - RNA, 21 nt, Mycobacterium avium subsp. paratuberculosis
cgugcgguuggcccgcggcgc

SEQ ID NO: 986385 - RNA, 23 nt, Mycobacterium avium subsp. paratuberculosis
cgugcgguuggcccgcggcgccc

SEQ ID NO: 986386 - RNA, 21 nt, Mycobacterium avium subsp. paratuberculosis
cgugcggggccucgucgccgc

SEQ ID NO: 986387 - RNA, 16 nt, Mycobacterium avium subsp. paratuberculosis
cgugcggcgccgcccg

SEQ ID NO: 986388 - RNA, 12 nt, Mycobacterium avium subsp. paratuberculosis
cgugcggcggcg

SEQ ID NO: 986389 - RNA, 19 nt, Mycobacterium avium subsp. paratuberculosis
cgugcgggugguccaccca

SEQ ID NO: 986390 - RNA, 18 nt, Mycobacterium avium subsp. paratuberculosis
cgugcggauggccccggc

SEQ ID NO: 986391 - RNA, 15 nt, Mycobacterium avium subsp. paratuberculosis
cgugcggcacgccgc

SEQ ID NO: 986392 - RNA, 12 nt, Mycobacterium avium subsp. paratuberculosis
cgugcggccgca

SEQ ID NO: 986393 - RNA, 18 nt, Mycobacterium avium subsp. paratuberculosis
cgugcggccgcagcgccc

SEQ ID NO: 986394 - RNA, 13 nt, Mycobacterium avium subsp. paratuberculosis
cgugcggccggcg

SEQ ID NO: 986395 - RNA, 21 nt, Mycobacterium avium subsp. paratuberculosis
cgugcgccccgcccugcuuga

SEQ ID NO: 986396 - RNA, 16 nt, Mycobacterium avium subsp. paratuberculosis
cgugcgacggcucuuc

SEQ ID NO: 986397 - RNA, 23 nt, Mycobacterium avium subsp. paratuberculosis
cgugcgacuugguggccagcacc

SEQ ID NO: 986398 - RNA, 23 nt, Mycobacterium avium subsp. paratuberculosis
cgugcgagccgagcacgcagccg

SEQ ID NO: 986399 - RNA, 20 nt, Mycobacterium avium subsp. paratuberculosis
cgugccuugcacccagcgga

SEQ ID NO: 986400 - RNA, 16 nt, Mycobacterium avium subsp. paratuberculosis
cgugcgaaugacgcgc

SEQ ID NO: 986401 - RNA, 17 nt, Mycobacterium avium subsp. paratuberculosis
cgugcgcggcgaccacc

SEQ ID NO: 986402 - RNA, 22 nt, Mycobacterium avium subsp. paratuberculosis
cgugcgcucgaccucggcggcc

SEQ ID NO: 986403 - RNA, 23 nt, Mycobacterium avium subsp. paratuberculosis
cgugcgcggcguucuccagcacc

SEQ ID NO: 986404 - RNA, 17 nt, Mycobacterium avium subsp. paratuberculosis
cgugcgcccgacgccgg

SEQ ID NO: 986405 - RNA, 15 nt, Mycobacterium avium subsp. paratuberculosis
cguggcacccgggcg

SEQ ID NO: 986406 - RNA, 17 nt, Mycobacterium avium subsp. paratuberculosis
cguggcaggccaucagc

SEQ ID NO: 986407 - RNA, 17 nt, Mycobacterium avium subsp. paratuberculosis
cguggcagggccagcag

SEQ ID NO: 986408 - RNA, 17 nt, Mycobacterium avium subsp. paratuberculosis
cguggacggcgagcggc

SEQ ID NO: 986409 - RNA, 21 nt, Mycobacterium avium subsp. paratuberculosis
cguggacggcgagcggcccug

SEQ ID NO: 986410 - RNA, 21 nt, Mycobacterium avium subsp. paratuberculosis
cguggacgucguuuuccagcc

SEQ ID NO: 986411 - RNA, 19 nt, Mycobacterium avium subsp. paratuberculosis
cgugcugcgcagcagcgcc

SEQ ID NO: 986412 - RNA, 22 nt, Mycobacterium avium subsp. paratuberculosis
cgugcucggaguaguccagcac

SEQ ID NO: 986413 - RNA, 17 nt, Mycobacterium avium subsp. paratuberculosis
cgugcucgucggcgggc

SEQ ID NO: 986414 - RNA, 18 nt, Mycobacterium avium subsp. paratuberculosis
cguggaaaucgagcgcgc

SEQ ID NO: 986415 - RNA, 17 nt, Mycobacterium avium subsp. paratuberculosis
cguggaacgacgccaga

SEQ ID NO: 986416 - RNA, 21 nt, Mycobacterium avium subsp. paratuberculosis
cgugcuuaacacaugcaaguc

SEQ ID NO: 986417 - RNA, 19 nt, Mycobacterium avium subsp. paratuberculosis
cgugggcaccggcaccgcc

SEQ ID NO: 986418 - RNA, 13 nt, Mycobacterium avium subsp. paratuberculosis
cgugggccaccac

SEQ ID NO: 986419 - RNA, 21 nt, Mycobacterium avium subsp. paratuberculosis
cgugggaaugcggcugggugg

SEQ ID NO: 986420 - RNA, 14 nt, Mycobacterium avium subsp. paratuberculosis
cgugggccgcagcg

SEQ ID NO: 986421 - RNA, 16 nt, Mycobacterium avium subsp. paratuberculosis
cgugggccgcagcgcg

SEQ ID NO: 986422 - RNA, 15 nt, Mycobacterium avium subsp. paratuberculosis
cgugggguucccggc

SEQ ID NO: 986423 - RNA, 23 nt, Mycobacterium avium subsp. paratuberculosis
cgugggguuuucggcgcgcgccg

SEQ ID NO: 986424 - RNA, 22 nt, Mycobacterium avium subsp. paratuberculosis
cgugggggucgacccgccgcag

SEQ ID NO: 986425 - RNA, 18 nt, Mycobacterium avium subsp. paratuberculosis
cguggguauccgccgcca

SEQ ID NO: 986426 - RNA, 17 nt, Mycobacterium avium subsp. paratuberculosis
cguggguggucugcugg

SEQ ID NO: 986427 - RNA, 24 nt, Mycobacterium avium subsp. paratuberculosis
cguggguguccuugcgcaccacgu

SEQ ID NO: 986428 - RNA, 19 nt, Mycobacterium avium subsp. paratuberculosis
cguggugggcgaacagcag

SEQ ID NO: 986429 - RNA, 21 nt, Mycobacterium avium subsp. paratuberculosis
cguggugggcgaacagcagca

SEQ ID NO: 986430 - RNA, 14 nt, Mycobacterium avium subsp. paratuberculosis
cguggugugcacca

SEQ ID NO: 986431 - RNA, 22 nt, Mycobacterium avium subsp. paratuberculosis
cguggugugcccgcgggccaga

SEQ ID NO: 986432 - RNA, 20 nt, Mycobacterium avium subsp. paratuberculosis
cgugguguugaucauccggc

SEQ ID NO: 986433 - RNA, 18 nt, Mycobacterium avium subsp. paratuberculosis
cguggucgaggcccucga

SEQ ID NO: 986434 - RNA, 13 nt, Mycobacterium avium subsp. paratuberculosis
cguggucgcgcag

SEQ ID NO: 986435 - RNA, 15 nt, Mycobacterium avium subsp. paratuberculosis
cguggucgcgcagca

SEQ ID NO: 986436 - RNA, 14 nt, Mycobacterium avium subsp. paratuberculosis
cguggucucgcacc

SEQ ID NO: 986437 - RNA, 18 nt, Mycobacterium avium subsp. paratuberculosis
cguggucgcugaccuucu

SEQ ID NO: 986438 - RNA, 14 nt, Mycobacterium avium subsp. paratuberculosis
cguggugcaccgcc

SEQ ID NO: 986439 - RNA, 23 nt, Mycobacterium avium subsp. paratuberculosis
cguggugcaccgccagcgcggcg

SEQ ID NO: 986440 - RNA, 14 nt, Mycobacterium avium subsp. paratuberculosis
cguggucggcagca

SEQ ID NO: 986441 - RNA, 17 nt, Mycobacterium avium subsp. paratuberculosis
cguggucggcagcaccg

SEQ ID NO: 986442 - RNA, 21 nt, Mycobacterium avium subsp. paratuberculosis
cguggucggcagcaccggcag

SEQ ID NO: 986443 - RNA, 15 nt, Mycobacterium avium subsp. paratuberculosis
cguggucgacgccgu

SEQ ID NO: 986444 - RNA, 14 nt, Mycobacterium avium subsp. paratuberculosis
cgugguccagccgg

SEQ ID NO: 986445 - RNA, 20 nt, Mycobacterium avium subsp. paratuberculosis
cguggucccaggaccacucc

SEQ ID NO: 986446 - RNA, 23 nt, Mycobacterium avium subsp. paratuberculosis
cguggucagcgucucgccgggga

SEQ ID NO: 986447 - RNA, 21 nt, Mycobacterium avium subsp. paratuberculosis
cguggcggaagcgcguucagg

SEQ ID NO: 986448 - RNA, 23 nt, Mycobacterium avium subsp. paratuberculosis
cguggcggccgucgcgcaccacc

SEQ ID NO: 986449 - RNA, 18 nt, Mycobacterium avium subsp. paratuberculosis
cguggcgcgccccggccc

SEQ ID NO: 986450 - RNA, 14 nt, Mycobacterium avium subsp. paratuberculosis
cguggcgcucagcg

SEQ ID NO: 986451 - RNA, 15 nt, Mycobacterium avium subsp. paratuberculosis
cguggcgcucagcgg

SEQ ID NO: 986452 - RNA, 17 nt, Mycobacterium avium subsp. paratuberculosis
cguggcgcucagcggca

SEQ ID NO: 986453 - RNA, 20 nt, Mycobacterium avium subsp. paratuberculosis
cguggcgcucagcggcagcg

SEQ ID NO: 986454 - RNA, 15 nt, Mycobacterium avium subsp. paratuberculosis
cguggcgggccaggc

SEQ ID NO: 986455 - RNA, 17 nt, Mycobacterium avium subsp. paratuberculosis
cguggcgggccaggcgg

SEQ ID NO: 986456 - RNA, 15 nt, Mycobacterium avium subsp. paratuberculosis
cguggcgguggcggc

SEQ ID NO: 986457 - RNA, 15 nt, Mycobacterium avium subsp. paratuberculosis
cguggcucagcggca

SEQ ID NO: 986458 - RNA, 15 nt, Mycobacterium avium subsp. paratuberculosis
cguggcugaggccgc

SEQ ID NO: 986459 - RNA, 19 nt, Mycobacterium avium subsp. paratuberculosis
cguggcugaggccgccccg

SEQ ID NO: 986460 - RNA, 18 nt, Mycobacterium avium subsp. paratuberculosis
cguggcucucguccucga

SEQ ID NO: 986461 - RNA, 15 nt, Mycobacterium avium subsp. paratuberculosis
cguggcggcgguguc

SEQ ID NO: 986462 - RNA, 15 nt, Mycobacterium avium subsp. paratuberculosis
cguggcccgcccagc

SEQ ID NO: 986463 - RNA, 12 nt, Mycobacterium avium subsp. paratuberculosis
cguggcccugcu

SEQ ID NO: 986464 - RNA, 20 nt, Mycobacterium avium subsp. paratuberculosis
cguggccgccaggaucugcu

SEQ ID NO: 986465 - RNA, 14 nt, Mycobacterium avium subsp. paratuberculosis
cguggcccagccgg

SEQ ID NO: 986466 - RNA, 14 nt, Mycobacterium avium subsp. paratuberculosis
cguggccccagcca

SEQ ID NO: 986467 - RNA, 16 nt, Mycobacterium avium subsp. paratuberculosis
cguggccagcgccagc

SEQ ID NO: 986468 - RNA, 23 nt, Mycobacterium avium subsp. paratuberculosis
cguggccagcaccgucagccagg

SEQ ID NO: 986469 - RNA, 14 nt, Mycobacterium avium subsp. paratuberculosis
cguggcgcacagcg

SEQ ID NO: 986470 - RNA, 16 nt, Mycobacterium avium subsp. paratuberculosis
cucaggaucagcagcc

SEQ ID NO: 986471 - RNA, 22 nt, Mycobacterium avium subsp. paratuberculosis
cucaggaauuugcggcccggcu

SEQ ID NO: 986472 - RNA, 12 nt, Mycobacterium avium subsp. paratuberculosis
cucagcccggcc

SEQ ID NO: 986473 - RNA, 16 nt, Mycobacterium avium subsp. paratuberculosis
cucagcccggcccagc

SEQ ID NO: 986474 - RNA, 13 nt, Mycobacterium avium subsp. paratuberculosis
cucagcacgcgga

SEQ ID NO: 986475 - RNA, 13 nt, Mycobacterium avium subsp. paratuberculosis
cucagccacgccg

SEQ ID NO: 986476 - RNA, 22 nt, Mycobacterium avium subsp. paratuberculosis
cucagaccauggcgcggcggcc

SEQ ID NO: 986477 - RNA, 15 nt, Mycobacterium avium subsp. paratuberculosis
cucagagcagcgccu

SEQ ID NO: 986478 - RNA, 20 nt, Mycobacterium avium subsp. paratuberculosis
cucaccgggaggacagggag

SEQ ID NO: 986479 - RNA, 22 nt, Mycobacterium avium subsp. paratuberculosis
cucaccgucgcggucagcucga

SEQ ID NO: 986480 - RNA, 16 nt, Mycobacterium avium subsp. paratuberculosis
cucaccggucagcugg

SEQ ID NO: 986481 - RNA, 22 nt, Mycobacterium avium subsp. paratuberculosis
cucaccggucagcuggugcaga

SEQ ID NO: 986482 - RNA, 18 nt, Mycobacterium avium subsp. paratuberculosis
cucaccgcgggccaggcc

SEQ ID NO: 986483 - RNA, 20 nt, Mycobacterium avium subsp. paratuberculosis
cucaccgcggggugcccggc

SEQ ID NO: 986484 - RNA, 17 nt, Mycobacterium avium subsp. paratuberculosis
cucaccggccagggccg

SEQ ID NO: 986485 - RNA, 22 nt, Mycobacterium avium subsp. paratuberculosis
cucaccggccagggccgccgca

SEQ ID NO: 986486 - RNA, 13 nt, Mycobacterium avium subsp. paratuberculosis
cucaccggcggcg

SEQ ID NO: 986487 - RNA, 17 nt, Mycobacterium avium subsp. paratuberculosis
cucaccggcggcggccu

SEQ ID NO: 986488 - RNA, 18 nt, Mycobacterium avium subsp. paratuberculosis
cucaugggcccggcccgu

SEQ ID NO: 986489 - RNA, 23 nt, Mycobacterium avium subsp. paratuberculosis
cucaugguguuccaccagcggcc

SEQ ID NO: 986490 - RNA, 23 nt, Mycobacterium avium subsp. paratuberculosis
cucaucgucgaguaccucgcugu

SEQ ID NO: 986491 - RNA, 16 nt, Mycobacterium avium subsp. paratuberculosis
cucaucguguccagca

SEQ ID NO: 986492 - RNA, 18 nt, Mycobacterium avium subsp. paratuberculosis
cucaucgcccagccggcg

SEQ ID NO: 986493 - RNA, 16 nt, Mycobacterium avium subsp. paratuberculosis
cucaguccagcuccca

SEQ ID NO: 986494 - RNA, 19 nt, Mycobacterium avium subsp. paratuberculosis
cucaggugcgacgcccacu

SEQ ID NO: 986495 - RNA, 19 nt, Mycobacterium avium subsp. paratuberculosis
cucagguggacagaugcca

SEQ ID NO: 986496 - RNA, 22 nt, Mycobacterium avium subsp. paratuberculosis
cucaaaccguugaccaccaggu

SEQ ID NO: 986497 - RNA, 14 nt, Mycobacterium avium subsp. paratuberculosis
cucaaccgcccagc

SEQ ID NO: 986498 - RNA, 15 nt, Mycobacterium avium subsp. paratuberculosis
cuauacacgccugga

SEQ ID NO: 986499 - RNA, 19 nt, Mycobacterium avium subsp. paratuberculosis
cuaggacgugcucugccua

SEQ ID NO: 986500 - RNA, 20 nt, Mycobacterium avium subsp. paratuberculosis
cuagcggccuaggacgccgc

SEQ ID NO: 986501 - RNA, 23 nt, Mycobacterium avium subsp. paratuberculosis
cuagcggcguguuguagucagac

SEQ ID NO: 986502 - RNA, 16 nt, Mycobacterium avium subsp. paratuberculosis
cuaggccagcagcgcg

SEQ ID NO: 986503 - RNA, 14 nt, Mycobacterium avium subsp. paratuberculosis
cuagcgcaauugaa

SEQ ID NO: 986504 - RNA, 23 nt, Mycobacterium avium subsp. paratuberculosis
cuagcagcuccggucggcgcucg

SEQ ID NO: 986505 - RNA, 20 nt, Mycobacterium avium subsp. paratuberculosis
cuaccuuguugugacacagc

SEQ ID NO: 986506 - RNA, 13 nt, Mycobacterium avium subsp. paratuberculosis
cuacgccguggcc

SEQ ID NO: 986507 - RNA, 13 nt, Mycobacterium avium subsp. paratuberculosis
cuacggcgccggu

SEQ ID NO: 986508 - RNA, 21 nt, Mycobacterium avium subsp. paratuberculosis
cuacggcgggccggcgccggu

SEQ ID NO: 986509 - RNA, 14 nt, Mycobacterium avium subsp. paratuberculosis
cuaccucaccacgu

SEQ ID NO: 986510 - RNA, 24 nt, Mycobacterium avium subsp. paratuberculosis
cucgcugacgucgaugccggccag

SEQ ID NO: 986511 - RNA, 15 nt, Mycobacterium avium subsp. paratuberculosis
cucgcugccgccccc

SEQ ID NO: 986512 - RNA, 15 nt, Mycobacterium avium subsp. paratuberculosis
cucgcuacgcgagcu

SEQ ID NO: 986513 - RNA, 17 nt, Mycobacterium avium subsp. paratuberculosis
cucgcguggccugggcg

SEQ ID NO: 986514 - RNA, 18 nt, Mycobacterium avium subsp. paratuberculosis
cucgcguggccugggcga

SEQ ID NO: 986515 - RNA, 18 nt, Mycobacterium avium subsp. paratuberculosis
cucgcgggugucgagcca

SEQ ID NO: 986516 - RNA, 13 nt, Mycobacterium avium subsp. paratuberculosis
cucgcguccccgc

SEQ ID NO: 986517 - RNA, 17 nt, Mycobacterium avium subsp. paratuberculosis
cucgcuaaucgccgcgc

SEQ ID NO: 986518 - RNA, 18 nt, Mycobacterium avium subsp. paratuberculosis
cucgcgguugggccgccg

SEQ ID NO: 986519 - RNA, 21 nt, Mycobacterium avium subsp. paratuberculosis
cucgcgguugggccgccggcc

SEQ ID NO: 986520 - RNA, 22 nt, Mycobacterium avium subsp. paratuberculosis
cucgcgguugggccgccggccg

SEQ ID NO: 986521 - RNA, 18 nt, Mycobacterium avium subsp. paratuberculosis
cucgcgguugggccggcg

SEQ ID NO: 986522 - RNA, 22 nt, Mycobacterium avium subsp. paratuberculosis
cucgcguagcgaggugugagga

SEQ ID NO: 986523 - RNA, 12 nt, Mycobacterium avium subsp. paratuberculosis
cucgcggcggcg

SEQ ID NO: 986524 - RNA, 15 nt, Mycobacterium avium subsp. paratuberculosis
cucgcgggggccgcg

SEQ ID NO: 986525 - RNA, 18 nt, Mycobacterium avium subsp. paratuberculosis
cucgcgggcgaccuggug

SEQ ID NO: 986526 - RNA, 20 nt, Mycobacterium avium subsp. paratuberculosis
cucgcgggcgagcagcgccc

SEQ ID NO: 986527 - RNA, 15 nt, Mycobacterium avium subsp. paratuberculosis
cucgcgggcgaucuc

SEQ ID NO: 986528 - RNA, 21 nt, Mycobacterium avium subsp. paratuberculosis
cucgcgggcgaugcggcccgg

SEQ ID NO: 986529 - RNA, 17 nt, Mycobacterium avium subsp. paratuberculosis
cucgcgggacggcggcg

SEQ ID NO: 986530 - RNA, 18 nt, Mycobacterium avium subsp. paratuberculosis
cucgcgggaguggccggc

SEQ ID NO: 986531 - RNA, 16 nt, Mycobacterium avium subsp. paratuberculosis
cucgcgggcccgcgcc

SEQ ID NO: 986532 - RNA, 19 nt, Mycobacterium avium subsp. paratuberculosis
cucgcgggcccgcgcggcg

SEQ ID NO: 986533 - RNA, 13 nt, Mycobacterium avium subsp. paratuberculosis
cucgcgggccugc

SEQ ID NO: 986534 - RNA, 14 nt, Mycobacterium avium subsp. paratuberculosis
cucgccagaccggu

SEQ ID NO: 986535 - RNA, 20 nt, Mycobacterium avium subsp. paratuberculosis
cucgccagccguccuggucg

SEQ ID NO: 986536 - RNA, 12 nt, Mycobacterium avium subsp. paratuberculosis
cucgcccagcac

SEQ ID NO: 986537 - RNA, 14 nt, Mycobacterium avium subsp. paratuberculosis
cucgcccagcgccg

SEQ ID NO: 986538 - RNA, 13 nt, Mycobacterium avium subsp. paratuberculosis
cucgccggcggcg

SEQ ID NO: 986539 - RNA, 15 nt, Mycobacterium avium subsp. paratuberculosis
cucgccggggaacac

SEQ ID NO: 986540 - RNA, 22 nt, Mycobacterium avium subsp. paratuberculosis
cucgccguacgcgccggccagc

SEQ ID NO: 986541 - RNA, 16 nt, Mycobacterium avium subsp. paratuberculosis
cucgcgcagccggccg

SEQ ID NO: 986542 - RNA, 19 nt, Mycobacterium avium subsp. paratuberculosis
cucgcgcaggaacuccagc

SEQ ID NO: 986543 - RNA, 21 nt, Mycobacterium avium subsp. paratuberculosis
cucgcgcagggccagcgccuc

SEQ ID NO: 986544 - RNA, 23 nt, Mycobacterium avium subsp. paratuberculosis
cucgcgcaggucacccuccucgc

SEQ ID NO: 986545 - RNA, 23 nt, Mycobacterium avium subsp. paratuberculosis
cucgccgucacaccgcggccagc

SEQ ID NO: 986546 - RNA, 16 nt, Mycobacterium avium subsp. paratuberculosis
cucgcgccgggcggcc

SEQ ID NO: 986547 - RNA, 19 nt, Mycobacterium avium subsp. paratuberculosis
cucgcgcucuugggcggcc

SEQ ID NO: 986548 - RNA, 22 nt, Mycobacterium avium subsp. paratuberculosis
cucgcgcggcaccaccagcgug

SEQ ID NO: 986549 - RNA, 23 nt, Mycobacterium avium subsp. paratuberculosis
cucgcgcccuaacgugcccggcc

SEQ ID NO: 986550 - RNA, 19 nt, Mycobacterium avium subsp. paratuberculosis
cucgcgccgacccgcccgc

SEQ ID NO: 986551 - RNA, 19 nt, Mycobacterium avium subsp. paratuberculosis
cucgaugggggugccgcag

SEQ ID NO: 986552 - RNA, 17 nt, Mycobacterium avium subsp. paratuberculosis
cucgaugucgguggugg

SEQ ID NO: 986553 - RNA, 13 nt, Mycobacterium avium subsp. paratuberculosis
cucgauggcggcg

SEQ ID NO: 986554 - RNA, 15 nt, Mycobacterium avium subsp. paratuberculosis
cucgauggcggcggc

SEQ ID NO: 986555 - RNA, 16 nt, Mycobacterium avium subsp. paratuberculosis
cucgauggcggcggcu

SEQ ID NO: 986556 - RNA, 18 nt, Mycobacterium avium subsp. paratuberculosis
cucgauggacaggcacuc

SEQ ID NO: 986557 - RNA, 16 nt, Mycobacterium avium subsp. paratuberculosis
cucgauggacgccagc

SEQ ID NO: 986558 - RNA, 14 nt, Mycobacterium avium subsp. paratuberculosis
cucgauggccagcg

SEQ ID NO: 986559 - RNA, 15 nt, Mycobacterium avium subsp. paratuberculosis
cucgauggccagcgc

SEQ ID NO: 986560 - RNA, 17 nt, Mycobacterium avium subsp. paratuberculosis
cucgagcaacaccaccu

SEQ ID NO: 986561 - RNA, 22 nt, Mycobacterium avium subsp. paratuberculosis
cucgagcaccacggcccgcgcc

SEQ ID NO: 986562 - RNA, 17 nt, Mycobacterium avium subsp. paratuberculosis
cucgagcaccggcggca

SEQ ID NO: 986563 - RNA, 14 nt, Mycobacterium avium subsp. paratuberculosis
cucgagcacgcccu

SEQ ID NO: 986564 - RNA, 20 nt, Mycobacterium avium subsp. paratuberculosis
cucgagcacgcccugcggcu

SEQ ID NO: 986565 - RNA, 16 nt, Mycobacterium avium subsp. paratuberculosis
cucgagcagcgcgcgc

SEQ ID NO: 986566 - RNA, 18 nt, Mycobacterium avium subsp. paratuberculosis
cucgagcagcgcgcgcuu

SEQ ID NO: 986567 - RNA, 21 nt, Mycobacterium avium subsp. paratuberculosis
cucgagcaggaacagacacag

SEQ ID NO: 986568 - RNA, 17 nt, Mycobacterium avium subsp. paratuberculosis
cucgagugccggcagcc

SEQ ID NO: 986569 - RNA, 18 nt, Mycobacterium avium subsp. paratuberculosis
cucgaguuuggccagcuc

SEQ ID NO: 986570 - RNA, 23 nt, Mycobacterium avium subsp. paratuberculosis
cucgaucagcgacucgaccccgc

SEQ ID NO: 986571 - RNA, 14 nt, Mycobacterium avium subsp. paratuberculosis
cucgaucagucguc

SEQ ID NO: 986572 - RNA, 15 nt, Mycobacterium avium subsp. paratuberculosis
cucgaucacccaggu

SEQ ID NO: 986573 - RNA, 19 nt, Mycobacterium avium subsp. paratuberculosis
cuccugccguucggccagc

SEQ ID NO: 986574 - RNA, 15 nt, Mycobacterium avium subsp. paratuberculosis
cucgacaggcagccc

SEQ ID NO: 986575 - RNA, 14 nt, Mycobacterium avium subsp. paratuberculosis
cuccugcaaggccc

SEQ ID NO: 986576 - RNA, 14 nt, Mycobacterium avium subsp. paratuberculosis
cuccugcagcgcgg

SEQ ID NO: 986577 - RNA, 23 nt, Mycobacterium avium subsp. paratuberculosis
cuccugcaggaucagcacuucau

SEQ ID NO: 986578 - RNA, 20 nt, Mycobacterium avium subsp. paratuberculosis
cucgaccacgcacaccaccg

SEQ ID NO: 986579 - RNA, 14 nt, Mycobacterium avium subsp. paratuberculosis
cucgaccagcaccg

SEQ ID NO: 986580 - RNA, 13 nt, Mycobacterium avium subsp. paratuberculosis
cucgaccagcgcg

SEQ ID NO: 986581 - RNA, 19 nt, Mycobacterium avium subsp. paratuberculosis
cucgaccagcgcgccgccc

SEQ ID NO: 986582 - RNA, 22 nt, Mycobacterium avium subsp. paratuberculosis
cucgaccagcgcgccgcccagc

SEQ ID NO: 986583 - RNA, 13 nt, Mycobacterium avium subsp. paratuberculosis
cucgaccaggccg

SEQ ID NO: 986584 - RNA, 20 nt, Mycobacterium avium subsp. paratuberculosis
cucgaccaggcuuggcccgc

SEQ ID NO: 986585 - RNA, 18 nt, Mycobacterium avium subsp. paratuberculosis
cucgacguccaggccggc

SEQ ID NO: 986586 - RNA, 22 nt, Mycobacterium avium subsp. paratuberculosis
cucgacguaguccggccagucc

SEQ ID NO: 986587 - RNA, 23 nt, Mycobacterium avium subsp. paratuberculosis
cucgacguaguccggccagucca

SEQ ID NO: 986588 - RNA, 15 nt, Mycobacterium avium subsp. paratuberculosis
cucgacggugcugcc

SEQ ID NO: 986589 - RNA, 23 nt, Mycobacterium avium subsp. paratuberculosis
cucguccuggcgcuggugcagca

SEQ ID NO: 986590 - RNA, 19 nt, Mycobacterium avium subsp. paratuberculosis
cucgugcaaaccggaccgc

SEQ ID NO: 986591 - RNA, 23 nt, Mycobacterium avium subsp. paratuberculosis
cucgucuuggugcgagccaccuc

SEQ ID NO: 986592 - RNA, 15 nt, Mycobacterium avium subsp. paratuberculosis
cucgugcacaugccc

SEQ ID NO: 986593 - RNA, 21 nt, Mycobacterium avium subsp. paratuberculosis
cucgucgugggugacccggcc

SEQ ID NO: 986594 - RNA, 16 nt, Mycobacterium avium subsp. paratuberculosis
cucgucgagccgggcc

SEQ ID NO: 986595 - RNA, 20 nt, Mycobacterium avium subsp. paratuberculosis
cucgucgcacaaccgggcca

SEQ ID NO: 986596 - RNA, 13 nt, Mycobacterium avium subsp. paratuberculosis
cucgucgccaccg

SEQ ID NO: 986597 - RNA, 16 nt, Mycobacterium avium subsp. paratuberculosis
cucguccgcgcuggcg

SEQ ID NO: 986598 - RNA, 12 nt, Mycobacterium avium subsp. paratuberculosis
cucguccucccg

SEQ ID NO: 986599 - RNA, 14 nt, Mycobacterium avium subsp. paratuberculosis
cucguccucccggu

SEQ ID NO: 986600 - RNA, 21 nt, Mycobacterium avium subsp. paratuberculosis
cucguccaggugcacccgcgg

SEQ ID NO: 986601 - RNA, 17 nt, Mycobacterium avium subsp. paratuberculosis
cucgucgaacucgugga

SEQ ID NO: 986602 - RNA, 21 nt, Mycobacterium avium subsp. paratuberculosis
cucgucgacgauggcccggac

SEQ ID NO: 986603 - RNA, 22 nt, Mycobacterium avium subsp. paratuberculosis
cucgucgacgauggcccggacc

SEQ ID NO: 986604 - RNA, 16 nt, Mycobacterium avium subsp. paratuberculosis
cucguccagcccgguc

SEQ ID NO: 986605 - RNA, 23 nt, Mycobacterium avium subsp. paratuberculosis
cucguacgacacgaugggucagg

SEQ ID NO: 986606 - RNA, 13 nt, Mycobacterium avium subsp. paratuberculosis
cucguaacgccac

SEQ ID NO: 986607 - RNA, 15 nt, Mycobacterium avium subsp. paratuberculosis
cucguaacgccacgg

SEQ ID NO: 986608 - RNA, 23 nt, Mycobacterium avium subsp. paratuberculosis
cucgguuucgaacugggucugcc

SEQ ID NO: 986609 - RNA, 22 nt, Mycobacterium avium subsp. paratuberculosis
cucggugugcugacccagcgcg

SEQ ID NO: 986610 - RNA, 13 nt, Mycobacterium avium subsp. paratuberculosis
cucggugagcagc

SEQ ID NO: 986611 - RNA, 22 nt, Mycobacterium avium subsp. paratuberculosis
cucggugucuuugcccuugaug

SEQ ID NO: 986612 - RNA, 16 nt, Mycobacterium avium subsp. paratuberculosis
cucguuggggccacca

SEQ ID NO: 986613 - RNA, 14 nt, Mycobacterium avium subsp. paratuberculosis
cucguuggccggcu

SEQ ID NO: 986614 - RNA, 15 nt, Mycobacterium avium subsp. paratuberculosis
cucgugcccgggccc

SEQ ID NO: 986615 - RNA, 16 nt, Mycobacterium avium subsp. paratuberculosis
cucgugccgcacccga

SEQ ID NO: 986616 - RNA, 17 nt, Mycobacterium avium subsp. paratuberculosis
cucgugcggcgccgccc

SEQ ID NO: 986617 - RNA, 20 nt, Mycobacterium avium subsp. paratuberculosis
cucgugcggcgccgcccggc

SEQ ID NO: 986618 - RNA, 14 nt, Mycobacterium avium subsp. paratuberculosis
cucggucgccacgg

SEQ ID NO: 986619 - RNA, 16 nt, Mycobacterium avium subsp. paratuberculosis
cucggucgccacggcc

SEQ ID NO: 986620 - RNA, 13 nt, Mycobacterium avium subsp. paratuberculosis
cucggucuccucc

SEQ ID NO: 986621 - RNA, 14 nt, Mycobacterium avium subsp. paratuberculosis
cucggucuccucca

SEQ ID NO: 986622 - RNA, 14 nt, Mycobacterium avium subsp. paratuberculosis
cucggugaagccgc

SEQ ID NO: 986623 - RNA, 16 nt, Mycobacterium avium subsp. paratuberculosis
cucggugaagccgcgg

SEQ ID NO: 986624 - RNA, 19 nt, Mycobacterium avium subsp. paratuberculosis
cucgggaaaugcgucggca

SEQ ID NO: 986625 - RNA, 20 nt, Mycobacterium avium subsp. paratuberculosis
cucgggcaacgcgccggcgg

SEQ ID NO: 986626 - RNA, 14 nt, Mycobacterium avium subsp. paratuberculosis
cucgggccagccca

SEQ ID NO: 986627 - RNA, 22 nt, Mycobacterium avium subsp. paratuberculosis
cucggcgcggcuuuuggcgucg

SEQ ID NO: 986628 - RNA, 22 nt, Mycobacterium avium subsp. paratuberculosis
cucggcgcuccagcgggcggcg

SEQ ID NO: 986629 - RNA, 14 nt, Mycobacterium avium subsp. paratuberculosis
cucggcgcucgccg

SEQ ID NO: 986630 - RNA, 16 nt, Mycobacterium avium subsp. paratuberculosis
cucggcgcugaacugc

SEQ ID NO: 986631 - RNA, 22 nt, Mycobacterium avium subsp. paratuberculosis
cucggcgcugaacugcucgacc

SEQ ID NO: 986632 - RNA, 16 nt, Mycobacterium avium subsp. paratuberculosis
cucggcgccgguggug

SEQ ID NO: 986633 - RNA, 17 nt, Mycobacterium avium subsp. paratuberculosis
cucggcgccccacgccu

SEQ ID NO: 986634 - RNA, 18 nt, Mycobacterium avium subsp. paratuberculosis
cucggcgccccacgccug

SEQ ID NO: 986635 - RNA, 13 nt, Mycobacterium avium subsp. paratuberculosis
cucggcgccgccg

SEQ ID NO: 986636 - RNA, 13 nt, Mycobacterium avium subsp. paratuberculosis
cucggcgccgcgg

SEQ ID NO: 986637 - RNA, 19 nt, Mycobacterium avium subsp. paratuberculosis
cucggcgccgcggggcgag

SEQ ID NO: 986638 - RNA, 14 nt, Mycobacterium avium subsp. paratuberculosis
cucggcucggccgg

SEQ ID NO: 986639 - RNA, 15 nt, Mycobacterium avium subsp. paratuberculosis
cucggcggcaccgcc

SEQ ID NO: 986640 - RNA, 16 nt, Mycobacterium avium subsp. paratuberculosis
cucggcgugcucggcc

SEQ ID NO: 986641 - RNA, 20 nt, Mycobacterium avium subsp. paratuberculosis
cucggcgugcucggccacga

SEQ ID NO: 986642 - RNA, 17 nt, Mycobacterium avium subsp. paratuberculosis
cucggcguggcgcucag

SEQ ID NO: 986643 - RNA, 20 nt, Mycobacterium avium subsp. paratuberculosis
cucggcguggcgcucagcgg

SEQ ID NO: 986644 - RNA, 15 nt, Mycobacterium avium subsp. paratuberculosis
cucgcugcgcgagga

SEQ ID NO: 986645 - RNA, 22 nt, Mycobacterium avium subsp. paratuberculosis
cucgcuggcgaucaccuugcgg

SEQ ID NO: 986646 - RNA, 23 nt, Mycobacterium avium subsp. paratuberculosis
cucgcuggcgaucaccuugcggc

SEQ ID NO: 986647 - RNA, 19 nt, Mycobacterium avium subsp. paratuberculosis
cucgcuugccagccgggcc

SEQ ID NO: 986648 - RNA, 20 nt, Mycobacterium avium subsp. paratuberculosis
cucggaaugaacugccgcgg

SEQ ID NO: 986649 - RNA, 22 nt, Mycobacterium avium subsp. paratuberculosis
cucggaaugaacugccgcggca

SEQ ID NO: 986650 - RNA, 12 nt, Mycobacterium avium subsp. paratuberculosis
cucggacgccgg

SEQ ID NO: 986651 - RNA, 15 nt, Mycobacterium avium subsp. paratuberculosis
cucggaguaguuccg

SEQ ID NO: 986652 - RNA, 23 nt, Mycobacterium avium subsp. paratuberculosis
cucggaucccggggcgcgcuggg

SEQ ID NO: 986653 - RNA, 13 nt, Mycobacterium avium subsp. paratuberculosis
cucggccaggaug

SEQ ID NO: 986654 - RNA, 18 nt, Mycobacterium avium subsp. paratuberculosis
cucggccagcgggugaug

SEQ ID NO: 986655 - RNA, 22 nt, Mycobacterium avium subsp. paratuberculosis
cucggccagggcucgugcagcc

SEQ ID NO: 986656 - RNA, 18 nt, Mycobacterium avium subsp. paratuberculosis
cucggccauccgggcggc

SEQ ID NO: 986657 - RNA, 19 nt, Mycobacterium avium subsp. paratuberculosis
cucggcccgcugcgcggcc

SEQ ID NO: 986658 - RNA, 19 nt, Mycobacterium avium subsp. paratuberculosis
cucggccggccggccgugc

SEQ ID NO: 986659 - RNA, 22 nt, Mycobacterium avium subsp. paratuberculosis
cucggccggguuguccuggccc

SEQ ID NO: 986660 - RNA, 14 nt, Mycobacterium avium subsp. paratuberculosis
cucggccgccaccg

SEQ ID NO: 986661 - RNA, 20 nt, Mycobacterium avium subsp. paratuberculosis
cucccacagcggaucggccu

SEQ ID NO: 986662 - RNA, 14 nt, Mycobacterium avium subsp. paratuberculosis
cucccaccacggcc

SEQ ID NO: 986663 - RNA, 16 nt, Mycobacterium avium subsp. paratuberculosis
cucccaccacggccga

SEQ ID NO: 986664 - RNA, 17 nt, Mycobacterium avium subsp. paratuberculosis
cucccaccacggccgau

SEQ ID NO: 986665 - RNA, 17 nt, Mycobacterium avium subsp. paratuberculosis
cucccagccgccggcca

SEQ ID NO: 986666 - RNA, 20 nt, Mycobacterium avium subsp. paratuberculosis
cucccagccgccggccacca

SEQ ID NO: 986667 - RNA, 23 nt, Mycobacterium avium subsp. paratuberculosis
cucccagucccagcacagccguc

SEQ ID NO: 986668 - RNA, 20 nt, Mycobacterium avium subsp. paratuberculosis
cucccggaacagcuuggcgc

SEQ ID NO: 986669 - RNA, 21 nt, Mycobacterium avium subsp. paratuberculosis
cuccccgaccacaccggcgcu

SEQ ID NO: 986670 - RNA, 14 nt, Mycobacterium avium subsp. paratuberculosis
cucccccaccacgu

SEQ ID NO: 986671 - RNA, 16 nt, Mycobacterium avium subsp. paratuberculosis
cucccgagcaucgccg

SEQ ID NO: 986672 - RNA, 14 nt, Mycobacterium avium subsp. paratuberculosis
cucccgcagcgcca

SEQ ID NO: 986673 - RNA, 13 nt, Mycobacterium avium subsp. paratuberculosis
cucccgcggcagc

SEQ ID NO: 986674 - RNA, 20 nt, Mycobacterium avium subsp. paratuberculosis
cuccgggcugugggcgcagg

SEQ ID NO: 986675 - RNA, 18 nt, Mycobacterium avium subsp. paratuberculosis
cuccgggucgaccgccuc

SEQ ID NO: 986676 - RNA, 20 nt, Mycobacterium avium subsp. paratuberculosis
cuccucgaccagcgcgccgc

SEQ ID NO: 986677 - RNA, 13 nt, Mycobacterium avium subsp. paratuberculosis
cuccucgaccccg

SEQ ID NO: 986678 - RNA, 21 nt, Mycobacterium avium subsp. paratuberculosis
cuccucgaucguccgaggccc

SEQ ID NO: 986679 - RNA, 19 nt, Mycobacterium avium subsp. paratuberculosis
cuccucgaucugggccagg

SEQ ID NO: 986680 - RNA, 13 nt, Mycobacterium avium subsp. paratuberculosis
cuccucggcccca

SEQ ID NO: 986681 - RNA, 13 nt, Mycobacterium avium subsp. paratuberculosis
cuccucggcggcc

SEQ ID NO: 986682 - RNA, 23 nt, Mycobacterium avium subsp. paratuberculosis
cuccucggcguagaggugcagcg

SEQ ID NO: 986683 - RNA, 14 nt, Mycobacterium avium subsp. paratuberculosis
cuccucggucagcu

SEQ ID NO: 986684 - RNA, 18 nt, Mycobacterium avium subsp. paratuberculosis
cuccucggucagcucggg

SEQ ID NO: 986685 - RNA, 23 nt, Mycobacterium avium subsp. paratuberculosis
cuccucggccagcaccagcagcc

SEQ ID NO: 986686 - RNA, 24 nt, Mycobacterium avium subsp. paratuberculosis
cuccucggccagcaccagcagccg

SEQ ID NO: 986687 - RNA, 21 nt, Mycobacterium avium subsp. paratuberculosis
cuccucggccagccccaccac

SEQ ID NO: 986688 - RNA, 14 nt, Mycobacterium avium subsp. paratuberculosis
cuccucgcgcggca

SEQ ID NO: 986689 - RNA, 20 nt, Mycobacterium avium subsp. paratuberculosis
cuccucgcggaacugcuccc

SEQ ID NO: 986690 - RNA, 22 nt, Mycobacterium avium subsp. paratuberculosis
cuccucgcggaacugcucccag

SEQ ID NO: 986691 - RNA, 16 nt, Mycobacterium avium subsp. paratuberculosis
cuccucgcgccgccac

SEQ ID NO: 986692 - RNA, 22 nt, Mycobacterium avium subsp. paratuberculosis
cuccggcggacccagcuccucg

SEQ ID NO: 986693 - RNA, 16 nt, Mycobacterium avium subsp. paratuberculosis
cuccggcggcagccag

SEQ ID NO: 986694 - RNA, 17 nt, Mycobacterium avium subsp. paratuberculosis
cuccggccccgagccga

SEQ ID NO: 986695 - RNA, 18 nt, Mycobacterium avium subsp. paratuberculosis
cuccggcccgagcaccac

SEQ ID NO: 986696 - RNA, 18 nt, Mycobacterium avium subsp. paratuberculosis
cuccggcgcgguugcccg

SEQ ID NO: 986697 - RNA, 21 nt, Mycobacterium avium subsp. paratuberculosis
cuccggcgcgguugcccgcac

SEQ ID NO: 986698 - RNA, 14 nt, Mycobacterium avium subsp. paratuberculosis
cuccggcaggccgc

SEQ ID NO: 986699 - RNA, 16 nt, Mycobacterium avium subsp. paratuberculosis
cuccgccgacaccagg

SEQ ID NO: 986700 - RNA, 15 nt, Mycobacterium avium subsp. paratuberculosis
cuccgccaccuccuc

SEQ ID NO: 986701 - RNA, 18 nt, Mycobacterium avium subsp. paratuberculosis
cuccaccgucgauggaca

SEQ ID NO: 986702 - RNA, 18 nt, Mycobacterium avium subsp. paratuberculosis
cuccaccguguucaccag

SEQ ID NO: 986703 - RNA, 20 nt, Mycobacterium avium subsp. paratuberculosis
cuccaccguguucaccagcg

SEQ ID NO: 986704 - RNA, 17 nt, Mycobacterium avium subsp. paratuberculosis
cuccacgucgucggaca

SEQ ID NO: 986705 - RNA, 15 nt, Mycobacterium avium subsp. paratuberculosis
cuccacgccgacgaa

SEQ ID NO: 986706 - RNA, 16 nt, Mycobacterium avium subsp. paratuberculosis
cuccagauagaggaac

SEQ ID NO: 986707 - RNA, 19 nt, Mycobacterium avium subsp. paratuberculosis
cuccagaucgccgcccauc

SEQ ID NO: 986708 - RNA, 13 nt, Mycobacterium avium subsp. paratuberculosis
cuccagcagcuuc

SEQ ID NO: 986709 - RNA, 14 nt, Mycobacterium avium subsp. paratuberculosis
cuccagcagcuuca

SEQ ID NO: 986710 - RNA, 17 nt, Mycobacterium avium subsp. paratuberculosis
cuccagcaggcgcgccg

SEQ ID NO: 986711 - RNA, 10 nt, Mycobacterium avium subsp. paratuberculosis
cuccagcacc

SEQ ID NO: 986712 - RNA, 15 nt, Mycobacterium avium subsp. paratuberculosis
cuccagcaccagcac

SEQ ID NO: 986713 - RNA, 13 nt, Mycobacterium avium subsp. paratuberculosis
cuccagcaccggc

SEQ ID NO: 986714 - RNA, 14 nt, Mycobacterium avium subsp. paratuberculosis
cuccagcaccggcg

SEQ ID NO: 986715 - RNA, 17 nt, Mycobacterium avium subsp. paratuberculosis
cuccagcaccggcgcca

SEQ ID NO: 986716 - RNA, 19 nt, Mycobacterium avium subsp. paratuberculosis
cuccagcacgaaggccgcc

SEQ ID NO: 986717 - RNA, 14 nt, Mycobacterium avium subsp. paratuberculosis
cuccagcagcgccu

SEQ ID NO: 986718 - RNA, 17 nt, Mycobacterium avium subsp. paratuberculosis
cuccagcagcgccuugc

SEQ ID NO: 986719 - RNA, 13 nt, Mycobacterium avium subsp. paratuberculosis
cuccagcagcggc

SEQ ID NO: 986720 - RNA, 14 nt, Mycobacterium avium subsp. paratuberculosis
cuccagcagcgcca

SEQ ID NO: 986721 - RNA, 20 nt, Mycobacterium avium subsp. paratuberculosis
cuccaggguucucgcggcgg

SEQ ID NO: 986722 - RNA, 18 nt, Mycobacterium avium subsp. paratuberculosis
cuccaguugacggcgcaa

SEQ ID NO: 986723 - RNA, 22 nt, Mycobacterium avium subsp. paratuberculosis
cuccaggcaugggaucagcagc

SEQ ID NO: 986724 - RNA, 21 nt, Mycobacterium avium subsp. paratuberculosis
cuccaggaugucgacgacacc

SEQ ID NO: 986725 - RNA, 19 nt, Mycobacterium avium subsp. paratuberculosis
cuccaggaagaacccggcg

SEQ ID NO: 986726 - RNA, 21 nt, Mycobacterium avium subsp. paratuberculosis
cuccagcuguugacgggccgc

SEQ ID NO: 986727 - RNA, 18 nt, Mycobacterium avium subsp. paratuberculosis
cuccagcuuugccagcag

SEQ ID NO: 986728 - RNA, 21 nt, Mycobacterium avium subsp. paratuberculosis
cuccagcuaggagccugcuga

SEQ ID NO: 986729 - RNA, 14 nt, Mycobacterium avium subsp. paratuberculosis
cuccagcuccucgg

SEQ ID NO: 986730 - RNA, 13 nt, Mycobacterium avium subsp. paratuberculosis
cuccagcgggcgg

SEQ ID NO: 986731 - RNA, 14 nt, Mycobacterium avium subsp. paratuberculosis
cuccagcggccaca

SEQ ID NO: 986732 - RNA, 17 nt, Mycobacterium avium subsp. paratuberculosis
cuccagcggccacaccg

SEQ ID NO: 986733 - RNA, 16 nt, Mycobacterium avium subsp. paratuberculosis
cuccagcggccgcagc

SEQ ID NO: 986734 - RNA, 20 nt, Mycobacterium avium subsp. paratuberculosis
cuccagcggccgcagcgcga

SEQ ID NO: 986735 - RNA, 17 nt, Mycobacterium avium subsp. paratuberculosis
cuccagcggccgggcga

SEQ ID NO: 986736 - RNA, 14 nt, Mycobacterium avium subsp. paratuberculosis
cuccagcggcggcc

SEQ ID NO: 986737 - RNA, 14 nt, Mycobacterium avium subsp. paratuberculosis
cuccagcccggcga

SEQ ID NO: 986738 - RNA, 14 nt, Mycobacterium avium subsp. paratuberculosis
cuccagccacucca

SEQ ID NO: 986739 - RNA, 14 nt, Mycobacterium avium subsp. paratuberculosis
cuccagccagcgcg

SEQ ID NO: 986740 - RNA, 19 nt, Mycobacterium avium subsp. paratuberculosis
cuccagccgcgcggccgcc

SEQ ID NO: 986741 - RNA, 19 nt, Mycobacterium avium subsp. paratuberculosis
cugcacucagagcagcgcc

SEQ ID NO: 986742 - RNA, 22 nt, Mycobacterium avium subsp. paratuberculosis
cugcacgucacgggccaggcgc

SEQ ID NO: 986743 - RNA, 23 nt, Mycobacterium avium subsp. paratuberculosis
cugcacgucggcgcgcaggcugg

SEQ ID NO: 986744 - RNA, 20 nt, Mycobacterium avium subsp. paratuberculosis
cugcacgucgccggcgaccg

SEQ ID NO: 986745 - RNA, 22 nt, Mycobacterium avium subsp. paratuberculosis
cugcacgucgccggcgaccgcc

SEQ ID NO: 986746 - RNA, 15 nt, Mycobacterium avium subsp. paratuberculosis
cugcagauaggaccc

SEQ ID NO: 986747 - RNA, 19 nt, Mycobacterium avium subsp. paratuberculosis
cugcaggccccagugggug

SEQ ID NO: 986748 - RNA, 13 nt, Mycobacterium avium subsp. paratuberculosis
cugcaggcccggg

SEQ ID NO: 986749 - RNA, 16 nt, Mycobacterium avium subsp. paratuberculosis
cugcagguggcccaca

SEQ ID NO: 986750 - RNA, 20 nt, Mycobacterium avium subsp. paratuberculosis
cugcagguggcccacacgcg

SEQ ID NO: 986751 - RNA, 20 nt, Mycobacterium avium subsp. paratuberculosis
cugcaggucguaguaggcgc

SEQ ID NO: 986752 - RNA, 21 nt, Mycobacterium avium subsp. paratuberculosis
cugcaggucguaguaggcgcc

SEQ ID NO: 986753 - RNA, 15 nt, Mycobacterium avium subsp. paratuberculosis
cugcaguagccggcc

SEQ ID NO: 986754 - RNA, 21 nt, Mycobacterium avium subsp. paratuberculosis
cugcaguagccggccagcucg

SEQ ID NO: 986755 - RNA, 14 nt, Mycobacterium avium subsp. paratuberculosis
cugcaacggcuggc

SEQ ID NO: 986756 - RNA, 13 nt, Mycobacterium avium subsp. paratuberculosis
cugaucuggaugc

SEQ ID NO: 986757 - RNA, 14 nt, Mycobacterium avium subsp. paratuberculosis
cugaucgggugaga

SEQ ID NO: 986758 - RNA, 19 nt, Mycobacterium avium subsp. paratuberculosis
cugaucgcguagcgccggu

SEQ ID NO: 986759 - RNA, 14 nt, Mycobacterium avium subsp. paratuberculosis
cugaucggccgcaa

SEQ ID NO: 986760 - RNA, 15 nt, Mycobacterium avium subsp. paratuberculosis
cugaucggccgcaag

SEQ ID NO: 986761 - RNA, 18 nt, Mycobacterium avium subsp. paratuberculosis
cugagcuucugcccggcc

SEQ ID NO: 986762 - RNA, 22 nt, Mycobacterium avium subsp. paratuberculosis
cugaggccgccccggccgcgca

SEQ ID NO: 986763 - RNA, 21 nt, Mycobacterium avium subsp. paratuberculosis
cugauacgacguccgggccgc

SEQ ID NO: 986764 - RNA, 18 nt, Mycobacterium avium subsp. paratuberculosis
cugauacccgcgcggcgc

SEQ ID NO: 986765 - RNA, 17 nt, Mycobacterium avium subsp. paratuberculosis
cugauaggggucggcga

SEQ ID NO: 986766 - RNA, 16 nt, Mycobacterium avium subsp. paratuberculosis
cugauccaccaucuuc

SEQ ID NO: 986767 - RNA, 17 nt, Mycobacterium avium subsp. paratuberculosis
cugauccaccaucuucc

SEQ ID NO: 986768 - RNA, 19 nt, Mycobacterium avium subsp. paratuberculosis
cugaucgcgauccgggcgc

SEQ ID NO: 986769 - RNA, 17 nt, Mycobacterium avium subsp. paratuberculosis
cugcgguuccgggcgcu

SEQ ID NO: 986770 - RNA, 15 nt, Mycobacterium avium subsp. paratuberculosis
cugcgguucgggccc

SEQ ID NO: 986771 - RNA, 20 nt, Mycobacterium avium subsp. paratuberculosis
cugcgguucgucgcggcggc

SEQ ID NO: 986772 - RNA, 14 nt, Mycobacterium avium subsp. paratuberculosis
cugcgugcugggca

SEQ ID NO: 986773 - RNA, 18 nt, Mycobacterium avium subsp. paratuberculosis
cugcgugcugggcaccgu

SEQ ID NO: 986774 - RNA, 12 nt, Mycobacterium avium subsp. paratuberculosis
cugcguguggcg

SEQ ID NO: 986775 - RNA, 19 nt, Mycobacterium avium subsp. paratuberculosis
cugcguguggcgcacgccc

SEQ ID NO: 986776 - RNA, 17 nt, Mycobacterium avium subsp. paratuberculosis
cugcggguugcgggcca

SEQ ID NO: 986777 - RNA, 23 nt, Mycobacterium avium subsp. paratuberculosis
cugcggguugcgggccaggcacg

SEQ ID NO: 986778 - RNA, 15 nt, Mycobacterium avium subsp. paratuberculosis
cugcgggugcggcca

SEQ ID NO: 986779 - RNA, 16 nt, Mycobacterium avium subsp. paratuberculosis
cugcgggcaucgcugg

SEQ ID NO: 986780 - RNA, 13 nt, Mycobacterium avium subsp. paratuberculosis
cugcgggccagcg

SEQ ID NO: 986781 - RNA, 12 nt, Mycobacterium avium subsp. paratuberculosis
cugcgggccauc

SEQ ID NO: 986782 - RNA, 16 nt, Mycobacterium avium subsp. paratuberculosis
cugcgcuugcggcgca

SEQ ID NO: 986783 - RNA, 23 nt, Mycobacterium avium subsp. paratuberculosis
cugcgcuugcggcgcagccagcu

SEQ ID NO: 986784 - RNA, 17 nt, Mycobacterium avium subsp. paratuberculosis
cugcgcguucggcgcca

SEQ ID NO: 986785 - RNA, 21 nt, Mycobacterium avium subsp. paratuberculosis
cugcgcguucggcgccacccc

SEQ ID NO: 986786 - RNA, 15 nt, Mycobacterium avium subsp. paratuberculosis
cugcgcuucgagcag

SEQ ID NO: 986787 - RNA, 17 nt, Mycobacterium avium subsp. paratuberculosis
cugcgcuucgagcagau

SEQ ID NO: 986788 - RNA, 14 nt, Mycobacterium avium subsp. paratuberculosis
cugcgggaacguca

SEQ ID NO: 986789 - RNA, 13 nt, Mycobacterium avium subsp. paratuberculosis
cugcgcagcgcag

SEQ ID NO: 986790 - RNA, 16 nt, Mycobacterium avium subsp. paratuberculosis
cugcgcagcgcagcac

SEQ ID NO: 986791 - RNA, 17 nt, Mycobacterium avium subsp. paratuberculosis
cugcgcagcgcagcacc

SEQ ID NO: 986792 - RNA, 11 nt, Mycobacterium avium subsp. paratuberculosis
cugcgcagccg

SEQ ID NO: 986793 - RNA, 20 nt, Mycobacterium avium subsp. paratuberculosis
cugcgcccgccgccaccacg

SEQ ID NO: 986794 - RNA, 20 nt, Mycobacterium avium subsp. paratuberculosis
cugcgccuuuugcacccgcc

SEQ ID NO: 986795 - RNA, 14 nt, Mycobacterium avium subsp. paratuberculosis
cugcgcgagcagau

SEQ ID NO: 986796 - RNA, 15 nt, Mycobacterium avium subsp. paratuberculosis
cugcgcgaucgccgg

SEQ ID NO: 986797 - RNA, 14 nt, Mycobacterium avium subsp. paratuberculosis
cugcgccuuggccu

SEQ ID NO: 986798 - RNA, 17 nt, Mycobacterium avium subsp. paratuberculosis
cugcgcgucgagcagca

SEQ ID NO: 986799 - RNA, 14 nt, Mycobacterium avium subsp. paratuberculosis
cugcgcggccggcg

SEQ ID NO: 986800 - RNA, 13 nt, Mycobacterium avium subsp. paratuberculosis
cugcgcgccggcg

SEQ ID NO: 986801 - RNA, 20 nt, Mycobacterium avium subsp. paratuberculosis
cugcgcgccccggcccggcg

SEQ ID NO: 986802 - RNA, 18 nt, Mycobacterium avium subsp. paratuberculosis
cugccacgcccaccggug

SEQ ID NO: 986803 - RNA, 19 nt, Mycobacterium avium subsp. paratuberculosis
cugccagaacggcggcagc

SEQ ID NO: 986804 - RNA, 18 nt, Mycobacterium avium subsp. paratuberculosis
cugccagaagaucugccg

SEQ ID NO: 986805 - RNA, 14 nt, Mycobacterium avium subsp. paratuberculosis
cugccagggccggg

SEQ ID NO: 986806 - RNA, 17 nt, Mycobacterium avium subsp. paratuberculosis
cugccagggccgggcgu

SEQ ID NO: 986807 - RNA, 21 nt, Mycobacterium avium subsp. paratuberculosis
cugccagggccgggcgugccc

SEQ ID NO: 986808 - RNA, 22 nt, Mycobacterium avium subsp. paratuberculosis
cugccaguugucgaucuccucg

SEQ ID NO: 986809 - RNA, 23 nt, Mycobacterium avium subsp. paratuberculosis
cugccaguugucgaucuccucgc

SEQ ID NO: 986810 - RNA, 18 nt, Mycobacterium avium subsp. paratuberculosis
cugcccaggaucaccggg

SEQ ID NO: 986811 - RNA, 15 nt, Mycobacterium avium subsp. paratuberculosis
cugcccagcggcacg

SEQ ID NO: 986812 - RNA, 22 nt, Mycobacterium avium subsp. paratuberculosis
cugcccggaguccggcucggug

SEQ ID NO: 986813 - RNA, 16 nt, Mycobacterium avium subsp. paratuberculosis
cugcccggccagcagg

SEQ ID NO: 986814 - RNA, 15 nt, Mycobacterium avium subsp. paratuberculosis
cugcccgggcauccc

SEQ ID NO: 986815 - RNA, 13 nt, Mycobacterium avium subsp. paratuberculosis
cugcccgggcccg

SEQ ID NO: 986816 - RNA, 13 nt, Mycobacterium avium subsp. paratuberculosis
cugcccggcccgc

SEQ ID NO: 986817 - RNA, 22 nt, Mycobacterium avium subsp. paratuberculosis
cugcccgcgacugucggcgccc

SEQ ID NO: 986818 - RNA, 13 nt, Mycobacterium avium subsp. paratuberculosis
cugcccgcgcagg

SEQ ID NO: 986819 - RNA, 19 nt, Mycobacterium avium subsp. paratuberculosis
cugcccgcggccgccgccg

SEQ ID NO: 986820 - RNA, 21 nt, Mycobacterium avium subsp. paratuberculosis
cugccccaucuugaccagggu

SEQ ID NO: 986821 - RNA, 14 nt, Mycobacterium avium subsp. paratuberculosis
cugcccgccgcggc

SEQ ID NO: 986822 - RNA, 17 nt, Mycobacterium avium subsp. paratuberculosis
cugcccgccgcggccgc

SEQ ID NO: 986823 - RNA, 14 nt, Mycobacterium avium subsp. paratuberculosis
cugcccgccgcggu

SEQ ID NO: 986824 - RNA, 18 nt, Mycobacterium avium subsp. paratuberculosis
cugcccgccgcguacagc

SEQ ID NO: 986825 - RNA, 20 nt, Mycobacterium avium subsp. paratuberculosis
cugcccgccgcguacagcag

SEQ ID NO: 986826 - RNA, 20 nt, Mycobacterium avium subsp. paratuberculosis
cugccccagggaccaguggu

SEQ ID NO: 986827 - RNA, 22 nt, Mycobacterium avium subsp. paratuberculosis
cugccccacacgcucggcgcgc

SEQ ID NO: 986828 - RNA, 17 nt, Mycobacterium avium subsp. paratuberculosis
cugccguagaaccgcuc

SEQ ID NO: 986829 - RNA, 19 nt, Mycobacterium avium subsp. paratuberculosis
cugccguagcgcuggguga

SEQ ID NO: 986830 - RNA, 14 nt, Mycobacterium avium subsp. paratuberculosis
cugccguccuucuc

SEQ ID NO: 986831 - RNA, 15 nt, Mycobacterium avium subsp. paratuberculosis
cugccguccuucucg

SEQ ID NO: 986832 - RNA, 19 nt, Mycobacterium avium subsp. paratuberculosis
cugccguugcgccagcggg

SEQ ID NO: 986833 - RNA, 17 nt, Mycobacterium avium subsp. paratuberculosis
cugccggggcgcagcug

SEQ ID NO: 986834 - RNA, 13 nt, Mycobacterium avium subsp. paratuberculosis
cugccgggcggcg

SEQ ID NO: 986835 - RNA, 13 nt, Mycobacterium avium subsp. paratuberculosis
cugccgggccgca

SEQ ID NO: 986836 - RNA, 16 nt, Mycobacterium avium subsp. paratuberculosis
cugccgggccgcaucc

SEQ ID NO: 986837 - RNA, 23 nt, Mycobacterium avium subsp. paratuberculosis
cugccgggccgcauccagcgccg

SEQ ID NO: 986838 - RNA, 22 nt, Mycobacterium avium subsp. paratuberculosis
cugccggcgcuucugcgccggu

SEQ ID NO: 986839 - RNA, 15 nt, Mycobacterium avium subsp. paratuberculosis
cugccggugcugcuc

SEQ ID NO: 986840 - RNA, 16 nt, Mycobacterium avium subsp. paratuberculosis
cugccgcugcgccggc

SEQ ID NO: 986841 - RNA, 19 nt, Mycobacterium avium subsp. paratuberculosis
cugccgcugcgccggcgcg

SEQ ID NO: 986842 - RNA, 15 nt, Mycobacterium avium subsp. paratuberculosis
cugccggacaccccg

SEQ ID NO: 986843 - RNA, 17 nt, Mycobacterium avium subsp. paratuberculosis
cugccggacaccccggc

SEQ ID NO: 986844 - RNA, 12 nt, Mycobacterium avium subsp. paratuberculosis
cugccggccgcc

SEQ ID NO: 986845 - RNA, 14 nt, Mycobacterium avium subsp. paratuberculosis
cugccggccgccgu

SEQ ID NO: 986846 - RNA, 23 nt, Mycobacterium avium subsp. paratuberculosis
cugccggccgccguaucccugcc

SEQ ID NO: 986847 - RNA, 16 nt, Mycobacterium avium subsp. paratuberculosis
cugccggccggcagcu

SEQ ID NO: 986848 - RNA, 15 nt, Mycobacterium avium subsp. paratuberculosis
cugccggcgaccagc

SEQ ID NO: 986849 - RNA, 19 nt, Mycobacterium avium subsp. paratuberculosis
cugccggcgaccagccccu

SEQ ID NO: 986850 - RNA, 21 nt, Mycobacterium avium subsp. paratuberculosis
cugccggcgaccagccccucg

SEQ ID NO: 986851 - RNA, 22 nt, Mycobacterium avium subsp. paratuberculosis
cugccggcgaccagccccucga

SEQ ID NO: 986852 - RNA, 16 nt, Mycobacterium avium subsp. paratuberculosis
cugccggcgcacccgc

SEQ ID NO: 986853 - RNA, 15 nt, Mycobacterium avium subsp. paratuberculosis
cugccggccggggcg

SEQ ID NO: 986854 - RNA, 18 nt, Mycobacterium avium subsp. paratuberculosis
cugccggccggggcggcg

SEQ ID NO: 986855 - RNA, 15 nt, Mycobacterium avium subsp. paratuberculosis
cugccgacccggcgu

SEQ ID NO: 986856 - RNA, 15 nt, Mycobacterium avium subsp. paratuberculosis
cugccgaccugcgcg

SEQ ID NO: 986857 - RNA, 12 nt, Mycobacterium avium subsp. paratuberculosis
cugccgaccagg

SEQ ID NO: 986858 - RNA, 13 nt, Mycobacterium avium subsp. paratuberculosis
cugccgagcaccu

SEQ ID NO: 986859 - RNA, 13 nt, Mycobacterium avium subsp. paratuberculosis
cugucgcgggccc

SEQ ID NO: 986860 - RNA, 21 nt, Mycobacterium avium subsp. paratuberculosis
cugucgcgggucuggcucggc

SEQ ID NO: 986861 - RNA, 21 nt, Mycobacterium avium subsp. paratuberculosis
cugucggggaccguccccguc

SEQ ID NO: 986862 - RNA, 22 nt, Mycobacterium avium subsp. paratuberculosis
cugucggugacgaggagggugu

SEQ ID NO: 986863 - RNA, 14 nt, Mycobacterium avium subsp. paratuberculosis
cuggugcgcagccc

SEQ ID NO: 986864 - RNA, 17 nt, Mycobacterium avium subsp. paratuberculosis
cuggugccgccgaugac

SEQ ID NO: 986865 - RNA, 21 nt, Mycobacterium avium subsp. paratuberculosis
cuggugccgccgaugacggcg

SEQ ID NO: 986866 - RNA, 21 nt, Mycobacterium avium subsp. paratuberculosis
cuguaguagccggggacggug

SEQ ID NO: 986867 - RNA, 16 nt, Mycobacterium avium subsp. paratuberculosis
cuguacgacaacagug

SEQ ID NO: 986868 - RNA, 17 nt, Mycobacterium avium subsp. paratuberculosis
cuguagggccaccacgc

SEQ ID NO: 986869 - RNA, 21 nt, Mycobacterium avium subsp. paratuberculosis
cuguagggccaccacgccagc

SEQ ID NO: 986870 - RNA, 14 nt, Mycobacterium avium subsp. paratuberculosis
cugggucaucaccu

SEQ ID NO: 986871 - RNA, 15 nt, Mycobacterium avium subsp. paratuberculosis
cugguacccgauggu

SEQ ID NO: 986872 - RNA, 16 nt, Mycobacterium avium subsp. paratuberculosis
cugggugcgcgggcgc

SEQ ID NO: 986873 - RNA, 17 nt, Mycobacterium avium subsp. paratuberculosis
cugggugcgcgggcgcc

SEQ ID NO: 986874 - RNA, 20 nt, Mycobacterium avium subsp. paratuberculosis
cugggugaguucgucggcga

SEQ ID NO: 986875 - RNA, 15 nt, Mycobacterium avium subsp. paratuberculosis
cugggugaacacccc

SEQ ID NO: 986876 - RNA, 14 nt, Mycobacterium avium subsp. paratuberculosis
cugggugccgcggu

SEQ ID NO: 986877 - RNA, 22 nt, Mycobacterium avium subsp. paratuberculosis
cuggcguaggacagcagccgcu

SEQ ID NO: 986878 - RNA, 17 nt, Mycobacterium avium subsp. paratuberculosis
cuggcggccuucuuggc

SEQ ID NO: 986879 - RNA, 17 nt, Mycobacterium avium subsp. paratuberculosis
cuggcgguuggacaggc

SEQ ID NO: 986880 - RNA, 21 nt, Mycobacterium avium subsp. paratuberculosis
cugggccucguccagggacuc

SEQ ID NO: 986881 - RNA, 13 nt, Mycobacterium avium subsp. paratuberculosis
cugggccuccggc

SEQ ID NO: 986882 - RNA, 19 nt, Mycobacterium avium subsp. paratuberculosis
cugggccuccggcggcaga

SEQ ID NO: 986883 - RNA, 23 nt, Mycobacterium avium subsp. paratuberculosis
cugggcgaccaugccgcgggcca

SEQ ID NO: 986884 - RNA, 23 nt, Mycobacterium avium subsp. paratuberculosis
cugggcgcgcaacucguccacca

SEQ ID NO: 986885 - RNA, 13 nt, Mycobacterium avium subsp. paratuberculosis
cugggcgcccaga

SEQ ID NO: 986886 - RNA, 16 nt, Mycobacterium avium subsp. paratuberculosis
cugggcgccgccggcg

SEQ ID NO: 986887 - RNA, 16 nt, Mycobacterium avium subsp. paratuberculosis
cuggugcagcagggcg

SEQ ID NO: 986888 - RNA, 14 nt, Mycobacterium avium subsp. paratuberculosis
cuggugcagcgacu

SEQ ID NO: 986889 - RNA, 13 nt, Mycobacterium avium subsp. paratuberculosis
cuggugcaccagg

SEQ ID NO: 986890 - RNA, 16 nt, Mycobacterium avium subsp. paratuberculosis
cuggugauggccaucu

SEQ ID NO: 986891 - RNA, 20 nt, Mycobacterium avium subsp. paratuberculosis
cuggucgaagauggccaggu

SEQ ID NO: 986892 - RNA, 23 nt, Mycobacterium avium subsp. paratuberculosis
cuggucgccgaacgugcgcggcg

SEQ ID NO: 986893 - RNA, 19 nt, Mycobacterium avium subsp. paratuberculosis
cuggucggccggcaggccg

SEQ ID NO: 986894 - RNA, 17 nt, Mycobacterium avium subsp. paratuberculosis
cuggucgucgagcugac

SEQ ID NO: 986895 - RNA, 17 nt, Mycobacterium avium subsp. paratuberculosis
cuggucgugcagcaccg

SEQ ID NO: 986896 - RNA, 20 nt, Mycobacterium avium subsp. paratuberculosis
cuggucgugcucgucggcgg

SEQ ID NO: 986897 - RNA, 16 nt, Mycobacterium avium subsp. paratuberculosis
cuggucgugcuggagc

SEQ ID NO: 986898 - RNA, 16 nt, Mycobacterium avium subsp. paratuberculosis
cuggucgucccagggu

SEQ ID NO: 986899 - RNA, 16 nt, Mycobacterium avium subsp. paratuberculosis
cugguaggcggccggg

SEQ ID NO: 986900 - RNA, 19 nt, Mycobacterium avium subsp. paratuberculosis
cugguagcugagcagcagg

SEQ ID NO: 986901 - RNA, 23 nt, Mycobacterium avium subsp. paratuberculosis
cugguagacccggggguccaggg

SEQ ID NO: 986902 - RNA, 15 nt, Mycobacterium avium subsp. paratuberculosis
cuggucacacccuug

SEQ ID NO: 986903 - RNA, 13 nt, Mycobacterium avium subsp. paratuberculosis
cuggucaaggugc

SEQ ID NO: 986904 - RNA, 22 nt, Mycobacterium avium subsp. paratuberculosis
cuggucaacucgacccgcaccu

SEQ ID NO: 986905 - RNA, 15 nt, Mycobacterium avium subsp. paratuberculosis
cuggucaguacagcu

SEQ ID NO: 986906 - RNA, 18 nt, Mycobacterium avium subsp. paratuberculosis
cuggucaugaaggcgacg

SEQ ID NO: 986907 - RNA, 22 nt, Mycobacterium avium subsp. paratuberculosis
cuggucaugaaggcgacgucgg

SEQ ID NO: 986908 - RNA, 16 nt, Mycobacterium avium subsp. paratuberculosis
cuggucaugccgucga

SEQ ID NO: 986909 - RNA, 22 nt, Mycobacterium avium subsp. paratuberculosis
cugguccuccaacggcaccacc

SEQ ID NO: 986910 - RNA, 17 nt, Mycobacterium avium subsp. paratuberculosis
cugguccaccgcggcgg

SEQ ID NO: 986911 - RNA, 13 nt, Mycobacterium avium subsp. paratuberculosis
cugguccagcgug

SEQ ID NO: 986912 - RNA, 13 nt, Mycobacterium avium subsp. paratuberculosis
cuggagugcugca

SEQ ID NO: 986913 - RNA, 20 nt, Mycobacterium avium subsp. paratuberculosis
cuggaguggucaggcccagg

SEQ ID NO: 986914 - RNA, 19 nt, Mycobacterium avium subsp. paratuberculosis
cuggagcggguccgccccg

SEQ ID NO: 986915 - RNA, 13 nt, Mycobacterium avium subsp. paratuberculosis
cuggaggccaacg

SEQ ID NO: 986916 - RNA, 21 nt, Mycobacterium avium subsp. paratuberculosis
cuggaggccaacgagcgcgcc

SEQ ID NO: 986917 - RNA, 18 nt, Mycobacterium avium subsp. paratuberculosis
cuggccccagaaccgcuc

SEQ ID NO: 986918 - RNA, 13 nt, Mycobacterium avium subsp. paratuberculosis
cuggccccgucgu

SEQ ID NO: 986919 - RNA, 23 nt, Mycobacterium avium subsp. paratuberculosis
cuggccaacucgaccugcccggg

SEQ ID NO: 986920 - RNA, 14 nt, Mycobacterium avium subsp. paratuberculosis
cuggccaccagcag

SEQ ID NO: 986921 - RNA, 16 nt, Mycobacterium avium subsp. paratuberculosis
cuggccaccagcagca

SEQ ID NO: 986922 - RNA, 18 nt, Mycobacterium avium subsp. paratuberculosis
cuggccaccgcaucgccg

SEQ ID NO: 986923 - RNA, 18 nt, Mycobacterium avium subsp. paratuberculosis
cuggccacgauccggggc

SEQ ID NO: 986924 - RNA, 19 nt, Mycobacterium avium subsp. paratuberculosis
cuggcaggugagccgggug

SEQ ID NO: 986925 - RNA, 21 nt, Mycobacterium avium subsp. paratuberculosis
cuggcaggugagccgggugcc

SEQ ID NO: 986926 - RNA, 16 nt, Mycobacterium avium subsp. paratuberculosis
cuggcauccgucggcc

SEQ ID NO: 986927 - RNA, 16 nt, Mycobacterium avium subsp. paratuberculosis
cuggcaucgucggcgc

SEQ ID NO: 986928 - RNA, 20 nt, Mycobacterium avium subsp. paratuberculosis
cuggcaucgucggcgccggc

SEQ ID NO: 986929 - RNA, 18 nt, Mycobacterium avium subsp. paratuberculosis
cuggcaugccggaacacc

SEQ ID NO: 986930 - RNA, 13 nt, Mycobacterium avium subsp. paratuberculosis
cuggcgcuccagc

SEQ ID NO: 986931 - RNA, 16 nt, Mycobacterium avium subsp. paratuberculosis
cuggcgcuccagccac

SEQ ID NO: 986932 - RNA, 17 nt, Mycobacterium avium subsp. paratuberculosis
cuggcgcuccagccacu

SEQ ID NO: 986933 - RNA, 18 nt, Mycobacterium avium subsp. paratuberculosis
cuggcgcuccagccacuc

SEQ ID NO: 986934 - RNA, 18 nt, Mycobacterium avium subsp. paratuberculosis
cuggcgcuggugcagcag

SEQ ID NO: 986935 - RNA, 22 nt, Mycobacterium avium subsp. paratuberculosis
cuggcgcuugcguucccagccc

SEQ ID NO: 986936 - RNA, 21 nt, Mycobacterium avium subsp. paratuberculosis
cuggcggacccgcucccggga

SEQ ID NO: 986937 - RNA, 19 nt, Mycobacterium avium subsp. paratuberculosis
cuggcggcaacggccauga

SEQ ID NO: 986938 - RNA, 15 nt, Mycobacterium avium subsp. paratuberculosis
cuggcggauggcgcc

SEQ ID NO: 986939 - RNA, 14 nt, Mycobacterium avium subsp. paratuberculosis
cuggcggccagcgu

SEQ ID NO: 986940 - RNA, 15 nt, Mycobacterium avium subsp. paratuberculosis
cuggccguggucggc

SEQ ID NO: 986941 - RNA, 17 nt, Mycobacterium avium subsp. paratuberculosis
cuggccguggucggcga

SEQ ID NO: 986942 - RNA, 16 nt, Mycobacterium avium subsp. paratuberculosis
cuggcccggcgcggcg

SEQ ID NO: 986943 - RNA, 12 nt, Mycobacterium avium subsp. paratuberculosis
cuggccuccagc

SEQ ID NO: 986944 - RNA, 22 nt, Mycobacterium avium subsp. paratuberculosis
cuggcgccggcguccagcgccg

SEQ ID NO: 986945 - RNA, 17 nt, Mycobacterium avium subsp. paratuberculosis
cuggcgccggucggugc

SEQ ID NO: 986946 - RNA, 20 nt, Mycobacterium avium subsp. paratuberculosis
cugcucaugagcccuccagc

SEQ ID NO: 986947 - RNA, 17 nt, Mycobacterium avium subsp. paratuberculosis
cugcuugaacagcaccc

SEQ ID NO: 986948 - RNA, 21 nt, Mycobacterium avium subsp. paratuberculosis
cugcuugaacagcacccccuc

SEQ ID NO: 986949 - RNA, 14 nt, Mycobacterium avium subsp. paratuberculosis
cugcucagcggcca

SEQ ID NO: 986950 - RNA, 23 nt, Mycobacterium avium subsp. paratuberculosis
cugcuuugucucacgccucgucg

SEQ ID NO: 986951 - RNA, 21 nt, Mycobacterium avium subsp. paratuberculosis
cuggaaaccccucagccggaa

SEQ ID NO: 986952 - RNA, 17 nt, Mycobacterium avium subsp. paratuberculosis
cugcuugggcagcagcu

SEQ ID NO: 986953 - RNA, 16 nt, Mycobacterium avium subsp. paratuberculosis
cugcuugacccgcucc

SEQ ID NO: 986954 - RNA, 24 nt, Mycobacterium avium subsp. paratuberculosis
cugcuugacccgcuccagcggcca

SEQ ID NO: 986955 - RNA, 14 nt, Mycobacterium avium subsp. paratuberculosis
cugcuugaccgugg

SEQ ID NO: 986956 - RNA, 14 nt, Mycobacterium avium subsp. paratuberculosis
cugcuugaucaggu

SEQ ID NO: 986957 - RNA, 15 nt, Mycobacterium avium subsp. paratuberculosis
cugcuugaugaugcc

SEQ ID NO: 986958 - RNA, 21 nt, Mycobacterium avium subsp. paratuberculosis
cugcuugaugaugccggccgc

SEQ ID NO: 986959 - RNA, 20 nt, Mycobacterium avium subsp. paratuberculosis
cuggacgucgucgcuguccu

SEQ ID NO: 986960 - RNA, 23 nt, Mycobacterium avium subsp. paratuberculosis
cuggacgucgucgcuguccucga

SEQ ID NO: 986961 - RNA, 20 nt, Mycobacterium avium subsp. paratuberculosis
cuggacgguuucaccgccgu

SEQ ID NO: 986962 - RNA, 18 nt, Mycobacterium avium subsp. paratuberculosis
cuggacagccacagcucg

SEQ ID NO: 986963 - RNA, 23 nt, Mycobacterium avium subsp. paratuberculosis
cuggacauucacgaggccgggcu

SEQ ID NO: 986964 - RNA, 23 nt, Mycobacterium avium subsp. paratuberculosis
cuggaagccuggcacgacgccgc

SEQ ID NO: 986965 - RNA, 21 nt, Mycobacterium avium subsp. paratuberculosis
cuggaagcgcaucgccggcgc

SEQ ID NO: 986966 - RNA, 17 nt, Mycobacterium avium subsp. paratuberculosis
cuggaaucccgccucgg

SEQ ID NO: 986967 - RNA, 17 nt, Mycobacterium avium subsp. paratuberculosis
cuggaacacccaggucu

SEQ ID NO: 986968 - RNA, 15 nt, Mycobacterium avium subsp. paratuberculosis
cuguuuuuccgccgg

SEQ ID NO: 986969 - RNA, 15 nt, Mycobacterium avium subsp. paratuberculosis
cuguucgcggcuggc

SEQ ID NO: 986970 - RNA, 18 nt, Mycobacterium avium subsp. paratuberculosis
cuguugguagcccaggau

SEQ ID NO: 986971 - RNA, 22 nt, Mycobacterium avium subsp. paratuberculosis
cuguuggccagauacuccucgg

SEQ ID NO: 986972 - RNA, 16 nt, Mycobacterium avium subsp. paratuberculosis
cuucacgugcgcggcg

SEQ ID NO: 986973 - RNA, 12 nt, Mycobacterium avium subsp. paratuberculosis
cuucacgcuggc

SEQ ID NO: 986974 - RNA, 15 nt, Mycobacterium avium subsp. paratuberculosis
cuucacgcuggccuc

SEQ ID NO: 986975 - RNA, 15 nt, Mycobacterium avium subsp. paratuberculosis
cuucagcccgcgcau

SEQ ID NO: 986976 - RNA, 15 nt, Mycobacterium avium subsp. paratuberculosis
cuucaucgaucgggu

SEQ ID NO: 986977 - RNA, 16 nt, Mycobacterium avium subsp. paratuberculosis
cuucaugcccuuggcc

SEQ ID NO: 986978 - RNA, 19 nt, Mycobacterium avium subsp. paratuberculosis
cuucagcgggcgcagcucg

SEQ ID NO: 986979 - RNA, 17 nt, Mycobacterium avium subsp. paratuberculosis
cuucagcuugaccguga

SEQ ID NO: 986980 - RNA, 16 nt, Mycobacterium avium subsp. paratuberculosis
cuucaggcagcgcacg

SEQ ID NO: 986981 - RNA, 16 nt, Mycobacterium avium subsp. paratuberculosis
cuucaguucggccggc

SEQ ID NO: 986982 - RNA, 18 nt, Mycobacterium avium subsp. paratuberculosis
cuucgcagcagauccuca

SEQ ID NO: 986983 - RNA, 21 nt, Mycobacterium avium subsp. paratuberculosis
cuucgccgcaaccuucuuggc

SEQ ID NO: 986984 - RNA, 22 nt, Mycobacterium avium subsp. paratuberculosis
cuucgccgcaaccuucuuggcc

SEQ ID NO: 986985 - RNA, 17 nt, Mycobacterium avium subsp. paratuberculosis
cuucgccggggccuucu

SEQ ID NO: 986986 - RNA, 21 nt, Mycobacterium avium subsp. paratuberculosis
cuucgccggggccuucuuggc

SEQ ID NO: 986987 - RNA, 20 nt, Mycobacterium avium subsp. paratuberculosis
cuucgaucaggcgcagcccg

SEQ ID NO: 986988 - RNA, 20 nt, Mycobacterium avium subsp. paratuberculosis
cuucccaaccccgggcggcu

SEQ ID NO: 986989 - RNA, 11 nt, Mycobacterium avium subsp. paratuberculosis
cuucccacccg

SEQ ID NO: 986990 - RNA, 13 nt, Mycobacterium avium subsp. paratuberculosis
cuucccacccggu

SEQ ID NO: 986991 - RNA, 15 nt, Mycobacterium avium subsp. paratuberculosis
cuuccgagccgguga

SEQ ID NO: 986992 - RNA, 17 nt, Mycobacterium avium subsp. paratuberculosis
cuuccgcggcggccggc

SEQ ID NO: 986993 - RNA, 18 nt, Mycobacterium avium subsp. paratuberculosis
cuuccgcgcgucgggggu

SEQ ID NO: 986994 - RNA, 17 nt, Mycobacterium avium subsp. paratuberculosis
cuuccgccgagucgcgc

SEQ ID NO: 986995 - RNA, 19 nt, Mycobacterium avium subsp. paratuberculosis
cuuccgccgagucgcgccg

SEQ ID NO: 986996 - RNA, 16 nt, Mycobacterium avium subsp. paratuberculosis
cuuccaucacgccccg

SEQ ID NO: 986997 - RNA, 21 nt, Mycobacterium avium subsp. paratuberculosis
cuuucgcgcacgccaucgccu

SEQ ID NO: 986998 - RNA, 21 nt, Mycobacterium avium subsp. paratuberculosis
cuuucgcgucugcucgccggc

SEQ ID NO: 986999 - RNA, 19 nt, Mycobacterium avium subsp. paratuberculosis
cuuuacgaggcgugcagcc

SEQ ID NO: 987000 - RNA, 21 nt, Mycobacterium avium subsp. paratuberculosis
cuuuacgaggcgugcagcccg

SEQ ID NO: 987001 - RNA, 11 nt, Mycobacterium avium subsp. paratuberculosis
cuuggagccga

SEQ ID NO: 987002 - RNA, 14 nt, Mycobacterium avium subsp. paratuberculosis
cuuggacagcagca

SEQ ID NO: 987003 - RNA, 15 nt, Mycobacterium avium subsp. paratuberculosis
cuugucccgcauggc

SEQ ID NO: 987004 - RNA, 11 nt, Mycobacterium avium subsp. paratuberculosis
cuuguccagga

SEQ ID NO: 987005 - RNA, 12 nt, Mycobacterium avium subsp. paratuberculosis
cuuguccaggau

SEQ ID NO: 987006 - RNA, 19 nt, Mycobacterium avium subsp. paratuberculosis
cuuguggcccaggccggcg

SEQ ID NO: 987007 - RNA, 22 nt, Mycobacterium avium subsp. paratuberculosis
cuuguggucgaucccgccggcg

SEQ ID NO: 987008 - RNA, 14 nt, Mycobacterium avium subsp. paratuberculosis
cuuguugaccuucu

SEQ ID NO: 987009 - RNA, 15 nt, Mycobacterium avium subsp. paratuberculosis
cuuguugaugguguu

SEQ ID NO: 987010 - RNA, 17 nt, Mycobacterium avium subsp. paratuberculosis
cuugcacccagcggaac

SEQ ID NO: 987011 - RNA, 17 nt, Mycobacterium avium subsp. paratuberculosis
cuugaugaugucggcgg

SEQ ID NO: 987012 - RNA, 15 nt, Mycobacterium avium subsp. paratuberculosis
cuugaugcagcgccu

SEQ ID NO: 987013 - RNA, 15 nt, Mycobacterium avium subsp. paratuberculosis
cuugagggucaagau

SEQ ID NO: 987014 - RNA, 22 nt, Mycobacterium avium subsp. paratuberculosis
cuugaaccggcuggacaccccc

SEQ ID NO: 987015 - RNA, 14 nt, Mycobacterium avium subsp. paratuberculosis
cuugaacagcaccc

SEQ ID NO: 987016 - RNA, 18 nt, Mycobacterium avium subsp. paratuberculosis
cuugaacagcacccccuc

SEQ ID NO: 987017 - RNA, 22 nt, Mycobacterium avium subsp. paratuberculosis
cuugagccgccgcggcaccuuc

SEQ ID NO: 987018 - RNA, 23 nt, Mycobacterium avium subsp. paratuberculosis
cuugcguugcgcggcggccaauc

SEQ ID NO: 987019 - RNA, 16 nt, Mycobacterium avium subsp. paratuberculosis
cuugcgguuggccgga

SEQ ID NO: 987020 - RNA, 22 nt, Mycobacterium avium subsp. paratuberculosis
cuugcgucgcgaugcccaagcc

SEQ ID NO: 987021 - RNA, 13 nt, Mycobacterium avium subsp. paratuberculosis
cuugcgggcggca

SEQ ID NO: 987022 - RNA, 14 nt, Mycobacterium avium subsp. paratuberculosis
cuugcgggccggag

SEQ ID NO: 987023 - RNA, 20 nt, Mycobacterium avium subsp. paratuberculosis
cuugcgggccggagccuucu

SEQ ID NO: 987024 - RNA, 13 nt, Mycobacterium avium subsp. paratuberculosis
cuugcgggugauc

SEQ ID NO: 987025 - RNA, 22 nt, Mycobacterium avium subsp. paratuberculosis
cuugcggccgccgaucaacagg

SEQ ID NO: 987026 - RNA, 20 nt, Mycobacterium avium subsp. paratuberculosis
cuugcucuucaggaacccga

SEQ ID NO: 987027 - RNA, 16 nt, Mycobacterium avium subsp. paratuberculosis
cuugcugauccccagc

SEQ ID NO: 987028 - RNA, 15 nt, Mycobacterium avium subsp. paratuberculosis
cuugcugagccggcc

SEQ ID NO: 987029 - RNA, 21 nt, Mycobacterium avium subsp. paratuberculosis
cuugccggagcccagcuuggc

SEQ ID NO: 987030 - RNA, 19 nt, Mycobacterium avium subsp. paratuberculosis
cuugcagccgcugccgcac

SEQ ID NO: 987031 - RNA, 23 nt, Mycobacterium avium subsp. paratuberculosis
cuugcagcccgcguccagcagca

SEQ ID NO: 987032 - RNA, 20 nt, Mycobacterium avium subsp. paratuberculosis
cuugcagcccgcugaccagg

SEQ ID NO: 987033 - RNA, 11 nt, Mycobacterium avium subsp. paratuberculosis
cuugcagcaca

SEQ ID NO: 987034 - RNA, 15 nt, Mycobacterium avium subsp. paratuberculosis
cuugcagcuguccug

SEQ ID NO: 987035 - RNA, 12 nt, Mycobacterium avium subsp. paratuberculosis
cuugcgccgcag

SEQ ID NO: 987036 - RNA, 14 nt, Mycobacterium avium subsp. paratuberculosis
cuugcgccgcagcg

SEQ ID NO: 987037 - RNA, 15 nt, Mycobacterium avium subsp. paratuberculosis
cuugccgugcagcag

SEQ ID NO: 987038 - RNA, 14 nt, Mycobacterium avium subsp. paratuberculosis
cuugcgccaucccc

SEQ ID NO: 987039 - RNA, 16 nt, Mycobacterium avium subsp. paratuberculosis
cuugcgccauccccgc

SEQ ID NO: 987040 - RNA, 15 nt, Mycobacterium avium subsp. paratuberculosis
cuucuucagccgcag

SEQ ID NO: 987041 - RNA, 22 nt, Mycobacterium avium subsp. paratuberculosis
cuucuucagcuugaccgugacg

SEQ ID NO: 987042 - RNA, 13 nt, Mycobacterium avium subsp. paratuberculosis
cuucuggcugggg

SEQ ID NO: 987043 - RNA, 20 nt, Mycobacterium avium subsp. paratuberculosis
cuucuucgccgcaaccuucu

SEQ ID NO: 987044 - RNA, 19 nt, Mycobacterium avium subsp. paratuberculosis
cuucuucgcgggugccuuc

SEQ ID NO: 987045 - RNA, 13 nt, Mycobacterium avium subsp. paratuberculosis
cuucuuggccgga

SEQ ID NO: 987046 - RNA, 13 nt, Mycobacterium avium subsp. paratuberculosis
cuucuuggcgggc

SEQ ID NO: 987047 - RNA, 21 nt, Mycobacterium avium subsp. paratuberculosis
cuucucgaagcgcagcagcuc

SEQ ID NO: 987048 - RNA, 13 nt, Mycobacterium avium subsp. paratuberculosis
cuucuccgcggcc

SEQ ID NO: 987049 - RNA, 21 nt, Mycobacterium avium subsp. paratuberculosis
cuucuccgcggccgcgcgccc

SEQ ID NO: 987050 - RNA, 14 nt, Mycobacterium avium subsp. paratuberculosis
cuucuccgccgggc

SEQ ID NO: 987051 - RNA, 15 nt, Mycobacterium avium subsp. paratuberculosis
cuucuccccgccucg

SEQ ID NO: 987052 - RNA, 19 nt, Mycobacterium avium subsp. paratuberculosis
cuucgcgguccaucuccag

SEQ ID NO: 987053 - RNA, 18 nt, Mycobacterium avium subsp. paratuberculosis
cuucgcggucggcaaccc

SEQ ID NO: 987054 - RNA, 22 nt, Mycobacterium avium subsp. paratuberculosis
cuucgcggucggcaacccgacc

SEQ ID NO: 987055 - RNA, 18 nt, Mycobacterium avium subsp. paratuberculosis
cuucgcggugugcggcag

SEQ ID NO: 987056 - RNA, 17 nt, Mycobacterium avium subsp. paratuberculosis
cuucgcgggugccuucu

SEQ ID NO: 987057 - RNA, 18 nt, Mycobacterium avium subsp. paratuberculosis
cuucgcgggugccuucuu

SEQ ID NO: 987058 - RNA, 20 nt, Mycobacterium avium subsp. paratuberculosis
cuucgcgggugccuucuugg

SEQ ID NO: 987059 - RNA, 22 nt, Mycobacterium avium subsp. paratuberculosis
cuucgcggugugcggcagcucg

SEQ ID NO: 987060 - RNA, 17 nt, Mycobacterium avium subsp. paratuberculosis
cuucucgcacagcacca

SEQ ID NO: 987061 - RNA, 13 nt, Mycobacterium avium subsp. paratuberculosis
cuucucgcugcuc

SEQ ID NO: 987062 - RNA, 18 nt, Mycobacterium avium subsp. paratuberculosis
cuucucggcguccccggc

SEQ ID NO: 987063 - RNA, 17 nt, Mycobacterium avium subsp. paratuberculosis
cuucucggcgugcccgc

SEQ ID NO: 987064 - RNA, 17 nt, Mycobacterium avium subsp. paratuberculosis
cuucucggugaucaccc

SEQ ID NO: 987065 - RNA, 18 nt, Mycobacterium avium subsp. paratuberculosis
gaagaugaucagcgcgcc

SEQ ID NO: 987066 - RNA, 16 nt, Mycobacterium avium subsp. paratuberculosis
gaagaugaucucgccg

SEQ ID NO: 987067 - RNA, 19 nt, Mycobacterium avium subsp. paratuberculosis
gaagaucaacagccgcccc

SEQ ID NO: 987068 - RNA, 16 nt, Mycobacterium avium subsp. paratuberculosis
gaagaucagcgaaggc

SEQ ID NO: 987069 - RNA, 20 nt, Mycobacterium avium subsp. paratuberculosis
gaagaucagcgccagcaaca

SEQ ID NO: 987070 - RNA, 14 nt, Mycobacterium avium subsp. paratuberculosis
gaagaggcgcgcua

SEQ ID NO: 987071 - RNA, 20 nt, Mycobacterium avium subsp. paratuberculosis
gaagcagaacuucuccgccg

SEQ ID NO: 987072 - RNA, 13 nt, Mycobacterium avium subsp. paratuberculosis
gaagcagccuucu

SEQ ID NO: 987073 - RNA, 22 nt, Mycobacterium avium subsp. paratuberculosis
gaagcagccuucuuggcgggcg

SEQ ID NO: 987074 - RNA, 13 nt, Mycobacterium avium subsp. paratuberculosis
gaagauggccagg

SEQ ID NO: 987075 - RNA, 14 nt, Mycobacterium avium subsp. paratuberculosis
gaagauggccagga

SEQ ID NO: 987076 - RNA, 22 nt, Mycobacterium avium subsp. paratuberculosis
gaagaugcgccggguccagccg

SEQ ID NO: 987077 - RNA, 16 nt, Mycobacterium avium subsp. paratuberculosis
gaagaugucgcggcgc

SEQ ID NO: 987078 - RNA, 15 nt, Mycobacterium avium subsp. paratuberculosis
gaagauguugccgcc

SEQ ID NO: 987079 - RNA, 19 nt, Mycobacterium avium subsp. paratuberculosis
gaagacguaggcggccagc

SEQ ID NO: 987080 - RNA, 23 nt, Mycobacterium avium subsp. paratuberculosis
gaagacguaggcggccagcagca

SEQ ID NO: 987081 - RNA, 16 nt, Mycobacterium avium subsp. paratuberculosis
gaagacgucgaacccg

SEQ ID NO: 987082 - RNA, 18 nt, Mycobacterium avium subsp. paratuberculosis
gaagacgcgaaagcagcg

SEQ ID NO: 987083 - RNA, 17 nt, Mycobacterium avium subsp. paratuberculosis
gaagaccgggccgauga

SEQ ID NO: 987084 - RNA, 18 nt, Mycobacterium avium subsp. paratuberculosis
gaagaccguugacgaccu

SEQ ID NO: 987085 - RNA, 16 nt, Mycobacterium avium subsp. paratuberculosis
gaagaccuggccggcc

SEQ ID NO: 987086 - RNA, 19 nt, Mycobacterium avium subsp. paratuberculosis
gaagaccugguugccgccc

SEQ ID NO: 987087 - RNA, 20 nt, Mycobacterium avium subsp. paratuberculosis
gaagaccugguugccgcccu

SEQ ID NO: 987088 - RNA, 17 nt, Mycobacterium avium subsp. paratuberculosis
gaagaagauguugcggc

SEQ ID NO: 987089 - RNA, 18 nt, Mycobacterium avium subsp. paratuberculosis
gaagaacucagccgaaga

SEQ ID NO: 987090 - RNA, 20 nt, Mycobacterium avium subsp. paratuberculosis
gaagaacgacuggcggcggc

SEQ ID NO: 987091 - RNA, 16 nt, Mycobacterium avium subsp. paratuberculosis
gaagaacaccccgacc

SEQ ID NO: 987092 - RNA, 20 nt, Mycobacterium avium subsp. paratuberculosis
gaagccggccaguucccggg

SEQ ID NO: 987093 - RNA, 16 nt, Mycobacterium avium subsp. paratuberculosis
gaagccggccccgccc

SEQ ID NO: 987094 - RNA, 16 nt, Mycobacterium avium subsp. paratuberculosis
gaagccgcggacggcg

SEQ ID NO: 987095 - RNA, 15 nt, Mycobacterium avium subsp. paratuberculosis
gaagccggugcccau

SEQ ID NO: 987096 - RNA, 20 nt, Mycobacterium avium subsp. paratuberculosis
gaagccggcgaacuccaccc

SEQ ID NO: 987097 - RNA, 22 nt, Mycobacterium avium subsp. paratuberculosis
gaagccggcgcagguguccagc

SEQ ID NO: 987098 - RNA, 13 nt, Mycobacterium avium subsp. paratuberculosis
gaagcccuucacc

SEQ ID NO: 987099 - RNA, 19 nt, Mycobacterium avium subsp. paratuberculosis
gaagcccuucaccucggcc

SEQ ID NO: 987100 - RNA, 17 nt, Mycobacterium avium subsp. paratuberculosis
gaagccccggaccggag

SEQ ID NO: 987101 - RNA, 18 nt, Mycobacterium avium subsp. paratuberculosis
gaagccccgguuccaacc

SEQ ID NO: 987102 - RNA, 13 nt, Mycobacterium avium subsp. paratuberculosis
gaagcccgcagcg

SEQ ID NO: 987103 - RNA, 21 nt, Mycobacterium avium subsp. paratuberculosis
gaagcccagcacccgcucgcc

SEQ ID NO: 987104 - RNA, 13 nt, Mycobacterium avium subsp. paratuberculosis
gaagcccaccgcc

SEQ ID NO: 987105 - RNA, 18 nt, Mycobacterium avium subsp. paratuberculosis
gaagcccaccgccguucc

SEQ ID NO: 987106 - RNA, 14 nt, Mycobacterium avium subsp. paratuberculosis
gaagcgcagcagcu

SEQ ID NO: 987107 - RNA, 17 nt, Mycobacterium avium subsp. paratuberculosis
gaagcgacaaaggaggg

SEQ ID NO: 987108 - RNA, 16 nt, Mycobacterium avium subsp. paratuberculosis
gaagccguggcaggca

SEQ ID NO: 987109 - RNA, 14 nt, Mycobacterium avium subsp. paratuberculosis
gaagccgugggugc

SEQ ID NO: 987110 - RNA, 15 nt, Mycobacterium avium subsp. paratuberculosis
gaagccuguuggcca

SEQ ID NO: 987111 - RNA, 17 nt, Mycobacterium avium subsp. paratuberculosis
gaagccuguuggccaga

SEQ ID NO: 987112 - RNA, 17 nt, Mycobacterium avium subsp. paratuberculosis
gaagcgcgaugcggcuc

SEQ ID NO: 987113 - RNA, 20 nt, Mycobacterium avium subsp. paratuberculosis
gaaggacucaaucggucagg

SEQ ID NO: 987114 - RNA, 18 nt, Mycobacterium avium subsp. paratuberculosis
gaaggaggcggucgacug

SEQ ID NO: 987115 - RNA, 15 nt, Mycobacterium avium subsp. paratuberculosis
gaaggccaaggccag

SEQ ID NO: 987116 - RNA, 18 nt, Mycobacterium avium subsp. paratuberculosis
gaaggccaaggccagcaa

SEQ ID NO: 987117 - RNA, 13 nt, Mycobacterium avium subsp. paratuberculosis
gaaggccgcgcug

SEQ ID NO: 987118 - RNA, 14 nt, Mycobacterium avium subsp. paratuberculosis
gaaggcacccagga

SEQ ID NO: 987119 - RNA, 23 nt, Mycobacterium avium subsp. paratuberculosis
gaagcuaaaccccacggccgcaa

SEQ ID NO: 987120 - RNA, 13 nt, Mycobacterium avium subsp. paratuberculosis
gaagcuagcuuca

SEQ ID NO: 987121 - RNA, 16 nt, Mycobacterium avium subsp. paratuberculosis
gaagcuaguuucacgc

SEQ ID NO: 987122 - RNA, 13 nt, Mycobacterium avium subsp. paratuberculosis
gaagcggccgggg

SEQ ID NO: 987123 - RNA, 13 nt, Mycobacterium avium subsp. paratuberculosis
gaagcgggacagc

SEQ ID NO: 987124 - RNA, 21 nt, Mycobacterium avium subsp. paratuberculosis
gaagcgggacugcagcgcggu

SEQ ID NO: 987125 - RNA, 13 nt, Mycobacterium avium subsp. paratuberculosis
gaagcgggcggcg

SEQ ID NO: 987126 - RNA, 21 nt, Mycobacterium avium subsp. paratuberculosis
gaagcgggccaaagagcuugg

SEQ ID NO: 987127 - RNA, 15 nt, Mycobacterium avium subsp. paratuberculosis
gaagcugcgccacaa

SEQ ID NO: 987128 - RNA, 15 nt, Mycobacterium avium subsp. paratuberculosis
gaagcuggccaccgc

SEQ ID NO: 987129 - RNA, 20 nt, Mycobacterium avium subsp. paratuberculosis
gaacugcgguaugccaagcc

SEQ ID NO: 987130 - RNA, 13 nt, Mycobacterium avium subsp. paratuberculosis
gaacugcucgacc

SEQ ID NO: 987131 - RNA, 16 nt, Mycobacterium avium subsp. paratuberculosis
gaacugcucgaccagc

SEQ ID NO: 987132 - RNA, 21 nt, Mycobacterium avium subsp. paratuberculosis
gaacugggccgccgucgccac

SEQ ID NO: 987133 - RNA, 19 nt, Mycobacterium avium subsp. paratuberculosis
gaacugugcggugcggcuu

SEQ ID NO: 987134 - RNA, 12 nt, Mycobacterium avium subsp. paratuberculosis
gaacugggugcc

SEQ ID NO: 987135 - RNA, 18 nt, Mycobacterium avium subsp. paratuberculosis
gaacugggugggcagcgg

SEQ ID NO: 987136 - RNA, 20 nt, Mycobacterium avium subsp. paratuberculosis
gaacugguuccacaccacca

SEQ ID NO: 987137 - RNA, 13 nt, Mycobacterium avium subsp. paratuberculosis
gaacuccagcagc

SEQ ID NO: 987138 - RNA, 15 nt, Mycobacterium avium subsp. paratuberculosis
gaacucaccgguggc

SEQ ID NO: 987139 - RNA, 17 nt, Mycobacterium avium subsp. paratuberculosis
gaacuccuugacccggc

SEQ ID NO: 987140 - RNA, 17 nt, Mycobacterium avium subsp. paratuberculosis
gaacuccgacuccagca

SEQ ID NO: 987141 - RNA, 16 nt, Mycobacterium avium subsp. paratuberculosis
gaacucggccagggcu

SEQ ID NO: 987142 - RNA, 22 nt, Mycobacterium avium subsp. paratuberculosis
gaacucgcgggcgagcagcgcc

SEQ ID NO: 987143 - RNA, 14 nt, Mycobacterium avium subsp. paratuberculosis
gaacucgcggcggg

SEQ ID NO: 987144 - RNA, 15 nt, Mycobacterium avium subsp. paratuberculosis
gaacucggcggcggu

SEQ ID NO: 987145 - RNA, 19 nt, Mycobacterium avium subsp. paratuberculosis
gaacucgggauuggacagc

SEQ ID NO: 987146 - RNA, 14 nt, Mycobacterium avium subsp. paratuberculosis
gaacucggccggca

SEQ ID NO: 987147 - RNA, 16 nt, Mycobacterium avium subsp. paratuberculosis
gaacuacuucgucagc

SEQ ID NO: 987148 - RNA, 17 nt, Mycobacterium avium subsp. paratuberculosis
gaacgugcugugcgggc

SEQ ID NO: 987149 - RNA, 14 nt, Mycobacterium avium subsp. paratuberculosis
gaacgugcgcggcg

SEQ ID NO: 987150 - RNA, 14 nt, Mycobacterium avium subsp. paratuberculosis
gaacgucaccaaca

SEQ ID NO: 987151 - RNA, 15 nt, Mycobacterium avium subsp. paratuberculosis
gaacgucaccaacau

SEQ ID NO: 987152 - RNA, 14 nt, Mycobacterium avium subsp. paratuberculosis
gaacgucaggaucc

SEQ ID NO: 987153 - RNA, 16 nt, Mycobacterium avium subsp. paratuberculosis
gaacgucauggccagc

SEQ ID NO: 987154 - RNA, 17 nt, Mycobacterium avium subsp. paratuberculosis
gaacgucuugggcgcga

SEQ ID NO: 987155 - RNA, 22 nt, Mycobacterium avium subsp. paratuberculosis
gaacgcucacucgucuugcagc

SEQ ID NO: 987156 - RNA, 20 nt, Mycobacterium avium subsp. paratuberculosis
gaacgcgucggucagcggcg

SEQ ID NO: 987157 - RNA, 22 nt, Mycobacterium avium subsp. paratuberculosis
gaacgcggcugaucagccggcg

SEQ ID NO: 987158 - RNA, 22 nt, Mycobacterium avium subsp. paratuberculosis
gaacgcggugggcaccagcagc

SEQ ID NO: 987159 - RNA, 16 nt, Mycobacterium avium subsp. paratuberculosis
gaacgcguacagcgcc

SEQ ID NO: 987160 - RNA, 19 nt, Mycobacterium avium subsp. paratuberculosis
gaacgcggcgaagcaggcc

SEQ ID NO: 987161 - RNA, 18 nt, Mycobacterium avium subsp. paratuberculosis
gaacgcggccagcgggcc

SEQ ID NO: 987162 - RNA, 21 nt, Mycobacterium avium subsp. paratuberculosis
gaacgcgcggaugcccaggcc

SEQ ID NO: 987163 - RNA, 19 nt, Mycobacterium avium subsp. paratuberculosis
gaacgcgcgggugcgggcg

SEQ ID NO: 987164 - RNA, 18 nt, Mycobacterium avium subsp. paratuberculosis
gaacgcgccccgccggga

SEQ ID NO: 987165 - RNA, 16 nt, Mycobacterium avium subsp. paratuberculosis
gaacggcuugcgcucg

SEQ ID NO: 987166 - RNA, 19 nt, Mycobacterium avium subsp. paratuberculosis
gaacggcuugcgcucggcc

SEQ ID NO: 987167 - RNA, 14 nt, Mycobacterium avium subsp. paratuberculosis
gaacgggccgggca

SEQ ID NO: 987168 - RNA, 14 nt, Mycobacterium avium subsp. paratuberculosis
gaacggguccuugc

SEQ ID NO: 987169 - RNA, 23 nt, Mycobacterium avium subsp. paratuberculosis
gaacgggucgaucucggcgcagg

SEQ ID NO: 987170 - RNA, 19 nt, Mycobacterium avium subsp. paratuberculosis
gaacggucagccgcggcuc

SEQ ID NO: 987171 - RNA, 23 nt, Mycobacterium avium subsp. paratuberculosis
gaacggcggggccuccaccagcg

SEQ ID NO: 987172 - RNA, 18 nt, Mycobacterium avium subsp. paratuberculosis
gaacggucggggcggcgg

SEQ ID NO: 987173 - RNA, 17 nt, Mycobacterium avium subsp. paratuberculosis
gaacggcacccgcagcu

SEQ ID NO: 987174 - RNA, 23 nt, Mycobacterium avium subsp. paratuberculosis
gaacggcaaccugggcggcggcg

SEQ ID NO: 987175 - RNA, 17 nt, Mycobacterium avium subsp. paratuberculosis
gaacggcggcagcgagg

SEQ ID NO: 987176 - RNA, 20 nt, Mycobacterium avium subsp. paratuberculosis
gaacggccggauggccagca

SEQ ID NO: 987177 - RNA, 12 nt, Mycobacterium avium subsp. paratuberculosis
gaaccuggccac

SEQ ID NO: 987178 - RNA, 14 nt, Mycobacterium avium subsp. paratuberculosis
gaaccuggccacca

SEQ ID NO: 987179 - RNA, 18 nt, Mycobacterium avium subsp. paratuberculosis
gaaccuggccaccagcag

SEQ ID NO: 987180 - RNA, 19 nt, Mycobacterium avium subsp. paratuberculosis
gaaccuggccaccagcagc

SEQ ID NO: 987181 - RNA, 15 nt, Mycobacterium avium subsp. paratuberculosis
gaaccuggagggagc

SEQ ID NO: 987182 - RNA, 22 nt, Mycobacterium avium subsp. paratuberculosis
gaaccucgagauucugcagccg

SEQ ID NO: 987183 - RNA, 23 nt, Mycobacterium avium subsp. paratuberculosis
gaaccucgagauucugcagccgc

SEQ ID NO: 987184 - RNA, 15 nt, Mycobacterium avium subsp. paratuberculosis
gaaccucgcggcggc

SEQ ID NO: 987185 - RNA, 22 nt, Mycobacterium avium subsp. paratuberculosis
gaaccggucguuggccuccucg

SEQ ID NO: 987186 - RNA, 18 nt, Mycobacterium avium subsp. paratuberculosis
gaaccguagaccaccucg

SEQ ID NO: 987187 - RNA, 18 nt, Mycobacterium avium subsp. paratuberculosis
gaacgagaaggcggcguc

SEQ ID NO: 987188 - RNA, 13 nt, Mycobacterium avium subsp. paratuberculosis
gaacgaguugccc

SEQ ID NO: 987189 - RNA, 18 nt, Mycobacterium avium subsp. paratuberculosis
gaacgaucggcuccagcg

SEQ ID NO: 987190 - RNA, 15 nt, Mycobacterium avium subsp. paratuberculosis
gaacgcaacagggcc

SEQ ID NO: 987191 - RNA, 16 nt, Mycobacterium avium subsp. paratuberculosis
gaacgcaccaccgcgg

SEQ ID NO: 987192 - RNA, 19 nt, Mycobacterium avium subsp. paratuberculosis
gaacgccaccaccuccucg

SEQ ID NO: 987193 - RNA, 20 nt, Mycobacterium avium subsp. paratuberculosis
gaacgccaccaccuccucgc

SEQ ID NO: 987194 - RNA, 16 nt, Mycobacterium avium subsp. paratuberculosis
gaacgccaccacggcg

SEQ ID NO: 987195 - RNA, 21 nt, Mycobacterium avium subsp. paratuberculosis
gaacgccaccuucaccgcgcc

SEQ ID NO: 987196 - RNA, 13 nt, Mycobacterium avium subsp. paratuberculosis
gaacgccagcgcc

SEQ ID NO: 987197 - RNA, 16 nt, Mycobacterium avium subsp. paratuberculosis
gaacgccaucaccagc

SEQ ID NO: 987198 - RNA, 17 nt, Mycobacterium avium subsp. paratuberculosis
gaacgccgcccccgccc

SEQ ID NO: 987199 - RNA, 22 nt, Mycobacterium avium subsp. paratuberculosis
gaacgccgccguguaggccgcg

SEQ ID NO: 987200 - RNA, 21 nt, Mycobacterium avium subsp. paratuberculosis
gaacgccucgggccggcagcc

SEQ ID NO: 987201 - RNA, 19 nt, Mycobacterium avium subsp. paratuberculosis
gaacgccucguuggccagc

SEQ ID NO: 987202 - RNA, 23 nt, Mycobacterium avium subsp. paratuberculosis
gaacgccucguuggccagcucgg

SEQ ID NO: 987203 - RNA, 12 nt, Mycobacterium avium subsp. paratuberculosis
gaacgccugccg

SEQ ID NO: 987204 - RNA, 20 nt, Mycobacterium avium subsp. paratuberculosis
gaacgccuugaccgccuugg

SEQ ID NO: 987205 - RNA, 18 nt, Mycobacterium avium subsp. paratuberculosis
gaaccgaaucggucgacc

SEQ ID NO: 987206 - RNA, 21 nt, Mycobacterium avium subsp. paratuberculosis
gaaccgaaucggucgaccagc

SEQ ID NO: 987207 - RNA, 19 nt, Mycobacterium avium subsp. paratuberculosis
gaaccgcccgcccggcacg

SEQ ID NO: 987208 - RNA, 16 nt, Mycobacterium avium subsp. paratuberculosis
gaaccgcccuuccagc

SEQ ID NO: 987209 - RNA, 19 nt, Mycobacterium avium subsp. paratuberculosis
gaaccgcccuuccagcacc

SEQ ID NO: 987210 - RNA, 17 nt, Mycobacterium avium subsp. paratuberculosis
gaaccgcaacaccagca

SEQ ID NO: 987211 - RNA, 18 nt, Mycobacterium avium subsp. paratuberculosis
gaacccgggcgcgcccac

SEQ ID NO: 987212 - RNA, 23 nt, Mycobacterium avium subsp. paratuberculosis
gaacccggcgugcuccagcaggc

SEQ ID NO: 987213 - RNA, 22 nt, Mycobacterium avium subsp. paratuberculosis
gaacccgccagggcgacgccgc

SEQ ID NO: 987214 - RNA, 18 nt, Mycobacterium avium subsp. paratuberculosis
gaaccgggccgcuggccg

SEQ ID NO: 987215 - RNA, 13 nt, Mycobacterium avium subsp. paratuberculosis
gaaccgggacagc

SEQ ID NO: 987216 - RNA, 13 nt, Mycobacterium avium subsp. paratuberculosis
gaaccggggcacc

SEQ ID NO: 987217 - RNA, 15 nt, Mycobacterium avium subsp. paratuberculosis
gaaccggggccagca

SEQ ID NO: 987218 - RNA, 19 nt, Mycobacterium avium subsp. paratuberculosis
gaaccggggccagcacgcc

SEQ ID NO: 987219 - RNA, 22 nt, Mycobacterium avium subsp. paratuberculosis
gaaccggggccagcacgccccc

SEQ ID NO: 987220 - RNA, 14 nt, Mycobacterium avium subsp. paratuberculosis
gaaccggggccgca

SEQ ID NO: 987221 - RNA, 13 nt, Mycobacterium avium subsp. paratuberculosis
gaaccggccacca

SEQ ID NO: 987222 - RNA, 18 nt, Mycobacterium avium subsp. paratuberculosis
gaaccggaucuggcccug

SEQ ID NO: 987223 - RNA, 19 nt, Mycobacterium avium subsp. paratuberculosis
gaaccggccggggcgccac

SEQ ID NO: 987224 - RNA, 15 nt, Mycobacterium avium subsp. paratuberculosis
gaaccggcuggacac

SEQ ID NO: 987225 - RNA, 21 nt, Mycobacterium avium subsp. paratuberculosis
gaaccgcuugcccagccccuu

SEQ ID NO: 987226 - RNA, 17 nt, Mycobacterium avium subsp. paratuberculosis
gaaccggcaacacagcc

SEQ ID NO: 987227 - RNA, 19 nt, Mycobacterium avium subsp. paratuberculosis
gaaccgcugcugcucggcc

SEQ ID NO: 987228 - RNA, 20 nt, Mycobacterium avium subsp. paratuberculosis
gaaccgcggcggcagcagcc

SEQ ID NO: 987229 - RNA, 18 nt, Mycobacterium avium subsp. paratuberculosis
gaaccaggccgcgcuggc

SEQ ID NO: 987230 - RNA, 19 nt, Mycobacterium avium subsp. paratuberculosis
gaaccaggccgcgcuggcg

SEQ ID NO: 987231 - RNA, 18 nt, Mycobacterium avium subsp. paratuberculosis
gaaccaggcgccggccag

SEQ ID NO: 987232 - RNA, 16 nt, Mycobacterium avium subsp. paratuberculosis
gaaccaguucgccacc

SEQ ID NO: 987233 - RNA, 14 nt, Mycobacterium avium subsp. paratuberculosis
gaaccagcaccgcc

SEQ ID NO: 987234 - RNA, 15 nt, Mycobacterium avium subsp. paratuberculosis
gaaccacgcggcggc

SEQ ID NO: 987235 - RNA, 17 nt, Mycobacterium avium subsp. paratuberculosis
gaaccauuugcccagca

SEQ ID NO: 987236 - RNA, 19 nt, Mycobacterium avium subsp. paratuberculosis
gaaccauuugcccagcagg

SEQ ID NO: 987237 - RNA, 12 nt, Mycobacterium avium subsp. paratuberculosis
gaacccagcgcc

SEQ ID NO: 987238 - RNA, 13 nt, Mycobacterium avium subsp. paratuberculosis
gaacccagcaccc

SEQ ID NO: 987239 - RNA, 14 nt, Mycobacterium avium subsp. paratuberculosis
gaacccagcacccc

SEQ ID NO: 987240 - RNA, 18 nt, Mycobacterium avium subsp. paratuberculosis
gaauucagugaggccagc

SEQ ID NO: 987241 - RNA, 21 nt, Mycobacterium avium subsp. paratuberculosis
gaauuguucugcuuggcaggc

SEQ ID NO: 987242 - RNA, 17 nt, Mycobacterium avium subsp. paratuberculosis
gaauugccgguggugcg

SEQ ID NO: 987243 - RNA, 17 nt, Mycobacterium avium subsp. paratuberculosis
gaauucuggccgaccgc

SEQ ID NO: 987244 - RNA, 17 nt, Mycobacterium avium subsp. paratuberculosis
gaauucggaacccugcc

SEQ ID NO: 987245 - RNA, 15 nt, Mycobacterium avium subsp. paratuberculosis
gaauucgaccacggc

SEQ ID NO: 987246 - RNA, 14 nt, Mycobacterium avium subsp. paratuberculosis
gaaugcgacgacgu

SEQ ID NO: 987247 - RNA, 12 nt, Mycobacterium avium subsp. paratuberculosis
gaauggcagcag

SEQ ID NO: 987248 - RNA, 14 nt, Mycobacterium avium subsp. paratuberculosis
gaauggcagcagcc

SEQ ID NO: 987249 - RNA, 15 nt, Mycobacterium avium subsp. paratuberculosis
gaauggcaaggccag

SEQ ID NO: 987250 - RNA, 17 nt, Mycobacterium avium subsp. paratuberculosis
gaauggcaaggccagca

SEQ ID NO: 987251 - RNA, 22 nt, Mycobacterium avium subsp. paratuberculosis
gaaugcccagcggguaguucuu

SEQ ID NO: 987252 - RNA, 20 nt, Mycobacterium avium subsp. paratuberculosis
gaaugcaucgcgaucgacag

SEQ ID NO: 987253 - RNA, 14 nt, Mycobacterium avium subsp. paratuberculosis
gaaugucgugacca

SEQ ID NO: 987254 - RNA, 17 nt, Mycobacterium avium subsp. paratuberculosis
gaaugucgugaccaaug

SEQ ID NO: 987255 - RNA, 17 nt, Mycobacterium avium subsp. paratuberculosis
gaaugaacgcggccagg

SEQ ID NO: 987256 - RNA, 22 nt, Mycobacterium avium subsp. paratuberculosis
gaaucgucggccacgcucgcca

SEQ ID NO: 987257 - RNA, 19 nt, Mycobacterium avium subsp. paratuberculosis
gaaucggcgcacagcuagg

SEQ ID NO: 987258 - RNA, 15 nt, Mycobacterium avium subsp. paratuberculosis
gaaucgcggcaggcg

SEQ ID NO: 987259 - RNA, 17 nt, Mycobacterium avium subsp. paratuberculosis
gaauccacacaggacca

SEQ ID NO: 987260 - RNA, 22 nt, Mycobacterium avium subsp. paratuberculosis
gaauccacacaggaccagcacu

SEQ ID NO: 987261 - RNA, 22 nt, Mycobacterium avium subsp. paratuberculosis
gaaucacgccccaggcgcccug

SEQ ID NO: 987262 - RNA, 12 nt, Mycobacterium avium subsp. paratuberculosis
gaauccgagcau

SEQ ID NO: 987263 - RNA, 17 nt, Mycobacterium avium subsp. paratuberculosis
gaaucccuccggcaggc

SEQ ID NO: 987264 - RNA, 15 nt, Mycobacterium avium subsp. paratuberculosis
gaaucccacccgcaa

SEQ ID NO: 987265 - RNA, 16 nt, Mycobacterium avium subsp. paratuberculosis
gaauccgcgcagcagc

SEQ ID NO: 987266 - RNA, 20 nt, Mycobacterium avium subsp. paratuberculosis
gaauccgauugcggcgcagg

SEQ ID NO: 987267 - RNA, 21 nt, Mycobacterium avium subsp. paratuberculosis
gaauccggucaacgccgcgcg

SEQ ID NO: 987268 - RNA, 13 nt, Mycobacterium avium subsp. paratuberculosis
gaauccggccgga

SEQ ID NO: 987269 - RNA, 14 nt, Mycobacterium avium subsp. paratuberculosis
gaauccggcggcgc

SEQ ID NO: 987270 - RNA, 22 nt, Mycobacterium avium subsp. paratuberculosis
gaauccuggccgauggucagcu

SEQ ID NO: 987271 - RNA, 16 nt, Mycobacterium avium subsp. paratuberculosis
gaaucgacaccgcacg

SEQ ID NO: 987272 - RNA, 13 nt, Mycobacterium avium subsp. paratuberculosis
gaaguucacgucc

SEQ ID NO: 987273 - RNA, 20 nt, Mycobacterium avium subsp. paratuberculosis
gaaguggucgaucugcaggc

SEQ ID NO: 987274 - RNA, 12 nt, Mycobacterium avium subsp. paratuberculosis
gaaguugccgcc

SEQ ID NO: 987275 - RNA, 22 nt, Mycobacterium avium subsp. paratuberculosis
gaaguugaagacgcgaaagcag

SEQ ID NO: 987276 - RNA, 14 nt, Mycobacterium avium subsp. paratuberculosis
gaaguugccgccgc

SEQ ID NO: 987277 - RNA, 17 nt, Mycobacterium avium subsp. paratuberculosis
gaaguugccggucaggc

SEQ ID NO: 987278 - RNA, 16 nt, Mycobacterium avium subsp. paratuberculosis
gaaguugcgguugacg

SEQ ID NO: 987279 - RNA, 18 nt, Mycobacterium avium subsp. paratuberculosis
gaaguuggccaccggggu

SEQ ID NO: 987280 - RNA, 15 nt, Mycobacterium avium subsp. paratuberculosis
gaaguuggcggcggu

SEQ ID NO: 987281 - RNA, 15 nt, Mycobacterium avium subsp. paratuberculosis
gaaguccgccagggu

SEQ ID NO: 987282 - RNA, 23 nt, Mycobacterium avium subsp. paratuberculosis
gaagucggugugggucagcgagg

SEQ ID NO: 987283 - RNA, 21 nt, Mycobacterium avium subsp. paratuberculosis
gaagugccggcugaaccugcu

SEQ ID NO: 987284 - RNA, 16 nt, Mycobacterium avium subsp. paratuberculosis
gaagugggccaucauc

SEQ ID NO: 987285 - RNA, 22 nt, Mycobacterium avium subsp. paratuberculosis
gaaguggcagcgcuccugcagc

SEQ ID NO: 987286 - RNA, 20 nt, Mycobacterium avium subsp. paratuberculosis
gaaguagcccuuggacuccc

SEQ ID NO: 987287 - RNA, 13 nt, Mycobacterium avium subsp. paratuberculosis
gaaggugcugaau

SEQ ID NO: 987288 - RNA, 15 nt, Mycobacterium avium subsp. paratuberculosis
gaaggugccccacgc

SEQ ID NO: 987289 - RNA, 19 nt, Mycobacterium avium subsp. paratuberculosis
gaaggugguccuggcggug

SEQ ID NO: 987290 - RNA, 22 nt, Mycobacterium avium subsp. paratuberculosis
gaaggugaagguccgguaggcg

SEQ ID NO: 987291 - RNA, 14 nt, Mycobacterium avium subsp. paratuberculosis
gaagggcgccagcc

SEQ ID NO: 987292 - RNA, 19 nt, Mycobacterium avium subsp. paratuberculosis
gaagggcgccagccguucc

SEQ ID NO: 987293 - RNA, 22 nt, Mycobacterium avium subsp. paratuberculosis
gaagggcgcgucguagccggca

SEQ ID NO: 987294 - RNA, 16 nt, Mycobacterium avium subsp. paratuberculosis
gaagggaaaggcagca

SEQ ID NO: 987295 - RNA, 21 nt, Mycobacterium avium subsp. paratuberculosis
gaagggcuuuagaaggccgcc

SEQ ID NO: 987296 - RNA, 22 nt, Mycobacterium avium subsp. paratuberculosis
gaagggcuuuagaaggccgccu

SEQ ID NO: 987297 - RNA, 23 nt, Mycobacterium avium subsp. paratuberculosis
gaaggcgccgucggugggggcca

SEQ ID NO: 987298 - RNA, 14 nt, Mycobacterium avium subsp. paratuberculosis
gaaggcggccaccg

SEQ ID NO: 987299 - RNA, 14 nt, Mycobacterium avium subsp. paratuberculosis
gaaggcggccgcga

SEQ ID NO: 987300 - RNA, 22 nt, Mycobacterium avium subsp. paratuberculosis
gaaggcgaacaccagcccggcc

SEQ ID NO: 987301 - RNA, 20 nt, Mycobacterium avium subsp. paratuberculosis
gaaggccuggaugccgcccu

SEQ ID NO: 987302 - RNA, 22 nt, Mycobacterium avium subsp. paratuberculosis
gaaggcguuggacuccaccgcc

SEQ ID NO: 987303 - RNA, 20 nt, Mycobacterium avium subsp. paratuberculosis
gaaggcguuggagccgacca

SEQ ID NO: 987304 - RNA, 17 nt, Mycobacterium avium subsp. paratuberculosis
gaauacgccaucagcac

SEQ ID NO: 987305 - RNA, 14 nt, Mycobacterium avium subsp. paratuberculosis
gaauaacgccggcc

SEQ ID NO: 987306 - RNA, 15 nt, Mycobacterium avium subsp. paratuberculosis
gaacauggcggccag

SEQ ID NO: 987307 - RNA, 17 nt, Mycobacterium avium subsp. paratuberculosis
gaacaugcugccgccgg

SEQ ID NO: 987308 - RNA, 14 nt, Mycobacterium avium subsp. paratuberculosis
gaacaucuuggggu

SEQ ID NO: 987309 - RNA, 22 nt, Mycobacterium avium subsp. paratuberculosis
gaacaucuuggucagccgcggc

SEQ ID NO: 987310 - RNA, 11 nt, Mycobacterium avium subsp. paratuberculosis
gaacaucagcc

SEQ ID NO: 987311 - RNA, 15 nt, Mycobacterium avium subsp. paratuberculosis
gaacauccacggcau

SEQ ID NO: 987312 - RNA, 18 nt, Mycobacterium avium subsp. paratuberculosis
gaacaucgagcccaccgc

SEQ ID NO: 987313 - RNA, 14 nt, Mycobacterium avium subsp. paratuberculosis
gaacaucgccagca

SEQ ID NO: 987314 - RNA, 15 nt, Mycobacterium avium subsp. paratuberculosis
gaacaucgccagcaa

SEQ ID NO: 987315 - RNA, 15 nt, Mycobacterium avium subsp. paratuberculosis
gaacagcgucgccga

SEQ ID NO: 987316 - RNA, 12 nt, Mycobacterium avium subsp. paratuberculosis
gaacagcgcggc

SEQ ID NO: 987317 - RNA, 15 nt, Mycobacterium avium subsp. paratuberculosis
gaacagcgccagggu

SEQ ID NO: 987318 - RNA, 15 nt, Mycobacterium avium subsp. paratuberculosis
gaacagcgaagccac

SEQ ID NO: 987319 - RNA, 17 nt, Mycobacterium avium subsp. paratuberculosis
gaacagcucgaccagcc

SEQ ID NO: 987320 - RNA, 19 nt, Mycobacterium avium subsp. paratuberculosis
gaacaggaugcagccggcc

SEQ ID NO: 987321 - RNA, 14 nt, Mycobacterium avium subsp. paratuberculosis
gaacaggcuggcca

SEQ ID NO: 987322 - RNA, 15 nt, Mycobacterium avium subsp. paratuberculosis
gaacaggcuggccag

SEQ ID NO: 987323 - RNA, 16 nt, Mycobacterium avium subsp. paratuberculosis
gaacaccgccuugccc

SEQ ID NO: 987324 - RNA, 20 nt, Mycobacterium avium subsp. paratuberculosis
gaacaccgcguuggccgcca

SEQ ID NO: 987325 - RNA, 16 nt, Mycobacterium avium subsp. paratuberculosis
gaacaccggcagcgcc

SEQ ID NO: 987326 - RNA, 17 nt, Mycobacterium avium subsp. paratuberculosis
gaacaccggcgcgacca

SEQ ID NO: 987327 - RNA, 22 nt, Mycobacterium avium subsp. paratuberculosis
gaacaccucgaaguucuccucg

SEQ ID NO: 987328 - RNA, 16 nt, Mycobacterium avium subsp. paratuberculosis
gaacaccagcccggcc

SEQ ID NO: 987329 - RNA, 13 nt, Mycobacterium avium subsp. paratuberculosis
gaacaccagcacc

SEQ ID NO: 987330 - RNA, 14 nt, Mycobacterium avium subsp. paratuberculosis
gaacaccagcaccc

SEQ ID NO: 987331 - RNA, 16 nt, Mycobacterium avium subsp. paratuberculosis
gaacaccaccaggccg

SEQ ID NO: 987332 - RNA, 13 nt, Mycobacterium avium subsp. paratuberculosis
gaacaccaccgcc

SEQ ID NO: 987333 - RNA, 19 nt, Mycobacterium avium subsp. paratuberculosis
gaacaccacguagccgacc

SEQ ID NO: 987334 - RNA, 19 nt, Mycobacterium avium subsp. paratuberculosis
gaacaccacgucguccagc

SEQ ID NO: 987335 - RNA, 14 nt, Mycobacterium avium subsp. paratuberculosis
gaacaauagagggg

SEQ ID NO: 987336 - RNA, 20 nt, Mycobacterium avium subsp. paratuberculosis
gaacaacgcgcacaacagcc

SEQ ID NO: 987337 - RNA, 14 nt, Mycobacterium avium subsp. paratuberculosis
gaacacgugcagcu

SEQ ID NO: 987338 - RNA, 22 nt, Mycobacterium avium subsp. paratuberculosis
gaacacguugcgcaucagcgcc

SEQ ID NO: 987339 - RNA, 15 nt, Mycobacterium avium subsp. paratuberculosis
gaacacggucgccgg

SEQ ID NO: 987340 - RNA, 16 nt, Mycobacterium avium subsp. paratuberculosis
gaacacggucgccggc

SEQ ID NO: 987341 - RNA, 19 nt, Mycobacterium avium subsp. paratuberculosis
gaacacgucggccagcgcg

SEQ ID NO: 987342 - RNA, 21 nt, Mycobacterium avium subsp. paratuberculosis
gaacacggcucgggggccgcu

SEQ ID NO: 987343 - RNA, 14 nt, Mycobacterium avium subsp. paratuberculosis
gaacacgggcggca

SEQ ID NO: 987344 - RNA, 22 nt, Mycobacterium avium subsp. paratuberculosis
gaacacgggcggcagggccagc

SEQ ID NO: 987345 - RNA, 16 nt, Mycobacterium avium subsp. paratuberculosis
gaacacgccccggcgg

SEQ ID NO: 987346 - RNA, 16 nt, Mycobacterium avium subsp. paratuberculosis
gaacaccugcggcggc

SEQ ID NO: 987347 - RNA, 14 nt, Mycobacterium avium subsp. paratuberculosis
gaacagcacccccu

SEQ ID NO: 987348 - RNA, 16 nt, Mycobacterium avium subsp. paratuberculosis
gaacagaugccugccc

SEQ ID NO: 987349 - RNA, 17 nt, Mycobacterium avium subsp. paratuberculosis
gaacagccgggccagca

SEQ ID NO: 987350 - RNA, 19 nt, Mycobacterium avium subsp. paratuberculosis
gaacagccgggccagcagc

SEQ ID NO: 987351 - RNA, 20 nt, Mycobacterium avium subsp. paratuberculosis
gaacagccgggccagcagcu

SEQ ID NO: 987352 - RNA, 17 nt, Mycobacterium avium subsp. paratuberculosis
gaacagccgggccgccc

SEQ ID NO: 987353 - RNA, 12 nt, Mycobacterium avium subsp. paratuberculosis
gaacagcaggcc

SEQ ID NO: 987354 - RNA, 18 nt, Mycobacterium avium subsp. paratuberculosis
gaacagcagcgaacccgc

SEQ ID NO: 987355 - RNA, 13 nt, Mycobacterium avium subsp. paratuberculosis
gaacaacagggcc

SEQ ID NO: 987356 - RNA, 13 nt, Mycobacterium avium subsp. paratuberculosis
gaaaugccuuggc

SEQ ID NO: 987357 - RNA, 18 nt, Mycobacterium avium subsp. paratuberculosis
gaaaugccuuggcggcgu

SEQ ID NO: 987358 - RNA, 20 nt, Mycobacterium avium subsp. paratuberculosis
gaaaugggccaugccggccu

SEQ ID NO: 987359 - RNA, 22 nt, Mycobacterium avium subsp. paratuberculosis
gaaaugcaacgcacgggcggcg

SEQ ID NO: 987360 - RNA, 17 nt, Mycobacterium avium subsp. paratuberculosis
gaaaucgagcgcgcugu

SEQ ID NO: 987361 - RNA, 17 nt, Mycobacterium avium subsp. paratuberculosis
gaaauccggggucaggg

SEQ ID NO: 987362 - RNA, 21 nt, Mycobacterium avium subsp. paratuberculosis
gaaagcagcguucggucagca

SEQ ID NO: 987363 - RNA, 11 nt, Mycobacterium avium subsp. paratuberculosis
gaaagcccagg

SEQ ID NO: 987364 - RNA, 12 nt, Mycobacterium avium subsp. paratuberculosis
gaaaggcagcag

SEQ ID NO: 987365 - RNA, 14 nt, Mycobacterium avium subsp. paratuberculosis
gaaaggcagcagcc

SEQ ID NO: 987366 - RNA, 11 nt, Mycobacterium avium subsp. paratuberculosis
gaaaggaucug

SEQ ID NO: 987367 - RNA, 14 nt, Mycobacterium avium subsp. paratuberculosis
gaaagugcaacugg

SEQ ID NO: 987368 - RNA, 16 nt, Mycobacterium avium subsp. paratuberculosis
gaaacucguugccagc

SEQ ID NO: 987369 - RNA, 16 nt, Mycobacterium avium subsp. paratuberculosis
gaaacgacgucgccac

SEQ ID NO: 987370 - RNA, 23 nt, Mycobacterium avium subsp. paratuberculosis
gaaaccguuuucacagcucaccu

SEQ ID NO: 987371 - RNA, 14 nt, Mycobacterium avium subsp. paratuberculosis
gaaaccggccagca

SEQ ID NO: 987372 - RNA, 16 nt, Mycobacterium avium subsp. paratuberculosis
gaaaccggccagcagc

SEQ ID NO: 987373 - RNA, 17 nt, Mycobacterium avium subsp. paratuberculosis
gaaaccggccagcagca

SEQ ID NO: 987374 - RNA, 19 nt, Mycobacterium avium subsp. paratuberculosis
gaaaccggccagcagcagc

SEQ ID NO: 987375 - RNA, 18 nt, Mycobacterium avium subsp. paratuberculosis
gaaaagauguaucaggau

SEQ ID NO: 987376 - RNA, 18 nt, Mycobacterium avium subsp. paratuberculosis
gaaaaggucgaacagcuc

SEQ ID NO: 987377 - RNA, 11 nt, Mycobacterium avium subsp. paratuberculosis
gaaaagugggu

SEQ ID NO: 987378 - RNA, 22 nt, Mycobacterium avium subsp. paratuberculosis
gaaaaagcguugcgccagcagg

SEQ ID NO: 987379 - RNA, 11 nt, Mycobacterium avium subsp. paratuberculosis
gaaaaccagca

SEQ ID NO: 987380 - RNA, 12 nt, Mycobacterium avium subsp. paratuberculosis
gaaaaccagcga

SEQ ID NO: 987381 - RNA, 23 nt, Mycobacterium avium subsp. paratuberculosis
gaaaaccagcgacgccagcggca

SEQ ID NO: 987382 - RNA, 16 nt, Mycobacterium avium subsp. paratuberculosis
gaaaaaacggcggcgg

SEQ ID NO: 987383 - RNA, 19 nt, Mycobacterium avium subsp. paratuberculosis
cuuuguacaagugaugacc

SEQ ID NO: 987384 - RNA, 22 nt, Mycobacterium avium subsp. paratuberculosis
aaaaaccugcggugccaaugaa

SEQ ID NO: 987385 - RNA, 13 nt, Mycobacterium avium subsp. paratuberculosis
aaaaaccaugcca

SEQ ID NO: 987386 - RNA, 17 nt, Mycobacterium avium subsp. paratuberculosis
aaaaccagcgacgccag

SEQ ID NO: 987387 - RNA, 16 nt, Mycobacterium avium subsp. paratuberculosis
aaaacaacgcgcagcc

SEQ ID NO: 987388 - RNA, 16 nt, Mycobacterium avium subsp. paratuberculosis
aaaccggccagcagca

SEQ ID NO: 987389 - RNA, 15 nt, Mycobacterium avium subsp. paratuberculosis
aaacagugcucaugu

SEQ ID NO: 987390 - RNA, 14 nt, Mycobacterium avium subsp. paratuberculosis
aaacacagcagcac

SEQ ID NO: 987391 - RNA, 20 nt, Mycobacterium avium subsp. paratuberculosis
aaaacgagaugccccaggcg

SEQ ID NO: 987392 - RNA, 14 nt, Mycobacterium avium subsp. paratuberculosis
aaaagggcccaugc

SEQ ID NO: 987393 - RNA, 21 nt, Mycobacterium avium subsp. paratuberculosis
aaaggcguuguugaggaacgc

SEQ ID NO: 987394 - RNA, 22 nt, Mycobacterium avium subsp. paratuberculosis
aaagccguaccgcaacaccgaa

SEQ ID NO: 987395 - RNA, 20 nt, Mycobacterium avium subsp. paratuberculosis
aaagccguagcgcaacaccg

SEQ ID NO: 987396 - RNA, 22 nt, Mycobacterium avium subsp. paratuberculosis
aaagccguagcgcaacaccgaa

SEQ ID NO: 987397 - RNA, 17 nt, Mycobacterium avium subsp. paratuberculosis
aaagccuccaacccaac

SEQ ID NO: 987398 - RNA, 15 nt, Mycobacterium avium subsp. paratuberculosis
aaagcgaccagcgcg

SEQ ID NO: 987399 - RNA, 17 nt, Mycobacterium avium subsp. paratuberculosis
aaagcgcgggcagccca

SEQ ID NO: 987400 - RNA, 15 nt, Mycobacterium avium subsp. paratuberculosis
aaagugcaacuggca

SEQ ID NO: 987401 - RNA, 16 nt, Mycobacterium avium subsp. paratuberculosis
aacaacuacgagcagc

SEQ ID NO: 987402 - RNA, 19 nt, Mycobacterium avium subsp. paratuberculosis
aacaacgcgcacaacagcc

SEQ ID NO: 987403 - RNA, 13 nt, Mycobacterium avium subsp. paratuberculosis
aacaacagggccg

SEQ ID NO: 987404 - RNA, 19 nt, Mycobacterium avium subsp. paratuberculosis
aagacguaggcggccagca

SEQ ID NO: 987405 - RNA, 23 nt, Mycobacterium avium subsp. paratuberculosis
aagaccggaagccuguuggccag

SEQ ID NO: 987406 - RNA, 22 nt, Mycobacterium avium subsp. paratuberculosis
aacuccugcucgcgggccaccg

SEQ ID NO: 987407 - RNA, 17 nt, Mycobacterium avium subsp. paratuberculosis
aacuccgucucgccgua

SEQ ID NO: 987408 - RNA, 17 nt, Mycobacterium avium subsp. paratuberculosis
aacuccgcgcgcggcac

SEQ ID NO: 987409 - RNA, 17 nt, Mycobacterium avium subsp. paratuberculosis
aacuccgacuccagcag

SEQ ID NO: 987410 - RNA, 21 nt, Mycobacterium avium subsp. paratuberculosis
aacucguugccagccggugcu

SEQ ID NO: 987411 - RNA, 23 nt, Mycobacterium avium subsp. paratuberculosis
aacucgccgaucgggaccgucac

SEQ ID NO: 987412 - RNA, 16 nt, Mycobacterium avium subsp. paratuberculosis
aacucgacgaucucgu

SEQ ID NO: 987413 - RNA, 14 nt, Mycobacterium avium subsp. paratuberculosis
aacucgacgcucgg

SEQ ID NO: 987414 - RNA, 13 nt, Mycobacterium avium subsp. paratuberculosis
aacugacaggcgg

SEQ ID NO: 987415 - RNA, 14 nt, Mycobacterium avium subsp. paratuberculosis
aacgggccgccuca

SEQ ID NO: 987416 - RNA, 21 nt, Mycobacterium avium subsp. paratuberculosis
aacggcggggccuccaccagc

SEQ ID NO: 987417 - RNA, 16 nt, Mycobacterium avium subsp. paratuberculosis
aacggcucggucaagc

SEQ ID NO: 987418 - RNA, 19 nt, Mycobacterium avium subsp. paratuberculosis
aacggcggaccggcggccg

SEQ ID NO: 987419 - RNA, 16 nt, Mycobacterium avium subsp. paratuberculosis
aacgggcuggccaggc

SEQ ID NO: 987420 - RNA, 13 nt, Mycobacterium avium subsp. paratuberculosis
aacuucagcugcu

SEQ ID NO: 987421 - RNA, 14 nt, Mycobacterium avium subsp. paratuberculosis
aacuucacgcucgg

SEQ ID NO: 987422 - RNA, 16 nt, Mycobacterium avium subsp. paratuberculosis
aacuucaggcccucau

SEQ ID NO: 987423 - RNA, 13 nt, Mycobacterium avium subsp. paratuberculosis
aacugccguagga

SEQ ID NO: 987424 - RNA, 22 nt, Mycobacterium avium subsp. paratuberculosis
aacugagcgcggcgagcggcaa

SEQ ID NO: 987425 - RNA, 18 nt, Mycobacterium avium subsp. paratuberculosis
aacgcugaccgcaggaaa

SEQ ID NO: 987426 - RNA, 21 nt, Mycobacterium avium subsp. paratuberculosis
aacggccggauggccagcagg

SEQ ID NO: 987427 - RNA, 18 nt, Mycobacterium avium subsp. paratuberculosis
aacggccggcgccgccgg

SEQ ID NO: 987428 - RNA, 18 nt, Mycobacterium avium subsp. paratuberculosis
aacggcgccuugaaccgg

SEQ ID NO: 987429 - RNA, 21 nt, Mycobacterium avium subsp. paratuberculosis
aacggcgcgaaccgggccagg

SEQ ID NO: 987430 - RNA, 19 nt, Mycobacterium avium subsp. paratuberculosis
aacgccugccggcgccgga

SEQ ID NO: 987431 - RNA, 12 nt, Mycobacterium avium subsp. paratuberculosis
aacgcgccggcg

SEQ ID NO: 987432 - RNA, 17 nt, Mycobacterium avium subsp. paratuberculosis
aacgcgccggugacccc

SEQ ID NO: 987433 - RNA, 15 nt, Mycobacterium avium subsp. paratuberculosis
aacgcgccccgccgg

SEQ ID NO: 987434 - RNA, 13 nt, Mycobacterium avium subsp. paratuberculosis
aacgcggccagcg

SEQ ID NO: 987435 - RNA, 13 nt, Mycobacterium avium subsp. paratuberculosis
aacgcggccaggg

SEQ ID NO: 987436 - RNA, 19 nt, Mycobacterium avium subsp. paratuberculosis
aacgcggugggcaccagca

SEQ ID NO: 987437 - RNA, 21 nt, Mycobacterium avium subsp. paratuberculosis
aacgcggugggcaccagcagc

SEQ ID NO: 987438 - RNA, 19 nt, Mycobacterium avium subsp. paratuberculosis
aacgcggcgaaggccagcg

SEQ ID NO: 987439 - RNA, 16 nt, Mycobacterium avium subsp. paratuberculosis
aacgcggccgccagcg

SEQ ID NO: 987440 - RNA, 15 nt, Mycobacterium avium subsp. paratuberculosis
aacgacccggccacc

SEQ ID NO: 987441 - RNA, 22 nt, Mycobacterium avium subsp. paratuberculosis
aacgaggccgacguggagcuga

SEQ ID NO: 987442 - RNA, 16 nt, Mycobacterium avium subsp. paratuberculosis
aaccugcggugccaau

SEQ ID NO: 987443 - RNA, 20 nt, Mycobacterium avium subsp. paratuberculosis
aaccugcugggcggcaccac

SEQ ID NO: 987444 - RNA, 18 nt, Mycobacterium avium subsp. paratuberculosis
aaccuggccaccagcagc

SEQ ID NO: 987445 - RNA, 17 nt, Mycobacterium avium subsp. paratuberculosis
aaccgggcacccggcgc

SEQ ID NO: 987446 - RNA, 16 nt, Mycobacterium avium subsp. paratuberculosis
aaccgggccaggauga

SEQ ID NO: 987447 - RNA, 22 nt, Mycobacterium avium subsp. paratuberculosis
aaccgggccgcacccccuccac

SEQ ID NO: 987448 - RNA, 15 nt, Mycobacterium avium subsp. paratuberculosis
aaccguugcagaaca

SEQ ID NO: 987449 - RNA, 18 nt, Mycobacterium avium subsp. paratuberculosis
aaccguuggacugcaacg

SEQ ID NO: 987450 - RNA, 17 nt, Mycobacterium avium subsp. paratuberculosis
aaccagcaccggcaccg

SEQ ID NO: 987451 - RNA, 17 nt, Mycobacterium avium subsp. paratuberculosis
aaccagcaugcgccaga

SEQ ID NO: 987452 - RNA, 15 nt, Mycobacterium avium subsp. paratuberculosis
aaccagcccaggucg

SEQ ID NO: 987453 - RNA, 22 nt, Mycobacterium avium subsp. paratuberculosis
aaccaggccgcgcuggcgcagg

SEQ ID NO: 987454 - RNA, 15 nt, Mycobacterium avium subsp. paratuberculosis
aaccccacggccgca

SEQ ID NO: 987455 - RNA, 19 nt, Mycobacterium avium subsp. paratuberculosis
aaccccgcucccauccgga

SEQ ID NO: 987456 - RNA, 15 nt, Mycobacterium avium subsp. paratuberculosis
aacccgaaagccccc

SEQ ID NO: 987457 - RNA, 20 nt, Mycobacterium avium subsp. paratuberculosis
aaccacuucuggcgcugcuc

SEQ ID NO: 987458 - RNA, 16 nt, Mycobacterium avium subsp. paratuberculosis
aacaucgucaacaugc

SEQ ID NO: 987459 - RNA, 23 nt, Mycobacterium avium subsp. paratuberculosis
aacagucggccggcguuguccag

SEQ ID NO: 987460 - RNA, 10 nt, Mycobacterium avium subsp. paratuberculosis
aacagugcac

SEQ ID NO: 987461 - RNA, 16 nt, Mycobacterium avium subsp. paratuberculosis
aacaucgagcccaccg

SEQ ID NO: 987462 - RNA, 18 nt, Mycobacterium avium subsp. paratuberculosis
aacaucgccagcaacgac

SEQ ID NO: 987463 - RNA, 18 nt, Mycobacterium avium subsp. paratuberculosis
aacagcuggucccacagc

SEQ ID NO: 987464 - RNA, 14 nt, Mycobacterium avium subsp. paratuberculosis
aacagcgucgccga

SEQ ID NO: 987465 - RNA, 23 nt, Mycobacterium avium subsp. paratuberculosis
aacaagguguggaucaccaucac

SEQ ID NO: 987466 - RNA, 13 nt, Mycobacterium avium subsp. paratuberculosis
aacagcggggugc

SEQ ID NO: 987467 - RNA, 17 nt, Mycobacterium avium subsp. paratuberculosis
aacagcgcgccggccgg

SEQ ID NO: 987468 - RNA, 23 nt, Mycobacterium avium subsp. paratuberculosis
aacagggccgcgcgggcgaccug

SEQ ID NO: 987469 - RNA, 17 nt, Mycobacterium avium subsp. paratuberculosis
aagcgguugagccacaa

SEQ ID NO: 987470 - RNA, 15 nt, Mycobacterium avium subsp. paratuberculosis
aagcgggccaaagag

SEQ ID NO: 987471 - RNA, 13 nt, Mycobacterium avium subsp. paratuberculosis
aagcgcagcagcu

SEQ ID NO: 987472 - RNA, 21 nt, Mycobacterium avium subsp. paratuberculosis
aagaucagcaccguccacagc

SEQ ID NO: 987473 - RNA, 15 nt, Mycobacterium avium subsp. paratuberculosis
aagaucagcaggcug

SEQ ID NO: 987474 - RNA, 21 nt, Mycobacterium avium subsp. paratuberculosis
aagaucgcccgccgcgagccg

SEQ ID NO: 987475 - RNA, 23 nt, Mycobacterium avium subsp. paratuberculosis
aagaucgcagcggugacacccag

SEQ ID NO: 987476 - RNA, 16 nt, Mycobacterium avium subsp. paratuberculosis
aagaucgucuugaccg

SEQ ID NO: 987477 - RNA, 19 nt, Mycobacterium avium subsp. paratuberculosis
aagccguaccgcaacaccg

SEQ ID NO: 987478 - RNA, 19 nt, Mycobacterium avium subsp. paratuberculosis
aagccguagcgcaacaccg

SEQ ID NO: 987479 - RNA, 13 nt, Mycobacterium avium subsp. paratuberculosis
aagccggucuugg

SEQ ID NO: 987480 - RNA, 19 nt, Mycobacterium avium subsp. paratuberculosis
aagccgggcggcagcagcu

SEQ ID NO: 987481 - RNA, 22 nt, Mycobacterium avium subsp. paratuberculosis
aagccgggcggcagcagcugcg

SEQ ID NO: 987482 - RNA, 13 nt, Mycobacterium avium subsp. paratuberculosis
aagccggccagca

SEQ ID NO: 987483 - RNA, 16 nt, Mycobacterium avium subsp. paratuberculosis
aagccggccagcagcg

SEQ ID NO: 987484 - RNA, 16 nt, Mycobacterium avium subsp. paratuberculosis
aagccggccaggccca

SEQ ID NO: 987485 - RNA, 21 nt, Mycobacterium avium subsp. paratuberculosis
aagccggccaggcccagccca

SEQ ID NO: 987486 - RNA, 19 nt, Mycobacterium avium subsp. paratuberculosis
aagccggcgaacuccaccc

SEQ ID NO: 987487 - RNA, 15 nt, Mycobacterium avium subsp. paratuberculosis
aagccuguuggccag

SEQ ID NO: 987488 - RNA, 17 nt, Mycobacterium avium subsp. paratuberculosis
aagcuccacgccgccgg

SEQ ID NO: 987489 - RNA, 21 nt, Mycobacterium avium subsp. paratuberculosis
aagcugguggugaucggccag

SEQ ID NO: 987490 - RNA, 11 nt, Mycobacterium avium subsp. paratuberculosis
aagcuggccac

SEQ ID NO: 987491 - RNA, 16 nt, Mycobacterium avium subsp. paratuberculosis
aaggacaagccggaga

SEQ ID NO: 987492 - RNA, 12 nt, Mycobacterium avium subsp. paratuberculosis
aaggcucgccac

SEQ ID NO: 987493 - RNA, 15 nt, Mycobacterium avium subsp. paratuberculosis
aaggcucgccacgcg

SEQ ID NO: 987494 - RNA, 11 nt, Mycobacterium avium subsp. paratuberculosis
aaggcccaccg

SEQ ID NO: 987495 - RNA, 16 nt, Mycobacterium avium subsp. paratuberculosis
aaggccaaggccagca

SEQ ID NO: 987496 - RNA, 17 nt, Mycobacterium avium subsp. paratuberculosis
aagugcccgccucacag

SEQ ID NO: 987497 - RNA, 14 nt, Mycobacterium avium subsp. paratuberculosis
aaguguuguuugag

SEQ ID NO: 987498 - RNA, 16 nt, Mycobacterium avium subsp. paratuberculosis
aagucguucagcugca

SEQ ID NO: 987499 - RNA, 21 nt, Mycobacterium avium subsp. paratuberculosis
aagucgcugaggcugcgggug

SEQ ID NO: 987500 - RNA, 17 nt, Mycobacterium avium subsp. paratuberculosis
aagucgggcgcggagaa

SEQ ID NO: 987501 - RNA, 21 nt, Mycobacterium avium subsp. paratuberculosis
aaguccggguccuaucaggac

SEQ ID NO: 987502 - RNA, 23 nt, Mycobacterium avium subsp. paratuberculosis
aaguccggguccuaucaggacug

SEQ ID NO: 987503 - RNA, 15 nt, Mycobacterium avium subsp. paratuberculosis
aaguagggccgcagc

SEQ ID NO: 987504 - RNA, 14 nt, Mycobacterium avium subsp. paratuberculosis
aaguagccggccag

SEQ ID NO: 987505 - RNA, 14 nt, Mycobacterium avium subsp. paratuberculosis
aaguaguagcuguu

SEQ ID NO: 987506 - RNA, 17 nt, Mycobacterium avium subsp. paratuberculosis
aaguacgccgucugguc

SEQ ID NO: 987507 - RNA, 15 nt, Mycobacterium avium subsp. paratuberculosis
aagggaaaggcagca

SEQ ID NO: 987508 - RNA, 16 nt, Mycobacterium avium subsp. paratuberculosis
aagggaaaggcagcag

SEQ ID NO: 987509 - RNA, 18 nt, Mycobacterium avium subsp. paratuberculosis
aagggaaaggcagcagcc

SEQ ID NO: 987510 - RNA, 19 nt, Mycobacterium avium subsp. paratuberculosis
aagggcgucacgagcucca

SEQ ID NO: 987511 - RNA, 9 nt, Mycobacterium avium subsp. paratuberculosis
aaggggucg

SEQ ID NO: 987512 - RNA, 23 nt, Mycobacterium avium subsp. paratuberculosis
aaaaauaggugaccucgagcagc

SEQ ID NO: 987513 - RNA, 17 nt, Mycobacterium avium subsp. paratuberculosis
aaguugguguccacccg

SEQ ID NO: 987514 - RNA, 13 nt, Mycobacterium avium subsp. paratuberculosis
accaccaugaugu

SEQ ID NO: 987515 - RNA, 22 nt, Mycobacterium avium subsp. paratuberculosis
accaccaguuccaccagugucc

SEQ ID NO: 987516 - RNA, 17 nt, Mycobacterium avium subsp. paratuberculosis
accaccauguuccagaa

SEQ ID NO: 987517 - RNA, 15 nt, Mycobacterium avium subsp. paratuberculosis
accacccagcccuug

SEQ ID NO: 987518 - RNA, 14 nt, Mycobacterium avium subsp. paratuberculosis
accaccacggccgc

SEQ ID NO: 987519 - RNA, 19 nt, Mycobacterium avium subsp. paratuberculosis
accaccacggccgccgagg

SEQ ID NO: 987520 - RNA, 13 nt, Mycobacterium avium subsp. paratuberculosis
accacccaggugg

SEQ ID NO: 987521 - RNA, 16 nt, Mycobacterium avium subsp. paratuberculosis
accacccaggccaccc

SEQ ID NO: 987522 - RNA, 19 nt, Mycobacterium avium subsp. paratuberculosis
accacccccgacccgaagc

SEQ ID NO: 987523 - RNA, 21 nt, Mycobacterium avium subsp. paratuberculosis
accaccgagguggcccagccg

SEQ ID NO: 987524 - RNA, 19 nt, Mycobacterium avium subsp. paratuberculosis
accacccucggucaggauc

SEQ ID NO: 987525 - RNA, 21 nt, Mycobacterium avium subsp. paratuberculosis
accacccucggucaggaucga

SEQ ID NO: 987526 - RNA, 16 nt, Mycobacterium avium subsp. paratuberculosis
accaccucgcgggcga

SEQ ID NO: 987527 - RNA, 20 nt, Mycobacterium avium subsp. paratuberculosis
accaccucgcgggcgaccug

SEQ ID NO: 987528 - RNA, 22 nt, Mycobacterium avium subsp. paratuberculosis
accaccuuggccggugcgccga

SEQ ID NO: 987529 - RNA, 16 nt, Mycobacterium avium subsp. paratuberculosis
accacgaacgcugcca

SEQ ID NO: 987530 - RNA, 17 nt, Mycobacterium avium subsp. paratuberculosis
accacgaacugggugcc

SEQ ID NO: 987531 - RNA, 22 nt, Mycobacterium avium subsp. paratuberculosis
accacgaacugggugccccgcc

SEQ ID NO: 987532 - RNA, 17 nt, Mycobacterium avium subsp. paratuberculosis
accacgaaccaggcgcc

SEQ ID NO: 987533 - RNA, 20 nt, Mycobacterium avium subsp. paratuberculosis
accacgaagggcgccagcac

SEQ ID NO: 987534 - RNA, 21 nt, Mycobacterium avium subsp. paratuberculosis
accacgaagggcgccagcacc

SEQ ID NO: 987535 - RNA, 24 nt, Mycobacterium avium subsp. paratuberculosis
accacgaccagugcccggccaacu

SEQ ID NO: 987536 - RNA, 15 nt, Mycobacterium avium subsp. paratuberculosis
accacgaccgggucu

SEQ ID NO: 987537 - RNA, 18 nt, Mycobacterium avium subsp. paratuberculosis
accaccgccaccagcgca

SEQ ID NO: 987538 - RNA, 23 nt, Mycobacterium avium subsp. paratuberculosis
accaccgcguugaucagcgccag

SEQ ID NO: 987539 - RNA, 18 nt, Mycobacterium avium subsp. paratuberculosis
accaccggcaaccgccac

SEQ ID NO: 987540 - RNA, 18 nt, Mycobacterium avium subsp. paratuberculosis
accaccggccgcccggcg

SEQ ID NO: 987541 - RNA, 19 nt, Mycobacterium avium subsp. paratuberculosis
accaccgugcuggccacca

SEQ ID NO: 987542 - RNA, 19 nt, Mycobacterium avium subsp. paratuberculosis
accaccguggccccagcca

SEQ ID NO: 987543 - RNA, 21 nt, Mycobacterium avium subsp. paratuberculosis
accacugauccgucaucucgu

SEQ ID NO: 987544 - RNA, 14 nt, Mycobacterium avium subsp. paratuberculosis
accacugcgcgccc

SEQ ID NO: 987545 - RNA, 15 nt, Mycobacterium avium subsp. paratuberculosis
accacuuccagcacc

SEQ ID NO: 987546 - RNA, 15 nt, Mycobacterium avium subsp. paratuberculosis
accacuugaaggagg

SEQ ID NO: 987547 - RNA, 20 nt, Mycobacterium avium subsp. paratuberculosis
accacgucgucggccugcac

SEQ ID NO: 987548 - RNA, 15 nt, Mycobacterium avium subsp. paratuberculosis
accacggccccagcc

SEQ ID NO: 987549 - RNA, 15 nt, Mycobacterium avium subsp. paratuberculosis
accacggucacagcc

SEQ ID NO: 987550 - RNA, 18 nt, Mycobacterium avium subsp. paratuberculosis
accacggagcgcccggcc

SEQ ID NO: 987551 - RNA, 14 nt, Mycobacterium avium subsp. paratuberculosis
accacgguggcgcc

SEQ ID NO: 987552 - RNA, 22 nt, Mycobacterium avium subsp. paratuberculosis
accacguaggcgaucagcgcgc

SEQ ID NO: 987553 - RNA, 22 nt, Mycobacterium avium subsp. paratuberculosis
accacgaucugcuuggucaccu

SEQ ID NO: 987554 - RNA, 13 nt, Mycobacterium avium subsp. paratuberculosis
accacgcacacca

SEQ ID NO: 987555 - RNA, 14 nt, Mycobacterium avium subsp. paratuberculosis
accacgcuguaggg

SEQ ID NO: 987556 - RNA, 17 nt, Mycobacterium avium subsp. paratuberculosis
accacgcgccaaugguu

SEQ ID NO: 987557 - RNA, 13 nt, Mycobacterium avium subsp. paratuberculosis
accacgccgugcc

SEQ ID NO: 987558 - RNA, 21 nt, Mycobacterium avium subsp. paratuberculosis
accacgccgcgcuugacggcc

SEQ ID NO: 987559 - RNA, 17 nt, Mycobacterium avium subsp. paratuberculosis
accaacuccaccgcccg

SEQ ID NO: 987560 - RNA, 16 nt, Mycobacterium avium subsp. paratuberculosis
accaacgccacguagc

SEQ ID NO: 987561 - RNA, 17 nt, Mycobacterium avium subsp. paratuberculosis
accaacgccgccuccga

SEQ ID NO: 987562 - RNA, 14 nt, Mycobacterium avium subsp. paratuberculosis
accaacgcggcgcc

SEQ ID NO: 987563 - RNA, 16 nt, Mycobacterium avium subsp. paratuberculosis
accaacggcagcagca

SEQ ID NO: 987564 - RNA, 14 nt, Mycobacterium avium subsp. paratuberculosis
accacaccagcaug

SEQ ID NO: 987565 - RNA, 14 nt, Mycobacterium avium subsp. paratuberculosis
accacacccagcgc

SEQ ID NO: 987566 - RNA, 14 nt, Mycobacterium avium subsp. paratuberculosis
accacaccccggcc

SEQ ID NO: 987567 - RNA, 15 nt, Mycobacterium avium subsp. paratuberculosis
accaauucgcgcugc

SEQ ID NO: 987568 - RNA, 21 nt, Mycobacterium avium subsp. paratuberculosis
accaauucgcgcugccagggc

SEQ ID NO: 987569 - RNA, 13 nt, Mycobacterium avium subsp. paratuberculosis
accaccacgcugg

SEQ ID NO: 987570 - RNA, 18 nt, Mycobacterium avium subsp. paratuberculosis
accaccacgugccccucc

SEQ ID NO: 987571 - RNA, 22 nt, Mycobacterium avium subsp. paratuberculosis
accaccacgugccccuccucgg

SEQ ID NO: 987572 - RNA, 15 nt, Mycobacterium avium subsp. paratuberculosis
accacaguggccgcc

SEQ ID NO: 987573 - RNA, 21 nt, Mycobacterium avium subsp. paratuberculosis
accacacccgcacgcugucgg

SEQ ID NO: 987574 - RNA, 17 nt, Mycobacterium avium subsp. paratuberculosis
accacaccggcgcugcc

SEQ ID NO: 987575 - RNA, 18 nt, Mycobacterium avium subsp. paratuberculosis
acaucgccaucagcagcg

SEQ ID NO: 987576 - RNA, 12 nt, Mycobacterium avium subsp. paratuberculosis
acaucgccgaga

SEQ ID NO: 987577 - RNA, 22 nt, Mycobacterium avium subsp. paratuberculosis
acaucgccgcggccggagaaca

SEQ ID NO: 987578 - RNA, 16 nt, Mycobacterium avium subsp. paratuberculosis
acaucccggagccguc

SEQ ID NO: 987579 - RNA, 12 nt, Mycobacterium avium subsp. paratuberculosis
acaugcugggcu

SEQ ID NO: 987580 - RNA, 20 nt, Mycobacterium avium subsp. paratuberculosis
acauucgcgugugcccagca

SEQ ID NO: 987581 - RNA, 17 nt, Mycobacterium avium subsp. paratuberculosis
acaggaugcccaacagc

SEQ ID NO: 987582 - RNA, 13 nt, Mycobacterium avium subsp. paratuberculosis
acaggccccacgc

SEQ ID NO: 987583 - RNA, 14 nt, Mycobacterium avium subsp. paratuberculosis
acaggcccagcagc

SEQ ID NO: 987584 - RNA, 18 nt, Mycobacterium avium subsp. paratuberculosis
acauacgccucaccccag

SEQ ID NO: 987585 - RNA, 16 nt, Mycobacterium avium subsp. paratuberculosis
acauagcgcagcucua

SEQ ID NO: 987586 - RNA, 20 nt, Mycobacterium avium subsp. paratuberculosis
acauagugacguuccgaacg

SEQ ID NO: 987587 - RNA, 21 nt, Mycobacterium avium subsp. paratuberculosis
acagacucagcccggcccagc

SEQ ID NO: 987588 - RNA, 12 nt, Mycobacterium avium subsp. paratuberculosis
acagacacagca

SEQ ID NO: 987589 - RNA, 22 nt, Mycobacterium avium subsp. paratuberculosis
acacguuucggcccuccagcac

SEQ ID NO: 987590 - RNA, 14 nt, Mycobacterium avium subsp. paratuberculosis
acaccgaaagccgu

SEQ ID NO: 987591 - RNA, 20 nt, Mycobacterium avium subsp. paratuberculosis
acaccgaauuguccagcagu

SEQ ID NO: 987592 - RNA, 21 nt, Mycobacterium avium subsp. paratuberculosis
acaccgaacccaccagcgccu

SEQ ID NO: 987593 - RNA, 17 nt, Mycobacterium avium subsp. paratuberculosis
acacccggugcgccggu

SEQ ID NO: 987594 - RNA, 17 nt, Mycobacterium avium subsp. paratuberculosis
acacugaaagccgaggc

SEQ ID NO: 987595 - RNA, 14 nt, Mycobacterium avium subsp. paratuberculosis
acagcaccgccauc

SEQ ID NO: 987596 - RNA, 18 nt, Mycobacterium avium subsp. paratuberculosis
acagcacccgcugcagcc

SEQ ID NO: 987597 - RNA, 22 nt, Mycobacterium avium subsp. paratuberculosis
acagcacccgcugcagccgguc

SEQ ID NO: 987598 - RNA, 15 nt, Mycobacterium avium subsp. paratuberculosis
acagcacccaggugc

SEQ ID NO: 987599 - RNA, 19 nt, Mycobacterium avium subsp. paratuberculosis
acagcacccaggugcugcc

SEQ ID NO: 987600 - RNA, 18 nt, Mycobacterium avium subsp. paratuberculosis
acagcacguaggucccgg

SEQ ID NO: 987601 - RNA, 16 nt, Mycobacterium avium subsp. paratuberculosis
acagaugccagacgaa

SEQ ID NO: 987602 - RNA, 14 nt, Mycobacterium avium subsp. paratuberculosis
acagaugccugccc

SEQ ID NO: 987603 - RNA, 19 nt, Mycobacterium avium subsp. paratuberculosis
acagaucgcccaucaccgc

SEQ ID NO: 987604 - RNA, 20 nt, Mycobacterium avium subsp. paratuberculosis
acagcguggucgcgcagcau

SEQ ID NO: 987605 - RNA, 20 nt, Mycobacterium avium subsp. paratuberculosis
acagcucgcgggccugcucg

SEQ ID NO: 987606 - RNA, 13 nt, Mycobacterium avium subsp. paratuberculosis
acagcgucagcau

SEQ ID NO: 987607 - RNA, 15 nt, Mycobacterium avium subsp. paratuberculosis
acagcgucagccccg

SEQ ID NO: 987608 - RNA, 17 nt, Mycobacterium avium subsp. paratuberculosis
acagcgucguccaugcc

SEQ ID NO: 987609 - RNA, 19 nt, Mycobacterium avium subsp. paratuberculosis
acaggacguugaggcggcg

SEQ ID NO: 987610 - RNA, 15 nt, Mycobacterium avium subsp. paratuberculosis
acagcugagcagccc

SEQ ID NO: 987611 - RNA, 21 nt, Mycobacterium avium subsp. paratuberculosis
acagcugggcguacugcucgg

SEQ ID NO: 987612 - RNA, 15 nt, Mycobacterium avium subsp. paratuberculosis
acagcccgugcagga

SEQ ID NO: 987613 - RNA, 19 nt, Mycobacterium avium subsp. paratuberculosis
acagcccguugcugcguuc

SEQ ID NO: 987614 - RNA, 16 nt, Mycobacterium avium subsp. paratuberculosis
acagccccgagccgcg

SEQ ID NO: 987615 - RNA, 14 nt, Mycobacterium avium subsp. paratuberculosis
acagcccgagcacg

SEQ ID NO: 987616 - RNA, 19 nt, Mycobacterium avium subsp. paratuberculosis
acagcggcggaugggugcg

SEQ ID NO: 987617 - RNA, 18 nt, Mycobacterium avium subsp. paratuberculosis
acagcgggcagagcugcu

SEQ ID NO: 987618 - RNA, 15 nt, Mycobacterium avium subsp. paratuberculosis
acagcggcgcaugac

SEQ ID NO: 987619 - RNA, 11 nt, Mycobacterium avium subsp. paratuberculosis
acagcgcgccg

SEQ ID NO: 987620 - RNA, 18 nt, Mycobacterium avium subsp. paratuberculosis
acagcgcgacgggcaccc

SEQ ID NO: 987621 - RNA, 14 nt, Mycobacterium avium subsp. paratuberculosis
acaccagcccggcc

SEQ ID NO: 987622 - RNA, 16 nt, Mycobacterium avium subsp. paratuberculosis
acacagcacgcccugg

SEQ ID NO: 987623 - RNA, 22 nt, Mycobacterium avium subsp. paratuberculosis
acacagccaaagccuacggcgc

SEQ ID NO: 987624 - RNA, 15 nt, Mycobacterium avium subsp. paratuberculosis
acacagcagcacgcc

SEQ ID NO: 987625 - RNA, 12 nt, Mycobacterium avium subsp. paratuberculosis
acacagcagcag

SEQ ID NO: 987626 - RNA, 21 nt, Mycobacterium avium subsp. paratuberculosis
acacagcagcagcaccaggcu

SEQ ID NO: 987627 - RNA, 21 nt, Mycobacterium avium subsp. paratuberculosis
acaauggauccgaucagcagc

SEQ ID NO: 987628 - RNA, 16 nt, Mycobacterium avium subsp. paratuberculosis
acaauggccccggcgu

SEQ ID NO: 987629 - RNA, 18 nt, Mycobacterium avium subsp. paratuberculosis
acaacgcggugaccgcgg

SEQ ID NO: 987630 - RNA, 20 nt, Mycobacterium avium subsp. paratuberculosis
acaacggcggaccggcggcc

SEQ ID NO: 987631 - RNA, 14 nt, Mycobacterium avium subsp. paratuberculosis
acaacucagaacag

SEQ ID NO: 987632 - RNA, 23 nt, Mycobacterium avium subsp. paratuberculosis
aauucgguggcgauggugcugcc

SEQ ID NO: 987633 - RNA, 17 nt, Mycobacterium avium subsp. paratuberculosis
aauuccucagcccggca

SEQ ID NO: 987634 - RNA, 18 nt, Mycobacterium avium subsp. paratuberculosis
aauugaagcccugcucgg

SEQ ID NO: 987635 - RNA, 17 nt, Mycobacterium avium subsp. paratuberculosis
aauuacaacuguuaaga

SEQ ID NO: 987636 - RNA, 15 nt, Mycobacterium avium subsp. paratuberculosis
aauugcgccagcagc

SEQ ID NO: 987637 - RNA, 23 nt, Mycobacterium avium subsp. paratuberculosis
aaugaugccgacccgcugcagcu

SEQ ID NO: 987638 - RNA, 14 nt, Mycobacterium avium subsp. paratuberculosis
aaugauggucagcc

SEQ ID NO: 987639 - RNA, 17 nt, Mycobacterium avium subsp. paratuberculosis
aaugauggucagccgca

SEQ ID NO: 987640 - RNA, 21 nt, Mycobacterium avium subsp. paratuberculosis
aaugauggucagccgcaccag

SEQ ID NO: 987641 - RNA, 22 nt, Mycobacterium avium subsp. paratuberculosis
aaugauggucagccgcaccagg

SEQ ID NO: 987642 - RNA, 14 nt, Mycobacterium avium subsp. paratuberculosis
aauggcaaggccag

SEQ ID NO: 987643 - RNA, 16 nt, Mycobacterium avium subsp. paratuberculosis
aauggcaaggccagca

SEQ ID NO: 987644 - RNA, 18 nt, Mycobacterium avium subsp. paratuberculosis
aauggcaaggccagcaac

SEQ ID NO: 987645 - RNA, 17 nt, Mycobacterium avium subsp. paratuberculosis
aaugccguagaucucgc

SEQ ID NO: 987646 - RNA, 23 nt, Mycobacterium avium subsp. paratuberculosis
aaugagacgacccgagagcugcu

SEQ ID NO: 987647 - RNA, 17 nt, Mycobacterium avium subsp. paratuberculosis
aaugaacgcggccaggg

SEQ ID NO: 987648 - RNA, 14 nt, Mycobacterium avium subsp. paratuberculosis
aaucgcccgcgaaa

SEQ ID NO: 987649 - RNA, 14 nt, Mycobacterium avium subsp. paratuberculosis
aaucggcgcacagc

SEQ ID NO: 987650 - RNA, 15 nt, Mycobacterium avium subsp. paratuberculosis
aaucguugagcacca

SEQ ID NO: 987651 - RNA, 22 nt, Mycobacterium avium subsp. paratuberculosis
acucucgcggcaaggcgcagaa

SEQ ID NO: 987652 - RNA, 22 nt, Mycobacterium avium subsp. paratuberculosis
acucuggcgugacguucggcca

SEQ ID NO: 987653 - RNA, 18 nt, Mycobacterium avium subsp. paratuberculosis
acucgaccugcccgggcc

SEQ ID NO: 987654 - RNA, 22 nt, Mycobacterium avium subsp. paratuberculosis
acucgagcgugcccgcgcccac

SEQ ID NO: 987655 - RNA, 16 nt, Mycobacterium avium subsp. paratuberculosis
acucgaacggcccgga

SEQ ID NO: 987656 - RNA, 15 nt, Mycobacterium avium subsp. paratuberculosis
acucgaagaaccgca

SEQ ID NO: 987657 - RNA, 20 nt, Mycobacterium avium subsp. paratuberculosis
acucgaagaucgccugcagg

SEQ ID NO: 987658 - RNA, 13 nt, Mycobacterium avium subsp. paratuberculosis
acuccucacaccu

SEQ ID NO: 987659 - RNA, 14 nt, Mycobacterium avium subsp. paratuberculosis
acuccucacaccuc

SEQ ID NO: 987660 - RNA, 11 nt, Mycobacterium avium subsp. paratuberculosis
acucggcgccg

SEQ ID NO: 987661 - RNA, 15 nt, Mycobacterium avium subsp. paratuberculosis
acucggcggcgggca

SEQ ID NO: 987662 - RNA, 18 nt, Mycobacterium avium subsp. paratuberculosis
acucccaggccgcggcca

SEQ ID NO: 987663 - RNA, 13 nt, Mycobacterium avium subsp. paratuberculosis
acucccccaccac

SEQ ID NO: 987664 - RNA, 18 nt, Mycobacterium avium subsp. paratuberculosis
acuccggcggcagccagg

SEQ ID NO: 987665 - RNA, 15 nt, Mycobacterium avium subsp. paratuberculosis
acuccggguggaacu

SEQ ID NO: 987666 - RNA, 14 nt, Mycobacterium avium subsp. paratuberculosis
acuggagugcugca

SEQ ID NO: 987667 - RNA, 24 nt, Mycobacterium avium subsp. paratuberculosis
acugcugcgggugcggccagcgca

SEQ ID NO: 987668 - RNA, 15 nt, Mycobacterium avium subsp. paratuberculosis
acugcaucaugucca

SEQ ID NO: 987669 - RNA, 13 nt, Mycobacterium avium subsp. paratuberculosis
acugcgcaccgcc

SEQ ID NO: 987670 - RNA, 15 nt, Mycobacterium avium subsp. paratuberculosis
acugcgcaccgccag

SEQ ID NO: 987671 - RNA, 14 nt, Mycobacterium avium subsp. paratuberculosis
acugcgccggggcc

SEQ ID NO: 987672 - RNA, 14 nt, Mycobacterium avium subsp. paratuberculosis
acucuucuuccugc

SEQ ID NO: 987673 - RNA, 15 nt, Mycobacterium avium subsp. paratuberculosis
acugagcgcccgguc

SEQ ID NO: 987674 - RNA, 21 nt, Mycobacterium avium subsp. paratuberculosis
acugagcgcccggucgagguc

SEQ ID NO: 987675 - RNA, 20 nt, Mycobacterium avium subsp. paratuberculosis
acugaucgacgagccgggcc

SEQ ID NO: 987676 - RNA, 16 nt, Mycobacterium avium subsp. paratuberculosis
acugaucgagcucggc

SEQ ID NO: 987677 - RNA, 13 nt, Mycobacterium avium subsp. paratuberculosis
acugaucaccgcg

SEQ ID NO: 987678 - RNA, 15 nt, Mycobacterium avium subsp. paratuberculosis
acuuccgcgcaggga

SEQ ID NO: 987679 - RNA, 12 nt, Mycobacterium avium subsp. paratuberculosis
acuuccuccucu

SEQ ID NO: 987680 - RNA, 14 nt, Mycobacterium avium subsp. paratuberculosis
acuuccuccucuuc

SEQ ID NO: 987681 - RNA, 15 nt, Mycobacterium avium subsp. paratuberculosis
acuucuggcgcugcu

SEQ ID NO: 987682 - RNA, 22 nt, Mycobacterium avium subsp. paratuberculosis
acuucugguugacgccgaugcg

SEQ ID NO: 987683 - RNA, 16 nt, Mycobacterium avium subsp. paratuberculosis
acuucggguguggugc

SEQ ID NO: 987684 - RNA, 15 nt, Mycobacterium avium subsp. paratuberculosis
acuucgucagcagcg

SEQ ID NO: 987685 - RNA, 14 nt, Mycobacterium avium subsp. paratuberculosis
acuugaccagcagc

SEQ ID NO: 987686 - RNA, 15 nt, Mycobacterium avium subsp. paratuberculosis
acuugaccagcagcu

SEQ ID NO: 987687 - RNA, 13 nt, Mycobacterium avium subsp. paratuberculosis
acuugaaggaggc

SEQ ID NO: 987688 - RNA, 12 nt, Mycobacterium avium subsp. paratuberculosis
acuucuucgccg

SEQ ID NO: 987689 - RNA, 11 nt, Mycobacterium avium subsp. paratuberculosis
acuucagcugc

SEQ ID NO: 987690 - RNA, 17 nt, Mycobacterium avium subsp. paratuberculosis
acuucaggcccucaucg

SEQ ID NO: 987691 - RNA, 15 nt, Mycobacterium avium subsp. paratuberculosis
acuguugucagccac

SEQ ID NO: 987692 - RNA, 19 nt, Mycobacterium avium subsp. paratuberculosis
acguuguugaccgcggaca

SEQ ID NO: 987693 - RNA, 14 nt, Mycobacterium avium subsp. paratuberculosis
acguugcccaggaa

SEQ ID NO: 987694 - RNA, 11 nt, Mycobacterium avium subsp. paratuberculosis
acguuggugau

SEQ ID NO: 987695 - RNA, 22 nt, Mycobacterium avium subsp. paratuberculosis
acguuggggugguuguugaagu

SEQ ID NO: 987696 - RNA, 15 nt, Mycobacterium avium subsp. paratuberculosis
acguuggccagcacc

SEQ ID NO: 987697 - RNA, 15 nt, Mycobacterium avium subsp. paratuberculosis
acguggaaauugcug

SEQ ID NO: 987698 - RNA, 16 nt, Mycobacterium avium subsp. paratuberculosis
acgugcgcggcgcgcg

SEQ ID NO: 987699 - RNA, 16 nt, Mycobacterium avium subsp. paratuberculosis
acgugcucggcggccg

SEQ ID NO: 987700 - RNA, 22 nt, Mycobacterium avium subsp. paratuberculosis
acgugcucggcggccgccagcg

SEQ ID NO: 987701 - RNA, 22 nt, Mycobacterium avium subsp. paratuberculosis
acgugcccuuccccggcggccg

SEQ ID NO: 987702 - RNA, 14 nt, Mycobacterium avium subsp. paratuberculosis
acgugccccuccuc

SEQ ID NO: 987703 - RNA, 15 nt, Mycobacterium avium subsp. paratuberculosis
acgugccccuccucg

SEQ ID NO: 987704 - RNA, 16 nt, Mycobacterium avium subsp. paratuberculosis
acgugcccgaucucgu

SEQ ID NO: 987705 - RNA, 18 nt, Mycobacterium avium subsp. paratuberculosis
acgucugcgggaagccca

SEQ ID NO: 987706 - RNA, 13 nt, Mycobacterium avium subsp. paratuberculosis
acgucuugcgcac

SEQ ID NO: 987707 - RNA, 21 nt, Mycobacterium avium subsp. paratuberculosis
acgucuugucggggaagggcg

SEQ ID NO: 987708 - RNA, 18 nt, Mycobacterium avium subsp. paratuberculosis
acguaggacagcaccaca

SEQ ID NO: 987709 - RNA, 18 nt, Mycobacterium avium subsp. paratuberculosis
acguaggcggccagcagc

SEQ ID NO: 987710 - RNA, 19 nt, Mycobacterium avium subsp. paratuberculosis
acguaggcggccagcagca

SEQ ID NO: 987711 - RNA, 14 nt, Mycobacterium avium subsp. paratuberculosis
acguagccgaccuu

SEQ ID NO: 987712 - RNA, 14 nt, Mycobacterium avium subsp. paratuberculosis
acguagcagcagac

SEQ ID NO: 987713 - RNA, 15 nt, Mycobacterium avium subsp. paratuberculosis
acguagcgguccagc

SEQ ID NO: 987714 - RNA, 22 nt, Mycobacterium avium subsp. paratuberculosis
acguagcgaucggugaacccgc

SEQ ID NO: 987715 - RNA, 23 nt, Mycobacterium avium subsp. paratuberculosis
acuaccgccucgccagccccacc

SEQ ID NO: 987716 - RNA, 17 nt, Mycobacterium avium subsp. paratuberculosis
acggauacccgcggccu

SEQ ID NO: 987717 - RNA, 15 nt, Mycobacterium avium subsp. paratuberculosis
acggagacgaccagg

SEQ ID NO: 987718 - RNA, 18 nt, Mycobacterium avium subsp. paratuberculosis
acggagccgagcaccagg

SEQ ID NO: 987719 - RNA, 19 nt, Mycobacterium avium subsp. paratuberculosis
acgcugagcacccgcccgg

SEQ ID NO: 987720 - RNA, 17 nt, Mycobacterium avium subsp. paratuberculosis
acgcugagcgccaggcc

SEQ ID NO: 987721 - RNA, 21 nt, Mycobacterium avium subsp. paratuberculosis
acgcugaccugugcgccccac

SEQ ID NO: 987722 - RNA, 21 nt, Mycobacterium avium subsp. paratuberculosis
acgcugacgaugcggccggcg

SEQ ID NO: 987723 - RNA, 20 nt, Mycobacterium avium subsp. paratuberculosis
acgcugucggggucgcggcc

SEQ ID NO: 987724 - RNA, 14 nt, Mycobacterium avium subsp. paratuberculosis
acgcugugcgccuu

SEQ ID NO: 987725 - RNA, 14 nt, Mycobacterium avium subsp. paratuberculosis
acgcuuccagcacc

SEQ ID NO: 987726 - RNA, 22 nt, Mycobacterium avium subsp. paratuberculosis
acgcuauuggccgagccgggcg

SEQ ID NO: 987727 - RNA, 13 nt, Mycobacterium avium subsp. paratuberculosis
acgccaucgccuc

SEQ ID NO: 987728 - RNA, 18 nt, Mycobacterium avium subsp. paratuberculosis
acgccaucgccucggcca

SEQ ID NO: 987729 - RNA, 15 nt, Mycobacterium avium subsp. paratuberculosis
acgccaucaccagcg

SEQ ID NO: 987730 - RNA, 22 nt, Mycobacterium avium subsp. paratuberculosis
acgcucggucgccacggccggc

SEQ ID NO: 987731 - RNA, 19 nt, Mycobacterium avium subsp. paratuberculosis
acgcucacccggcccaccg

SEQ ID NO: 987732 - RNA, 13 nt, Mycobacterium avium subsp. paratuberculosis
acgggccaggcgc

SEQ ID NO: 987733 - RNA, 15 nt, Mycobacterium avium subsp. paratuberculosis
acgggccaggcgcgc

SEQ ID NO: 987734 - RNA, 17 nt, Mycobacterium avium subsp. paratuberculosis
acgggccgggcaccgcg

SEQ ID NO: 987735 - RNA, 16 nt, Mycobacterium avium subsp. paratuberculosis
acggcucccaggccca

SEQ ID NO: 987736 - RNA, 18 nt, Mycobacterium avium subsp. paratuberculosis
acggcucaacggccggcg

SEQ ID NO: 987737 - RNA, 18 nt, Mycobacterium avium subsp. paratuberculosis
acggcucggucaagccgg

SEQ ID NO: 987738 - RNA, 19 nt, Mycobacterium avium subsp. paratuberculosis
acggcguggcugaggccgc

SEQ ID NO: 987739 - RNA, 22 nt, Mycobacterium avium subsp. paratuberculosis
acggcguggcugaggccgcccc

SEQ ID NO: 987740 - RNA, 23 nt, Mycobacterium avium subsp. paratuberculosis
acggcguugaccaacgccgccuc

SEQ ID NO: 987741 - RNA, 19 nt, Mycobacterium avium subsp. paratuberculosis
acggcgucggcggccugcu

SEQ ID NO: 987742 - RNA, 20 nt, Mycobacterium avium subsp. paratuberculosis
acggcgucguugagcaggcu

SEQ ID NO: 987743 - RNA, 23 nt, Mycobacterium avium subsp. paratuberculosis
acggcgucguugagcaggcugga

SEQ ID NO: 987744 - RNA, 14 nt, Mycobacterium avium subsp. paratuberculosis
acggcgccgcccgg

SEQ ID NO: 987745 - RNA, 23 nt, Mycobacterium avium subsp. paratuberculosis
acggcgcuggcgaccaucagccu

SEQ ID NO: 987746 - RNA, 23 nt, Mycobacterium avium subsp. paratuberculosis
acggcgcgaaccgggccaggaug

SEQ ID NO: 987747 - RNA, 14 nt, Mycobacterium avium subsp. paratuberculosis
acggguugagccag

SEQ ID NO: 987748 - RNA, 22 nt, Mycobacterium avium subsp. paratuberculosis
acggguugggcgccagcagcac

SEQ ID NO: 987749 - RNA, 17 nt, Mycobacterium avium subsp. paratuberculosis
acgggcugaccgccagg

SEQ ID NO: 987750 - RNA, 18 nt, Mycobacterium avium subsp. paratuberculosis
acgggugaccggcggcca

SEQ ID NO: 987751 - RNA, 23 nt, Mycobacterium avium subsp. paratuberculosis
acgggcguguagccugcggccug

SEQ ID NO: 987752 - RNA, 20 nt, Mycobacterium avium subsp. paratuberculosis
acgggcguccgagaagggcc

SEQ ID NO: 987753 - RNA, 20 nt, Mycobacterium avium subsp. paratuberculosis
acggugaucagggucccggu

SEQ ID NO: 987754 - RNA, 18 nt, Mycobacterium avium subsp. paratuberculosis
acgguggggcuggccgca

SEQ ID NO: 987755 - RNA, 21 nt, Mycobacterium avium subsp. paratuberculosis
acgguggggcuggccgcacgg

SEQ ID NO: 987756 - RNA, 21 nt, Mycobacterium avium subsp. paratuberculosis
acgguggccucggcgcugccc

SEQ ID NO: 987757 - RNA, 22 nt, Mycobacterium avium subsp. paratuberculosis
acgguggcgcccagcgagcugc

SEQ ID NO: 987758 - RNA, 17 nt, Mycobacterium avium subsp. paratuberculosis
acgguggcgccggcauc

SEQ ID NO: 987759 - RNA, 17 nt, Mycobacterium avium subsp. paratuberculosis
acgguuguucagcccgg

SEQ ID NO: 987760 - RNA, 15 nt, Mycobacterium avium subsp. paratuberculosis
acgguggacccgacc

SEQ ID NO: 987761 - RNA, 19 nt, Mycobacterium avium subsp. paratuberculosis
acgguggccgccaccaaca

SEQ ID NO: 987762 - RNA, 17 nt, Mycobacterium avium subsp. paratuberculosis
acgguuucugccggccg

SEQ ID NO: 987763 - RNA, 22 nt, Mycobacterium avium subsp. paratuberculosis
acgguuuuggucugcgccggcg

SEQ ID NO: 987764 - RNA, 15 nt, Mycobacterium avium subsp. paratuberculosis
acguacaccgggauc

SEQ ID NO: 987765 - RNA, 17 nt, Mycobacterium avium subsp. paratuberculosis
acguacuggcgccgguc

SEQ ID NO: 987766 - RNA, 14 nt, Mycobacterium avium subsp. paratuberculosis
acgcagguccagga

SEQ ID NO: 987767 - RNA, 19 nt, Mycobacterium avium subsp. paratuberculosis
acgcagugccgcaccagca

SEQ ID NO: 987768 - RNA, 19 nt, Mycobacterium avium subsp. paratuberculosis
acgcaucgccgagagcguc

SEQ ID NO: 987769 - RNA, 20 nt, Mycobacterium avium subsp. paratuberculosis
acgccaacugguccugcggc

SEQ ID NO: 987770 - RNA, 16 nt, Mycobacterium avium subsp. paratuberculosis
acgccacaaacagcgc

SEQ ID NO: 987771 - RNA, 12 nt, Mycobacterium avium subsp. paratuberculosis
acgccacguagc

SEQ ID NO: 987772 - RNA, 20 nt, Mycobacterium avium subsp. paratuberculosis
acgccagaugcgccgcggau

SEQ ID NO: 987773 - RNA, 12 nt, Mycobacterium avium subsp. paratuberculosis
acgccagcagcc

SEQ ID NO: 987774 - RNA, 11 nt, Mycobacterium avium subsp. paratuberculosis
acgccagccag

SEQ ID NO: 987775 - RNA, 14 nt, Mycobacterium avium subsp. paratuberculosis
acgccagccaggcg

SEQ ID NO: 987776 - RNA, 20 nt, Mycobacterium avium subsp. paratuberculosis
acgcaccacgagcagccgau

SEQ ID NO: 987777 - RNA, 13 nt, Mycobacterium avium subsp. paratuberculosis
acgcaccucggcc

SEQ ID NO: 987778 - RNA, 22 nt, Mycobacterium avium subsp. paratuberculosis
acgcaccucggccggguccugg

SEQ ID NO: 987779 - RNA, 18 nt, Mycobacterium avium subsp. paratuberculosis
acgcaaucgcccaguccc

SEQ ID NO: 987780 - RNA, 16 nt, Mycobacterium avium subsp. paratuberculosis
acgcagcggugcagcc

SEQ ID NO: 987781 - RNA, 17 nt, Mycobacterium avium subsp. paratuberculosis
acgcagcggugcagccc

SEQ ID NO: 987782 - RNA, 19 nt, Mycobacterium avium subsp. paratuberculosis
acgcagcggugcagccccg

SEQ ID NO: 987783 - RNA, 13 nt, Mycobacterium avium subsp. paratuberculosis
acgaggccgggcu

SEQ ID NO: 987784 - RNA, 14 nt, Mycobacterium avium subsp. paratuberculosis
acgaggccgggcug

SEQ ID NO: 987785 - RNA, 17 nt, Mycobacterium avium subsp. paratuberculosis
acgaggcacggcccgcu

SEQ ID NO: 987786 - RNA, 16 nt, Mycobacterium avium subsp. paratuberculosis
acgaggcccggacggc

SEQ ID NO: 987787 - RNA, 12 nt, Mycobacterium avium subsp. paratuberculosis
acgaagucgacc

SEQ ID NO: 987788 - RNA, 20 nt, Mycobacterium avium subsp. paratuberculosis
acgaacgcgccgccgagcaa

SEQ ID NO: 987789 - RNA, 17 nt, Mycobacterium avium subsp. paratuberculosis
acgaacgcggccgccag

SEQ ID NO: 987790 - RNA, 14 nt, Mycobacterium avium subsp. paratuberculosis
acgaaccuggcugc

SEQ ID NO: 987791 - RNA, 21 nt, Mycobacterium avium subsp. paratuberculosis
acgaacggcgcgaaccgggcc

SEQ ID NO: 987792 - RNA, 23 nt, Mycobacterium avium subsp. paratuberculosis
acgaacggcgcgaaccgggccag

SEQ ID NO: 987793 - RNA, 20 nt, Mycobacterium avium subsp. paratuberculosis
acgaacuccgagccggugga

SEQ ID NO: 987794 - RNA, 20 nt, Mycobacterium avium subsp. paratuberculosis
acgaagaaggacgccucgcg

SEQ ID NO: 987795 - RNA, 20 nt, Mycobacterium avium subsp. paratuberculosis
acgaagacguacggaugccc

SEQ ID NO: 987796 - RNA, 12 nt, Mycobacterium avium subsp. paratuberculosis
acgaagcagcuc

SEQ ID NO: 987797 - RNA, 18 nt, Mycobacterium avium subsp. paratuberculosis
acgaagaugcgcccgguc

SEQ ID NO: 987798 - RNA, 22 nt, Mycobacterium avium subsp. paratuberculosis
acgaagauggcgugccacagca

SEQ ID NO: 987799 - RNA, 19 nt, Mycobacterium avium subsp. paratuberculosis
acgaagcuggcgaacagca

SEQ ID NO: 987800 - RNA, 19 nt, Mycobacterium avium subsp. paratuberculosis
acgcaaaagccccgcgaca

SEQ ID NO: 987801 - RNA, 21 nt, Mycobacterium avium subsp. paratuberculosis
acgcaaaagccccgcgacacg

SEQ ID NO: 987802 - RNA, 20 nt, Mycobacterium avium subsp. paratuberculosis
acgauucuugaccaccuugg

SEQ ID NO: 987803 - RNA, 21 nt, Mycobacterium avium subsp. paratuberculosis
acgaugcgcugugcgggugag

SEQ ID NO: 987804 - RNA, 15 nt, Mycobacterium avium subsp. paratuberculosis
acgaugcgcaccccc

SEQ ID NO: 987805 - RNA, 21 nt, Mycobacterium avium subsp. paratuberculosis
acgaugcccuuggccagcagu

SEQ ID NO: 987806 - RNA, 15 nt, Mycobacterium avium subsp. paratuberculosis
acgaugagggugaug

SEQ ID NO: 987807 - RNA, 23 nt, Mycobacterium avium subsp. paratuberculosis
acgaugaugucggccggcaguuc

SEQ ID NO: 987808 - RNA, 15 nt, Mycobacterium avium subsp. paratuberculosis
acgauggcguccacc

SEQ ID NO: 987809 - RNA, 15 nt, Mycobacterium avium subsp. paratuberculosis
acgauggcgcggcgc

SEQ ID NO: 987810 - RNA, 19 nt, Mycobacterium avium subsp. paratuberculosis
acgauggcccggaccgccg

SEQ ID NO: 987811 - RNA, 18 nt, Mycobacterium avium subsp. paratuberculosis
acgauggcgaccgcgcag

SEQ ID NO: 987812 - RNA, 20 nt, Mycobacterium avium subsp. paratuberculosis
acgaugucgaaacccaggaa

SEQ ID NO: 987813 - RNA, 23 nt, Mycobacterium avium subsp. paratuberculosis
acgaugggucaggucaaccaggc

SEQ ID NO: 987814 - RNA, 19 nt, Mycobacterium avium subsp. paratuberculosis
acgaugguguaguccugcu

SEQ ID NO: 987815 - RNA, 23 nt, Mycobacterium avium subsp. paratuberculosis
acgaucgucgacgucaacaccgu

SEQ ID NO: 987816 - RNA, 20 nt, Mycobacterium avium subsp. paratuberculosis
acgaucggcuugaugaacgc

SEQ ID NO: 987817 - RNA, 19 nt, Mycobacterium avium subsp. paratuberculosis
acgaucuugccgaacaggc

SEQ ID NO: 987818 - RNA, 12 nt, Mycobacterium avium subsp. paratuberculosis
accuggucgguc

SEQ ID NO: 987819 - RNA, 22 nt, Mycobacterium avium subsp. paratuberculosis
acgaaccgguugcgggccgaac

SEQ ID NO: 987820 - RNA, 14 nt, Mycobacterium avium subsp. paratuberculosis
acgaaccaggcgcc

SEQ ID NO: 987821 - RNA, 18 nt, Mycobacterium avium subsp. paratuberculosis
accuugccguuggucugu

SEQ ID NO: 987822 - RNA, 16 nt, Mycobacterium avium subsp. paratuberculosis
accuugcgcagcagca

SEQ ID NO: 987823 - RNA, 20 nt, Mycobacterium avium subsp. paratuberculosis
accuugcgcgggucgccggg

SEQ ID NO: 987824 - RNA, 23 nt, Mycobacterium avium subsp. paratuberculosis
accuugcagcccgcguccagcag

SEQ ID NO: 987825 - RNA, 19 nt, Mycobacterium avium subsp. paratuberculosis
accggucguagaccucuug

SEQ ID NO: 987826 - RNA, 14 nt, Mycobacterium avium subsp. paratuberculosis
accggugcaccgcg

SEQ ID NO: 987827 - RNA, 15 nt, Mycobacterium avium subsp. paratuberculosis
accggggaucaccuc

SEQ ID NO: 987828 - RNA, 14 nt, Mycobacterium avium subsp. paratuberculosis
accgggcuccagcg

SEQ ID NO: 987829 - RNA, 12 nt, Mycobacterium avium subsp. paratuberculosis
accgggcggccg

SEQ ID NO: 987830 - RNA, 20 nt, Mycobacterium avium subsp. paratuberculosis
accgggcggugaccacgccg

SEQ ID NO: 987831 - RNA, 18 nt, Mycobacterium avium subsp. paratuberculosis
accggggugccgcccaac

SEQ ID NO: 987832 - RNA, 17 nt, Mycobacterium avium subsp. paratuberculosis
accgggucagcaccacc

SEQ ID NO: 987833 - RNA, 23 nt, Mycobacterium avium subsp. paratuberculosis
accgggucagcaccaccaacagc

SEQ ID NO: 987834 - RNA, 19 nt, Mycobacterium avium subsp. paratuberculosis
accgggugaacgaggccgc

SEQ ID NO: 987835 - RNA, 16 nt, Mycobacterium avium subsp. paratuberculosis
accuagggcccacgcu

SEQ ID NO: 987836 - RNA, 12 nt, Mycobacterium avium subsp. paratuberculosis
accuccuccggu

SEQ ID NO: 987837 - RNA, 20 nt, Mycobacterium avium subsp. paratuberculosis
accuccgugccgauggccac

SEQ ID NO: 987838 - RNA, 20 nt, Mycobacterium avium subsp. paratuberculosis
accucgaagcagccuucuug

SEQ ID NO: 987839 - RNA, 14 nt, Mycobacterium avium subsp. paratuberculosis
accucgaagggcgc

SEQ ID NO: 987840 - RNA, 21 nt, Mycobacterium avium subsp. paratuberculosis
accucgaagggcgccagccgu

SEQ ID NO: 987841 - RNA, 14 nt, Mycobacterium avium subsp. paratuberculosis
accuccugcacccg

SEQ ID NO: 987842 - RNA, 14 nt, Mycobacterium avium subsp. paratuberculosis
accucacacugaaa

SEQ ID NO: 987843 - RNA, 16 nt, Mycobacterium avium subsp. paratuberculosis
accucaccacgugcca

SEQ ID NO: 987844 - RNA, 16 nt, Mycobacterium avium subsp. paratuberculosis
accugaccgaacagcu

SEQ ID NO: 987845 - RNA, 17 nt, Mycobacterium avium subsp. paratuberculosis
accucggugucgagguc

SEQ ID NO: 987846 - RNA, 15 nt, Mycobacterium avium subsp. paratuberculosis
accucgucgcccggc

SEQ ID NO: 987847 - RNA, 20 nt, Mycobacterium avium subsp. paratuberculosis
accucggcgaucugcuccuc

SEQ ID NO: 987848 - RNA, 22 nt, Mycobacterium avium subsp. paratuberculosis
accucgggccgggcgggcaccc

SEQ ID NO: 987849 - RNA, 20 nt, Mycobacterium avium subsp. paratuberculosis
accucgucgucgaugaacag

SEQ ID NO: 987850 - RNA, 13 nt, Mycobacterium avium subsp. paratuberculosis
accucgugcacau

SEQ ID NO: 987851 - RNA, 22 nt, Mycobacterium avium subsp. paratuberculosis
accucgcgcaccggcugcccca

SEQ ID NO: 987852 - RNA, 18 nt, Mycobacterium avium subsp. paratuberculosis
accucgcgcggggcggcc

SEQ ID NO: 987853 - RNA, 17 nt, Mycobacterium avium subsp. paratuberculosis
accucggccaccaccuc

SEQ ID NO: 987854 - RNA, 18 nt, Mycobacterium avium subsp. paratuberculosis
accucggccaccaccucg

SEQ ID NO: 987855 - RNA, 20 nt, Mycobacterium avium subsp. paratuberculosis
accucgcuggaaaccucuug

SEQ ID NO: 987856 - RNA, 18 nt, Mycobacterium avium subsp. paratuberculosis
accucggcggcaccgccc

SEQ ID NO: 987857 - RNA, 19 nt, Mycobacterium avium subsp. paratuberculosis
accucggcggcaccgcccg

SEQ ID NO: 987858 - RNA, 13 nt, Mycobacterium avium subsp. paratuberculosis
accucggcggcca

SEQ ID NO: 987859 - RNA, 18 nt, Mycobacterium avium subsp. paratuberculosis
accucggcggcggcgcgc

SEQ ID NO: 987860 - RNA, 14 nt, Mycobacterium avium subsp. paratuberculosis
accucggccggguc

SEQ ID NO: 987861 - RNA, 14 nt, Mycobacterium avium subsp. paratuberculosis
accucggccaggua

SEQ ID NO: 987862 - RNA, 21 nt, Mycobacterium avium subsp. paratuberculosis
accucgaggccgaggucgguc

SEQ ID NO: 987863 - RNA, 17 nt, Mycobacterium avium subsp. paratuberculosis
accucgauggguucuuc

SEQ ID NO: 987864 - RNA, 22 nt, Mycobacterium avium subsp. paratuberculosis
accucgccgacgucccagcaca

SEQ ID NO: 987865 - RNA, 17 nt, Mycobacterium avium subsp. paratuberculosis
accucgccgagcagccg

SEQ ID NO: 987866 - RNA, 12 nt, Mycobacterium avium subsp. paratuberculosis
accucgcccggc

SEQ ID NO: 987867 - RNA, 14 nt, Mycobacterium avium subsp. paratuberculosis
accucgcccggcuc

SEQ ID NO: 987868 - RNA, 15 nt, Mycobacterium avium subsp. paratuberculosis
accucgccgcccucg

SEQ ID NO: 987869 - RNA, 21 nt, Mycobacterium avium subsp. paratuberculosis
accucgccguccuugacgaac

SEQ ID NO: 987870 - RNA, 15 nt, Mycobacterium avium subsp. paratuberculosis
accucgccuccagca

SEQ ID NO: 987871 - RNA, 21 nt, Mycobacterium avium subsp. paratuberculosis
accucgccuccagcagggaca

SEQ ID NO: 987872 - RNA, 12 nt, Mycobacterium avium subsp. paratuberculosis
accgcgcgcacc

SEQ ID NO: 987873 - RNA, 12 nt, Mycobacterium avium subsp. paratuberculosis
accgcgcggaga

SEQ ID NO: 987874 - RNA, 19 nt, Mycobacterium avium subsp. paratuberculosis
accgcgccgggcaccacca

SEQ ID NO: 987875 - RNA, 22 nt, Mycobacterium avium subsp. paratuberculosis
accgcgccgggcaccaccaccg

SEQ ID NO: 987876 - RNA, 20 nt, Mycobacterium avium subsp. paratuberculosis
accgcgccgucgucgagcac

SEQ ID NO: 987877 - RNA, 21 nt, Mycobacterium avium subsp. paratuberculosis
accgcgcgcaggccccggcgc

SEQ ID NO: 987878 - RNA, 15 nt, Mycobacterium avium subsp. paratuberculosis
accgcgccccggcgc

SEQ ID NO: 987879 - RNA, 16 nt, Mycobacterium avium subsp. paratuberculosis
accgcgcaaccgggcc

SEQ ID NO: 987880 - RNA, 14 nt, Mycobacterium avium subsp. paratuberculosis
accgcgagcgggug

SEQ ID NO: 987881 - RNA, 19 nt, Mycobacterium avium subsp. paratuberculosis
accgcgcgggccagcgccu

SEQ ID NO: 987882 - RNA, 20 nt, Mycobacterium avium subsp. paratuberculosis
accgcgcggugcaccaggac

SEQ ID NO: 987883 - RNA, 20 nt, Mycobacterium avium subsp. paratuberculosis
accgcggccaccaccgccac

SEQ ID NO: 987884 - RNA, 24 nt, Mycobacterium avium subsp. paratuberculosis
accgcggcgacgucgugcacgccg

SEQ ID NO: 987885 - RNA, 23 nt, Mycobacterium avium subsp. paratuberculosis
accgcugagguagucccgcgccu

SEQ ID NO: 987886 - RNA, 20 nt, Mycobacterium avium subsp. paratuberculosis
accgcgggaauggccgcgcc

SEQ ID NO: 987887 - RNA, 16 nt, Mycobacterium avium subsp. paratuberculosis
accgcgggcagcagcu

SEQ ID NO: 987888 - RNA, 13 nt, Mycobacterium avium subsp. paratuberculosis
accgcggcggcca

SEQ ID NO: 987889 - RNA, 19 nt, Mycobacterium avium subsp. paratuberculosis
accgcggcggcggcccguc

SEQ ID NO: 987890 - RNA, 18 nt, Mycobacterium avium subsp. paratuberculosis
accgcggcguagcgccag

SEQ ID NO: 987891 - RNA, 20 nt, Mycobacterium avium subsp. paratuberculosis
accgcggcuccggccgcgcc

SEQ ID NO: 987892 - RNA, 14 nt, Mycobacterium avium subsp. paratuberculosis
accgccgcgcucgc

SEQ ID NO: 987893 - RNA, 18 nt, Mycobacterium avium subsp. paratuberculosis
accgccgcgcucgcacca

SEQ ID NO: 987894 - RNA, 23 nt, Mycobacterium avium subsp. paratuberculosis
accgccgcggcgaccacgaacac

SEQ ID NO: 987895 - RNA, 18 nt, Mycobacterium avium subsp. paratuberculosis
accgccgcggcgcccggc

SEQ ID NO: 987896 - RNA, 22 nt, Mycobacterium avium subsp. paratuberculosis
accgccgcggcgguggccugcc

SEQ ID NO: 987897 - RNA, 23 nt, Mycobacterium avium subsp. paratuberculosis
accgccgcggcgguggccugccc

SEQ ID NO: 987898 - RNA, 21 nt, Mycobacterium avium subsp. paratuberculosis
accgccgcguacagccagccc

SEQ ID NO: 987899 - RNA, 19 nt, Mycobacterium avium subsp. paratuberculosis
accgccgggcgggccgcag

SEQ ID NO: 987900 - RNA, 14 nt, Mycobacterium avium subsp. paratuberculosis
accgccggcccagg

SEQ ID NO: 987901 - RNA, 20 nt, Mycobacterium avium subsp. paratuberculosis
accgccguuccgaugaagaa

SEQ ID NO: 987902 - RNA, 21 nt, Mycobacterium avium subsp. paratuberculosis
accgccggugcgcagcuugcu

SEQ ID NO: 987903 - RNA, 23 nt, Mycobacterium avium subsp. paratuberculosis
accgccguggcagggccagcagc

SEQ ID NO: 987904 - RNA, 21 nt, Mycobacterium avium subsp. paratuberculosis
accgccucgccagccccaccg

SEQ ID NO: 987905 - RNA, 18 nt, Mycobacterium avium subsp. paratuberculosis
accgcgacacgucgacac

SEQ ID NO: 987906 - RNA, 23 nt, Mycobacterium avium subsp. paratuberculosis
accgcgacacgucgacacgccgg

SEQ ID NO: 987907 - RNA, 20 nt, Mycobacterium avium subsp. paratuberculosis
accgcgaccacgccgcgguc

SEQ ID NO: 987908 - RNA, 18 nt, Mycobacterium avium subsp. paratuberculosis
accgcgaccaugcccggc

SEQ ID NO: 987909 - RNA, 14 nt, Mycobacterium avium subsp. paratuberculosis
accgcgaacagcac

SEQ ID NO: 987910 - RNA, 14 nt, Mycobacterium avium subsp. paratuberculosis
accgcgaccgccuc

SEQ ID NO: 987911 - RNA, 20 nt, Mycobacterium avium subsp. paratuberculosis
accgcgaccgucaucuuggu

SEQ ID NO: 987912 - RNA, 15 nt, Mycobacterium avium subsp. paratuberculosis
accgcgacggcgccc

SEQ ID NO: 987913 - RNA, 20 nt, Mycobacterium avium subsp. paratuberculosis
accgcgacggcgcccgcccc

SEQ ID NO: 987914 - RNA, 21 nt, Mycobacterium avium subsp. paratuberculosis
accgcgacggcgcccgccccg

SEQ ID NO: 987915 - RNA, 23 nt, Mycobacterium avium subsp. paratuberculosis
accgcgacggcgcccgccccgac

SEQ ID NO: 987916 - RNA, 21 nt, Mycobacterium avium subsp. paratuberculosis
accgccucggccaccuugcgc

SEQ ID NO: 987917 - RNA, 12 nt, Mycobacterium avium subsp. paratuberculosis
accgccugcuug

SEQ ID NO: 987918 - RNA, 14 nt, Mycobacterium avium subsp. paratuberculosis
accgcgaaaacagc

SEQ ID NO: 987919 - RNA, 15 nt, Mycobacterium avium subsp. paratuberculosis
accgccuugcccggc

SEQ ID NO: 987920 - RNA, 20 nt, Mycobacterium avium subsp. paratuberculosis
accgcgaaagugcaacuggc

SEQ ID NO: 987921 - RNA, 18 nt, Mycobacterium avium subsp. paratuberculosis
accgccuuccgccacgcc

SEQ ID NO: 987922 - RNA, 21 nt, Mycobacterium avium subsp. paratuberculosis
accgccuucgacggccggccc

SEQ ID NO: 987923 - RNA, 22 nt, Mycobacterium avium subsp. paratuberculosis
accgggccgaugaacaugcccu

SEQ ID NO: 987924 - RNA, 12 nt, Mycobacterium avium subsp. paratuberculosis
accgggccgcac

SEQ ID NO: 987925 - RNA, 22 nt, Mycobacterium avium subsp. paratuberculosis
accgggccgcacccccuccaca

SEQ ID NO: 987926 - RNA, 20 nt, Mycobacterium avium subsp. paratuberculosis
accggcuggccgagcggcug

SEQ ID NO: 987927 - RNA, 23 nt, Mycobacterium avium subsp. paratuberculosis
accggcgucacauacgccucacc

SEQ ID NO: 987928 - RNA, 16 nt, Mycobacterium avium subsp. paratuberculosis
accggcgucauggugc

SEQ ID NO: 987929 - RNA, 21 nt, Mycobacterium avium subsp. paratuberculosis
accggcgucgacagccggucg

SEQ ID NO: 987930 - RNA, 18 nt, Mycobacterium avium subsp. paratuberculosis
accggcucgccggcgcgc

SEQ ID NO: 987931 - RNA, 20 nt, Mycobacterium avium subsp. paratuberculosis
accggcugcccgacccgcac

SEQ ID NO: 987932 - RNA, 19 nt, Mycobacterium avium subsp. paratuberculosis
accggcugcucgcgcugcc

SEQ ID NO: 987933 - RNA, 20 nt, Mycobacterium avium subsp. paratuberculosis
accggccggcgcgcacggca

SEQ ID NO: 987934 - RNA, 18 nt, Mycobacterium avium subsp. paratuberculosis
accggcgauuucggccgu

SEQ ID NO: 987935 - RNA, 14 nt, Mycobacterium avium subsp. paratuberculosis
accggccgcccggc

SEQ ID NO: 987936 - RNA, 17 nt, Mycobacterium avium subsp. paratuberculosis
accggcgaggugcgcca

SEQ ID NO: 987937 - RNA, 18 nt, Mycobacterium avium subsp. paratuberculosis
accggcggucaccaaggc

SEQ ID NO: 987938 - RNA, 17 nt, Mycobacterium avium subsp. paratuberculosis
accggcgcgcccgaguc

SEQ ID NO: 987939 - RNA, 23 nt, Mycobacterium avium subsp. paratuberculosis
accggcgcgaccacauaccggga

SEQ ID NO: 987940 - RNA, 22 nt, Mycobacterium avium subsp. paratuberculosis
accggcgcgcagcaucucuuga

SEQ ID NO: 987941 - RNA, 19 nt, Mycobacterium avium subsp. paratuberculosis
accggcaaggugccguccg

SEQ ID NO: 987942 - RNA, 23 nt, Mycobacterium avium subsp. paratuberculosis
accggccagcacgaacaccacgu

SEQ ID NO: 987943 - RNA, 21 nt, Mycobacterium avium subsp. paratuberculosis
accggccagcagcagcccgcc

SEQ ID NO: 987944 - RNA, 15 nt, Mycobacterium avium subsp. paratuberculosis
accggccagcagccg

SEQ ID NO: 987945 - RNA, 19 nt, Mycobacterium avium subsp. paratuberculosis
accggccagggccgccgca

SEQ ID NO: 987946 - RNA, 22 nt, Mycobacterium avium subsp. paratuberculosis
accggccgcgcguagaucaucu

SEQ ID NO: 987947 - RNA, 16 nt, Mycobacterium avium subsp. paratuberculosis
accggcccagcagcgu

SEQ ID NO: 987948 - RNA, 20 nt, Mycobacterium avium subsp. paratuberculosis
accggcccgaacaccuccuc

SEQ ID NO: 987949 - RNA, 13 nt, Mycobacterium avium subsp. paratuberculosis
accgcugcaaccg

SEQ ID NO: 987950 - RNA, 15 nt, Mycobacterium avium subsp. paratuberculosis
accgcugcugcugcc

SEQ ID NO: 987951 - RNA, 14 nt, Mycobacterium avium subsp. paratuberculosis
accggagccuuggu

SEQ ID NO: 987952 - RNA, 13 nt, Mycobacterium avium subsp. paratuberculosis
accggaggccgcg

SEQ ID NO: 987953 - RNA, 16 nt, Mycobacterium avium subsp. paratuberculosis
accggaugcaccggca

SEQ ID NO: 987954 - RNA, 16 nt, Mycobacterium avium subsp. paratuberculosis
accggaugcucaccgg

SEQ ID NO: 987955 - RNA, 16 nt, Mycobacterium avium subsp. paratuberculosis
accggauggcgcccgg

SEQ ID NO: 987956 - RNA, 16 nt, Mycobacterium avium subsp. paratuberculosis
acccgucggggugcgc

SEQ ID NO: 987957 - RNA, 23 nt, Mycobacterium avium subsp. paratuberculosis
acccgucggugaaguuggcggcg

SEQ ID NO: 987958 - RNA, 20 nt, Mycobacterium avium subsp. paratuberculosis
accgagauggccaccaucag

SEQ ID NO: 987959 - RNA, 19 nt, Mycobacterium avium subsp. paratuberculosis
accgcaauccuguuccccg

SEQ ID NO: 987960 - RNA, 18 nt, Mycobacterium avium subsp. paratuberculosis
accgagcggcgcugcagc

SEQ ID NO: 987961 - RNA, 22 nt, Mycobacterium avium subsp. paratuberculosis
accgagcggcgcugcagcagcc

SEQ ID NO: 987962 - RNA, 18 nt, Mycobacterium avium subsp. paratuberculosis
accgagccggugccgccc

SEQ ID NO: 987963 - RNA, 13 nt, Mycobacterium avium subsp. paratuberculosis
accgagcccguuc

SEQ ID NO: 987964 - RNA, 21 nt, Mycobacterium avium subsp. paratuberculosis
accgagcccguucagugacca

SEQ ID NO: 987965 - RNA, 15 nt, Mycobacterium avium subsp. paratuberculosis
accgaucaccggcag

SEQ ID NO: 987966 - RNA, 16 nt, Mycobacterium avium subsp. paratuberculosis
accgaucaccggcagc

SEQ ID NO: 987967 - RNA, 19 nt, Mycobacterium avium subsp. paratuberculosis
accgaucagcaugccgguc

SEQ ID NO: 987968 - RNA, 12 nt, Mycobacterium avium subsp. paratuberculosis
accgaucaggau

SEQ ID NO: 987969 - RNA, 17 nt, Mycobacterium avium subsp. paratuberculosis
accgcauucggccgcca

SEQ ID NO: 987970 - RNA, 13 nt, Mycobacterium avium subsp. paratuberculosis
accgccaccaccc

SEQ ID NO: 987971 - RNA, 22 nt, Mycobacterium avium subsp. paratuberculosis
accgcacgaucagggugucgaa

SEQ ID NO: 987972 - RNA, 16 nt, Mycobacterium avium subsp. paratuberculosis
accgcacggcccauca

SEQ ID NO: 987973 - RNA, 19 nt, Mycobacterium avium subsp. paratuberculosis
accgcagccuucuucgccg

SEQ ID NO: 987974 - RNA, 22 nt, Mycobacterium avium subsp. paratuberculosis
accgcagcggcuugaccggcuc

SEQ ID NO: 987975 - RNA, 22 nt, Mycobacterium avium subsp. paratuberculosis
accgccgagggcccgggcaggc

SEQ ID NO: 987976 - RNA, 23 nt, Mycobacterium avium subsp. paratuberculosis
accgccgagggcccgggcaggca

SEQ ID NO: 987977 - RNA, 16 nt, Mycobacterium avium subsp. paratuberculosis
accgccgcacccagcg

SEQ ID NO: 987978 - RNA, 16 nt, Mycobacterium avium subsp. paratuberculosis
accgcccgcccggcac

SEQ ID NO: 987979 - RNA, 11 nt, Mycobacterium avium subsp. paratuberculosis
accgcccggcg

SEQ ID NO: 987980 - RNA, 19 nt, Mycobacterium avium subsp. paratuberculosis
accgcccggggcgcggacc

SEQ ID NO: 987981 - RNA, 22 nt, Mycobacterium avium subsp. paratuberculosis
accgcccggggcgcggaccgca

SEQ ID NO: 987982 - RNA, 15 nt, Mycobacterium avium subsp. paratuberculosis
accgcccgggugaug

SEQ ID NO: 987983 - RNA, 22 nt, Mycobacterium avium subsp. paratuberculosis
accgcccgggugauggucuccc

SEQ ID NO: 987984 - RNA, 15 nt, Mycobacterium avium subsp. paratuberculosis
accgccaccgcccgc

SEQ ID NO: 987985 - RNA, 23 nt, Mycobacterium avium subsp. paratuberculosis
accgccagacugaugcccucgcc

SEQ ID NO: 987986 - RNA, 17 nt, Mycobacterium avium subsp. paratuberculosis
accgccaccggcccggc

SEQ ID NO: 987987 - RNA, 20 nt, Mycobacterium avium subsp. paratuberculosis
accgccagcagcagccgcgc

SEQ ID NO: 987988 - RNA, 21 nt, Mycobacterium avium subsp. paratuberculosis
accgccagcagcagccgcgcc

SEQ ID NO: 987989 - RNA, 15 nt, Mycobacterium avium subsp. paratuberculosis
accgccagcaccgcc

SEQ ID NO: 987990 - RNA, 23 nt, Mycobacterium avium subsp. paratuberculosis
accgccagcauccgcuggugcgc

SEQ ID NO: 987991 - RNA, 18 nt, Mycobacterium avium subsp. paratuberculosis
accgccagcgccggcagc

SEQ ID NO: 987992 - RNA, 13 nt, Mycobacterium avium subsp. paratuberculosis
acccgcggccgcu

SEQ ID NO: 987993 - RNA, 18 nt, Mycobacterium avium subsp. paratuberculosis
acccgcucaggucggccg

SEQ ID NO: 987994 - RNA, 15 nt, Mycobacterium avium subsp. paratuberculosis
acccgcuccccgauc

SEQ ID NO: 987995 - RNA, 21 nt, Mycobacterium avium subsp. paratuberculosis
acccgcgauggcacacagcgu

SEQ ID NO: 987996 - RNA, 13 nt, Mycobacterium avium subsp. paratuberculosis
acccgcggcgccg

SEQ ID NO: 987997 - RNA, 19 nt, Mycobacterium avium subsp. paratuberculosis
acccgcgcggcgucggccu

SEQ ID NO: 987998 - RNA, 18 nt, Mycobacterium avium subsp. paratuberculosis
acccgcgcggugcccgga

SEQ ID NO: 987999 - RNA, 20 nt, Mycobacterium avium subsp. paratuberculosis
acccgcgcggugcccggaac

SEQ ID NO: 988000 - RNA, 20 nt, Mycobacterium avium subsp. paratuberculosis
acccgaaaagcaccaggcuc

SEQ ID NO: 988001 - RNA, 22 nt, Mycobacterium avium subsp. paratuberculosis
acccgaaaagguauucgcgcaa

SEQ ID NO: 988002 - RNA, 22 nt, Mycobacterium avium subsp. paratuberculosis
accccuggcggguacagccgca

SEQ ID NO: 988003 - RNA, 23 nt, Mycobacterium avium subsp. paratuberculosis
accccuggcggguacagccgcag

SEQ ID NO: 988004 - RNA, 15 nt, Mycobacterium avium subsp. paratuberculosis
acccgcuucgcccgg

SEQ ID NO: 988005 - RNA, 20 nt, Mycobacterium avium subsp. paratuberculosis
acccgcuggucaaugcccuc

SEQ ID NO: 988006 - RNA, 13 nt, Mycobacterium avium subsp. paratuberculosis
acccggaggcggc

SEQ ID NO: 988007 - RNA, 13 nt, Mycobacterium avium subsp. paratuberculosis
acccggaacccgc

SEQ ID NO: 988008 - RNA, 19 nt, Mycobacterium avium subsp. paratuberculosis
acccgggcggccugcugca

SEQ ID NO: 988009 - RNA, 17 nt, Mycobacterium avium subsp. paratuberculosis
acccgggcuagacgcgc

SEQ ID NO: 988010 - RNA, 15 nt, Mycobacterium avium subsp. paratuberculosis
acccgggccagcagg

SEQ ID NO: 988011 - RNA, 14 nt, Mycobacterium avium subsp. paratuberculosis
acccgggccugcgg

SEQ ID NO: 988012 - RNA, 21 nt, Mycobacterium avium subsp. paratuberculosis
acccgggcgacaugcccgcgg

SEQ ID NO: 988013 - RNA, 12 nt, Mycobacterium avium subsp. paratuberculosis
acccggcuucgc

SEQ ID NO: 988014 - RNA, 19 nt, Mycobacterium avium subsp. paratuberculosis
acccggcuucgcugcgccg

SEQ ID NO: 988015 - RNA, 20 nt, Mycobacterium avium subsp. paratuberculosis
acccggcggcaccgcggcuc

SEQ ID NO: 988016 - RNA, 18 nt, Mycobacterium avium subsp. paratuberculosis
acccggcccuauggcauc

SEQ ID NO: 988017 - RNA, 21 nt, Mycobacterium avium subsp. paratuberculosis
acccggcccuauggcaucgcc

SEQ ID NO: 988018 - RNA, 15 nt, Mycobacterium avium subsp. paratuberculosis
acccggccgcacacc

SEQ ID NO: 988019 - RNA, 20 nt, Mycobacterium avium subsp. paratuberculosis
acccggccgcacaccaccac

SEQ ID NO: 988020 - RNA, 21 nt, Mycobacterium avium subsp. paratuberculosis
acccauccccaggauggccgc

SEQ ID NO: 988021 - RNA, 19 nt, Mycobacterium avium subsp. paratuberculosis
acccaucaggaugcccggg

SEQ ID NO: 988022 - RNA, 18 nt, Mycobacterium avium subsp. paratuberculosis
accccacaccguccgacc

SEQ ID NO: 988023 - RNA, 18 nt, Mycobacterium avium subsp. paratuberculosis
accccacagcgcgcccca

SEQ ID NO: 988024 - RNA, 23 nt, Mycobacterium avium subsp. paratuberculosis
acccaccagccgagaucgacccg

SEQ ID NO: 988025 - RNA, 20 nt, Mycobacterium avium subsp. paratuberculosis
accccggccagggugccgac

SEQ ID NO: 988026 - RNA, 14 nt, Mycobacterium avium subsp. paratuberculosis
accccggccaccag

SEQ ID NO: 988027 - RNA, 14 nt, Mycobacterium avium subsp. paratuberculosis
accccggaccgcgg

SEQ ID NO: 988028 - RNA, 13 nt, Mycobacterium avium subsp. paratuberculosis
accccgccguucc

SEQ ID NO: 988029 - RNA, 10 nt, Mycobacterium avium subsp. paratuberculosis
accccgcucg

SEQ ID NO: 988030 - RNA, 20 nt, Mycobacterium avium subsp. paratuberculosis
accccgcucggccagcgcgc

SEQ ID NO: 988031 - RNA, 15 nt, Mycobacterium avium subsp. paratuberculosis
accccgcgccacgcc

SEQ ID NO: 988032 - RNA, 15 nt, Mycobacterium avium subsp. paratuberculosis
accccgccgcagccc

SEQ ID NO: 988033 - RNA, 21 nt, Mycobacterium avium subsp. paratuberculosis
accccgcagaacaccagcgca

SEQ ID NO: 988034 - RNA, 15 nt, Mycobacterium avium subsp. paratuberculosis
accccgcccagcgca

SEQ ID NO: 988035 - RNA, 12 nt, Mycobacterium avium subsp. paratuberculosis
accccagcuccg

SEQ ID NO: 988036 - RNA, 16 nt, Mycobacterium avium subsp. paratuberculosis
acccaaaaaggcgcgg

SEQ ID NO: 988037 - RNA, 20 nt, Mycobacterium avium subsp. paratuberculosis
acccacacguugagcccgga

SEQ ID NO: 988038 - RNA, 21 nt, Mycobacterium avium subsp. paratuberculosis
acccacacguugagcccggac

SEQ ID NO: 988039 - RNA, 21 nt, Mycobacterium avium subsp. paratuberculosis
accaugucggcgucgccgagc

SEQ ID NO: 988040 - RNA, 14 nt, Mycobacterium avium subsp. paratuberculosis
accaugcccggcgc

SEQ ID NO: 988041 - RNA, 20 nt, Mycobacterium avium subsp. paratuberculosis
accaucccgccgccgaacag

SEQ ID NO: 988042 - RNA, 17 nt, Mycobacterium avium subsp. paratuberculosis
accaucaggccggccug

SEQ ID NO: 988043 - RNA, 14 nt, Mycobacterium avium subsp. paratuberculosis
accaucagcggcuc

SEQ ID NO: 988044 - RNA, 15 nt, Mycobacterium avium subsp. paratuberculosis
agcagucggccugca

SEQ ID NO: 988045 - RNA, 23 nt, Mycobacterium avium subsp. paratuberculosis
agcaguccccgccuucgaugccc

SEQ ID NO: 988046 - RNA, 14 nt, Mycobacterium avium subsp. paratuberculosis
agcagugccaccac

SEQ ID NO: 988047 - RNA, 17 nt, Mycobacterium avium subsp. paratuberculosis
agcagugccaccaccac

SEQ ID NO: 988048 - RNA, 19 nt, Mycobacterium avium subsp. paratuberculosis
agcagugccaccaccacgg

SEQ ID NO: 988049 - RNA, 21 nt, Mycobacterium avium subsp. paratuberculosis
agcaucggguugccggcggcc

SEQ ID NO: 988050 - RNA, 20 nt, Mycobacterium avium subsp. paratuberculosis
agcagggacauccgugaggg

SEQ ID NO: 988051 - RNA, 14 nt, Mycobacterium avium subsp. paratuberculosis
agcaggcccucggc

SEQ ID NO: 988052 - RNA, 12 nt, Mycobacterium avium subsp. paratuberculosis
agcaggcgcgca

SEQ ID NO: 988053 - RNA, 15 nt, Mycobacterium avium subsp. paratuberculosis
agcaggcgcgcagca

SEQ ID NO: 988054 - RNA, 16 nt, Mycobacterium avium subsp. paratuberculosis
agcaggcgcgccgagc

SEQ ID NO: 988055 - RNA, 15 nt, Mycobacterium avium subsp. paratuberculosis
agcagcuagcccaga

SEQ ID NO: 988056 - RNA, 16 nt, Mycobacterium avium subsp. paratuberculosis
agcagcgucugcgcca

SEQ ID NO: 988057 - RNA, 20 nt, Mycobacterium avium subsp. paratuberculosis
agcagcgucugcgccagcug

SEQ ID NO: 988058 - RNA, 16 nt, Mycobacterium avium subsp. paratuberculosis
agcagcgucugcgccc

SEQ ID NO: 988059 - RNA, 22 nt, Mycobacterium avium subsp. paratuberculosis
agcagcgucugcgccccggcgu

SEQ ID NO: 988060 - RNA, 22 nt, Mycobacterium avium subsp. paratuberculosis
agcagcuccggucggcgcucgc

SEQ ID NO: 988061 - RNA, 16 nt, Mycobacterium avium subsp. paratuberculosis
agcagcucggucacca

SEQ ID NO: 988062 - RNA, 21 nt, Mycobacterium avium subsp. paratuberculosis
agcagcucgcguagcgaggug

SEQ ID NO: 988063 - RNA, 23 nt, Mycobacterium avium subsp. paratuberculosis
agcagcucgcguagcgaggugug

SEQ ID NO: 988064 - RNA, 19 nt, Mycobacterium avium subsp. paratuberculosis
agcaggacgcgcccggcga

SEQ ID NO: 988065 - RNA, 21 nt, Mycobacterium avium subsp. paratuberculosis
agcagcggcagccacggcagc

SEQ ID NO: 988066 - RNA, 22 nt, Mycobacterium avium subsp. paratuberculosis
agcagcggcagccacggcagcu

SEQ ID NO: 988067 - RNA, 12 nt, Mycobacterium avium subsp. paratuberculosis
agcagcggggug

SEQ ID NO: 988068 - RNA, 15 nt, Mycobacterium avium subsp. paratuberculosis
agcagcgggaucagc

SEQ ID NO: 988069 - RNA, 21 nt, Mycobacterium avium subsp. paratuberculosis
agcagcggcuuggucaccagc

SEQ ID NO: 988070 - RNA, 22 nt, Mycobacterium avium subsp. paratuberculosis
agcagcggcuuggucaccagcu

SEQ ID NO: 988071 - RNA, 12 nt, Mycobacterium avium subsp. paratuberculosis
agcagcccggcc

SEQ ID NO: 988072 - RNA, 22 nt, Mycobacterium avium subsp. paratuberculosis
agcagcgccacaauggauccga

SEQ ID NO: 988073 - RNA, 19 nt, Mycobacterium avium subsp. paratuberculosis
agcagcgccagcaccgccu

SEQ ID NO: 988074 - RNA, 15 nt, Mycobacterium avium subsp. paratuberculosis
agcagcgccagcagc

SEQ ID NO: 988075 - RNA, 17 nt, Mycobacterium avium subsp. paratuberculosis
agcagccccugcaccac

SEQ ID NO: 988076 - RNA, 16 nt, Mycobacterium avium subsp. paratuberculosis
agcagcccgaccaccu

SEQ ID NO: 988077 - RNA, 23 nt, Mycobacterium avium subsp. paratuberculosis
agcagcgccuugccgacgacguc

SEQ ID NO: 988078 - RNA, 13 nt, Mycobacterium avium subsp. paratuberculosis
agcagcgcggcuu

SEQ ID NO: 988079 - RNA, 14 nt, Mycobacterium avium subsp. paratuberculosis
agcagcccgccgau

SEQ ID NO: 988080 - RNA, 13 nt, Mycobacterium avium subsp. paratuberculosis
agcagcgcccggg

SEQ ID NO: 988081 - RNA, 14 nt, Mycobacterium avium subsp. paratuberculosis
agcagaugccgccc

SEQ ID NO: 988082 - RNA, 13 nt, Mycobacterium avium subsp. paratuberculosis
agcagaucggguc

SEQ ID NO: 988083 - RNA, 18 nt, Mycobacterium avium subsp. paratuberculosis
agcagauagcccagccag

SEQ ID NO: 988084 - RNA, 15 nt, Mycobacterium avium subsp. paratuberculosis
agcacugagcggcag

SEQ ID NO: 988085 - RNA, 18 nt, Mycobacterium avium subsp. paratuberculosis
agcagcaucggucccagu

SEQ ID NO: 988086 - RNA, 16 nt, Mycobacterium avium subsp. paratuberculosis
agcagcaugccgagca

SEQ ID NO: 988087 - RNA, 17 nt, Mycobacterium avium subsp. paratuberculosis
agcagcaugccgagcac

SEQ ID NO: 988088 - RNA, 23 nt, Mycobacterium avium subsp. paratuberculosis
agcagccagguccgggcacucga

SEQ ID NO: 988089 - RNA, 16 nt, Mycobacterium avium subsp. paratuberculosis
agcagccagcccagcc

SEQ ID NO: 988090 - RNA, 16 nt, Mycobacterium avium subsp. paratuberculosis
agcagccaggacagcg

SEQ ID NO: 988091 - RNA, 17 nt, Mycobacterium avium subsp. paratuberculosis
agcagcagaaccagcac

SEQ ID NO: 988092 - RNA, 16 nt, Mycobacterium avium subsp. paratuberculosis
agcagcacgcccagcc

SEQ ID NO: 988093 - RNA, 21 nt, Mycobacterium avium subsp. paratuberculosis
agcagcacgcccagcccgcgg

SEQ ID NO: 988094 - RNA, 17 nt, Mycobacterium avium subsp. paratuberculosis
agcagcaccuggaucca

SEQ ID NO: 988095 - RNA, 16 nt, Mycobacterium avium subsp. paratuberculosis
agcagcagcccgaaca

SEQ ID NO: 988096 - RNA, 13 nt, Mycobacterium avium subsp. paratuberculosis
agcagcagccgcg

SEQ ID NO: 988097 - RNA, 16 nt, Mycobacterium avium subsp. paratuberculosis
agcagcagcgccgcca

SEQ ID NO: 988098 - RNA, 14 nt, Mycobacterium avium subsp. paratuberculosis
agcagcaccagaug

SEQ ID NO: 988099 - RNA, 14 nt, Mycobacterium avium subsp. paratuberculosis
agcagcaccagcgc

SEQ ID NO: 988100 - RNA, 15 nt, Mycobacterium avium subsp. paratuberculosis
agcagcaccgcgacc

SEQ ID NO: 988101 - RNA, 17 nt, Mycobacterium avium subsp. paratuberculosis
agcagcaccgcgaccca

SEQ ID NO: 988102 - RNA, 19 nt, Mycobacterium avium subsp. paratuberculosis
agcagcacccgggugauca

SEQ ID NO: 988103 - RNA, 17 nt, Mycobacterium avium subsp. paratuberculosis
agcagcaacggcggcgg

SEQ ID NO: 988104 - RNA, 14 nt, Mycobacterium avium subsp. paratuberculosis
agcacgaacaccac

SEQ ID NO: 988105 - RNA, 15 nt, Mycobacterium avium subsp. paratuberculosis
agcacgaaggccgcc

SEQ ID NO: 988106 - RNA, 19 nt, Mycobacterium avium subsp. paratuberculosis
agcacgaaggccgccgggu

SEQ ID NO: 988107 - RNA, 16 nt, Mycobacterium avium subsp. paratuberculosis
agcaccuggauccagu

SEQ ID NO: 988108 - RNA, 18 nt, Mycobacterium avium subsp. paratuberculosis
agcaccuggauccaguuc

SEQ ID NO: 988109 - RNA, 19 nt, Mycobacterium avium subsp. paratuberculosis
agcaccuggauccaguuca

SEQ ID NO: 988110 - RNA, 19 nt, Mycobacterium avium subsp. paratuberculosis
agcacggugaucagcagca

SEQ ID NO: 988111 - RNA, 13 nt, Mycobacterium avium subsp. paratuberculosis
agcacgacauccu

SEQ ID NO: 988112 - RNA, 14 nt, Mycobacterium avium subsp. paratuberculosis
agcacgaccgccag

SEQ ID NO: 988113 - RNA, 22 nt, Mycobacterium avium subsp. paratuberculosis
agcacguugugggcgggcgcgu

SEQ ID NO: 988114 - RNA, 19 nt, Mycobacterium avium subsp. paratuberculosis
agcacgugcgcgggaacga

SEQ ID NO: 988115 - RNA, 19 nt, Mycobacterium avium subsp. paratuberculosis
agcacgucguaggccaucc

SEQ ID NO: 988116 - RNA, 17 nt, Mycobacterium avium subsp. paratuberculosis
agcacgucgggguggcc

SEQ ID NO: 988117 - RNA, 14 nt, Mycobacterium avium subsp. paratuberculosis
agcacgugaugcag

SEQ ID NO: 988118 - RNA, 17 nt, Mycobacterium avium subsp. paratuberculosis
agcacgugaugcagcug

SEQ ID NO: 988119 - RNA, 18 nt, Mycobacterium avium subsp. paratuberculosis
agcacuccccgugugugg

SEQ ID NO: 988120 - RNA, 18 nt, Mycobacterium avium subsp. paratuberculosis
agcaacgacccggccacc

SEQ ID NO: 988121 - RNA, 12 nt, Mycobacterium avium subsp. paratuberculosis
agcaaccgguuc

SEQ ID NO: 988122 - RNA, 21 nt, Mycobacterium avium subsp. paratuberculosis
agcaccggaucgaccaacucc

SEQ ID NO: 988123 - RNA, 19 nt, Mycobacterium avium subsp. paratuberculosis
agcaaccgcaccuugcgcc

SEQ ID NO: 988124 - RNA, 22 nt, Mycobacterium avium subsp. paratuberculosis
agcaaccggaauggcagcagcc

SEQ ID NO: 988125 - RNA, 16 nt, Mycobacterium avium subsp. paratuberculosis
agcaccgggcccagcu

SEQ ID NO: 988126 - RNA, 17 nt, Mycobacterium avium subsp. paratuberculosis
agcaccgggcccagcuc

SEQ ID NO: 988127 - RNA, 22 nt, Mycobacterium avium subsp. paratuberculosis
agcaccgggcugucgggcaggc

SEQ ID NO: 988128 - RNA, 14 nt, Mycobacterium avium subsp. paratuberculosis
agcaccgucaccgc

SEQ ID NO: 988129 - RNA, 22 nt, Mycobacterium avium subsp. paratuberculosis
agcaccgugcugauccacgccc

SEQ ID NO: 988130 - RNA, 18 nt, Mycobacterium avium subsp. paratuberculosis
agcaccgggaacagccag

SEQ ID NO: 988131 - RNA, 20 nt, Mycobacterium avium subsp. paratuberculosis
agcaccgggaacagccaggc

SEQ ID NO: 988132 - RNA, 15 nt, Mycobacterium avium subsp. paratuberculosis
agcaccggcgccccg

SEQ ID NO: 988133 - RNA, 20 nt, Mycobacterium avium subsp. paratuberculosis
agcaccggcuggccgagcgg

SEQ ID NO: 988134 - RNA, 15 nt, Mycobacterium avium subsp. paratuberculosis
agcaccggcuggucg

SEQ ID NO: 988135 - RNA, 22 nt, Mycobacterium avium subsp. paratuberculosis
agcaccggcuggugcagcagcu

SEQ ID NO: 988136 - RNA, 18 nt, Mycobacterium avium subsp. paratuberculosis
agcaccggcagccgcagc

SEQ ID NO: 988137 - RNA, 15 nt, Mycobacterium avium subsp. paratuberculosis
agcaccggcaccgcc

SEQ ID NO: 988138 - RNA, 21 nt, Mycobacterium avium subsp. paratuberculosis
agcaccggcaugugccacagg

SEQ ID NO: 988139 - RNA, 21 nt, Mycobacterium avium subsp. paratuberculosis
agcaccguugugacccgcucg

SEQ ID NO: 988140 - RNA, 16 nt, Mycobacterium avium subsp. paratuberculosis
agccauuucagcagcg

SEQ ID NO: 988141 - RNA, 19 nt, Mycobacterium avium subsp. paratuberculosis
agcccaagugcccgcgggu

SEQ ID NO: 988142 - RNA, 19 nt, Mycobacterium avium subsp. paratuberculosis
agccauggcggcccgcgcc

SEQ ID NO: 988143 - RNA, 12 nt, Mycobacterium avium subsp. paratuberculosis
agccaucugcug

SEQ ID NO: 988144 - RNA, 17 nt, Mycobacterium avium subsp. paratuberculosis
agccaucugcugacuuu

SEQ ID NO: 988145 - RNA, 21 nt, Mycobacterium avium subsp. paratuberculosis
agccaucagaacgcccgcaac

SEQ ID NO: 988146 - RNA, 16 nt, Mycobacterium avium subsp. paratuberculosis
agccaguucgccagca

SEQ ID NO: 988147 - RNA, 17 nt, Mycobacterium avium subsp. paratuberculosis
agcaugcguccggucug

SEQ ID NO: 988148 - RNA, 22 nt, Mycobacterium avium subsp. paratuberculosis
agcauggcgaucaccccggcga

SEQ ID NO: 988149 - RNA, 13 nt, Mycobacterium avium subsp. paratuberculosis
agcauggcccaca

SEQ ID NO: 988150 - RNA, 17 nt, Mycobacterium avium subsp. paratuberculosis
agccagcgggccgagcg

SEQ ID NO: 988151 - RNA, 20 nt, Mycobacterium avium subsp. paratuberculosis
agccagaucgaggccagcgc

SEQ ID NO: 988152 - RNA, 19 nt, Mycobacterium avium subsp. paratuberculosis
agccacgccaacugguccu

SEQ ID NO: 988153 - RNA, 16 nt, Mycobacterium avium subsp. paratuberculosis
agccacggcagcugca

SEQ ID NO: 988154 - RNA, 20 nt, Mycobacterium avium subsp. paratuberculosis
agccccaggaggcacuggcg

SEQ ID NO: 988155 - RNA, 16 nt, Mycobacterium avium subsp. paratuberculosis
agccccaccggccacu

SEQ ID NO: 988156 - RNA, 15 nt, Mycobacterium avium subsp. paratuberculosis
agcccccaccgcgcc

SEQ ID NO: 988157 - RNA, 13 nt, Mycobacterium avium subsp. paratuberculosis
agcccccaccuga

SEQ ID NO: 988158 - RNA, 13 nt, Mycobacterium avium subsp. paratuberculosis
agcccccagcucu

SEQ ID NO: 988159 - RNA, 13 nt, Mycobacterium avium subsp. paratuberculosis
agcccccgcagcc

SEQ ID NO: 988160 - RNA, 14 nt, Mycobacterium avium subsp. paratuberculosis
agcccccgcagccc

SEQ ID NO: 988161 - RNA, 23 nt, Mycobacterium avium subsp. paratuberculosis
agcccgacaucugccgggcggcg

SEQ ID NO: 988162 - RNA, 17 nt, Mycobacterium avium subsp. paratuberculosis
agcccgaccuucugcug

SEQ ID NO: 988163 - RNA, 15 nt, Mycobacterium avium subsp. paratuberculosis
agccccucggggcug

SEQ ID NO: 988164 - RNA, 17 nt, Mycobacterium avium subsp. paratuberculosis
agccccucguccaggug

SEQ ID NO: 988165 - RNA, 23 nt, Mycobacterium avium subsp. paratuberculosis
agccccucguccaggugcacccg

SEQ ID NO: 988166 - RNA, 13 nt, Mycobacterium avium subsp. paratuberculosis
agcccaccgccgu

SEQ ID NO: 988167 - RNA, 19 nt, Mycobacterium avium subsp. paratuberculosis
agcccaccgcgcccagccc

SEQ ID NO: 988168 - RNA, 20 nt, Mycobacterium avium subsp. paratuberculosis
agcccaccgcgcccagcccc

SEQ ID NO: 988169 - RNA, 16 nt, Mycobacterium avium subsp. paratuberculosis
agcccaccucgagcac

SEQ ID NO: 988170 - RNA, 17 nt, Mycobacterium avium subsp. paratuberculosis
agcccaggcccagcagc

SEQ ID NO: 988171 - RNA, 19 nt, Mycobacterium avium subsp. paratuberculosis
agcccaggcccagcagcac

SEQ ID NO: 988172 - RNA, 12 nt, Mycobacterium avium subsp. paratuberculosis
agcccagcugcg

SEQ ID NO: 988173 - RNA, 13 nt, Mycobacterium avium subsp. paratuberculosis
agcccagccagcc

SEQ ID NO: 988174 - RNA, 13 nt, Mycobacterium avium subsp. paratuberculosis
agcccaucagcac

SEQ ID NO: 988175 - RNA, 16 nt, Mycobacterium avium subsp. paratuberculosis
agcccaucagcacgcc

SEQ ID NO: 988176 - RNA, 16 nt, Mycobacterium avium subsp. paratuberculosis
agcccaugccgaugcc

SEQ ID NO: 988177 - RNA, 20 nt, Mycobacterium avium subsp. paratuberculosis
agcccauguaguucgacugg

SEQ ID NO: 988178 - RNA, 23 nt, Mycobacterium avium subsp. paratuberculosis
agccgacgccguuucggauccau

SEQ ID NO: 988179 - RNA, 18 nt, Mycobacterium avium subsp. paratuberculosis
agccgaccuugacccagg

SEQ ID NO: 988180 - RNA, 14 nt, Mycobacterium avium subsp. paratuberculosis
agccgagcaccggg

SEQ ID NO: 988181 - RNA, 17 nt, Mycobacterium avium subsp. paratuberculosis
agccgagcaccgggcug

SEQ ID NO: 988182 - RNA, 17 nt, Mycobacterium avium subsp. paratuberculosis
agccgagccgacccggg

SEQ ID NO: 988183 - RNA, 14 nt, Mycobacterium avium subsp. paratuberculosis
agccgagccgggcc

SEQ ID NO: 988184 - RNA, 16 nt, Mycobacterium avium subsp. paratuberculosis
agccgaggucgccggu

SEQ ID NO: 988185 - RNA, 13 nt, Mycobacterium avium subsp. paratuberculosis
agccgcagcagcc

SEQ ID NO: 988186 - RNA, 13 nt, Mycobacterium avium subsp. paratuberculosis
agccgcagcaggu

SEQ ID NO: 988187 - RNA, 18 nt, Mycobacterium avium subsp. paratuberculosis
agcccuucaccucggccu

SEQ ID NO: 988188 - RNA, 20 nt, Mycobacterium avium subsp. paratuberculosis
agcccugcgccagcagcagc

SEQ ID NO: 988189 - RNA, 14 nt, Mycobacterium avium subsp. paratuberculosis
agcccguggccagc

SEQ ID NO: 988190 - RNA, 14 nt, Mycobacterium avium subsp. paratuberculosis
agccgaccgccccg

SEQ ID NO: 988191 - RNA, 22 nt, Mycobacterium avium subsp. paratuberculosis
agcccuuggacucccccaccac

SEQ ID NO: 988192 - RNA, 18 nt, Mycobacterium avium subsp. paratuberculosis
agcccgaugccgccgagg

SEQ ID NO: 988193 - RNA, 22 nt, Mycobacterium avium subsp. paratuberculosis
agcccgaaacgucgcagcccgg

SEQ ID NO: 988194 - RNA, 15 nt, Mycobacterium avium subsp. paratuberculosis
agcccgaucgccagc

SEQ ID NO: 988195 - RNA, 18 nt, Mycobacterium avium subsp. paratuberculosis
agcccgacggcagcaccg

SEQ ID NO: 988196 - RNA, 15 nt, Mycobacterium avium subsp. paratuberculosis
agcccgagcaccagc

SEQ ID NO: 988197 - RNA, 16 nt, Mycobacterium avium subsp. paratuberculosis
agcccgagcaccagcg

SEQ ID NO: 988198 - RNA, 15 nt, Mycobacterium avium subsp. paratuberculosis
agcccgauucagccg

SEQ ID NO: 988199 - RNA, 19 nt, Mycobacterium avium subsp. paratuberculosis
agcccgccgaccaccuugc

SEQ ID NO: 988200 - RNA, 20 nt, Mycobacterium avium subsp. paratuberculosis
agcccgucggccuccagccg

SEQ ID NO: 988201 - RNA, 20 nt, Mycobacterium avium subsp. paratuberculosis
agcccgucgacgggccacca

SEQ ID NO: 988202 - RNA, 13 nt, Mycobacterium avium subsp. paratuberculosis
agcccgucggccu

SEQ ID NO: 988203 - RNA, 16 nt, Mycobacterium avium subsp. paratuberculosis
agcccgggcugcagca

SEQ ID NO: 988204 - RNA, 20 nt, Mycobacterium avium subsp. paratuberculosis
agcccggguauuucgagcac

SEQ ID NO: 988205 - RNA, 21 nt, Mycobacterium avium subsp. paratuberculosis
agcccggguauuucgagcaca

SEQ ID NO: 988206 - RNA, 21 nt, Mycobacterium avium subsp. paratuberculosis
agcccggguugagcaggucag

SEQ ID NO: 988207 - RNA, 18 nt, Mycobacterium avium subsp. paratuberculosis
agcccggcuggcaggucg

SEQ ID NO: 988208 - RNA, 22 nt, Mycobacterium avium subsp. paratuberculosis
agcccggcguccugcagcagcc

SEQ ID NO: 988209 - RNA, 22 nt, Mycobacterium avium subsp. paratuberculosis
agcccggcgacgaagcagcucg

SEQ ID NO: 988210 - RNA, 23 nt, Mycobacterium avium subsp. paratuberculosis
agcccgccgcggcgaccggggcg

SEQ ID NO: 988211 - RNA, 12 nt, Mycobacterium avium subsp. paratuberculosis
agcccgcgccca

SEQ ID NO: 988212 - RNA, 21 nt, Mycobacterium avium subsp. paratuberculosis
agcccgcgcgagcgcagcgcc

SEQ ID NO: 988213 - RNA, 12 nt, Mycobacterium avium subsp. paratuberculosis
agcuaucagcuc

SEQ ID NO: 988214 - RNA, 21 nt, Mycobacterium avium subsp. paratuberculosis
agcucaugguguuccaccagc

SEQ ID NO: 988215 - RNA, 21 nt, Mycobacterium avium subsp. paratuberculosis
agcucagcugcugcgcggcgg

SEQ ID NO: 988216 - RNA, 15 nt, Mycobacterium avium subsp. paratuberculosis
agcucaggccggccu

SEQ ID NO: 988217 - RNA, 16 nt, Mycobacterium avium subsp. paratuberculosis
agcguucgucgccggu

SEQ ID NO: 988218 - RNA, 19 nt, Mycobacterium avium subsp. paratuberculosis
agcguuccggcggccggcg

SEQ ID NO: 988219 - RNA, 14 nt, Mycobacterium avium subsp. paratuberculosis
agcgugucgggguc

SEQ ID NO: 988220 - RNA, 18 nt, Mycobacterium avium subsp. paratuberculosis
agcguucuccacccgccc

SEQ ID NO: 988221 - RNA, 14 nt, Mycobacterium avium subsp. paratuberculosis
agcguugccggccg

SEQ ID NO: 988222 - RNA, 16 nt, Mycobacterium avium subsp. paratuberculosis
agcguugcgccagcag

SEQ ID NO: 988223 - RNA, 16 nt, Mycobacterium avium subsp. paratuberculosis
agcuaggcggccgggc

SEQ ID NO: 988224 - RNA, 12 nt, Mycobacterium avium subsp. paratuberculosis
agcuacggacgc

SEQ ID NO: 988225 - RNA, 18 nt, Mycobacterium avium subsp. paratuberculosis
agcgggagccggccaggu

SEQ ID NO: 988226 - RNA, 17 nt, Mycobacterium avium subsp. paratuberculosis
agcgggcacgccgccgc

SEQ ID NO: 988227 - RNA, 16 nt, Mycobacterium avium subsp. paratuberculosis
agcgggccaaagagcu

SEQ ID NO: 988228 - RNA, 21 nt, Mycobacterium avium subsp. paratuberculosis
agcgggcccgccuuccgggaa

SEQ ID NO: 988229 - RNA, 16 nt, Mycobacterium avium subsp. paratuberculosis
agcgggccgacagcac

SEQ ID NO: 988230 - RNA, 21 nt, Mycobacterium avium subsp. paratuberculosis
agcgggccgaccuggcggccg

SEQ ID NO: 988231 - RNA, 23 nt, Mycobacterium avium subsp. paratuberculosis
agcgggccggcgucgucgagcac

SEQ ID NO: 988232 - RNA, 14 nt, Mycobacterium avium subsp. paratuberculosis
agcgggcggccagc

SEQ ID NO: 988233 - RNA, 12 nt, Mycobacterium avium subsp. paratuberculosis
agcgggcggccc

SEQ ID NO: 988234 - RNA, 12 nt, Mycobacterium avium subsp. paratuberculosis
agcgggcgcgca

SEQ ID NO: 988235 - RNA, 22 nt, Mycobacterium avium subsp. paratuberculosis
agcgggcggcgaacaccagcac

SEQ ID NO: 988236 - RNA, 12 nt, Mycobacterium avium subsp. paratuberculosis
agcgggcggcgg

SEQ ID NO: 988237 - RNA, 17 nt, Mycobacterium avium subsp. paratuberculosis
agcgggcugugccggcg

SEQ ID NO: 988238 - RNA, 23 nt, Mycobacterium avium subsp. paratuberculosis
agcgggcugugccggcgggucag

SEQ ID NO: 988239 - RNA, 17 nt, Mycobacterium avium subsp. paratuberculosis
agcggggaggcccagcc

SEQ ID NO: 988240 - RNA, 23 nt, Mycobacterium avium subsp. paratuberculosis
agcggcucgcgggugcggcgcug

SEQ ID NO: 988241 - RNA, 13 nt, Mycobacterium avium subsp. paratuberculosis
agcggcucggccu

SEQ ID NO: 988242 - RNA, 21 nt, Mycobacterium avium subsp. paratuberculosis
agcggcucggccuucggggug

SEQ ID NO: 988243 - RNA, 14 nt, Mycobacterium avium subsp. paratuberculosis
agcggcugcagcag

SEQ ID NO: 988244 - RNA, 20 nt, Mycobacterium avium subsp. paratuberculosis
agcgggaagccgaggucgcc

SEQ ID NO: 988245 - RNA, 13 nt, Mycobacterium avium subsp. paratuberculosis
agcggcuuggccg

SEQ ID NO: 988246 - RNA, 20 nt, Mycobacterium avium subsp. paratuberculosis
agcggcuuggucaccagcuc

SEQ ID NO: 988247 - RNA, 18 nt, Mycobacterium avium subsp. paratuberculosis
agcggcuguagcacccgg

SEQ ID NO: 988248 - RNA, 22 nt, Mycobacterium avium subsp. paratuberculosis
agcggcuguagcacccggccgg

SEQ ID NO: 988249 - RNA, 15 nt, Mycobacterium avium subsp. paratuberculosis
agcggcugcuggucg

SEQ ID NO: 988250 - RNA, 23 nt, Mycobacterium avium subsp. paratuberculosis
agcggcggccauucaucgcgcac

SEQ ID NO: 988251 - RNA, 19 nt, Mycobacterium avium subsp. paratuberculosis
agcggcgucaggaugguga

SEQ ID NO: 988252 - RNA, 19 nt, Mycobacterium avium subsp. paratuberculosis
agcggcgugaccgggaagu

SEQ ID NO: 988253 - RNA, 21 nt, Mycobacterium avium subsp. paratuberculosis
agcggcguaccgcggcggcgu

SEQ ID NO: 988254 - RNA, 19 nt, Mycobacterium avium subsp. paratuberculosis
agcggcccugcgcggccug

SEQ ID NO: 988255 - RNA, 19 nt, Mycobacterium avium subsp. paratuberculosis
agcggccgacugauccacc

SEQ ID NO: 988256 - RNA, 18 nt, Mycobacterium avium subsp. paratuberculosis
agcggcccgaucaccgcc

SEQ ID NO: 988257 - RNA, 22 nt, Mycobacterium avium subsp. paratuberculosis
agcggccgcacgcgaacaccag

SEQ ID NO: 988258 - RNA, 12 nt, Mycobacterium avium subsp. paratuberculosis
agcggcccagcu

SEQ ID NO: 988259 - RNA, 20 nt, Mycobacterium avium subsp. paratuberculosis
agcggccccccgcacaccgg

SEQ ID NO: 988260 - RNA, 20 nt, Mycobacterium avium subsp. paratuberculosis
agcggcccgaaaacgcccgg

SEQ ID NO: 988261 - RNA, 17 nt, Mycobacterium avium subsp. paratuberculosis
agcggcccgaucaccag

SEQ ID NO: 988262 - RNA, 14 nt, Mycobacterium avium subsp. paratuberculosis
agcgcgucgagcac

SEQ ID NO: 988263 - RNA, 14 nt, Mycobacterium avium subsp. paratuberculosis
agcgcguucuccac

SEQ ID NO: 988264 - RNA, 23 nt, Mycobacterium avium subsp. paratuberculosis
agcgcuaaggccgcugcccggcg

SEQ ID NO: 988265 - RNA, 14 nt, Mycobacterium avium subsp. paratuberculosis
agcgucauuccgcc

SEQ ID NO: 988266 - RNA, 18 nt, Mycobacterium avium subsp. paratuberculosis
agcgguuggcccuucgac

SEQ ID NO: 988267 - RNA, 17 nt, Mycobacterium avium subsp. paratuberculosis
agcgguuuggauggccc

SEQ ID NO: 988268 - RNA, 15 nt, Mycobacterium avium subsp. paratuberculosis
agcgugacgcccggc

SEQ ID NO: 988269 - RNA, 23 nt, Mycobacterium avium subsp. paratuberculosis
agcgugacgcccggcgccggcgg

SEQ ID NO: 988270 - RNA, 16 nt, Mycobacterium avium subsp. paratuberculosis
agcgucuugcccagcg

SEQ ID NO: 988271 - RNA, 12 nt, Mycobacterium avium subsp. paratuberculosis
agcgugaagcua

SEQ ID NO: 988272 - RNA, 19 nt, Mycobacterium avium subsp. paratuberculosis
agcgugaacagcgcccggc

SEQ ID NO: 988273 - RNA, 14 nt, Mycobacterium avium subsp. paratuberculosis
agcgucgacugcac

SEQ ID NO: 988274 - RNA, 15 nt, Mycobacterium avium subsp. paratuberculosis
agcgucgacugcacc

SEQ ID NO: 988275 - RNA, 23 nt, Mycobacterium avium subsp. paratuberculosis
agcguccgggcguagugcagcug

SEQ ID NO: 988276 - RNA, 23 nt, Mycobacterium avium subsp. paratuberculosis
agcguuccagguucagcccggcg

SEQ ID NO: 988277 - RNA, 22 nt, Mycobacterium avium subsp. paratuberculosis
agcguguggcgugugggcucgc

SEQ ID NO: 988278 - RNA, 16 nt, Mycobacterium avium subsp. paratuberculosis
agcguggcgcgccccg

SEQ ID NO: 988279 - RNA, 16 nt, Mycobacterium avium subsp. paratuberculosis
agcgugccguccagcu

SEQ ID NO: 988280 - RNA, 20 nt, Mycobacterium avium subsp. paratuberculosis
agcgugccgcgcaccaccuc

SEQ ID NO: 988281 - RNA, 17 nt, Mycobacterium avium subsp. paratuberculosis
agcgugcccgcgcccac

SEQ ID NO: 988282 - RNA, 14 nt, Mycobacterium avium subsp. paratuberculosis
agcgugggggccau

SEQ ID NO: 988283 - RNA, 18 nt, Mycobacterium avium subsp. paratuberculosis
agcgugggcaccggcacc

SEQ ID NO: 988284 - RNA, 15 nt, Mycobacterium avium subsp. paratuberculosis
agcguggucagcguc

SEQ ID NO: 988285 - RNA, 23 nt, Mycobacterium avium subsp. paratuberculosis
agcgugguccagcacgugcccag

SEQ ID NO: 988286 - RNA, 17 nt, Mycobacterium avium subsp. paratuberculosis
agcguggucuccuggcc

SEQ ID NO: 988287 - RNA, 18 nt, Mycobacterium avium subsp. paratuberculosis
agcguggcgucggcgcgc

SEQ ID NO: 988288 - RNA, 22 nt, Mycobacterium avium subsp. paratuberculosis
agcgugggauccgaggguucgg

SEQ ID NO: 988289 - RNA, 13 nt, Mycobacterium avium subsp. paratuberculosis
agcguggccggca

SEQ ID NO: 988290 - RNA, 13 nt, Mycobacterium avium subsp. paratuberculosis
agcguggccagca

SEQ ID NO: 988291 - RNA, 19 nt, Mycobacterium avium subsp. paratuberculosis
agcguggacaccgcaccca

SEQ ID NO: 988292 - RNA, 18 nt, Mycobacterium avium subsp. paratuberculosis
agcgugcugccggacacc

SEQ ID NO: 988293 - RNA, 13 nt, Mycobacterium avium subsp. paratuberculosis
agcgccacuggcu

SEQ ID NO: 988294 - RNA, 16 nt, Mycobacterium avium subsp. paratuberculosis
agcgcaugaugcccag

SEQ ID NO: 988295 - RNA, 21 nt, Mycobacterium avium subsp. paratuberculosis
agcgcaucgccggcgcgcuga

SEQ ID NO: 988296 - RNA, 18 nt, Mycobacterium avium subsp. paratuberculosis
agcgccagcacggccacc

SEQ ID NO: 988297 - RNA, 17 nt, Mycobacterium avium subsp. paratuberculosis
agcgccagcagcggcac

SEQ ID NO: 988298 - RNA, 20 nt, Mycobacterium avium subsp. paratuberculosis
agcgccagcgcggugcccag

SEQ ID NO: 988299 - RNA, 22 nt, Mycobacterium avium subsp. paratuberculosis
agcgccagggucuggcccggug

SEQ ID NO: 988300 - RNA, 17 nt, Mycobacterium avium subsp. paratuberculosis
agcgccagggugccccg

SEQ ID NO: 988301 - RNA, 17 nt, Mycobacterium avium subsp. paratuberculosis
agcgccaggcagaagcu

SEQ ID NO: 988302 - RNA, 15 nt, Mycobacterium avium subsp. paratuberculosis
agcgcacacagcagc

SEQ ID NO: 988303 - RNA, 13 nt, Mycobacterium avium subsp. paratuberculosis
agcgcaucagcuc

SEQ ID NO: 988304 - RNA, 24 nt, Mycobacterium avium subsp. paratuberculosis
agcgauugcggccgccggccagcu

SEQ ID NO: 988305 - RNA, 21 nt, Mycobacterium avium subsp. paratuberculosis
agcgccucggccugcgcccgg

SEQ ID NO: 988306 - RNA, 20 nt, Mycobacterium avium subsp. paratuberculosis
agcgccuucggcgccagccc

SEQ ID NO: 988307 - RNA, 15 nt, Mycobacterium avium subsp. paratuberculosis
agcgccugguccucc

SEQ ID NO: 988308 - RNA, 14 nt, Mycobacterium avium subsp. paratuberculosis
agcgccugcccgga

SEQ ID NO: 988309 - RNA, 17 nt, Mycobacterium avium subsp. paratuberculosis
agcgccgagaccagcca

SEQ ID NO: 988310 - RNA, 18 nt, Mycobacterium avium subsp. paratuberculosis
agcgccgaggccagcacg

SEQ ID NO: 988311 - RNA, 13 nt, Mycobacterium avium subsp. paratuberculosis
agcgccucccgga

SEQ ID NO: 988312 - RNA, 15 nt, Mycobacterium avium subsp. paratuberculosis
agcgccgccaccggc

SEQ ID NO: 988313 - RNA, 14 nt, Mycobacterium avium subsp. paratuberculosis
agcgcgaacagcgc

SEQ ID NO: 988314 - RNA, 14 nt, Mycobacterium avium subsp. paratuberculosis
agcgcgaaaaccag

SEQ ID NO: 988315 - RNA, 16 nt, Mycobacterium avium subsp. paratuberculosis
agcgcgccgagcagcu

SEQ ID NO: 988316 - RNA, 18 nt, Mycobacterium avium subsp. paratuberculosis
agcgcgccgagcagcugg

SEQ ID NO: 988317 - RNA, 21 nt, Mycobacterium avium subsp. paratuberculosis
agcgcgcccaggcugaacacc

SEQ ID NO: 988318 - RNA, 12 nt, Mycobacterium avium subsp. paratuberculosis
agcgcgccccag

SEQ ID NO: 988319 - RNA, 14 nt, Mycobacterium avium subsp. paratuberculosis
agcgcgaccagccc

SEQ ID NO: 988320 - RNA, 16 nt, Mycobacterium avium subsp. paratuberculosis
agcgcgccgccgccgc

SEQ ID NO: 988321 - RNA, 17 nt, Mycobacterium avium subsp. paratuberculosis
agcgcgcgaucgccggu

SEQ ID NO: 988322 - RNA, 17 nt, Mycobacterium avium subsp. paratuberculosis
agcgcgccgggguccuc

SEQ ID NO: 988323 - RNA, 16 nt, Mycobacterium avium subsp. paratuberculosis
agcgcgccggccggca

SEQ ID NO: 988324 - RNA, 16 nt, Mycobacterium avium subsp. paratuberculosis
agcgcgccggccagca

SEQ ID NO: 988325 - RNA, 19 nt, Mycobacterium avium subsp. paratuberculosis
agcgcgccggccagcagca

SEQ ID NO: 988326 - RNA, 21 nt, Mycobacterium avium subsp. paratuberculosis
agcgcgccgagguggcccgcc

SEQ ID NO: 988327 - RNA, 12 nt, Mycobacterium avium subsp. paratuberculosis
agcgcggccacc

SEQ ID NO: 988328 - RNA, 17 nt, Mycobacterium avium subsp. paratuberculosis
agcgcggccaccaccac

SEQ ID NO: 988329 - RNA, 13 nt, Mycobacterium avium subsp. paratuberculosis
agcgcggccaccu

SEQ ID NO: 988330 - RNA, 15 nt, Mycobacterium avium subsp. paratuberculosis
agcgcggccgcccgu

SEQ ID NO: 988331 - RNA, 13 nt, Mycobacterium avium subsp. paratuberculosis
agcgcggccagca

SEQ ID NO: 988332 - RNA, 15 nt, Mycobacterium avium subsp. paratuberculosis
agcgcggccagcacg

SEQ ID NO: 988333 - RNA, 15 nt, Mycobacterium avium subsp. paratuberculosis
agcgcggccggaaga

SEQ ID NO: 988334 - RNA, 14 nt, Mycobacterium avium subsp. paratuberculosis
agcgcgucgagguc

SEQ ID NO: 988335 - RNA, 22 nt, Mycobacterium avium subsp. paratuberculosis
agcgcgucgcacagcgccgcgu

SEQ ID NO: 988336 - RNA, 17 nt, Mycobacterium avium subsp. paratuberculosis
agcgcggcggccaccuc

SEQ ID NO: 988337 - RNA, 16 nt, Mycobacterium avium subsp. paratuberculosis
agcgcggcggccagcu

SEQ ID NO: 988338 - RNA, 16 nt, Mycobacterium avium subsp. paratuberculosis
agcgcggcggccucgg

SEQ ID NO: 988339 - RNA, 13 nt, Mycobacterium avium subsp. paratuberculosis
agcgcggcggcgc

SEQ ID NO: 988340 - RNA, 21 nt, Mycobacterium avium subsp. paratuberculosis
agcgcggcgaucgucaugccu

SEQ ID NO: 988341 - RNA, 23 nt, Mycobacterium avium subsp. paratuberculosis
agcgcggcgaugaccgccugcgg

SEQ ID NO: 988342 - RNA, 21 nt, Mycobacterium avium subsp. paratuberculosis
agcgagaccgcuugcggcuca

SEQ ID NO: 988343 - RNA, 12 nt, Mycobacterium avium subsp. paratuberculosis
agcgagaccucc

SEQ ID NO: 988344 - RNA, 13 nt, Mycobacterium avium subsp. paratuberculosis
agcgacuugacca

SEQ ID NO: 988345 - RNA, 17 nt, Mycobacterium avium subsp. paratuberculosis
agcgacuugaccagcag

SEQ ID NO: 988346 - RNA, 18 nt, Mycobacterium avium subsp. paratuberculosis
agcgacuugaccagcagc

SEQ ID NO: 988347 - RNA, 19 nt, Mycobacterium avium subsp. paratuberculosis
agcgacuugaccagcagcu

SEQ ID NO: 988348 - RNA, 16 nt, Mycobacterium avium subsp. paratuberculosis
agcgacuugccgccgg

SEQ ID NO: 988349 - RNA, 16 nt, Mycobacterium avium subsp. paratuberculosis
agcgagcccagcugcg

SEQ ID NO: 988350 - RNA, 17 nt, Mycobacterium avium subsp. paratuberculosis
agcgagaugaucagccg

SEQ ID NO: 988351 - RNA, 20 nt, Mycobacterium avium subsp. paratuberculosis
agcgacgcggugagcgcgcc

SEQ ID NO: 988352 - RNA, 14 nt, Mycobacterium avium subsp. paratuberculosis
agcgaucggcggcu

SEQ ID NO: 988353 - RNA, 13 nt, Mycobacterium avium subsp. paratuberculosis
agcgaguggguga

SEQ ID NO: 988354 - RNA, 18 nt, Mycobacterium avium subsp. paratuberculosis
agcgagucgaaggcgcgg

SEQ ID NO: 988355 - RNA, 15 nt, Mycobacterium avium subsp. paratuberculosis
agcgaggugugagga

SEQ ID NO: 988356 - RNA, 20 nt, Mycobacterium avium subsp. paratuberculosis
agcgaggugugaggagucgg

SEQ ID NO: 988357 - RNA, 22 nt, Mycobacterium avium subsp. paratuberculosis
agcgagucggcgaaggcgcgca

SEQ ID NO: 988358 - RNA, 18 nt, Mycobacterium avium subsp. paratuberculosis
agcgaggggguggguccg

SEQ ID NO: 988359 - RNA, 20 nt, Mycobacterium avium subsp. paratuberculosis
agcgaggcgauggugcccuc

SEQ ID NO: 988360 - RNA, 16 nt, Mycobacterium avium subsp. paratuberculosis
agccgcaggugcagcu

SEQ ID NO: 988361 - RNA, 15 nt, Mycobacterium avium subsp. paratuberculosis
agccgcauggugcgg

SEQ ID NO: 988362 - RNA, 23 nt, Mycobacterium avium subsp. paratuberculosis
agccuggcacgacgccgccgagg

SEQ ID NO: 988363 - RNA, 18 nt, Mycobacterium avium subsp. paratuberculosis
agcaaacccagcaccaac

SEQ ID NO: 988364 - RNA, 15 nt, Mycobacterium avium subsp. paratuberculosis
agcaacaccagcugg

SEQ ID NO: 988365 - RNA, 15 nt, Mycobacterium avium subsp. paratuberculosis
agcaacaccagggug

SEQ ID NO: 988366 - RNA, 13 nt, Mycobacterium avium subsp. paratuberculosis
agauuuuguuugg

SEQ ID NO: 988367 - RNA, 19 nt, Mycobacterium avium subsp. paratuberculosis
agauuuuguuuggagaguu

SEQ ID NO: 988368 - RNA, 12 nt, Mycobacterium avium subsp. paratuberculosis
agauugguucgg

SEQ ID NO: 988369 - RNA, 21 nt, Mycobacterium avium subsp. paratuberculosis
agauugcggcccuugcggccg

SEQ ID NO: 988370 - RNA, 17 nt, Mycobacterium avium subsp. paratuberculosis
agauuggauuccagauc

SEQ ID NO: 988371 - RNA, 20 nt, Mycobacterium avium subsp. paratuberculosis
agauucgaggucaucgagcc

SEQ ID NO: 988372 - RNA, 16 nt, Mycobacterium avium subsp. paratuberculosis
agauggcaacacguuu

SEQ ID NO: 988373 - RNA, 23 nt, Mycobacterium avium subsp. paratuberculosis
agaugcgccgcggauguggaggc

SEQ ID NO: 988374 - RNA, 18 nt, Mycobacterium avium subsp. paratuberculosis
agaugcgcgucgcggcgc

SEQ ID NO: 988375 - RNA, 16 nt, Mycobacterium avium subsp. paratuberculosis
agaugcccacccgcuc

SEQ ID NO: 988376 - RNA, 14 nt, Mycobacterium avium subsp. paratuberculosis
agaugccagacgaa

SEQ ID NO: 988377 - RNA, 20 nt, Mycobacterium avium subsp. paratuberculosis
agaugccgcucggcgcucca

SEQ ID NO: 988378 - RNA, 23 nt, Mycobacterium avium subsp. paratuberculosis
agaugccgcucggcgcuccagcg

SEQ ID NO: 988379 - RNA, 12 nt, Mycobacterium avium subsp. paratuberculosis
agaugccgggcu

SEQ ID NO: 988380 - RNA, 19 nt, Mycobacterium avium subsp. paratuberculosis
agauggcgugccacagcau

SEQ ID NO: 988381 - RNA, 15 nt, Mycobacterium avium subsp. paratuberculosis
agaugucacccguuu

SEQ ID NO: 988382 - RNA, 22 nt, Mycobacterium avium subsp. paratuberculosis
agauggccaccaucaggccggc

SEQ ID NO: 988383 - RNA, 15 nt, Mycobacterium avium subsp. paratuberculosis
agauggccagcacca

SEQ ID NO: 988384 - RNA, 18 nt, Mycobacterium avium subsp. paratuberculosis
agauggccagcaccaccg

SEQ ID NO: 988385 - RNA, 13 nt, Mycobacterium avium subsp. paratuberculosis
agauggccaggaa

SEQ ID NO: 988386 - RNA, 12 nt, Mycobacterium avium subsp. paratuberculosis
agauggccaggu

SEQ ID NO: 988387 - RNA, 17 nt, Mycobacterium avium subsp. paratuberculosis
agaugaccugaucgagu

SEQ ID NO: 988388 - RNA, 20 nt, Mycobacterium avium subsp. paratuberculosis
agaugagauccuuugcggcc

SEQ ID NO: 988389 - RNA, 13 nt, Mycobacterium avium subsp. paratuberculosis
agauacuccucgg

SEQ ID NO: 988390 - RNA, 21 nt, Mycobacterium avium subsp. paratuberculosis
agaucagggugcucagccgca

SEQ ID NO: 988391 - RNA, 17 nt, Mycobacterium avium subsp. paratuberculosis
agaucaucccggccacc

SEQ ID NO: 988392 - RNA, 20 nt, Mycobacterium avium subsp. paratuberculosis
agaucagcaggcccucggcc

SEQ ID NO: 988393 - RNA, 21 nt, Mycobacterium avium subsp. paratuberculosis
agaucagcaggcccucggcca

SEQ ID NO: 988394 - RNA, 12 nt, Mycobacterium avium subsp. paratuberculosis
agaucagcgcca

SEQ ID NO: 988395 - RNA, 14 nt, Mycobacterium avium subsp. paratuberculosis
agaucagcgccagc

SEQ ID NO: 988396 - RNA, 18 nt, Mycobacterium avium subsp. paratuberculosis
agaucagcgccagcaaca

SEQ ID NO: 988397 - RNA, 22 nt, Mycobacterium avium subsp. paratuberculosis
agaucagcgcguccaaccgcgg

SEQ ID NO: 988398 - RNA, 21 nt, Mycobacterium avium subsp. paratuberculosis
agaucagcaccguccacagcc

SEQ ID NO: 988399 - RNA, 14 nt, Mycobacterium avium subsp. paratuberculosis
agaucaccgcgacg

SEQ ID NO: 988400 - RNA, 13 nt, Mycobacterium avium subsp. paratuberculosis
agaggcgcggcgc

SEQ ID NO: 988401 - RNA, 14 nt, Mycobacterium avium subsp. paratuberculosis
agaggcgcggcgcg

SEQ ID NO: 988402 - RNA, 19 nt, Mycobacterium avium subsp. paratuberculosis
agaggcggcgaccgcgacg

SEQ ID NO: 988403 - RNA, 16 nt, Mycobacterium avium subsp. paratuberculosis
agaggcgggcacuuaa

SEQ ID NO: 988404 - RNA, 15 nt, Mycobacterium avium subsp. paratuberculosis
agaggcuguccagca

SEQ ID NO: 988405 - RNA, 16 nt, Mycobacterium avium subsp. paratuberculosis
agaggcuguccagcag

SEQ ID NO: 988406 - RNA, 15 nt, Mycobacterium avium subsp. paratuberculosis
agagcuucaugcccu

SEQ ID NO: 988407 - RNA, 17 nt, Mycobacterium avium subsp. paratuberculosis
agagcuggugggccauc

SEQ ID NO: 988408 - RNA, 22 nt, Mycobacterium avium subsp. paratuberculosis
agagcugcugaugcggacacca

SEQ ID NO: 988409 - RNA, 15 nt, Mycobacterium avium subsp. paratuberculosis
agagcaccgcgcuca

SEQ ID NO: 988410 - RNA, 17 nt, Mycobacterium avium subsp. paratuberculosis
agagccgguagaucagc

SEQ ID NO: 988411 - RNA, 23 nt, Mycobacterium avium subsp. paratuberculosis
agagcagcgccugcugccaggac

SEQ ID NO: 988412 - RNA, 17 nt, Mycobacterium avium subsp. paratuberculosis
agacguugccgcacacc

SEQ ID NO: 988413 - RNA, 14 nt, Mycobacterium avium subsp. paratuberculosis
agacguaggcggcc

SEQ ID NO: 988414 - RNA, 17 nt, Mycobacterium avium subsp. paratuberculosis
agacguaggcggccagc

SEQ ID NO: 988415 - RNA, 21 nt, Mycobacterium avium subsp. paratuberculosis
agacguaggcggccagcagca

SEQ ID NO: 988416 - RNA, 18 nt, Mycobacterium avium subsp. paratuberculosis
agacguacggaugccccu

SEQ ID NO: 988417 - RNA, 14 nt, Mycobacterium avium subsp. paratuberculosis
agacgguggggcug

SEQ ID NO: 988418 - RNA, 20 nt, Mycobacterium avium subsp. paratuberculosis
agaccgcacaauccggucag

SEQ ID NO: 988419 - RNA, 16 nt, Mycobacterium avium subsp. paratuberculosis
agaccaugucggccag

SEQ ID NO: 988420 - RNA, 20 nt, Mycobacterium avium subsp. paratuberculosis
agaccgccggugcgcagcuu

SEQ ID NO: 988421 - RNA, 19 nt, Mycobacterium avium subsp. paratuberculosis
agaccgcgaucagccccag

SEQ ID NO: 988422 - RNA, 19 nt, Mycobacterium avium subsp. paratuberculosis
agaccgcggcggucgccac

SEQ ID NO: 988423 - RNA, 12 nt, Mycobacterium avium subsp. paratuberculosis
agaccgcgguca

SEQ ID NO: 988424 - RNA, 21 nt, Mycobacterium avium subsp. paratuberculosis
agaccucuugggacuggaugg

SEQ ID NO: 988425 - RNA, 15 nt, Mycobacterium avium subsp. paratuberculosis
agacacccucgcgca

SEQ ID NO: 988426 - RNA, 19 nt, Mycobacterium avium subsp. paratuberculosis
agacagcguggucgcgcag

SEQ ID NO: 988427 - RNA, 21 nt, Mycobacterium avium subsp. paratuberculosis
agaaccgcucgauggcgccga

SEQ ID NO: 988428 - RNA, 22 nt, Mycobacterium avium subsp. paratuberculosis
agaacagguaggacaccgaacc

SEQ ID NO: 988429 - RNA, 23 nt, Mycobacterium avium subsp. paratuberculosis
agaacaauguuuuucugcucuuc

SEQ ID NO: 988430 - RNA, 20 nt, Mycobacterium avium subsp. paratuberculosis
agaacacguuucggcccucc

SEQ ID NO: 988431 - RNA, 20 nt, Mycobacterium avium subsp. paratuberculosis
agaacaccccgaccgacgcg

SEQ ID NO: 988432 - RNA, 16 nt, Mycobacterium avium subsp. paratuberculosis
agaaccggggccagca

SEQ ID NO: 988433 - RNA, 18 nt, Mycobacterium avium subsp. paratuberculosis
agaaccggggccagcacg

SEQ ID NO: 988434 - RNA, 19 nt, Mycobacterium avium subsp. paratuberculosis
agaaccgcaacaccagcac

SEQ ID NO: 988435 - RNA, 12 nt, Mycobacterium avium subsp. paratuberculosis
agaacucgggau

SEQ ID NO: 988436 - RNA, 17 nt, Mycobacterium avium subsp. paratuberculosis
agaacucgaucugcagc

SEQ ID NO: 988437 - RNA, 15 nt, Mycobacterium avium subsp. paratuberculosis
agaacucgucgccac

SEQ ID NO: 988438 - RNA, 14 nt, Mycobacterium avium subsp. paratuberculosis
agaacugggccgcc

SEQ ID NO: 988439 - RNA, 16 nt, Mycobacterium avium subsp. paratuberculosis
agaacuucaucuggaa

SEQ ID NO: 988440 - RNA, 22 nt, Mycobacterium avium subsp. paratuberculosis
agaacuucaucuggaacauggc

SEQ ID NO: 988441 - RNA, 23 nt, Mycobacterium avium subsp. paratuberculosis
agaacuucgccagcgggccgacc

SEQ ID NO: 988442 - RNA, 20 nt, Mycobacterium avium subsp. paratuberculosis
agaagauguugcggcggccg

SEQ ID NO: 988443 - RNA, 14 nt, Mycobacterium avium subsp. paratuberculosis
agaagcuaacgcca

SEQ ID NO: 988444 - RNA, 19 nt, Mycobacterium avium subsp. paratuberculosis
acuugaugcugcccggcgc

SEQ ID NO: 988445 - RNA, 15 nt, Mycobacterium avium subsp. paratuberculosis
aggaaccuggucggg

SEQ ID NO: 988446 - RNA, 22 nt, Mycobacterium avium subsp. paratuberculosis
aggaaccgggucagcaccacca

SEQ ID NO: 988447 - RNA, 20 nt, Mycobacterium avium subsp. paratuberculosis
aggaacuggucgaacagcgc

SEQ ID NO: 988448 - RNA, 17 nt, Mycobacterium avium subsp. paratuberculosis
aggaagacguaggcggc

SEQ ID NO: 988449 - RNA, 22 nt, Mycobacterium avium subsp. paratuberculosis
aggaagacguaggcggccagca

SEQ ID NO: 988450 - RNA, 17 nt, Mycobacterium avium subsp. paratuberculosis
aggaagccaugccgggg

SEQ ID NO: 988451 - RNA, 16 nt, Mycobacterium avium subsp. paratuberculosis
aggaacagacacagca

SEQ ID NO: 988452 - RNA, 18 nt, Mycobacterium avium subsp. paratuberculosis
aggagacgucggccgggu

SEQ ID NO: 988453 - RNA, 19 nt, Mycobacterium avium subsp. paratuberculosis
aggaccacccacucccagc

SEQ ID NO: 988454 - RNA, 12 nt, Mycobacterium avium subsp. paratuberculosis
aggacagcacca

SEQ ID NO: 988455 - RNA, 14 nt, Mycobacterium avium subsp. paratuberculosis
aggacagcaccaca

SEQ ID NO: 988456 - RNA, 12 nt, Mycobacterium avium subsp. paratuberculosis
aggacagcagcc

SEQ ID NO: 988457 - RNA, 19 nt, Mycobacterium avium subsp. paratuberculosis
aggacaggaacgggccggc

SEQ ID NO: 988458 - RNA, 19 nt, Mycobacterium avium subsp. paratuberculosis
aggaauuugcggcccggcu

SEQ ID NO: 988459 - RNA, 17 nt, Mycobacterium avium subsp. paratuberculosis
aggaaguccggcgcgcc

SEQ ID NO: 988460 - RNA, 22 nt, Mycobacterium avium subsp. paratuberculosis
aggaagccggcgacgaccgcac

SEQ ID NO: 988461 - RNA, 13 nt, Mycobacterium avium subsp. paratuberculosis
agcuugcagcugu

SEQ ID NO: 988462 - RNA, 21 nt, Mycobacterium avium subsp. paratuberculosis
agcuucugcccggccagcagg

SEQ ID NO: 988463 - RNA, 16 nt, Mycobacterium avium subsp. paratuberculosis
agcuucugcagcucgc

SEQ ID NO: 988464 - RNA, 16 nt, Mycobacterium avium subsp. paratuberculosis
agcuucucggugauca

SEQ ID NO: 988465 - RNA, 18 nt, Mycobacterium avium subsp. paratuberculosis
agcuucucggugaucacc

SEQ ID NO: 988466 - RNA, 18 nt, Mycobacterium avium subsp. paratuberculosis
agcuugggagacuuccac

SEQ ID NO: 988467 - RNA, 21 nt, Mycobacterium avium subsp. paratuberculosis
agcuugggccggugcagcacg

SEQ ID NO: 988468 - RNA, 12 nt, Mycobacterium avium subsp. paratuberculosis
agcuuccgaacc

SEQ ID NO: 988469 - RNA, 14 nt, Mycobacterium avium subsp. paratuberculosis
agcuuccgccgagu

SEQ ID NO: 988470 - RNA, 16 nt, Mycobacterium avium subsp. paratuberculosis
agcuucgugucaccgc

SEQ ID NO: 988471 - RNA, 22 nt, Mycobacterium avium subsp. paratuberculosis
agcuggugggccaucgccagga

SEQ ID NO: 988472 - RNA, 23 nt, Mycobacterium avium subsp. paratuberculosis
agcugguggugaucggccaggcg

SEQ ID NO: 988473 - RNA, 20 nt, Mycobacterium avium subsp. paratuberculosis
agcugcuucgucgccgggcu

SEQ ID NO: 988474 - RNA, 17 nt, Mycobacterium avium subsp. paratuberculosis
agcugcuggcugcggcc

SEQ ID NO: 988475 - RNA, 19 nt, Mycobacterium avium subsp. paratuberculosis
agcuggaaauaggccgggc

SEQ ID NO: 988476 - RNA, 21 nt, Mycobacterium avium subsp. paratuberculosis
agcuggaacaccacggccggc

SEQ ID NO: 988477 - RNA, 22 nt, Mycobacterium avium subsp. paratuberculosis
agcuggaacaccacggccggca

SEQ ID NO: 988478 - RNA, 21 nt, Mycobacterium avium subsp. paratuberculosis
agcugucccagugcgugaccu

SEQ ID NO: 988479 - RNA, 21 nt, Mycobacterium avium subsp. paratuberculosis
agcugucgccgagguccucga

SEQ ID NO: 988480 - RNA, 19 nt, Mycobacterium avium subsp. paratuberculosis
agcuccaaugcggccgacu

SEQ ID NO: 988481 - RNA, 12 nt, Mycobacterium avium subsp. paratuberculosis
agcuccacgccg

SEQ ID NO: 988482 - RNA, 12 nt, Mycobacterium avium subsp. paratuberculosis
agcuccagcagc

SEQ ID NO: 988483 - RNA, 13 nt, Mycobacterium avium subsp. paratuberculosis
agcuccagcagcc

SEQ ID NO: 988484 - RNA, 16 nt, Mycobacterium avium subsp. paratuberculosis
agcugcccugaagcug

SEQ ID NO: 988485 - RNA, 20 nt, Mycobacterium avium subsp. paratuberculosis
agcugcccgucggaggacaa

SEQ ID NO: 988486 - RNA, 13 nt, Mycobacterium avium subsp. paratuberculosis
agcugccccuucg

SEQ ID NO: 988487 - RNA, 15 nt, Mycobacterium avium subsp. paratuberculosis
agcugcccgcacugg

SEQ ID NO: 988488 - RNA, 17 nt, Mycobacterium avium subsp. paratuberculosis
agcugccguccgggucc

SEQ ID NO: 988489 - RNA, 13 nt, Mycobacterium avium subsp. paratuberculosis
agcugccggccgu

SEQ ID NO: 988490 - RNA, 15 nt, Mycobacterium avium subsp. paratuberculosis
aggcacccgcugcac

SEQ ID NO: 988491 - RNA, 17 nt, Mycobacterium avium subsp. paratuberculosis
aggcacccgcugcacca

SEQ ID NO: 988492 - RNA, 11 nt, Mycobacterium avium subsp. paratuberculosis
aggcacagcag

SEQ ID NO: 988493 - RNA, 13 nt, Mycobacterium avium subsp. paratuberculosis
aggcacagcagca

SEQ ID NO: 988494 - RNA, 21 nt, Mycobacterium avium subsp. paratuberculosis
aggagcugccggcgaccagcc

SEQ ID NO: 988495 - RNA, 21 nt, Mycobacterium avium subsp. paratuberculosis
aggcaccgaacgccagcagcu

SEQ ID NO: 988496 - RNA, 17 nt, Mycobacterium avium subsp. paratuberculosis
aggcacucgaucagcac

SEQ ID NO: 988497 - RNA, 21 nt, Mycobacterium avium subsp. paratuberculosis
aggcacucgaucagcaccgcc

SEQ ID NO: 988498 - RNA, 15 nt, Mycobacterium avium subsp. paratuberculosis
aggcacucgcccagg

SEQ ID NO: 988499 - RNA, 15 nt, Mycobacterium avium subsp. paratuberculosis
aggcagaagcuccac

SEQ ID NO: 988500 - RNA, 21 nt, Mycobacterium avium subsp. paratuberculosis
aggcagaagcuccacgccgcc

SEQ ID NO: 988501 - RNA, 14 nt, Mycobacterium avium subsp. paratuberculosis
aggcauuccagugc

SEQ ID NO: 988502 - RNA, 16 nt, Mycobacterium avium subsp. paratuberculosis
aggcagacccccagca

SEQ ID NO: 988503 - RNA, 12 nt, Mycobacterium avium subsp. paratuberculosis
aggccaacagca

SEQ ID NO: 988504 - RNA, 15 nt, Mycobacterium avium subsp. paratuberculosis
aggccagcaaccgcc

SEQ ID NO: 988505 - RNA, 22 nt, Mycobacterium avium subsp. paratuberculosis
aggccagcaaccggaauggcag

SEQ ID NO: 988506 - RNA, 12 nt, Mycobacterium avium subsp. paratuberculosis
aggccagcaccc

SEQ ID NO: 988507 - RNA, 12 nt, Mycobacterium avium subsp. paratuberculosis
aggccagcaccu

SEQ ID NO: 988508 - RNA, 18 nt, Mycobacterium avium subsp. paratuberculosis
aggccacaugggccacgg

SEQ ID NO: 988509 - RNA, 20 nt, Mycobacterium avium subsp. paratuberculosis
aggccacaugggccacggcg

SEQ ID NO: 988510 - RNA, 19 nt, Mycobacterium avium subsp. paratuberculosis
aggccagcagauacuccuc

SEQ ID NO: 988511 - RNA, 21 nt, Mycobacterium avium subsp. paratuberculosis
aggcccaccaccacgaggacc

SEQ ID NO: 988512 - RNA, 22 nt, Mycobacterium avium subsp. paratuberculosis
aggcccaacgugaugagcgcgu

SEQ ID NO: 988513 - RNA, 18 nt, Mycobacterium avium subsp. paratuberculosis
aggcccagcccggcccca

SEQ ID NO: 988514 - RNA, 15 nt, Mycobacterium avium subsp. paratuberculosis
aggcccaguagcgga

SEQ ID NO: 988515 - RNA, 14 nt, Mycobacterium avium subsp. paratuberculosis
aggcccagcccacc

SEQ ID NO: 988516 - RNA, 15 nt, Mycobacterium avium subsp. paratuberculosis
aggcccagcagcgca

SEQ ID NO: 988517 - RNA, 10 nt, Mycobacterium avium subsp. paratuberculosis
aggcgcggcg

SEQ ID NO: 988518 - RNA, 12 nt, Mycobacterium avium subsp. paratuberculosis
aggcgcgccggu

SEQ ID NO: 988519 - RNA, 14 nt, Mycobacterium avium subsp. paratuberculosis
aggcgccacagcag

SEQ ID NO: 988520 - RNA, 15 nt, Mycobacterium avium subsp. paratuberculosis
aggcgccacagcagc

SEQ ID NO: 988521 - RNA, 17 nt, Mycobacterium avium subsp. paratuberculosis
aggcgcccagcacccgg

SEQ ID NO: 988522 - RNA, 14 nt, Mycobacterium avium subsp. paratuberculosis
aggcgcgaaagcgc

SEQ ID NO: 988523 - RNA, 18 nt, Mycobacterium avium subsp. paratuberculosis
aggcgccgucgguggggg

SEQ ID NO: 988524 - RNA, 15 nt, Mycobacterium avium subsp. paratuberculosis
aggcgccggccagca

SEQ ID NO: 988525 - RNA, 14 nt, Mycobacterium avium subsp. paratuberculosis
aggcgcaacaccgg

SEQ ID NO: 988526 - RNA, 22 nt, Mycobacterium avium subsp. paratuberculosis
aggcgauggcgucggccagcgg

SEQ ID NO: 988527 - RNA, 22 nt, Mycobacterium avium subsp. paratuberculosis
aggcgaucagcgcgcacagcgc

SEQ ID NO: 988528 - RNA, 17 nt, Mycobacterium avium subsp. paratuberculosis
aggcgcaccgccgggca

SEQ ID NO: 988529 - RNA, 15 nt, Mycobacterium avium subsp. paratuberculosis
aggcgcaccaccagc

SEQ ID NO: 988530 - RNA, 21 nt, Mycobacterium avium subsp. paratuberculosis
aggcgcagaagcuaacgccag

SEQ ID NO: 988531 - RNA, 17 nt, Mycobacterium avium subsp. paratuberculosis
aggcgcaguagccgacg

SEQ ID NO: 988532 - RNA, 14 nt, Mycobacterium avium subsp. paratuberculosis
aggcgagugaggac

SEQ ID NO: 988533 - RNA, 19 nt, Mycobacterium avium subsp. paratuberculosis
aggcgagugaggacgaggc

SEQ ID NO: 988534 - RNA, 18 nt, Mycobacterium avium subsp. paratuberculosis
aggcgagccgacagucgc

SEQ ID NO: 988535 - RNA, 20 nt, Mycobacterium avium subsp. paratuberculosis
aggcgaaauaacccaccccg

SEQ ID NO: 988536 - RNA, 18 nt, Mycobacterium avium subsp. paratuberculosis
aggcgaaugcggccaugu

SEQ ID NO: 988537 - RNA, 16 nt, Mycobacterium avium subsp. paratuberculosis
aggcgaauaagggggu

SEQ ID NO: 988538 - RNA, 23 nt, Mycobacterium avium subsp. paratuberculosis
aggcgaccacaccgccggccacg

SEQ ID NO: 988539 - RNA, 17 nt, Mycobacterium avium subsp. paratuberculosis
aggcgaacauggcggcc

SEQ ID NO: 988540 - RNA, 14 nt, Mycobacterium avium subsp. paratuberculosis
aggccuggaacacc

SEQ ID NO: 988541 - RNA, 15 nt, Mycobacterium avium subsp. paratuberculosis
aggccucuacucagc

SEQ ID NO: 988542 - RNA, 20 nt, Mycobacterium avium subsp. paratuberculosis
aggccucgaggaucgcggcc

SEQ ID NO: 988543 - RNA, 17 nt, Mycobacterium avium subsp. paratuberculosis
aggccgagcgcgcugga

SEQ ID NO: 988544 - RNA, 23 nt, Mycobacterium avium subsp. paratuberculosis
aggccgacuggugauagaucauc

SEQ ID NO: 988545 - RNA, 18 nt, Mycobacterium avium subsp. paratuberculosis
aggccgacgccggccacc

SEQ ID NO: 988546 - RNA, 21 nt, Mycobacterium avium subsp. paratuberculosis
aggccccguucgguggccacc

SEQ ID NO: 988547 - RNA, 15 nt, Mycobacterium avium subsp. paratuberculosis
aggcccgcaagaugu

SEQ ID NO: 988548 - RNA, 14 nt, Mycobacterium avium subsp. paratuberculosis
aggccgggguguag

SEQ ID NO: 988549 - RNA, 17 nt, Mycobacterium avium subsp. paratuberculosis
aggccgggauagagcac

SEQ ID NO: 988550 - RNA, 21 nt, Mycobacterium avium subsp. paratuberculosis
aggccgcccgcuccugcaggc

SEQ ID NO: 988551 - RNA, 13 nt, Mycobacterium avium subsp. paratuberculosis
aggccguccacca

SEQ ID NO: 988552 - RNA, 15 nt, Mycobacterium avium subsp. paratuberculosis
aggccgucucgagcc

SEQ ID NO: 988553 - RNA, 15 nt, Mycobacterium avium subsp. paratuberculosis
aggccgugaucggcc

SEQ ID NO: 988554 - RNA, 20 nt, Mycobacterium avium subsp. paratuberculosis
aggccgugaucggccagcca

SEQ ID NO: 988555 - RNA, 14 nt, Mycobacterium avium subsp. paratuberculosis
aggccguagagcac

SEQ ID NO: 988556 - RNA, 20 nt, Mycobacterium avium subsp. paratuberculosis
agggugaugacguuggugau

SEQ ID NO: 988557 - RNA, 22 nt, Mycobacterium avium subsp. paratuberculosis
agggugacccgggcgauggugc

SEQ ID NO: 988558 - RNA, 21 nt, Mycobacterium avium subsp. paratuberculosis
agggugccgauguaggacagg

SEQ ID NO: 988559 - RNA, 13 nt, Mycobacterium avium subsp. paratuberculosis
agggugccgccgg

SEQ ID NO: 988560 - RNA, 18 nt, Mycobacterium avium subsp. paratuberculosis
agggugccgccgggcacc

SEQ ID NO: 988561 - RNA, 19 nt, Mycobacterium avium subsp. paratuberculosis
agggugccgccgggcaccu

SEQ ID NO: 988562 - RNA, 15 nt, Mycobacterium avium subsp. paratuberculosis
agggugccggccacc

SEQ ID NO: 988563 - RNA, 23 nt, Mycobacterium avium subsp. paratuberculosis
agggugccccgcaccgccaggcu

SEQ ID NO: 988564 - RNA, 12 nt, Mycobacterium avium subsp. paratuberculosis
agggugcucagc

SEQ ID NO: 988565 - RNA, 15 nt, Mycobacterium avium subsp. paratuberculosis
aggguggccgccacc

SEQ ID NO: 988566 - RNA, 13 nt, Mycobacterium avium subsp. paratuberculosis
agguagugguggg

SEQ ID NO: 988567 - RNA, 21 nt, Mycobacterium avium subsp. paratuberculosis
agguaguccagcacagcauca

SEQ ID NO: 988568 - RNA, 17 nt, Mycobacterium avium subsp. paratuberculosis
agguagucggcccaggc

SEQ ID NO: 988569 - RNA, 13 nt, Mycobacterium avium subsp. paratuberculosis
agguacugcagca

SEQ ID NO: 988570 - RNA, 13 nt, Mycobacterium avium subsp. paratuberculosis
agguagcggcuga

SEQ ID NO: 988571 - RNA, 19 nt, Mycobacterium avium subsp. paratuberculosis
agguacacguagcggucca

SEQ ID NO: 988572 - RNA, 20 nt, Mycobacterium avium subsp. paratuberculosis
agguacaccaccagguugga

SEQ ID NO: 988573 - RNA, 22 nt, Mycobacterium avium subsp. paratuberculosis
agguacgcggcguugccgccgg

SEQ ID NO: 988574 - RNA, 16 nt, Mycobacterium avium subsp. paratuberculosis
agguccaccaggugac

SEQ ID NO: 988575 - RNA, 20 nt, Mycobacterium avium subsp. paratuberculosis
agguccgccggugccagcaa

SEQ ID NO: 988576 - RNA, 16 nt, Mycobacterium avium subsp. paratuberculosis
aggucgaucugcggca

SEQ ID NO: 988577 - RNA, 17 nt, Mycobacterium avium subsp. paratuberculosis
aggucgcacaccagcac

SEQ ID NO: 988578 - RNA, 16 nt, Mycobacterium avium subsp. paratuberculosis
aggucgcugcgcucgc

SEQ ID NO: 988579 - RNA, 18 nt, Mycobacterium avium subsp. paratuberculosis
aggucgcgccggagccgg

SEQ ID NO: 988580 - RNA, 16 nt, Mycobacterium avium subsp. paratuberculosis
aggucgccggcggccg

SEQ ID NO: 988581 - RNA, 17 nt, Mycobacterium avium subsp. paratuberculosis
aggucgccuccagguga

SEQ ID NO: 988582 - RNA, 17 nt, Mycobacterium avium subsp. paratuberculosis
aggucgcgguagucggg

SEQ ID NO: 988583 - RNA, 12 nt, Mycobacterium avium subsp. paratuberculosis
agguaucucuga

SEQ ID NO: 988584 - RNA, 15 nt, Mycobacterium avium subsp. paratuberculosis
aggugaucguguugu

SEQ ID NO: 988585 - RNA, 16 nt, Mycobacterium avium subsp. paratuberculosis
aggugaucuuguuguu

SEQ ID NO: 988586 - RNA, 20 nt, Mycobacterium avium subsp. paratuberculosis
aggucggggcccguccccac

SEQ ID NO: 988587 - RNA, 21 nt, Mycobacterium avium subsp. paratuberculosis
aggucggggcccguccccacc

SEQ ID NO: 988588 - RNA, 13 nt, Mycobacterium avium subsp. paratuberculosis
aggucggugaggc

SEQ ID NO: 988589 - RNA, 17 nt, Mycobacterium avium subsp. paratuberculosis
aggucggugaggcuggg

SEQ ID NO: 988590 - RNA, 15 nt, Mycobacterium avium subsp. paratuberculosis
aggucgguggccacc

SEQ ID NO: 988591 - RNA, 22 nt, Mycobacterium avium subsp. paratuberculosis
aggucgguggccaccaccgagg

SEQ ID NO: 988592 - RNA, 17 nt, Mycobacterium avium subsp. paratuberculosis
aggucgucgagggccac

SEQ ID NO: 988593 - RNA, 18 nt, Mycobacterium avium subsp. paratuberculosis
aggucgucgagggccacc

SEQ ID NO: 988594 - RNA, 21 nt, Mycobacterium avium subsp. paratuberculosis
aggucgucgcguccagcaugc

SEQ ID NO: 988595 - RNA, 13 nt, Mycobacterium avium subsp. paratuberculosis
aggucgucggcca

SEQ ID NO: 988596 - RNA, 17 nt, Mycobacterium avium subsp. paratuberculosis
aggugcucgacggcacc

SEQ ID NO: 988597 - RNA, 20 nt, Mycobacterium avium subsp. paratuberculosis
aggugcugaaugaacgaccu

SEQ ID NO: 988598 - RNA, 20 nt, Mycobacterium avium subsp. paratuberculosis
aggugcugucgucgcccuga

SEQ ID NO: 988599 - RNA, 15 nt, Mycobacterium avium subsp. paratuberculosis
aggugcaucgccacc

SEQ ID NO: 988600 - RNA, 15 nt, Mycobacterium avium subsp. paratuberculosis
aggugcacgcccaga

SEQ ID NO: 988601 - RNA, 21 nt, Mycobacterium avium subsp. paratuberculosis
aggugcaccacccaggccacc

SEQ ID NO: 988602 - RNA, 17 nt, Mycobacterium avium subsp. paratuberculosis
aggugcacccgcggcgc

SEQ ID NO: 988603 - RNA, 19 nt, Mycobacterium avium subsp. paratuberculosis
aggugcagcagcagccacg

SEQ ID NO: 988604 - RNA, 17 nt, Mycobacterium avium subsp. paratuberculosis
agggcguguugcaggcg

SEQ ID NO: 988605 - RNA, 22 nt, Mycobacterium avium subsp. paratuberculosis
agggcguguugcaggcggaccu

SEQ ID NO: 988606 - RNA, 20 nt, Mycobacterium avium subsp. paratuberculosis
agggcuccgcgcugaccagc

SEQ ID NO: 988607 - RNA, 15 nt, Mycobacterium avium subsp. paratuberculosis
aggggcagcugauag

SEQ ID NO: 988608 - RNA, 13 nt, Mycobacterium avium subsp. paratuberculosis
aggggcagcagca

SEQ ID NO: 988609 - RNA, 15 nt, Mycobacterium avium subsp. paratuberculosis
aggggcagcagcaga

SEQ ID NO: 988610 - RNA, 16 nt, Mycobacterium avium subsp. paratuberculosis
aggguaacccgggacc

SEQ ID NO: 988611 - RNA, 16 nt, Mycobacterium avium subsp. paratuberculosis
aggggcgcgcgccggg

SEQ ID NO: 988612 - RNA, 17 nt, Mycobacterium avium subsp. paratuberculosis
agggcggcgccgcggcc

SEQ ID NO: 988613 - RNA, 11 nt, Mycobacterium avium subsp. paratuberculosis
agggccgccgc

SEQ ID NO: 988614 - RNA, 19 nt, Mycobacterium avium subsp. paratuberculosis
agggccgcgcgggcgaccu

SEQ ID NO: 988615 - RNA, 23 nt, Mycobacterium avium subsp. paratuberculosis
agggcgugacgccgcugcgugcc

SEQ ID NO: 988616 - RNA, 18 nt, Mycobacterium avium subsp. paratuberculosis
agggcgugcgcggccgcc

SEQ ID NO: 988617 - RNA, 17 nt, Mycobacterium avium subsp. paratuberculosis
agggcguccuuccaacg

SEQ ID NO: 988618 - RNA, 16 nt, Mycobacterium avium subsp. paratuberculosis
agggcgguggcggcga

SEQ ID NO: 988619 - RNA, 13 nt, Mycobacterium avium subsp. paratuberculosis
agggcgucaggcg

SEQ ID NO: 988620 - RNA, 17 nt, Mycobacterium avium subsp. paratuberculosis
agggccaccgucagggu

SEQ ID NO: 988621 - RNA, 14 nt, Mycobacterium avium subsp. paratuberculosis
agggccagcggcaa

SEQ ID NO: 988622 - RNA, 13 nt, Mycobacterium avium subsp. paratuberculosis
agggccagcagcc

SEQ ID NO: 988623 - RNA, 19 nt, Mycobacterium avium subsp. paratuberculosis
agggcccacagcagccgca

SEQ ID NO: 988624 - RNA, 16 nt, Mycobacterium avium subsp. paratuberculosis
agggcacaccggugcu

SEQ ID NO: 988625 - RNA, 14 nt, Mycobacterium avium subsp. paratuberculosis
agggccccggcauc

SEQ ID NO: 988626 - RNA, 22 nt, Mycobacterium avium subsp. paratuberculosis
agggccccguuggugcggugca

SEQ ID NO: 988627 - RNA, 16 nt, Mycobacterium avium subsp. paratuberculosis
agggcaaccgcagcau

SEQ ID NO: 988628 - RNA, 16 nt, Mycobacterium avium subsp. paratuberculosis
agggacugcgccgggg

SEQ ID NO: 988629 - RNA, 14 nt, Mycobacterium avium subsp. paratuberculosis
agggaccuccagcg

SEQ ID NO: 988630 - RNA, 15 nt, Mycobacterium avium subsp. paratuberculosis
agggaccaguggugg

SEQ ID NO: 988631 - RNA, 12 nt, Mycobacterium avium subsp. paratuberculosis
aggcuuggcccg

SEQ ID NO: 988632 - RNA, 19 nt, Mycobacterium avium subsp. paratuberculosis
aggcuuggcccgccgccgg

SEQ ID NO: 988633 - RNA, 21 nt, Mycobacterium avium subsp. paratuberculosis
aggcuuggcccgccgccggcg

SEQ ID NO: 988634 - RNA, 13 nt, Mycobacterium avium subsp. paratuberculosis
aggcggccaccgc

SEQ ID NO: 988635 - RNA, 20 nt, Mycobacterium avium subsp. paratuberculosis
aguagcagcgucugcgcccc

SEQ ID NO: 988636 - RNA, 19 nt, Mycobacterium avium subsp. paratuberculosis
aguagcccggagugaaguc

SEQ ID NO: 988637 - RNA, 16 nt, Mycobacterium avium subsp. paratuberculosis
aguagccgaucuccac

SEQ ID NO: 988638 - RNA, 18 nt, Mycobacterium avium subsp. paratuberculosis
aguagccgaucuccaccg

SEQ ID NO: 988639 - RNA, 14 nt, Mycobacterium avium subsp. paratuberculosis
aguagccggccagc

SEQ ID NO: 988640 - RNA, 16 nt, Mycobacterium avium subsp. paratuberculosis
aguacccgccgcaccu

SEQ ID NO: 988641 - RNA, 15 nt, Mycobacterium avium subsp. paratuberculosis
aguaccccgggcuga

SEQ ID NO: 988642 - RNA, 20 nt, Mycobacterium avium subsp. paratuberculosis
aguaggcgaccacaccgccg

SEQ ID NO: 988643 - RNA, 13 nt, Mycobacterium avium subsp. paratuberculosis
aguaggcgccgcc

SEQ ID NO: 988644 - RNA, 23 nt, Mycobacterium avium subsp. paratuberculosis
aguagcugcccugaagcugggcg

SEQ ID NO: 988645 - RNA, 13 nt, Mycobacterium avium subsp. paratuberculosis
agguuggcggcgg

SEQ ID NO: 988646 - RNA, 16 nt, Mycobacterium avium subsp. paratuberculosis
agguuguagucggcgc

SEQ ID NO: 988647 - RNA, 19 nt, Mycobacterium avium subsp. paratuberculosis
agguugucgucgggcacca

SEQ ID NO: 988648 - RNA, 22 nt, Mycobacterium avium subsp. paratuberculosis
agguggccgaucagcggcgggc

SEQ ID NO: 988649 - RNA, 18 nt, Mycobacterium avium subsp. paratuberculosis
agguggauugucggccgc

SEQ ID NO: 988650 - RNA, 12 nt, Mycobacterium avium subsp. paratuberculosis
agguggccauga

SEQ ID NO: 988651 - RNA, 14 nt, Mycobacterium avium subsp. paratuberculosis
agguggccaugggg

SEQ ID NO: 988652 - RNA, 15 nt, Mycobacterium avium subsp. paratuberculosis
aggugcuuggucagc

SEQ ID NO: 988653 - RNA, 19 nt, Mycobacterium avium subsp. paratuberculosis
agguggacgagcagccgca

SEQ ID NO: 988654 - RNA, 22 nt, Mycobacterium avium subsp. paratuberculosis
aguccggccagcguuugagcac

SEQ ID NO: 988655 - RNA, 20 nt, Mycobacterium avium subsp. paratuberculosis
aguccggccgugaugcgccg

SEQ ID NO: 988656 - RNA, 15 nt, Mycobacterium avium subsp. paratuberculosis
aguccgggccgccgg

SEQ ID NO: 988657 - RNA, 19 nt, Mycobacterium avium subsp. paratuberculosis
aguccggguccuaucagga

SEQ ID NO: 988658 - RNA, 23 nt, Mycobacterium avium subsp. paratuberculosis
aguccggguccuaucaggacugg

SEQ ID NO: 988659 - RNA, 16 nt, Mycobacterium avium subsp. paratuberculosis
agucgaucgccagcgc

SEQ ID NO: 988660 - RNA, 12 nt, Mycobacterium avium subsp. paratuberculosis
agucgagcaccg

SEQ ID NO: 988661 - RNA, 14 nt, Mycobacterium avium subsp. paratuberculosis
agucgaccggggcg

SEQ ID NO: 988662 - RNA, 13 nt, Mycobacterium avium subsp. paratuberculosis
agucgcugggugu

SEQ ID NO: 988663 - RNA, 15 nt, Mycobacterium avium subsp. paratuberculosis
agucgcgggcagccg

SEQ ID NO: 988664 - RNA, 16 nt, Mycobacterium avium subsp. paratuberculosis
agucgcucggcggcga

SEQ ID NO: 988665 - RNA, 13 nt, Mycobacterium avium subsp. paratuberculosis
agucgcgccgagg

SEQ ID NO: 988666 - RNA, 23 nt, Mycobacterium avium subsp. paratuberculosis
aguccucgcgguugcggguggcg

SEQ ID NO: 988667 - RNA, 18 nt, Mycobacterium avium subsp. paratuberculosis
aguccucgguggccaccu

SEQ ID NO: 988668 - RNA, 19 nt, Mycobacterium avium subsp. paratuberculosis
agucgaagccguggcaggc

SEQ ID NO: 988669 - RNA, 20 nt, Mycobacterium avium subsp. paratuberculosis
agucgaagccguggcaggca

SEQ ID NO: 988670 - RNA, 24 nt, Mycobacterium avium subsp. paratuberculosis
agucgaagcggugcaccaccgugc

SEQ ID NO: 988671 - RNA, 14 nt, Mycobacterium avium subsp. paratuberculosis
aguccugcgccgcg

SEQ ID NO: 988672 - RNA, 18 nt, Mycobacterium avium subsp. paratuberculosis
agucugagcccgggcagg

SEQ ID NO: 988673 - RNA, 11 nt, Mycobacterium avium subsp. paratuberculosis
agucggccacc

SEQ ID NO: 988674 - RNA, 16 nt, Mycobacterium avium subsp. paratuberculosis
agucggccaucagcac

SEQ ID NO: 988675 - RNA, 22 nt, Mycobacterium avium subsp. paratuberculosis
agucggccggcguuguccaggu

SEQ ID NO: 988676 - RNA, 16 nt, Mycobacterium avium subsp. paratuberculosis
agucggcgcagcgcac

SEQ ID NO: 988677 - RNA, 21 nt, Mycobacterium avium subsp. paratuberculosis
agucggcgccgacggccagca

SEQ ID NO: 988678 - RNA, 22 nt, Mycobacterium avium subsp. paratuberculosis
agucggcgccgacggccagcag

SEQ ID NO: 988679 - RNA, 15 nt, Mycobacterium avium subsp. paratuberculosis
agucgggcccgcccc

SEQ ID NO: 988680 - RNA, 21 nt, Mycobacterium avium subsp. paratuberculosis
agucgggaaaucggacccagc

SEQ ID NO: 988681 - RNA, 15 nt, Mycobacterium avium subsp. paratuberculosis
agucggcgucggcca

SEQ ID NO: 988682 - RNA, 19 nt, Mycobacterium avium subsp. paratuberculosis
agucggcgucggccaccgc

SEQ ID NO: 988683 - RNA, 14 nt, Mycobacterium avium subsp. paratuberculosis
agugccgcaccagc

SEQ ID NO: 988684 - RNA, 16 nt, Mycobacterium avium subsp. paratuberculosis
agugccgcaccagcac

SEQ ID NO: 988685 - RNA, 17 nt, Mycobacterium avium subsp. paratuberculosis
agugccgcaccagcacc

SEQ ID NO: 988686 - RNA, 22 nt, Mycobacterium avium subsp. paratuberculosis
agugccaccaccacggccagga

SEQ ID NO: 988687 - RNA, 15 nt, Mycobacterium avium subsp. paratuberculosis
agugcaugccggccu

SEQ ID NO: 988688 - RNA, 21 nt, Mycobacterium avium subsp. paratuberculosis
agugcacucggcgaugcgccg

SEQ ID NO: 988689 - RNA, 22 nt, Mycobacterium avium subsp. paratuberculosis
agugauccugguuucagguggc

SEQ ID NO: 988690 - RNA, 14 nt, Mycobacterium avium subsp. paratuberculosis
agugaugaccugga

SEQ ID NO: 988691 - RNA, 13 nt, Mycobacterium avium subsp. paratuberculosis
aguggucggccgc

SEQ ID NO: 988692 - RNA, 19 nt, Mycobacterium avium subsp. paratuberculosis
agugguaccggguggccgu

SEQ ID NO: 988693 - RNA, 22 nt, Mycobacterium avium subsp. paratuberculosis
agugcgcuguggugacggcccc

SEQ ID NO: 988694 - RNA, 17 nt, Mycobacterium avium subsp. paratuberculosis
agugcucgauggccagc

SEQ ID NO: 988695 - RNA, 19 nt, Mycobacterium avium subsp. paratuberculosis
agugcucggcguugagccg

SEQ ID NO: 988696 - RNA, 11 nt, Mycobacterium avium subsp. paratuberculosis
agugccgggcc

SEQ ID NO: 988697 - RNA, 16 nt, Mycobacterium avium subsp. paratuberculosis
agugccgggccagcug

SEQ ID NO: 988698 - RNA, 17 nt, Mycobacterium avium subsp. paratuberculosis
agugccggacccccucg

SEQ ID NO: 988699 - RNA, 23 nt, Mycobacterium avium subsp. paratuberculosis
agugccggccagcucgccgccga

SEQ ID NO: 988700 - RNA, 17 nt, Mycobacterium avium subsp. paratuberculosis
agugccggcgcaccgcg

SEQ ID NO: 988701 - RNA, 15 nt, Mycobacterium avium subsp. paratuberculosis
agugccgcagguggu

SEQ ID NO: 988702 - RNA, 12 nt, Mycobacterium avium subsp. paratuberculosis
agugcgcaggcg

SEQ ID NO: 988703 - RNA, 18 nt, Mycobacterium avium subsp. paratuberculosis
agugcgccgugcagcacg

SEQ ID NO: 988704 - RNA, 16 nt, Mycobacterium avium subsp. paratuberculosis
aguugccccguguggu

SEQ ID NO: 988705 - RNA, 18 nt, Mycobacterium avium subsp. paratuberculosis
aguugccguuguccuuga

SEQ ID NO: 988706 - RNA, 22 nt, Mycobacterium avium subsp. paratuberculosis
aguugccguuguccuugagccg

SEQ ID NO: 988707 - RNA, 16 nt, Mycobacterium avium subsp. paratuberculosis
aguuguagcgcagcau

SEQ ID NO: 988708 - RNA, 15 nt, Mycobacterium avium subsp. paratuberculosis
aguuguuggccgggc

SEQ ID NO: 988709 - RNA, 16 nt, Mycobacterium avium subsp. paratuberculosis
aguuguuggccgggca

SEQ ID NO: 988710 - RNA, 16 nt, Mycobacterium avium subsp. paratuberculosis
aguugucggugaaguc

SEQ ID NO: 988711 - RNA, 14 nt, Mycobacterium avium subsp. paratuberculosis
aguucggccaccgc

SEQ ID NO: 988712 - RNA, 17 nt, Mycobacterium avium subsp. paratuberculosis
aguucggccaccgcguc

SEQ ID NO: 988713 - RNA, 22 nt, Mycobacterium avium subsp. paratuberculosis
aguucggccagaucggccaggu

SEQ ID NO: 988714 - RNA, 22 nt, Mycobacterium avium subsp. paratuberculosis
aguucggccggcuugaucucga

SEQ ID NO: 988715 - RNA, 14 nt, Mycobacterium avium subsp. paratuberculosis
aguucgucggccgu

SEQ ID NO: 988716 - RNA, 19 nt, Mycobacterium avium subsp. paratuberculosis
aguucgguggggccgccgu

SEQ ID NO: 988717 - RNA, 19 nt, Mycobacterium avium subsp. paratuberculosis
aguucucgccgugcagcac

SEQ ID NO: 988718 - RNA, 15 nt, Mycobacterium avium subsp. paratuberculosis
aguugaucgcggcgg

SEQ ID NO: 988719 - RNA, 16 nt, Mycobacterium avium subsp. paratuberculosis
aguugaucgcggcgga

SEQ ID NO: 988720 - RNA, 22 nt, Mycobacterium avium subsp. paratuberculosis
aguugcacucucgcggcaaggc

SEQ ID NO: 988721 - RNA, 21 nt, Mycobacterium avium subsp. paratuberculosis
aguugcacuuucggcagcuga

SEQ ID NO: 988722 - RNA, 14 nt, Mycobacterium avium subsp. paratuberculosis
aguucaccaccgcg

SEQ ID NO: 988723 - RNA, 16 nt, Mycobacterium avium subsp. paratuberculosis
aguucaccaccgcgcu

SEQ ID NO: 988724 - RNA, 16 nt, Mycobacterium avium subsp. paratuberculosis
aguguccagucggccg

SEQ ID NO: 988725 - RNA, 16 nt, Mycobacterium avium subsp. paratuberculosis
auacacgccuggacag

SEQ ID NO: 988726 - RNA, 16 nt, Mycobacterium avium subsp. paratuberculosis
aucaccgccagcgcgc

SEQ ID NO: 988727 - RNA, 19 nt, Mycobacterium avium subsp. paratuberculosis
aucaccucgaacuugaccg

SEQ ID NO: 988728 - RNA, 21 nt, Mycobacterium avium subsp. paratuberculosis
aucaccucaucgcccagccgg

SEQ ID NO: 988729 - RNA, 22 nt, Mycobacterium avium subsp. paratuberculosis
aucaccucgauggccgggaagu

SEQ ID NO: 988730 - RNA, 20 nt, Mycobacterium avium subsp. paratuberculosis
aucacgucccgcucgaucug

SEQ ID NO: 988731 - RNA, 22 nt, Mycobacterium avium subsp. paratuberculosis
aucacgccccaggcgcccugca

SEQ ID NO: 988732 - RNA, 22 nt, Mycobacterium avium subsp. paratuberculosis
aucagcggagugaccgccagca

SEQ ID NO: 988733 - RNA, 14 nt, Mycobacterium avium subsp. paratuberculosis
aucagcugcccgga

SEQ ID NO: 988734 - RNA, 16 nt, Mycobacterium avium subsp. paratuberculosis
aucagcugccguccgg

SEQ ID NO: 988735 - RNA, 18 nt, Mycobacterium avium subsp. paratuberculosis
aucagcgcgcccaggccc

SEQ ID NO: 988736 - RNA, 17 nt, Mycobacterium avium subsp. paratuberculosis
aucagcgccaccagcac

SEQ ID NO: 988737 - RNA, 15 nt, Mycobacterium avium subsp. paratuberculosis
aucagcgccagcaac

SEQ ID NO: 988738 - RNA, 14 nt, Mycobacterium avium subsp. paratuberculosis
aucaucccggccac

SEQ ID NO: 988739 - RNA, 15 nt, Mycobacterium avium subsp. paratuberculosis
aucaucccggccacc

SEQ ID NO: 988740 - RNA, 17 nt, Mycobacterium avium subsp. paratuberculosis
aucauccaggugaacag

SEQ ID NO: 988741 - RNA, 20 nt, Mycobacterium avium subsp. paratuberculosis
aucaucaccaccgccgccga

SEQ ID NO: 988742 - RNA, 14 nt, Mycobacterium avium subsp. paratuberculosis
aucaggcgcagccc

SEQ ID NO: 988743 - RNA, 20 nt, Mycobacterium avium subsp. paratuberculosis
aucaggccggccaccagguc

SEQ ID NO: 988744 - RNA, 16 nt, Mycobacterium avium subsp. paratuberculosis
aucagugcgggcaucg

SEQ ID NO: 988745 - RNA, 15 nt, Mycobacterium avium subsp. paratuberculosis
aucaacaggcccagc

SEQ ID NO: 988746 - RNA, 18 nt, Mycobacterium avium subsp. paratuberculosis
auaucgcaccggcgccuc

SEQ ID NO: 988747 - RNA, 21 nt, Mycobacterium avium subsp. paratuberculosis
auaguucgccgccgccagcac

SEQ ID NO: 988748 - RNA, 22 nt, Mycobacterium avium subsp. paratuberculosis
auaguucgccgccgccagcacc

SEQ ID NO: 988749 - RNA, 15 nt, Mycobacterium avium subsp. paratuberculosis
auagaucaucccggc

SEQ ID NO: 988750 - RNA, 17 nt, Mycobacterium avium subsp. paratuberculosis
auacaggagggccaggg

SEQ ID NO: 988751 - RNA, 23 nt, Mycobacterium avium subsp. paratuberculosis
auacagcggcgcgcgccgcagcg

SEQ ID NO: 988752 - RNA, 13 nt, Mycobacterium avium subsp. paratuberculosis
auaccgcccgcgc

SEQ ID NO: 988753 - RNA, 14 nt, Mycobacterium avium subsp. paratuberculosis
auaccggcccagcg

SEQ ID NO: 988754 - RNA, 23 nt, Mycobacterium avium subsp. paratuberculosis
auaccggcagcaggugcaccacc

SEQ ID NO: 988755 - RNA, 21 nt, Mycobacterium avium subsp. paratuberculosis
auaccugcguccgauaccagc

SEQ ID NO: 988756 - RNA, 17 nt, Mycobacterium avium subsp. paratuberculosis
auaccuugccggagugc

SEQ ID NO: 988757 - RNA, 16 nt, Mycobacterium avium subsp. paratuberculosis
auacgccgacgcaugu

SEQ ID NO: 988758 - RNA, 16 nt, Mycobacterium avium subsp. paratuberculosis
auacgcccggccaccu

SEQ ID NO: 988759 - RNA, 15 nt, Mycobacterium avium subsp. paratuberculosis
aucgaguaggcccag

SEQ ID NO: 988760 - RNA, 17 nt, Mycobacterium avium subsp. paratuberculosis
aucgagggggucaucag

SEQ ID NO: 988761 - RNA, 21 nt, Mycobacterium avium subsp. paratuberculosis
aucgacuugccgccgcacacu

SEQ ID NO: 988762 - RNA, 17 nt, Mycobacterium avium subsp. paratuberculosis
aucgaccgcccgcugaa

SEQ ID NO: 988763 - RNA, 14 nt, Mycobacterium avium subsp. paratuberculosis
aucgaaggccaggu

SEQ ID NO: 988764 - RNA, 13 nt, Mycobacterium avium subsp. paratuberculosis
aucgacagcucca

SEQ ID NO: 988765 - RNA, 14 nt, Mycobacterium avium subsp. paratuberculosis
aucgagggcgcgca

SEQ ID NO: 988766 - RNA, 12 nt, Mycobacterium avium subsp. paratuberculosis
aucgccaccugg

SEQ ID NO: 988767 - RNA, 19 nt, Mycobacterium avium subsp. paratuberculosis
aucgccacgccgaccaggu

SEQ ID NO: 988768 - RNA, 15 nt, Mycobacterium avium subsp. paratuberculosis
aucgccagcacauag

SEQ ID NO: 988769 - RNA, 21 nt, Mycobacterium avium subsp. paratuberculosis
auccuggccuggucggccggc

SEQ ID NO: 988770 - RNA, 23 nt, Mycobacterium avium subsp. paratuberculosis
auccuggccgauggucagcugcc

SEQ ID NO: 988771 - RNA, 12 nt, Mycobacterium avium subsp. paratuberculosis
auccugcccggu

SEQ ID NO: 988772 - RNA, 19 nt, Mycobacterium avium subsp. paratuberculosis
auccgcgacgccagcaccu

SEQ ID NO: 988773 - RNA, 21 nt, Mycobacterium avium subsp. paratuberculosis
auccgcggguacggucggccg

SEQ ID NO: 988774 - RNA, 13 nt, Mycobacterium avium subsp. paratuberculosis
aucgaacagggcg

SEQ ID NO: 988775 - RNA, 17 nt, Mycobacterium avium subsp. paratuberculosis
auccugguuucaggugg

SEQ ID NO: 988776 - RNA, 17 nt, Mycobacterium avium subsp. paratuberculosis
auccugugcaccgugcu

SEQ ID NO: 988777 - RNA, 21 nt, Mycobacterium avium subsp. paratuberculosis
auccugucauccgucgcccgc

SEQ ID NO: 988778 - RNA, 17 nt, Mycobacterium avium subsp. paratuberculosis
aucggcugcgggccagc

SEQ ID NO: 988779 - RNA, 19 nt, Mycobacterium avium subsp. paratuberculosis
aucggcucggcgccccacg

SEQ ID NO: 988780 - RNA, 22 nt, Mycobacterium avium subsp. paratuberculosis
aucggcucggcgccccacgccu

SEQ ID NO: 988781 - RNA, 17 nt, Mycobacterium avium subsp. paratuberculosis
aucgggcccagcagccu

SEQ ID NO: 988782 - RNA, 21 nt, Mycobacterium avium subsp. paratuberculosis
aucggcggccaccagccggcc

SEQ ID NO: 988783 - RNA, 15 nt, Mycobacterium avium subsp. paratuberculosis
aucggcgcccaccgc

SEQ ID NO: 988784 - RNA, 22 nt, Mycobacterium avium subsp. paratuberculosis
aucgggguggacgcgaccaggc

SEQ ID NO: 988785 - RNA, 17 nt, Mycobacterium avium subsp. paratuberculosis
aucgggucccagaugcg

SEQ ID NO: 988786 - RNA, 12 nt, Mycobacterium avium subsp. paratuberculosis
aucggugaagcg

SEQ ID NO: 988787 - RNA, 23 nt, Mycobacterium avium subsp. paratuberculosis
aucggugccucuucgucggccgg

SEQ ID NO: 988788 - RNA, 21 nt, Mycobacterium avium subsp. paratuberculosis
aucggugcggaaggcccccgg

SEQ ID NO: 988789 - RNA, 21 nt, Mycobacterium avium subsp. paratuberculosis
aucgguggcaccccgcgccgg

SEQ ID NO: 988790 - RNA, 19 nt, Mycobacterium avium subsp. paratuberculosis
aucgguguagcccggugcc

SEQ ID NO: 988791 - RNA, 14 nt, Mycobacterium avium subsp. paratuberculosis
aucggacccagccc

SEQ ID NO: 988792 - RNA, 15 nt, Mycobacterium avium subsp. paratuberculosis
aucggacccagcccg

SEQ ID NO: 988793 - RNA, 19 nt, Mycobacterium avium subsp. paratuberculosis
aucggcccccgggcccgaa

SEQ ID NO: 988794 - RNA, 22 nt, Mycobacterium avium subsp. paratuberculosis
aucggcagcagggugccgccgc

SEQ ID NO: 988795 - RNA, 16 nt, Mycobacterium avium subsp. paratuberculosis
aucggcagcccggagg

SEQ ID NO: 988796 - RNA, 18 nt, Mycobacterium avium subsp. paratuberculosis
aucggcaguccgcgccgg

SEQ ID NO: 988797 - RNA, 20 nt, Mycobacterium avium subsp. paratuberculosis
aucggcaguccgcgccgguc

SEQ ID NO: 988798 - RNA, 21 nt, Mycobacterium avium subsp. paratuberculosis
aucggcaugacgcccagcugc

SEQ ID NO: 988799 - RNA, 20 nt, Mycobacterium avium subsp. paratuberculosis
aucgcuugaccaccgaccgg

SEQ ID NO: 988800 - RNA, 21 nt, Mycobacterium avium subsp. paratuberculosis
aucgccaggcguugcaccgcg

SEQ ID NO: 988801 - RNA, 13 nt, Mycobacterium avium subsp. paratuberculosis
aucgccaggaacc

SEQ ID NO: 988802 - RNA, 19 nt, Mycobacterium avium subsp. paratuberculosis
aucgccgagguagccgcgc

SEQ ID NO: 988803 - RNA, 16 nt, Mycobacterium avium subsp. paratuberculosis
aucgccgaaccgggcg

SEQ ID NO: 988804 - RNA, 19 nt, Mycobacterium avium subsp. paratuberculosis
aucgccgaaccgggcgcgc

SEQ ID NO: 988805 - RNA, 18 nt, Mycobacterium avium subsp. paratuberculosis
aucgccgaaccgucccac

SEQ ID NO: 988806 - RNA, 20 nt, Mycobacterium avium subsp. paratuberculosis
aucgccgccaucgccgccgc

SEQ ID NO: 988807 - RNA, 18 nt, Mycobacterium avium subsp. paratuberculosis
aucgccgacgccagcacg

SEQ ID NO: 988808 - RNA, 18 nt, Mycobacterium avium subsp. paratuberculosis
aucgccgacggugagcac

SEQ ID NO: 988809 - RNA, 17 nt, Mycobacterium avium subsp. paratuberculosis
aucgcuacaccccaccg

SEQ ID NO: 988810 - RNA, 21 nt, Mycobacterium avium subsp. paratuberculosis
aucgcggccagcgugaacacc

SEQ ID NO: 988811 - RNA, 23 nt, Mycobacterium avium subsp. paratuberculosis
aucgcggcccccugaucggccgc

SEQ ID NO: 988812 - RNA, 15 nt, Mycobacterium avium subsp. paratuberculosis
aucgcggccgcccgg

SEQ ID NO: 988813 - RNA, 17 nt, Mycobacterium avium subsp. paratuberculosis
aucgcggccgcccgguc

SEQ ID NO: 988814 - RNA, 13 nt, Mycobacterium avium subsp. paratuberculosis
aucccgucggcca

SEQ ID NO: 988815 - RNA, 14 nt, Mycobacterium avium subsp. paratuberculosis
aucccgucggccau

SEQ ID NO: 988816 - RNA, 17 nt, Mycobacterium avium subsp. paratuberculosis
aucccggggcgcgcugg

SEQ ID NO: 988817 - RNA, 15 nt, Mycobacterium avium subsp. paratuberculosis
aucccuugccgccga

SEQ ID NO: 988818 - RNA, 20 nt, Mycobacterium avium subsp. paratuberculosis
auccgcaggccgucgccggu

SEQ ID NO: 988819 - RNA, 15 nt, Mycobacterium avium subsp. paratuberculosis
auccgacaccgccuu

SEQ ID NO: 988820 - RNA, 15 nt, Mycobacterium avium subsp. paratuberculosis
auccgagcgcugccc

SEQ ID NO: 988821 - RNA, 22 nt, Mycobacterium avium subsp. paratuberculosis
auccgaucagcagcaccuggau

SEQ ID NO: 988822 - RNA, 21 nt, Mycobacterium avium subsp. paratuberculosis
auccgaucgcggcccccugau

SEQ ID NO: 988823 - RNA, 23 nt, Mycobacterium avium subsp. paratuberculosis
aucccagcgggacagcaccacca

SEQ ID NO: 988824 - RNA, 20 nt, Mycobacterium avium subsp. paratuberculosis
auccccgcagcucccccggc

SEQ ID NO: 988825 - RNA, 23 nt, Mycobacterium avium subsp. paratuberculosis
aucccggccacgucgaugccgaa

SEQ ID NO: 988826 - RNA, 22 nt, Mycobacterium avium subsp. paratuberculosis
aucccgcgggucgcggcccacc

SEQ ID NO: 988827 - RNA, 23 nt, Mycobacterium avium subsp. paratuberculosis
aucccgccgaacccgcccucgcc

SEQ ID NO: 988828 - RNA, 17 nt, Mycobacterium avium subsp. paratuberculosis
auccauucgguuucccc

SEQ ID NO: 988829 - RNA, 17 nt, Mycobacterium avium subsp. paratuberculosis
auccaggugaacagcag

SEQ ID NO: 988830 - RNA, 17 nt, Mycobacterium avium subsp. paratuberculosis
auccagguacugggcgu

SEQ ID NO: 988831 - RNA, 19 nt, Mycobacterium avium subsp. paratuberculosis
aucauuugaccgcacaugc

SEQ ID NO: 988832 - RNA, 16 nt, Mycobacterium avium subsp. paratuberculosis
auccaaggagaaggcc

SEQ ID NO: 988833 - RNA, 17 nt, Mycobacterium avium subsp. paratuberculosis
auccaaggagaaggccg

SEQ ID NO: 988834 - RNA, 16 nt, Mycobacterium avium subsp. paratuberculosis
auccagaacagccagu

SEQ ID NO: 988835 - RNA, 17 nt, Mycobacterium avium subsp. paratuberculosis
auccagcgccgccaacc

SEQ ID NO: 988836 - RNA, 16 nt, Mycobacterium avium subsp. paratuberculosis
auccaccgcgcggcca

SEQ ID NO: 988837 - RNA, 16 nt, Mycobacterium avium subsp. paratuberculosis
aucuuccaucacgccc

SEQ ID NO: 988838 - RNA, 13 nt, Mycobacterium avium subsp. paratuberculosis
aucugggccagga

SEQ ID NO: 988839 - RNA, 16 nt, Mycobacterium avium subsp. paratuberculosis
aucuccaccgagugcg

SEQ ID NO: 988840 - RNA, 16 nt, Mycobacterium avium subsp. paratuberculosis
aucucgauggccacgc

SEQ ID NO: 988841 - RNA, 18 nt, Mycobacterium avium subsp. paratuberculosis
aucucgauggccucgucg

SEQ ID NO: 988842 - RNA, 19 nt, Mycobacterium avium subsp. paratuberculosis
aucucgacccgggccaggu

SEQ ID NO: 988843 - RNA, 13 nt, Mycobacterium avium subsp. paratuberculosis
aucucgcgccgcg

SEQ ID NO: 988844 - RNA, 15 nt, Mycobacterium avium subsp. paratuberculosis
aucucgccgagcaca

SEQ ID NO: 988845 - RNA, 21 nt, Mycobacterium avium subsp. paratuberculosis
aucucuuucgauuucgccugc

SEQ ID NO: 988846 - RNA, 16 nt, Mycobacterium avium subsp. paratuberculosis
augacguuggugaucg

SEQ ID NO: 988847 - RNA, 16 nt, Mycobacterium avium subsp. paratuberculosis
augaacaugcccugca

SEQ ID NO: 988848 - RNA, 17 nt, Mycobacterium avium subsp. paratuberculosis
augaaccgcugcugcuc

SEQ ID NO: 988849 - RNA, 18 nt, Mycobacterium avium subsp. paratuberculosis
augaaccacugcggcaga

SEQ ID NO: 988850 - RNA, 23 nt, Mycobacterium avium subsp. paratuberculosis
augaacgccucgagcgcccgggc

SEQ ID NO: 988851 - RNA, 14 nt, Mycobacterium avium subsp. paratuberculosis
augaacgcggccag

SEQ ID NO: 988852 - RNA, 22 nt, Mycobacterium avium subsp. paratuberculosis
augaacuccgacuccagcagcg

SEQ ID NO: 988853 - RNA, 14 nt, Mycobacterium avium subsp. paratuberculosis
augaacugccgcgg

SEQ ID NO: 988854 - RNA, 18 nt, Mycobacterium avium subsp. paratuberculosis
augaagccgugcccgcgg

SEQ ID NO: 988855 - RNA, 19 nt, Mycobacterium avium subsp. paratuberculosis
augaauccgcgcagcagcg

SEQ ID NO: 988856 - RNA, 21 nt, Mycobacterium avium subsp. paratuberculosis
aucuucgccuccgggaaggcg

SEQ ID NO: 988857 - RNA, 14 nt, Mycobacterium avium subsp. paratuberculosis
auguugcggccggc

SEQ ID NO: 988858 - RNA, 23 nt, Mycobacterium avium subsp. paratuberculosis
auguugcggcggccggccagcag

SEQ ID NO: 988859 - RNA, 16 nt, Mycobacterium avium subsp. paratuberculosis
auguccuccugcgccg

SEQ ID NO: 988860 - RNA, 19 nt, Mycobacterium avium subsp. paratuberculosis
auguccuuggugaugucgg

SEQ ID NO: 988861 - RNA, 22 nt, Mycobacterium avium subsp. paratuberculosis
auguccggcaggcucagcagca

SEQ ID NO: 988862 - RNA, 13 nt, Mycobacterium avium subsp. paratuberculosis
auucaggccacgc

SEQ ID NO: 988863 - RNA, 14 nt, Mycobacterium avium subsp. paratuberculosis
auucacgcagcugg

SEQ ID NO: 988864 - RNA, 21 nt, Mycobacterium avium subsp. paratuberculosis
aaaagauguaucaggaucugc

SEQ ID NO: 988865 - RNA, 15 nt, Mycobacterium avium subsp. paratuberculosis
auguccacucgaugu

SEQ ID NO: 988866 - RNA, 16 nt, Mycobacterium avium subsp. paratuberculosis
augucacgguccaggu

SEQ ID NO: 988867 - RNA, 18 nt, Mycobacterium avium subsp. paratuberculosis
augucacgguccaggucc

SEQ ID NO: 988868 - RNA, 21 nt, Mycobacterium avium subsp. paratuberculosis
auguagcggcggucggcgccg

SEQ ID NO: 988869 - RNA, 12 nt, Mycobacterium avium subsp. paratuberculosis
auguaggacagg

SEQ ID NO: 988870 - RNA, 13 nt, Mycobacterium avium subsp. paratuberculosis
auggucaccgugu

SEQ ID NO: 988871 - RNA, 13 nt, Mycobacterium avium subsp. paratuberculosis
auggucagcugcc

SEQ ID NO: 988872 - RNA, 13 nt, Mycobacterium avium subsp. paratuberculosis
auggucuggauga

SEQ ID NO: 988873 - RNA, 16 nt, Mycobacterium avium subsp. paratuberculosis
auggucuugccgcuga

SEQ ID NO: 988874 - RNA, 22 nt, Mycobacterium avium subsp. paratuberculosis
auggucgucggguuggccaggg

SEQ ID NO: 988875 - RNA, 23 nt, Mycobacterium avium subsp. paratuberculosis
auggucgucggguuggccagggc

SEQ ID NO: 988876 - RNA, 22 nt, Mycobacterium avium subsp. paratuberculosis
auggucgucguggugacgggcg

SEQ ID NO: 988877 - RNA, 22 nt, Mycobacterium avium subsp. paratuberculosis
auggucgggacgucggcgcgcu

SEQ ID NO: 988878 - RNA, 15 nt, Mycobacterium avium subsp. paratuberculosis
auggugaagccgugc

SEQ ID NO: 988879 - RNA, 14 nt, Mycobacterium avium subsp. paratuberculosis
augguuuccacugc

SEQ ID NO: 988880 - RNA, 21 nt, Mycobacterium avium subsp. paratuberculosis
augggguugaccuugaccagc

SEQ ID NO: 988881 - RNA, 11 nt, Mycobacterium avium subsp. paratuberculosis
augggccaggu

SEQ ID NO: 988882 - RNA, 15 nt, Mycobacterium avium subsp. paratuberculosis
auggcgguguggaga

SEQ ID NO: 988883 - RNA, 14 nt, Mycobacterium avium subsp. paratuberculosis
auggcgggcgcgcc

SEQ ID NO: 988884 - RNA, 14 nt, Mycobacterium avium subsp. paratuberculosis
auggcggcggcugc

SEQ ID NO: 988885 - RNA, 23 nt, Mycobacterium avium subsp. paratuberculosis
augcuggugacgccgcuguccuc

SEQ ID NO: 988886 - RNA, 20 nt, Mycobacterium avium subsp. paratuberculosis
augcugagcgggucggccgg

SEQ ID NO: 988887 - RNA, 19 nt, Mycobacterium avium subsp. paratuberculosis
auggccugguggcccaggc

SEQ ID NO: 988888 - RNA, 18 nt, Mycobacterium avium subsp. paratuberculosis
auggcgaaguucggcauc

SEQ ID NO: 988889 - RNA, 23 nt, Mycobacterium avium subsp. paratuberculosis
auggcgacggucugccgggacag

SEQ ID NO: 988890 - RNA, 13 nt, Mycobacterium avium subsp. paratuberculosis
auggcgcccagcc

SEQ ID NO: 988891 - RNA, 13 nt, Mycobacterium avium subsp. paratuberculosis
auggcgcagaaca

SEQ ID NO: 988892 - RNA, 13 nt, Mycobacterium avium subsp. paratuberculosis
auggccaggaacg

SEQ ID NO: 988893 - RNA, 18 nt, Mycobacterium avium subsp. paratuberculosis
auggccucgucgcggaac

SEQ ID NO: 988894 - RNA, 15 nt, Mycobacterium avium subsp. paratuberculosis
augcguucggccagu

SEQ ID NO: 988895 - RNA, 17 nt, Mycobacterium avium subsp. paratuberculosis
augcuauucgggccagc

SEQ ID NO: 988896 - RNA, 11 nt, Mycobacterium avium subsp. paratuberculosis
augcucuugcg

SEQ ID NO: 988897 - RNA, 14 nt, Mycobacterium avium subsp. paratuberculosis
augcucaggaugau

SEQ ID NO: 988898 - RNA, 14 nt, Mycobacterium avium subsp. paratuberculosis
augcgcaccaucac

SEQ ID NO: 988899 - RNA, 22 nt, Mycobacterium avium subsp. paratuberculosis
augcgcacgucggccgccaggg

SEQ ID NO: 988900 - RNA, 23 nt, Mycobacterium avium subsp. paratuberculosis
augcgcugcuuagccccucccac

SEQ ID NO: 988901 - RNA, 12 nt, Mycobacterium avium subsp. paratuberculosis
augcggcaccag

SEQ ID NO: 988902 - RNA, 13 nt, Mycobacterium avium subsp. paratuberculosis
augcguuccaggu

SEQ ID NO: 988903 - RNA, 18 nt, Mycobacterium avium subsp. paratuberculosis
augcggugccgggugcug

SEQ ID NO: 988904 - RNA, 13 nt, Mycobacterium avium subsp. paratuberculosis
augcggugguggg

SEQ ID NO: 988905 - RNA, 23 nt, Mycobacterium avium subsp. paratuberculosis
augcggcccagcccggccagcac

SEQ ID NO: 988906 - RNA, 13 nt, Mycobacterium avium subsp. paratuberculosis
augcggcucccac

SEQ ID NO: 988907 - RNA, 22 nt, Mycobacterium avium subsp. paratuberculosis
augcggcugccggccaaggcaa

SEQ ID NO: 988908 - RNA, 12 nt, Mycobacterium avium subsp. paratuberculosis
augcggcugggu

SEQ ID NO: 988909 - RNA, 18 nt, Mycobacterium avium subsp. paratuberculosis
augcgguccucgagcugg

SEQ ID NO: 988910 - RNA, 20 nt, Mycobacterium avium subsp. paratuberculosis
augcggucgaugagcuggug

SEQ ID NO: 988911 - RNA, 17 nt, Mycobacterium avium subsp. paratuberculosis
augccagacgaacgcgg

SEQ ID NO: 988912 - RNA, 15 nt, Mycobacterium avium subsp. paratuberculosis
augccagcagguccg

SEQ ID NO: 988913 - RNA, 22 nt, Mycobacterium avium subsp. paratuberculosis
augcccagcaguccggcgguca

SEQ ID NO: 988914 - RNA, 20 nt, Mycobacterium avium subsp. paratuberculosis
augcccagcggguaguucuu

SEQ ID NO: 988915 - RNA, 16 nt, Mycobacterium avium subsp. paratuberculosis
augcccaggcccacca

SEQ ID NO: 988916 - RNA, 21 nt, Mycobacterium avium subsp. paratuberculosis
augcccaggcccaccagcugg

SEQ ID NO: 988917 - RNA, 16 nt, Mycobacterium avium subsp. paratuberculosis
augccaguccugggcc

SEQ ID NO: 988918 - RNA, 21 nt, Mycobacterium avium subsp. paratuberculosis
augcccgccccggacauccau

SEQ ID NO: 988919 - RNA, 18 nt, Mycobacterium avium subsp. paratuberculosis
augcccgccacggccagc

SEQ ID NO: 988920 - RNA, 9 nt, Mycobacterium avium subsp. paratuberculosis
augcccgua

SEQ ID NO: 988921 - RNA, 17 nt, Mycobacterium avium subsp. paratuberculosis
augcccgugaucgccac

SEQ ID NO: 988922 - RNA, 16 nt, Mycobacterium avium subsp. paratuberculosis
augccguagaccagca

SEQ ID NO: 988923 - RNA, 17 nt, Mycobacterium avium subsp. paratuberculosis
augccguagcgcaugau

SEQ ID NO: 988924 - RNA, 15 nt, Mycobacterium avium subsp. paratuberculosis
augccgguacggccg

SEQ ID NO: 988925 - RNA, 22 nt, Mycobacterium avium subsp. paratuberculosis
augccggucauccgggccacca

SEQ ID NO: 988926 - RNA, 20 nt, Mycobacterium avium subsp. paratuberculosis
augccggaucgggaccggga

SEQ ID NO: 988927 - RNA, 19 nt, Mycobacterium avium subsp. paratuberculosis
augccggccagcggccagc

SEQ ID NO: 988928 - RNA, 19 nt, Mycobacterium avium subsp. paratuberculosis
augccgggcaaccacagcg

SEQ ID NO: 988929 - RNA, 13 nt, Mycobacterium avium subsp. paratuberculosis
augccgggccagc

SEQ ID NO: 988930 - RNA, 14 nt, Mycobacterium avium subsp. paratuberculosis
augccggccaggca

SEQ ID NO: 988931 - RNA, 17 nt, Mycobacterium avium subsp. paratuberculosis
augccggggcagcaccc

SEQ ID NO: 988932 - RNA, 22 nt, Mycobacterium avium subsp. paratuberculosis
augccggcgguguccacgaugc

SEQ ID NO: 988933 - RNA, 22 nt, Mycobacterium avium subsp. paratuberculosis
augcacgaucucccaacgcagc

SEQ ID NO: 988934 - RNA, 14 nt, Mycobacterium avium subsp. paratuberculosis
augcacggcgcugg

SEQ ID NO: 988935 - RNA, 15 nt, Mycobacterium avium subsp. paratuberculosis
augcacggucggccc

SEQ ID NO: 988936 - RNA, 13 nt, Mycobacterium avium subsp. paratuberculosis
augcagugguuga

SEQ ID NO: 988937 - RNA, 19 nt, Mycobacterium avium subsp. paratuberculosis
auugaacgccgccaacagg

SEQ ID NO: 988938 - RNA, 17 nt, Mycobacterium avium subsp. paratuberculosis
auucgaucaaaucccgc

SEQ ID NO: 988939 - RNA, 22 nt, Mycobacterium avium subsp. paratuberculosis
auucggguggcgucgccgccgg

SEQ ID NO: 988940 - RNA, 23 nt, Mycobacterium avium subsp. paratuberculosis
auucgguaccagggcagcgccuc

SEQ ID NO: 988941 - RNA, 11 nt, Mycobacterium avium subsp. paratuberculosis
auucggcgccg

SEQ ID NO: 988942 - RNA, 21 nt, Mycobacterium avium subsp. paratuberculosis
auucggagaccaggucggccu

SEQ ID NO: 988943 - RNA, 17 nt, Mycobacterium avium subsp. paratuberculosis
auuccagaucugucuuc

SEQ ID NO: 988944 - RNA, 10 nt, Mycobacterium avium subsp. paratuberculosis
auuccagcaa

SEQ ID NO: 988945 - RNA, 14 nt, Mycobacterium avium subsp. paratuberculosis
auuccgccagaacg

SEQ ID NO: 988946 - RNA, 22 nt, Mycobacterium avium subsp. paratuberculosis
auuccggggaaccgcccuucca

SEQ ID NO: 988947 - RNA, 20 nt, Mycobacterium avium subsp. paratuberculosis
auuccggcacccgccagccc

SEQ ID NO: 988948 - RNA, 13 nt, Mycobacterium avium subsp. paratuberculosis
auugcgccagcag

SEQ ID NO: 988949 - RNA, 16 nt, Mycobacterium avium subsp. paratuberculosis
auugcgcugcaccgca

SEQ ID NO: 988950 - RNA, 14 nt, Mycobacterium avium subsp. paratuberculosis
auugcgcggcgccg

SEQ ID NO: 988951 - RNA, 17 nt, Mycobacterium avium subsp. paratuberculosis
auuggccgagccgggcg

SEQ ID NO: 988952 - RNA, 22 nt, Mycobacterium avium subsp. paratuberculosis
auuggccgcgcgcaggcgcuga

SEQ ID NO: 988953 - RNA, 14 nt, Mycobacterium avium subsp. paratuberculosis
auuggacgacacca

SEQ ID NO: 988954 - RNA, 16 nt, Mycobacterium avium subsp. paratuberculosis
caaaaacgagaugccc

SEQ ID NO: 988955 - RNA, 18 nt, Mycobacterium avium subsp. paratuberculosis
auuugccgacaugcuggg

SEQ ID NO: 988956 - RNA, 12 nt, Mycobacterium avium subsp. paratuberculosis
auuucagcagcg

SEQ ID NO: 988957 - RNA, 17 nt, Mycobacterium avium subsp. paratuberculosis
auuucaaggggccgggc

SEQ ID NO: 988958 - RNA, 16 nt, Mycobacterium avium subsp. paratuberculosis
auuucaagguggacga

SEQ ID NO: 988959 - RNA, 17 nt, Mycobacterium avium subsp. paratuberculosis
auuuccagguccgggaa

SEQ ID NO: 988960 - RNA, 20 nt, Mycobacterium avium subsp. paratuberculosis
cacguccccgugcagccggg

SEQ ID NO: 988961 - RNA, 23 nt, Mycobacterium avium subsp. paratuberculosis
cacguccccgugcagccgggccu

SEQ ID NO: 988962 - RNA, 19 nt, Mycobacterium avium subsp. paratuberculosis
cacgucgagcuccucggcc

SEQ ID NO: 988963 - RNA, 17 nt, Mycobacterium avium subsp. paratuberculosis
cacguccgccuccgacc

SEQ ID NO: 988964 - RNA, 18 nt, Mycobacterium avium subsp. paratuberculosis
cacguccgccuccgacca

SEQ ID NO: 988965 - RNA, 19 nt, Mycobacterium avium subsp. paratuberculosis
cacguccggaugcggcgcc

SEQ ID NO: 988966 - RNA, 14 nt, Mycobacterium avium subsp. paratuberculosis
cacgucacgggcca

SEQ ID NO: 988967 - RNA, 17 nt, Mycobacterium avium subsp. paratuberculosis
cacgucacgggccaggc

SEQ ID NO: 988968 - RNA, 17 nt, Mycobacterium avium subsp. paratuberculosis
cacguccagcugggcug

SEQ ID NO: 988969 - RNA, 18 nt, Mycobacterium avium subsp. paratuberculosis
cacguccagcugggcugc

SEQ ID NO: 988970 - RNA, 16 nt, Mycobacterium avium subsp. paratuberculosis
cacgguuggccggccc

SEQ ID NO: 988971 - RNA, 14 nt, Mycobacterium avium subsp. paratuberculosis
cacguagaaggcgc

SEQ ID NO: 988972 - RNA, 14 nt, Mycobacterium avium subsp. paratuberculosis
cacguaguccgacg

SEQ ID NO: 988973 - RNA, 21 nt, Mycobacterium avium subsp. paratuberculosis
cacguaggcgaucagcgcgca

SEQ ID NO: 988974 - RNA, 17 nt, Mycobacterium avium subsp. paratuberculosis
cacguagcgguccagcg

SEQ ID NO: 988975 - RNA, 14 nt, Mycobacterium avium subsp. paratuberculosis
cacguagcccagcg

SEQ ID NO: 988976 - RNA, 19 nt, Mycobacterium avium subsp. paratuberculosis
cacggucgccgcgccgccg

SEQ ID NO: 988977 - RNA, 20 nt, Mycobacterium avium subsp. paratuberculosis
cacggucggcguccagcgcg

SEQ ID NO: 988978 - RNA, 22 nt, Mycobacterium avium subsp. paratuberculosis
cacggugaacuccgggcccacc

SEQ ID NO: 988979 - RNA, 23 nt, Mycobacterium avium subsp. paratuberculosis
cacggugcgggugccgaacacgu

SEQ ID NO: 988980 - RNA, 23 nt, Mycobacterium avium subsp. paratuberculosis
cacggugaucagcagcagguccu

SEQ ID NO: 988981 - RNA, 17 nt, Mycobacterium avium subsp. paratuberculosis
cacggugaucagcagca

SEQ ID NO: 988982 - RNA, 14 nt, Mycobacterium avium subsp. paratuberculosis
cacgguggccgcca

SEQ ID NO: 988983 - RNA, 23 nt, Mycobacterium avium subsp. paratuberculosis
cacgguguagacgcgggccggca

SEQ ID NO: 988984 - RNA, 19 nt, Mycobacterium avium subsp. paratuberculosis
cacgguguagcggcggcug

SEQ ID NO: 988985 - RNA, 15 nt, Mycobacterium avium subsp. paratuberculosis
cacgguccagguccu

SEQ ID NO: 988986 - RNA, 21 nt, Mycobacterium avium subsp. paratuberculosis
cacggucaggcgcagccagcg

SEQ ID NO: 988987 - RNA, 16 nt, Mycobacterium avium subsp. paratuberculosis
cacgguccccgcgccc

SEQ ID NO: 988988 - RNA, 17 nt, Mycobacterium avium subsp. paratuberculosis
cacgguccccgcgcccg

SEQ ID NO: 988989 - RNA, 15 nt, Mycobacterium avium subsp. paratuberculosis
cacggucagcggcca

SEQ ID NO: 988990 - RNA, 17 nt, Mycobacterium avium subsp. paratuberculosis
cacggucagcucgcgcc

SEQ ID NO: 988991 - RNA, 16 nt, Mycobacterium avium subsp. paratuberculosis
cacggucacagccgcg

SEQ ID NO: 988992 - RNA, 17 nt, Mycobacterium avium subsp. paratuberculosis
cacgcugggcuccgacc

SEQ ID NO: 988993 - RNA, 20 nt, Mycobacterium avium subsp. paratuberculosis
cacgcugucggggucgcggc

SEQ ID NO: 988994 - RNA, 18 nt, Mycobacterium avium subsp. paratuberculosis
cacgcuguagggccacca

SEQ ID NO: 988995 - RNA, 19 nt, Mycobacterium avium subsp. paratuberculosis
cacgcuguagggccaccac

SEQ ID NO: 988996 - RNA, 17 nt, Mycobacterium avium subsp. paratuberculosis
cacgcuggugugacgcu

SEQ ID NO: 988997 - RNA, 15 nt, Mycobacterium avium subsp. paratuberculosis
cacgcuuccgugcuu

SEQ ID NO: 988998 - RNA, 20 nt, Mycobacterium avium subsp. paratuberculosis
cacgcuuccgugcuugcccg

SEQ ID NO: 988999 - RNA, 16 nt, Mycobacterium avium subsp. paratuberculosis
cacgcugaagcacacc

SEQ ID NO: 989000 - RNA, 16 nt, Mycobacterium avium subsp. paratuberculosis
cacgcucucgccgguc

SEQ ID NO: 989001 - RNA, 16 nt, Mycobacterium avium subsp. paratuberculosis
cacgcucggcaggcgg

SEQ ID NO: 989002 - RNA, 17 nt, Mycobacterium avium subsp. paratuberculosis
cacgcucggcgagugcg

SEQ ID NO: 989003 - RNA, 15 nt, Mycobacterium avium subsp. paratuberculosis
cacgcucggcgcgcg

SEQ ID NO: 989004 - RNA, 16 nt, Mycobacterium avium subsp. paratuberculosis
cacgcucggcggcgcg

SEQ ID NO: 989005 - RNA, 18 nt, Mycobacterium avium subsp. paratuberculosis
cacgcucgggccggcgcc

SEQ ID NO: 989006 - RNA, 20 nt, Mycobacterium avium subsp. paratuberculosis
cacgccggcgaucuccaccg

SEQ ID NO: 989007 - RNA, 19 nt, Mycobacterium avium subsp. paratuberculosis
cacgccgggcauccgcccg

SEQ ID NO: 989008 - RNA, 14 nt, Mycobacterium avium subsp. paratuberculosis
cacgccggcggcca

SEQ ID NO: 989009 - RNA, 13 nt, Mycobacterium avium subsp. paratuberculosis
cacgccggggccc

SEQ ID NO: 989010 - RNA, 22 nt, Mycobacterium avium subsp. paratuberculosis
cacgccgggguagaggccgcgg

SEQ ID NO: 989011 - RNA, 22 nt, Mycobacterium avium subsp. paratuberculosis
cacgccggguugggcggcggcc

SEQ ID NO: 989012 - RNA, 14 nt, Mycobacterium avium subsp. paratuberculosis
cacgcucgccagac

SEQ ID NO: 989013 - RNA, 14 nt, Mycobacterium avium subsp. paratuberculosis
cacgcucgcgugcg

SEQ ID NO: 989014 - RNA, 18 nt, Mycobacterium avium subsp. paratuberculosis
cacggcucgggggccgcu

SEQ ID NO: 989015 - RNA, 20 nt, Mycobacterium avium subsp. paratuberculosis
cacggcucgggggccgcucc

SEQ ID NO: 989016 - RNA, 14 nt, Mycobacterium avium subsp. paratuberculosis
cacggcugcacccu

SEQ ID NO: 989017 - RNA, 20 nt, Mycobacterium avium subsp. paratuberculosis
cacggcggggucaagcggca

SEQ ID NO: 989018 - RNA, 14 nt, Mycobacterium avium subsp. paratuberculosis
cacggcggcgugca

SEQ ID NO: 989019 - RNA, 20 nt, Mycobacterium avium subsp. paratuberculosis
cacggcggcgaacgccgccg

SEQ ID NO: 989020 - RNA, 12 nt, Mycobacterium avium subsp. paratuberculosis
cacggcggcgcg

SEQ ID NO: 989021 - RNA, 14 nt, Mycobacterium avium subsp. paratuberculosis
cacggcggcgcgca

SEQ ID NO: 989022 - RNA, 12 nt, Mycobacterium avium subsp. paratuberculosis
cacggccgccag

SEQ ID NO: 989023 - RNA, 14 nt, Mycobacterium avium subsp. paratuberculosis
cacggccgccagga

SEQ ID NO: 989024 - RNA, 17 nt, Mycobacterium avium subsp. paratuberculosis
cacggccgccuccagca

SEQ ID NO: 989025 - RNA, 18 nt, Mycobacterium avium subsp. paratuberculosis
cacggccgcggcccggcc

SEQ ID NO: 989026 - RNA, 14 nt, Mycobacterium avium subsp. paratuberculosis
cacggcccgcgccc

SEQ ID NO: 989027 - RNA, 16 nt, Mycobacterium avium subsp. paratuberculosis
cacggccacugccccg

SEQ ID NO: 989028 - RNA, 19 nt, Mycobacterium avium subsp. paratuberculosis
cacggccagccagccgccc

SEQ ID NO: 989029 - RNA, 18 nt, Mycobacterium avium subsp. paratuberculosis
cacggccccagccgccgc

SEQ ID NO: 989030 - RNA, 21 nt, Mycobacterium avium subsp. paratuberculosis
cacggccaacugcaucgccag

SEQ ID NO: 989031 - RNA, 13 nt, Mycobacterium avium subsp. paratuberculosis
cacggccacaacg

SEQ ID NO: 989032 - RNA, 12 nt, Mycobacterium avium subsp. paratuberculosis
cacggccaccgc

SEQ ID NO: 989033 - RNA, 16 nt, Mycobacterium avium subsp. paratuberculosis
cacggcagcugcagcg

SEQ ID NO: 989034 - RNA, 22 nt, Mycobacterium avium subsp. paratuberculosis
cacgacgaccgcgacggcgccc

SEQ ID NO: 989035 - RNA, 16 nt, Mycobacterium avium subsp. paratuberculosis
cacgacgaacaccacc

SEQ ID NO: 989036 - RNA, 17 nt, Mycobacterium avium subsp. paratuberculosis
cacgaccuggcgggcca

SEQ ID NO: 989037 - RNA, 20 nt, Mycobacterium avium subsp. paratuberculosis
cacgacggucacggccgcca

SEQ ID NO: 989038 - RNA, 21 nt, Mycobacterium avium subsp. paratuberculosis
cacgacgcgccacgccccggc

SEQ ID NO: 989039 - RNA, 16 nt, Mycobacterium avium subsp. paratuberculosis
cacgacgcggcgcgcg

SEQ ID NO: 989040 - RNA, 23 nt, Mycobacterium avium subsp. paratuberculosis
cacgacgucugggccgccgagca

SEQ ID NO: 989041 - RNA, 12 nt, Mycobacterium avium subsp. paratuberculosis
cacgaacggcac

SEQ ID NO: 989042 - RNA, 21 nt, Mycobacterium avium subsp. paratuberculosis
cacgaacggcacguugcccag

SEQ ID NO: 989043 - RNA, 12 nt, Mycobacterium avium subsp. paratuberculosis
cacgaacggcgc

SEQ ID NO: 989044 - RNA, 14 nt, Mycobacterium avium subsp. paratuberculosis
cacgaacgcggcca

SEQ ID NO: 989045 - RNA, 17 nt, Mycobacterium avium subsp. paratuberculosis
cacgaacgcggccgcca

SEQ ID NO: 989046 - RNA, 19 nt, Mycobacterium avium subsp. paratuberculosis
cacgaacgcggccgccauc

SEQ ID NO: 989047 - RNA, 21 nt, Mycobacterium avium subsp. paratuberculosis
cacgaccgggucugccacgcc

SEQ ID NO: 989048 - RNA, 16 nt, Mycobacterium avium subsp. paratuberculosis
cacgaccccggcggca

SEQ ID NO: 989049 - RNA, 14 nt, Mycobacterium avium subsp. paratuberculosis
cacgaaguugaucg

SEQ ID NO: 989050 - RNA, 22 nt, Mycobacterium avium subsp. paratuberculosis
cacgaaguugguguccacccgc

SEQ ID NO: 989051 - RNA, 20 nt, Mycobacterium avium subsp. paratuberculosis
caccugcgguucgucgcggc

SEQ ID NO: 989052 - RNA, 23 nt, Mycobacterium avium subsp. paratuberculosis
caccugcgguucgucgcggcggc

SEQ ID NO: 989053 - RNA, 16 nt, Mycobacterium avium subsp. paratuberculosis
caccugcgugccuugc

SEQ ID NO: 989054 - RNA, 12 nt, Mycobacterium avium subsp. paratuberculosis
caccuucugcgc

SEQ ID NO: 989055 - RNA, 16 nt, Mycobacterium avium subsp. paratuberculosis
caccuucugcgcgccg

SEQ ID NO: 989056 - RNA, 18 nt, Mycobacterium avium subsp. paratuberculosis
caccuucugcgcgccguc

SEQ ID NO: 989057 - RNA, 20 nt, Mycobacterium avium subsp. paratuberculosis
caccugccgcaacgggccgc

SEQ ID NO: 989058 - RNA, 22 nt, Mycobacterium avium subsp. paratuberculosis
caccugccgcaacgggccgcag

SEQ ID NO: 989059 - RNA, 23 nt, Mycobacterium avium subsp. paratuberculosis
caccugccgcacaccgucuccca

SEQ ID NO: 989060 - RNA, 17 nt, Mycobacterium avium subsp. paratuberculosis
caccugcggcaccucgg

SEQ ID NO: 989061 - RNA, 20 nt, Mycobacterium avium subsp. paratuberculosis
caccugcggcaccucggccu

SEQ ID NO: 989062 - RNA, 23 nt, Mycobacterium avium subsp. paratuberculosis
caccugcggcaggucggccagcg

SEQ ID NO: 989063 - RNA, 13 nt, Mycobacterium avium subsp. paratuberculosis
caccugcggcccc

SEQ ID NO: 989064 - RNA, 15 nt, Mycobacterium avium subsp. paratuberculosis
caccugcgcgacgcu

SEQ ID NO: 989065 - RNA, 14 nt, Mycobacterium avium subsp. paratuberculosis
cacgauccaaccga

SEQ ID NO: 989066 - RNA, 14 nt, Mycobacterium avium subsp. paratuberculosis
cacgaucaccacca

SEQ ID NO: 989067 - RNA, 22 nt, Mycobacterium avium subsp. paratuberculosis
cacgaucaccaccaccgccguc

SEQ ID NO: 989068 - RNA, 23 nt, Mycobacterium avium subsp. paratuberculosis
cacgcaguguccgaucgccuccu

SEQ ID NO: 989069 - RNA, 17 nt, Mycobacterium avium subsp. paratuberculosis
cacgcagccgcgcccga

SEQ ID NO: 989070 - RNA, 13 nt, Mycobacterium avium subsp. paratuberculosis
cacgccagccggg

SEQ ID NO: 989071 - RNA, 21 nt, Mycobacterium avium subsp. paratuberculosis
cacgccaacugguccugcggc

SEQ ID NO: 989072 - RNA, 20 nt, Mycobacterium avium subsp. paratuberculosis
cacgccaugugccggcgcuc

SEQ ID NO: 989073 - RNA, 22 nt, Mycobacterium avium subsp. paratuberculosis
cacgccagcgugacgcucgggc

SEQ ID NO: 989074 - RNA, 19 nt, Mycobacterium avium subsp. paratuberculosis
cacgccaguguggccgcgg

SEQ ID NO: 989075 - RNA, 23 nt, Mycobacterium avium subsp. paratuberculosis
cacgccaguguggccgcggcggc

SEQ ID NO: 989076 - RNA, 13 nt, Mycobacterium avium subsp. paratuberculosis
cacgcccagcccg

SEQ ID NO: 989077 - RNA, 13 nt, Mycobacterium avium subsp. paratuberculosis
cacgccccgaugg

SEQ ID NO: 989078 - RNA, 14 nt, Mycobacterium avium subsp. paratuberculosis
cacgccccggcgcc

SEQ ID NO: 989079 - RNA, 16 nt, Mycobacterium avium subsp. paratuberculosis
cacgccgccgggaaca

SEQ ID NO: 989080 - RNA, 15 nt, Mycobacterium avium subsp. paratuberculosis
cacgccgcgcccguc

SEQ ID NO: 989081 - RNA, 13 nt, Mycobacterium avium subsp. paratuberculosis
cacgccgcggaag

SEQ ID NO: 989082 - RNA, 19 nt, Mycobacterium avium subsp. paratuberculosis
cacgccgcggaaggccagc

SEQ ID NO: 989083 - RNA, 22 nt, Mycobacterium avium subsp. paratuberculosis
cacgccgcggaaggccagcucc

SEQ ID NO: 989084 - RNA, 20 nt, Mycobacterium avium subsp. paratuberculosis
cacgcccgcgaucggcgcca

SEQ ID NO: 989085 - RNA, 21 nt, Mycobacterium avium subsp. paratuberculosis
cacgccgcccaggccccggcc

SEQ ID NO: 989086 - RNA, 17 nt, Mycobacterium avium subsp. paratuberculosis
caccggcccggccggcg

SEQ ID NO: 989087 - RNA, 20 nt, Mycobacterium avium subsp. paratuberculosis
caccggcccggccggcgcga

SEQ ID NO: 989088 - RNA, 23 nt, Mycobacterium avium subsp. paratuberculosis
caccggcccggccggcgcgacca

SEQ ID NO: 989089 - RNA, 14 nt, Mycobacterium avium subsp. paratuberculosis
caccggcccggcgg

SEQ ID NO: 989090 - RNA, 15 nt, Mycobacterium avium subsp. paratuberculosis
caccggcaccgcccc

SEQ ID NO: 989091 - RNA, 16 nt, Mycobacterium avium subsp. paratuberculosis
caccggcaccgccccc

SEQ ID NO: 989092 - RNA, 14 nt, Mycobacterium avium subsp. paratuberculosis
caccggcaccgcgg

SEQ ID NO: 989093 - RNA, 13 nt, Mycobacterium avium subsp. paratuberculosis
caccggcaccacg

SEQ ID NO: 989094 - RNA, 18 nt, Mycobacterium avium subsp. paratuberculosis
caccggauucggcuccug

SEQ ID NO: 989095 - RNA, 20 nt, Mycobacterium avium subsp. paratuberculosis
caccggauucggcuccugcc

SEQ ID NO: 989096 - RNA, 14 nt, Mycobacterium avium subsp. paratuberculosis
caccgcgccgggca

SEQ ID NO: 989097 - RNA, 17 nt, Mycobacterium avium subsp. paratuberculosis
caccgcgccgggcacca

SEQ ID NO: 989098 - RNA, 19 nt, Mycobacterium avium subsp. paratuberculosis
caccgcgcgaacgcaacag

SEQ ID NO: 989099 - RNA, 22 nt, Mycobacterium avium subsp. paratuberculosis
caccgcgcgaagucccacugcc

SEQ ID NO: 989100 - RNA, 17 nt, Mycobacterium avium subsp. paratuberculosis
caccgcgcgcaccacgu

SEQ ID NO: 989101 - RNA, 12 nt, Mycobacterium avium subsp. paratuberculosis
caccgcgcgcca

SEQ ID NO: 989102 - RNA, 19 nt, Mycobacterium avium subsp. paratuberculosis
caccgcgcgcugccgcgcc

SEQ ID NO: 989103 - RNA, 12 nt, Mycobacterium avium subsp. paratuberculosis
caccgggucccc

SEQ ID NO: 989104 - RNA, 20 nt, Mycobacterium avium subsp. paratuberculosis
caccgggucccccgccgacc

SEQ ID NO: 989105 - RNA, 23 nt, Mycobacterium avium subsp. paratuberculosis
caccggucgcguugaaagccgcg

SEQ ID NO: 989106 - RNA, 20 nt, Mycobacterium avium subsp. paratuberculosis
caccggucggugcccagcac

SEQ ID NO: 989107 - RNA, 18 nt, Mycobacterium avium subsp. paratuberculosis
caccggugaacgggucaa

SEQ ID NO: 989108 - RNA, 15 nt, Mycobacterium avium subsp. paratuberculosis
caccggugcucuccu

SEQ ID NO: 989109 - RNA, 18 nt, Mycobacterium avium subsp. paratuberculosis
caccggugcucuccugcu

SEQ ID NO: 989110 - RNA, 20 nt, Mycobacterium avium subsp. paratuberculosis
caccgguggccgcgucgacc

SEQ ID NO: 989111 - RNA, 18 nt, Mycobacterium avium subsp. paratuberculosis
caccgguggcguugcggg

SEQ ID NO: 989112 - RNA, 19 nt, Mycobacterium avium subsp. paratuberculosis
caccgguuugucggcgccc

SEQ ID NO: 989113 - RNA, 17 nt, Mycobacterium avium subsp. paratuberculosis
caccggggucugcacga

SEQ ID NO: 989114 - RNA, 16 nt, Mycobacterium avium subsp. paratuberculosis
caccggggugccgccc

SEQ ID NO: 989115 - RNA, 14 nt, Mycobacterium avium subsp. paratuberculosis
caccggggccaggu

SEQ ID NO: 989116 - RNA, 13 nt, Mycobacterium avium subsp. paratuberculosis
caccgggccgcca

SEQ ID NO: 989117 - RNA, 18 nt, Mycobacterium avium subsp. paratuberculosis
caccggcgcgccguccuu

SEQ ID NO: 989118 - RNA, 16 nt, Mycobacterium avium subsp. paratuberculosis
caccgggcgucggggc

SEQ ID NO: 989119 - RNA, 19 nt, Mycobacterium avium subsp. paratuberculosis
caccgggcucggucacccc

SEQ ID NO: 989120 - RNA, 16 nt, Mycobacterium avium subsp. paratuberculosis
caccggcgccucgaug

SEQ ID NO: 989121 - RNA, 20 nt, Mycobacterium avium subsp. paratuberculosis
caccggccgcccggcgagca

SEQ ID NO: 989122 - RNA, 14 nt, Mycobacterium avium subsp. paratuberculosis
caccggccggcccc

SEQ ID NO: 989123 - RNA, 19 nt, Mycobacterium avium subsp. paratuberculosis
caccggccgguccgcccag

SEQ ID NO: 989124 - RNA, 15 nt, Mycobacterium avium subsp. paratuberculosis
caccggcgaugcaga

SEQ ID NO: 989125 - RNA, 23 nt, Mycobacterium avium subsp. paratuberculosis
caccucuucgcgguccaucucca

SEQ ID NO: 989126 - RNA, 16 nt, Mycobacterium avium subsp. paratuberculosis
caccucuucgggcagc

SEQ ID NO: 989127 - RNA, 17 nt, Mycobacterium avium subsp. paratuberculosis
caccugacgcaucacca

SEQ ID NO: 989128 - RNA, 23 nt, Mycobacterium avium subsp. paratuberculosis
caccucgucgaucuucgcggcgu

SEQ ID NO: 989129 - RNA, 18 nt, Mycobacterium avium subsp. paratuberculosis
caccucgucgcccggcgu

SEQ ID NO: 989130 - RNA, 14 nt, Mycobacterium avium subsp. paratuberculosis
caccucggugaucu

SEQ ID NO: 989131 - RNA, 15 nt, Mycobacterium avium subsp. paratuberculosis
caccucgucccagcg

SEQ ID NO: 989132 - RNA, 14 nt, Mycobacterium avium subsp. paratuberculosis
caccucggccaggu

SEQ ID NO: 989133 - RNA, 23 nt, Mycobacterium avium subsp. paratuberculosis
caccucggcgacgauggccaggc

SEQ ID NO: 989134 - RNA, 16 nt, Mycobacterium avium subsp. paratuberculosis
caccugaucgcggcga

SEQ ID NO: 989135 - RNA, 11 nt, Mycobacterium avium subsp. paratuberculosis
caccugcagcc

SEQ ID NO: 989136 - RNA, 15 nt, Mycobacterium avium subsp. paratuberculosis
caccuccuccaaagc

SEQ ID NO: 989137 - RNA, 19 nt, Mycobacterium avium subsp. paratuberculosis
caccguggucggcagcacc

SEQ ID NO: 989138 - RNA, 20 nt, Mycobacterium avium subsp. paratuberculosis
caccguggucggcagcaccg

SEQ ID NO: 989139 - RNA, 22 nt, Mycobacterium avium subsp. paratuberculosis
caccguggugacccggaccggg

SEQ ID NO: 989140 - RNA, 23 nt, Mycobacterium avium subsp. paratuberculosis
caccguggugugcccgcgggcca

SEQ ID NO: 989141 - RNA, 15 nt, Mycobacterium avium subsp. paratuberculosis
caccgugcgcgcgca

SEQ ID NO: 989142 - RNA, 23 nt, Mycobacterium avium subsp. paratuberculosis
caccguggccccacgggccaugu

SEQ ID NO: 989143 - RNA, 21 nt, Mycobacterium avium subsp. paratuberculosis
caccguggccccagccaccgu

SEQ ID NO: 989144 - RNA, 15 nt, Mycobacterium avium subsp. paratuberculosis
caccgucuucggggc

SEQ ID NO: 989145 - RNA, 22 nt, Mycobacterium avium subsp. paratuberculosis
caccgucuucggggccgccguc

SEQ ID NO: 989146 - RNA, 13 nt, Mycobacterium avium subsp. paratuberculosis
caccgugccgccc

SEQ ID NO: 989147 - RNA, 16 nt, Mycobacterium avium subsp. paratuberculosis
caccgugccgcgcggc

SEQ ID NO: 989148 - RNA, 18 nt, Mycobacterium avium subsp. paratuberculosis
caccgugaucgccaccac

SEQ ID NO: 989149 - RNA, 19 nt, Mycobacterium avium subsp. paratuberculosis
caccgugaucgccaccacc

SEQ ID NO: 989150 - RNA, 19 nt, Mycobacterium avium subsp. paratuberculosis
caccucggccagcgccgcg

SEQ ID NO: 989151 - RNA, 14 nt, Mycobacterium avium subsp. paratuberculosis
caccucgaggaacu

SEQ ID NO: 989152 - RNA, 22 nt, Mycobacterium avium subsp. paratuberculosis
caccucgcuggaaaccucuugc

SEQ ID NO: 989153 - RNA, 21 nt, Mycobacterium avium subsp. paratuberculosis
caccucggcggcaccgcccgg

SEQ ID NO: 989154 - RNA, 21 nt, Mycobacterium avium subsp. paratuberculosis
caccucgggauagccgagcgg

SEQ ID NO: 989155 - RNA, 17 nt, Mycobacterium avium subsp. paratuberculosis
caccucgggaugggcau

SEQ ID NO: 989156 - RNA, 20 nt, Mycobacterium avium subsp. paratuberculosis
caccucgggcacguccagcc

SEQ ID NO: 989157 - RNA, 23 nt, Mycobacterium avium subsp. paratuberculosis
caccucgggcacguccagcccgc

SEQ ID NO: 989158 - RNA, 23 nt, Mycobacterium avium subsp. paratuberculosis
caccucgggccgggcgggcaccc

SEQ ID NO: 989159 - RNA, 17 nt, Mycobacterium avium subsp. paratuberculosis
caccucgccgcaggcgu

SEQ ID NO: 989160 - RNA, 16 nt, Mycobacterium avium subsp. paratuberculosis
caccucgccggccgcc

SEQ ID NO: 989161 - RNA, 14 nt, Mycobacterium avium subsp. paratuberculosis
caccucgccuccag

SEQ ID NO: 989162 - RNA, 15 nt, Mycobacterium avium subsp. paratuberculosis
caccucgccuccagc

SEQ ID NO: 989163 - RNA, 16 nt, Mycobacterium avium subsp. paratuberculosis
caccucgccuccagca

SEQ ID NO: 989164 - RNA, 17 nt, Mycobacterium avium subsp. paratuberculosis
caccucgccuccagcag

SEQ ID NO: 989165 - RNA, 19 nt, Mycobacterium avium subsp. paratuberculosis
caccucgcuacgcgagcug

SEQ ID NO: 989166 - RNA, 23 nt, Mycobacterium avium subsp. paratuberculosis
caccucgcuacgcgagcugcuuc

SEQ ID NO: 989167 - RNA, 16 nt, Mycobacterium avium subsp. paratuberculosis
caccucgagcaaccgc

SEQ ID NO: 989168 - RNA, 17 nt, Mycobacterium avium subsp. paratuberculosis
caccucgagcacgcccu

SEQ ID NO: 989169 - RNA, 17 nt, Mycobacterium avium subsp. paratuberculosis
caccucgaugccgugcc

SEQ ID NO: 989170 - RNA, 14 nt, Mycobacterium avium subsp. paratuberculosis
caccucgauggguu

SEQ ID NO: 989171 - RNA, 23 nt, Mycobacterium avium subsp. paratuberculosis
caccuccucgcgggcgaucucca

SEQ ID NO: 989172 - RNA, 18 nt, Mycobacterium avium subsp. paratuberculosis
caccuccugcacccgucc

SEQ ID NO: 989173 - RNA, 17 nt, Mycobacterium avium subsp. paratuberculosis
caccucgaagggcgcca

SEQ ID NO: 989174 - RNA, 19 nt, Mycobacterium avium subsp. paratuberculosis
caccucgaagggcgccagc

SEQ ID NO: 989175 - RNA, 20 nt, Mycobacterium avium subsp. paratuberculosis
caccucgaagggcgccagcc

SEQ ID NO: 989176 - RNA, 22 nt, Mycobacterium avium subsp. paratuberculosis
caccucgaagggcgccagccgu

SEQ ID NO: 989177 - RNA, 17 nt, Mycobacterium avium subsp. paratuberculosis
caccucgaccagauccu

SEQ ID NO: 989178 - RNA, 16 nt, Mycobacterium avium subsp. paratuberculosis
caccucgaacuugacc

SEQ ID NO: 989179 - RNA, 23 nt, Mycobacterium avium subsp. paratuberculosis
caccucgaagccgaucgcggcga

SEQ ID NO: 989180 - RNA, 14 nt, Mycobacterium avium subsp. paratuberculosis
caccgaaccgcccc

SEQ ID NO: 989181 - RNA, 15 nt, Mycobacterium avium subsp. paratuberculosis
caccgaaccgccccg

SEQ ID NO: 989182 - RNA, 16 nt, Mycobacterium avium subsp. paratuberculosis
caccgaacgccagcag

SEQ ID NO: 989183 - RNA, 18 nt, Mycobacterium avium subsp. paratuberculosis
caccgaagaaccccgaga

SEQ ID NO: 989184 - RNA, 20 nt, Mycobacterium avium subsp. paratuberculosis
caccgaaucacccacggcca

SEQ ID NO: 989185 - RNA, 17 nt, Mycobacterium avium subsp. paratuberculosis
caccgaaguccgccagg

SEQ ID NO: 989186 - RNA, 19 nt, Mycobacterium avium subsp. paratuberculosis
caccgaaguccgccagggu

SEQ ID NO: 989187 - RNA, 21 nt, Mycobacterium avium subsp. paratuberculosis
caccgacaagggccgggcgcu

SEQ ID NO: 989188 - RNA, 14 nt, Mycobacterium avium subsp. paratuberculosis
caccgacaccaccg

SEQ ID NO: 989189 - RNA, 15 nt, Mycobacterium avium subsp. paratuberculosis
caccgaugcccgaca

SEQ ID NO: 989190 - RNA, 22 nt, Mycobacterium avium subsp. paratuberculosis
caccgaugcccgacaccgcccc

SEQ ID NO: 989191 - RNA, 15 nt, Mycobacterium avium subsp. paratuberculosis
caccgaugcgggcca

SEQ ID NO: 989192 - RNA, 14 nt, Mycobacterium avium subsp. paratuberculosis
caccgccaccagca

SEQ ID NO: 989193 - RNA, 16 nt, Mycobacterium avium subsp. paratuberculosis
caccgccaccgcgaac

SEQ ID NO: 989194 - RNA, 12 nt, Mycobacterium avium subsp. paratuberculosis
caccgccaccgg

SEQ ID NO: 989195 - RNA, 17 nt, Mycobacterium avium subsp. paratuberculosis
caccgccagcagcgccg

SEQ ID NO: 989196 - RNA, 17 nt, Mycobacterium avium subsp. paratuberculosis
caccgccaggaaggcca

SEQ ID NO: 989197 - RNA, 15 nt, Mycobacterium avium subsp. paratuberculosis
caccgccaggaccac

SEQ ID NO: 989198 - RNA, 16 nt, Mycobacterium avium subsp. paratuberculosis
caccgccagcgcgccg

SEQ ID NO: 989199 - RNA, 21 nt, Mycobacterium avium subsp. paratuberculosis
caccgccagcgcggcggcgcc

SEQ ID NO: 989200 - RNA, 14 nt, Mycobacterium avium subsp. paratuberculosis
caccgccaucucgg

SEQ ID NO: 989201 - RNA, 19 nt, Mycobacterium avium subsp. paratuberculosis
caccgcccccgcggcggcc

SEQ ID NO: 989202 - RNA, 13 nt, Mycobacterium avium subsp. paratuberculosis
caccgccccagcc

SEQ ID NO: 989203 - RNA, 14 nt, Mycobacterium avium subsp. paratuberculosis
caccgccgccagca

SEQ ID NO: 989204 - RNA, 15 nt, Mycobacterium avium subsp. paratuberculosis
caccgccgcaccguc

SEQ ID NO: 989205 - RNA, 22 nt, Mycobacterium avium subsp. paratuberculosis
caccgccccggucaccccggcc

SEQ ID NO: 989206 - RNA, 17 nt, Mycobacterium avium subsp. paratuberculosis
caccgccgagccgcucc

SEQ ID NO: 989207 - RNA, 17 nt, Mycobacterium avium subsp. paratuberculosis
caccgccgucccgucac

SEQ ID NO: 989208 - RNA, 19 nt, Mycobacterium avium subsp. paratuberculosis
caccgcgaucaccaccccg

SEQ ID NO: 989209 - RNA, 20 nt, Mycobacterium avium subsp. paratuberculosis
caccgcgcaaccgggccgca

SEQ ID NO: 989210 - RNA, 13 nt, Mycobacterium avium subsp. paratuberculosis
caccgcccggacc

SEQ ID NO: 989211 - RNA, 15 nt, Mycobacterium avium subsp. paratuberculosis
caccgccggccacgu

SEQ ID NO: 989212 - RNA, 14 nt, Mycobacterium avium subsp. paratuberculosis
caccgccggcccgg

SEQ ID NO: 989213 - RNA, 14 nt, Mycobacterium avium subsp. paratuberculosis
caccgccggcggcc

SEQ ID NO: 989214 - RNA, 19 nt, Mycobacterium avium subsp. paratuberculosis
cacccaaaaaggcgcgggu

SEQ ID NO: 989215 - RNA, 16 nt, Mycobacterium avium subsp. paratuberculosis
caccccggugccgcag

SEQ ID NO: 989216 - RNA, 16 nt, Mycobacterium avium subsp. paratuberculosis
cacccgaggccguuca

SEQ ID NO: 989217 - RNA, 19 nt, Mycobacterium avium subsp. paratuberculosis
cacccgauccacggcgacc

SEQ ID NO: 989218 - RNA, 17 nt, Mycobacterium avium subsp. paratuberculosis
caccccguugccgccgg

SEQ ID NO: 989219 - RNA, 17 nt, Mycobacterium avium subsp. paratuberculosis
cacccguuggcaggccc

SEQ ID NO: 989220 - RNA, 18 nt, Mycobacterium avium subsp. paratuberculosis
cacccggcggcaccgcgg

SEQ ID NO: 989221 - RNA, 19 nt, Mycobacterium avium subsp. paratuberculosis
cacccggcggcaccgcggc

SEQ ID NO: 989222 - RNA, 19 nt, Mycobacterium avium subsp. paratuberculosis
cacccuuuuccaucugggc

SEQ ID NO: 989223 - RNA, 18 nt, Mycobacterium avium subsp. paratuberculosis
cacccuccucgcggcggu

SEQ ID NO: 989224 - RNA, 15 nt, Mycobacterium avium subsp. paratuberculosis
cacccucgccgccgc

SEQ ID NO: 989225 - RNA, 16 nt, Mycobacterium avium subsp. paratuberculosis
cacccucggcccgcca

SEQ ID NO: 989226 - RNA, 18 nt, Mycobacterium avium subsp. paratuberculosis
cacccucggcgucccguc

SEQ ID NO: 989227 - RNA, 14 nt, Mycobacterium avium subsp. paratuberculosis
cacccgcuccucgc

SEQ ID NO: 989228 - RNA, 19 nt, Mycobacterium avium subsp. paratuberculosis
cacccgcugcagccggucc

SEQ ID NO: 989229 - RNA, 19 nt, Mycobacterium avium subsp. paratuberculosis
cacccggcccaccggcccg

SEQ ID NO: 989230 - RNA, 23 nt, Mycobacterium avium subsp. paratuberculosis
cacccggcccccugaggagacga

SEQ ID NO: 989231 - RNA, 18 nt, Mycobacterium avium subsp. paratuberculosis
cacccgcaacgcgcgcga

SEQ ID NO: 989232 - RNA, 17 nt, Mycobacterium avium subsp. paratuberculosis
cacccgcaacgcugacc

SEQ ID NO: 989233 - RNA, 18 nt, Mycobacterium avium subsp. paratuberculosis
cacccgcaccucgcuggc

SEQ ID NO: 989234 - RNA, 13 nt, Mycobacterium avium subsp. paratuberculosis
cacccgcgcgaca

SEQ ID NO: 989235 - RNA, 22 nt, Mycobacterium avium subsp. paratuberculosis
cacccgcgcgacaucaccgcgg

SEQ ID NO: 989236 - RNA, 19 nt, Mycobacterium avium subsp. paratuberculosis
cacccgcggaacgcucacu

SEQ ID NO: 989237 - RNA, 21 nt, Mycobacterium avium subsp. paratuberculosis
cacccgcggccgcugcgccca

SEQ ID NO: 989238 - RNA, 20 nt, Mycobacterium avium subsp. paratuberculosis
cacccgcggccggcccagcg

SEQ ID NO: 989239 - RNA, 13 nt, Mycobacterium avium subsp. paratuberculosis
cacccgcacgccc

SEQ ID NO: 989240 - RNA, 22 nt, Mycobacterium avium subsp. paratuberculosis
caccagggcguguugcaggcgg

SEQ ID NO: 989241 - RNA, 19 nt, Mycobacterium avium subsp. paratuberculosis
caccagggccgcgagcgcu

SEQ ID NO: 989242 - RNA, 17 nt, Mycobacterium avium subsp. paratuberculosis
caccaggcgccacagca

SEQ ID NO: 989243 - RNA, 17 nt, Mycobacterium avium subsp. paratuberculosis
caccaggcgcaccagcu

SEQ ID NO: 989244 - RNA, 20 nt, Mycobacterium avium subsp. paratuberculosis
caccaggccgaagacgauga

SEQ ID NO: 989245 - RNA, 17 nt, Mycobacterium avium subsp. paratuberculosis
caccaggccgacgcugg

SEQ ID NO: 989246 - RNA, 14 nt, Mycobacterium avium subsp. paratuberculosis
caccagcgcagguc

SEQ ID NO: 989247 - RNA, 15 nt, Mycobacterium avium subsp. paratuberculosis
caccagcucggcgcu

SEQ ID NO: 989248 - RNA, 14 nt, Mycobacterium avium subsp. paratuberculosis
caccagcuggaugg

SEQ ID NO: 989249 - RNA, 17 nt, Mycobacterium avium subsp. paratuberculosis
caccagcucgaggccgc

SEQ ID NO: 989250 - RNA, 23 nt, Mycobacterium avium subsp. paratuberculosis
caccagcucgaggccgcgggcgu

SEQ ID NO: 989251 - RNA, 14 nt, Mycobacterium avium subsp. paratuberculosis
caccaggagcaccu

SEQ ID NO: 989252 - RNA, 14 nt, Mycobacterium avium subsp. paratuberculosis
caccaggaaggcga

SEQ ID NO: 989253 - RNA, 13 nt, Mycobacterium avium subsp. paratuberculosis
caccaggcccagg

SEQ ID NO: 989254 - RNA, 23 nt, Mycobacterium avium subsp. paratuberculosis
caccagaccggcgaagcuaaacc

SEQ ID NO: 989255 - RNA, 19 nt, Mycobacterium avium subsp. paratuberculosis
caccacgguguagcggcgg

SEQ ID NO: 989256 - RNA, 12 nt, Mycobacterium avium subsp. paratuberculosis
caccagcccgcc

SEQ ID NO: 989257 - RNA, 16 nt, Mycobacterium avium subsp. paratuberculosis
caccagccggccggcc

SEQ ID NO: 989258 - RNA, 13 nt, Mycobacterium avium subsp. paratuberculosis
caccagcgacagc

SEQ ID NO: 989259 - RNA, 16 nt, Mycobacterium avium subsp. paratuberculosis
caccagcgacagcacc

SEQ ID NO: 989260 - RNA, 17 nt, Mycobacterium avium subsp. paratuberculosis
caccagcgacagcaccc

SEQ ID NO: 989261 - RNA, 19 nt, Mycobacterium avium subsp. paratuberculosis
caccaguuccugcaugccg

SEQ ID NO: 989262 - RNA, 17 nt, Mycobacterium avium subsp. paratuberculosis
caccagugucagggcag

SEQ ID NO: 989263 - RNA, 18 nt, Mycobacterium avium subsp. paratuberculosis
caccagugucagggcagc

SEQ ID NO: 989264 - RNA, 20 nt, Mycobacterium avium subsp. paratuberculosis
caccaguguccgggcgccca

SEQ ID NO: 989265 - RNA, 20 nt, Mycobacterium avium subsp. paratuberculosis
caccagggcgaccgccgcgu

SEQ ID NO: 989266 - RNA, 21 nt, Mycobacterium avium subsp. paratuberculosis
caccagggucucgcgcagcac

SEQ ID NO: 989267 - RNA, 22 nt, Mycobacterium avium subsp. paratuberculosis
caccagggucucgcgcagcacg

SEQ ID NO: 989268 - RNA, 20 nt, Mycobacterium avium subsp. paratuberculosis
caccagggucuucagcccgc

SEQ ID NO: 989269 - RNA, 20 nt, Mycobacterium avium subsp. paratuberculosis
caccagggugccgccgggca

SEQ ID NO: 989270 - RNA, 20 nt, Mycobacterium avium subsp. paratuberculosis
caccagggugcgcagcgcgu

SEQ ID NO: 989271 - RNA, 13 nt, Mycobacterium avium subsp. paratuberculosis
caccaggguggcc

SEQ ID NO: 989272 - RNA, 18 nt, Mycobacterium avium subsp. paratuberculosis
caccaggguggccgccac

SEQ ID NO: 989273 - RNA, 20 nt, Mycobacterium avium subsp. paratuberculosis
caccaggguggccgccacca

SEQ ID NO: 989274 - RNA, 20 nt, Mycobacterium avium subsp. paratuberculosis
caccagguaccggcgggcga

SEQ ID NO: 989275 - RNA, 16 nt, Mycobacterium avium subsp. paratuberculosis
caccaggucgcacacc

SEQ ID NO: 989276 - RNA, 17 nt, Mycobacterium avium subsp. paratuberculosis
caccaggucgcacacca

SEQ ID NO: 989277 - RNA, 12 nt, Mycobacterium avium subsp. paratuberculosis
caccaucagcgg

SEQ ID NO: 989278 - RNA, 13 nt, Mycobacterium avium subsp. paratuberculosis
caccaucagcggc

SEQ ID NO: 989279 - RNA, 14 nt, Mycobacterium avium subsp. paratuberculosis
caccauccagugca

SEQ ID NO: 989280 - RNA, 17 nt, Mycobacterium avium subsp. paratuberculosis
caccauccgcgacgcca

SEQ ID NO: 989281 - RNA, 17 nt, Mycobacterium avium subsp. paratuberculosis
caccaugaucagcgccg

SEQ ID NO: 989282 - RNA, 20 nt, Mycobacterium avium subsp. paratuberculosis
caccaugauguagcggcggu

SEQ ID NO: 989283 - RNA, 15 nt, Mycobacterium avium subsp. paratuberculosis
caccaauggcggcca

SEQ ID NO: 989284 - RNA, 15 nt, Mycobacterium avium subsp. paratuberculosis
caccaaugcgccggc

SEQ ID NO: 989285 - RNA, 22 nt, Mycobacterium avium subsp. paratuberculosis
caccaaugcgccggcggccgcg

SEQ ID NO: 989286 - RNA, 21 nt, Mycobacterium avium subsp. paratuberculosis
caccaauucgcgcugccaggg

SEQ ID NO: 989287 - RNA, 14 nt, Mycobacterium avium subsp. paratuberculosis
caccaagcgcgaca

SEQ ID NO: 989288 - RNA, 15 nt, Mycobacterium avium subsp. paratuberculosis
caccacccgcaccuc

SEQ ID NO: 989289 - RNA, 18 nt, Mycobacterium avium subsp. paratuberculosis
caccacccgguccuucuc

SEQ ID NO: 989290 - RNA, 21 nt, Mycobacterium avium subsp. paratuberculosis
caccaccauguuccagaaccg

SEQ ID NO: 989291 - RNA, 12 nt, Mycobacterium avium subsp. paratuberculosis
caccacccaggc

SEQ ID NO: 989292 - RNA, 14 nt, Mycobacterium avium subsp. paratuberculosis
caccaccgagccgg

SEQ ID NO: 989293 - RNA, 16 nt, Mycobacterium avium subsp. paratuberculosis
caccaccgacaccccg

SEQ ID NO: 989294 - RNA, 17 nt, Mycobacterium avium subsp. paratuberculosis
caccaccgacagcaccc

SEQ ID NO: 989295 - RNA, 22 nt, Mycobacterium avium subsp. paratuberculosis
caccaccgacgcgucgcggcgg

SEQ ID NO: 989296 - RNA, 14 nt, Mycobacterium avium subsp. paratuberculosis
caccaccgccaggu

SEQ ID NO: 989297 - RNA, 17 nt, Mycobacterium avium subsp. paratuberculosis
caccaccgcccacagca

SEQ ID NO: 989298 - RNA, 20 nt, Mycobacterium avium subsp. paratuberculosis
caccaccgcccacagcaacg

SEQ ID NO: 989299 - RNA, 17 nt, Mycobacterium avium subsp. paratuberculosis
caccaccgccaccagcg

SEQ ID NO: 989300 - RNA, 19 nt, Mycobacterium avium subsp. paratuberculosis
caccacgguggccgcgaag

SEQ ID NO: 989301 - RNA, 21 nt, Mycobacterium avium subsp. paratuberculosis
caccacgguggccgcgaagau

SEQ ID NO: 989302 - RNA, 19 nt, Mycobacterium avium subsp. paratuberculosis
caccacgggucggucggcc

SEQ ID NO: 989303 - RNA, 20 nt, Mycobacterium avium subsp. paratuberculosis
caccacgggucggucggccc

SEQ ID NO: 989304 - RNA, 19 nt, Mycobacterium avium subsp. paratuberculosis
caccacgguccccgcgccc

SEQ ID NO: 989305 - RNA, 19 nt, Mycobacterium avium subsp. paratuberculosis
caccacggucgccgcgccg

SEQ ID NO: 989306 - RNA, 23 nt, Mycobacterium avium subsp. paratuberculosis
caccacggugaucucgccgagca

SEQ ID NO: 989307 - RNA, 24 nt, Mycobacterium avium subsp. paratuberculosis
caccacgguggcgccgcgcagcca

SEQ ID NO: 989308 - RNA, 20 nt, Mycobacterium avium subsp. paratuberculosis
caccacgguggcgccggcau

SEQ ID NO: 989309 - RNA, 21 nt, Mycobacterium avium subsp. paratuberculosis
caccacgguggcguccagcgg

SEQ ID NO: 989310 - RNA, 12 nt, Mycobacterium avium subsp. paratuberculosis
caccaccucuug

SEQ ID NO: 989311 - RNA, 15 nt, Mycobacterium avium subsp. paratuberculosis
caccacggcgucgcu

SEQ ID NO: 989312 - RNA, 14 nt, Mycobacterium avium subsp. paratuberculosis
caccacggccgccg

SEQ ID NO: 989313 - RNA, 20 nt, Mycobacterium avium subsp. paratuberculosis
caccacggccgccgaggcga

SEQ ID NO: 989314 - RNA, 13 nt, Mycobacterium avium subsp. paratuberculosis
caccacggcgccc

SEQ ID NO: 989315 - RNA, 15 nt, Mycobacterium avium subsp. paratuberculosis
caccaccggagcggc

SEQ ID NO: 989316 - RNA, 17 nt, Mycobacterium avium subsp. paratuberculosis
caccaccggagcggcgg

SEQ ID NO: 989317 - RNA, 15 nt, Mycobacterium avium subsp. paratuberculosis
caccaccgcgccguc

SEQ ID NO: 989318 - RNA, 14 nt, Mycobacterium avium subsp. paratuberculosis
caccaccgcgcgca

SEQ ID NO: 989319 - RNA, 20 nt, Mycobacterium avium subsp. paratuberculosis
caccaccgcgcugcgcgcgu

SEQ ID NO: 989320 - RNA, 14 nt, Mycobacterium avium subsp. paratuberculosis
caccaccgcggcgc

SEQ ID NO: 989321 - RNA, 15 nt, Mycobacterium avium subsp. paratuberculosis
caccaccgcggcgcc

SEQ ID NO: 989322 - RNA, 22 nt, Mycobacterium avium subsp. paratuberculosis
caccaccgcguugaucagcgcc

SEQ ID NO: 989323 - RNA, 23 nt, Mycobacterium avium subsp. paratuberculosis
caccaccgcguugaucagcgcca

SEQ ID NO: 989324 - RNA, 15 nt, Mycobacterium avium subsp. paratuberculosis
caccaccgccggccc

SEQ ID NO: 989325 - RNA, 22 nt, Mycobacterium avium subsp. paratuberculosis
caccaccgccggcccaggcagu

SEQ ID NO: 989326 - RNA, 12 nt, Mycobacterium avium subsp. paratuberculosis
caccaccgccgg

SEQ ID NO: 989327 - RNA, 17 nt, Mycobacterium avium subsp. paratuberculosis
caccaccgucaccgccg

SEQ ID NO: 989328 - RNA, 11 nt, Mycobacterium avium subsp. paratuberculosis
caccaccgugc

SEQ ID NO: 989329 - RNA, 14 nt, Mycobacterium avium subsp. paratuberculosis
caccaccguggcga

SEQ ID NO: 989330 - RNA, 20 nt, Mycobacterium avium subsp. paratuberculosis
caccaccggcaaccgccacg

SEQ ID NO: 989331 - RNA, 16 nt, Mycobacterium avium subsp. paratuberculosis
caccaccggccgcccg

SEQ ID NO: 989332 - RNA, 14 nt, Mycobacterium avium subsp. paratuberculosis
caccaccggccgcg

SEQ ID NO: 989333 - RNA, 15 nt, Mycobacterium avium subsp. paratuberculosis
caccaccggccgcgc

SEQ ID NO: 989334 - RNA, 17 nt, Mycobacterium avium subsp. paratuberculosis
cacaugccgaggcacag

SEQ ID NO: 989335 - RNA, 14 nt, Mycobacterium avium subsp. paratuberculosis
cacaucugccggca

SEQ ID NO: 989336 - RNA, 19 nt, Mycobacterium avium subsp. paratuberculosis
cacaucugccggcagaucu

SEQ ID NO: 989337 - RNA, 20 nt, Mycobacterium avium subsp. paratuberculosis
cacaucgggauuggcggcca

SEQ ID NO: 989338 - RNA, 19 nt, Mycobacterium avium subsp. paratuberculosis
cacagcgccucgucgagcc

SEQ ID NO: 989339 - RNA, 13 nt, Mycobacterium avium subsp. paratuberculosis
cacagcgccacac

SEQ ID NO: 989340 - RNA, 22 nt, Mycobacterium avium subsp. paratuberculosis
cacagcgacaacgggccgccuc

SEQ ID NO: 989341 - RNA, 13 nt, Mycobacterium avium subsp. paratuberculosis
cacaggaugccca

SEQ ID NO: 989342 - RNA, 20 nt, Mycobacterium avium subsp. paratuberculosis
cacaggaugcccaacagcuc

SEQ ID NO: 989343 - RNA, 15 nt, Mycobacterium avium subsp. paratuberculosis
cacagccggcgcgcg

SEQ ID NO: 989344 - RNA, 14 nt, Mycobacterium avium subsp. paratuberculosis
cacagccggcggcu

SEQ ID NO: 989345 - RNA, 16 nt, Mycobacterium avium subsp. paratuberculosis
cacagcccgugcagga

SEQ ID NO: 989346 - RNA, 14 nt, Mycobacterium avium subsp. paratuberculosis
cacaggggcgcgua

SEQ ID NO: 989347 - RNA, 15 nt, Mycobacterium avium subsp. paratuberculosis
cacagguacaggguc

SEQ ID NO: 989348 - RNA, 12 nt, Mycobacterium avium subsp. paratuberculosis
cacaggccgccg

SEQ ID NO: 989349 - RNA, 19 nt, Mycobacterium avium subsp. paratuberculosis
cacaggccgaacagcagcg

SEQ ID NO: 989350 - RNA, 16 nt, Mycobacterium avium subsp. paratuberculosis
cacagucgcugggugu

SEQ ID NO: 989351 - RNA, 23 nt, Mycobacterium avium subsp. paratuberculosis
cacaguaggcggcugucgacagg

SEQ ID NO: 989352 - RNA, 17 nt, Mycobacterium avium subsp. paratuberculosis
cacaggugacgacgcuc

SEQ ID NO: 989353 - RNA, 12 nt, Mycobacterium avium subsp. paratuberculosis
cacaccaccacg

SEQ ID NO: 989354 - RNA, 16 nt, Mycobacterium avium subsp. paratuberculosis
cacaccccggccacca

SEQ ID NO: 989355 - RNA, 13 nt, Mycobacterium avium subsp. paratuberculosis
cacacccagcgcc

SEQ ID NO: 989356 - RNA, 18 nt, Mycobacterium avium subsp. paratuberculosis
cacaccgcgcgcaggccc

SEQ ID NO: 989357 - RNA, 16 nt, Mycobacterium avium subsp. paratuberculosis
cacaccgaucagcaug

SEQ ID NO: 989358 - RNA, 19 nt, Mycobacterium avium subsp. paratuberculosis
cacaccgucguccacgccc

SEQ ID NO: 989359 - RNA, 14 nt, Mycobacterium avium subsp. paratuberculosis
cacacugaaagccg

SEQ ID NO: 989360 - RNA, 22 nt, Mycobacterium avium subsp. paratuberculosis
cacacuggcgugacgcucggcc

SEQ ID NO: 989361 - RNA, 20 nt, Mycobacterium avium subsp. paratuberculosis
cacaccgucucccacgaacg

SEQ ID NO: 989362 - RNA, 19 nt, Mycobacterium avium subsp. paratuberculosis
caauacccgaccagcaccg

SEQ ID NO: 989363 - RNA, 21 nt, Mycobacterium avium subsp. paratuberculosis
caauacccgaccagcaccgcg

SEQ ID NO: 989364 - RNA, 22 nt, Mycobacterium avium subsp. paratuberculosis
caaugauggucagccgcaccag

SEQ ID NO: 989365 - RNA, 22 nt, Mycobacterium avium subsp. paratuberculosis
caauccugcccggucugcggcc

SEQ ID NO: 989366 - RNA, 12 nt, Mycobacterium avium subsp. paratuberculosis
caaucggcgccg

SEQ ID NO: 989367 - RNA, 13 nt, Mycobacterium avium subsp. paratuberculosis
caaucggacccag

SEQ ID NO: 989368 - RNA, 16 nt, Mycobacterium avium subsp. paratuberculosis
caaucggacccagccc

SEQ ID NO: 989369 - RNA, 15 nt, Mycobacterium avium subsp. paratuberculosis
caagcgguuccagac

SEQ ID NO: 989370 - RNA, 18 nt, Mycobacterium avium subsp. paratuberculosis
caagccauuucagcagcg

SEQ ID NO: 989371 - RNA, 14 nt, Mycobacterium avium subsp. paratuberculosis
caagcagcggcagc

SEQ ID NO: 989372 - RNA, 16 nt, Mycobacterium avium subsp. paratuberculosis
caagcagcggcagcca

SEQ ID NO: 989373 - RNA, 15 nt, Mycobacterium avium subsp. paratuberculosis
caagcaccggcuggc

SEQ ID NO: 989374 - RNA, 12 nt, Mycobacterium avium subsp. paratuberculosis
caagcagagcag

SEQ ID NO: 989375 - RNA, 11 nt, Mycobacterium avium subsp. paratuberculosis
caaggccugcg

SEQ ID NO: 989376 - RNA, 13 nt, Mycobacterium avium subsp. paratuberculosis
caaggacaagcug

SEQ ID NO: 989377 - RNA, 20 nt, Mycobacterium avium subsp. paratuberculosis
caaggagaaggccgcgcgca

SEQ ID NO: 989378 - RNA, 14 nt, Mycobacterium avium subsp. paratuberculosis
caaggccagcaacc

SEQ ID NO: 989379 - RNA, 18 nt, Mycobacterium avium subsp. paratuberculosis
caagguggacgagcagcc

SEQ ID NO: 989380 - RNA, 20 nt, Mycobacterium avium subsp. paratuberculosis
caagguguggaucaccauca

SEQ ID NO: 989381 - RNA, 17 nt, Mycobacterium avium subsp. paratuberculosis
caaggugccguccgggu

SEQ ID NO: 989382 - RNA, 13 nt, Mycobacterium avium subsp. paratuberculosis
caagggccgggcg

SEQ ID NO: 989383 - RNA, 20 nt, Mycobacterium avium subsp. paratuberculosis
caaggggcuguccucccagc

SEQ ID NO: 989384 - RNA, 18 nt, Mycobacterium avium subsp. paratuberculosis
caacuacgagcagcaaga

SEQ ID NO: 989385 - RNA, 17 nt, Mycobacterium avium subsp. paratuberculosis
caacucccgcgccgcgg

SEQ ID NO: 989386 - RNA, 22 nt, Mycobacterium avium subsp. paratuberculosis
caacgccagccagaacacgccc

SEQ ID NO: 989387 - RNA, 16 nt, Mycobacterium avium subsp. paratuberculosis
caacgccgcgcgcagc

SEQ ID NO: 989388 - RNA, 17 nt, Mycobacterium avium subsp. paratuberculosis
caacuggucgugcagca

SEQ ID NO: 989389 - RNA, 20 nt, Mycobacterium avium subsp. paratuberculosis
caacugcagauaggacccgg

SEQ ID NO: 989390 - RNA, 15 nt, Mycobacterium avium subsp. paratuberculosis
caacugcaucgccag

SEQ ID NO: 989391 - RNA, 17 nt, Mycobacterium avium subsp. paratuberculosis
caacugcaucgccagca

SEQ ID NO: 989392 - RNA, 21 nt, Mycobacterium avium subsp. paratuberculosis
caacucgaccugcccgggccc

SEQ ID NO: 989393 - RNA, 22 nt, Mycobacterium avium subsp. paratuberculosis
caaccaaaaagcuagcgggagg

SEQ ID NO: 989394 - RNA, 23 nt, Mycobacterium avium subsp. paratuberculosis
caacagguuucgcucgucggcgc

SEQ ID NO: 989395 - RNA, 17 nt, Mycobacterium avium subsp. paratuberculosis
caacaggucggcgugca

SEQ ID NO: 989396 - RNA, 16 nt, Mycobacterium avium subsp. paratuberculosis
caacaggcccagcagc

SEQ ID NO: 989397 - RNA, 17 nt, Mycobacterium avium subsp. paratuberculosis
caacaggcccagcagcg

SEQ ID NO: 989398 - RNA, 15 nt, Mycobacterium avium subsp. paratuberculosis
caaccaccggcaucg

SEQ ID NO: 989399 - RNA, 18 nt, Mycobacterium avium subsp. paratuberculosis
caaccaccguggccccag

SEQ ID NO: 989400 - RNA, 19 nt, Mycobacterium avium subsp. paratuberculosis
caaccaccguggccccagc

SEQ ID NO: 989401 - RNA, 21 nt, Mycobacterium avium subsp. paratuberculosis
caaccaccguggccccagcca

SEQ ID NO: 989402 - RNA, 16 nt, Mycobacterium avium subsp. paratuberculosis
caaccacaccagcaug

SEQ ID NO: 989403 - RNA, 19 nt, Mycobacterium avium subsp. paratuberculosis
caaccacagcggcgcauga

SEQ ID NO: 989404 - RNA, 15 nt, Mycobacterium avium subsp. paratuberculosis
caaccccgcggugca

SEQ ID NO: 989405 - RNA, 21 nt, Mycobacterium avium subsp. paratuberculosis
caacccgaccucgucgacggc

SEQ ID NO: 989406 - RNA, 14 nt, Mycobacterium avium subsp. paratuberculosis
caacccgagcaccg

SEQ ID NO: 989407 - RNA, 23 nt, Mycobacterium avium subsp. paratuberculosis
caacccgcucaggucggccgcgg

SEQ ID NO: 989408 - RNA, 12 nt, Mycobacterium avium subsp. paratuberculosis
caaccuucuugg

SEQ ID NO: 989409 - RNA, 18 nt, Mycobacterium avium subsp. paratuberculosis
caaccugugccauagacc

SEQ ID NO: 989410 - RNA, 14 nt, Mycobacterium avium subsp. paratuberculosis
caaccgcugcugcu

SEQ ID NO: 989411 - RNA, 15 nt, Mycobacterium avium subsp. paratuberculosis
caaccgccggcagcg

SEQ ID NO: 989412 - RNA, 18 nt, Mycobacterium avium subsp. paratuberculosis
caaccgcauucggccgcc

SEQ ID NO: 989413 - RNA, 18 nt, Mycobacterium avium subsp. paratuberculosis
caaccgauguggacgaug

SEQ ID NO: 989414 - RNA, 19 nt, Mycobacterium avium subsp. paratuberculosis
caaccgauuucggccagcc

SEQ ID NO: 989415 - RNA, 14 nt, Mycobacterium avium subsp. paratuberculosis
caacgagcgcgccg

SEQ ID NO: 989416 - RNA, 14 nt, Mycobacterium avium subsp. paratuberculosis
caacgaggccaggg

SEQ ID NO: 989417 - RNA, 21 nt, Mycobacterium avium subsp. paratuberculosis
caacgcaaugcgucgcggcgg

SEQ ID NO: 989418 - RNA, 20 nt, Mycobacterium avium subsp. paratuberculosis
caacgccacaaacagcgcgg

SEQ ID NO: 989419 - RNA, 17 nt, Mycobacterium avium subsp. paratuberculosis
caacaacuucgagcaga

SEQ ID NO: 989420 - RNA, 18 nt, Mycobacterium avium subsp. paratuberculosis
caacacuuuuaaggagca

SEQ ID NO: 989421 - RNA, 23 nt, Mycobacterium avium subsp. paratuberculosis
caacaccucggcgacguccuuga

SEQ ID NO: 989422 - RNA, 18 nt, Mycobacterium avium subsp. paratuberculosis
caacacgauggcggccca

SEQ ID NO: 989423 - RNA, 18 nt, Mycobacterium avium subsp. paratuberculosis
caacacguccuggcgcca

SEQ ID NO: 989424 - RNA, 21 nt, Mycobacterium avium subsp. paratuberculosis
caacacgucguccggcgcgca

SEQ ID NO: 989425 - RNA, 19 nt, Mycobacterium avium subsp. paratuberculosis
caacacucgagcgcgcuca

SEQ ID NO: 989426 - RNA, 21 nt, Mycobacterium avium subsp. paratuberculosis
caaaccccuuggcguccaugu

SEQ ID NO: 989427 - RNA, 16 nt, Mycobacterium avium subsp. paratuberculosis
caaacccguugcagca

SEQ ID NO: 989428 - RNA, 12 nt, Mycobacterium avium subsp. paratuberculosis
cagauggugaag

SEQ ID NO: 989429 - RNA, 21 nt, Mycobacterium avium subsp. paratuberculosis
cagauggugaaggugcccucc

SEQ ID NO: 989430 - RNA, 17 nt, Mycobacterium avium subsp. paratuberculosis
cagaucgcgcaucaccc

SEQ ID NO: 989431 - RNA, 13 nt, Mycobacterium avium subsp. paratuberculosis
cagaucguguccg

SEQ ID NO: 989432 - RNA, 22 nt, Mycobacterium avium subsp. paratuberculosis
cagaucuguauuaagcuggcag

SEQ ID NO: 989433 - RNA, 23 nt, Mycobacterium avium subsp. paratuberculosis
cagaugcaccucgcccugcagcc

SEQ ID NO: 989434 - RNA, 13 nt, Mycobacterium avium subsp. paratuberculosis
cagaugcccagca

SEQ ID NO: 989435 - RNA, 15 nt, Mycobacterium avium subsp. paratuberculosis
cagaugcccagcggc

SEQ ID NO: 989436 - RNA, 17 nt, Mycobacterium avium subsp. paratuberculosis
cagaugcccgccccgcc

SEQ ID NO: 989437 - RNA, 14 nt, Mycobacterium avium subsp. paratuberculosis
cagaugccgcccag

SEQ ID NO: 989438 - RNA, 13 nt, Mycobacterium avium subsp. paratuberculosis
cagaugccgccgc

SEQ ID NO: 989439 - RNA, 18 nt, Mycobacterium avium subsp. paratuberculosis
cagaugccgggcuccgcg

SEQ ID NO: 989440 - RNA, 17 nt, Mycobacterium avium subsp. paratuberculosis
cagaugccugcccagcg

SEQ ID NO: 989441 - RNA, 19 nt, Mycobacterium avium subsp. paratuberculosis
cagaugccugcccagcggc

SEQ ID NO: 989442 - RNA, 14 nt, Mycobacterium avium subsp. paratuberculosis
cagaucgccccgcu

SEQ ID NO: 989443 - RNA, 13 nt, Mycobacterium avium subsp. paratuberculosis
cagaucgccagca

SEQ ID NO: 989444 - RNA, 17 nt, Mycobacterium avium subsp. paratuberculosis
cagaucgcccaucaccg

SEQ ID NO: 989445 - RNA, 14 nt, Mycobacterium avium subsp. paratuberculosis
cagaucgccuggca

SEQ ID NO: 989446 - RNA, 19 nt, Mycobacterium avium subsp. paratuberculosis
cagaucgcggcccgccgcu

SEQ ID NO: 989447 - RNA, 20 nt, Mycobacterium avium subsp. paratuberculosis
cagaucgcggcccgccgcuc

SEQ ID NO: 989448 - RNA, 18 nt, Mycobacterium avium subsp. paratuberculosis
cagaucgcgguccaccag

SEQ ID NO: 989449 - RNA, 15 nt, Mycobacterium avium subsp. paratuberculosis
cagaucgagcugggc

SEQ ID NO: 989450 - RNA, 17 nt, Mycobacterium avium subsp. paratuberculosis
cagaucgaggccagcgc

SEQ ID NO: 989451 - RNA, 20 nt, Mycobacterium avium subsp. paratuberculosis
cagaucguagggcucggcgu

SEQ ID NO: 989452 - RNA, 22 nt, Mycobacterium avium subsp. paratuberculosis
cagaucggagacguccucgguc

SEQ ID NO: 989453 - RNA, 19 nt, Mycobacterium avium subsp. paratuberculosis
cagaucggccagcgcggcc

SEQ ID NO: 989454 - RNA, 14 nt, Mycobacterium avium subsp. paratuberculosis
cagaucggccaggu

SEQ ID NO: 989455 - RNA, 20 nt, Mycobacterium avium subsp. paratuberculosis
cagaucgggucccagaugcg

SEQ ID NO: 989456 - RNA, 18 nt, Mycobacterium avium subsp. paratuberculosis
cagaucgggucgcccggg

SEQ ID NO: 989457 - RNA, 14 nt, Mycobacterium avium subsp. paratuberculosis
cagaucggcgcgcg

SEQ ID NO: 989458 - RNA, 18 nt, Mycobacterium avium subsp. paratuberculosis
cagaucggcgcgcggggu

SEQ ID NO: 989459 - RNA, 15 nt, Mycobacterium avium subsp. paratuberculosis
cagcacuucaugguc

SEQ ID NO: 989460 - RNA, 22 nt, Mycobacterium avium subsp. paratuberculosis
cagcacgcggaucgcgcugacc

SEQ ID NO: 989461 - RNA, 15 nt, Mycobacterium avium subsp. paratuberculosis
cagcaccgucggcgu

SEQ ID NO: 989462 - RNA, 23 nt, Mycobacterium avium subsp. paratuberculosis
cagcaccgugcugauccacgccc

SEQ ID NO: 989463 - RNA, 20 nt, Mycobacterium avium subsp. paratuberculosis
cagcaccgugggcccgugcg

SEQ ID NO: 989464 - RNA, 16 nt, Mycobacterium avium subsp. paratuberculosis
cagcaccgucagccag

SEQ ID NO: 989465 - RNA, 17 nt, Mycobacterium avium subsp. paratuberculosis
cagcaccguccacagcc

SEQ ID NO: 989466 - RNA, 12 nt, Mycobacterium avium subsp. paratuberculosis
cagcaccggcgu

SEQ ID NO: 989467 - RNA, 14 nt, Mycobacterium avium subsp. paratuberculosis
cagcaccggcgucg

SEQ ID NO: 989468 - RNA, 14 nt, Mycobacterium avium subsp. paratuberculosis
cagcaccggcgcca

SEQ ID NO: 989469 - RNA, 17 nt, Mycobacterium avium subsp. paratuberculosis
cagcaccggcgccauga

SEQ ID NO: 989470 - RNA, 14 nt, Mycobacterium avium subsp. paratuberculosis
cagcaccggcgccc

SEQ ID NO: 989471 - RNA, 14 nt, Mycobacterium avium subsp. paratuberculosis
cagcaccggcgccu

SEQ ID NO: 989472 - RNA, 16 nt, Mycobacterium avium subsp. paratuberculosis
cagcaccggcgccucg

SEQ ID NO: 989473 - RNA, 15 nt, Mycobacterium avium subsp. paratuberculosis
cagcaccggcgcgcc

SEQ ID NO: 989474 - RNA, 16 nt, Mycobacterium avium subsp. paratuberculosis
cagcacgaugacgacc

SEQ ID NO: 989475 - RNA, 23 nt, Mycobacterium avium subsp. paratuberculosis
cagcacgaugaucccgaggaugc

SEQ ID NO: 989476 - RNA, 18 nt, Mycobacterium avium subsp. paratuberculosis
cagcacgccgcggaaggc

SEQ ID NO: 989477 - RNA, 17 nt, Mycobacterium avium subsp. paratuberculosis
cagcaccgggcccagcu

SEQ ID NO: 989478 - RNA, 16 nt, Mycobacterium avium subsp. paratuberculosis
cagcacgcccagaugc

SEQ ID NO: 989479 - RNA, 14 nt, Mycobacterium avium subsp. paratuberculosis
cagcacccgcagcc

SEQ ID NO: 989480 - RNA, 17 nt, Mycobacterium avium subsp. paratuberculosis
cagcaccccgccgcagc

SEQ ID NO: 989481 - RNA, 21 nt, Mycobacterium avium subsp. paratuberculosis
cagcaccccgccgcagcccag

SEQ ID NO: 989482 - RNA, 23 nt, Mycobacterium avium subsp. paratuberculosis
cagcaccccgccgcagcccaggc

SEQ ID NO: 989483 - RNA, 13 nt, Mycobacterium avium subsp. paratuberculosis
cagcacccgcacc

SEQ ID NO: 989484 - RNA, 19 nt, Mycobacterium avium subsp. paratuberculosis
cagcacccagcacagcgag

SEQ ID NO: 989485 - RNA, 18 nt, Mycobacterium avium subsp. paratuberculosis
cagcacccaggugcugcc

SEQ ID NO: 989486 - RNA, 13 nt, Mycobacterium avium subsp. paratuberculosis
cagcacccggccc

SEQ ID NO: 989487 - RNA, 14 nt, Mycobacterium avium subsp. paratuberculosis
cagcacccggcccc

SEQ ID NO: 989488 - RNA, 16 nt, Mycobacterium avium subsp. paratuberculosis
cagcacccgggccugc

SEQ ID NO: 989489 - RNA, 17 nt, Mycobacterium avium subsp. paratuberculosis
cagcacccgggccuugu

SEQ ID NO: 989490 - RNA, 22 nt, Mycobacterium avium subsp. paratuberculosis
cagcacccggucggugagcugg

SEQ ID NO: 989491 - RNA, 16 nt, Mycobacterium avium subsp. paratuberculosis
cagcacccgcugcagc

SEQ ID NO: 989492 - RNA, 13 nt, Mycobacterium avium subsp. paratuberculosis
cagcaccggcagc

SEQ ID NO: 989493 - RNA, 19 nt, Mycobacterium avium subsp. paratuberculosis
cagcaccggaugcucaccg

SEQ ID NO: 989494 - RNA, 20 nt, Mycobacterium avium subsp. paratuberculosis
cagcaccggcaccgcggcga

SEQ ID NO: 989495 - RNA, 15 nt, Mycobacterium avium subsp. paratuberculosis
cagcaccgcgcggcg

SEQ ID NO: 989496 - RNA, 22 nt, Mycobacterium avium subsp. paratuberculosis
cagcaccgcggcguagcgccag

SEQ ID NO: 989497 - RNA, 21 nt, Mycobacterium avium subsp. paratuberculosis
cagcaccgcgucggcgcuggc

SEQ ID NO: 989498 - RNA, 15 nt, Mycobacterium avium subsp. paratuberculosis
cagcaccgcgacgau

SEQ ID NO: 989499 - RNA, 18 nt, Mycobacterium avium subsp. paratuberculosis
cagcacaccuuccaccac

SEQ ID NO: 989500 - RNA, 22 nt, Mycobacterium avium subsp. paratuberculosis
cagcacaccuuccaccaccgcg

SEQ ID NO: 989501 - RNA, 16 nt, Mycobacterium avium subsp. paratuberculosis
cagcacagccgucgca

SEQ ID NO: 989502 - RNA, 17 nt, Mycobacterium avium subsp. paratuberculosis
cagcacaacgccuccga

SEQ ID NO: 989503 - RNA, 13 nt, Mycobacterium avium subsp. paratuberculosis
cagcacaaaaggg

SEQ ID NO: 989504 - RNA, 14 nt, Mycobacterium avium subsp. paratuberculosis
cagcaacgccaggg

SEQ ID NO: 989505 - RNA, 22 nt, Mycobacterium avium subsp. paratuberculosis
cagcaaccgccguggcagggcc

SEQ ID NO: 989506 - RNA, 23 nt, Mycobacterium avium subsp. paratuberculosis
cagcaaccgcgaaaacagcgacc

SEQ ID NO: 989507 - RNA, 20 nt, Mycobacterium avium subsp. paratuberculosis
cagcaacgacccggccaccg

SEQ ID NO: 989508 - RNA, 22 nt, Mycobacterium avium subsp. paratuberculosis
cagcaacgacccggccaccgcc

SEQ ID NO: 989509 - RNA, 23 nt, Mycobacterium avium subsp. paratuberculosis
cagcaacgacccggccaccgccg

SEQ ID NO: 989510 - RNA, 20 nt, Mycobacterium avium subsp. paratuberculosis
cagacucacggcggcagcgc

SEQ ID NO: 989511 - RNA, 17 nt, Mycobacterium avium subsp. paratuberculosis
cagacucagcccggccc

SEQ ID NO: 989512 - RNA, 22 nt, Mycobacterium avium subsp. paratuberculosis
cagacucagcccggcccagccg

SEQ ID NO: 989513 - RNA, 19 nt, Mycobacterium avium subsp. paratuberculosis
cagaccacaagggccaccg

SEQ ID NO: 989514 - RNA, 18 nt, Mycobacterium avium subsp. paratuberculosis
cagaccauggcgcggcgg

SEQ ID NO: 989515 - RNA, 17 nt, Mycobacterium avium subsp. paratuberculosis
cagacguguggcacccg

SEQ ID NO: 989516 - RNA, 18 nt, Mycobacterium avium subsp. paratuberculosis
cagacguguggcacccgg

SEQ ID NO: 989517 - RNA, 17 nt, Mycobacterium avium subsp. paratuberculosis
cagaagccccgguucca

SEQ ID NO: 989518 - RNA, 16 nt, Mycobacterium avium subsp. paratuberculosis
cagaagcuaacgccag

SEQ ID NO: 989519 - RNA, 17 nt, Mycobacterium avium subsp. paratuberculosis
cagaacagccagucgaa

SEQ ID NO: 989520 - RNA, 15 nt, Mycobacterium avium subsp. paratuberculosis
cagaacagcacgaga

SEQ ID NO: 989521 - RNA, 12 nt, Mycobacterium avium subsp. paratuberculosis
cagaacaccacc

SEQ ID NO: 989522 - RNA, 20 nt, Mycobacterium avium subsp. paratuberculosis
cagaauucgccggggcacca

SEQ ID NO: 989523 - RNA, 16 nt, Mycobacterium avium subsp. paratuberculosis
cagacacagcacgccc

SEQ ID NO: 989524 - RNA, 16 nt, Mycobacterium avium subsp. paratuberculosis
cagacaggccggccgc

SEQ ID NO: 989525 - RNA, 12 nt, Mycobacterium avium subsp. paratuberculosis
cacuuucgcggc

SEQ ID NO: 989526 - RNA, 20 nt, Mycobacterium avium subsp. paratuberculosis
cacgucgucggacagcagca

SEQ ID NO: 989527 - RNA, 14 nt, Mycobacterium avium subsp. paratuberculosis
cacgucggccagcg

SEQ ID NO: 989528 - RNA, 14 nt, Mycobacterium avium subsp. paratuberculosis
cacgucggccagga

SEQ ID NO: 989529 - RNA, 19 nt, Mycobacterium avium subsp. paratuberculosis
cacgucggcgauggcggcg

SEQ ID NO: 989530 - RNA, 23 nt, Mycobacterium avium subsp. paratuberculosis
cacgucggcgauggcggcgugca

SEQ ID NO: 989531 - RNA, 14 nt, Mycobacterium avium subsp. paratuberculosis
cacgucggcgcgca

SEQ ID NO: 989532 - RNA, 17 nt, Mycobacterium avium subsp. paratuberculosis
cacgucguccggcgcgc

SEQ ID NO: 989533 - RNA, 13 nt, Mycobacterium avium subsp. paratuberculosis
cacgucguaggcc

SEQ ID NO: 989534 - RNA, 16 nt, Mycobacterium avium subsp. paratuberculosis
cacgucgccggcgacc

SEQ ID NO: 989535 - RNA, 16 nt, Mycobacterium avium subsp. paratuberculosis
cacgucgcggcccugg

SEQ ID NO: 989536 - RNA, 19 nt, Mycobacterium avium subsp. paratuberculosis
cacgucgaucacgccgccg

SEQ ID NO: 989537 - RNA, 14 nt, Mycobacterium avium subsp. paratuberculosis
cagcaugcgccaga

SEQ ID NO: 989538 - RNA, 15 nt, Mycobacterium avium subsp. paratuberculosis
cagcaugcgccagag

SEQ ID NO: 989539 - RNA, 18 nt, Mycobacterium avium subsp. paratuberculosis
cagcaugcgccagagcgc

SEQ ID NO: 989540 - RNA, 20 nt, Mycobacterium avium subsp. paratuberculosis
cagcaugucgcccgcgucgu

SEQ ID NO: 989541 - RNA, 21 nt, Mycobacterium avium subsp. paratuberculosis
cagcaugaagaucagcaccgu

SEQ ID NO: 989542 - RNA, 17 nt, Mycobacterium avium subsp. paratuberculosis
cagcaugcccacgccgu

SEQ ID NO: 989543 - RNA, 23 nt, Mycobacterium avium subsp. paratuberculosis
cagcaugccggucauccgggcca

SEQ ID NO: 989544 - RNA, 17 nt, Mycobacterium avium subsp. paratuberculosis
cagcaugccgagcaccu

SEQ ID NO: 989545 - RNA, 21 nt, Mycobacterium avium subsp. paratuberculosis
cagcauccgcuggugcgcgcc

SEQ ID NO: 989546 - RNA, 22 nt, Mycobacterium avium subsp. paratuberculosis
cagcauccgcuggugcgcgccg

SEQ ID NO: 989547 - RNA, 15 nt, Mycobacterium avium subsp. paratuberculosis
cagcaucgggacgcc

SEQ ID NO: 989548 - RNA, 14 nt, Mycobacterium avium subsp. paratuberculosis
cagcaucggguaga

SEQ ID NO: 989549 - RNA, 16 nt, Mycobacterium avium subsp. paratuberculosis
cagcaucggucccagu

SEQ ID NO: 989550 - RNA, 18 nt, Mycobacterium avium subsp. paratuberculosis
cagcauuucgcgcggcau

SEQ ID NO: 989551 - RNA, 20 nt, Mycobacterium avium subsp. paratuberculosis
cagcauuucgcgcggcaucg

SEQ ID NO: 989552 - RNA, 14 nt, Mycobacterium avium subsp. paratuberculosis
cagccacaccgccg

SEQ ID NO: 989553 - RNA, 15 nt, Mycobacterium avium subsp. paratuberculosis
cagccacaccgccgc

SEQ ID NO: 989554 - RNA, 16 nt, Mycobacterium avium subsp. paratuberculosis
cagccacaccgccggc

SEQ ID NO: 989555 - RNA, 16 nt, Mycobacterium avium subsp. paratuberculosis
cagccacgagcccagc

SEQ ID NO: 989556 - RNA, 17 nt, Mycobacterium avium subsp. paratuberculosis
cagccacgagcccagcc

SEQ ID NO: 989557 - RNA, 18 nt, Mycobacterium avium subsp. paratuberculosis
cagccacgagcccagccg

SEQ ID NO: 989558 - RNA, 14 nt, Mycobacterium avium subsp. paratuberculosis
cagccacgccagcc

SEQ ID NO: 989559 - RNA, 15 nt, Mycobacterium avium subsp. paratuberculosis
cagccacagcucggg

SEQ ID NO: 989560 - RNA, 12 nt, Mycobacterium avium subsp. paratuberculosis
cagccacaucug

SEQ ID NO: 989561 - RNA, 23 nt, Mycobacterium avium subsp. paratuberculosis
cagccaggacuccuugggagacu

SEQ ID NO: 989562 - RNA, 16 nt, Mycobacterium avium subsp. paratuberculosis
cagccagcuggugaag

SEQ ID NO: 989563 - RNA, 16 nt, Mycobacterium avium subsp. paratuberculosis
cagccagguggugaac

SEQ ID NO: 989564 - RNA, 20 nt, Mycobacterium avium subsp. paratuberculosis
cagccagguguaggcggcca

SEQ ID NO: 989565 - RNA, 17 nt, Mycobacterium avium subsp. paratuberculosis
cagccagccgcccagca

SEQ ID NO: 989566 - RNA, 20 nt, Mycobacterium avium subsp. paratuberculosis
cagccagccgguggcggcca

SEQ ID NO: 989567 - RNA, 17 nt, Mycobacterium avium subsp. paratuberculosis
cagccagcgcagcacug

SEQ ID NO: 989568 - RNA, 14 nt, Mycobacterium avium subsp. paratuberculosis
cagccagcgcgcga

SEQ ID NO: 989569 - RNA, 18 nt, Mycobacterium avium subsp. paratuberculosis
cagccacgcgcaaccauc

SEQ ID NO: 989570 - RNA, 13 nt, Mycobacterium avium subsp. paratuberculosis
cagccagcccgcg

SEQ ID NO: 989571 - RNA, 15 nt, Mycobacterium avium subsp. paratuberculosis
cagccacgccgacac

SEQ ID NO: 989572 - RNA, 15 nt, Mycobacterium avium subsp. paratuberculosis
cagcaguuuguccug

SEQ ID NO: 989573 - RNA, 14 nt, Mycobacterium avium subsp. paratuberculosis
cagcagugccccgu

SEQ ID NO: 989574 - RNA, 21 nt, Mycobacterium avium subsp. paratuberculosis
cagcagugccccguccggcgc

SEQ ID NO: 989575 - RNA, 23 nt, Mycobacterium avium subsp. paratuberculosis
cagcagugccaacacggcggcgc

SEQ ID NO: 989576 - RNA, 15 nt, Mycobacterium avium subsp. paratuberculosis
cagcagugccaccac

SEQ ID NO: 989577 - RNA, 23 nt, Mycobacterium avium subsp. paratuberculosis
cagcagugccaccaccacggcca

SEQ ID NO: 989578 - RNA, 23 nt, Mycobacterium avium subsp. paratuberculosis
cagcaguccggcggucagcaccg

SEQ ID NO: 989579 - RNA, 21 nt, Mycobacterium avium subsp. paratuberculosis
cagcagggcaccgacggccgc

SEQ ID NO: 989580 - RNA, 19 nt, Mycobacterium avium subsp. paratuberculosis
cagcagggcaucucccgcg

SEQ ID NO: 989581 - RNA, 12 nt, Mycobacterium avium subsp. paratuberculosis
cagcaggcuguc

SEQ ID NO: 989582 - RNA, 14 nt, Mycobacterium avium subsp. paratuberculosis
cagcaggcgccgca

SEQ ID NO: 989583 - RNA, 23 nt, Mycobacterium avium subsp. paratuberculosis
cagcagggucgagaucagcaccg

SEQ ID NO: 989584 - RNA, 13 nt, Mycobacterium avium subsp. paratuberculosis
cagcagggccucg

SEQ ID NO: 989585 - RNA, 13 nt, Mycobacterium avium subsp. paratuberculosis
cagcagggcggca

SEQ ID NO: 989586 - RNA, 13 nt, Mycobacterium avium subsp. paratuberculosis
cagcagggcggcg

SEQ ID NO: 989587 - RNA, 23 nt, Mycobacterium avium subsp. paratuberculosis
cagcagggcgcgcaucugcucgg

SEQ ID NO: 989588 - RNA, 23 nt, Mycobacterium avium subsp. paratuberculosis
cagcagguagaucgccagcgccc

SEQ ID NO: 989589 - RNA, 22 nt, Mycobacterium avium subsp. paratuberculosis
cagcagguaaaccagcagcgcc

SEQ ID NO: 989590 - RNA, 17 nt, Mycobacterium avium subsp. paratuberculosis
cagcaggucggcgugcu

SEQ ID NO: 989591 - RNA, 16 nt, Mycobacterium avium subsp. paratuberculosis
cagcaggugcaccacc

SEQ ID NO: 989592 - RNA, 17 nt, Mycobacterium avium subsp. paratuberculosis
cagcaggugcaucgcca

SEQ ID NO: 989593 - RNA, 17 nt, Mycobacterium avium subsp. paratuberculosis
cagcaggucggccagcu

SEQ ID NO: 989594 - RNA, 21 nt, Mycobacterium avium subsp. paratuberculosis
cagcagcucauacagcggcgc

SEQ ID NO: 989595 - RNA, 21 nt, Mycobacterium avium subsp. paratuberculosis
cagcagcgucugcgccagcug

SEQ ID NO: 989596 - RNA, 14 nt, Mycobacterium avium subsp. paratuberculosis
cagcagcuccaucg

SEQ ID NO: 989597 - RNA, 21 nt, Mycobacterium avium subsp. paratuberculosis
cagcagcugcgucggcaccag

SEQ ID NO: 989598 - RNA, 18 nt, Mycobacterium avium subsp. paratuberculosis
cagcagcucggcgaucac

SEQ ID NO: 989599 - RNA, 16 nt, Mycobacterium avium subsp. paratuberculosis
cagcagcugcacccgc

SEQ ID NO: 989600 - RNA, 23 nt, Mycobacterium avium subsp. paratuberculosis
cagcagcuuggcgaagucgcagu

SEQ ID NO: 989601 - RNA, 11 nt, Mycobacterium avium subsp. paratuberculosis
cagcaggacca

SEQ ID NO: 989602 - RNA, 15 nt, Mycobacterium avium subsp. paratuberculosis
cagcaggacgcgccc

SEQ ID NO: 989603 - RNA, 17 nt, Mycobacterium avium subsp. paratuberculosis
cagcaggcccaacguga

SEQ ID NO: 989604 - RNA, 22 nt, Mycobacterium avium subsp. paratuberculosis
cagcaggaucuggugcgcgcgc

SEQ ID NO: 989605 - RNA, 14 nt, Mycobacterium avium subsp. paratuberculosis
cagcaggaugauga

SEQ ID NO: 989606 - RNA, 14 nt, Mycobacterium avium subsp. paratuberculosis
cagcaggcccaggc

SEQ ID NO: 989607 - RNA, 16 nt, Mycobacterium avium subsp. paratuberculosis
cagcaggcccaggccg

SEQ ID NO: 989608 - RNA, 22 nt, Mycobacterium avium subsp. paratuberculosis
cagcaggccccguucgguggcc

SEQ ID NO: 989609 - RNA, 19 nt, Mycobacterium avium subsp. paratuberculosis
cagcaggcccucggccagc

SEQ ID NO: 989610 - RNA, 20 nt, Mycobacterium avium subsp. paratuberculosis
cagcaggcggacggcgaccu

SEQ ID NO: 989611 - RNA, 18 nt, Mycobacterium avium subsp. paratuberculosis
cagcagcgccacaaugga

SEQ ID NO: 989612 - RNA, 21 nt, Mycobacterium avium subsp. paratuberculosis
cagcagcgccacaauggaucc

SEQ ID NO: 989613 - RNA, 14 nt, Mycobacterium avium subsp. paratuberculosis
cagcagaccgccgg

SEQ ID NO: 989614 - RNA, 15 nt, Mycobacterium avium subsp. paratuberculosis
cagcagaaccagcac

SEQ ID NO: 989615 - RNA, 18 nt, Mycobacterium avium subsp. paratuberculosis
cagcagaaccagcaccgc

SEQ ID NO: 989616 - RNA, 17 nt, Mycobacterium avium subsp. paratuberculosis
cagcagcgccagcaccg

SEQ ID NO: 989617 - RNA, 13 nt, Mycobacterium avium subsp. paratuberculosis
cagcagcgcgccg

SEQ ID NO: 989618 - RNA, 15 nt, Mycobacterium avium subsp. paratuberculosis
cagcagcgcgccgcg

SEQ ID NO: 989619 - RNA, 14 nt, Mycobacterium avium subsp. paratuberculosis
cagcagcgcggcau

SEQ ID NO: 989620 - RNA, 18 nt, Mycobacterium avium subsp. paratuberculosis
cagcagcgcggcgaucuc

SEQ ID NO: 989621 - RNA, 14 nt, Mycobacterium avium subsp. paratuberculosis
cagcagcgcgucgu

SEQ ID NO: 989622 - RNA, 16 nt, Mycobacterium avium subsp. paratuberculosis
cagcagcgugggaucc

SEQ ID NO: 989623 - RNA, 20 nt, Mycobacterium avium subsp. paratuberculosis
cagcagcguuccgucggcga

SEQ ID NO: 989624 - RNA, 16 nt, Mycobacterium avium subsp. paratuberculosis
cagcagcggcagcgaa

SEQ ID NO: 989625 - RNA, 20 nt, Mycobacterium avium subsp. paratuberculosis
cagcagcggcuugagcgcca

SEQ ID NO: 989626 - RNA, 20 nt, Mycobacterium avium subsp. paratuberculosis
cagcagcgggaucagcuccu

SEQ ID NO: 989627 - RNA, 16 nt, Mycobacterium avium subsp. paratuberculosis
cagccugccuccacgu

SEQ ID NO: 989628 - RNA, 13 nt, Mycobacterium avium subsp. paratuberculosis
cagccggccaccg

SEQ ID NO: 989629 - RNA, 14 nt, Mycobacterium avium subsp. paratuberculosis
cagccggccaccgc

SEQ ID NO: 989630 - RNA, 16 nt, Mycobacterium avium subsp. paratuberculosis
cagccggccaccgccc

SEQ ID NO: 989631 - RNA, 17 nt, Mycobacterium avium subsp. paratuberculosis
cagccggccaccgcccc

SEQ ID NO: 989632 - RNA, 13 nt, Mycobacterium avium subsp. paratuberculosis
cagccggaacaca

SEQ ID NO: 989633 - RNA, 15 nt, Mycobacterium avium subsp. paratuberculosis
cagccggaaggccaa

SEQ ID NO: 989634 - RNA, 23 nt, Mycobacterium avium subsp. paratuberculosis
cagccggaaggccaaggccagca

SEQ ID NO: 989635 - RNA, 13 nt, Mycobacterium avium subsp. paratuberculosis
cagccggacagcg

SEQ ID NO: 989636 - RNA, 18 nt, Mycobacterium avium subsp. paratuberculosis
cagccucagauucuucuu

SEQ ID NO: 989637 - RNA, 12 nt, Mycobacterium avium subsp. paratuberculosis
cagccggccgcu

SEQ ID NO: 989638 - RNA, 19 nt, Mycobacterium avium subsp. paratuberculosis
cagccggccgcugaggaug

SEQ ID NO: 989639 - RNA, 15 nt, Mycobacterium avium subsp. paratuberculosis
cagccggccugcuuu

SEQ ID NO: 989640 - RNA, 12 nt, Mycobacterium avium subsp. paratuberculosis
cagccggcccuc

SEQ ID NO: 989641 - RNA, 19 nt, Mycobacterium avium subsp. paratuberculosis
cagccggcccuccaggaag

SEQ ID NO: 989642 - RNA, 20 nt, Mycobacterium avium subsp. paratuberculosis
cagccggcccuccaggaaga

SEQ ID NO: 989643 - RNA, 19 nt, Mycobacterium avium subsp. paratuberculosis
cagccggcccgagcccugc

SEQ ID NO: 989644 - RNA, 17 nt, Mycobacterium avium subsp. paratuberculosis
cagccggccgaccgccu

SEQ ID NO: 989645 - RNA, 19 nt, Mycobacterium avium subsp. paratuberculosis
cagccggccgacgcggccu

SEQ ID NO: 989646 - RNA, 15 nt, Mycobacterium avium subsp. paratuberculosis
cagccggccgagcga

SEQ ID NO: 989647 - RNA, 15 nt, Mycobacterium avium subsp. paratuberculosis
cagcgaaggcauggg

SEQ ID NO: 989648 - RNA, 22 nt, Mycobacterium avium subsp. paratuberculosis
cagcgaaggcaugggcgugccg

SEQ ID NO: 989649 - RNA, 14 nt, Mycobacterium avium subsp. paratuberculosis
cagcgaagccacgg

SEQ ID NO: 989650 - RNA, 17 nt, Mycobacterium avium subsp. paratuberculosis
cagcgaacgcggcugau

SEQ ID NO: 989651 - RNA, 14 nt, Mycobacterium avium subsp. paratuberculosis
cagcgacagcaccc

SEQ ID NO: 989652 - RNA, 16 nt, Mycobacterium avium subsp. paratuberculosis
cagcgacagcacccgc

SEQ ID NO: 989653 - RNA, 18 nt, Mycobacterium avium subsp. paratuberculosis
cagcgacagcacccgcug

SEQ ID NO: 989654 - RNA, 17 nt, Mycobacterium avium subsp. paratuberculosis
cagcgacaacgggccgc

SEQ ID NO: 989655 - RNA, 19 nt, Mycobacterium avium subsp. paratuberculosis
cagcgacaacgggccgccu

SEQ ID NO: 989656 - RNA, 13 nt, Mycobacterium avium subsp. paratuberculosis
cagccgcaacacg

SEQ ID NO: 989657 - RNA, 14 nt, Mycobacterium avium subsp. paratuberculosis
cagccgcacaccgc

SEQ ID NO: 989658 - RNA, 12 nt, Mycobacterium avium subsp. paratuberculosis
cagccgcagcag

SEQ ID NO: 989659 - RNA, 14 nt, Mycobacterium avium subsp. paratuberculosis
cagccgcagcagcc

SEQ ID NO: 989660 - RNA, 23 nt, Mycobacterium avium subsp. paratuberculosis
cagccgcagcaggcacuccuggu

SEQ ID NO: 989661 - RNA, 16 nt, Mycobacterium avium subsp. paratuberculosis
cagccgcaccggcgcc

SEQ ID NO: 989662 - RNA, 16 nt, Mycobacterium avium subsp. paratuberculosis
cagccgcacgaaccgc

SEQ ID NO: 989663 - RNA, 22 nt, Mycobacterium avium subsp. paratuberculosis
cagccgaucucguagcccaccu

SEQ ID NO: 989664 - RNA, 19 nt, Mycobacterium avium subsp. paratuberculosis
cagccgcccggcgccccgc

SEQ ID NO: 989665 - RNA, 22 nt, Mycobacterium avium subsp. paratuberculosis
cagccgccgcguggccucccgg

SEQ ID NO: 989666 - RNA, 18 nt, Mycobacterium avium subsp. paratuberculosis
cagccgccggcucagcgg

SEQ ID NO: 989667 - RNA, 14 nt, Mycobacterium avium subsp. paratuberculosis
cagccgccgggcca

SEQ ID NO: 989668 - RNA, 16 nt, Mycobacterium avium subsp. paratuberculosis
cagccgcgacagccgc

SEQ ID NO: 989669 - RNA, 13 nt, Mycobacterium avium subsp. paratuberculosis
cagccgcgccaau

SEQ ID NO: 989670 - RNA, 18 nt, Mycobacterium avium subsp. paratuberculosis
cagccgcgccaccgcggg

SEQ ID NO: 989671 - RNA, 16 nt, Mycobacterium avium subsp. paratuberculosis
cagccgcgacggcggg

SEQ ID NO: 989672 - RNA, 16 nt, Mycobacterium avium subsp. paratuberculosis
cagccgcgcccgaugg

SEQ ID NO: 989673 - RNA, 20 nt, Mycobacterium avium subsp. paratuberculosis
cagccgcgccgacgcccaca

SEQ ID NO: 989674 - RNA, 15 nt, Mycobacterium avium subsp. paratuberculosis
cagccgcgccgccgc

SEQ ID NO: 989675 - RNA, 13 nt, Mycobacterium avium subsp. paratuberculosis
cagccgcgccgcg

SEQ ID NO: 989676 - RNA, 14 nt, Mycobacterium avium subsp. paratuberculosis
cagccgccagccgg

SEQ ID NO: 989677 - RNA, 17 nt, Mycobacterium avium subsp. paratuberculosis
cagccgcaucaccuucu

SEQ ID NO: 989678 - RNA, 20 nt, Mycobacterium avium subsp. paratuberculosis
cagccgcaggugcagcuccu

SEQ ID NO: 989679 - RNA, 23 nt, Mycobacterium avium subsp. paratuberculosis
cagccgcaggugcagcuccuuga

SEQ ID NO: 989680 - RNA, 14 nt, Mycobacterium avium subsp. paratuberculosis
cagccaucugcuga

SEQ ID NO: 989681 - RNA, 17 nt, Mycobacterium avium subsp. paratuberculosis
cagccauucgucgggga

SEQ ID NO: 989682 - RNA, 14 nt, Mycobacterium avium subsp. paratuberculosis
cagcccguggccag

SEQ ID NO: 989683 - RNA, 21 nt, Mycobacterium avium subsp. paratuberculosis
cagcccguugucgagcaccgc

SEQ ID NO: 989684 - RNA, 22 nt, Mycobacterium avium subsp. paratuberculosis
cagcccguugucgagcaccgcg

SEQ ID NO: 989685 - RNA, 21 nt, Mycobacterium avium subsp. paratuberculosis
cagcccguuguggcggccagc

SEQ ID NO: 989686 - RNA, 15 nt, Mycobacterium avium subsp. paratuberculosis
cagcccuacccgucc

SEQ ID NO: 989687 - RNA, 16 nt, Mycobacterium avium subsp. paratuberculosis
cagcccuacccgucca

SEQ ID NO: 989688 - RNA, 16 nt, Mycobacterium avium subsp. paratuberculosis
cagcccugcucggcca

SEQ ID NO: 989689 - RNA, 18 nt, Mycobacterium avium subsp. paratuberculosis
cagccgaaguauccgguc

SEQ ID NO: 989690 - RNA, 13 nt, Mycobacterium avium subsp. paratuberculosis
cagcgcacacacc

SEQ ID NO: 989691 - RNA, 17 nt, Mycobacterium avium subsp. paratuberculosis
cagcgcacacagcagca

SEQ ID NO: 989692 - RNA, 22 nt, Mycobacterium avium subsp. paratuberculosis
cagcgcaccgccgucggggcgu

SEQ ID NO: 989693 - RNA, 20 nt, Mycobacterium avium subsp. paratuberculosis
cagcgcaccggcgaugcaga

SEQ ID NO: 989694 - RNA, 19 nt, Mycobacterium avium subsp. paratuberculosis
cagcgcacgucgccgccgc

SEQ ID NO: 989695 - RNA, 14 nt, Mycobacterium avium subsp. paratuberculosis
cagcgcagcaccau

SEQ ID NO: 989696 - RNA, 16 nt, Mycobacterium avium subsp. paratuberculosis
cagcgcagcaucggca

SEQ ID NO: 989697 - RNA, 14 nt, Mycobacterium avium subsp. paratuberculosis
cagcgagacgacca

SEQ ID NO: 989698 - RNA, 20 nt, Mycobacterium avium subsp. paratuberculosis
cagcgacuugaccagcagcu

SEQ ID NO: 989699 - RNA, 15 nt, Mycobacterium avium subsp. paratuberculosis
cagcgacggcccgcc

SEQ ID NO: 989700 - RNA, 14 nt, Mycobacterium avium subsp. paratuberculosis
cagcgacgggccgg

SEQ ID NO: 989701 - RNA, 15 nt, Mycobacterium avium subsp. paratuberculosis
cagcgacgggccggg

SEQ ID NO: 989702 - RNA, 23 nt, Mycobacterium avium subsp. paratuberculosis
cagcgacggccgggucaggaaca

SEQ ID NO: 989703 - RNA, 14 nt, Mycobacterium avium subsp. paratuberculosis
cagcgacuccagcg

SEQ ID NO: 989704 - RNA, 17 nt, Mycobacterium avium subsp. paratuberculosis
cagcgacuccugacgca

SEQ ID NO: 989705 - RNA, 16 nt, Mycobacterium avium subsp. paratuberculosis
cagcgacucgggcagg

SEQ ID NO: 989706 - RNA, 20 nt, Mycobacterium avium subsp. paratuberculosis
cagcgacucgggcaggaugg

SEQ ID NO: 989707 - RNA, 23 nt, Mycobacterium avium subsp. paratuberculosis
cagcgacugcacccgggucaggu

SEQ ID NO: 989708 - RNA, 23 nt, Mycobacterium avium subsp. paratuberculosis
cagcgccacgcucaugcccgcca

SEQ ID NO: 989709 - RNA, 15 nt, Mycobacterium avium subsp. paratuberculosis
cagcgccacuggcug

SEQ ID NO: 989710 - RNA, 23 nt, Mycobacterium avium subsp. paratuberculosis
cagcgccacggguugagccagac

SEQ ID NO: 989711 - RNA, 14 nt, Mycobacterium avium subsp. paratuberculosis
cagcgccacccccc

SEQ ID NO: 989712 - RNA, 17 nt, Mycobacterium avium subsp. paratuberculosis
cagcgccaccagcaccg

SEQ ID NO: 989713 - RNA, 19 nt, Mycobacterium avium subsp. paratuberculosis
cagcgccaccagcaccggg

SEQ ID NO: 989714 - RNA, 17 nt, Mycobacterium avium subsp. paratuberculosis
cagcgccaccagcuccu

SEQ ID NO: 989715 - RNA, 18 nt, Mycobacterium avium subsp. paratuberculosis
cagcgccagcagcggcac

SEQ ID NO: 989716 - RNA, 13 nt, Mycobacterium avium subsp. paratuberculosis
cagcgccagcggc

SEQ ID NO: 989717 - RNA, 21 nt, Mycobacterium avium subsp. paratuberculosis
cagcgccagcaccgccugggu

SEQ ID NO: 989718 - RNA, 13 nt, Mycobacterium avium subsp. paratuberculosis
cagcgccagcacg

SEQ ID NO: 989719 - RNA, 21 nt, Mycobacterium avium subsp. paratuberculosis
cagcgccagcacggccaccag

SEQ ID NO: 989720 - RNA, 21 nt, Mycobacterium avium subsp. paratuberculosis
cagcgccagcaacacccagcc

SEQ ID NO: 989721 - RNA, 15 nt, Mycobacterium avium subsp. paratuberculosis
cagcgccagcggcuu

SEQ ID NO: 989722 - RNA, 19 nt, Mycobacterium avium subsp. paratuberculosis
cagcgccaggugggugaac

SEQ ID NO: 989723 - RNA, 20 nt, Mycobacterium avium subsp. paratuberculosis
cagcgcccccgacaggccca

SEQ ID NO: 989724 - RNA, 12 nt, Mycobacterium avium subsp. paratuberculosis
cagcgcccccag

SEQ ID NO: 989725 - RNA, 16 nt, Mycobacterium avium subsp. paratuberculosis
cagcgcccgcgcgggc

SEQ ID NO: 989726 - RNA, 14 nt, Mycobacterium avium subsp. paratuberculosis
cagcgcccgcgcgu

SEQ ID NO: 989727 - RNA, 18 nt, Mycobacterium avium subsp. paratuberculosis
cagcgcccgcgcgugggc

SEQ ID NO: 989728 - RNA, 23 nt, Mycobacterium avium subsp. paratuberculosis
cagcgcccgcgcgugggccaacg

SEQ ID NO: 989729 - RNA, 16 nt, Mycobacterium avium subsp. paratuberculosis
cagcgcccgcgggugc

SEQ ID NO: 989730 - RNA, 14 nt, Mycobacterium avium subsp. paratuberculosis
cagcgcccggcagc

SEQ ID NO: 989731 - RNA, 19 nt, Mycobacterium avium subsp. paratuberculosis
cagcgccucggccugcgcc

SEQ ID NO: 989732 - RNA, 14 nt, Mycobacterium avium subsp. paratuberculosis
cagcgccucggcgu

SEQ ID NO: 989733 - RNA, 19 nt, Mycobacterium avium subsp. paratuberculosis
cagcgccucgucgagccgg

SEQ ID NO: 989734 - RNA, 22 nt, Mycobacterium avium subsp. paratuberculosis
cagcgccucgucgagccgggcc

SEQ ID NO: 989735 - RNA, 21 nt, Mycobacterium avium subsp. paratuberculosis
cagcgcgaccagcccggccgc

SEQ ID NO: 989736 - RNA, 20 nt, Mycobacterium avium subsp. paratuberculosis
cagcgcgaacagcgcggcca

SEQ ID NO: 989737 - RNA, 15 nt, Mycobacterium avium subsp. paratuberculosis
cagcgcgaucgccgg

SEQ ID NO: 989738 - RNA, 17 nt, Mycobacterium avium subsp. paratuberculosis
cagcgcgaucuccuuga

SEQ ID NO: 989739 - RNA, 14 nt, Mycobacterium avium subsp. paratuberculosis
cagcgcgcacagcg

SEQ ID NO: 989740 - RNA, 20 nt, Mycobacterium avium subsp. paratuberculosis
cagcgcgacgaacagcaccg

SEQ ID NO: 989741 - RNA, 19 nt, Mycobacterium avium subsp. paratuberculosis
cagcgcgacgggcacccgc

SEQ ID NO: 989742 - RNA, 20 nt, Mycobacterium avium subsp. paratuberculosis
cagcgcgacgggcacccgcg

SEQ ID NO: 989743 - RNA, 22 nt, Mycobacterium avium subsp. paratuberculosis
cagcgcgacugggugcucccgc

SEQ ID NO: 989744 - RNA, 15 nt, Mycobacterium avium subsp. paratuberculosis
cagcgcgaccagugc

SEQ ID NO: 989745 - RNA, 20 nt, Mycobacterium avium subsp. paratuberculosis
cagcgcgacgccgacgccca

SEQ ID NO: 989746 - RNA, 14 nt, Mycobacterium avium subsp. paratuberculosis
cagcgcgacgcgca

SEQ ID NO: 989747 - RNA, 21 nt, Mycobacterium avium subsp. paratuberculosis
cagcgcgaccucgguggugcu

SEQ ID NO: 989748 - RNA, 14 nt, Mycobacterium avium subsp. paratuberculosis
cagcgcgcccgcca

SEQ ID NO: 989749 - RNA, 17 nt, Mycobacterium avium subsp. paratuberculosis
cagcgcgccgcccagcg

SEQ ID NO: 989750 - RNA, 21 nt, Mycobacterium avium subsp. paratuberculosis
cagcgcgcccugaggcccggu

SEQ ID NO: 989751 - RNA, 13 nt, Mycobacterium avium subsp. paratuberculosis
cagcgcgccgaac

SEQ ID NO: 989752 - RNA, 20 nt, Mycobacterium avium subsp. paratuberculosis
cagcgcgcgaucagcgccgu

SEQ ID NO: 989753 - RNA, 21 nt, Mycobacterium avium subsp. paratuberculosis
cagcgcgcgaucagcgccguc

SEQ ID NO: 989754 - RNA, 20 nt, Mycobacterium avium subsp. paratuberculosis
cagcgcgcgaccgcgaugcg

SEQ ID NO: 989755 - RNA, 14 nt, Mycobacterium avium subsp. paratuberculosis
cagcgcggcggcca

SEQ ID NO: 989756 - RNA, 17 nt, Mycobacterium avium subsp. paratuberculosis
cagcgcggcggccagcu

SEQ ID NO: 989757 - RNA, 13 nt, Mycobacterium avium subsp. paratuberculosis
cagcgcgcggcgc

SEQ ID NO: 989758 - RNA, 18 nt, Mycobacterium avium subsp. paratuberculosis
cagcgcgcggcggauguc

SEQ ID NO: 989759 - RNA, 12 nt, Mycobacterium avium subsp. paratuberculosis
cagcgccgcccg

SEQ ID NO: 989760 - RNA, 16 nt, Mycobacterium avium subsp. paratuberculosis
cagcgccgcccgcacc

SEQ ID NO: 989761 - RNA, 17 nt, Mycobacterium avium subsp. paratuberculosis
cagcgccgcccgcaccu

SEQ ID NO: 989762 - RNA, 16 nt, Mycobacterium avium subsp. paratuberculosis
cagcgccgccagccgc

SEQ ID NO: 989763 - RNA, 15 nt, Mycobacterium avium subsp. paratuberculosis
cagcgccgccacggc

SEQ ID NO: 989764 - RNA, 21 nt, Mycobacterium avium subsp. paratuberculosis
cagcgccgccacggccaccgc

SEQ ID NO: 989765 - RNA, 16 nt, Mycobacterium avium subsp. paratuberculosis
cagcgccgccaaccag

SEQ ID NO: 989766 - RNA, 15 nt, Mycobacterium avium subsp. paratuberculosis
cagcgccgaggugcu

SEQ ID NO: 989767 - RNA, 21 nt, Mycobacterium avium subsp. paratuberculosis
cagcgccgagaucgcgguggc

SEQ ID NO: 989768 - RNA, 13 nt, Mycobacterium avium subsp. paratuberculosis
cagcgcccgggcg

SEQ ID NO: 989769 - RNA, 14 nt, Mycobacterium avium subsp. paratuberculosis
cagcgccgcgcgcg

SEQ ID NO: 989770 - RNA, 19 nt, Mycobacterium avium subsp. paratuberculosis
cagcgccgcgcgcgcggcc

SEQ ID NO: 989771 - RNA, 20 nt, Mycobacterium avium subsp. paratuberculosis
cagcgccgcgcgcgcggccu

SEQ ID NO: 989772 - RNA, 13 nt, Mycobacterium avium subsp. paratuberculosis
cagcgccgccauc

SEQ ID NO: 989773 - RNA, 22 nt, Mycobacterium avium subsp. paratuberculosis
cagcgccgcgaugaucacaccc

SEQ ID NO: 989774 - RNA, 20 nt, Mycobacterium avium subsp. paratuberculosis
cagcgccgucuccucgacca

SEQ ID NO: 989775 - RNA, 18 nt, Mycobacterium avium subsp. paratuberculosis
cagcgccguggcccgguc

SEQ ID NO: 989776 - RNA, 13 nt, Mycobacterium avium subsp. paratuberculosis
cagcgccuccagc

SEQ ID NO: 989777 - RNA, 14 nt, Mycobacterium avium subsp. paratuberculosis
cagcgccuccagcc

SEQ ID NO: 989778 - RNA, 14 nt, Mycobacterium avium subsp. paratuberculosis
cagcgccucccgga

SEQ ID NO: 989779 - RNA, 14 nt, Mycobacterium avium subsp. paratuberculosis
cagcgccggcagcg

SEQ ID NO: 989780 - RNA, 13 nt, Mycobacterium avium subsp. paratuberculosis
cagcgccggcagc

SEQ ID NO: 989781 - RNA, 14 nt, Mycobacterium avium subsp. paratuberculosis
cagcgccggcagca

SEQ ID NO: 989782 - RNA, 16 nt, Mycobacterium avium subsp. paratuberculosis
cagcgccgcgccgacc

SEQ ID NO: 989783 - RNA, 23 nt, Mycobacterium avium subsp. paratuberculosis
cagcgccggaccgauccggcgcc

SEQ ID NO: 989784 - RNA, 14 nt, Mycobacterium avium subsp. paratuberculosis
cagcgccgcggcga

SEQ ID NO: 989785 - RNA, 16 nt, Mycobacterium avium subsp. paratuberculosis
cagcgccgcggcgccc

SEQ ID NO: 989786 - RNA, 16 nt, Mycobacterium avium subsp. paratuberculosis
cagcgccgcggccagc

SEQ ID NO: 989787 - RNA, 19 nt, Mycobacterium avium subsp. paratuberculosis
cagcgccgcggccagccgg

SEQ ID NO: 989788 - RNA, 18 nt, Mycobacterium avium subsp. paratuberculosis
caguaccggcgaugccag

SEQ ID NO: 989789 - RNA, 20 nt, Mycobacterium avium subsp. paratuberculosis
caguacgcaucggcgccgga

SEQ ID NO: 989790 - RNA, 19 nt, Mycobacterium avium subsp. paratuberculosis
caguaggucacccgguccc

SEQ ID NO: 989791 - RNA, 19 nt, Mycobacterium avium subsp. paratuberculosis
caguagccgaucuccaccg

SEQ ID NO: 989792 - RNA, 17 nt, Mycobacterium avium subsp. paratuberculosis
caguagccgccgggcgu

SEQ ID NO: 989793 - RNA, 17 nt, Mycobacterium avium subsp. paratuberculosis
caguagugguccaccgc

SEQ ID NO: 989794 - RNA, 20 nt, Mycobacterium avium subsp. paratuberculosis
caguagugguccaccgccgc

SEQ ID NO: 989795 - RNA, 15 nt, Mycobacterium avium subsp. paratuberculosis
caguaugcccgccgc

SEQ ID NO: 989796 - RNA, 24 nt, Mycobacterium avium subsp. paratuberculosis
cagucccagaucguagggcucggc

SEQ ID NO: 989797 - RNA, 17 nt, Mycobacterium avium subsp. paratuberculosis
caguccagucgcgccga

SEQ ID NO: 989798 - RNA, 22 nt, Mycobacterium avium subsp. paratuberculosis
cagucccaguuguuuccccagc

SEQ ID NO: 989799 - RNA, 15 nt, Mycobacterium avium subsp. paratuberculosis
caguccugggccggg

SEQ ID NO: 989800 - RNA, 15 nt, Mycobacterium avium subsp. paratuberculosis
cagucgaucuugcgc

SEQ ID NO: 989801 - RNA, 22 nt, Mycobacterium avium subsp. paratuberculosis
cagucgaugucgguggcgcgca

SEQ ID NO: 989802 - RNA, 14 nt, Mycobacterium avium subsp. paratuberculosis
cagucgaagauguc

SEQ ID NO: 989803 - RNA, 21 nt, Mycobacterium avium subsp. paratuberculosis
cagucgaagaugucgcggcgc

SEQ ID NO: 989804 - RNA, 17 nt, Mycobacterium avium subsp. paratuberculosis
cagucgaccucgcgcgu

SEQ ID NO: 989805 - RNA, 19 nt, Mycobacterium avium subsp. paratuberculosis
cagucgaccucgcgcguca

SEQ ID NO: 989806 - RNA, 13 nt, Mycobacterium avium subsp. paratuberculosis
cagucccguugcg

SEQ ID NO: 989807 - RNA, 22 nt, Mycobacterium avium subsp. paratuberculosis
cagucccguugcgggacugggc

SEQ ID NO: 989808 - RNA, 22 nt, Mycobacterium avium subsp. paratuberculosis
caguccccgccuucgaugcccu

SEQ ID NO: 989809 - RNA, 18 nt, Mycobacterium avium subsp. paratuberculosis
caguccccgguucaccag

SEQ ID NO: 989810 - RNA, 20 nt, Mycobacterium avium subsp. paratuberculosis
caguccggcgaguacccgcc

SEQ ID NO: 989811 - RNA, 16 nt, Mycobacterium avium subsp. paratuberculosis
caguccggcgcccggc

SEQ ID NO: 989812 - RNA, 19 nt, Mycobacterium avium subsp. paratuberculosis
caguccggcgcccggcucc

SEQ ID NO: 989813 - RNA, 14 nt, Mycobacterium avium subsp. paratuberculosis
caguccggcgccga

SEQ ID NO: 989814 - RNA, 18 nt, Mycobacterium avium subsp. paratuberculosis
caguccggacacggccag

SEQ ID NO: 989815 - RNA, 13 nt, Mycobacterium avium subsp. paratuberculosis
caguccgcccagc

SEQ ID NO: 989816 - RNA, 17 nt, Mycobacterium avium subsp. paratuberculosis
caguccgccccgaugcg

SEQ ID NO: 989817 - RNA, 13 nt, Mycobacterium avium subsp. paratuberculosis
cagucggucgguc

SEQ ID NO: 989818 - RNA, 17 nt, Mycobacterium avium subsp. paratuberculosis
cagucgugacgcggcgu

SEQ ID NO: 989819 - RNA, 13 nt, Mycobacterium avium subsp. paratuberculosis
cagucggccggcg

SEQ ID NO: 989820 - RNA, 23 nt, Mycobacterium avium subsp. paratuberculosis
cagucggccggcguuguccaggu

SEQ ID NO: 989821 - RNA, 18 nt, Mycobacterium avium subsp. paratuberculosis
cagucggcgucgcggcgc

SEQ ID NO: 989822 - RNA, 14 nt, Mycobacterium avium subsp. paratuberculosis
cagucggcgccgau

SEQ ID NO: 989823 - RNA, 17 nt, Mycobacterium avium subsp. paratuberculosis
cagucggcgccgaugca

SEQ ID NO: 989824 - RNA, 14 nt, Mycobacterium avium subsp. paratuberculosis
cagucggccaccgc

SEQ ID NO: 989825 - RNA, 15 nt, Mycobacterium avium subsp. paratuberculosis
cagucggccaccgcg

SEQ ID NO: 989826 - RNA, 15 nt, Mycobacterium avium subsp. paratuberculosis
cagucgcgggcagcc

SEQ ID NO: 989827 - RNA, 21 nt, Mycobacterium avium subsp. paratuberculosis
cagucgcgggcagccggcgcc

SEQ ID NO: 989828 - RNA, 16 nt, Mycobacterium avium subsp. paratuberculosis
cagucgcgggcgagcc

SEQ ID NO: 989829 - RNA, 19 nt, Mycobacterium avium subsp. paratuberculosis
cagucgcgccgccagcaac

SEQ ID NO: 989830 - RNA, 14 nt, Mycobacterium avium subsp. paratuberculosis
cagucgcgcagcgu

SEQ ID NO: 989831 - RNA, 17 nt, Mycobacterium avium subsp. paratuberculosis
cagucgcaggccccgga

SEQ ID NO: 989832 - RNA, 13 nt, Mycobacterium avium subsp. paratuberculosis
cagucgccgccgc

SEQ ID NO: 989833 - RNA, 21 nt, Mycobacterium avium subsp. paratuberculosis
cagucgccgccgcgcaccgcg

SEQ ID NO: 989834 - RNA, 15 nt, Mycobacterium avium subsp. paratuberculosis
cagucgcagcagcag

SEQ ID NO: 989835 - RNA, 22 nt, Mycobacterium avium subsp. paratuberculosis
cagugcacugccgacccggcgu

SEQ ID NO: 989836 - RNA, 20 nt, Mycobacterium avium subsp. paratuberculosis
cagugaucggcggaacccgg

SEQ ID NO: 989837 - RNA, 14 nt, Mycobacterium avium subsp. paratuberculosis
cagugaggccagca

SEQ ID NO: 989838 - RNA, 17 nt, Mycobacterium avium subsp. paratuberculosis
cagugaccgcacgauca

SEQ ID NO: 989839 - RNA, 16 nt, Mycobacterium avium subsp. paratuberculosis
caggugugcccgcccu

SEQ ID NO: 989840 - RNA, 15 nt, Mycobacterium avium subsp. paratuberculosis
caggugugccgcugg

SEQ ID NO: 989841 - RNA, 22 nt, Mycobacterium avium subsp. paratuberculosis
cagguguaggcguggcaggcca

SEQ ID NO: 989842 - RNA, 17 nt, Mycobacterium avium subsp. paratuberculosis
cagguggugggcgugca

SEQ ID NO: 989843 - RNA, 16 nt, Mycobacterium avium subsp. paratuberculosis
caggugggguggugga

SEQ ID NO: 989844 - RNA, 14 nt, Mycobacterium avium subsp. paratuberculosis
caggugggcgcgca

SEQ ID NO: 989845 - RNA, 14 nt, Mycobacterium avium subsp. paratuberculosis
caggugggcggcca

SEQ ID NO: 989846 - RNA, 16 nt, Mycobacterium avium subsp. paratuberculosis
cagguggggcaccaga

SEQ ID NO: 989847 - RNA, 19 nt, Mycobacterium avium subsp. paratuberculosis
cagguggggcaccagaaca

SEQ ID NO: 989848 - RNA, 16 nt, Mycobacterium avium subsp. paratuberculosis
cagguggacagaugcc

SEQ ID NO: 989849 - RNA, 16 nt, Mycobacterium avium subsp. paratuberculosis
caggugcuuggucagc

SEQ ID NO: 989850 - RNA, 22 nt, Mycobacterium avium subsp. paratuberculosis
caggugcuuggucagcgcggcc

SEQ ID NO: 989851 - RNA, 14 nt, Mycobacterium avium subsp. paratuberculosis
cagguggcgcccgg

SEQ ID NO: 989852 - RNA, 21 nt, Mycobacterium avium subsp. paratuberculosis
cagguggcgccuccgcccggg

SEQ ID NO: 989853 - RNA, 23 nt, Mycobacterium avium subsp. paratuberculosis
cagguggccgaucagcggcgggc

SEQ ID NO: 989854 - RNA, 23 nt, Mycobacterium avium subsp. paratuberculosis
cagguggaugcgagccagcugcg

SEQ ID NO: 989855 - RNA, 19 nt, Mycobacterium avium subsp. paratuberculosis
cagguggauugucggccgc

SEQ ID NO: 989856 - RNA, 24 nt, Mycobacterium avium subsp. paratuberculosis
caggugcagcagcagccacgccag

SEQ ID NO: 989857 - RNA, 16 nt, Mycobacterium avium subsp. paratuberculosis
caggugcgacgcccac

SEQ ID NO: 989858 - RNA, 12 nt, Mycobacterium avium subsp. paratuberculosis
caggugcagcgu

SEQ ID NO: 989859 - RNA, 23 nt, Mycobacterium avium subsp. paratuberculosis
caggugcagcuccuugagccgcc

SEQ ID NO: 989860 - RNA, 20 nt, Mycobacterium avium subsp. paratuberculosis
caggugcauccagucggcgc

SEQ ID NO: 989861 - RNA, 15 nt, Mycobacterium avium subsp. paratuberculosis
caggugcaucgaccg

SEQ ID NO: 989862 - RNA, 16 nt, Mycobacterium avium subsp. paratuberculosis
caggugcaucgaccgg

SEQ ID NO: 989863 - RNA, 17 nt, Mycobacterium avium subsp. paratuberculosis
caggugcaucgccaccg

SEQ ID NO: 989864 - RNA, 22 nt, Mycobacterium avium subsp. paratuberculosis
caggugccggugacggucaggg

SEQ ID NO: 989865 - RNA, 18 nt, Mycobacterium avium subsp. paratuberculosis
caggugcacccgcggcgc

SEQ ID NO: 989866 - RNA, 20 nt, Mycobacterium avium subsp. paratuberculosis
caggugcacccgcggcgcga

SEQ ID NO: 989867 - RNA, 18 nt, Mycobacterium avium subsp. paratuberculosis
caggugcagaccggacag

SEQ ID NO: 989868 - RNA, 20 nt, Mycobacterium avium subsp. paratuberculosis
caggugcagaccggacagcu

SEQ ID NO: 989869 - RNA, 21 nt, Mycobacterium avium subsp. paratuberculosis
caggugcagaccggacagcug

SEQ ID NO: 989870 - RNA, 13 nt, Mycobacterium avium subsp. paratuberculosis
caggugacgccgc

SEQ ID NO: 989871 - RNA, 14 nt, Mycobacterium avium subsp. paratuberculosis
caggugacgccgca

SEQ ID NO: 989872 - RNA, 16 nt, Mycobacterium avium subsp. paratuberculosis
cagguccggcagcgcg

SEQ ID NO: 989873 - RNA, 17 nt, Mycobacterium avium subsp. paratuberculosis
cagguccuugcccagca

SEQ ID NO: 989874 - RNA, 20 nt, Mycobacterium avium subsp. paratuberculosis
cagguccuugcgcgccgcga

SEQ ID NO: 989875 - RNA, 15 nt, Mycobacterium avium subsp. paratuberculosis
cagguccuguccggu

SEQ ID NO: 989876 - RNA, 21 nt, Mycobacterium avium subsp. paratuberculosis
cagguccgguucgaccggcgu

SEQ ID NO: 989877 - RNA, 20 nt, Mycobacterium avium subsp. paratuberculosis
cagguccucgaucgacaccu

SEQ ID NO: 989878 - RNA, 15 nt, Mycobacterium avium subsp. paratuberculosis
cagguccucgcuggc

SEQ ID NO: 989879 - RNA, 21 nt, Mycobacterium avium subsp. paratuberculosis
caggucaugguggcggcgccg

SEQ ID NO: 989880 - RNA, 14 nt, Mycobacterium avium subsp. paratuberculosis
cagguccaccccgc

SEQ ID NO: 989881 - RNA, 12 nt, Mycobacterium avium subsp. paratuberculosis
cagguccacccg

SEQ ID NO: 989882 - RNA, 17 nt, Mycobacterium avium subsp. paratuberculosis
cagguccacccgccccg

SEQ ID NO: 989883 - RNA, 18 nt, Mycobacterium avium subsp. paratuberculosis
cagguccacccgccccgc

SEQ ID NO: 989884 - RNA, 16 nt, Mycobacterium avium subsp. paratuberculosis
caggggugccagccgu

SEQ ID NO: 989885 - RNA, 13 nt, Mycobacterium avium subsp. paratuberculosis
cagggggcgcagc

SEQ ID NO: 989886 - RNA, 16 nt, Mycobacterium avium subsp. paratuberculosis
cagggguuggcgcgca

SEQ ID NO: 989887 - RNA, 23 nt, Mycobacterium avium subsp. paratuberculosis
cagguauucaucgcggccgccgg

SEQ ID NO: 989888 - RNA, 16 nt, Mycobacterium avium subsp. paratuberculosis
caggucaaccaggccu

SEQ ID NO: 989889 - RNA, 22 nt, Mycobacterium avium subsp. paratuberculosis
caggucacccuccucgcggcgg

SEQ ID NO: 989890 - RNA, 23 nt, Mycobacterium avium subsp. paratuberculosis
caggucaccgcgcgaagucccac

SEQ ID NO: 989891 - RNA, 22 nt, Mycobacterium avium subsp. paratuberculosis
caggucgacggggucggacaga

SEQ ID NO: 989892 - RNA, 15 nt, Mycobacterium avium subsp. paratuberculosis
caggucgaucucggc

SEQ ID NO: 989893 - RNA, 16 nt, Mycobacterium avium subsp. paratuberculosis
caggucgaucugcggc

SEQ ID NO: 989894 - RNA, 19 nt, Mycobacterium avium subsp. paratuberculosis
caggucgaugauguugccc

SEQ ID NO: 989895 - RNA, 20 nt, Mycobacterium avium subsp. paratuberculosis
caggucgaccaucugccggc

SEQ ID NO: 989896 - RNA, 20 nt, Mycobacterium avium subsp. paratuberculosis
caggucgaagcgcagcaccu

SEQ ID NO: 989897 - RNA, 12 nt, Mycobacterium avium subsp. paratuberculosis
caggucgcgccg

SEQ ID NO: 989898 - RNA, 20 nt, Mycobacterium avium subsp. paratuberculosis
caggucgccgauccagccgu

SEQ ID NO: 989899 - RNA, 20 nt, Mycobacterium avium subsp. paratuberculosis
caggucgccgcgcagcaccg

SEQ ID NO: 989900 - RNA, 21 nt, Mycobacterium avium subsp. paratuberculosis
caggucgccgcgcagcaccgc

SEQ ID NO: 989901 - RNA, 22 nt, Mycobacterium avium subsp. paratuberculosis
caggucgccgcgcagcaccgcg

SEQ ID NO: 989902 - RNA, 18 nt, Mycobacterium avium subsp. paratuberculosis
caggucgcugcccggcgu

SEQ ID NO: 989903 - RNA, 14 nt, Mycobacterium avium subsp. paratuberculosis
caggucggcgaugg

SEQ ID NO: 989904 - RNA, 23 nt, Mycobacterium avium subsp. paratuberculosis
caggucgucgucgccgcgcgcgu

SEQ ID NO: 989905 - RNA, 19 nt, Mycobacterium avium subsp. paratuberculosis
caggucguucauucagcac

SEQ ID NO: 989906 - RNA, 15 nt, Mycobacterium avium subsp. paratuberculosis
caggucguugccggu

SEQ ID NO: 989907 - RNA, 22 nt, Mycobacterium avium subsp. paratuberculosis
caggucggcgugcagcacgggg

SEQ ID NO: 989908 - RNA, 19 nt, Mycobacterium avium subsp. paratuberculosis
caggucggggcccgucccc

SEQ ID NO: 989909 - RNA, 21 nt, Mycobacterium avium subsp. paratuberculosis
caggucggggcccguccccac

SEQ ID NO: 989910 - RNA, 17 nt, Mycobacterium avium subsp. paratuberculosis
cagguugcgcagcagcc

SEQ ID NO: 989911 - RNA, 20 nt, Mycobacterium avium subsp. paratuberculosis
cagguugucgucgggcacca

SEQ ID NO: 989912 - RNA, 16 nt, Mycobacterium avium subsp. paratuberculosis
cagguuggucagcagc

SEQ ID NO: 989913 - RNA, 16 nt, Mycobacterium avium subsp. paratuberculosis
cagguuguccagccgg

SEQ ID NO: 989914 - RNA, 24 nt, Mycobacterium avium subsp. paratuberculosis
cagguuguccagccggugcaccac

SEQ ID NO: 989915 - RNA, 15 nt, Mycobacterium avium subsp. paratuberculosis
cagguugaccaccag

SEQ ID NO: 989916 - RNA, 19 nt, Mycobacterium avium subsp. paratuberculosis
cagguugauccgcgcgucu

SEQ ID NO: 989917 - RNA, 15 nt, Mycobacterium avium subsp. paratuberculosis
cagguucuccggccc

SEQ ID NO: 989918 - RNA, 16 nt, Mycobacterium avium subsp. paratuberculosis
cagguucuccggcccg

SEQ ID NO: 989919 - RNA, 15 nt, Mycobacterium avium subsp. paratuberculosis
cagguucuccuccca

SEQ ID NO: 989920 - RNA, 19 nt, Mycobacterium avium subsp. paratuberculosis
cagguucuccucccagccc

SEQ ID NO: 989921 - RNA, 20 nt, Mycobacterium avium subsp. paratuberculosis
cagguuugagcgugccgccg

SEQ ID NO: 989922 - RNA, 21 nt, Mycobacterium avium subsp. paratuberculosis
caguacagcuaggccagcagc

SEQ ID NO: 989923 - RNA, 19 nt, Mycobacterium avium subsp. paratuberculosis
caggaucugcagcacgccc

SEQ ID NO: 989924 - RNA, 17 nt, Mycobacterium avium subsp. paratuberculosis
caggaucugcgcaagaa

SEQ ID NO: 989925 - RNA, 19 nt, Mycobacterium avium subsp. paratuberculosis
caggaucugcgcaagaagg

SEQ ID NO: 989926 - RNA, 21 nt, Mycobacterium avium subsp. paratuberculosis
caggaucugcgcaagaagggc

SEQ ID NO: 989927 - RNA, 23 nt, Mycobacterium avium subsp. paratuberculosis
caggaucugggugagcgacacca

SEQ ID NO: 989928 - RNA, 22 nt, Mycobacterium avium subsp. paratuberculosis
caggcauuccaccgcgcggcgc

SEQ ID NO: 989929 - RNA, 18 nt, Mycobacterium avium subsp. paratuberculosis
caggcauuagcgcguguc

SEQ ID NO: 989930 - RNA, 15 nt, Mycobacterium avium subsp. paratuberculosis
caggaugcccagcac

SEQ ID NO: 989931 - RNA, 16 nt, Mycobacterium avium subsp. paratuberculosis
caggaugcccagcacc

SEQ ID NO: 989932 - RNA, 17 nt, Mycobacterium avium subsp. paratuberculosis
caggaugcccagcacca

SEQ ID NO: 989933 - RNA, 23 nt, Mycobacterium avium subsp. paratuberculosis
caggaugcccagcaccacuucca

SEQ ID NO: 989934 - RNA, 13 nt, Mycobacterium avium subsp. paratuberculosis
caggaugcccagg

SEQ ID NO: 989935 - RNA, 14 nt, Mycobacterium avium subsp. paratuberculosis
caggaugcccagga

SEQ ID NO: 989936 - RNA, 20 nt, Mycobacterium avium subsp. paratuberculosis
caggaugcccgggccguccg

SEQ ID NO: 989937 - RNA, 23 nt, Mycobacterium avium subsp. paratuberculosis
caggaugagcugggcggcgcgcu

SEQ ID NO: 989938 - RNA, 18 nt, Mycobacterium avium subsp. paratuberculosis
caggaugaccgcccagga

SEQ ID NO: 989939 - RNA, 14 nt, Mycobacterium avium subsp. paratuberculosis
caggaugacgccga

SEQ ID NO: 989940 - RNA, 14 nt, Mycobacterium avium subsp. paratuberculosis
caggaugacgccgc

SEQ ID NO: 989941 - RNA, 16 nt, Mycobacterium avium subsp. paratuberculosis
caggaugacgccgcgg

SEQ ID NO: 989942 - RNA, 15 nt, Mycobacterium avium subsp. paratuberculosis
caggccccuccagcu

SEQ ID NO: 989943 - RNA, 17 nt, Mycobacterium avium subsp. paratuberculosis
caggccccuccagcugg

SEQ ID NO: 989944 - RNA, 17 nt, Mycobacterium avium subsp. paratuberculosis
caggccccggccgagcg

SEQ ID NO: 989945 - RNA, 19 nt, Mycobacterium avium subsp. paratuberculosis
caggcccaucgcggucagc

SEQ ID NO: 989946 - RNA, 12 nt, Mycobacterium avium subsp. paratuberculosis
caggccccaccc

SEQ ID NO: 989947 - RNA, 13 nt, Mycobacterium avium subsp. paratuberculosis
caggccccacccg

SEQ ID NO: 989948 - RNA, 23 nt, Mycobacterium avium subsp. paratuberculosis
caggccccggauccgucgccccg

SEQ ID NO: 989949 - RNA, 16 nt, Mycobacterium avium subsp. paratuberculosis
caggcccaccagcugg

SEQ ID NO: 989950 - RNA, 12 nt, Mycobacterium avium subsp. paratuberculosis
caggcccagccc

SEQ ID NO: 989951 - RNA, 17 nt, Mycobacterium avium subsp. paratuberculosis
caggcccagcagcaccg

SEQ ID NO: 989952 - RNA, 18 nt, Mycobacterium avium subsp. paratuberculosis
caggcccagcagcaccgc

SEQ ID NO: 989953 - RNA, 16 nt, Mycobacterium avium subsp. paratuberculosis
caggcccagcagcgca

SEQ ID NO: 989954 - RNA, 17 nt, Mycobacterium avium subsp. paratuberculosis
caggcccagcagcgcac

SEQ ID NO: 989955 - RNA, 15 nt, Mycobacterium avium subsp. paratuberculosis
caggcccagcccggc

SEQ ID NO: 989956 - RNA, 17 nt, Mycobacterium avium subsp. paratuberculosis
caggcccagcccggccc

SEQ ID NO: 989957 - RNA, 16 nt, Mycobacterium avium subsp. paratuberculosis
caggcccagcugcugg

SEQ ID NO: 989958 - RNA, 22 nt, Mycobacterium avium subsp. paratuberculosis
caggcccagcugcuggaaucgc

SEQ ID NO: 989959 - RNA, 17 nt, Mycobacterium avium subsp. paratuberculosis
caggcccaggccgaugg

SEQ ID NO: 989960 - RNA, 17 nt, Mycobacterium avium subsp. paratuberculosis
caggccacgcaggucca

SEQ ID NO: 989961 - RNA, 15 nt, Mycobacterium avium subsp. paratuberculosis
caggccacgcccacg

SEQ ID NO: 989962 - RNA, 16 nt, Mycobacterium avium subsp. paratuberculosis
caggccacgcccacgc

SEQ ID NO: 989963 - RNA, 17 nt, Mycobacterium avium subsp. paratuberculosis
caggccagcaccuggcg

SEQ ID NO: 989964 - RNA, 17 nt, Mycobacterium avium subsp. paratuberculosis
caggccaucagcccggc

SEQ ID NO: 989965 - RNA, 17 nt, Mycobacterium avium subsp. paratuberculosis
caggccaggugcagcug

SEQ ID NO: 989966 - RNA, 21 nt, Mycobacterium avium subsp. paratuberculosis
caggccgaguauccgcgcagc

SEQ ID NO: 989967 - RNA, 16 nt, Mycobacterium avium subsp. paratuberculosis
caggccgaacagcagc

SEQ ID NO: 989968 - RNA, 22 nt, Mycobacterium avium subsp. paratuberculosis
caggccgaaugacguggcaacg

SEQ ID NO: 989969 - RNA, 16 nt, Mycobacterium avium subsp. paratuberculosis
caggcccuugccccac

SEQ ID NO: 989970 - RNA, 18 nt, Mycobacterium avium subsp. paratuberculosis
caggcccuugccccacca

SEQ ID NO: 989971 - RNA, 19 nt, Mycobacterium avium subsp. paratuberculosis
caggcccuugccccaccac

SEQ ID NO: 989972 - RNA, 14 nt, Mycobacterium avium subsp. paratuberculosis
caggcccucggcca

SEQ ID NO: 989973 - RNA, 19 nt, Mycobacterium avium subsp. paratuberculosis
caggcccggguagcgcagc

SEQ ID NO: 989974 - RNA, 23 nt, Mycobacterium avium subsp. paratuberculosis
caggcccgguagauauggcccuc

SEQ ID NO: 989975 - RNA, 13 nt, Mycobacterium avium subsp. paratuberculosis
caggccgcccggc

SEQ ID NO: 989976 - RNA, 15 nt, Mycobacterium avium subsp. paratuberculosis
caggccgcccggccc

SEQ ID NO: 989977 - RNA, 23 nt, Mycobacterium avium subsp. paratuberculosis
caggccgaugaugaugccgccca

SEQ ID NO: 989978 - RNA, 16 nt, Mycobacterium avium subsp. paratuberculosis
caggccgccgccaccg

SEQ ID NO: 989979 - RNA, 15 nt, Mycobacterium avium subsp. paratuberculosis
caggccgcgagcccg

SEQ ID NO: 989980 - RNA, 19 nt, Mycobacterium avium subsp. paratuberculosis
caggcgauggcgucggcca

SEQ ID NO: 989981 - RNA, 22 nt, Mycobacterium avium subsp. paratuberculosis
caggcgauggcgucggccagcg

SEQ ID NO: 989982 - RNA, 17 nt, Mycobacterium avium subsp. paratuberculosis
caggccuugucguccuc

SEQ ID NO: 989983 - RNA, 22 nt, Mycobacterium avium subsp. paratuberculosis
caggccuuccgcaacaucguca

SEQ ID NO: 989984 - RNA, 14 nt, Mycobacterium avium subsp. paratuberculosis
caggccggccugcc

SEQ ID NO: 989985 - RNA, 20 nt, Mycobacterium avium subsp. paratuberculosis
caggccggccugccaccgcg

SEQ ID NO: 989986 - RNA, 15 nt, Mycobacterium avium subsp. paratuberculosis
caggccggcgccggg

SEQ ID NO: 989987 - RNA, 20 nt, Mycobacterium avium subsp. paratuberculosis
caggccggcgccgggaaagu

SEQ ID NO: 989988 - RNA, 17 nt, Mycobacterium avium subsp. paratuberculosis
caggccggucacccagg

SEQ ID NO: 989989 - RNA, 18 nt, Mycobacterium avium subsp. paratuberculosis
caggccguagcgagcgcu

SEQ ID NO: 989990 - RNA, 16 nt, Mycobacterium avium subsp. paratuberculosis
caggccguagcggcuc

SEQ ID NO: 989991 - RNA, 18 nt, Mycobacterium avium subsp. paratuberculosis
cagggcguguugcaggcg

SEQ ID NO: 989992 - RNA, 18 nt, Mycobacterium avium subsp. paratuberculosis
cagggcucgugcagccgg

SEQ ID NO: 989993 - RNA, 21 nt, Mycobacterium avium subsp. paratuberculosis
caggggcagcugauagcccgc

SEQ ID NO: 989994 - RNA, 22 nt, Mycobacterium avium subsp. paratuberculosis
caggggcagcugauagcccgcc

SEQ ID NO: 989995 - RNA, 19 nt, Mycobacterium avium subsp. paratuberculosis
cagggccgcggccgccgcg

SEQ ID NO: 989996 - RNA, 11 nt, Mycobacterium avium subsp. paratuberculosis
cagggccgcga

SEQ ID NO: 989997 - RNA, 17 nt, Mycobacterium avium subsp. paratuberculosis
cagggcaccgacggccg

SEQ ID NO: 989998 - RNA, 21 nt, Mycobacterium avium subsp. paratuberculosis
cagggacaugccgagcagcac

SEQ ID NO: 989999 - RNA, 22 nt, Mycobacterium avium subsp. paratuberculosis
cagggacaugccgagcagcacc

SEQ ID NO: 990000 - RNA, 13 nt, Mycobacterium avium subsp. paratuberculosis
cagggaggacagc

SEQ ID NO: 990001 - RNA, 16 nt, Mycobacterium avium subsp. paratuberculosis
cagggaggacagcacc

SEQ ID NO: 990002 - RNA, 17 nt, Mycobacterium avium subsp. paratuberculosis
cagggaggacagcaccg

SEQ ID NO: 990003 - RNA, 19 nt, Mycobacterium avium subsp. paratuberculosis
cagggaggacagcaccgcc

SEQ ID NO: 990004 - RNA, 16 nt, Mycobacterium avium subsp. paratuberculosis
cagggccaagacacgc

SEQ ID NO: 990005 - RNA, 21 nt, Mycobacterium avium subsp. paratuberculosis
cagggcauccgggaggccagc

SEQ ID NO: 990006 - RNA, 21 nt, Mycobacterium avium subsp. paratuberculosis
cagggccagguucaggcccgc

SEQ ID NO: 990007 - RNA, 13 nt, Mycobacterium avium subsp. paratuberculosis
cagggccagcgcc

SEQ ID NO: 990008 - RNA, 13 nt, Mycobacterium avium subsp. paratuberculosis
cagggaauucagc

SEQ ID NO: 990009 - RNA, 19 nt, Mycobacterium avium subsp. paratuberculosis
cagggaauucagccugccu

SEQ ID NO: 990010 - RNA, 13 nt, Mycobacterium avium subsp. paratuberculosis
caggcgcaccacc

SEQ ID NO: 990011 - RNA, 17 nt, Mycobacterium avium subsp. paratuberculosis
caggcgcagccagcggu

SEQ ID NO: 990012 - RNA, 21 nt, Mycobacterium avium subsp. paratuberculosis
caggcgcagcccgagcggcau

SEQ ID NO: 990013 - RNA, 13 nt, Mycobacterium avium subsp. paratuberculosis
caggcguccagca

SEQ ID NO: 990014 - RNA, 15 nt, Mycobacterium avium subsp. paratuberculosis
caggcguccagccag

SEQ ID NO: 990015 - RNA, 20 nt, Mycobacterium avium subsp. paratuberculosis
caggcguccagggccaccgc

SEQ ID NO: 990016 - RNA, 12 nt, Mycobacterium avium subsp. paratuberculosis
caggcgguggug

SEQ ID NO: 990017 - RNA, 15 nt, Mycobacterium avium subsp. paratuberculosis
caggcguccgcaagc

SEQ ID NO: 990018 - RNA, 13 nt, Mycobacterium avium subsp. paratuberculosis
caggcucagcagc

SEQ ID NO: 990019 - RNA, 14 nt, Mycobacterium avium subsp. paratuberculosis
caggcucagcagca

SEQ ID NO: 990020 - RNA, 16 nt, Mycobacterium avium subsp. paratuberculosis
caggcucagcagcacc

SEQ ID NO: 990021 - RNA, 18 nt, Mycobacterium avium subsp. paratuberculosis
caggcucagcagcaccgc

SEQ ID NO: 990022 - RNA, 20 nt, Mycobacterium avium subsp. paratuberculosis
caggcucaggaucagcagcc

SEQ ID NO: 990023 - RNA, 15 nt, Mycobacterium avium subsp. paratuberculosis
caggaauagcccgaa

SEQ ID NO: 990024 - RNA, 14 nt, Mycobacterium avium subsp. paratuberculosis
caggaacgccuuga

SEQ ID NO: 990025 - RNA, 23 nt, Mycobacterium avium subsp. paratuberculosis
caggaacgccuuggugccguuga

SEQ ID NO: 990026 - RNA, 20 nt, Mycobacterium avium subsp. paratuberculosis
caggaaccgggucagcacca

SEQ ID NO: 990027 - RNA, 23 nt, Mycobacterium avium subsp. paratuberculosis
caggaacgccggcuugccccggu

SEQ ID NO: 990028 - RNA, 14 nt, Mycobacterium avium subsp. paratuberculosis
caggaacacgggau

SEQ ID NO: 990029 - RNA, 17 nt, Mycobacterium avium subsp. paratuberculosis
caggaacagacacagca

SEQ ID NO: 990030 - RNA, 20 nt, Mycobacterium avium subsp. paratuberculosis
caggaacgcgccggcgcaca

SEQ ID NO: 990031 - RNA, 17 nt, Mycobacterium avium subsp. paratuberculosis
caggaaguagccggcca

SEQ ID NO: 990032 - RNA, 21 nt, Mycobacterium avium subsp. paratuberculosis
caggaaguagccggccagcgu

SEQ ID NO: 990033 - RNA, 23 nt, Mycobacterium avium subsp. paratuberculosis
caggacguugaggcggcggcggg

SEQ ID NO: 990034 - RNA, 14 nt, Mycobacterium avium subsp. paratuberculosis
caggacuccuuggg

SEQ ID NO: 990035 - RNA, 17 nt, Mycobacterium avium subsp. paratuberculosis
caggacgcgaccggcca

SEQ ID NO: 990036 - RNA, 16 nt, Mycobacterium avium subsp. paratuberculosis
caggacgcggugacgg

SEQ ID NO: 990037 - RNA, 13 nt, Mycobacterium avium subsp. paratuberculosis
cagcuuuccggcc

SEQ ID NO: 990038 - RNA, 20 nt, Mycobacterium avium subsp. paratuberculosis
cagcuuucgggcggccugcc

SEQ ID NO: 990039 - RNA, 16 nt, Mycobacterium avium subsp. paratuberculosis
cagcuuugccagcaga

SEQ ID NO: 990040 - RNA, 17 nt, Mycobacterium avium subsp. paratuberculosis
caggaacaccgagccgg

SEQ ID NO: 990041 - RNA, 20 nt, Mycobacterium avium subsp. paratuberculosis
cagcuugcucuucaggaacc

SEQ ID NO: 990042 - RNA, 23 nt, Mycobacterium avium subsp. paratuberculosis
cagcuugccggagcccagcuugg

SEQ ID NO: 990043 - RNA, 19 nt, Mycobacterium avium subsp. paratuberculosis
cagcuugaugcuggcaacg

SEQ ID NO: 990044 - RNA, 21 nt, Mycobacterium avium subsp. paratuberculosis
cagcuugacgucggucagcau

SEQ ID NO: 990045 - RNA, 15 nt, Mycobacterium avium subsp. paratuberculosis
cagcuugaagcccuc

SEQ ID NO: 990046 - RNA, 15 nt, Mycobacterium avium subsp. paratuberculosis
cagcuguugcggcgu

SEQ ID NO: 990047 - RNA, 15 nt, Mycobacterium avium subsp. paratuberculosis
cagcuguuccuggua

SEQ ID NO: 990048 - RNA, 21 nt, Mycobacterium avium subsp. paratuberculosis
cagcuguuccugguagucguc

SEQ ID NO: 990049 - RNA, 14 nt, Mycobacterium avium subsp. paratuberculosis
cagcgcuuccagcg

SEQ ID NO: 990050 - RNA, 19 nt, Mycobacterium avium subsp. paratuberculosis
cagcgcggucaacaccggg

SEQ ID NO: 990051 - RNA, 19 nt, Mycobacterium avium subsp. paratuberculosis
cagcgcggucgccaccacc

SEQ ID NO: 990052 - RNA, 23 nt, Mycobacterium avium subsp. paratuberculosis
cagcgcggucucgaucugcacca

SEQ ID NO: 990053 - RNA, 19 nt, Mycobacterium avium subsp. paratuberculosis
cagcgcggugugcggcggc

SEQ ID NO: 990054 - RNA, 16 nt, Mycobacterium avium subsp. paratuberculosis
cagcgcggugagcagc

SEQ ID NO: 990055 - RNA, 20 nt, Mycobacterium avium subsp. paratuberculosis
cagcgcggugaugugcagga

SEQ ID NO: 990056 - RNA, 15 nt, Mycobacterium avium subsp. paratuberculosis
cagcgcggugcccag

SEQ ID NO: 990057 - RNA, 18 nt, Mycobacterium avium subsp. paratuberculosis
cagcgcggugcccagcca

SEQ ID NO: 990058 - RNA, 19 nt, Mycobacterium avium subsp. paratuberculosis
cagcgcggugccgaccugg

SEQ ID NO: 990059 - RNA, 18 nt, Mycobacterium avium subsp. paratuberculosis
cagcgcggcuuggccacc

SEQ ID NO: 990060 - RNA, 22 nt, Mycobacterium avium subsp. paratuberculosis
cagcgcggcuuggccaccacca

SEQ ID NO: 990061 - RNA, 21 nt, Mycobacterium avium subsp. paratuberculosis
cagcgcggcggucgcgcgccg

SEQ ID NO: 990062 - RNA, 15 nt, Mycobacterium avium subsp. paratuberculosis
cagcgcuccugcagc

SEQ ID NO: 990063 - RNA, 16 nt, Mycobacterium avium subsp. paratuberculosis
cagcgcuccugcagcg

SEQ ID NO: 990064 - RNA, 23 nt, Mycobacterium avium subsp. paratuberculosis
cagcgcguagucggcgucggcca

SEQ ID NO: 990065 - RNA, 15 nt, Mycobacterium avium subsp. paratuberculosis
cagcuagcccagaac

SEQ ID NO: 990066 - RNA, 14 nt, Mycobacterium avium subsp. paratuberculosis
cagcucaccugcgu

SEQ ID NO: 990067 - RNA, 15 nt, Mycobacterium avium subsp. paratuberculosis
cagcucaccgggcuc

SEQ ID NO: 990068 - RNA, 17 nt, Mycobacterium avium subsp. paratuberculosis
cagcucagccgccuggc

SEQ ID NO: 990069 - RNA, 18 nt, Mycobacterium avium subsp. paratuberculosis
cagcuccaccugcggcac

SEQ ID NO: 990070 - RNA, 20 nt, Mycobacterium avium subsp. paratuberculosis
cagcuccaccugcggcaccu

SEQ ID NO: 990071 - RNA, 13 nt, Mycobacterium avium subsp. paratuberculosis
cagcuccagcagc

SEQ ID NO: 990072 - RNA, 14 nt, Mycobacterium avium subsp. paratuberculosis
cagcuccagcagcc

SEQ ID NO: 990073 - RNA, 17 nt, Mycobacterium avium subsp. paratuberculosis
cagcuccagcagcccgg

SEQ ID NO: 990074 - RNA, 16 nt, Mycobacterium avium subsp. paratuberculosis
cagcuccgcggccagc

SEQ ID NO: 990075 - RNA, 23 nt, Mycobacterium avium subsp. paratuberculosis
cagcuccggcaacgaggccaggg

SEQ ID NO: 990076 - RNA, 15 nt, Mycobacterium avium subsp. paratuberculosis
cagcucccgggcggc

SEQ ID NO: 990077 - RNA, 16 nt, Mycobacterium avium subsp. paratuberculosis
cagcuccgccacccug

SEQ ID NO: 990078 - RNA, 12 nt, Mycobacterium avium subsp. paratuberculosis
cagcucccccga

SEQ ID NO: 990079 - RNA, 18 nt, Mycobacterium avium subsp. paratuberculosis
cagcucccccgacaccgc

SEQ ID NO: 990080 - RNA, 12 nt, Mycobacterium avium subsp. paratuberculosis
cagcuccggguc

SEQ ID NO: 990081 - RNA, 22 nt, Mycobacterium avium subsp. paratuberculosis
cagcuccgggucgaccgccucg

SEQ ID NO: 990082 - RNA, 13 nt, Mycobacterium avium subsp. paratuberculosis
cagcuccuccugc

SEQ ID NO: 990083 - RNA, 15 nt, Mycobacterium avium subsp. paratuberculosis
cagcuccucggcccc

SEQ ID NO: 990084 - RNA, 13 nt, Mycobacterium avium subsp. paratuberculosis
cagcuccucgguc

SEQ ID NO: 990085 - RNA, 22 nt, Mycobacterium avium subsp. paratuberculosis
cagcuccuugagccgccgcggc

SEQ ID NO: 990086 - RNA, 20 nt, Mycobacterium avium subsp. paratuberculosis
cagcucgaucgccgcgccca

SEQ ID NO: 990087 - RNA, 18 nt, Mycobacterium avium subsp. paratuberculosis
cagcucgacaucggccgc

SEQ ID NO: 990088 - RNA, 20 nt, Mycobacterium avium subsp. paratuberculosis
cagcucgacaucggccgccu

SEQ ID NO: 990089 - RNA, 21 nt, Mycobacterium avium subsp. paratuberculosis
cagcucgacaucggccgccuu

SEQ ID NO: 990090 - RNA, 14 nt, Mycobacterium avium subsp. paratuberculosis
cagcucgaccagcc

SEQ ID NO: 990091 - RNA, 17 nt, Mycobacterium avium subsp. paratuberculosis
cagcucgaccgcggcga

SEQ ID NO: 990092 - RNA, 21 nt, Mycobacterium avium subsp. paratuberculosis
cagcucgcgggccugcucguc

SEQ ID NO: 990093 - RNA, 22 nt, Mycobacterium avium subsp. paratuberculosis
cagcucgcguagcgagguguga

SEQ ID NO: 990094 - RNA, 16 nt, Mycobacterium avium subsp. paratuberculosis
cagcucgcgcccggcc

SEQ ID NO: 990095 - RNA, 17 nt, Mycobacterium avium subsp. paratuberculosis
cagcucgcgcccggcca

SEQ ID NO: 990096 - RNA, 16 nt, Mycobacterium avium subsp. paratuberculosis
cagcucgccggcgcgc

SEQ ID NO: 990097 - RNA, 17 nt, Mycobacterium avium subsp. paratuberculosis
cagcucgccggcgcgca

SEQ ID NO: 990098 - RNA, 18 nt, Mycobacterium avium subsp. paratuberculosis
cagcucguugccggcggc

SEQ ID NO: 990099 - RNA, 19 nt, Mycobacterium avium subsp. paratuberculosis
cagcucguugccggcggcc

SEQ ID NO: 990100 - RNA, 20 nt, Mycobacterium avium subsp. paratuberculosis
cagcucguugccggcggcca

SEQ ID NO: 990101 - RNA, 23 nt, Mycobacterium avium subsp. paratuberculosis
cagcucguugccggcggccagca

SEQ ID NO: 990102 - RNA, 15 nt, Mycobacterium avium subsp. paratuberculosis
cagcucggcccgcug

SEQ ID NO: 990103 - RNA, 13 nt, Mycobacterium avium subsp. paratuberculosis
cagcucgcgcuga

SEQ ID NO: 990104 - RNA, 13 nt, Mycobacterium avium subsp. paratuberculosis
cagcucggcagcc

SEQ ID NO: 990105 - RNA, 15 nt, Mycobacterium avium subsp. paratuberculosis
cagcucggcagcccc

SEQ ID NO: 990106 - RNA, 16 nt, Mycobacterium avium subsp. paratuberculosis
cagcucggcagccccg

SEQ ID NO: 990107 - RNA, 17 nt, Mycobacterium avium subsp. paratuberculosis
cagcucggcagccccgu

SEQ ID NO: 990108 - RNA, 23 nt, Mycobacterium avium subsp. paratuberculosis
ccagcagcuugacgucggucagc

SEQ ID NO: 990109 - RNA, 14 nt, Mycobacterium avium subsp. paratuberculosis
ccagcaggcgcgcc

SEQ ID NO: 990110 - RNA, 20 nt, Mycobacterium avium subsp. paratuberculosis
ccagcaguguccagucggcc

SEQ ID NO: 990111 - RNA, 20 nt, Mycobacterium avium subsp. paratuberculosis
ccagcaguccggcggucagc

SEQ ID NO: 990112 - RNA, 20 nt, Mycobacterium avium subsp. paratuberculosis
ccagcagguccauggccuug

SEQ ID NO: 990113 - RNA, 21 nt, Mycobacterium avium subsp. paratuberculosis
ccagcagguccauggccuuga

SEQ ID NO: 990114 - RNA, 13 nt, Mycobacterium avium subsp. paratuberculosis
ccagcaggucguc

SEQ ID NO: 990115 - RNA, 21 nt, Mycobacterium avium subsp. paratuberculosis
ccagcaugcgaugaccacccu

SEQ ID NO: 990116 - RNA, 20 nt, Mycobacterium avium subsp. paratuberculosis
ccagcaugaucaccgccagc

SEQ ID NO: 990117 - RNA, 22 nt, Mycobacterium avium subsp. paratuberculosis
ccagcauggcgaucaccccggc

SEQ ID NO: 990118 - RNA, 15 nt, Mycobacterium avium subsp. paratuberculosis
ccagcaugugcuccc

SEQ ID NO: 990119 - RNA, 22 nt, Mycobacterium avium subsp. paratuberculosis
ccagcauccggcauuugcccuc

SEQ ID NO: 990120 - RNA, 21 nt, Mycobacterium avium subsp. paratuberculosis
ccagcccgucggccuccagcc

SEQ ID NO: 990121 - RNA, 23 nt, Mycobacterium avium subsp. paratuberculosis
ccagcccgucggccuccagccgg

SEQ ID NO: 990122 - RNA, 22 nt, Mycobacterium avium subsp. paratuberculosis
ccagccgaaguauccggucagc

SEQ ID NO: 990123 - RNA, 16 nt, Mycobacterium avium subsp. paratuberculosis
ccagccgagccgggcc

SEQ ID NO: 990124 - RNA, 22 nt, Mycobacterium avium subsp. paratuberculosis
ccagccgcaggugcucgccggc

SEQ ID NO: 990125 - RNA, 17 nt, Mycobacterium avium subsp. paratuberculosis
ccagcccguggccagcg

SEQ ID NO: 990126 - RNA, 13 nt, Mycobacterium avium subsp. paratuberculosis
ccagcccgcucag

SEQ ID NO: 990127 - RNA, 11 nt, Mycobacterium avium subsp. paratuberculosis
ccagcccggcc

SEQ ID NO: 990128 - RNA, 17 nt, Mycobacterium avium subsp. paratuberculosis
ccagcccggccagcggc

SEQ ID NO: 990129 - RNA, 17 nt, Mycobacterium avium subsp. paratuberculosis
ccagcccggcguacagc

SEQ ID NO: 990130 - RNA, 12 nt, Mycobacterium avium subsp. paratuberculosis
ccagcccgccgg

SEQ ID NO: 990131 - RNA, 23 nt, Mycobacterium avium subsp. paratuberculosis
ccagcccgcgcgagcgcagcgcc

SEQ ID NO: 990132 - RNA, 18 nt, Mycobacterium avium subsp. paratuberculosis
ccagcccgcggcagccag

SEQ ID NO: 990133 - RNA, 21 nt, Mycobacterium avium subsp. paratuberculosis
ccagcccggccccaccgccgc

SEQ ID NO: 990134 - RNA, 13 nt, Mycobacterium avium subsp. paratuberculosis
ccagcccggcccg

SEQ ID NO: 990135 - RNA, 21 nt, Mycobacterium avium subsp. paratuberculosis
ccagcccggcccgucgagcgg

SEQ ID NO: 990136 - RNA, 16 nt, Mycobacterium avium subsp. paratuberculosis
ccagcccagccgccag

SEQ ID NO: 990137 - RNA, 12 nt, Mycobacterium avium subsp. paratuberculosis
ccagccccacca

SEQ ID NO: 990138 - RNA, 18 nt, Mycobacterium avium subsp. paratuberculosis
ccagccccucgaccaccu

SEQ ID NO: 990139 - RNA, 22 nt, Mycobacterium avium subsp. paratuberculosis
ccagccccucgacguccaggcc

SEQ ID NO: 990140 - RNA, 16 nt, Mycobacterium avium subsp. paratuberculosis
ccagccaguccgccgc

SEQ ID NO: 990141 - RNA, 23 nt, Mycobacterium avium subsp. paratuberculosis
ccagccagccgguggcggccacg

SEQ ID NO: 990142 - RNA, 16 nt, Mycobacterium avium subsp. paratuberculosis
ccagccaggccgccgg

SEQ ID NO: 990143 - RNA, 19 nt, Mycobacterium avium subsp. paratuberculosis
ccagccagaacacgccccg

SEQ ID NO: 990144 - RNA, 19 nt, Mycobacterium avium subsp. paratuberculosis
ccagccagccgcccagcau

SEQ ID NO: 990145 - RNA, 20 nt, Mycobacterium avium subsp. paratuberculosis
ccagccaccacaucgcuggg

SEQ ID NO: 990146 - RNA, 16 nt, Mycobacterium avium subsp. paratuberculosis
ccagccacaccgccgc

SEQ ID NO: 990147 - RNA, 14 nt, Mycobacterium avium subsp. paratuberculosis
ccagccacagccgc

SEQ ID NO: 990148 - RNA, 15 nt, Mycobacterium avium subsp. paratuberculosis
ccagcacagccgucg

SEQ ID NO: 990149 - RNA, 14 nt, Mycobacterium avium subsp. paratuberculosis
ccagcacagcgagg

SEQ ID NO: 990150 - RNA, 14 nt, Mycobacterium avium subsp. paratuberculosis
ccagcacaacgccu

SEQ ID NO: 990151 - RNA, 13 nt, Mycobacterium avium subsp. paratuberculosis
ccagcaccaccgc

SEQ ID NO: 990152 - RNA, 19 nt, Mycobacterium avium subsp. paratuberculosis
ccagcaccaacagcggccc

SEQ ID NO: 990153 - RNA, 20 nt, Mycobacterium avium subsp. paratuberculosis
ccagcaccaacagcggcccg

SEQ ID NO: 990154 - RNA, 12 nt, Mycobacterium avium subsp. paratuberculosis
ccagcaccacca

SEQ ID NO: 990155 - RNA, 20 nt, Mycobacterium avium subsp. paratuberculosis
ccagcaccaccacgcuggcc

SEQ ID NO: 990156 - RNA, 12 nt, Mycobacterium avium subsp. paratuberculosis
ccagcaccagcc

SEQ ID NO: 990157 - RNA, 13 nt, Mycobacterium avium subsp. paratuberculosis
ccagcaccagccc

SEQ ID NO: 990158 - RNA, 14 nt, Mycobacterium avium subsp. paratuberculosis
ccagcaccaccguc

SEQ ID NO: 990159 - RNA, 19 nt, Mycobacterium avium subsp. paratuberculosis
ccagcaccauccagugcag

SEQ ID NO: 990160 - RNA, 12 nt, Mycobacterium avium subsp. paratuberculosis
ccagcacccaga

SEQ ID NO: 990161 - RNA, 13 nt, Mycobacterium avium subsp. paratuberculosis
ccagcacccagca

SEQ ID NO: 990162 - RNA, 18 nt, Mycobacterium avium subsp. paratuberculosis
ccagcacccagcacagcg

SEQ ID NO: 990163 - RNA, 15 nt, Mycobacterium avium subsp. paratuberculosis
ccagcaaaaccccgc

SEQ ID NO: 990164 - RNA, 15 nt, Mycobacterium avium subsp. paratuberculosis
ccagcaacgacccgg

SEQ ID NO: 990165 - RNA, 17 nt, Mycobacterium avium subsp. paratuberculosis
ccagcaacgacccggcc

SEQ ID NO: 990166 - RNA, 18 nt, Mycobacterium avium subsp. paratuberculosis
ccagcaacgacccggcca

SEQ ID NO: 990167 - RNA, 20 nt, Mycobacterium avium subsp. paratuberculosis
ccagcaacgacccggccacc

SEQ ID NO: 990168 - RNA, 22 nt, Mycobacterium avium subsp. paratuberculosis
ccagcaacgacccggccaccgc

SEQ ID NO: 990169 - RNA, 23 nt, Mycobacterium avium subsp. paratuberculosis
ccagcaacgacccggccaccgcc

SEQ ID NO: 990170 - RNA, 17 nt, Mycobacterium avium subsp. paratuberculosis
ccagcaacaccagcugg

SEQ ID NO: 990171 - RNA, 15 nt, Mycobacterium avium subsp. paratuberculosis
ccagcaacagcagcg

SEQ ID NO: 990172 - RNA, 22 nt, Mycobacterium avium subsp. paratuberculosis
ccagcaacugcucgaccagccc

SEQ ID NO: 990173 - RNA, 17 nt, Mycobacterium avium subsp. paratuberculosis
ccagcagauagcccagc

SEQ ID NO: 990174 - RNA, 18 nt, Mycobacterium avium subsp. paratuberculosis
ccagcacgaucccgccgc

SEQ ID NO: 990175 - RNA, 20 nt, Mycobacterium avium subsp. paratuberculosis
ccagcacgaucccgccgccc

SEQ ID NO: 990176 - RNA, 19 nt, Mycobacterium avium subsp. paratuberculosis
ccagcacgcccagaucgcc

SEQ ID NO: 990177 - RNA, 22 nt, Mycobacterium avium subsp. paratuberculosis
ccagcacgcccagaugcaggcu

SEQ ID NO: 990178 - RNA, 18 nt, Mycobacterium avium subsp. paratuberculosis
ccagcacgcccccgcugg

SEQ ID NO: 990179 - RNA, 21 nt, Mycobacterium avium subsp. paratuberculosis
ccagcacggccaccagcagcg

SEQ ID NO: 990180 - RNA, 13 nt, Mycobacterium avium subsp. paratuberculosis
ccagcacggccgc

SEQ ID NO: 990181 - RNA, 20 nt, Mycobacterium avium subsp. paratuberculosis
ccagcacguggccgggcucg

SEQ ID NO: 990182 - RNA, 17 nt, Mycobacterium avium subsp. paratuberculosis
ccagcacggcgaccagc

SEQ ID NO: 990183 - RNA, 22 nt, Mycobacterium avium subsp. paratuberculosis
ccagcacggcggcgugcaccgc

SEQ ID NO: 990184 - RNA, 21 nt, Mycobacterium avium subsp. paratuberculosis
ccagcaccggcaccgccagcc

SEQ ID NO: 990185 - RNA, 11 nt, Mycobacterium avium subsp. paratuberculosis
ccagcaccgcg

SEQ ID NO: 990186 - RNA, 13 nt, Mycobacterium avium subsp. paratuberculosis
ccagcaccgcggc

SEQ ID NO: 990187 - RNA, 18 nt, Mycobacterium avium subsp. paratuberculosis
ccagcaccgcggccgucg

SEQ ID NO: 990188 - RNA, 13 nt, Mycobacterium avium subsp. paratuberculosis
ccagcaccgccgg

SEQ ID NO: 990189 - RNA, 16 nt, Mycobacterium avium subsp. paratuberculosis
ccagcaccgccgcggc

SEQ ID NO: 990190 - RNA, 17 nt, Mycobacterium avium subsp. paratuberculosis
ccagcaccgccgcggcc

SEQ ID NO: 990191 - RNA, 15 nt, Mycobacterium avium subsp. paratuberculosis
ccagcaccgcauccc

SEQ ID NO: 990192 - RNA, 13 nt, Mycobacterium avium subsp. paratuberculosis
ccagcaccgccac

SEQ ID NO: 990193 - RNA, 16 nt, Mycobacterium avium subsp. paratuberculosis
ccagcaccgaguugau

SEQ ID NO: 990194 - RNA, 13 nt, Mycobacterium avium subsp. paratuberculosis
ccagcacccggcc

SEQ ID NO: 990195 - RNA, 18 nt, Mycobacterium avium subsp. paratuberculosis
ccagcacccggcccacgc

SEQ ID NO: 990196 - RNA, 17 nt, Mycobacterium avium subsp. paratuberculosis
ccagcaccgagaucucg

SEQ ID NO: 990197 - RNA, 15 nt, Mycobacterium avium subsp. paratuberculosis
ccagcaccccgccgc

SEQ ID NO: 990198 - RNA, 13 nt, Mycobacterium avium subsp. paratuberculosis
ccagcaccccguc

SEQ ID NO: 990199 - RNA, 14 nt, Mycobacterium avium subsp. paratuberculosis
ccagcacccgggcc

SEQ ID NO: 990200 - RNA, 21 nt, Mycobacterium avium subsp. paratuberculosis
ccagcaccucggcgaccacgu

SEQ ID NO: 990201 - RNA, 18 nt, Mycobacterium avium subsp. paratuberculosis
ccagcaccucgcggcagc

SEQ ID NO: 990202 - RNA, 12 nt, Mycobacterium avium subsp. paratuberculosis
ccagcaccgugc

SEQ ID NO: 990203 - RNA, 17 nt, Mycobacterium avium subsp. paratuberculosis
ccagcaccgggcccagc

SEQ ID NO: 990204 - RNA, 13 nt, Mycobacterium avium subsp. paratuberculosis
ccagcaccggcgc

SEQ ID NO: 990205 - RNA, 15 nt, Mycobacterium avium subsp. paratuberculosis
ccagcaccggcgccc

SEQ ID NO: 990206 - RNA, 20 nt, Mycobacterium avium subsp. paratuberculosis
ccagcaccggcgccccgggc

SEQ ID NO: 990207 - RNA, 13 nt, Mycobacterium avium subsp. paratuberculosis
ccagcaccugcuc

SEQ ID NO: 990208 - RNA, 20 nt, Mycobacterium avium subsp. paratuberculosis
ccagcacgaccccgcccacg

SEQ ID NO: 990209 - RNA, 19 nt, Mycobacterium avium subsp. paratuberculosis
ccagcacgacgccgcuggg

SEQ ID NO: 990210 - RNA, 13 nt, Mycobacterium avium subsp. paratuberculosis
ccagcagcaccag

SEQ ID NO: 990211 - RNA, 19 nt, Mycobacterium avium subsp. paratuberculosis
ccagcagcaccagaugcac

SEQ ID NO: 990212 - RNA, 17 nt, Mycobacterium avium subsp. paratuberculosis
ccagcagcaccagggcg

SEQ ID NO: 990213 - RNA, 13 nt, Mycobacterium avium subsp. paratuberculosis
ccagcagcagcgc

SEQ ID NO: 990214 - RNA, 13 nt, Mycobacterium avium subsp. paratuberculosis
ccagcagcagccg

SEQ ID NO: 990215 - RNA, 20 nt, Mycobacterium avium subsp. paratuberculosis
ccagcagcagccgcgccgcc

SEQ ID NO: 990216 - RNA, 21 nt, Mycobacterium avium subsp. paratuberculosis
ccagcagcagccgcgccgccg

SEQ ID NO: 990217 - RNA, 14 nt, Mycobacterium avium subsp. paratuberculosis
ccagcagcagcgcc

SEQ ID NO: 990218 - RNA, 22 nt, Mycobacterium avium subsp. paratuberculosis
ccagcagcagcgcggcauggcu

SEQ ID NO: 990219 - RNA, 13 nt, Mycobacterium avium subsp. paratuberculosis
ccagcagcaggua

SEQ ID NO: 990220 - RNA, 13 nt, Mycobacterium avium subsp. paratuberculosis
ccagcagccagcc

SEQ ID NO: 990221 - RNA, 16 nt, Mycobacterium avium subsp. paratuberculosis
ccagcagccagcccag

SEQ ID NO: 990222 - RNA, 17 nt, Mycobacterium avium subsp. paratuberculosis
ccagcagccagcccagc

SEQ ID NO: 990223 - RNA, 18 nt, Mycobacterium avium subsp. paratuberculosis
ccagcagccagcccagcc

SEQ ID NO: 990224 - RNA, 20 nt, Mycobacterium avium subsp. paratuberculosis
ccagcagcgagaaccggcgc

SEQ ID NO: 990225 - RNA, 12 nt, Mycobacterium avium subsp. paratuberculosis
ccagcagcgcca

SEQ ID NO: 990226 - RNA, 16 nt, Mycobacterium avium subsp. paratuberculosis
ccagcagccugccccc

SEQ ID NO: 990227 - RNA, 9 nt, Mycobacterium avium subsp. paratuberculosis
ccagcagcg

SEQ ID NO: 990228 - RNA, 17 nt, Mycobacterium avium subsp. paratuberculosis
ccagcagccgguacagc

SEQ ID NO: 990229 - RNA, 13 nt, Mycobacterium avium subsp. paratuberculosis
ccagcagcccggc

SEQ ID NO: 990230 - RNA, 15 nt, Mycobacterium avium subsp. paratuberculosis
ccagcagcccgggcu

SEQ ID NO: 990231 - RNA, 17 nt, Mycobacterium avium subsp. paratuberculosis
ccagcagcggccggcgc

SEQ ID NO: 990232 - RNA, 13 nt, Mycobacterium avium subsp. paratuberculosis
ccagcagcgccuu

SEQ ID NO: 990233 - RNA, 14 nt, Mycobacterium avium subsp. paratuberculosis
ccagcagcgccucg

SEQ ID NO: 990234 - RNA, 22 nt, Mycobacterium avium subsp. paratuberculosis
ccagcagcggggcgagcuggcc

SEQ ID NO: 990235 - RNA, 17 nt, Mycobacterium avium subsp. paratuberculosis
ccagcagcggcacccgg

SEQ ID NO: 990236 - RNA, 16 nt, Mycobacterium avium subsp. paratuberculosis
ccagacuugggcagca

SEQ ID NO: 990237 - RNA, 20 nt, Mycobacterium avium subsp. paratuberculosis
ccagacugcgcaccgccagc

SEQ ID NO: 990238 - RNA, 16 nt, Mycobacterium avium subsp. paratuberculosis
ccagacugaugcccuc

SEQ ID NO: 990239 - RNA, 15 nt, Mycobacterium avium subsp. paratuberculosis
ccagacguccagcgc

SEQ ID NO: 990240 - RNA, 19 nt, Mycobacterium avium subsp. paratuberculosis
ccagacguccagcgccgcc

SEQ ID NO: 990241 - RNA, 17 nt, Mycobacterium avium subsp. paratuberculosis
ccagagcgcgaaaacca

SEQ ID NO: 990242 - RNA, 20 nt, Mycobacterium avium subsp. paratuberculosis
ccagagcgcgaaaaccagca

SEQ ID NO: 990243 - RNA, 21 nt, Mycobacterium avium subsp. paratuberculosis
ccagagcgcgaaaaccagcac

SEQ ID NO: 990244 - RNA, 22 nt, Mycobacterium avium subsp. paratuberculosis
ccagagcgcgaaaaccagcacc

SEQ ID NO: 990245 - RNA, 15 nt, Mycobacterium avium subsp. paratuberculosis
ccagaccacaagggc

SEQ ID NO: 990246 - RNA, 18 nt, Mycobacterium avium subsp. paratuberculosis
ccagacaggccggccgcu

SEQ ID NO: 990247 - RNA, 23 nt, Mycobacterium avium subsp. paratuberculosis
ccagacgcgcaccgccaccgccc

SEQ ID NO: 990248 - RNA, 22 nt, Mycobacterium avium subsp. paratuberculosis
ccagacgcgggcgcccagcaaa

SEQ ID NO: 990249 - RNA, 21 nt, Mycobacterium avium subsp. paratuberculosis
ccagaccggccggggcgggca

SEQ ID NO: 990250 - RNA, 13 nt, Mycobacterium avium subsp. paratuberculosis
ccagaccggcggc

SEQ ID NO: 990251 - RNA, 23 nt, Mycobacterium avium subsp. paratuberculosis
ccagaccguggaggacgaggccc

SEQ ID NO: 990252 - RNA, 20 nt, Mycobacterium avium subsp. paratuberculosis
ccagaucagcguggucagcg

SEQ ID NO: 990253 - RNA, 21 nt, Mycobacterium avium subsp. paratuberculosis
ccagaucgccuggcagcugcc

SEQ ID NO: 990254 - RNA, 22 nt, Mycobacterium avium subsp. paratuberculosis
ccagaucgccuggcagcugccg

SEQ ID NO: 990255 - RNA, 13 nt, Mycobacterium avium subsp. paratuberculosis
ccagaucgccccg

SEQ ID NO: 990256 - RNA, 15 nt, Mycobacterium avium subsp. paratuberculosis
ccagaucgcccgggc

SEQ ID NO: 990257 - RNA, 21 nt, Mycobacterium avium subsp. paratuberculosis
ccagaucgcccgggcggcggg

SEQ ID NO: 990258 - RNA, 17 nt, Mycobacterium avium subsp. paratuberculosis
ccagaucgccgacccgg

SEQ ID NO: 990259 - RNA, 14 nt, Mycobacterium avium subsp. paratuberculosis
ccagaucgacgccg

SEQ ID NO: 990260 - RNA, 16 nt, Mycobacterium avium subsp. paratuberculosis
ccagaucgagcugggc

SEQ ID NO: 990261 - RNA, 15 nt, Mycobacterium avium subsp. paratuberculosis
ccagaucgaggccag

SEQ ID NO: 990262 - RNA, 16 nt, Mycobacterium avium subsp. paratuberculosis
ccagaucgaggccagc

SEQ ID NO: 990263 - RNA, 14 nt, Mycobacterium avium subsp. paratuberculosis
ccagauucaccagc

SEQ ID NO: 990264 - RNA, 21 nt, Mycobacterium avium subsp. paratuberculosis
ccagauucaccagcgccucgg

SEQ ID NO: 990265 - RNA, 15 nt, Mycobacterium avium subsp. paratuberculosis
ccagauugcggcccu

SEQ ID NO: 990266 - RNA, 18 nt, Mycobacterium avium subsp. paratuberculosis
ccagaucggccagccacg

SEQ ID NO: 990267 - RNA, 15 nt, Mycobacterium avium subsp. paratuberculosis
ccagaucggccagcg

SEQ ID NO: 990268 - RNA, 20 nt, Mycobacterium avium subsp. paratuberculosis
ccagaucggccagcgcggcc

SEQ ID NO: 990269 - RNA, 21 nt, Mycobacterium avium subsp. paratuberculosis
ccagaucggccagcgcggccg

SEQ ID NO: 990270 - RNA, 12 nt, Mycobacterium avium subsp. paratuberculosis
ccagaucggcca

SEQ ID NO: 990271 - RNA, 14 nt, Mycobacterium avium subsp. paratuberculosis
ccagaucggccagc

SEQ ID NO: 990272 - RNA, 15 nt, Mycobacterium avium subsp. paratuberculosis
ccagaucggccaggu

SEQ ID NO: 990273 - RNA, 14 nt, Mycobacterium avium subsp. paratuberculosis
ccagaugcccagca

SEQ ID NO: 990274 - RNA, 16 nt, Mycobacterium avium subsp. paratuberculosis
ccagaugcccagcggc

SEQ ID NO: 990275 - RNA, 14 nt, Mycobacterium avium subsp. paratuberculosis
ccagaugcccgccc

SEQ ID NO: 990276 - RNA, 16 nt, Mycobacterium avium subsp. paratuberculosis
ccagaugcccgccccg

SEQ ID NO: 990277 - RNA, 21 nt, Mycobacterium avium subsp. paratuberculosis
ccagaugccgggugggcagcc

SEQ ID NO: 990278 - RNA, 13 nt, Mycobacterium avium subsp. paratuberculosis
ccagaacggcggc

SEQ ID NO: 990279 - RNA, 16 nt, Mycobacterium avium subsp. paratuberculosis
ccagaacggcggcagc

SEQ ID NO: 990280 - RNA, 17 nt, Mycobacterium avium subsp. paratuberculosis
ccagaacggaauucagu

SEQ ID NO: 990281 - RNA, 14 nt, Mycobacterium avium subsp. paratuberculosis
ccagaacagccagu

SEQ ID NO: 990282 - RNA, 20 nt, Mycobacterium avium subsp. paratuberculosis
ccagaacacguuucggcccu

SEQ ID NO: 990283 - RNA, 16 nt, Mycobacterium avium subsp. paratuberculosis
ccagaacugggccgcc

SEQ ID NO: 990284 - RNA, 21 nt, Mycobacterium avium subsp. paratuberculosis
ccagaacugggccgccgucgc

SEQ ID NO: 990285 - RNA, 15 nt, Mycobacterium avium subsp. paratuberculosis
ccagaacugguccuc

SEQ ID NO: 990286 - RNA, 18 nt, Mycobacterium avium subsp. paratuberculosis
ccacuucuggcgcugcuc

SEQ ID NO: 990287 - RNA, 15 nt, Mycobacterium avium subsp. paratuberculosis
ccacuugaaggaggc

SEQ ID NO: 990288 - RNA, 22 nt, Mycobacterium avium subsp. paratuberculosis
ccacuuccgcgcagggacgggc

SEQ ID NO: 990289 - RNA, 16 nt, Mycobacterium avium subsp. paratuberculosis
ccacuucgacggcagc

SEQ ID NO: 990290 - RNA, 17 nt, Mycobacterium avium subsp. paratuberculosis
ccacuucgacggcagcg

SEQ ID NO: 990291 - RNA, 12 nt, Mycobacterium avium subsp. paratuberculosis
ccacuuccagca

SEQ ID NO: 990292 - RNA, 15 nt, Mycobacterium avium subsp. paratuberculosis
ccacuuacgcgagcg

SEQ ID NO: 990293 - RNA, 21 nt, Mycobacterium avium subsp. paratuberculosis
ccacuggucguugcacacccg

SEQ ID NO: 990294 - RNA, 16 nt, Mycobacterium avium subsp. paratuberculosis
ccacugguaaccgccc

SEQ ID NO: 990295 - RNA, 19 nt, Mycobacterium avium subsp. paratuberculosis
ccacuggcuggucacccac

SEQ ID NO: 990296 - RNA, 17 nt, Mycobacterium avium subsp. paratuberculosis
ccacuggcggccggccg

SEQ ID NO: 990297 - RNA, 22 nt, Mycobacterium avium subsp. paratuberculosis
ccacugggcgucggcgcccccc

SEQ ID NO: 990298 - RNA, 18 nt, Mycobacterium avium subsp. paratuberculosis
ccacugccugacccggcc

SEQ ID NO: 990299 - RNA, 20 nt, Mycobacterium avium subsp. paratuberculosis
ccacugccugacccggccgu

SEQ ID NO: 990300 - RNA, 13 nt, Mycobacterium avium subsp. paratuberculosis
ccacugcgcgccc

SEQ ID NO: 990301 - RNA, 16 nt, Mycobacterium avium subsp. paratuberculosis
ccacuggcgccaccuc

SEQ ID NO: 990302 - RNA, 14 nt, Mycobacterium avium subsp. paratuberculosis
ccacgccagccucu

SEQ ID NO: 990303 - RNA, 17 nt, Mycobacterium avium subsp. paratuberculosis
ccacgccagccucuuga

SEQ ID NO: 990304 - RNA, 15 nt, Mycobacterium avium subsp. paratuberculosis
ccacugccgccgccc

SEQ ID NO: 990305 - RNA, 16 nt, Mycobacterium avium subsp. paratuberculosis
ccacugccgccgccca

SEQ ID NO: 990306 - RNA, 17 nt, Mycobacterium avium subsp. paratuberculosis
ccacugccgccgcccag

SEQ ID NO: 990307 - RNA, 19 nt, Mycobacterium avium subsp. paratuberculosis
ccacugccgccgcccaggc

SEQ ID NO: 990308 - RNA, 20 nt, Mycobacterium avium subsp. paratuberculosis
ccacugccgccgcccaggcc

SEQ ID NO: 990309 - RNA, 19 nt, Mycobacterium avium subsp. paratuberculosis
ccacacggcaggcggcccg

SEQ ID NO: 990310 - RNA, 16 nt, Mycobacterium avium subsp. paratuberculosis
ccacaccggggccagg

SEQ ID NO: 990311 - RNA, 23 nt, Mycobacterium avium subsp. paratuberculosis
ccacaucgguugcuccggcgucg

SEQ ID NO: 990312 - RNA, 17 nt, Mycobacterium avium subsp. paratuberculosis
ccacauucccgccgccg

SEQ ID NO: 990313 - RNA, 20 nt, Mycobacterium avium subsp. paratuberculosis
ccacauucccgccgccgcgg

SEQ ID NO: 990314 - RNA, 16 nt, Mycobacterium avium subsp. paratuberculosis
ccacauugcugaugcc

SEQ ID NO: 990315 - RNA, 15 nt, Mycobacterium avium subsp. paratuberculosis
ccaauucgcgcugcc

SEQ ID NO: 990316 - RNA, 14 nt, Mycobacterium avium subsp. paratuberculosis
ccacaagggccacc

SEQ ID NO: 990317 - RNA, 22 nt, Mycobacterium avium subsp. paratuberculosis
ccacaacacggggcuauccggg

SEQ ID NO: 990318 - RNA, 24 nt, Mycobacterium avium subsp. paratuberculosis
ccaaugaaauucaggccacgcagg

SEQ ID NO: 990319 - RNA, 17 nt, Mycobacterium avium subsp. paratuberculosis
ccaccaacggcagcagc

SEQ ID NO: 990320 - RNA, 18 nt, Mycobacterium avium subsp. paratuberculosis
ccaccaacggcagcagca

SEQ ID NO: 990321 - RNA, 14 nt, Mycobacterium avium subsp. paratuberculosis
ccaccaacggcucg

SEQ ID NO: 990322 - RNA, 12 nt, Mycobacterium avium subsp. paratuberculosis
ccaccaccagcg

SEQ ID NO: 990323 - RNA, 18 nt, Mycobacterium avium subsp. paratuberculosis
ccaccacauucccgccgc

SEQ ID NO: 990324 - RNA, 17 nt, Mycobacterium avium subsp. paratuberculosis
ccaccacaucggucucg

SEQ ID NO: 990325 - RNA, 12 nt, Mycobacterium avium subsp. paratuberculosis
ccaccagcgccc

SEQ ID NO: 990326 - RNA, 17 nt, Mycobacterium avium subsp. paratuberculosis
ccaccagcgccugggcg

SEQ ID NO: 990327 - RNA, 14 nt, Mycobacterium avium subsp. paratuberculosis
ccacccaggccacc

SEQ ID NO: 990328 - RNA, 20 nt, Mycobacterium avium subsp. paratuberculosis
ccacccacucccagccgccg

SEQ ID NO: 990329 - RNA, 20 nt, Mycobacterium avium subsp. paratuberculosis
ccacccacucggacaggugg

SEQ ID NO: 990330 - RNA, 14 nt, Mycobacterium avium subsp. paratuberculosis
ccaccaggagcacc

SEQ ID NO: 990331 - RNA, 18 nt, Mycobacterium avium subsp. paratuberculosis
ccaccccgaacccggcca

SEQ ID NO: 990332 - RNA, 20 nt, Mycobacterium avium subsp. paratuberculosis
ccaccccgaacccggccagc

SEQ ID NO: 990333 - RNA, 18 nt, Mycobacterium avium subsp. paratuberculosis
ccacccgaugaccggccc

SEQ ID NO: 990334 - RNA, 21 nt, Mycobacterium avium subsp. paratuberculosis
ccacccgaugaccggcccggc

SEQ ID NO: 990335 - RNA, 14 nt, Mycobacterium avium subsp. paratuberculosis
ccacccgcagcgcg

SEQ ID NO: 990336 - RNA, 13 nt, Mycobacterium avium subsp. paratuberculosis
ccacccgccagcc

SEQ ID NO: 990337 - RNA, 14 nt, Mycobacterium avium subsp. paratuberculosis
ccacccgccagccc

SEQ ID NO: 990338 - RNA, 15 nt, Mycobacterium avium subsp. paratuberculosis
ccacccgccagcccg

SEQ ID NO: 990339 - RNA, 15 nt, Mycobacterium avium subsp. paratuberculosis
ccacccgcggccggc

SEQ ID NO: 990340 - RNA, 20 nt, Mycobacterium avium subsp. paratuberculosis
ccacccgcggccggcccagc

SEQ ID NO: 990341 - RNA, 14 nt, Mycobacterium avium subsp. paratuberculosis
ccacccgcgccggc

SEQ ID NO: 990342 - RNA, 16 nt, Mycobacterium avium subsp. paratuberculosis
ccacccgcuccucgca

SEQ ID NO: 990343 - RNA, 13 nt, Mycobacterium avium subsp. paratuberculosis
ccaccgagcagcu

SEQ ID NO: 990344 - RNA, 19 nt, Mycobacterium avium subsp. paratuberculosis
ccaccgagcagcugcaugu

SEQ ID NO: 990345 - RNA, 14 nt, Mycobacterium avium subsp. paratuberculosis
ccaccgaggccagc

SEQ ID NO: 990346 - RNA, 21 nt, Mycobacterium avium subsp. paratuberculosis
ccaccgacagcacccggcccc

SEQ ID NO: 990347 - RNA, 17 nt, Mycobacterium avium subsp. paratuberculosis
ccaccgacgcgucgcgg

SEQ ID NO: 990348 - RNA, 19 nt, Mycobacterium avium subsp. paratuberculosis
ccaccgagguggcccagcc

SEQ ID NO: 990349 - RNA, 19 nt, Mycobacterium avium subsp. paratuberculosis
ccaccgcgcaaccgggccg

SEQ ID NO: 990350 - RNA, 14 nt, Mycobacterium avium subsp. paratuberculosis
ccaccgcgcccagc

SEQ ID NO: 990351 - RNA, 15 nt, Mycobacterium avium subsp. paratuberculosis
ccaccgcgcccagcc

SEQ ID NO: 990352 - RNA, 16 nt, Mycobacterium avium subsp. paratuberculosis
ccaccgcgcccagccc

SEQ ID NO: 990353 - RNA, 17 nt, Mycobacterium avium subsp. paratuberculosis
ccaccuuggacaggccc

SEQ ID NO: 990354 - RNA, 18 nt, Mycobacterium avium subsp. paratuberculosis
ccaccuugcgcagcagca

SEQ ID NO: 990355 - RNA, 21 nt, Mycobacterium avium subsp. paratuberculosis
ccaccuuggcgucgaucagcg

SEQ ID NO: 990356 - RNA, 20 nt, Mycobacterium avium subsp. paratuberculosis
ccaccuugguggccgcggcc

SEQ ID NO: 990357 - RNA, 17 nt, Mycobacterium avium subsp. paratuberculosis
ccaccuugucggcgccc

SEQ ID NO: 990358 - RNA, 18 nt, Mycobacterium avium subsp. paratuberculosis
ccacgaaccgguugcggg

SEQ ID NO: 990359 - RNA, 17 nt, Mycobacterium avium subsp. paratuberculosis
ccacgaacgcgccgccg

SEQ ID NO: 990360 - RNA, 14 nt, Mycobacterium avium subsp. paratuberculosis
ccacgaacgcugcc

SEQ ID NO: 990361 - RNA, 15 nt, Mycobacterium avium subsp. paratuberculosis
ccacgcagguccagg

SEQ ID NO: 990362 - RNA, 15 nt, Mycobacterium avium subsp. paratuberculosis
ccacgcagcggugca

SEQ ID NO: 990363 - RNA, 20 nt, Mycobacterium avium subsp. paratuberculosis
ccaccugcggcaccucggcc

SEQ ID NO: 990364 - RNA, 15 nt, Mycobacterium avium subsp. paratuberculosis
ccaccuggaggccaa

SEQ ID NO: 990365 - RNA, 12 nt, Mycobacterium avium subsp. paratuberculosis
ccaccggccgcc

SEQ ID NO: 990366 - RNA, 13 nt, Mycobacterium avium subsp. paratuberculosis
ccaccggccgccc

SEQ ID NO: 990367 - RNA, 20 nt, Mycobacterium avium subsp. paratuberculosis
ccaccguguucaccagcggg

SEQ ID NO: 990368 - RNA, 15 nt, Mycobacterium avium subsp. paratuberculosis
ccaccgugccgucgc

SEQ ID NO: 990369 - RNA, 15 nt, Mycobacterium avium subsp. paratuberculosis
ccaccguggccccag

SEQ ID NO: 990370 - RNA, 23 nt, Mycobacterium avium subsp. paratuberculosis
ccaccggauggcgcccggcagcc

SEQ ID NO: 990371 - RNA, 17 nt, Mycobacterium avium subsp. paratuberculosis
ccaccggcaaccgccac

SEQ ID NO: 990372 - RNA, 14 nt, Mycobacterium avium subsp. paratuberculosis
ccaccggcccggcg

SEQ ID NO: 990373 - RNA, 16 nt, Mycobacterium avium subsp. paratuberculosis
ccaccggaagcgcgca

SEQ ID NO: 990374 - RNA, 18 nt, Mycobacterium avium subsp. paratuberculosis
ccaccgcguugaucagcg

SEQ ID NO: 990375 - RNA, 20 nt, Mycobacterium avium subsp. paratuberculosis
ccaccgcggugaccgcccgc

SEQ ID NO: 990376 - RNA, 22 nt, Mycobacterium avium subsp. paratuberculosis
ccaccgcggugagcggccgcag

SEQ ID NO: 990377 - RNA, 16 nt, Mycobacterium avium subsp. paratuberculosis
ccaccgcggugggcca

SEQ ID NO: 990378 - RNA, 18 nt, Mycobacterium avium subsp. paratuberculosis
ccaccgcggugggccagu

SEQ ID NO: 990379 - RNA, 19 nt, Mycobacterium avium subsp. paratuberculosis
ccaccgcucgucgggcucg

SEQ ID NO: 990380 - RNA, 17 nt, Mycobacterium avium subsp. paratuberculosis
ccaccgcgccgucuucc

SEQ ID NO: 990381 - RNA, 21 nt, Mycobacterium avium subsp. paratuberculosis
ccaccgcgcgcugccgcgccc

SEQ ID NO: 990382 - RNA, 23 nt, Mycobacterium avium subsp. paratuberculosis
ccaccgcggccagcugcgacagc

SEQ ID NO: 990383 - RNA, 16 nt, Mycobacterium avium subsp. paratuberculosis
ccaccgcggcggccag

SEQ ID NO: 990384 - RNA, 20 nt, Mycobacterium avium subsp. paratuberculosis
ccaaccggaucggcuagcag

SEQ ID NO: 990385 - RNA, 17 nt, Mycobacterium avium subsp. paratuberculosis
ccaacgugaugagcgcg

SEQ ID NO: 990386 - RNA, 15 nt, Mycobacterium avium subsp. paratuberculosis
ccaacuccggcggca

SEQ ID NO: 990387 - RNA, 17 nt, Mycobacterium avium subsp. paratuberculosis
ccaacuccggcggcagc

SEQ ID NO: 990388 - RNA, 21 nt, Mycobacterium avium subsp. paratuberculosis
ccaacucaugggcccggcccg

SEQ ID NO: 990389 - RNA, 13 nt, Mycobacterium avium subsp. paratuberculosis
ccaagacgguggg

SEQ ID NO: 990390 - RNA, 19 nt, Mycobacterium avium subsp. paratuberculosis
ccaagccauuucagcagcg

SEQ ID NO: 990391 - RNA, 23 nt, Mycobacterium avium subsp. paratuberculosis
ccaagccauuucagcagcgcggc

SEQ ID NO: 990392 - RNA, 18 nt, Mycobacterium avium subsp. paratuberculosis
ccaagccgggcggcagca

SEQ ID NO: 990393 - RNA, 20 nt, Mycobacterium avium subsp. paratuberculosis
ccaaggucgucaacgacccg

SEQ ID NO: 990394 - RNA, 18 nt, Mycobacterium avium subsp. paratuberculosis
ccaaccccgggcggcucg

SEQ ID NO: 990395 - RNA, 14 nt, Mycobacterium avium subsp. paratuberculosis
ccaacagcagcaga

SEQ ID NO: 990396 - RNA, 19 nt, Mycobacterium avium subsp. paratuberculosis
ccaacacuuuuaaggagca

SEQ ID NO: 990397 - RNA, 11 nt, Mycobacterium avium subsp. paratuberculosis
ccaacaugccu

SEQ ID NO: 990398 - RNA, 18 nt, Mycobacterium avium subsp. paratuberculosis
ccaaacugcgcaaccacu

SEQ ID NO: 990399 - RNA, 22 nt, Mycobacterium avium subsp. paratuberculosis
ccaaaaagugccggacccccuc

SEQ ID NO: 990400 - RNA, 13 nt, Mycobacterium avium subsp. paratuberculosis
ccaaaagccuuga

SEQ ID NO: 990401 - RNA, 15 nt, Mycobacterium avium subsp. paratuberculosis
cauugaucuccgcgg

SEQ ID NO: 990402 - RNA, 17 nt, Mycobacterium avium subsp. paratuberculosis
cauucacgguccaucag

SEQ ID NO: 990403 - RNA, 17 nt, Mycobacterium avium subsp. paratuberculosis
cauucacgcagcuggcc

SEQ ID NO: 990404 - RNA, 16 nt, Mycobacterium avium subsp. paratuberculosis
cauguaguucagcagc

SEQ ID NO: 990405 - RNA, 18 nt, Mycobacterium avium subsp. paratuberculosis
cauggcgaucaccccggc

SEQ ID NO: 990406 - RNA, 13 nt, Mycobacterium avium subsp. paratuberculosis
caugguggcggcg

SEQ ID NO: 990407 - RNA, 19 nt, Mycobacterium avium subsp. paratuberculosis
cauggcggcgaccaaugcc

SEQ ID NO: 990408 - RNA, 18 nt, Mycobacterium avium subsp. paratuberculosis
caugggcgugccggcccg

SEQ ID NO: 990409 - RNA, 17 nt, Mycobacterium avium subsp. paratuberculosis
caugggccacggcgcga

SEQ ID NO: 990410 - RNA, 16 nt, Mycobacterium avium subsp. paratuberculosis
caugaugcccaggccc

SEQ ID NO: 990411 - RNA, 19 nt, Mycobacterium avium subsp. paratuberculosis
caugaucacaccgcugucg

SEQ ID NO: 990412 - RNA, 15 nt, Mycobacterium avium subsp. paratuberculosis
caugaucaccgccag

SEQ ID NO: 990413 - RNA, 15 nt, Mycobacterium avium subsp. paratuberculosis
caugauccggaagcc

SEQ ID NO: 990414 - RNA, 22 nt, Mycobacterium avium subsp. paratuberculosis
caugcccaccaucccgccgccg

SEQ ID NO: 990415 - RNA, 22 nt, Mycobacterium avium subsp. paratuberculosis
caugcccacgccgucgacccgu

SEQ ID NO: 990416 - RNA, 12 nt, Mycobacterium avium subsp. paratuberculosis
caugcccagcag

SEQ ID NO: 990417 - RNA, 14 nt, Mycobacterium avium subsp. paratuberculosis
caugccagaccaca

SEQ ID NO: 990418 - RNA, 14 nt, Mycobacterium avium subsp. paratuberculosis
caugccagacgcgc

SEQ ID NO: 990419 - RNA, 16 nt, Mycobacterium avium subsp. paratuberculosis
caugccacuugcgcac

SEQ ID NO: 990420 - RNA, 18 nt, Mycobacterium avium subsp. paratuberculosis
caugccgaacaacagggc

SEQ ID NO: 990421 - RNA, 16 nt, Mycobacterium avium subsp. paratuberculosis
caugcccuuggcccgg

SEQ ID NO: 990422 - RNA, 20 nt, Mycobacterium avium subsp. paratuberculosis
caugcccggcgacggcgccu

SEQ ID NO: 990423 - RNA, 18 nt, Mycobacterium avium subsp. paratuberculosis
caugcccgcgaacgccuc

SEQ ID NO: 990424 - RNA, 18 nt, Mycobacterium avium subsp. paratuberculosis
caugcccgccacggccag

SEQ ID NO: 990425 - RNA, 16 nt, Mycobacterium avium subsp. paratuberculosis
caugcccgcggugcag

SEQ ID NO: 990426 - RNA, 17 nt, Mycobacterium avium subsp. paratuberculosis
caugccgagcagcaccg

SEQ ID NO: 990427 - RNA, 18 nt, Mycobacterium avium subsp. paratuberculosis
caugccgagcagcaccgc

SEQ ID NO: 990428 - RNA, 15 nt, Mycobacterium avium subsp. paratuberculosis
caugccgagccgcuu

SEQ ID NO: 990429 - RNA, 18 nt, Mycobacterium avium subsp. paratuberculosis
caugccgaggcacagcag

SEQ ID NO: 990430 - RNA, 20 nt, Mycobacterium avium subsp. paratuberculosis
caugccgcgggccagcagcc

SEQ ID NO: 990431 - RNA, 22 nt, Mycobacterium avium subsp. paratuberculosis
caugccgcgcuugguggcgacg

SEQ ID NO: 990432 - RNA, 16 nt, Mycobacterium avium subsp. paratuberculosis
caugccgcccgggccg

SEQ ID NO: 990433 - RNA, 19 nt, Mycobacterium avium subsp. paratuberculosis
caugccgggccagccggcc

SEQ ID NO: 990434 - RNA, 21 nt, Mycobacterium avium subsp. paratuberculosis
caugccgggccagccggcccu

SEQ ID NO: 990435 - RNA, 13 nt, Mycobacterium avium subsp. paratuberculosis
caugccggcgccg

SEQ ID NO: 990436 - RNA, 15 nt, Mycobacterium avium subsp. paratuberculosis
caugccggcgccgau

SEQ ID NO: 990437 - RNA, 21 nt, Mycobacterium avium subsp. paratuberculosis
caugccguaaguggcgccgcg

SEQ ID NO: 990438 - RNA, 16 nt, Mycobacterium avium subsp. paratuberculosis
caugccgucggcgccc

SEQ ID NO: 990439 - RNA, 23 nt, Mycobacterium avium subsp. paratuberculosis
caugccguagcggucgccccaga

SEQ ID NO: 990440 - RNA, 17 nt, Mycobacterium avium subsp. paratuberculosis
caugcgaugaccacccu

SEQ ID NO: 990441 - RNA, 19 nt, Mycobacterium avium subsp. paratuberculosis
caugccguucagcgcggcc

SEQ ID NO: 990442 - RNA, 19 nt, Mycobacterium avium subsp. paratuberculosis
caugccucuucggcgcgcc

SEQ ID NO: 990443 - RNA, 18 nt, Mycobacterium avium subsp. paratuberculosis
caugaacgccggguccca

SEQ ID NO: 990444 - RNA, 18 nt, Mycobacterium avium subsp. paratuberculosis
caugaacaucggccgggu

SEQ ID NO: 990445 - RNA, 19 nt, Mycobacterium avium subsp. paratuberculosis
caugacccgguugaaggcc

SEQ ID NO: 990446 - RNA, 16 nt, Mycobacterium avium subsp. paratuberculosis
caugaagccguugaug

SEQ ID NO: 990447 - RNA, 23 nt, Mycobacterium avium subsp. paratuberculosis
caugaagccguugaugcgcaccg

SEQ ID NO: 990448 - RNA, 15 nt, Mycobacterium avium subsp. paratuberculosis
caugagcccuccagc

SEQ ID NO: 990449 - RNA, 16 nt, Mycobacterium avium subsp. paratuberculosis
caugagcccuccagcu

SEQ ID NO: 990450 - RNA, 12 nt, Mycobacterium avium subsp. paratuberculosis
caugaccggcca

SEQ ID NO: 990451 - RNA, 17 nt, Mycobacterium avium subsp. paratuberculosis
caugacgcccagcugca

SEQ ID NO: 990452 - RNA, 14 nt, Mycobacterium avium subsp. paratuberculosis
cauccacucggcca

SEQ ID NO: 990453 - RNA, 19 nt, Mycobacterium avium subsp. paratuberculosis
cauccacucgggccagccc

SEQ ID NO: 990454 - RNA, 18 nt, Mycobacterium avium subsp. paratuberculosis
cauccagaugcccagcag

SEQ ID NO: 990455 - RNA, 18 nt, Mycobacterium avium subsp. paratuberculosis
caucagcaggaccaggcc

SEQ ID NO: 990456 - RNA, 15 nt, Mycobacterium avium subsp. paratuberculosis
caucccgaccagcug

SEQ ID NO: 990457 - RNA, 16 nt, Mycobacterium avium subsp. paratuberculosis
caucccgaccagcuga

SEQ ID NO: 990458 - RNA, 12 nt, Mycobacterium avium subsp. paratuberculosis
cauccccgugcg

SEQ ID NO: 990459 - RNA, 19 nt, Mycobacterium avium subsp. paratuberculosis
caucccgccgaacccgccc

SEQ ID NO: 990460 - RNA, 13 nt, Mycobacterium avium subsp. paratuberculosis
caucccgccgggc

SEQ ID NO: 990461 - RNA, 11 nt, Mycobacterium avium subsp. paratuberculosis
caucccgcuuc

SEQ ID NO: 990462 - RNA, 17 nt, Mycobacterium avium subsp. paratuberculosis
cauccgcagcaccaggg

SEQ ID NO: 990463 - RNA, 20 nt, Mycobacterium avium subsp. paratuberculosis
cauccccgcggccaccccgg

SEQ ID NO: 990464 - RNA, 23 nt, Mycobacterium avium subsp. paratuberculosis
caucccacccggguugcgugcag

SEQ ID NO: 990465 - RNA, 19 nt, Mycobacterium avium subsp. paratuberculosis
cauccaggaccgcgcgccg

SEQ ID NO: 990466 - RNA, 20 nt, Mycobacterium avium subsp. paratuberculosis
cauccaggugaacagcagcc

SEQ ID NO: 990467 - RNA, 20 nt, Mycobacterium avium subsp. paratuberculosis
cauccagguggcgccuccgc

SEQ ID NO: 990468 - RNA, 15 nt, Mycobacterium avium subsp. paratuberculosis
cauccgcgacgccag

SEQ ID NO: 990469 - RNA, 19 nt, Mycobacterium avium subsp. paratuberculosis
cauccgccgggcggcgucc

SEQ ID NO: 990470 - RNA, 23 nt, Mycobacterium avium subsp. paratuberculosis
cauccggcauuugcccuccuucc

SEQ ID NO: 990471 - RNA, 20 nt, Mycobacterium avium subsp. paratuberculosis
cauccggccggcgaggaacu

SEQ ID NO: 990472 - RNA, 18 nt, Mycobacterium avium subsp. paratuberculosis
cauccggcgcacggcgcc

SEQ ID NO: 990473 - RNA, 20 nt, Mycobacterium avium subsp. paratuberculosis
cauccggcgcacggcgccca

SEQ ID NO: 990474 - RNA, 17 nt, Mycobacterium avium subsp. paratuberculosis
cauccgggccaccacca

SEQ ID NO: 990475 - RNA, 13 nt, Mycobacterium avium subsp. paratuberculosis
caucgaaccgccg

SEQ ID NO: 990476 - RNA, 16 nt, Mycobacterium avium subsp. paratuberculosis
caucgaggaucgccaa

SEQ ID NO: 990477 - RNA, 20 nt, Mycobacterium avium subsp. paratuberculosis
caucgagcaguagacgccgc

SEQ ID NO: 990478 - RNA, 14 nt, Mycobacterium avium subsp. paratuberculosis
caucgagccgagca

SEQ ID NO: 990479 - RNA, 13 nt, Mycobacterium avium subsp. paratuberculosis
caucgagaugcug

SEQ ID NO: 990480 - RNA, 17 nt, Mycobacterium avium subsp. paratuberculosis
caucgacuugccgccgc

SEQ ID NO: 990481 - RNA, 19 nt, Mycobacterium avium subsp. paratuberculosis
caucgagcccaccgcgccc

SEQ ID NO: 990482 - RNA, 20 nt, Mycobacterium avium subsp. paratuberculosis
caucgagcccaccgcgccca

SEQ ID NO: 990483 - RNA, 17 nt, Mycobacterium avium subsp. paratuberculosis
caucgacuccagcaccg

SEQ ID NO: 990484 - RNA, 19 nt, Mycobacterium avium subsp. paratuberculosis
caucgccaucagcagcgcc

SEQ ID NO: 990485 - RNA, 14 nt, Mycobacterium avium subsp. paratuberculosis
caucgccaggaacc

SEQ ID NO: 990486 - RNA, 23 nt, Mycobacterium avium subsp. paratuberculosis
caucgcccagccggcggauauag

SEQ ID NO: 990487 - RNA, 21 nt, Mycobacterium avium subsp. paratuberculosis
caucgccagcaacgacccggc

SEQ ID NO: 990488 - RNA, 14 nt, Mycobacterium avium subsp. paratuberculosis
caucgccaccugga

SEQ ID NO: 990489 - RNA, 19 nt, Mycobacterium avium subsp. paratuberculosis
caucgccaccuggaagcgc

SEQ ID NO: 990490 - RNA, 15 nt, Mycobacterium avium subsp. paratuberculosis
caucgccgacgguga

SEQ ID NO: 990491 - RNA, 22 nt, Mycobacterium avium subsp. paratuberculosis
caucgcuggggugcccaccagc

SEQ ID NO: 990492 - RNA, 23 nt, Mycobacterium avium subsp. paratuberculosis
caucgccgaaccgggcgcgcaga

SEQ ID NO: 990493 - RNA, 21 nt, Mycobacterium avium subsp. paratuberculosis
caucgccgaaccgucccacac

SEQ ID NO: 990494 - RNA, 18 nt, Mycobacterium avium subsp. paratuberculosis
caucggcagacccagcag

SEQ ID NO: 990495 - RNA, 23 nt, Mycobacterium avium subsp. paratuberculosis
caucggcaguccgcgccgguccc

SEQ ID NO: 990496 - RNA, 17 nt, Mycobacterium avium subsp. paratuberculosis
caucgucguuggcgcuc

SEQ ID NO: 990497 - RNA, 22 nt, Mycobacterium avium subsp. paratuberculosis
caucgucgcggcgcuaaagcca

SEQ ID NO: 990498 - RNA, 14 nt, Mycobacterium avium subsp. paratuberculosis
caucgucggcgccg

SEQ ID NO: 990499 - RNA, 16 nt, Mycobacterium avium subsp. paratuberculosis
caucgucggcgccggc

SEQ ID NO: 990500 - RNA, 16 nt, Mycobacterium avium subsp. paratuberculosis
caucggggcuacaaaa

SEQ ID NO: 990501 - RNA, 13 nt, Mycobacterium avium subsp. paratuberculosis
caucggucccagu

SEQ ID NO: 990502 - RNA, 14 nt, Mycobacterium avium subsp. paratuberculosis
caucggcucguagc

SEQ ID NO: 990503 - RNA, 12 nt, Mycobacterium avium subsp. paratuberculosis
caucggcgcccu

SEQ ID NO: 990504 - RNA, 15 nt, Mycobacterium avium subsp. paratuberculosis
caucgggcccagcag

SEQ ID NO: 990505 - RNA, 23 nt, Mycobacterium avium subsp. paratuberculosis
caucgggcccagcagccugcccc

SEQ ID NO: 990506 - RNA, 13 nt, Mycobacterium avium subsp. paratuberculosis
caucagcaccgcg

SEQ ID NO: 990507 - RNA, 17 nt, Mycobacterium avium subsp. paratuberculosis
caucaccgaggucaccg

SEQ ID NO: 990508 - RNA, 12 nt, Mycobacterium avium subsp. paratuberculosis
caucacccggcg

SEQ ID NO: 990509 - RNA, 15 nt, Mycobacterium avium subsp. paratuberculosis
caucacccggcgcgc

SEQ ID NO: 990510 - RNA, 19 nt, Mycobacterium avium subsp. paratuberculosis
caucaccgcgggcgcgccg

SEQ ID NO: 990511 - RNA, 20 nt, Mycobacterium avium subsp. paratuberculosis
caucaccgcgggcgcgccgu

SEQ ID NO: 990512 - RNA, 22 nt, Mycobacterium avium subsp. paratuberculosis
caucaccggaccggccagcagc

SEQ ID NO: 990513 - RNA, 24 nt, Mycobacterium avium subsp. paratuberculosis
caucaccggaccggccagcagccg

SEQ ID NO: 990514 - RNA, 19 nt, Mycobacterium avium subsp. paratuberculosis
caucaccuucugcgcgccg

SEQ ID NO: 990515 - RNA, 20 nt, Mycobacterium avium subsp. paratuberculosis
caucaccuccuuggccaggc

SEQ ID NO: 990516 - RNA, 13 nt, Mycobacterium avium subsp. paratuberculosis
caucaccagcaga

SEQ ID NO: 990517 - RNA, 21 nt, Mycobacterium avium subsp. paratuberculosis
cauaucgacggccccccgggc

SEQ ID NO: 990518 - RNA, 21 nt, Mycobacterium avium subsp. paratuberculosis
cauaggccgcgaggauuucgc

SEQ ID NO: 990519 - RNA, 14 nt, Mycobacterium avium subsp. paratuberculosis
cauaggccagcacc

SEQ ID NO: 990520 - RNA, 22 nt, Mycobacterium avium subsp. paratuberculosis
cauagacguuacgguagcacuu

SEQ ID NO: 990521 - RNA, 18 nt, Mycobacterium avium subsp. paratuberculosis
cauagagcuggugggcca

SEQ ID NO: 990522 - RNA, 20 nt, Mycobacterium avium subsp. paratuberculosis
cauagauaccggccagcacg

SEQ ID NO: 990523 - RNA, 14 nt, Mycobacterium avium subsp. paratuberculosis
cagugccaccacca

SEQ ID NO: 990524 - RNA, 20 nt, Mycobacterium avium subsp. paratuberculosis
cagugccaccaccacggcca

SEQ ID NO: 990525 - RNA, 21 nt, Mycobacterium avium subsp. paratuberculosis
cagugccaccaccacggccag

SEQ ID NO: 990526 - RNA, 14 nt, Mycobacterium avium subsp. paratuberculosis
cauacugacgccgg

SEQ ID NO: 990527 - RNA, 11 nt, Mycobacterium avium subsp. paratuberculosis
cgacaccagcg

SEQ ID NO: 990528 - RNA, 13 nt, Mycobacterium avium subsp. paratuberculosis
cgacaccagcgcg

SEQ ID NO: 990529 - RNA, 15 nt, Mycobacterium avium subsp. paratuberculosis
cgacacgauguugau

SEQ ID NO: 990530 - RNA, 19 nt, Mycobacterium avium subsp. paratuberculosis
cgacaccgcguccuucucc

SEQ ID NO: 990531 - RNA, 18 nt, Mycobacterium avium subsp. paratuberculosis
cgacaccgccagcagcgc

SEQ ID NO: 990532 - RNA, 23 nt, Mycobacterium avium subsp. paratuberculosis
cgacaccgccccgccgcgccggg

SEQ ID NO: 990533 - RNA, 15 nt, Mycobacterium avium subsp. paratuberculosis
cgacaacgacagcac

SEQ ID NO: 990534 - RNA, 17 nt, Mycobacterium avium subsp. paratuberculosis
cgacaacgacagcaccc

SEQ ID NO: 990535 - RNA, 12 nt, Mycobacterium avium subsp. paratuberculosis
cgacaacaggcg

SEQ ID NO: 990536 - RNA, 14 nt, Mycobacterium avium subsp. paratuberculosis
cgacaacagugccu

SEQ ID NO: 990537 - RNA, 22 nt, Mycobacterium avium subsp. paratuberculosis
cgacaacauccgcgacgacacc

SEQ ID NO: 990538 - RNA, 14 nt, Mycobacterium avium subsp. paratuberculosis
cgacagcagcucau

SEQ ID NO: 990539 - RNA, 23 nt, Mycobacterium avium subsp. paratuberculosis
cgacagcagcucauacagcggcg

SEQ ID NO: 990540 - RNA, 14 nt, Mycobacterium avium subsp. paratuberculosis
cgacagcaggaucu

SEQ ID NO: 990541 - RNA, 22 nt, Mycobacterium avium subsp. paratuberculosis
cgacagcaccucgcccugcagc

SEQ ID NO: 990542 - RNA, 20 nt, Mycobacterium avium subsp. paratuberculosis
cgacacguggaccgagcgcg

SEQ ID NO: 990543 - RNA, 22 nt, Mycobacterium avium subsp. paratuberculosis
cgacacguggaccgagcgcgcg

SEQ ID NO: 990544 - RNA, 20 nt, Mycobacterium avium subsp. paratuberculosis
cgacacguaggccgccugcc

SEQ ID NO: 990545 - RNA, 18 nt, Mycobacterium avium subsp. paratuberculosis
cgacacguccagcucucg

SEQ ID NO: 990546 - RNA, 14 nt, Mycobacterium avium subsp. paratuberculosis
cgacagcuccaaca

SEQ ID NO: 990547 - RNA, 22 nt, Mycobacterium avium subsp. paratuberculosis
cgacagcgggauguagccgguc

SEQ ID NO: 990548 - RNA, 18 nt, Mycobacterium avium subsp. paratuberculosis
cgacagcgcguacagguc

SEQ ID NO: 990549 - RNA, 17 nt, Mycobacterium avium subsp. paratuberculosis
cgacagcgcgucggcca

SEQ ID NO: 990550 - RNA, 16 nt, Mycobacterium avium subsp. paratuberculosis
cgacagccgcaccaga

SEQ ID NO: 990551 - RNA, 22 nt, Mycobacterium avium subsp. paratuberculosis
cgacagccgcaccggcgccgcc

SEQ ID NO: 990552 - RNA, 16 nt, Mycobacterium avium subsp. paratuberculosis
cgacagccggucgcgc

SEQ ID NO: 990553 - RNA, 18 nt, Mycobacterium avium subsp. paratuberculosis
cgacaucggcgccgacgg

SEQ ID NO: 990554 - RNA, 21 nt, Mycobacterium avium subsp. paratuberculosis
cgacaucgccaucagcagcgc

SEQ ID NO: 990555 - RNA, 15 nt, Mycobacterium avium subsp. paratuberculosis
cgacaucaccaccgc

SEQ ID NO: 990556 - RNA, 21 nt, Mycobacterium avium subsp. paratuberculosis
cgacaucaccgcgggcgcgcc

SEQ ID NO: 990557 - RNA, 16 nt, Mycobacterium avium subsp. paratuberculosis
cgacagcugagcagcc

SEQ ID NO: 990558 - RNA, 21 nt, Mycobacterium avium subsp. paratuberculosis
cgacagcugagcagcccgacc

SEQ ID NO: 990559 - RNA, 14 nt, Mycobacterium avium subsp. paratuberculosis
cgacaggaugcugg

SEQ ID NO: 990560 - RNA, 22 nt, Mycobacterium avium subsp. paratuberculosis
cgacaggaugcuggggucggcc

SEQ ID NO: 990561 - RNA, 15 nt, Mycobacterium avium subsp. paratuberculosis
cgacagggagccgac

SEQ ID NO: 990562 - RNA, 23 nt, Mycobacterium avium subsp. paratuberculosis
cgacagguucuuggcggccugcu

SEQ ID NO: 990563 - RNA, 14 nt, Mycobacterium avium subsp. paratuberculosis
cgacaguccgaccg

SEQ ID NO: 990564 - RNA, 21 nt, Mycobacterium avium subsp. paratuberculosis
cgacagucgcgggcggggcgc

SEQ ID NO: 990565 - RNA, 17 nt, Mycobacterium avium subsp. paratuberculosis
cgacaggucgagcacca

SEQ ID NO: 990566 - RNA, 21 nt, Mycobacterium avium subsp. paratuberculosis
cgacaggucgagcaccagguc

SEQ ID NO: 990567 - RNA, 14 nt, Mycobacterium avium subsp. paratuberculosis
cgacaggucggcgg

SEQ ID NO: 990568 - RNA, 22 nt, Mycobacterium avium subsp. paratuberculosis
cgaauccgauugcggcgcaggc

SEQ ID NO: 990569 - RNA, 16 nt, Mycobacterium avium subsp. paratuberculosis
cgaauccagcgcgccg

SEQ ID NO: 990570 - RNA, 18 nt, Mycobacterium avium subsp. paratuberculosis
cgaaucccggccucgugc

SEQ ID NO: 990571 - RNA, 18 nt, Mycobacterium avium subsp. paratuberculosis
cgaauccggccggagacc

SEQ ID NO: 990572 - RNA, 18 nt, Mycobacterium avium subsp. paratuberculosis
cgaauccggugaccgccu

SEQ ID NO: 990573 - RNA, 17 nt, Mycobacterium avium subsp. paratuberculosis
cgaaucgggcugggucc

SEQ ID NO: 990574 - RNA, 22 nt, Mycobacterium avium subsp. paratuberculosis
cgaauguccuugacguacuggc

SEQ ID NO: 990575 - RNA, 16 nt, Mycobacterium avium subsp. paratuberculosis
cgaaugucgaccaccg

SEQ ID NO: 990576 - RNA, 14 nt, Mycobacterium avium subsp. paratuberculosis
cgaaugcggcugcc

SEQ ID NO: 990577 - RNA, 22 nt, Mycobacterium avium subsp. paratuberculosis
cgaaucagcagcuugaucgccg

SEQ ID NO: 990578 - RNA, 12 nt, Mycobacterium avium subsp. paratuberculosis
cgaauccacaca

SEQ ID NO: 990579 - RNA, 17 nt, Mycobacterium avium subsp. paratuberculosis
cgaaguucgacacggug

SEQ ID NO: 990580 - RNA, 21 nt, Mycobacterium avium subsp. paratuberculosis
cgaaguuggcgucgggcaccu

SEQ ID NO: 990581 - RNA, 18 nt, Mycobacterium avium subsp. paratuberculosis
cgaaguuggucaccacca

SEQ ID NO: 990582 - RNA, 15 nt, Mycobacterium avium subsp. paratuberculosis
cgaaggccagcgaua

SEQ ID NO: 990583 - RNA, 15 nt, Mycobacterium avium subsp. paratuberculosis
cgaaguggacaugca

SEQ ID NO: 990584 - RNA, 21 nt, Mycobacterium avium subsp. paratuberculosis
cgaaguggacaugcagccgcc

SEQ ID NO: 990585 - RNA, 19 nt, Mycobacterium avium subsp. paratuberculosis
cgaacgugcugugcgggcg

SEQ ID NO: 990586 - RNA, 13 nt, Mycobacterium avium subsp. paratuberculosis
cgaacgucggguc

SEQ ID NO: 990587 - RNA, 19 nt, Mycobacterium avium subsp. paratuberculosis
cgaacuccacccugccgac

SEQ ID NO: 990588 - RNA, 21 nt, Mycobacterium avium subsp. paratuberculosis
cgaacuccuugacccggccca

SEQ ID NO: 990589 - RNA, 15 nt, Mycobacterium avium subsp. paratuberculosis
cgaacgccagcagcu

SEQ ID NO: 990590 - RNA, 14 nt, Mycobacterium avium subsp. paratuberculosis
cgaacgccaccacg

SEQ ID NO: 990591 - RNA, 15 nt, Mycobacterium avium subsp. paratuberculosis
cgaacgucaccaaca

SEQ ID NO: 990592 - RNA, 22 nt, Mycobacterium avium subsp. paratuberculosis
cgaacggguccuugccggcggc

SEQ ID NO: 990593 - RNA, 23 nt, Mycobacterium avium subsp. paratuberculosis
cgaacggguccuugccggcggcg

SEQ ID NO: 990594 - RNA, 22 nt, Mycobacterium avium subsp. paratuberculosis
cgaaccucgagauucugcagcc

SEQ ID NO: 990595 - RNA, 15 nt, Mycobacterium avium subsp. paratuberculosis
cgaacgcaccaccgc

SEQ ID NO: 990596 - RNA, 17 nt, Mycobacterium avium subsp. paratuberculosis
cgaaccggggcaccacg

SEQ ID NO: 990597 - RNA, 19 nt, Mycobacterium avium subsp. paratuberculosis
cgaaccgggugacgaccau

SEQ ID NO: 990598 - RNA, 23 nt, Mycobacterium avium subsp. paratuberculosis
cgaacuugaccgggcuccagcgg

SEQ ID NO: 990599 - RNA, 21 nt, Mycobacterium avium subsp. paratuberculosis
cgaacugcaucauguccaggu

SEQ ID NO: 990600 - RNA, 15 nt, Mycobacterium avium subsp. paratuberculosis
cgaacugcaccagca

SEQ ID NO: 990601 - RNA, 17 nt, Mycobacterium avium subsp. paratuberculosis
cgaagauggccagcgcg

SEQ ID NO: 990602 - RNA, 15 nt, Mycobacterium avium subsp. paratuberculosis
cgaagauggccaggu

SEQ ID NO: 990603 - RNA, 15 nt, Mycobacterium avium subsp. paratuberculosis
cgaagauggcgugcc

SEQ ID NO: 990604 - RNA, 23 nt, Mycobacterium avium subsp. paratuberculosis
cgaagaacuggcugagcaccggg

SEQ ID NO: 990605 - RNA, 23 nt, Mycobacterium avium subsp. paratuberculosis
cgaagcucaucaccggcgcgccg

SEQ ID NO: 990606 - RNA, 19 nt, Mycobacterium avium subsp. paratuberculosis
cgaagcguuucagcaaccc

SEQ ID NO: 990607 - RNA, 13 nt, Mycobacterium avium subsp. paratuberculosis
cgaagcccgcagc

SEQ ID NO: 990608 - RNA, 14 nt, Mycobacterium avium subsp. paratuberculosis
cgaagcccgcagcg

SEQ ID NO: 990609 - RNA, 14 nt, Mycobacterium avium subsp. paratuberculosis
cgaagcccgugccg

SEQ ID NO: 990610 - RNA, 14 nt, Mycobacterium avium subsp. paratuberculosis
cgaagcgggcggcg

SEQ ID NO: 990611 - RNA, 19 nt, Mycobacterium avium subsp. paratuberculosis
cgaagcgggucggggagcc

SEQ ID NO: 990612 - RNA, 17 nt, Mycobacterium avium subsp. paratuberculosis
cgaagcggugcaccacc

SEQ ID NO: 990613 - RNA, 22 nt, Mycobacterium avium subsp. paratuberculosis
cgaccgugcccaccagccggcc

SEQ ID NO: 990614 - RNA, 17 nt, Mycobacterium avium subsp. paratuberculosis
cgaccguugaccgacgc

SEQ ID NO: 990615 - RNA, 21 nt, Mycobacterium avium subsp. paratuberculosis
cgaccgucuucuucagccgca

SEQ ID NO: 990616 - RNA, 20 nt, Mycobacterium avium subsp. paratuberculosis
cgaccgguccgccgccggcg

SEQ ID NO: 990617 - RNA, 22 nt, Mycobacterium avium subsp. paratuberculosis
cgaccgguccgccgccggcgga

SEQ ID NO: 990618 - RNA, 20 nt, Mycobacterium avium subsp. paratuberculosis
cgaccggucucgaccgcggc

SEQ ID NO: 990619 - RNA, 19 nt, Mycobacterium avium subsp. paratuberculosis
cgaccggcucagcccggcg

SEQ ID NO: 990620 - RNA, 22 nt, Mycobacterium avium subsp. paratuberculosis
cgaccggcggaaguagcccgga

SEQ ID NO: 990621 - RNA, 20 nt, Mycobacterium avium subsp. paratuberculosis
cgaccggcagcaccggccgg

SEQ ID NO: 990622 - RNA, 15 nt, Mycobacterium avium subsp. paratuberculosis
cgaccgccccgccgg

SEQ ID NO: 990623 - RNA, 22 nt, Mycobacterium avium subsp. paratuberculosis
cgaccgcggcgccgauggcgaa

SEQ ID NO: 990624 - RNA, 16 nt, Mycobacterium avium subsp. paratuberculosis
cgaccgcggcuccggc

SEQ ID NO: 990625 - RNA, 19 nt, Mycobacterium avium subsp. paratuberculosis
cgaccgcggcuccggccgc

SEQ ID NO: 990626 - RNA, 14 nt, Mycobacterium avium subsp. paratuberculosis
cgaccgcgccgggg

SEQ ID NO: 990627 - RNA, 22 nt, Mycobacterium avium subsp. paratuberculosis
cgaccgcgaucagggccgcggc

SEQ ID NO: 990628 - RNA, 18 nt, Mycobacterium avium subsp. paratuberculosis
cgaccgcgaugcgacacc

SEQ ID NO: 990629 - RNA, 18 nt, Mycobacterium avium subsp. paratuberculosis
cgaccgcgcaccggcgcu

SEQ ID NO: 990630 - RNA, 14 nt, Mycobacterium avium subsp. paratuberculosis
cgacccguccagcg

SEQ ID NO: 990631 - RNA, 21 nt, Mycobacterium avium subsp. paratuberculosis
cgacccugcguccggcccggc

SEQ ID NO: 990632 - RNA, 17 nt, Mycobacterium avium subsp. paratuberculosis
cgacccguuccggcgag

SEQ ID NO: 990633 - RNA, 18 nt, Mycobacterium avium subsp. paratuberculosis
cgacccgcuucgcccggc

SEQ ID NO: 990634 - RNA, 15 nt, Mycobacterium avium subsp. paratuberculosis
cgacccggccaccgc

SEQ ID NO: 990635 - RNA, 14 nt, Mycobacterium avium subsp. paratuberculosis
cgacccggccagcg

SEQ ID NO: 990636 - RNA, 14 nt, Mycobacterium avium subsp. paratuberculosis
cgacccgggccagc

SEQ ID NO: 990637 - RNA, 14 nt, Mycobacterium avium subsp. paratuberculosis
cgaccgacagccgc

SEQ ID NO: 990638 - RNA, 20 nt, Mycobacterium avium subsp. paratuberculosis
cgaccgcaccgaccagcggg

SEQ ID NO: 990639 - RNA, 20 nt, Mycobacterium avium subsp. paratuberculosis
cgaccgccaccacccggcga

SEQ ID NO: 990640 - RNA, 21 nt, Mycobacterium avium subsp. paratuberculosis
cgaccccggcggcaccgccgc

SEQ ID NO: 990641 - RNA, 18 nt, Mycobacterium avium subsp. paratuberculosis
cgacccgaagccaggugu

SEQ ID NO: 990642 - RNA, 14 nt, Mycobacterium avium subsp. paratuberculosis
cgacccgaagccca

SEQ ID NO: 990643 - RNA, 15 nt, Mycobacterium avium subsp. paratuberculosis
cgacccgcaccaccg

SEQ ID NO: 990644 - RNA, 22 nt, Mycobacterium avium subsp. paratuberculosis
cgacccgcacgaugccgcgcuc

SEQ ID NO: 990645 - RNA, 16 nt, Mycobacterium avium subsp. paratuberculosis
cgacccgcccgccggg

SEQ ID NO: 990646 - RNA, 16 nt, Mycobacterium avium subsp. paratuberculosis
cgacccaggccgccgc

SEQ ID NO: 990647 - RNA, 22 nt, Mycobacterium avium subsp. paratuberculosis
cgacccccgccgcgucggucag

SEQ ID NO: 990648 - RNA, 13 nt, Mycobacterium avium subsp. paratuberculosis
cgaccccgccagc

SEQ ID NO: 990649 - RNA, 17 nt, Mycobacterium avium subsp. paratuberculosis
cgaccccgccagcaccg

SEQ ID NO: 990650 - RNA, 16 nt, Mycobacterium avium subsp. paratuberculosis
cgaccccgccggcccg

SEQ ID NO: 990651 - RNA, 21 nt, Mycobacterium avium subsp. paratuberculosis
cgaccccgccgucgacgcgug

SEQ ID NO: 990652 - RNA, 13 nt, Mycobacterium avium subsp. paratuberculosis
cgaccaacgccau

SEQ ID NO: 990653 - RNA, 18 nt, Mycobacterium avium subsp. paratuberculosis
cgaccaacuccaccgccc

SEQ ID NO: 990654 - RNA, 20 nt, Mycobacterium avium subsp. paratuberculosis
cgaccaacuccaccgcccgg

SEQ ID NO: 990655 - RNA, 20 nt, Mycobacterium avium subsp. paratuberculosis
cgacauggucgggcgcacca

SEQ ID NO: 990656 - RNA, 23 nt, Mycobacterium avium subsp. paratuberculosis
cgacaugcuguuccagacgucgg

SEQ ID NO: 990657 - RNA, 14 nt, Mycobacterium avium subsp. paratuberculosis
cgacauggccagca

SEQ ID NO: 990658 - RNA, 14 nt, Mycobacterium avium subsp. paratuberculosis
cgaccacacccgca

SEQ ID NO: 990659 - RNA, 18 nt, Mycobacterium avium subsp. paratuberculosis
cgaccacaccgccggcca

SEQ ID NO: 990660 - RNA, 16 nt, Mycobacterium avium subsp. paratuberculosis
cgaccacaccggcgcu

SEQ ID NO: 990661 - RNA, 13 nt, Mycobacterium avium subsp. paratuberculosis
cgaccacagcgcc

SEQ ID NO: 990662 - RNA, 15 nt, Mycobacterium avium subsp. paratuberculosis
cgaccaccaccgccc

SEQ ID NO: 990663 - RNA, 24 nt, Mycobacterium avium subsp. paratuberculosis
cgaccaccucuucgcgguccaucu

SEQ ID NO: 990664 - RNA, 21 nt, Mycobacterium avium subsp. paratuberculosis
cgaccacgaacaccggcgcga

SEQ ID NO: 990665 - RNA, 18 nt, Mycobacterium avium subsp. paratuberculosis
cgaccacgcacaccaccg

SEQ ID NO: 990666 - RNA, 19 nt, Mycobacterium avium subsp. paratuberculosis
cgaccaccgccggcccggc

SEQ ID NO: 990667 - RNA, 18 nt, Mycobacterium avium subsp. paratuberculosis
cgaccacccccagcccgc

SEQ ID NO: 990668 - RNA, 17 nt, Mycobacterium avium subsp. paratuberculosis
cgaccacccucaccacg

SEQ ID NO: 990669 - RNA, 15 nt, Mycobacterium avium subsp. paratuberculosis
cgaccacggccccag

SEQ ID NO: 990670 - RNA, 13 nt, Mycobacterium avium subsp. paratuberculosis
cgaccauggucag

SEQ ID NO: 990671 - RNA, 14 nt, Mycobacterium avium subsp. paratuberculosis
cgaccaugccgcgg

SEQ ID NO: 990672 - RNA, 19 nt, Mycobacterium avium subsp. paratuberculosis
cgaccagguccaccccgcc

SEQ ID NO: 990673 - RNA, 17 nt, Mycobacterium avium subsp. paratuberculosis
cgaccaucauggccucc

SEQ ID NO: 990674 - RNA, 20 nt, Mycobacterium avium subsp. paratuberculosis
cgaccaucauggccucccca

SEQ ID NO: 990675 - RNA, 16 nt, Mycobacterium avium subsp. paratuberculosis
cgaccauccacucggg

SEQ ID NO: 990676 - RNA, 15 nt, Mycobacterium avium subsp. paratuberculosis
cgaccaucagcccgg

SEQ ID NO: 990677 - RNA, 21 nt, Mycobacterium avium subsp. paratuberculosis
cgaccaucagcgcccgggugg

SEQ ID NO: 990678 - RNA, 22 nt, Mycobacterium avium subsp. paratuberculosis
cgaccaguagaaguggccgacc

SEQ ID NO: 990679 - RNA, 20 nt, Mycobacterium avium subsp. paratuberculosis
cgaccagcuugucgaucucu

SEQ ID NO: 990680 - RNA, 21 nt, Mycobacterium avium subsp. paratuberculosis
cgaccaccuccccgcggugcc

SEQ ID NO: 990681 - RNA, 11 nt, Mycobacterium avium subsp. paratuberculosis
cgaccagcagg

SEQ ID NO: 990682 - RNA, 18 nt, Mycobacterium avium subsp. paratuberculosis
cgaccagcaggacgcgcc

SEQ ID NO: 990683 - RNA, 21 nt, Mycobacterium avium subsp. paratuberculosis
cgaccaggaugcccaggauga

SEQ ID NO: 990684 - RNA, 14 nt, Mycobacterium avium subsp. paratuberculosis
cgaccagcuccugg

SEQ ID NO: 990685 - RNA, 19 nt, Mycobacterium avium subsp. paratuberculosis
cgaccagcccggccgccga

SEQ ID NO: 990686 - RNA, 16 nt, Mycobacterium avium subsp. paratuberculosis
cgaccagcgacggcag

SEQ ID NO: 990687 - RNA, 17 nt, Mycobacterium avium subsp. paratuberculosis
cgaccagcgacggcagg

SEQ ID NO: 990688 - RNA, 12 nt, Mycobacterium avium subsp. paratuberculosis
cgaccagcgccg

SEQ ID NO: 990689 - RNA, 13 nt, Mycobacterium avium subsp. paratuberculosis
cgaccagcgcgcc

SEQ ID NO: 990690 - RNA, 14 nt, Mycobacterium avium subsp. paratuberculosis
cgaccagcgcgccg

SEQ ID NO: 990691 - RNA, 23 nt, Mycobacterium avium subsp. paratuberculosis
cgaccagcgcgccggccagcagc

SEQ ID NO: 990692 - RNA, 18 nt, Mycobacterium avium subsp. paratuberculosis
cgaccagcggcagcacgu

SEQ ID NO: 990693 - RNA, 22 nt, Mycobacterium avium subsp. paratuberculosis
cgaccagcggcagcagcaccag

SEQ ID NO: 990694 - RNA, 22 nt, Mycobacterium avium subsp. paratuberculosis
cgaccugguccaccgcggcggc

SEQ ID NO: 990695 - RNA, 19 nt, Mycobacterium avium subsp. paratuberculosis
cgaccuugcgcagccggca

SEQ ID NO: 990696 - RNA, 18 nt, Mycobacterium avium subsp. paratuberculosis
cgaccuucgagccgccgc

SEQ ID NO: 990697 - RNA, 19 nt, Mycobacterium avium subsp. paratuberculosis
cgacgaaauugggcugggu

SEQ ID NO: 990698 - RNA, 22 nt, Mycobacterium avium subsp. paratuberculosis
cgaccuugucgcgcacccgcac

SEQ ID NO: 990699 - RNA, 18 nt, Mycobacterium avium subsp. paratuberculosis
cgacgaagaugcgcccgg

SEQ ID NO: 990700 - RNA, 14 nt, Mycobacterium avium subsp. paratuberculosis
cgacgaagcagcuc

SEQ ID NO: 990701 - RNA, 16 nt, Mycobacterium avium subsp. paratuberculosis
cgacgaacgccggcau

SEQ ID NO: 990702 - RNA, 21 nt, Mycobacterium avium subsp. paratuberculosis
cgacgaacgcggugagcgugc

SEQ ID NO: 990703 - RNA, 13 nt, Mycobacterium avium subsp. paratuberculosis
cgacgaagucgac

SEQ ID NO: 990704 - RNA, 17 nt, Mycobacterium avium subsp. paratuberculosis
cgacgaagccgccgccc

SEQ ID NO: 990705 - RNA, 21 nt, Mycobacterium avium subsp. paratuberculosis
cgaccucuucgcuggacagcc

SEQ ID NO: 990706 - RNA, 17 nt, Mycobacterium avium subsp. paratuberculosis
cgaccugaacgcgcagu

SEQ ID NO: 990707 - RNA, 19 nt, Mycobacterium avium subsp. paratuberculosis
cgaccugcgcgacggcgcu

SEQ ID NO: 990708 - RNA, 19 nt, Mycobacterium avium subsp. paratuberculosis
cgaccugcgggcccaccgc

SEQ ID NO: 990709 - RNA, 16 nt, Mycobacterium avium subsp. paratuberculosis
cgaccugcccgggccc

SEQ ID NO: 990710 - RNA, 15 nt, Mycobacterium avium subsp. paratuberculosis
cgaccuggcgggcca

SEQ ID NO: 990711 - RNA, 18 nt, Mycobacterium avium subsp. paratuberculosis
cgaccuggcgggccagcu

SEQ ID NO: 990712 - RNA, 19 nt, Mycobacterium avium subsp. paratuberculosis
cgaccugggcggccaccgc

SEQ ID NO: 990713 - RNA, 16 nt, Mycobacterium avium subsp. paratuberculosis
cgaccucgcccgccgc

SEQ ID NO: 990714 - RNA, 19 nt, Mycobacterium avium subsp. paratuberculosis
cgaccucgaugcgcagggc

SEQ ID NO: 990715 - RNA, 22 nt, Mycobacterium avium subsp. paratuberculosis
cgaccuccugcaaggcccccgc

SEQ ID NO: 990716 - RNA, 19 nt, Mycobacterium avium subsp. paratuberculosis
cgaccuccaaugcgcccug

SEQ ID NO: 990717 - RNA, 16 nt, Mycobacterium avium subsp. paratuberculosis
cgaccucaccccgcuu

SEQ ID NO: 990718 - RNA, 19 nt, Mycobacterium avium subsp. paratuberculosis
cgacgcaccacgagcagcc

SEQ ID NO: 990719 - RNA, 21 nt, Mycobacterium avium subsp. paratuberculosis
cgacgcacgaaaccgcguggc

SEQ ID NO: 990720 - RNA, 23 nt, Mycobacterium avium subsp. paratuberculosis
cgacgcacgaaaccgcguggcgc

SEQ ID NO: 990721 - RNA, 15 nt, Mycobacterium avium subsp. paratuberculosis
cgacgaucucguggg

SEQ ID NO: 990722 - RNA, 18 nt, Mycobacterium avium subsp. paratuberculosis
cgacgaucugcacacggg

SEQ ID NO: 990723 - RNA, 17 nt, Mycobacterium avium subsp. paratuberculosis
cgacgaugagggccagc

SEQ ID NO: 990724 - RNA, 20 nt, Mycobacterium avium subsp. paratuberculosis
cgacgaugagggccagcagu

SEQ ID NO: 990725 - RNA, 15 nt, Mycobacterium avium subsp. paratuberculosis
cgacgaugccggccg

SEQ ID NO: 990726 - RNA, 22 nt, Mycobacterium avium subsp. paratuberculosis
cgacgauggcccggaccgccgc

SEQ ID NO: 990727 - RNA, 15 nt, Mycobacterium avium subsp. paratuberculosis
cgacgauggucugga

SEQ ID NO: 990728 - RNA, 18 nt, Mycobacterium avium subsp. paratuberculosis
cgacgauggucuggauga

SEQ ID NO: 990729 - RNA, 22 nt, Mycobacterium avium subsp. paratuberculosis
cgacgaugucgacccgcggcgc

SEQ ID NO: 990730 - RNA, 12 nt, Mycobacterium avium subsp. paratuberculosis
cgacgccaccgc

SEQ ID NO: 990731 - RNA, 13 nt, Mycobacterium avium subsp. paratuberculosis
cgacgccagcggc

SEQ ID NO: 990732 - RNA, 13 nt, Mycobacterium avium subsp. paratuberculosis
cgacgagcccgcg

SEQ ID NO: 990733 - RNA, 21 nt, Mycobacterium avium subsp. paratuberculosis
cgacgauaucggccgcggggc

SEQ ID NO: 990734 - RNA, 14 nt, Mycobacterium avium subsp. paratuberculosis
cgacgauccgggcg

SEQ ID NO: 990735 - RNA, 22 nt, Mycobacterium avium subsp. paratuberculosis
cgacgaucgcgacggccggggc

SEQ ID NO: 990736 - RNA, 18 nt, Mycobacterium avium subsp. paratuberculosis
cgacgaccgcgacggcgc

SEQ ID NO: 990737 - RNA, 22 nt, Mycobacterium avium subsp. paratuberculosis
cgacgaccucccccgacgccga

SEQ ID NO: 990738 - RNA, 15 nt, Mycobacterium avium subsp. paratuberculosis
cgacgaccaucagcg

SEQ ID NO: 990739 - RNA, 18 nt, Mycobacterium avium subsp. paratuberculosis
cgacgaccaucagcgccc

SEQ ID NO: 990740 - RNA, 11 nt, Mycobacterium avium subsp. paratuberculosis
cgacgacuggg

SEQ ID NO: 990741 - RNA, 20 nt, Mycobacterium avium subsp. paratuberculosis
cgacgacugggugcgcgggc

SEQ ID NO: 990742 - RNA, 21 nt, Mycobacterium avium subsp. paratuberculosis
cgacgacugggugcgcgggcg

SEQ ID NO: 990743 - RNA, 22 nt, Mycobacterium avium subsp. paratuberculosis
cgacgagagcggaucggcggcg

SEQ ID NO: 990744 - RNA, 18 nt, Mycobacterium avium subsp. paratuberculosis
cgacgagaucagcaccag

SEQ ID NO: 990745 - RNA, 22 nt, Mycobacterium avium subsp. paratuberculosis
cgacgacggucuucccgccgcc

SEQ ID NO: 990746 - RNA, 20 nt, Mycobacterium avium subsp. paratuberculosis
cgacgacgugacgaccuggu

SEQ ID NO: 990747 - RNA, 18 nt, Mycobacterium avium subsp. paratuberculosis
cgacguaaccguacggcc

SEQ ID NO: 990748 - RNA, 14 nt, Mycobacterium avium subsp. paratuberculosis
cgacguagcccgcc

SEQ ID NO: 990749 - RNA, 22 nt, Mycobacterium avium subsp. paratuberculosis
cgacggugaugucgccggcggc

SEQ ID NO: 990750 - RNA, 16 nt, Mycobacterium avium subsp. paratuberculosis
cgacggugcaugcgcu

SEQ ID NO: 990751 - RNA, 15 nt, Mycobacterium avium subsp. paratuberculosis
cgacgguggagcggc

SEQ ID NO: 990752 - RNA, 17 nt, Mycobacterium avium subsp. paratuberculosis
cgacgguggagcggccc

SEQ ID NO: 990753 - RNA, 17 nt, Mycobacterium avium subsp. paratuberculosis
cgacgguguaggacgcc

SEQ ID NO: 990754 - RNA, 16 nt, Mycobacterium avium subsp. paratuberculosis
cgacgguguccgcggg

SEQ ID NO: 990755 - RNA, 20 nt, Mycobacterium avium subsp. paratuberculosis
cgacggugaccggcucgagc

SEQ ID NO: 990756 - RNA, 17 nt, Mycobacterium avium subsp. paratuberculosis
cgacggugagcaccgcc

SEQ ID NO: 990757 - RNA, 18 nt, Mycobacterium avium subsp. paratuberculosis
cgacgggccgggcacguc

SEQ ID NO: 990758 - RNA, 18 nt, Mycobacterium avium subsp. paratuberculosis
cgacgggcacccgcgcgu

SEQ ID NO: 990759 - RNA, 15 nt, Mycobacterium avium subsp. paratuberculosis
cgacgggcugcugca

SEQ ID NO: 990760 - RNA, 17 nt, Mycobacterium avium subsp. paratuberculosis
cgacggucaccggcagg

SEQ ID NO: 990761 - RNA, 17 nt, Mycobacterium avium subsp. paratuberculosis
cgacggucacggccgcc

SEQ ID NO: 990762 - RNA, 21 nt, Mycobacterium avium subsp. paratuberculosis
cgacggucacggccgccagca

SEQ ID NO: 990763 - RNA, 15 nt, Mycobacterium avium subsp. paratuberculosis
cgacggucgugcugg

SEQ ID NO: 990764 - RNA, 23 nt, Mycobacterium avium subsp. paratuberculosis
cgacggucgugcugggccgggcg

SEQ ID NO: 990765 - RNA, 17 nt, Mycobacterium avium subsp. paratuberculosis
cgacggcacccggcccu

SEQ ID NO: 990766 - RNA, 15 nt, Mycobacterium avium subsp. paratuberculosis
cgacggcaccgccgg

SEQ ID NO: 990767 - RNA, 21 nt, Mycobacterium avium subsp. paratuberculosis
cgacggcagcaccucgcgcag

SEQ ID NO: 990768 - RNA, 14 nt, Mycobacterium avium subsp. paratuberculosis
cgacggcagcggca

SEQ ID NO: 990769 - RNA, 14 nt, Mycobacterium avium subsp. paratuberculosis
cgacggcaauccgg

SEQ ID NO: 990770 - RNA, 17 nt, Mycobacterium avium subsp. paratuberculosis
cgacggccagcgcggcg

SEQ ID NO: 990771 - RNA, 22 nt, Mycobacterium avium subsp. paratuberculosis
cgacggccccccgggcaccagc

SEQ ID NO: 990772 - RNA, 18 nt, Mycobacterium avium subsp. paratuberculosis
cgacggccgccgcgacgc

SEQ ID NO: 990773 - RNA, 14 nt, Mycobacterium avium subsp. paratuberculosis
cgacggcgccgccc

SEQ ID NO: 990774 - RNA, 13 nt, Mycobacterium avium subsp. paratuberculosis
cgacggcgcgccc

SEQ ID NO: 990775 - RNA, 15 nt, Mycobacterium avium subsp. paratuberculosis
cgacggcgcgcccga

SEQ ID NO: 990776 - RNA, 14 nt, Mycobacterium avium subsp. paratuberculosis
cgacggccggcccu

SEQ ID NO: 990777 - RNA, 15 nt, Mycobacterium avium subsp. paratuberculosis
cgacggcgacggcca

SEQ ID NO: 990778 - RNA, 15 nt, Mycobacterium avium subsp. paratuberculosis
cgacggccggggcca

SEQ ID NO: 990779 - RNA, 20 nt, Mycobacterium avium subsp. paratuberculosis
cgacggcucuucgcggcggg

SEQ ID NO: 990780 - RNA, 23 nt, Mycobacterium avium subsp. paratuberculosis
cgacggcgguucgaagcgcagcg

SEQ ID NO: 990781 - RNA, 16 nt, Mycobacterium avium subsp. paratuberculosis
cgacggcggcgaagac

SEQ ID NO: 990782 - RNA, 17 nt, Mycobacterium avium subsp. paratuberculosis
cgacgcugcccaaccgu

SEQ ID NO: 990783 - RNA, 15 nt, Mycobacterium avium subsp. paratuberculosis
cgacgcugccggggc

SEQ ID NO: 990784 - RNA, 14 nt, Mycobacterium avium subsp. paratuberculosis
cgacgcggcacgcc

SEQ ID NO: 990785 - RNA, 16 nt, Mycobacterium avium subsp. paratuberculosis
cgacgcgccacgcccc

SEQ ID NO: 990786 - RNA, 23 nt, Mycobacterium avium subsp. paratuberculosis
cgacgcguuguugcucggcggcc

SEQ ID NO: 990787 - RNA, 18 nt, Mycobacterium avium subsp. paratuberculosis
cgacgcccacagcgccag

SEQ ID NO: 990788 - RNA, 19 nt, Mycobacterium avium subsp. paratuberculosis
cgacgcccacagcgccagc

SEQ ID NO: 990789 - RNA, 17 nt, Mycobacterium avium subsp. paratuberculosis
cgacgccgacaccagcg

SEQ ID NO: 990790 - RNA, 14 nt, Mycobacterium avium subsp. paratuberculosis
cgacgccgcgcagc

SEQ ID NO: 990791 - RNA, 15 nt, Mycobacterium avium subsp. paratuberculosis
cgacgccgcggaagc

SEQ ID NO: 990792 - RNA, 22 nt, Mycobacterium avium subsp. paratuberculosis
cgacgccgcggaagccccaggc

SEQ ID NO: 990793 - RNA, 17 nt, Mycobacterium avium subsp. paratuberculosis
cgacgccgauccgcagc

SEQ ID NO: 990794 - RNA, 11 nt, Mycobacterium avium subsp. paratuberculosis
cgacgccgcgc

SEQ ID NO: 990795 - RNA, 13 nt, Mycobacterium avium subsp. paratuberculosis
cgacgccgcgcag

SEQ ID NO: 990796 - RNA, 22 nt, Mycobacterium avium subsp. paratuberculosis
cgacgcgacggucgugcugggc

SEQ ID NO: 990797 - RNA, 16 nt, Mycobacterium avium subsp. paratuberculosis
cgacgcgaccggcccg

SEQ ID NO: 990798 - RNA, 17 nt, Mycobacterium avium subsp. paratuberculosis
cgacgcgaccggcccga

SEQ ID NO: 990799 - RNA, 20 nt, Mycobacterium avium subsp. paratuberculosis
cgacgccugcgcgaacagcg

SEQ ID NO: 990800 - RNA, 14 nt, Mycobacterium avium subsp. paratuberculosis
cgacgccgcugggc

SEQ ID NO: 990801 - RNA, 12 nt, Mycobacterium avium subsp. paratuberculosis
cgacgccgugcu

SEQ ID NO: 990802 - RNA, 20 nt, Mycobacterium avium subsp. paratuberculosis
cgacgccgugguccagccgg

SEQ ID NO: 990803 - RNA, 23 nt, Mycobacterium avium subsp. paratuberculosis
cgacgccgugguccagccggucg

SEQ ID NO: 990804 - RNA, 14 nt, Mycobacterium avium subsp. paratuberculosis
cgacgccgggcagc

SEQ ID NO: 990805 - RNA, 15 nt, Mycobacterium avium subsp. paratuberculosis
cgacgccgggcagcg

SEQ ID NO: 990806 - RNA, 18 nt, Mycobacterium avium subsp. paratuberculosis
ccuuuggucgaacacuuc

SEQ ID NO: 990807 - RNA, 13 nt, Mycobacterium avium subsp. paratuberculosis
ccuuuugcacccg

SEQ ID NO: 990808 - RNA, 14 nt, Mycobacterium avium subsp. paratuberculosis
ccuuuggcggccag

SEQ ID NO: 990809 - RNA, 18 nt, Mycobacterium avium subsp. paratuberculosis
ccuuguugugacacagcc

SEQ ID NO: 990810 - RNA, 17 nt, Mycobacterium avium subsp. paratuberculosis
ccuuggcgcccagcgug

SEQ ID NO: 990811 - RNA, 18 nt, Mycobacterium avium subsp. paratuberculosis
ccuuggcgcccagcgugg

SEQ ID NO: 990812 - RNA, 17 nt, Mycobacterium avium subsp. paratuberculosis
ccuuggccgccagcacc

SEQ ID NO: 990813 - RNA, 17 nt, Mycobacterium avium subsp. paratuberculosis
ccuuguaggucaucagc

SEQ ID NO: 990814 - RNA, 13 nt, Mycobacterium avium subsp. paratuberculosis
ccuugucgcugac

SEQ ID NO: 990815 - RNA, 22 nt, Mycobacterium avium subsp. paratuberculosis
ccuugucgcgcaccgcggcggg

SEQ ID NO: 990816 - RNA, 15 nt, Mycobacterium avium subsp. paratuberculosis
ccuugucggcgagcu

SEQ ID NO: 990817 - RNA, 12 nt, Mycobacterium avium subsp. paratuberculosis
ccuugaccaccg

SEQ ID NO: 990818 - RNA, 16 nt, Mycobacterium avium subsp. paratuberculosis
ccuugaccagcugcga

SEQ ID NO: 990819 - RNA, 13 nt, Mycobacterium avium subsp. paratuberculosis
ccuugacccggcc

SEQ ID NO: 990820 - RNA, 18 nt, Mycobacterium avium subsp. paratuberculosis
ccuugaccgccuuggcca

SEQ ID NO: 990821 - RNA, 23 nt, Mycobacterium avium subsp. paratuberculosis
ccuugagcacggugaucagcagc

SEQ ID NO: 990822 - RNA, 23 nt, Mycobacterium avium subsp. paratuberculosis
ccuugcgggccggagccuucuug

SEQ ID NO: 990823 - RNA, 20 nt, Mycobacterium avium subsp. paratuberculosis
ccuuggacgaaacccggcgg

SEQ ID NO: 990824 - RNA, 17 nt, Mycobacterium avium subsp. paratuberculosis
ccuugcugagccggccc

SEQ ID NO: 990825 - RNA, 21 nt, Mycobacterium avium subsp. paratuberculosis
ccuugcuggcggccuucuugg

SEQ ID NO: 990826 - RNA, 23 nt, Mycobacterium avium subsp. paratuberculosis
ccuugcuggcggccuucuuggcc

SEQ ID NO: 990827 - RNA, 15 nt, Mycobacterium avium subsp. paratuberculosis
ccuugcucgccgcgu

SEQ ID NO: 990828 - RNA, 18 nt, Mycobacterium avium subsp. paratuberculosis
ccuuggcccgcgcggccg

SEQ ID NO: 990829 - RNA, 20 nt, Mycobacterium avium subsp. paratuberculosis
ccuuggcccgcgcggccgcc

SEQ ID NO: 990830 - RNA, 15 nt, Mycobacterium avium subsp. paratuberculosis
ccuuggccgcaggcg

SEQ ID NO: 990831 - RNA, 23 nt, Mycobacterium avium subsp. paratuberculosis
ccuuggccagcagugccaccacc

SEQ ID NO: 990832 - RNA, 15 nt, Mycobacterium avium subsp. paratuberculosis
ccuucgagccgccgc

SEQ ID NO: 990833 - RNA, 22 nt, Mycobacterium avium subsp. paratuberculosis
ccuucgaugucgccggcgaccg

SEQ ID NO: 990834 - RNA, 16 nt, Mycobacterium avium subsp. paratuberculosis
ccuuccugggacagcc

SEQ ID NO: 990835 - RNA, 22 nt, Mycobacterium avium subsp. paratuberculosis
ccuucgaaugcgaugagcucgc

SEQ ID NO: 990836 - RNA, 21 nt, Mycobacterium avium subsp. paratuberculosis
ccuucuucgccgcagccuucu

SEQ ID NO: 990837 - RNA, 21 nt, Mycobacterium avium subsp. paratuberculosis
ccuucuucgcgggugccuucu

SEQ ID NO: 990838 - RNA, 15 nt, Mycobacterium avium subsp. paratuberculosis
ccuucggccggcagc

SEQ ID NO: 990839 - RNA, 21 nt, Mycobacterium avium subsp. paratuberculosis
ccuucuuggcggcggccuucu

SEQ ID NO: 990840 - RNA, 18 nt, Mycobacterium avium subsp. paratuberculosis
ccuucuuggcggcggucu

SEQ ID NO: 990841 - RNA, 22 nt, Mycobacterium avium subsp. paratuberculosis
ccuucuuggcgggcgccuucuu

SEQ ID NO: 990842 - RNA, 18 nt, Mycobacterium avium subsp. paratuberculosis
ccuucuugaacagcgccg

SEQ ID NO: 990843 - RNA, 21 nt, Mycobacterium avium subsp. paratuberculosis
ccuucuugaccgcagccuucu

SEQ ID NO: 990844 - RNA, 22 nt, Mycobacterium avium subsp. paratuberculosis
ccuucuugaccgcagccuucuu

SEQ ID NO: 990845 - RNA, 11 nt, Mycobacterium avium subsp. paratuberculosis
ccuucuuggcg

SEQ ID NO: 990846 - RNA, 19 nt, Mycobacterium avium subsp. paratuberculosis
ccuucacgcuggccuccag

SEQ ID NO: 990847 - RNA, 19 nt, Mycobacterium avium subsp. paratuberculosis
ccuggaaaccccucagccg

SEQ ID NO: 990848 - RNA, 18 nt, Mycobacterium avium subsp. paratuberculosis
ccuggaagaugacccgcc

SEQ ID NO: 990849 - RNA, 17 nt, Mycobacterium avium subsp. paratuberculosis
ccuggaagcgcaucgcc

SEQ ID NO: 990850 - RNA, 14 nt, Mycobacterium avium subsp. paratuberculosis
ccugcuugagcccg

SEQ ID NO: 990851 - RNA, 23 nt, Mycobacterium avium subsp. paratuberculosis
ccugcuugaugaugccggccgcg

SEQ ID NO: 990852 - RNA, 14 nt, Mycobacterium avium subsp. paratuberculosis
ccugcuugaccgcc

SEQ ID NO: 990853 - RNA, 16 nt, Mycobacterium avium subsp. paratuberculosis
ccugcuugaccgccag

SEQ ID NO: 990854 - RNA, 23 nt, Mycobacterium avium subsp. paratuberculosis
ccugcuugaccgccagacugaug

SEQ ID NO: 990855 - RNA, 15 nt, Mycobacterium avium subsp. paratuberculosis
ccugcuugaccgugg

SEQ ID NO: 990856 - RNA, 22 nt, Mycobacterium avium subsp. paratuberculosis
ccugcuuggcggccugcgccag

SEQ ID NO: 990857 - RNA, 18 nt, Mycobacterium avium subsp. paratuberculosis
ccugcuugggcagcagcu

SEQ ID NO: 990858 - RNA, 19 nt, Mycobacterium avium subsp. paratuberculosis
ccugcuuggucuccggccc

SEQ ID NO: 990859 - RNA, 19 nt, Mycobacterium avium subsp. paratuberculosis
ccuggaucagccaguugau

SEQ ID NO: 990860 - RNA, 18 nt, Mycobacterium avium subsp. paratuberculosis
ccuggaucgcgccuuggg

SEQ ID NO: 990861 - RNA, 16 nt, Mycobacterium avium subsp. paratuberculosis
ccuggaugaacagcac

SEQ ID NO: 990862 - RNA, 23 nt, Mycobacterium avium subsp. paratuberculosis
ccuggaugaacagcacgugcccg

SEQ ID NO: 990863 - RNA, 17 nt, Mycobacterium avium subsp. paratuberculosis
ccuggagcggguccgcc

SEQ ID NO: 990864 - RNA, 19 nt, Mycobacterium avium subsp. paratuberculosis
ccuggagggagcacucgau

SEQ ID NO: 990865 - RNA, 20 nt, Mycobacterium avium subsp. paratuberculosis
ccuggaugucacgguccagg

SEQ ID NO: 990866 - RNA, 23 nt, Mycobacterium avium subsp. paratuberculosis
ccuggcacggcugcucccgaaag

SEQ ID NO: 990867 - RNA, 13 nt, Mycobacterium avium subsp. paratuberculosis
ccuggccagcacc

SEQ ID NO: 990868 - RNA, 13 nt, Mycobacterium avium subsp. paratuberculosis
ccuggcaggugag

SEQ ID NO: 990869 - RNA, 13 nt, Mycobacterium avium subsp. paratuberculosis
ccuggccaccagc

SEQ ID NO: 990870 - RNA, 17 nt, Mycobacterium avium subsp. paratuberculosis
ccuggccaccagcagca

SEQ ID NO: 990871 - RNA, 11 nt, Mycobacterium avium subsp. paratuberculosis
ccuggcauccg

SEQ ID NO: 990872 - RNA, 20 nt, Mycobacterium avium subsp. paratuberculosis
ccuggcauccgucggccuug

SEQ ID NO: 990873 - RNA, 21 nt, Mycobacterium avium subsp. paratuberculosis
ccuggccgauggucagcugcc

SEQ ID NO: 990874 - RNA, 23 nt, Mycobacterium avium subsp. paratuberculosis
ccuggcccagacaggccggccgc

SEQ ID NO: 990875 - RNA, 16 nt, Mycobacterium avium subsp. paratuberculosis
ccuggcccagccgcgu

SEQ ID NO: 990876 - RNA, 18 nt, Mycobacterium avium subsp. paratuberculosis
ccuggccuggucggccgg

SEQ ID NO: 990877 - RNA, 16 nt, Mycobacterium avium subsp. paratuberculosis
ccuggcgaaccgcggc

SEQ ID NO: 990878 - RNA, 14 nt, Mycobacterium avium subsp. paratuberculosis
ccuggccggccucg

SEQ ID NO: 990879 - RNA, 23 nt, Mycobacterium avium subsp. paratuberculosis
ccuggccgcguuccaggaccuga

SEQ ID NO: 990880 - RNA, 11 nt, Mycobacterium avium subsp. paratuberculosis
ccuggcugccu

SEQ ID NO: 990881 - RNA, 14 nt, Mycobacterium avium subsp. paratuberculosis
ccuggcuccccggc

SEQ ID NO: 990882 - RNA, 20 nt, Mycobacterium avium subsp. paratuberculosis
ccuggcggguacagccgcag

SEQ ID NO: 990883 - RNA, 18 nt, Mycobacterium avium subsp. paratuberculosis
ccuggcgcuccagccacu

SEQ ID NO: 990884 - RNA, 15 nt, Mycobacterium avium subsp. paratuberculosis
ccugggacagcgaga

SEQ ID NO: 990885 - RNA, 18 nt, Mycobacterium avium subsp. paratuberculosis
ccugggccagaucgaccc

SEQ ID NO: 990886 - RNA, 18 nt, Mycobacterium avium subsp. paratuberculosis
ccugggccucguccaggg

SEQ ID NO: 990887 - RNA, 18 nt, Mycobacterium avium subsp. paratuberculosis
ccugggcggcgacacgcc

SEQ ID NO: 990888 - RNA, 22 nt, Mycobacterium avium subsp. paratuberculosis
ccuggucggccggcaggccgcc

SEQ ID NO: 990889 - RNA, 21 nt, Mycobacterium avium subsp. paratuberculosis
ccuggugcaacaccgaaagcc

SEQ ID NO: 990890 - RNA, 14 nt, Mycobacterium avium subsp. paratuberculosis
ccuggucgccgccg

SEQ ID NO: 990891 - RNA, 19 nt, Mycobacterium avium subsp. paratuberculosis
ccuggguaagccaggucac

SEQ ID NO: 990892 - RNA, 15 nt, Mycobacterium avium subsp. paratuberculosis
ccugggucaucaccu

SEQ ID NO: 990893 - RNA, 16 nt, Mycobacterium avium subsp. paratuberculosis
ccugggucaucaccuu

SEQ ID NO: 990894 - RNA, 15 nt, Mycobacterium avium subsp. paratuberculosis
ccuggugcucgcgcu

SEQ ID NO: 990895 - RNA, 17 nt, Mycobacterium avium subsp. paratuberculosis
ccugguggcccaggcag

SEQ ID NO: 990896 - RNA, 12 nt, Mycobacterium avium subsp. paratuberculosis
ccuggugcacca

SEQ ID NO: 990897 - RNA, 19 nt, Mycobacterium avium subsp. paratuberculosis
ccugcugggcggcaccacc

SEQ ID NO: 990898 - RNA, 21 nt, Mycobacterium avium subsp. paratuberculosis
ccugcugggcgggcagccgcu

SEQ ID NO: 990899 - RNA, 14 nt, Mycobacterium avium subsp. paratuberculosis
ccugcugcucgucc

SEQ ID NO: 990900 - RNA, 23 nt, Mycobacterium avium subsp. paratuberculosis
ccugcucgaugcgcgccagcagc

SEQ ID NO: 990901 - RNA, 21 nt, Mycobacterium avium subsp. paratuberculosis
ccugcucaccgagcugggccg

SEQ ID NO: 990902 - RNA, 15 nt, Mycobacterium avium subsp. paratuberculosis
ccugcggcugguaga

SEQ ID NO: 990903 - RNA, 19 nt, Mycobacterium avium subsp. paratuberculosis
ccugcggcugguagaugcc

SEQ ID NO: 990904 - RNA, 13 nt, Mycobacterium avium subsp. paratuberculosis
ccugcgggcccag

SEQ ID NO: 990905 - RNA, 15 nt, Mycobacterium avium subsp. paratuberculosis
ccugcgggcccagcu

SEQ ID NO: 990906 - RNA, 18 nt, Mycobacterium avium subsp. paratuberculosis
ccugcggccagugccggg

SEQ ID NO: 990907 - RNA, 22 nt, Mycobacterium avium subsp. paratuberculosis
ccugcgaauacccgcccagcac

SEQ ID NO: 990908 - RNA, 20 nt, Mycobacterium avium subsp. paratuberculosis
ccugcggcaggucggccagc

SEQ ID NO: 990909 - RNA, 16 nt, Mycobacterium avium subsp. paratuberculosis
ccugcgagcacacccu

SEQ ID NO: 990910 - RNA, 20 nt, Mycobacterium avium subsp. paratuberculosis
ccugcgagcacacccucacc

SEQ ID NO: 990911 - RNA, 20 nt, Mycobacterium avium subsp. paratuberculosis
ccugcgacuucuacggcggg

SEQ ID NO: 990912 - RNA, 16 nt, Mycobacterium avium subsp. paratuberculosis
ccugcgaccgccgccg

SEQ ID NO: 990913 - RNA, 14 nt, Mycobacterium avium subsp. paratuberculosis
ccugccccacggcc

SEQ ID NO: 990914 - RNA, 16 nt, Mycobacterium avium subsp. paratuberculosis
ccugcccgggcgccga

SEQ ID NO: 990915 - RNA, 18 nt, Mycobacterium avium subsp. paratuberculosis
ccugcccggagaaaccgu

SEQ ID NO: 990916 - RNA, 19 nt, Mycobacterium avium subsp. paratuberculosis
ccugcccggagaaaccguc

SEQ ID NO: 990917 - RNA, 13 nt, Mycobacterium avium subsp. paratuberculosis
ccugcccgcgcag

SEQ ID NO: 990918 - RNA, 18 nt, Mycobacterium avium subsp. paratuberculosis
ccugccagggggaguagu

SEQ ID NO: 990919 - RNA, 22 nt, Mycobacterium avium subsp. paratuberculosis
ccugccaguugucgaucuccuc

SEQ ID NO: 990920 - RNA, 12 nt, Mycobacterium avium subsp. paratuberculosis
ccugccagcggc

SEQ ID NO: 990921 - RNA, 22 nt, Mycobacterium avium subsp. paratuberculosis
ccugcagugucggaaucggcgc

SEQ ID NO: 990922 - RNA, 15 nt, Mycobacterium avium subsp. paratuberculosis
ccucgggguagccgg

SEQ ID NO: 990923 - RNA, 18 nt, Mycobacterium avium subsp. paratuberculosis
ccucggggucggccggau

SEQ ID NO: 990924 - RNA, 14 nt, Mycobacterium avium subsp. paratuberculosis
ccucggggugguga

SEQ ID NO: 990925 - RNA, 18 nt, Mycobacterium avium subsp. paratuberculosis
ccucggggcugcgcggcu

SEQ ID NO: 990926 - RNA, 22 nt, Mycobacterium avium subsp. paratuberculosis
ccucggggcugcgcggcuugcu

SEQ ID NO: 990927 - RNA, 23 nt, Mycobacterium avium subsp. paratuberculosis
ccucgggguacucggcggcgggc

SEQ ID NO: 990928 - RNA, 14 nt, Mycobacterium avium subsp. paratuberculosis
ccucgggccggcag

SEQ ID NO: 990929 - RNA, 17 nt, Mycobacterium avium subsp. paratuberculosis
ccucgggccggcagccg

SEQ ID NO: 990930 - RNA, 16 nt, Mycobacterium avium subsp. paratuberculosis
ccucggggaucgccag

SEQ ID NO: 990931 - RNA, 20 nt, Mycobacterium avium subsp. paratuberculosis
ccucggggaucgccaggcgu

SEQ ID NO: 990932 - RNA, 17 nt, Mycobacterium avium subsp. paratuberculosis
ccucgggcauuggcagc

SEQ ID NO: 990933 - RNA, 13 nt, Mycobacterium avium subsp. paratuberculosis
ccucgggcacguc

SEQ ID NO: 990934 - RNA, 16 nt, Mycobacterium avium subsp. paratuberculosis
ccucgggcacguccag

SEQ ID NO: 990935 - RNA, 19 nt, Mycobacterium avium subsp. paratuberculosis
ccucgggcacguccagccc

SEQ ID NO: 990936 - RNA, 16 nt, Mycobacterium avium subsp. paratuberculosis
ccucggcggcaccgcc

SEQ ID NO: 990937 - RNA, 14 nt, Mycobacterium avium subsp. paratuberculosis
ccucggcggccagc

SEQ ID NO: 990938 - RNA, 20 nt, Mycobacterium avium subsp. paratuberculosis
ccucggccagccccaccacc

SEQ ID NO: 990939 - RNA, 21 nt, Mycobacterium avium subsp. paratuberculosis
ccucggccagcucaccggcca

SEQ ID NO: 990940 - RNA, 16 nt, Mycobacterium avium subsp. paratuberculosis
ccucggcggccgcccg

SEQ ID NO: 990941 - RNA, 15 nt, Mycobacterium avium subsp. paratuberculosis
ccucggcggccgccu

SEQ ID NO: 990942 - RNA, 15 nt, Mycobacterium avium subsp. paratuberculosis
ccucggcggcggcgc

SEQ ID NO: 990943 - RNA, 17 nt, Mycobacterium avium subsp. paratuberculosis
ccucggcggcggcgcgc

SEQ ID NO: 990944 - RNA, 23 nt, Mycobacterium avium subsp. paratuberculosis
ccucggcgggaucggaccgcacc

SEQ ID NO: 990945 - RNA, 21 nt, Mycobacterium avium subsp. paratuberculosis
ccucggcgggccgcccggcgc

SEQ ID NO: 990946 - RNA, 21 nt, Mycobacterium avium subsp. paratuberculosis
ccugcacgcgcgggucgucgg

SEQ ID NO: 990947 - RNA, 17 nt, Mycobacterium avium subsp. paratuberculosis
ccugcagguagguggcc

SEQ ID NO: 990948 - RNA, 20 nt, Mycobacterium avium subsp. paratuberculosis
ccugcacgaaauaaccgcgc

SEQ ID NO: 990949 - RNA, 15 nt, Mycobacterium avium subsp. paratuberculosis
ccugcacgucggcgc

SEQ ID NO: 990950 - RNA, 13 nt, Mycobacterium avium subsp. paratuberculosis
ccugcacccgucc

SEQ ID NO: 990951 - RNA, 19 nt, Mycobacterium avium subsp. paratuberculosis
ccugcaccuugcccgucgc

SEQ ID NO: 990952 - RNA, 19 nt, Mycobacterium avium subsp. paratuberculosis
ccucgaacaccgcaccggu

SEQ ID NO: 990953 - RNA, 12 nt, Mycobacterium avium subsp. paratuberculosis
ccucgaacaggc

SEQ ID NO: 990954 - RNA, 17 nt, Mycobacterium avium subsp. paratuberculosis
ccucgaacaggcuggcc

SEQ ID NO: 990955 - RNA, 21 nt, Mycobacterium avium subsp. paratuberculosis
ccucgaacaggcuggccagcu

SEQ ID NO: 990956 - RNA, 14 nt, Mycobacterium avium subsp. paratuberculosis
ccucgaagaucucc

SEQ ID NO: 990957 - RNA, 18 nt, Mycobacterium avium subsp. paratuberculosis
ccucgaaccucgcggcgg

SEQ ID NO: 990958 - RNA, 18 nt, Mycobacterium avium subsp. paratuberculosis
ccucgaauccgcgggcgu

SEQ ID NO: 990959 - RNA, 22 nt, Mycobacterium avium subsp. paratuberculosis
ccucgaauccgcgggcguggcg

SEQ ID NO: 990960 - RNA, 16 nt, Mycobacterium avium subsp. paratuberculosis
ccucgaagggcgccag

SEQ ID NO: 990961 - RNA, 21 nt, Mycobacterium avium subsp. paratuberculosis
ccucgaaguagagccgcugca

SEQ ID NO: 990962 - RNA, 22 nt, Mycobacterium avium subsp. paratuberculosis
ccucgaagauggucgcgccgcg

SEQ ID NO: 990963 - RNA, 20 nt, Mycobacterium avium subsp. paratuberculosis
ccucgaagcagccuucuugg

SEQ ID NO: 990964 - RNA, 13 nt, Mycobacterium avium subsp. paratuberculosis
ccucgacaccggu

SEQ ID NO: 990965 - RNA, 19 nt, Mycobacterium avium subsp. paratuberculosis
ccucgacacgggccgcgcc

SEQ ID NO: 990966 - RNA, 19 nt, Mycobacterium avium subsp. paratuberculosis
ccucgaccagcgcgccgcc

SEQ ID NO: 990967 - RNA, 22 nt, Mycobacterium avium subsp. paratuberculosis
ccucgaccagcgcgccgcccag

SEQ ID NO: 990968 - RNA, 18 nt, Mycobacterium avium subsp. paratuberculosis
ccucgaccacgcacacca

SEQ ID NO: 990969 - RNA, 20 nt, Mycobacterium avium subsp. paratuberculosis
ccucgaccacgcacaccacc

SEQ ID NO: 990970 - RNA, 13 nt, Mycobacterium avium subsp. paratuberculosis
ccucgaccaggcu

SEQ ID NO: 990971 - RNA, 21 nt, Mycobacterium avium subsp. paratuberculosis
ccucgaccaggcuuggcccgc

SEQ ID NO: 990972 - RNA, 12 nt, Mycobacterium avium subsp. paratuberculosis
ccucgagcagcg

SEQ ID NO: 990973 - RNA, 14 nt, Mycobacterium avium subsp. paratuberculosis
ccucgagcagcgcg

SEQ ID NO: 990974 - RNA, 18 nt, Mycobacterium avium subsp. paratuberculosis
ccucgagcagcgcgcgcu

SEQ ID NO: 990975 - RNA, 18 nt, Mycobacterium avium subsp. paratuberculosis
ccucgacggugaccucgu

SEQ ID NO: 990976 - RNA, 18 nt, Mycobacterium avium subsp. paratuberculosis
ccucgacguaggugagca

SEQ ID NO: 990977 - RNA, 20 nt, Mycobacterium avium subsp. paratuberculosis
ccucgagagucgcuggcgcg

SEQ ID NO: 990978 - RNA, 16 nt, Mycobacterium avium subsp. paratuberculosis
ccucgagcaaccgcac

SEQ ID NO: 990979 - RNA, 19 nt, Mycobacterium avium subsp. paratuberculosis
ccucgagcaacggccgcag

SEQ ID NO: 990980 - RNA, 17 nt, Mycobacterium avium subsp. paratuberculosis
ccucgaucaccgggcgg

SEQ ID NO: 990981 - RNA, 18 nt, Mycobacterium avium subsp. paratuberculosis
ccucgaucagagcgggcc

SEQ ID NO: 990982 - RNA, 23 nt, Mycobacterium avium subsp. paratuberculosis
ccucgccugucggucguacgucu

SEQ ID NO: 990983 - RNA, 22 nt, Mycobacterium avium subsp. paratuberculosis
ccucgcgcaccggcugccccag

SEQ ID NO: 990984 - RNA, 16 nt, Mycobacterium avium subsp. paratuberculosis
ccucgcgcaucagcac

SEQ ID NO: 990985 - RNA, 13 nt, Mycobacterium avium subsp. paratuberculosis
ccucgcugccggc

SEQ ID NO: 990986 - RNA, 16 nt, Mycobacterium avium subsp. paratuberculosis
ccucgcugccggccgg

SEQ ID NO: 990987 - RNA, 14 nt, Mycobacterium avium subsp. paratuberculosis
ccucggccagcgcc

SEQ ID NO: 990988 - RNA, 12 nt, Mycobacterium avium subsp. paratuberculosis
ccucggccagca

SEQ ID NO: 990989 - RNA, 22 nt, Mycobacterium avium subsp. paratuberculosis
ccucggccagcaccagcagccg

SEQ ID NO: 990990 - RNA, 19 nt, Mycobacterium avium subsp. paratuberculosis
ccucggccagcgccgcgcg

SEQ ID NO: 990991 - RNA, 14 nt, Mycobacterium avium subsp. paratuberculosis
ccucggccaccacc

SEQ ID NO: 990992 - RNA, 17 nt, Mycobacterium avium subsp. paratuberculosis
ccucggccaccagaugc

SEQ ID NO: 990993 - RNA, 22 nt, Mycobacterium avium subsp. paratuberculosis
ccucggccaccagaugccgggc

SEQ ID NO: 990994 - RNA, 23 nt, Mycobacterium avium subsp. paratuberculosis
ccucggccaccagaugccgggcu

SEQ ID NO: 990995 - RNA, 21 nt, Mycobacterium avium subsp. paratuberculosis
ccucggaggccaccgcgccgu

SEQ ID NO: 990996 - RNA, 18 nt, Mycobacterium avium subsp. paratuberculosis
ccucggaggugccgcgcg

SEQ ID NO: 990997 - RNA, 17 nt, Mycobacterium avium subsp. paratuberculosis
ccucgcccugcagccgg

SEQ ID NO: 990998 - RNA, 21 nt, Mycobacterium avium subsp. paratuberculosis
ccucgcccugcagccgggugg

SEQ ID NO: 990999 - RNA, 16 nt, Mycobacterium avium subsp. paratuberculosis
ccucgcccugcagcgc

SEQ ID NO: 991000 - RNA, 20 nt, Mycobacterium avium subsp. paratuberculosis
ccucgccgcgggccagccag

SEQ ID NO: 991001 - RNA, 15 nt, Mycobacterium avium subsp. paratuberculosis
ccucgccggccgccg

SEQ ID NO: 991002 - RNA, 22 nt, Mycobacterium avium subsp. paratuberculosis
ccucgccggccgccguggccca

SEQ ID NO: 991003 - RNA, 15 nt, Mycobacterium avium subsp. paratuberculosis
ccucgccgggcccgc

SEQ ID NO: 991004 - RNA, 20 nt, Mycobacterium avium subsp. paratuberculosis
ccucgccgggcgucacucug

SEQ ID NO: 991005 - RNA, 23 nt, Mycobacterium avium subsp. paratuberculosis
ccucgccguacgcgccggccagc

SEQ ID NO: 991006 - RNA, 19 nt, Mycobacterium avium subsp. paratuberculosis
ccucgccguugccggcccg

SEQ ID NO: 991007 - RNA, 14 nt, Mycobacterium avium subsp. paratuberculosis
ccucgccuccagca

SEQ ID NO: 991008 - RNA, 22 nt, Mycobacterium avium subsp. paratuberculosis
ccucgaucugguucaccgccac

SEQ ID NO: 991009 - RNA, 14 nt, Mycobacterium avium subsp. paratuberculosis
ccucgaugucgucg

SEQ ID NO: 991010 - RNA, 19 nt, Mycobacterium avium subsp. paratuberculosis
ccucgaugccgaccgacag

SEQ ID NO: 991011 - RNA, 12 nt, Mycobacterium avium subsp. paratuberculosis
ccuccuggguga

SEQ ID NO: 991012 - RNA, 16 nt, Mycobacterium avium subsp. paratuberculosis
ccuccggguccccgcc

SEQ ID NO: 991013 - RNA, 20 nt, Mycobacterium avium subsp. paratuberculosis
ccuccggguccccgccgccg

SEQ ID NO: 991014 - RNA, 12 nt, Mycobacterium avium subsp. paratuberculosis
ccuccggcgccu

SEQ ID NO: 991015 - RNA, 18 nt, Mycobacterium avium subsp. paratuberculosis
ccuccagguucgccgccc

SEQ ID NO: 991016 - RNA, 21 nt, Mycobacterium avium subsp. paratuberculosis
ccuccaguugcgaccccgccg

SEQ ID NO: 991017 - RNA, 22 nt, Mycobacterium avium subsp. paratuberculosis
ccucccacaggucgaaacccgu

SEQ ID NO: 991018 - RNA, 14 nt, Mycobacterium avium subsp. paratuberculosis
ccucccagcccucg

SEQ ID NO: 991019 - RNA, 20 nt, Mycobacterium avium subsp. paratuberculosis
ccuccggagaucgccccggg

SEQ ID NO: 991020 - RNA, 22 nt, Mycobacterium avium subsp. paratuberculosis
ccuccacgacuucacaggccgc

SEQ ID NO: 991021 - RNA, 16 nt, Mycobacterium avium subsp. paratuberculosis
ccuccaaugcgcccug

SEQ ID NO: 991022 - RNA, 21 nt, Mycobacterium avium subsp. paratuberculosis
ccuccaacccaaccugugcca

SEQ ID NO: 991023 - RNA, 14 nt, Mycobacterium avium subsp. paratuberculosis
ccuccaccagcggc

SEQ ID NO: 991024 - RNA, 15 nt, Mycobacterium avium subsp. paratuberculosis
ccuccagcugguuga

SEQ ID NO: 991025 - RNA, 14 nt, Mycobacterium avium subsp. paratuberculosis
ccuccagcuguuga

SEQ ID NO: 991026 - RNA, 21 nt, Mycobacterium avium subsp. paratuberculosis
ccuccaggaaacggcccauca

SEQ ID NO: 991027 - RNA, 23 nt, Mycobacterium avium subsp. paratuberculosis
ccuccagguagacgaugcccagc

SEQ ID NO: 991028 - RNA, 18 nt, Mycobacterium avium subsp. paratuberculosis
ccucaucgcccagccggc

SEQ ID NO: 991029 - RNA, 21 nt, Mycobacterium avium subsp. paratuberculosis
ccuagccuuggccgcaggcgg

SEQ ID NO: 991030 - RNA, 19 nt, Mycobacterium avium subsp. paratuberculosis
ccuagcgugccguccagcu

SEQ ID NO: 991031 - RNA, 19 nt, Mycobacterium avium subsp. paratuberculosis
ccuagugccgggggccgag

SEQ ID NO: 991032 - RNA, 14 nt, Mycobacterium avium subsp. paratuberculosis
ccuagucgacgccg

SEQ ID NO: 991033 - RNA, 21 nt, Mycobacterium avium subsp. paratuberculosis
ccuagucgacgccgaugguga

SEQ ID NO: 991034 - RNA, 14 nt, Mycobacterium avium subsp. paratuberculosis
ccucacaccucgcu

SEQ ID NO: 991035 - RNA, 12 nt, Mycobacterium avium subsp. paratuberculosis
ccucagcccggc

SEQ ID NO: 991036 - RNA, 21 nt, Mycobacterium avium subsp. paratuberculosis
ccucaccccagcgcgaccagu

SEQ ID NO: 991037 - RNA, 23 nt, Mycobacterium avium subsp. paratuberculosis
ccucaccgaauuugaaaaugucc

SEQ ID NO: 991038 - RNA, 23 nt, Mycobacterium avium subsp. paratuberculosis
ccucacagcgacaacgggccgcc

SEQ ID NO: 991039 - RNA, 20 nt, Mycobacterium avium subsp. paratuberculosis
ccuacaggugccggcggcgc

SEQ ID NO: 991040 - RNA, 22 nt, Mycobacterium avium subsp. paratuberculosis
ccuacgggcgcaccgcgcgcca

SEQ ID NO: 991041 - RNA, 22 nt, Mycobacterium avium subsp. paratuberculosis
ccuaccggguggccagcaccag

SEQ ID NO: 991042 - RNA, 21 nt, Mycobacterium avium subsp. paratuberculosis
ccuacgccguggccugcgacu

SEQ ID NO: 991043 - RNA, 13 nt, Mycobacterium avium subsp. paratuberculosis
ccgucgcgccagg

SEQ ID NO: 991044 - RNA, 22 nt, Mycobacterium avium subsp. paratuberculosis
ccgucgcgccaggaccagcggg

SEQ ID NO: 991045 - RNA, 16 nt, Mycobacterium avium subsp. paratuberculosis
ccgucgcgucccuggc

SEQ ID NO: 991046 - RNA, 22 nt, Mycobacterium avium subsp. paratuberculosis
ccgucgcgggaaucccacccgc

SEQ ID NO: 991047 - RNA, 18 nt, Mycobacterium avium subsp. paratuberculosis
ccgucgcgggcgucgggc

SEQ ID NO: 991048 - RNA, 12 nt, Mycobacterium avium subsp. paratuberculosis
ccgucgccgccg

SEQ ID NO: 991049 - RNA, 21 nt, Mycobacterium avium subsp. paratuberculosis
ccgucgccggaggcgaucagg

SEQ ID NO: 991050 - RNA, 12 nt, Mycobacterium avium subsp. paratuberculosis
ccgucgccgguc

SEQ ID NO: 991051 - RNA, 16 nt, Mycobacterium avium subsp. paratuberculosis
ccgucgccgugaucug

SEQ ID NO: 991052 - RNA, 13 nt, Mycobacterium avium subsp. paratuberculosis
ccgucgccgugcg

SEQ ID NO: 991053 - RNA, 22 nt, Mycobacterium avium subsp. paratuberculosis
ccgucgcuguuggcgacggcgc

SEQ ID NO: 991054 - RNA, 17 nt, Mycobacterium avium subsp. paratuberculosis
ccgucggccaucagccg

SEQ ID NO: 991055 - RNA, 12 nt, Mycobacterium avium subsp. paratuberculosis
ccgucggcccgc

SEQ ID NO: 991056 - RNA, 15 nt, Mycobacterium avium subsp. paratuberculosis
ccgucguaggcgcgg

SEQ ID NO: 991057 - RNA, 21 nt, Mycobacterium avium subsp. paratuberculosis
ccgucgucgagcaccacccgg

SEQ ID NO: 991058 - RNA, 23 nt, Mycobacterium avium subsp. paratuberculosis
ccgucgucguccgcaaccgccgg

SEQ ID NO: 991059 - RNA, 15 nt, Mycobacterium avium subsp. paratuberculosis
ccgucgucgucggcc

SEQ ID NO: 991060 - RNA, 15 nt, Mycobacterium avium subsp. paratuberculosis
ccgucgaccaaugcg

SEQ ID NO: 991061 - RNA, 15 nt, Mycobacterium avium subsp. paratuberculosis
ccgucgaccaggacg

SEQ ID NO: 991062 - RNA, 23 nt, Mycobacterium avium subsp. paratuberculosis
ccgucgaccaggacgucggccgg

SEQ ID NO: 991063 - RNA, 14 nt, Mycobacterium avium subsp. paratuberculosis
ccgucgaccagggu

SEQ ID NO: 991064 - RNA, 17 nt, Mycobacterium avium subsp. paratuberculosis
ccgucgaccccgccggc

SEQ ID NO: 991065 - RNA, 17 nt, Mycobacterium avium subsp. paratuberculosis
ccgucgaaggccgggcu

SEQ ID NO: 991066 - RNA, 22 nt, Mycobacterium avium subsp. paratuberculosis
ccgucgagcggcuugccgccgc

SEQ ID NO: 991067 - RNA, 22 nt, Mycobacterium avium subsp. paratuberculosis
ccgucgagcgucauuccgccgc

SEQ ID NO: 991068 - RNA, 17 nt, Mycobacterium avium subsp. paratuberculosis
ccgucgacggugaucag

SEQ ID NO: 991069 - RNA, 21 nt, Mycobacterium avium subsp. paratuberculosis
ccgucgacgacgaaucccgcc

SEQ ID NO: 991070 - RNA, 16 nt, Mycobacterium avium subsp. paratuberculosis
ccgguugcggcagcac

SEQ ID NO: 991071 - RNA, 15 nt, Mycobacterium avium subsp. paratuberculosis
ccgguuggccaggug

SEQ ID NO: 991072 - RNA, 19 nt, Mycobacterium avium subsp. paratuberculosis
ccgguuccaccgggccgcc

SEQ ID NO: 991073 - RNA, 17 nt, Mycobacterium avium subsp. paratuberculosis
ccgguuccacgauuccu

SEQ ID NO: 991074 - RNA, 20 nt, Mycobacterium avium subsp. paratuberculosis
ccgguucggacacggcgccg

SEQ ID NO: 991075 - RNA, 23 nt, Mycobacterium avium subsp. paratuberculosis
ccgguugagugcgccgugcagca

SEQ ID NO: 991076 - RNA, 13 nt, Mycobacterium avium subsp. paratuberculosis
ccguggucggcga

SEQ ID NO: 991077 - RNA, 16 nt, Mycobacterium avium subsp. paratuberculosis
ccguggugacccggac

SEQ ID NO: 991078 - RNA, 17 nt, Mycobacterium avium subsp. paratuberculosis
ccguggugaucgccgcg

SEQ ID NO: 991079 - RNA, 18 nt, Mycobacterium avium subsp. paratuberculosis
ccguggugaucgccgcgg

SEQ ID NO: 991080 - RNA, 16 nt, Mycobacterium avium subsp. paratuberculosis
ccgugggggucgaccc

SEQ ID NO: 991081 - RNA, 19 nt, Mycobacterium avium subsp. paratuberculosis
ccgugggggucgacccgcc

SEQ ID NO: 991082 - RNA, 14 nt, Mycobacterium avium subsp. paratuberculosis
ccguggcggcgggc

SEQ ID NO: 991083 - RNA, 17 nt, Mycobacterium avium subsp. paratuberculosis
ccgugggccgaccggcc

SEQ ID NO: 991084 - RNA, 18 nt, Mycobacterium avium subsp. paratuberculosis
ccgugucgcccguggccc

SEQ ID NO: 991085 - RNA, 16 nt, Mycobacterium avium subsp. paratuberculosis
ccguguaggccgcgcu

SEQ ID NO: 991086 - RNA, 21 nt, Mycobacterium avium subsp. paratuberculosis
ccguggacggcgagcggcccu

SEQ ID NO: 991087 - RNA, 22 nt, Mycobacterium avium subsp. paratuberculosis
ccguggaggcguagugcgccca

SEQ ID NO: 991088 - RNA, 18 nt, Mycobacterium avium subsp. paratuberculosis
ccgugccgaugccggccu

SEQ ID NO: 991089 - RNA, 18 nt, Mycobacterium avium subsp. paratuberculosis
ccgugcugccggccggca

SEQ ID NO: 991090 - RNA, 14 nt, Mycobacterium avium subsp. paratuberculosis
ccgugcuuggcggc

SEQ ID NO: 991091 - RNA, 22 nt, Mycobacterium avium subsp. paratuberculosis
ccgugcuuggcggcgcacucca

SEQ ID NO: 991092 - RNA, 15 nt, Mycobacterium avium subsp. paratuberculosis
ccguggcccaugugg

SEQ ID NO: 991093 - RNA, 13 nt, Mycobacterium avium subsp. paratuberculosis
ccguggccccagc

SEQ ID NO: 991094 - RNA, 18 nt, Mycobacterium avium subsp. paratuberculosis
ccguggcccggucggagu

SEQ ID NO: 991095 - RNA, 13 nt, Mycobacterium avium subsp. paratuberculosis
ccguggccagcgc

SEQ ID NO: 991096 - RNA, 20 nt, Mycobacterium avium subsp. paratuberculosis
ccguggcagggccagcagcc

SEQ ID NO: 991097 - RNA, 16 nt, Mycobacterium avium subsp. paratuberculosis
ccgugcaucgggcgcu

SEQ ID NO: 991098 - RNA, 18 nt, Mycobacterium avium subsp. paratuberculosis
ccgugcagggggcgcagc

SEQ ID NO: 991099 - RNA, 19 nt, Mycobacterium avium subsp. paratuberculosis
ccgugcccaacacgccccg

SEQ ID NO: 991100 - RNA, 17 nt, Mycobacterium avium subsp. paratuberculosis
ccgugcccaccagccgg

SEQ ID NO: 991101 - RNA, 19 nt, Mycobacterium avium subsp. paratuberculosis
ccgugcccgcgggacacgg

SEQ ID NO: 991102 - RNA, 17 nt, Mycobacterium avium subsp. paratuberculosis
ccgugcaccgucgccgg

SEQ ID NO: 991103 - RNA, 16 nt, Mycobacterium avium subsp. paratuberculosis
ccgugcacgaacaggg

SEQ ID NO: 991104 - RNA, 21 nt, Mycobacterium avium subsp. paratuberculosis
ccgugcagccgggccugcagc

SEQ ID NO: 991105 - RNA, 22 nt, Mycobacterium avium subsp. paratuberculosis
ccgucguggguauccgccgcca

SEQ ID NO: 991106 - RNA, 21 nt, Mycobacterium avium subsp. paratuberculosis
ccgucguugacgcccuccugg

SEQ ID NO: 991107 - RNA, 23 nt, Mycobacterium avium subsp. paratuberculosis
ccgucguugacgcccuccuggcg

SEQ ID NO: 991108 - RNA, 17 nt, Mycobacterium avium subsp. paratuberculosis
ccgucuccggcguaucu

SEQ ID NO: 991109 - RNA, 16 nt, Mycobacterium avium subsp. paratuberculosis
ccgucucgacccgggc

SEQ ID NO: 991110 - RNA, 15 nt, Mycobacterium avium subsp. paratuberculosis
ccgucucgagccggc

SEQ ID NO: 991111 - RNA, 17 nt, Mycobacterium avium subsp. paratuberculosis
ccguuccagccggcccg

SEQ ID NO: 991112 - RNA, 21 nt, Mycobacterium avium subsp. paratuberculosis
ccguucauuaucccgcaccgc

SEQ ID NO: 991113 - RNA, 23 nt, Mycobacterium avium subsp. paratuberculosis
ccguucaacggccaaccgcccgg

SEQ ID NO: 991114 - RNA, 21 nt, Mycobacterium avium subsp. paratuberculosis
ccguucgccgguaccgccggc

SEQ ID NO: 991115 - RNA, 21 nt, Mycobacterium avium subsp. paratuberculosis
ccguuccgaugaagaacaccc

SEQ ID NO: 991116 - RNA, 18 nt, Mycobacterium avium subsp. paratuberculosis
ccguugugcaccaucuuc

SEQ ID NO: 991117 - RNA, 16 nt, Mycobacterium avium subsp. paratuberculosis
ccguuucagcagcgcg

SEQ ID NO: 991118 - RNA, 17 nt, Mycobacterium avium subsp. paratuberculosis
ccguugcggcccacggu

SEQ ID NO: 991119 - RNA, 19 nt, Mycobacterium avium subsp. paratuberculosis
ccguugcgggugucgccgg

SEQ ID NO: 991120 - RNA, 12 nt, Mycobacterium avium subsp. paratuberculosis
ccguugggccag

SEQ ID NO: 991121 - RNA, 21 nt, Mycobacterium avium subsp. paratuberculosis
ccguuggcguggauggccggc

SEQ ID NO: 991122 - RNA, 22 nt, Mycobacterium avium subsp. paratuberculosis
ccguucuuguggaacaucucca

SEQ ID NO: 991123 - RNA, 19 nt, Mycobacterium avium subsp. paratuberculosis
ccguucucgcgcaggucac

SEQ ID NO: 991124 - RNA, 16 nt, Mycobacterium avium subsp. paratuberculosis
ccguucgcugcccucg

SEQ ID NO: 991125 - RNA, 16 nt, Mycobacterium avium subsp. paratuberculosis
ccguugccgccgcgcg

SEQ ID NO: 991126 - RNA, 19 nt, Mycobacterium avium subsp. paratuberculosis
ccguugcccgaucagccgg

SEQ ID NO: 991127 - RNA, 13 nt, Mycobacterium avium subsp. paratuberculosis
ccguugacggugu

SEQ ID NO: 991128 - RNA, 21 nt, Mycobacterium avium subsp. paratuberculosis
ccggaugcugcgggucagcag

SEQ ID NO: 991129 - RNA, 22 nt, Mycobacterium avium subsp. paratuberculosis
ccggauggagcgcgacgggcug

SEQ ID NO: 991130 - RNA, 14 nt, Mycobacterium avium subsp. paratuberculosis
ccggauggccagca

SEQ ID NO: 991131 - RNA, 15 nt, Mycobacterium avium subsp. paratuberculosis
ccggauggccagcag

SEQ ID NO: 991132 - RNA, 16 nt, Mycobacterium avium subsp. paratuberculosis
ccggauucguucaugu

SEQ ID NO: 991133 - RNA, 13 nt, Mycobacterium avium subsp. paratuberculosis
ccggaugggcgca

SEQ ID NO: 991134 - RNA, 13 nt, Mycobacterium avium subsp. paratuberculosis
ccggaugucgggc

SEQ ID NO: 991135 - RNA, 17 nt, Mycobacterium avium subsp. paratuberculosis
ccggauggcggucgcgc

SEQ ID NO: 991136 - RNA, 14 nt, Mycobacterium avium subsp. paratuberculosis
ccggaugccggcgc

SEQ ID NO: 991137 - RNA, 21 nt, Mycobacterium avium subsp. paratuberculosis
ccggaugccggcgcccagcgg

SEQ ID NO: 991138 - RNA, 14 nt, Mycobacterium avium subsp. paratuberculosis
ccggaugccagcag

SEQ ID NO: 991139 - RNA, 15 nt, Mycobacterium avium subsp. paratuberculosis
ccggaugcggcgccc

SEQ ID NO: 991140 - RNA, 16 nt, Mycobacterium avium subsp. paratuberculosis
ccggaugcggcgccca

SEQ ID NO: 991141 - RNA, 22 nt, Mycobacterium avium subsp. paratuberculosis
ccggaugcggcgcccacagcag

SEQ ID NO: 991142 - RNA, 20 nt, Mycobacterium avium subsp. paratuberculosis
ccggaugcggccgaagucca

SEQ ID NO: 991143 - RNA, 23 nt, Mycobacterium avium subsp. paratuberculosis
ccggaugaucuugaugucggggc

SEQ ID NO: 991144 - RNA, 19 nt, Mycobacterium avium subsp. paratuberculosis
ccggaucuugccgucggcc

SEQ ID NO: 991145 - RNA, 21 nt, Mycobacterium avium subsp. paratuberculosis
ccggaucgugucccggcgccc

SEQ ID NO: 991146 - RNA, 16 nt, Mycobacterium avium subsp. paratuberculosis
ccggaucucgucgggc

SEQ ID NO: 991147 - RNA, 12 nt, Mycobacterium avium subsp. paratuberculosis
ccggaucccaga

SEQ ID NO: 991148 - RNA, 15 nt, Mycobacterium avium subsp. paratuberculosis
ccggaucggccagca

SEQ ID NO: 991149 - RNA, 19 nt, Mycobacterium avium subsp. paratuberculosis
ccggaucaaccacaccagc

SEQ ID NO: 991150 - RNA, 22 nt, Mycobacterium avium subsp. paratuberculosis
ccggaucagcagugccccgucc

SEQ ID NO: 991151 - RNA, 14 nt, Mycobacterium avium subsp. paratuberculosis
ccggaucagcugac

SEQ ID NO: 991152 - RNA, 21 nt, Mycobacterium avium subsp. paratuberculosis
ccggaucgaauccggcggcgc

SEQ ID NO: 991153 - RNA, 16 nt, Mycobacterium avium subsp. paratuberculosis
ccggacggagccgugc

SEQ ID NO: 991154 - RNA, 14 nt, Mycobacterium avium subsp. paratuberculosis
ccggacgaugccgc

SEQ ID NO: 991155 - RNA, 16 nt, Mycobacterium avium subsp. paratuberculosis
ccggacgaugccgcgg

SEQ ID NO: 991156 - RNA, 19 nt, Mycobacterium avium subsp. paratuberculosis
ccggacgcgcacacggccu

SEQ ID NO: 991157 - RNA, 15 nt, Mycobacterium avium subsp. paratuberculosis
ccggauagccgucgg

SEQ ID NO: 991158 - RNA, 15 nt, Mycobacterium avium subsp. paratuberculosis
ccgcugucugcgugc

SEQ ID NO: 991159 - RNA, 16 nt, Mycobacterium avium subsp. paratuberculosis
ccgcugucgucgaaga

SEQ ID NO: 991160 - RNA, 23 nt, Mycobacterium avium subsp. paratuberculosis
ccgcugucgucgaagagcugguc

SEQ ID NO: 991161 - RNA, 13 nt, Mycobacterium avium subsp. paratuberculosis
ccgccucgccagc

SEQ ID NO: 991162 - RNA, 15 nt, Mycobacterium avium subsp. paratuberculosis
ccgccucgacgguga

SEQ ID NO: 991163 - RNA, 16 nt, Mycobacterium avium subsp. paratuberculosis
ccgccucgacggugac

SEQ ID NO: 991164 - RNA, 21 nt, Mycobacterium avium subsp. paratuberculosis
ccgccuccgguuugcgccggc

SEQ ID NO: 991165 - RNA, 17 nt, Mycobacterium avium subsp. paratuberculosis
ccgcuucccacccgguc

SEQ ID NO: 991166 - RNA, 19 nt, Mycobacterium avium subsp. paratuberculosis
ccggaccgcuugacgccgc

SEQ ID NO: 991167 - RNA, 15 nt, Mycobacterium avium subsp. paratuberculosis
ccggaccggccagca

SEQ ID NO: 991168 - RNA, 16 nt, Mycobacterium avium subsp. paratuberculosis
ccggaccggccagcag

SEQ ID NO: 991169 - RNA, 17 nt, Mycobacterium avium subsp. paratuberculosis
ccggaccggccagcagc

SEQ ID NO: 991170 - RNA, 14 nt, Mycobacterium avium subsp. paratuberculosis
ccggaccgccgaga

SEQ ID NO: 991171 - RNA, 14 nt, Mycobacterium avium subsp. paratuberculosis
ccggaccgccgcgg

SEQ ID NO: 991172 - RNA, 15 nt, Mycobacterium avium subsp. paratuberculosis
ccggaccgccgcggc

SEQ ID NO: 991173 - RNA, 22 nt, Mycobacterium avium subsp. paratuberculosis
ccggaccgccgcggcggccugc

SEQ ID NO: 991174 - RNA, 22 nt, Mycobacterium avium subsp. paratuberculosis
ccggacgaccugggcgccgucg

SEQ ID NO: 991175 - RNA, 15 nt, Mycobacterium avium subsp. paratuberculosis
ccggaccucgaccag

SEQ ID NO: 991176 - RNA, 17 nt, Mycobacterium avium subsp. paratuberculosis
ccggaccugccggcgau

SEQ ID NO: 991177 - RNA, 20 nt, Mycobacterium avium subsp. paratuberculosis
ccggacccauucgucggcgg

SEQ ID NO: 991178 - RNA, 18 nt, Mycobacterium avium subsp. paratuberculosis
ccggacccccucggggcu

SEQ ID NO: 991179 - RNA, 13 nt, Mycobacterium avium subsp. paratuberculosis
ccggaccaccagg

SEQ ID NO: 991180 - RNA, 23 nt, Mycobacterium avium subsp. paratuberculosis
ccggacauccauugggccgcggc

SEQ ID NO: 991181 - RNA, 22 nt, Mycobacterium avium subsp. paratuberculosis
ccggaccaggguggccccagcc

SEQ ID NO: 991182 - RNA, 23 nt, Mycobacterium avium subsp. paratuberculosis
ccggaccaggguggccccagccc

SEQ ID NO: 991183 - RNA, 21 nt, Mycobacterium avium subsp. paratuberculosis
ccggacagaucgcccaucacc

SEQ ID NO: 991184 - RNA, 15 nt, Mycobacterium avium subsp. paratuberculosis
ccggacagccacucc

SEQ ID NO: 991185 - RNA, 15 nt, Mycobacterium avium subsp. paratuberculosis
ccgcuuuugccgucg

SEQ ID NO: 991186 - RNA, 15 nt, Mycobacterium avium subsp. paratuberculosis
ccggacaccccggcc

SEQ ID NO: 991187 - RNA, 21 nt, Mycobacterium avium subsp. paratuberculosis
ccggacaccccggccaguccg

SEQ ID NO: 991188 - RNA, 16 nt, Mycobacterium avium subsp. paratuberculosis
ccggacacggccagcg

SEQ ID NO: 991189 - RNA, 13 nt, Mycobacterium avium subsp. paratuberculosis
ccggacagcuggg

SEQ ID NO: 991190 - RNA, 19 nt, Mycobacterium avium subsp. paratuberculosis
ccggccagguugaccacca

SEQ ID NO: 991191 - RNA, 21 nt, Mycobacterium avium subsp. paratuberculosis
ccggccaggucgccgcgcagc

SEQ ID NO: 991192 - RNA, 17 nt, Mycobacterium avium subsp. paratuberculosis
ccggccccggccggcgg

SEQ ID NO: 991193 - RNA, 19 nt, Mycobacterium avium subsp. paratuberculosis
ccggccccgggggaccagc

SEQ ID NO: 991194 - RNA, 14 nt, Mycobacterium avium subsp. paratuberculosis
ccggccaguccagc

SEQ ID NO: 991195 - RNA, 15 nt, Mycobacterium avium subsp. paratuberculosis
ccggcccgagcccug

SEQ ID NO: 991196 - RNA, 14 nt, Mycobacterium avium subsp. paratuberculosis
ccggcccgcagcca

SEQ ID NO: 991197 - RNA, 21 nt, Mycobacterium avium subsp. paratuberculosis
ccggccagcucgccgccgacg

SEQ ID NO: 991198 - RNA, 17 nt, Mycobacterium avium subsp. paratuberculosis
ccggccaggccggccug

SEQ ID NO: 991199 - RNA, 13 nt, Mycobacterium avium subsp. paratuberculosis
ccggccaggaugg

SEQ ID NO: 991200 - RNA, 12 nt, Mycobacterium avium subsp. paratuberculosis
ccggccaggccc

SEQ ID NO: 991201 - RNA, 16 nt, Mycobacterium avium subsp. paratuberculosis
ccggccaggcccagcc

SEQ ID NO: 991202 - RNA, 17 nt, Mycobacterium avium subsp. paratuberculosis
ccggccaggcccagccc

SEQ ID NO: 991203 - RNA, 15 nt, Mycobacterium avium subsp. paratuberculosis
ccggccagcggcagc

SEQ ID NO: 991204 - RNA, 22 nt, Mycobacterium avium subsp. paratuberculosis
ccggccagcggcagcggcgucg

SEQ ID NO: 991205 - RNA, 18 nt, Mycobacterium avium subsp. paratuberculosis
ccggccagcggccagccc

SEQ ID NO: 991206 - RNA, 14 nt, Mycobacterium avium subsp. paratuberculosis
ccggccagcggcuu

SEQ ID NO: 991207 - RNA, 18 nt, Mycobacterium avium subsp. paratuberculosis
ccggccagcuccgccacc

SEQ ID NO: 991208 - RNA, 18 nt, Mycobacterium avium subsp. paratuberculosis
ccggcauucguguggcgc

SEQ ID NO: 991209 - RNA, 17 nt, Mycobacterium avium subsp. paratuberculosis
ccggcaugugccacagg

SEQ ID NO: 991210 - RNA, 19 nt, Mycobacterium avium subsp. paratuberculosis
ccggcaugggcggcaagcc

SEQ ID NO: 991211 - RNA, 21 nt, Mycobacterium avium subsp. paratuberculosis
ccggcaucgacaugcccggcg

SEQ ID NO: 991212 - RNA, 20 nt, Mycobacterium avium subsp. paratuberculosis
ccggccguggacccgccccg

SEQ ID NO: 991213 - RNA, 20 nt, Mycobacterium avium subsp. paratuberculosis
ccggccguucgccggccagc

SEQ ID NO: 991214 - RNA, 15 nt, Mycobacterium avium subsp. paratuberculosis
ccggccgugccgugg

SEQ ID NO: 991215 - RNA, 19 nt, Mycobacterium avium subsp. paratuberculosis
ccggcgaaacacagcagca

SEQ ID NO: 991216 - RNA, 15 nt, Mycobacterium avium subsp. paratuberculosis
ccggcgaaccgggac

SEQ ID NO: 991217 - RNA, 18 nt, Mycobacterium avium subsp. paratuberculosis
ccggcgaaccucacccau

SEQ ID NO: 991218 - RNA, 20 nt, Mycobacterium avium subsp. paratuberculosis
ccggcgaacuccacccugcc

SEQ ID NO: 991219 - RNA, 21 nt, Mycobacterium avium subsp. paratuberculosis
ccggcgaagcuaaaccccacg

SEQ ID NO: 991220 - RNA, 18 nt, Mycobacterium avium subsp. paratuberculosis
ccggcgaaggacagccgg

SEQ ID NO: 991221 - RNA, 15 nt, Mycobacterium avium subsp. paratuberculosis
ccggccggggcgggc

SEQ ID NO: 991222 - RNA, 17 nt, Mycobacterium avium subsp. paratuberculosis
ccggccgguccgcccag

SEQ ID NO: 991223 - RNA, 15 nt, Mycobacterium avium subsp. paratuberculosis
ccggccggccccggg

SEQ ID NO: 991224 - RNA, 23 nt, Mycobacterium avium subsp. paratuberculosis
ccggccggcccgcccggcggcgc

SEQ ID NO: 991225 - RNA, 14 nt, Mycobacterium avium subsp. paratuberculosis
ccggccggccgccg

SEQ ID NO: 991226 - RNA, 10 nt, Mycobacterium avium subsp. paratuberculosis
ccggccggcg

SEQ ID NO: 991227 - RNA, 17 nt, Mycobacterium avium subsp. paratuberculosis
ccggccggcgaggaacu

SEQ ID NO: 991228 - RNA, 18 nt, Mycobacterium avium subsp. paratuberculosis
ccggccggcgcgaccagc

SEQ ID NO: 991229 - RNA, 21 nt, Mycobacterium avium subsp. paratuberculosis
ccggccggcgcgcacggcagc

SEQ ID NO: 991230 - RNA, 17 nt, Mycobacterium avium subsp. paratuberculosis
ccggccggcgcggcggc

SEQ ID NO: 991231 - RNA, 23 nt, Mycobacterium avium subsp. paratuberculosis
ccggccggcggacgcggccagcg

SEQ ID NO: 991232 - RNA, 19 nt, Mycobacterium avium subsp. paratuberculosis
ccggccggcggucaggccg

SEQ ID NO: 991233 - RNA, 15 nt, Mycobacterium avium subsp. paratuberculosis
ccggccgggacgcgg

SEQ ID NO: 991234 - RNA, 17 nt, Mycobacterium avium subsp. paratuberculosis
ccggccggcacgauggc

SEQ ID NO: 991235 - RNA, 18 nt, Mycobacterium avium subsp. paratuberculosis
ccggccgaacacggccgc

SEQ ID NO: 991236 - RNA, 22 nt, Mycobacterium avium subsp. paratuberculosis
ccggccgaacacggccgccucc

SEQ ID NO: 991237 - RNA, 16 nt, Mycobacterium avium subsp. paratuberculosis
ccggcccuggucggcc

SEQ ID NO: 991238 - RNA, 19 nt, Mycobacterium avium subsp. paratuberculosis
ccggcccuggucggccagg

SEQ ID NO: 991239 - RNA, 13 nt, Mycobacterium avium subsp. paratuberculosis
ccggcccggcgau

SEQ ID NO: 991240 - RNA, 14 nt, Mycobacterium avium subsp. paratuberculosis
ccggcccggcggcc

SEQ ID NO: 991241 - RNA, 18 nt, Mycobacterium avium subsp. paratuberculosis
ccggcccggcggccggcc

SEQ ID NO: 991242 - RNA, 16 nt, Mycobacterium avium subsp. paratuberculosis
ccggcccggcgggcau

SEQ ID NO: 991243 - RNA, 14 nt, Mycobacterium avium subsp. paratuberculosis
ccggcccggcgucg

SEQ ID NO: 991244 - RNA, 13 nt, Mycobacterium avium subsp. paratuberculosis
ccggcccgcccgu

SEQ ID NO: 991245 - RNA, 16 nt, Mycobacterium avium subsp. paratuberculosis
ccggcaggccgcccga

SEQ ID NO: 991246 - RNA, 16 nt, Mycobacterium avium subsp. paratuberculosis
ccggcaguccggacac

SEQ ID NO: 991247 - RNA, 17 nt, Mycobacterium avium subsp. paratuberculosis
ccggcaguugcggccgc

SEQ ID NO: 991248 - RNA, 20 nt, Mycobacterium avium subsp. paratuberculosis
ccggcaggacgggggccggu

SEQ ID NO: 991249 - RNA, 15 nt, Mycobacterium avium subsp. paratuberculosis
ccggcaggcgguagc

SEQ ID NO: 991250 - RNA, 20 nt, Mycobacterium avium subsp. paratuberculosis
ccggcaggccgcggccgucg

SEQ ID NO: 991251 - RNA, 17 nt, Mycobacterium avium subsp. paratuberculosis
ccggcagcaaccggcgg

SEQ ID NO: 991252 - RNA, 14 nt, Mycobacterium avium subsp. paratuberculosis
ccggcagcaccgcc

SEQ ID NO: 991253 - RNA, 16 nt, Mycobacterium avium subsp. paratuberculosis
ccggcagcaccgccga

SEQ ID NO: 991254 - RNA, 19 nt, Mycobacterium avium subsp. paratuberculosis
ccggcacggugcacacgcc

SEQ ID NO: 991255 - RNA, 23 nt, Mycobacterium avium subsp. paratuberculosis
ccggcagcggccgcaaucggcgc

SEQ ID NO: 991256 - RNA, 14 nt, Mycobacterium avium subsp. paratuberculosis
ccggcagcgcgccc

SEQ ID NO: 991257 - RNA, 20 nt, Mycobacterium avium subsp. paratuberculosis
ccggcagcgcucgucgucgg

SEQ ID NO: 991258 - RNA, 13 nt, Mycobacterium avium subsp. paratuberculosis
ccggcagcggcug

SEQ ID NO: 991259 - RNA, 23 nt, Mycobacterium avium subsp. paratuberculosis
ccggcagcggcugcugcagcgcc

SEQ ID NO: 991260 - RNA, 12 nt, Mycobacterium avium subsp. paratuberculosis
ccggcagcggug

SEQ ID NO: 991261 - RNA, 15 nt, Mycobacterium avium subsp. paratuberculosis
ccggcagcggugccg

SEQ ID NO: 991262 - RNA, 19 nt, Mycobacterium avium subsp. paratuberculosis
ccggcagcggugccgcccg

SEQ ID NO: 991263 - RNA, 19 nt, Mycobacterium avium subsp. paratuberculosis
ccggcagccggccaccucg

SEQ ID NO: 991264 - RNA, 23 nt, Mycobacterium avium subsp. paratuberculosis
ccggcagccggccaccucguccc

SEQ ID NO: 991265 - RNA, 22 nt, Mycobacterium avium subsp. paratuberculosis
ccggcagccggggugcccgggc

SEQ ID NO: 991266 - RNA, 20 nt, Mycobacterium avium subsp. paratuberculosis
ccggcagaucgcggcccgcc

SEQ ID NO: 991267 - RNA, 16 nt, Mycobacterium avium subsp. paratuberculosis
ccggcagcgccucccg

SEQ ID NO: 991268 - RNA, 23 nt, Mycobacterium avium subsp. paratuberculosis
ccggcagcaggugcaccacccag

SEQ ID NO: 991269 - RNA, 16 nt, Mycobacterium avium subsp. paratuberculosis
ccggcagccagauguc

SEQ ID NO: 991270 - RNA, 22 nt, Mycobacterium avium subsp. paratuberculosis
ccggcacgaucgucgccgccaa

SEQ ID NO: 991271 - RNA, 20 nt, Mycobacterium avium subsp. paratuberculosis
ccggcacgauggcgcggcgc

SEQ ID NO: 991272 - RNA, 19 nt, Mycobacterium avium subsp. paratuberculosis
ccggcacgaacgcgacgau

SEQ ID NO: 991273 - RNA, 13 nt, Mycobacterium avium subsp. paratuberculosis
ccggcacccgggc

SEQ ID NO: 991274 - RNA, 15 nt, Mycobacterium avium subsp. paratuberculosis
ccggcacucgccucg

SEQ ID NO: 991275 - RNA, 17 nt, Mycobacterium avium subsp. paratuberculosis
ccggcacgucggccacg

SEQ ID NO: 991276 - RNA, 19 nt, Mycobacterium avium subsp. paratuberculosis
ccggcacgucggccacgcc

SEQ ID NO: 991277 - RNA, 21 nt, Mycobacterium avium subsp. paratuberculosis
ccggcacgugcggguuggcgc

SEQ ID NO: 991278 - RNA, 16 nt, Mycobacterium avium subsp. paratuberculosis
ccggcacuaccgccuc

SEQ ID NO: 991279 - RNA, 17 nt, Mycobacterium avium subsp. paratuberculosis
ccggcacuaccgccucg

SEQ ID NO: 991280 - RNA, 18 nt, Mycobacterium avium subsp. paratuberculosis
ccggcaccagcagccagc

SEQ ID NO: 991281 - RNA, 18 nt, Mycobacterium avium subsp. paratuberculosis
ccggcaccagcagccgca

SEQ ID NO: 991282 - RNA, 13 nt, Mycobacterium avium subsp. paratuberculosis
ccggcaccacgau

SEQ ID NO: 991283 - RNA, 13 nt, Mycobacterium avium subsp. paratuberculosis
ccggcaccgccag

SEQ ID NO: 991284 - RNA, 18 nt, Mycobacterium avium subsp. paratuberculosis
ccggcaccgccagccacc

SEQ ID NO: 991285 - RNA, 14 nt, Mycobacterium avium subsp. paratuberculosis
ccggcaccgccccc

SEQ ID NO: 991286 - RNA, 18 nt, Mycobacterium avium subsp. paratuberculosis
ccggcacaccgagcgagc

SEQ ID NO: 991287 - RNA, 15 nt, Mycobacterium avium subsp. paratuberculosis
ccggcgugcugggcc

SEQ ID NO: 991288 - RNA, 19 nt, Mycobacterium avium subsp. paratuberculosis
ccggcgugcugggccacga

SEQ ID NO: 991289 - RNA, 17 nt, Mycobacterium avium subsp. paratuberculosis
ccggcgugggccgcagc

SEQ ID NO: 991290 - RNA, 20 nt, Mycobacterium avium subsp. paratuberculosis
ccggcguggugggcagaugc

SEQ ID NO: 991291 - RNA, 15 nt, Mycobacterium avium subsp. paratuberculosis
ccggcgugucggcgc

SEQ ID NO: 991292 - RNA, 17 nt, Mycobacterium avium subsp. paratuberculosis
ccggcgugucggcgcca

SEQ ID NO: 991293 - RNA, 19 nt, Mycobacterium avium subsp. paratuberculosis
ccggcuacucggacgccgg

SEQ ID NO: 991294 - RNA, 16 nt, Mycobacterium avium subsp. paratuberculosis
ccggcuauucgggccu

SEQ ID NO: 991295 - RNA, 21 nt, Mycobacterium avium subsp. paratuberculosis
ccggcgugccaccgcugggcg

SEQ ID NO: 991296 - RNA, 21 nt, Mycobacterium avium subsp. paratuberculosis
ccggcgugcacaggccgccgc

SEQ ID NO: 991297 - RNA, 20 nt, Mycobacterium avium subsp. paratuberculosis
ccggcgggcuggugcgcagc

SEQ ID NO: 991298 - RNA, 21 nt, Mycobacterium avium subsp. paratuberculosis
ccggcgucgaaauagcggcgc

SEQ ID NO: 991299 - RNA, 14 nt, Mycobacterium avium subsp. paratuberculosis
ccggcguccagcgc

SEQ ID NO: 991300 - RNA, 16 nt, Mycobacterium avium subsp. paratuberculosis
ccggcguccagcgccg

SEQ ID NO: 991301 - RNA, 17 nt, Mycobacterium avium subsp. paratuberculosis
ccggcguccagcgccgc

SEQ ID NO: 991302 - RNA, 18 nt, Mycobacterium avium subsp. paratuberculosis
ccggcguccagcgccgcc

SEQ ID NO: 991303 - RNA, 19 nt, Mycobacterium avium subsp. paratuberculosis
ccggcguccagcgccgcca

SEQ ID NO: 991304 - RNA, 21 nt, Mycobacterium avium subsp. paratuberculosis
ccggcguccaguagccgccgg

SEQ ID NO: 991305 - RNA, 13 nt, Mycobacterium avium subsp. paratuberculosis
ccggcgucgccgc

SEQ ID NO: 991306 - RNA, 19 nt, Mycobacterium avium subsp. paratuberculosis
ccggcgucgccgcugguga

SEQ ID NO: 991307 - RNA, 18 nt, Mycobacterium avium subsp. paratuberculosis
ccggcgcaccaggcgcca

SEQ ID NO: 991308 - RNA, 22 nt, Mycobacterium avium subsp. paratuberculosis
ccggcgcaccaggcgccacagc

SEQ ID NO: 991309 - RNA, 23 nt, Mycobacterium avium subsp. paratuberculosis
ccggcgcaccaggcgccacagca

SEQ ID NO: 991310 - RNA, 21 nt, Mycobacterium avium subsp. paratuberculosis
ccggcgcaacucguccagcgu

SEQ ID NO: 991311 - RNA, 13 nt, Mycobacterium avium subsp. paratuberculosis
ccggcgcaccgcg

SEQ ID NO: 991312 - RNA, 22 nt, Mycobacterium avium subsp. paratuberculosis
ccggcgcaccgcgucgaccacc

SEQ ID NO: 991313 - RNA, 17 nt, Mycobacterium avium subsp. paratuberculosis
ccggcgcacggcgccca

SEQ ID NO: 991314 - RNA, 15 nt, Mycobacterium avium subsp. paratuberculosis
ccggcgcacucccgc

SEQ ID NO: 991315 - RNA, 13 nt, Mycobacterium avium subsp. paratuberculosis
ccggcgaucucgu

SEQ ID NO: 991316 - RNA, 21 nt, Mycobacterium avium subsp. paratuberculosis
ccggcgaucucgucgcgcagc

SEQ ID NO: 991317 - RNA, 21 nt, Mycobacterium avium subsp. paratuberculosis
ccggcgaugcgcacgucggcc

SEQ ID NO: 991318 - RNA, 16 nt, Mycobacterium avium subsp. paratuberculosis
ccggcgaugguggcgc

SEQ ID NO: 991319 - RNA, 15 nt, Mycobacterium avium subsp. paratuberculosis
ccggcgaugucgggc

SEQ ID NO: 991320 - RNA, 17 nt, Mycobacterium avium subsp. paratuberculosis
ccggcggcgcggcagga

SEQ ID NO: 991321 - RNA, 17 nt, Mycobacterium avium subsp. paratuberculosis
ccggcggcgaucggcgc

SEQ ID NO: 991322 - RNA, 18 nt, Mycobacterium avium subsp. paratuberculosis
ccggcggcgaagccggcc

SEQ ID NO: 991323 - RNA, 19 nt, Mycobacterium avium subsp. paratuberculosis
ccggcggcgaagccggccc

SEQ ID NO: 991324 - RNA, 21 nt, Mycobacterium avium subsp. paratuberculosis
ccggcggcgaagccggccccg

SEQ ID NO: 991325 - RNA, 16 nt, Mycobacterium avium subsp. paratuberculosis
ccggcggccgcgucgg

SEQ ID NO: 991326 - RNA, 19 nt, Mycobacterium avium subsp. paratuberculosis
ccggcggccgcgucggcgg

SEQ ID NO: 991327 - RNA, 15 nt, Mycobacterium avium subsp. paratuberculosis
ccggcggccggcccc

SEQ ID NO: 991328 - RNA, 14 nt, Mycobacterium avium subsp. paratuberculosis
ccggcggccggcgg

SEQ ID NO: 991329 - RNA, 18 nt, Mycobacterium avium subsp. paratuberculosis
ccggcgcagcgccgcgcc

SEQ ID NO: 991330 - RNA, 19 nt, Mycobacterium avium subsp. paratuberculosis
ccggcgcagcgccgcgccg

SEQ ID NO: 991331 - RNA, 13 nt, Mycobacterium avium subsp. paratuberculosis
ccggcggccgccg

SEQ ID NO: 991332 - RNA, 17 nt, Mycobacterium avium subsp. paratuberculosis
ccggcggccgccgcccg

SEQ ID NO: 991333 - RNA, 18 nt, Mycobacterium avium subsp. paratuberculosis
ccggcggcggugcgucgg

SEQ ID NO: 991334 - RNA, 21 nt, Mycobacterium avium subsp. paratuberculosis
ccggcgggcgccggucggcgg

SEQ ID NO: 991335 - RNA, 13 nt, Mycobacterium avium subsp. paratuberculosis
ccggcgggcggcc

SEQ ID NO: 991336 - RNA, 15 nt, Mycobacterium avium subsp. paratuberculosis
ccggcgggucagcag

SEQ ID NO: 991337 - RNA, 18 nt, Mycobacterium avium subsp. paratuberculosis
ccggcggguuggccgucg

SEQ ID NO: 991338 - RNA, 19 nt, Mycobacterium avium subsp. paratuberculosis
ccggcgguaugcccgggcc

SEQ ID NO: 991339 - RNA, 22 nt, Mycobacterium avium subsp. paratuberculosis
ccggcgguaugcccgggccguc

SEQ ID NO: 991340 - RNA, 13 nt, Mycobacterium avium subsp. paratuberculosis
ccggcggucacca

SEQ ID NO: 991341 - RNA, 15 nt, Mycobacterium avium subsp. paratuberculosis
ccggcggucaggccg

SEQ ID NO: 991342 - RNA, 19 nt, Mycobacterium avium subsp. paratuberculosis
ccggcggugauccgcccgg

SEQ ID NO: 991343 - RNA, 13 nt, Mycobacterium avium subsp. paratuberculosis
ccggcggugcagg

SEQ ID NO: 991344 - RNA, 19 nt, Mycobacterium avium subsp. paratuberculosis
ccggcggcgucccacgugg

SEQ ID NO: 991345 - RNA, 21 nt, Mycobacterium avium subsp. paratuberculosis
ccggcggugcggguggugugg

SEQ ID NO: 991346 - RNA, 18 nt, Mycobacterium avium subsp. paratuberculosis
ccggcguagcagucggcc

SEQ ID NO: 991347 - RNA, 14 nt, Mycobacterium avium subsp. paratuberculosis
ccggcguacccgcc

SEQ ID NO: 991348 - RNA, 15 nt, Mycobacterium avium subsp. paratuberculosis
ccggcguacccgccc

SEQ ID NO: 991349 - RNA, 19 nt, Mycobacterium avium subsp. paratuberculosis
ccgggauuucccgggcgau

SEQ ID NO: 991350 - RNA, 14 nt, Mycobacterium avium subsp. paratuberculosis
ccggcugcucgcgc

SEQ ID NO: 991351 - RNA, 15 nt, Mycobacterium avium subsp. paratuberculosis
ccggcuggccgcaca

SEQ ID NO: 991352 - RNA, 13 nt, Mycobacterium avium subsp. paratuberculosis
ccggcuggccgga

SEQ ID NO: 991353 - RNA, 15 nt, Mycobacterium avium subsp. paratuberculosis
ccggcuggucggcgg

SEQ ID NO: 991354 - RNA, 15 nt, Mycobacterium avium subsp. paratuberculosis
ccggcuggugcagca

SEQ ID NO: 991355 - RNA, 17 nt, Mycobacterium avium subsp. paratuberculosis
ccggcuggugcagcagc

SEQ ID NO: 991356 - RNA, 23 nt, Mycobacterium avium subsp. paratuberculosis
ccggcuggugcagcagcuggaac

SEQ ID NO: 991357 - RNA, 18 nt, Mycobacterium avium subsp. paratuberculosis
ccgggcaccgcgcccgcc

SEQ ID NO: 991358 - RNA, 16 nt, Mycobacterium avium subsp. paratuberculosis
ccgggcaacagcgcgc

SEQ ID NO: 991359 - RNA, 20 nt, Mycobacterium avium subsp. paratuberculosis
ccgggcaccccggucaccgg

SEQ ID NO: 991360 - RNA, 17 nt, Mycobacterium avium subsp. paratuberculosis
ccggcuccaccgcgccg

SEQ ID NO: 991361 - RNA, 16 nt, Mycobacterium avium subsp. paratuberculosis
ccggcucagcggcaac

SEQ ID NO: 991362 - RNA, 22 nt, Mycobacterium avium subsp. paratuberculosis
ccggcucagcccgauucagccg

SEQ ID NO: 991363 - RNA, 21 nt, Mycobacterium avium subsp. paratuberculosis
ccggcucagcgcgacgugccg

SEQ ID NO: 991364 - RNA, 23 nt, Mycobacterium avium subsp. paratuberculosis
ccggcucagcgcgacgugccggc

SEQ ID NO: 991365 - RNA, 19 nt, Mycobacterium avium subsp. paratuberculosis
ccggcuccccgaccacacc

SEQ ID NO: 991366 - RNA, 21 nt, Mycobacterium avium subsp. paratuberculosis
ccggcucgaaguggcagcgcu

SEQ ID NO: 991367 - RNA, 20 nt, Mycobacterium avium subsp. paratuberculosis
ccggcucgaccucaccccgc

SEQ ID NO: 991368 - RNA, 13 nt, Mycobacterium avium subsp. paratuberculosis
ccggcugcgcagc

SEQ ID NO: 991369 - RNA, 17 nt, Mycobacterium avium subsp. paratuberculosis
ccggcugcccgacccgc

SEQ ID NO: 991370 - RNA, 14 nt, Mycobacterium avium subsp. paratuberculosis
ccggcugcccuggg

SEQ ID NO: 991371 - RNA, 16 nt, Mycobacterium avium subsp. paratuberculosis
ccggcugcagccgggc

SEQ ID NO: 991372 - RNA, 13 nt, Mycobacterium avium subsp. paratuberculosis
ccggcucgagcag

SEQ ID NO: 991373 - RNA, 12 nt, Mycobacterium avium subsp. paratuberculosis
ccgggcagcgcg

SEQ ID NO: 991374 - RNA, 17 nt, Mycobacterium avium subsp. paratuberculosis
ccgggcagcggccccac

SEQ ID NO: 991375 - RNA, 15 nt, Mycobacterium avium subsp. paratuberculosis
ccgggcagccgcaca

SEQ ID NO: 991376 - RNA, 14 nt, Mycobacterium avium subsp. paratuberculosis
ccgggcagcccgcc

SEQ ID NO: 991377 - RNA, 17 nt, Mycobacterium avium subsp. paratuberculosis
ccgggcagcccgccgcg

SEQ ID NO: 991378 - RNA, 22 nt, Mycobacterium avium subsp. paratuberculosis
ccgggcaugccguucagcgcgg

SEQ ID NO: 991379 - RNA, 14 nt, Mycobacterium avium subsp. paratuberculosis
ccgggcauggucac

SEQ ID NO: 991380 - RNA, 17 nt, Mycobacterium avium subsp. paratuberculosis
ccgggcauggucaccgg

SEQ ID NO: 991381 - RNA, 21 nt, Mycobacterium avium subsp. paratuberculosis
ccgggcauccgggccgccgcg

SEQ ID NO: 991382 - RNA, 19 nt, Mycobacterium avium subsp. paratuberculosis
ccgggcagcuuccgccucg

SEQ ID NO: 991383 - RNA, 12 nt, Mycobacterium avium subsp. paratuberculosis
ccgggcaggcau

SEQ ID NO: 991384 - RNA, 17 nt, Mycobacterium avium subsp. paratuberculosis
ccgggcaguagaacggc

SEQ ID NO: 991385 - RNA, 18 nt, Mycobacterium avium subsp. paratuberculosis
ccgggccuguccagccgg

SEQ ID NO: 991386 - RNA, 15 nt, Mycobacterium avium subsp. paratuberculosis
ccgggcgaccccggc

SEQ ID NO: 991387 - RNA, 16 nt, Mycobacterium avium subsp. paratuberculosis
ccgggcgaccccggcc

SEQ ID NO: 991388 - RNA, 17 nt, Mycobacterium avium subsp. paratuberculosis
ccgggcgacugcgugcu

SEQ ID NO: 991389 - RNA, 16 nt, Mycobacterium avium subsp. paratuberculosis
ccgggcgacuucguug

SEQ ID NO: 991390 - RNA, 19 nt, Mycobacterium avium subsp. paratuberculosis
ccgggcgaucagcccgccc

SEQ ID NO: 991391 - RNA, 19 nt, Mycobacterium avium subsp. paratuberculosis
ccgggcgaucauccaggug

SEQ ID NO: 991392 - RNA, 12 nt, Mycobacterium avium subsp. paratuberculosis
ccgggcccgguc

SEQ ID NO: 991393 - RNA, 17 nt, Mycobacterium avium subsp. paratuberculosis
ccgggcccggucgucgc

SEQ ID NO: 991394 - RNA, 12 nt, Mycobacterium avium subsp. paratuberculosis
ccgggcccggcg

SEQ ID NO: 991395 - RNA, 15 nt, Mycobacterium avium subsp. paratuberculosis
ccgggcccggcgcca

SEQ ID NO: 991396 - RNA, 18 nt, Mycobacterium avium subsp. paratuberculosis
ccgggccgaaggcggcgc

SEQ ID NO: 991397 - RNA, 13 nt, Mycobacterium avium subsp. paratuberculosis
ccgggccagcagc

SEQ ID NO: 991398 - RNA, 15 nt, Mycobacterium avium subsp. paratuberculosis
ccgggccaggaugac

SEQ ID NO: 991399 - RNA, 14 nt, Mycobacterium avium subsp. paratuberculosis
ccgggcccaccagg

SEQ ID NO: 991400 - RNA, 14 nt, Mycobacterium avium subsp. paratuberculosis
ccgggcccagcacc

SEQ ID NO: 991401 - RNA, 12 nt, Mycobacterium avium subsp. paratuberculosis
ccgggccacacc

SEQ ID NO: 991402 - RNA, 15 nt, Mycobacterium avium subsp. paratuberculosis
ccgggccacacccgu

SEQ ID NO: 991403 - RNA, 12 nt, Mycobacterium avium subsp. paratuberculosis
ccgggccaccac

SEQ ID NO: 991404 - RNA, 19 nt, Mycobacterium avium subsp. paratuberculosis
ccgggccaccaccacggcc

SEQ ID NO: 991405 - RNA, 14 nt, Mycobacterium avium subsp. paratuberculosis
ccgggccagauagc

SEQ ID NO: 991406 - RNA, 16 nt, Mycobacterium avium subsp. paratuberculosis
ccggguuguccuggcc

SEQ ID NO: 991407 - RNA, 18 nt, Mycobacterium avium subsp. paratuberculosis
ccggguuguccuggcccu

SEQ ID NO: 991408 - RNA, 20 nt, Mycobacterium avium subsp. paratuberculosis
ccggguuucgaagacgcccc

SEQ ID NO: 991409 - RNA, 18 nt, Mycobacterium avium subsp. paratuberculosis
ccggguuucggcccggcu

SEQ ID NO: 991410 - RNA, 15 nt, Mycobacterium avium subsp. paratuberculosis
ccggguugcacaggu

SEQ ID NO: 991411 - RNA, 16 nt, Mycobacterium avium subsp. paratuberculosis
ccggguugcaggcgcc

SEQ ID NO: 991412 - RNA, 22 nt, Mycobacterium avium subsp. paratuberculosis
ccgguacagcgccgcggccagc

SEQ ID NO: 991413 - RNA, 20 nt, Mycobacterium avium subsp. paratuberculosis
ccgguacaggccccacgcgc

SEQ ID NO: 991414 - RNA, 15 nt, Mycobacterium avium subsp. paratuberculosis
ccgggugaugucgcc

SEQ ID NO: 991415 - RNA, 12 nt, Mycobacterium avium subsp. paratuberculosis
ccgggugaaccc

SEQ ID NO: 991416 - RNA, 22 nt, Mycobacterium avium subsp. paratuberculosis
ccgggugaacgaggccgcgccg

SEQ ID NO: 991417 - RNA, 16 nt, Mycobacterium avium subsp. paratuberculosis
ccgggucuuccacgcc

SEQ ID NO: 991418 - RNA, 17 nt, Mycobacterium avium subsp. paratuberculosis
ccgggucuuccacgccg

SEQ ID NO: 991419 - RNA, 13 nt, Mycobacterium avium subsp. paratuberculosis
ccggguggugggc

SEQ ID NO: 991420 - RNA, 16 nt, Mycobacterium avium subsp. paratuberculosis
ccggguguagcugggc

SEQ ID NO: 991421 - RNA, 15 nt, Mycobacterium avium subsp. paratuberculosis
ccgggugugggcgcc

SEQ ID NO: 991422 - RNA, 17 nt, Mycobacterium avium subsp. paratuberculosis
ccggguggccggggcca

SEQ ID NO: 991423 - RNA, 20 nt, Mycobacterium avium subsp. paratuberculosis
ccggguggccggggccaucu

SEQ ID NO: 991424 - RNA, 14 nt, Mycobacterium avium subsp. paratuberculosis
ccgggugggccgac

SEQ ID NO: 991425 - RNA, 14 nt, Mycobacterium avium subsp. paratuberculosis
ccgggugggcggca

SEQ ID NO: 991426 - RNA, 12 nt, Mycobacterium avium subsp. paratuberculosis
ccgggugcgggc

SEQ ID NO: 991427 - RNA, 21 nt, Mycobacterium avium subsp. paratuberculosis
ccgggugcugaacgccugccg

SEQ ID NO: 991428 - RNA, 16 nt, Mycobacterium avium subsp. paratuberculosis
ccggguggacgcccgc

SEQ ID NO: 991429 - RNA, 17 nt, Mycobacterium avium subsp. paratuberculosis
ccggguggcccgcccgg

SEQ ID NO: 991430 - RNA, 13 nt, Mycobacterium avium subsp. paratuberculosis
ccggguggccgcc

SEQ ID NO: 991431 - RNA, 20 nt, Mycobacterium avium subsp. paratuberculosis
ccgggcgccacccgcaugcu

SEQ ID NO: 991432 - RNA, 14 nt, Mycobacterium avium subsp. paratuberculosis
ccgggcgccacgcu

SEQ ID NO: 991433 - RNA, 15 nt, Mycobacterium avium subsp. paratuberculosis
ccgggcgccauccgc

SEQ ID NO: 991434 - RNA, 13 nt, Mycobacterium avium subsp. paratuberculosis
ccgggcgcccaga

SEQ ID NO: 991435 - RNA, 14 nt, Mycobacterium avium subsp. paratuberculosis
ccgggcgucacgcc

SEQ ID NO: 991436 - RNA, 19 nt, Mycobacterium avium subsp. paratuberculosis
ccgggcgucacgccagcgu

SEQ ID NO: 991437 - RNA, 13 nt, Mycobacterium avium subsp. paratuberculosis
ccgggcgucgcgc

SEQ ID NO: 991438 - RNA, 14 nt, Mycobacterium avium subsp. paratuberculosis
ccgggcgucggcgg

SEQ ID NO: 991439 - RNA, 14 nt, Mycobacterium avium subsp. paratuberculosis
ccgggcgucggggc

SEQ ID NO: 991440 - RNA, 15 nt, Mycobacterium avium subsp. paratuberculosis
ccgggcgccggcgau

SEQ ID NO: 991441 - RNA, 19 nt, Mycobacterium avium subsp. paratuberculosis
ccgggcgggcugcgggcau

SEQ ID NO: 991442 - RNA, 20 nt, Mycobacterium avium subsp. paratuberculosis
ccgggcggugaccacgccgu

SEQ ID NO: 991443 - RNA, 22 nt, Mycobacterium avium subsp. paratuberculosis
ccgggcggugaccacgccgugc

SEQ ID NO: 991444 - RNA, 23 nt, Mycobacterium avium subsp. paratuberculosis
ccgggcucccgcuccauggcggc

SEQ ID NO: 991445 - RNA, 17 nt, Mycobacterium avium subsp. paratuberculosis
ccgggcuaucgcccggc

SEQ ID NO: 991446 - RNA, 16 nt, Mycobacterium avium subsp. paratuberculosis
ccgggcguucccgcgc

SEQ ID NO: 991447 - RNA, 13 nt, Mycobacterium avium subsp. paratuberculosis
ccgggucccccgc

SEQ ID NO: 991448 - RNA, 14 nt, Mycobacterium avium subsp. paratuberculosis
ccggguccccgccg

SEQ ID NO: 991449 - RNA, 16 nt, Mycobacterium avium subsp. paratuberculosis
ccggguccccgccgcc

SEQ ID NO: 991450 - RNA, 14 nt, Mycobacterium avium subsp. paratuberculosis
ccggguccgaggug

SEQ ID NO: 991451 - RNA, 16 nt, Mycobacterium avium subsp. paratuberculosis
ccgggcugcccaccac

SEQ ID NO: 991452 - RNA, 16 nt, Mycobacterium avium subsp. paratuberculosis
ccgggucagcaccacc

SEQ ID NO: 991453 - RNA, 19 nt, Mycobacterium avium subsp. paratuberculosis
ccgggucagcaccaccaac

SEQ ID NO: 991454 - RNA, 23 nt, Mycobacterium avium subsp. paratuberculosis
ccgggucgcggugggcucggcgc

SEQ ID NO: 991455 - RNA, 15 nt, Mycobacterium avium subsp. paratuberculosis
ccgggucgcacgccg

SEQ ID NO: 991456 - RNA, 14 nt, Mycobacterium avium subsp. paratuberculosis
ccgggucgacgccg

SEQ ID NO: 991457 - RNA, 20 nt, Mycobacterium avium subsp. paratuberculosis
ccgggucgcagcggcacguc

SEQ ID NO: 991458 - RNA, 16 nt, Mycobacterium avium subsp. paratuberculosis
ccgggucgcaggcagc

SEQ ID NO: 991459 - RNA, 17 nt, Mycobacterium avium subsp. paratuberculosis
ccggguccuaucaggac

SEQ ID NO: 991460 - RNA, 16 nt, Mycobacterium avium subsp. paratuberculosis
ccgggucgaccgccuc

SEQ ID NO: 991461 - RNA, 17 nt, Mycobacterium avium subsp. paratuberculosis
ccgggucgaccgccucg

SEQ ID NO: 991462 - RNA, 17 nt, Mycobacterium avium subsp. paratuberculosis
ccgggucgagcgcgccg

SEQ ID NO: 991463 - RNA, 18 nt, Mycobacterium avium subsp. paratuberculosis
ccgggucgagcggcccgc

SEQ ID NO: 991464 - RNA, 19 nt, Mycobacterium avium subsp. paratuberculosis
ccgggucgagcggcccgca

SEQ ID NO: 991465 - RNA, 19 nt, Mycobacterium avium subsp. paratuberculosis
ccggugcguccgccggcgg

SEQ ID NO: 991466 - RNA, 15 nt, Mycobacterium avium subsp. paratuberculosis
ccggugcucuccugc

SEQ ID NO: 991467 - RNA, 17 nt, Mycobacterium avium subsp. paratuberculosis
ccggugcugacccgguc

SEQ ID NO: 991468 - RNA, 17 nt, Mycobacterium avium subsp. paratuberculosis
ccggugcuguccacauc

SEQ ID NO: 991469 - RNA, 15 nt, Mycobacterium avium subsp. paratuberculosis
ccggugccgcagccg

SEQ ID NO: 991470 - RNA, 18 nt, Mycobacterium avium subsp. paratuberculosis
ccggugccgcagccgucc

SEQ ID NO: 991471 - RNA, 17 nt, Mycobacterium avium subsp. paratuberculosis
ccggugccgagcgcgcu

SEQ ID NO: 991472 - RNA, 14 nt, Mycobacterium avium subsp. paratuberculosis
ccgguggagauggc

SEQ ID NO: 991473 - RNA, 19 nt, Mycobacterium avium subsp. paratuberculosis
ccgguggacgcgauggcgc

SEQ ID NO: 991474 - RNA, 17 nt, Mycobacterium avium subsp. paratuberculosis
ccgguggcagcccggcu

SEQ ID NO: 991475 - RNA, 21 nt, Mycobacterium avium subsp. paratuberculosis
ccgguggacuccagcaccagc

SEQ ID NO: 991476 - RNA, 18 nt, Mycobacterium avium subsp. paratuberculosis
ccgguggccgggagugcu

SEQ ID NO: 991477 - RNA, 18 nt, Mycobacterium avium subsp. paratuberculosis
ccggugauucgugcagug

SEQ ID NO: 991478 - RNA, 21 nt, Mycobacterium avium subsp. paratuberculosis
ccggugaucgcggcgcugccg

SEQ ID NO: 991479 - RNA, 18 nt, Mycobacterium avium subsp. paratuberculosis
ccggugaugaacgcgccg

SEQ ID NO: 991480 - RNA, 21 nt, Mycobacterium avium subsp. paratuberculosis
ccggugaugacgucgcccacc

SEQ ID NO: 991481 - RNA, 13 nt, Mycobacterium avium subsp. paratuberculosis
ccggugccacgau

SEQ ID NO: 991482 - RNA, 17 nt, Mycobacterium avium subsp. paratuberculosis
ccggugccacggucagg

SEQ ID NO: 991483 - RNA, 18 nt, Mycobacterium avium subsp. paratuberculosis
ccggucggucagucgcgc

SEQ ID NO: 991484 - RNA, 20 nt, Mycobacterium avium subsp. paratuberculosis
ccggucggucagucgcgccg

SEQ ID NO: 991485 - RNA, 19 nt, Mycobacterium avium subsp. paratuberculosis
ccggucggugcccagcacc

SEQ ID NO: 991486 - RNA, 16 nt, Mycobacterium avium subsp. paratuberculosis
ccggucguagcgucgg

SEQ ID NO: 991487 - RNA, 19 nt, Mycobacterium avium subsp. paratuberculosis
ccggucguagucggcccgc

SEQ ID NO: 991488 - RNA, 18 nt, Mycobacterium avium subsp. paratuberculosis
ccggucggcccgcucccc

SEQ ID NO: 991489 - RNA, 18 nt, Mycobacterium avium subsp. paratuberculosis
ccggucgugcgacuccug

SEQ ID NO: 991490 - RNA, 20 nt, Mycobacterium avium subsp. paratuberculosis
ccggucgugcgacuccuggg

SEQ ID NO: 991491 - RNA, 20 nt, Mycobacterium avium subsp. paratuberculosis
ccggugagcaccgggaacag

SEQ ID NO: 991492 - RNA, 22 nt, Mycobacterium avium subsp. paratuberculosis
ccggugagccucagggcgcgcu

SEQ ID NO: 991493 - RNA, 16 nt, Mycobacterium avium subsp. paratuberculosis
ccggucagcgccagca

SEQ ID NO: 991494 - RNA, 16 nt, Mycobacterium avium subsp. paratuberculosis
ccggucacccaggccg

SEQ ID NO: 991495 - RNA, 15 nt, Mycobacterium avium subsp. paratuberculosis
ccggucaccccggcc

SEQ ID NO: 991496 - RNA, 22 nt, Mycobacterium avium subsp. paratuberculosis
ccggucagcguggcgucggcgc

SEQ ID NO: 991497 - RNA, 20 nt, Mycobacterium avium subsp. paratuberculosis
ccggucaggaacccggcccg

SEQ ID NO: 991498 - RNA, 23 nt, Mycobacterium avium subsp. paratuberculosis
ccggucagggcucgcaaccgucu

SEQ ID NO: 991499 - RNA, 17 nt, Mycobacterium avium subsp. paratuberculosis
ccggucacgcccggggu

SEQ ID NO: 991500 - RNA, 22 nt, Mycobacterium avium subsp. paratuberculosis
ccggucgcguugaaagccgcga

SEQ ID NO: 991501 - RNA, 18 nt, Mycobacterium avium subsp. paratuberculosis
ccggucgaugugcgcgcu

SEQ ID NO: 991502 - RNA, 16 nt, Mycobacterium avium subsp. paratuberculosis
ccggucauccgggcca

SEQ ID NO: 991503 - RNA, 21 nt, Mycobacterium avium subsp. paratuberculosis
ccggucauccgggccaccacc

SEQ ID NO: 991504 - RNA, 19 nt, Mycobacterium avium subsp. paratuberculosis
ccggucauccucgccgcgc

SEQ ID NO: 991505 - RNA, 20 nt, Mycobacterium avium subsp. paratuberculosis
ccggucauccucgccgcgcc

SEQ ID NO: 991506 - RNA, 14 nt, Mycobacterium avium subsp. paratuberculosis
ccgguagcgacacg

SEQ ID NO: 991507 - RNA, 17 nt, Mycobacterium avium subsp. paratuberculosis
ccgguaggcgcaccgcc

SEQ ID NO: 991508 - RNA, 16 nt, Mycobacterium avium subsp. paratuberculosis
ccgguaggcggccagc

SEQ ID NO: 991509 - RNA, 17 nt, Mycobacterium avium subsp. paratuberculosis
ccgguaggcggccagcg

SEQ ID NO: 991510 - RNA, 18 nt, Mycobacterium avium subsp. paratuberculosis
ccgguaggcggccagcgc

SEQ ID NO: 991511 - RNA, 23 nt, Mycobacterium avium subsp. paratuberculosis
ccgguaggcggccagcgcccgcg

SEQ ID NO: 991512 - RNA, 15 nt, Mycobacterium avium subsp. paratuberculosis
ccggucaacggcucg

SEQ ID NO: 991513 - RNA, 19 nt, Mycobacterium avium subsp. paratuberculosis
ccgcaggaucgagccggcc

SEQ ID NO: 991514 - RNA, 16 nt, Mycobacterium avium subsp. paratuberculosis
ccgcaguucggccgcc

SEQ ID NO: 991515 - RNA, 16 nt, Mycobacterium avium subsp. paratuberculosis
ccgcaggugcagcucc

SEQ ID NO: 991516 - RNA, 17 nt, Mycobacterium avium subsp. paratuberculosis
ccgcaggugcucgccgg

SEQ ID NO: 991517 - RNA, 15 nt, Mycobacterium avium subsp. paratuberculosis
ccgcagguggugggc

SEQ ID NO: 991518 - RNA, 14 nt, Mycobacterium avium subsp. paratuberculosis
ccgcagaacaccag

SEQ ID NO: 991519 - RNA, 16 nt, Mycobacterium avium subsp. paratuberculosis
ccgcacuuggccucgg

SEQ ID NO: 991520 - RNA, 16 nt, Mycobacterium avium subsp. paratuberculosis
ccgcaggaaaggaagg

SEQ ID NO: 991521 - RNA, 20 nt, Mycobacterium avium subsp. paratuberculosis
ccgcaggaaaggaaggcgca

SEQ ID NO: 991522 - RNA, 14 nt, Mycobacterium avium subsp. paratuberculosis
ccgcagcuccagcg

SEQ ID NO: 991523 - RNA, 22 nt, Mycobacterium avium subsp. paratuberculosis
ccgcagcuccagcgaguuggcc

SEQ ID NO: 991524 - RNA, 17 nt, Mycobacterium avium subsp. paratuberculosis
ccgcagcucgcccagca

SEQ ID NO: 991525 - RNA, 14 nt, Mycobacterium avium subsp. paratuberculosis
ccgcagcucgccgg

SEQ ID NO: 991526 - RNA, 17 nt, Mycobacterium avium subsp. paratuberculosis
ccgcagcucgccggugg

SEQ ID NO: 991527 - RNA, 12 nt, Mycobacterium avium subsp. paratuberculosis
ccgcagcucguu

SEQ ID NO: 991528 - RNA, 14 nt, Mycobacterium avium subsp. paratuberculosis
ccgcagcggcggcu

SEQ ID NO: 991529 - RNA, 20 nt, Mycobacterium avium subsp. paratuberculosis
ccgcauagcgggagccggcc

SEQ ID NO: 991530 - RNA, 16 nt, Mycobacterium avium subsp. paratuberculosis
ccgcaucaacugcacc

SEQ ID NO: 991531 - RNA, 20 nt, Mycobacterium avium subsp. paratuberculosis
ccgcaucaacugcaccagcg

SEQ ID NO: 991532 - RNA, 15 nt, Mycobacterium avium subsp. paratuberculosis
ccgcaucgaaccgcc

SEQ ID NO: 991533 - RNA, 16 nt, Mycobacterium avium subsp. paratuberculosis
ccgcaucgaaccgccg

SEQ ID NO: 991534 - RNA, 20 nt, Mycobacterium avium subsp. paratuberculosis
ccgcaucgaaccgccgcgcu

SEQ ID NO: 991535 - RNA, 19 nt, Mycobacterium avium subsp. paratuberculosis
ccgcauccgccgggcggcg

SEQ ID NO: 991536 - RNA, 23 nt, Mycobacterium avium subsp. paratuberculosis
ccgcauucggccgccaccgaggu

SEQ ID NO: 991537 - RNA, 16 nt, Mycobacterium avium subsp. paratuberculosis
ccgcauuccucggcca

SEQ ID NO: 991538 - RNA, 19 nt, Mycobacterium avium subsp. paratuberculosis
ccgcaugucgaccucggcc

SEQ ID NO: 991539 - RNA, 22 nt, Mycobacterium avium subsp. paratuberculosis
ccgcauguucucgagcccgauc

SEQ ID NO: 991540 - RNA, 23 nt, Mycobacterium avium subsp. paratuberculosis
ccgcauguugugcccgacggcgc

SEQ ID NO: 991541 - RNA, 20 nt, Mycobacterium avium subsp. paratuberculosis
ccgcaucguugguccaggcg

SEQ ID NO: 991542 - RNA, 14 nt, Mycobacterium avium subsp. paratuberculosis
ccgcaugcccgggc

SEQ ID NO: 991543 - RNA, 16 nt, Mycobacterium avium subsp. paratuberculosis
ccgauugcccgacucc

SEQ ID NO: 991544 - RNA, 17 nt, Mycobacterium avium subsp. paratuberculosis
ccgauugcccgacuccu

SEQ ID NO: 991545 - RNA, 15 nt, Mycobacterium avium subsp. paratuberculosis
ccgauguuuugggug

SEQ ID NO: 991546 - RNA, 15 nt, Mycobacterium avium subsp. paratuberculosis
ccgauguggccggcg

SEQ ID NO: 991547 - RNA, 17 nt, Mycobacterium avium subsp. paratuberculosis
ccgauuucccgacuccu

SEQ ID NO: 991548 - RNA, 20 nt, Mycobacterium avium subsp. paratuberculosis
ccgagcgucauuccgccgcg

SEQ ID NO: 991549 - RNA, 21 nt, Mycobacterium avium subsp. paratuberculosis
ccgagcgucauuccgccgcgc

SEQ ID NO: 991550 - RNA, 15 nt, Mycobacterium avium subsp. paratuberculosis
ccgagcgugaaacua

SEQ ID NO: 991551 - RNA, 17 nt, Mycobacterium avium subsp. paratuberculosis
ccgagcgucacgccagc

SEQ ID NO: 991552 - RNA, 19 nt, Mycobacterium avium subsp. paratuberculosis
ccgagcgucacgccagcgu

SEQ ID NO: 991553 - RNA, 16 nt, Mycobacterium avium subsp. paratuberculosis
ccgagccgggcggcca

SEQ ID NO: 991554 - RNA, 18 nt, Mycobacterium avium subsp. paratuberculosis
ccgagccgggcggccagc

SEQ ID NO: 991555 - RNA, 21 nt, Mycobacterium avium subsp. paratuberculosis
ccgagccgggcggccagcgug

SEQ ID NO: 991556 - RNA, 22 nt, Mycobacterium avium subsp. paratuberculosis
ccgagccgggcggccagcgugg

SEQ ID NO: 991557 - RNA, 17 nt, Mycobacterium avium subsp. paratuberculosis
ccgagcugggccggcgc

SEQ ID NO: 991558 - RNA, 13 nt, Mycobacterium avium subsp. paratuberculosis
ccgaugucggcga

SEQ ID NO: 991559 - RNA, 21 nt, Mycobacterium avium subsp. paratuberculosis
ccgagcucgauguccagguag

SEQ ID NO: 991560 - RNA, 19 nt, Mycobacterium avium subsp. paratuberculosis
ccgcaauacggugcccgcc

SEQ ID NO: 991561 - RNA, 18 nt, Mycobacterium avium subsp. paratuberculosis
ccgcacaauccggucagc

SEQ ID NO: 991562 - RNA, 22 nt, Mycobacterium avium subsp. paratuberculosis
ccgcacaccgcggcggcgucgg

SEQ ID NO: 991563 - RNA, 19 nt, Mycobacterium avium subsp. paratuberculosis
ccgcaauugcgccagcagc

SEQ ID NO: 991564 - RNA, 14 nt, Mycobacterium avium subsp. paratuberculosis
ccgcacccccucca

SEQ ID NO: 991565 - RNA, 18 nt, Mycobacterium avium subsp. paratuberculosis
ccgcacccccuccacacg

SEQ ID NO: 991566 - RNA, 14 nt, Mycobacterium avium subsp. paratuberculosis
ccgcacccagcggg

SEQ ID NO: 991567 - RNA, 18 nt, Mycobacterium avium subsp. paratuberculosis
ccgcacccagcgggcgac

SEQ ID NO: 991568 - RNA, 23 nt, Mycobacterium avium subsp. paratuberculosis
ccgcaccagcaccccgccgcagc

SEQ ID NO: 991569 - RNA, 18 nt, Mycobacterium avium subsp. paratuberculosis
ccgcaccaccgcccggac

SEQ ID NO: 991570 - RNA, 19 nt, Mycobacterium avium subsp. paratuberculosis
ccgcaccagaucgucgggc

SEQ ID NO: 991571 - RNA, 16 nt, Mycobacterium avium subsp. paratuberculosis
ccgccaucgcccggug

SEQ ID NO: 991572 - RNA, 16 nt, Mycobacterium avium subsp. paratuberculosis
ccgccaucgccgccgc

SEQ ID NO: 991573 - RNA, 16 nt, Mycobacterium avium subsp. paratuberculosis
ccgccaguuguuggcc

SEQ ID NO: 991574 - RNA, 14 nt, Mycobacterium avium subsp. paratuberculosis
ccgccagggugccg

SEQ ID NO: 991575 - RNA, 15 nt, Mycobacterium avium subsp. paratuberculosis
ccgccaggucggggc

SEQ ID NO: 991576 - RNA, 20 nt, Mycobacterium avium subsp. paratuberculosis
ccgccaggucggggcccguc

SEQ ID NO: 991577 - RNA, 19 nt, Mycobacterium avium subsp. paratuberculosis
ccgccagguuggcggcggc

SEQ ID NO: 991578 - RNA, 21 nt, Mycobacterium avium subsp. paratuberculosis
ccgccagguuggcggcggccc

SEQ ID NO: 991579 - RNA, 23 nt, Mycobacterium avium subsp. paratuberculosis
ccgccagguuggcggcggcccgc

SEQ ID NO: 991580 - RNA, 23 nt, Mycobacterium avium subsp. paratuberculosis
ccgccagggcgacgccgcggaag

SEQ ID NO: 991581 - RNA, 22 nt, Mycobacterium avium subsp. paratuberculosis
ccgccagggcgcggcgcaccga

SEQ ID NO: 991582 - RNA, 20 nt, Mycobacterium avium subsp. paratuberculosis
ccgccaggcuggccaggcug

SEQ ID NO: 991583 - RNA, 14 nt, Mycobacterium avium subsp. paratuberculosis
ccgccagcgccggc

SEQ ID NO: 991584 - RNA, 19 nt, Mycobacterium avium subsp. paratuberculosis
ccgccagcucguccagcgu

SEQ ID NO: 991585 - RNA, 23 nt, Mycobacterium avium subsp. paratuberculosis
ccgccaggaucugcucggcgucg

SEQ ID NO: 991586 - RNA, 17 nt, Mycobacterium avium subsp. paratuberculosis
ccgccaggaaggccagu

SEQ ID NO: 991587 - RNA, 21 nt, Mycobacterium avium subsp. paratuberculosis
ccgccaggaauaacgccggcc

SEQ ID NO: 991588 - RNA, 17 nt, Mycobacterium avium subsp. paratuberculosis
ccgccaggaccacccac

SEQ ID NO: 991589 - RNA, 14 nt, Mycobacterium avium subsp. paratuberculosis
ccgccagcgcgccg

SEQ ID NO: 991590 - RNA, 16 nt, Mycobacterium avium subsp. paratuberculosis
ccgccagcgcggcggc

SEQ ID NO: 991591 - RNA, 18 nt, Mycobacterium avium subsp. paratuberculosis
ccgccagcgcggcggcgc

SEQ ID NO: 991592 - RNA, 20 nt, Mycobacterium avium subsp. paratuberculosis
ccgccagcgcggggucggcc

SEQ ID NO: 991593 - RNA, 24 nt, Mycobacterium avium subsp. paratuberculosis
ccgccagcgucccguccugggccu

SEQ ID NO: 991594 - RNA, 22 nt, Mycobacterium avium subsp. paratuberculosis
aaaccagcagcgccacaaugga

SEQ ID NO: 991595 - RNA, 23 nt, Mycobacterium avium subsp. paratuberculosis
ccgcauuggcaccgucgaccucg

SEQ ID NO: 991596 - RNA, 17 nt, Mycobacterium avium subsp. paratuberculosis
ccgccaaucaccgcggu

SEQ ID NO: 991597 - RNA, 12 nt, Mycobacterium avium subsp. paratuberculosis
ccgccaagugcg

SEQ ID NO: 991598 - RNA, 18 nt, Mycobacterium avium subsp. paratuberculosis
ccgccaacgcgaacgggu

SEQ ID NO: 991599 - RNA, 15 nt, Mycobacterium avium subsp. paratuberculosis
ccgccaccacccggc

SEQ ID NO: 991600 - RNA, 15 nt, Mycobacterium avium subsp. paratuberculosis
ccgccacagcgccuc

SEQ ID NO: 991601 - RNA, 16 nt, Mycobacterium avium subsp. paratuberculosis
ccgccacagcgccucg

SEQ ID NO: 991602 - RNA, 18 nt, Mycobacterium avium subsp. paratuberculosis
ccgccacagcgccucgcg

SEQ ID NO: 991603 - RNA, 14 nt, Mycobacterium avium subsp. paratuberculosis
ccgccaccgcccgc

SEQ ID NO: 991604 - RNA, 21 nt, Mycobacterium avium subsp. paratuberculosis
ccgccaccgcgaaagcgucgg

SEQ ID NO: 991605 - RNA, 12 nt, Mycobacterium avium subsp. paratuberculosis
ccgccaccggcc

SEQ ID NO: 991606 - RNA, 14 nt, Mycobacterium avium subsp. paratuberculosis
ccgccaccggcccg

SEQ ID NO: 991607 - RNA, 13 nt, Mycobacterium avium subsp. paratuberculosis
ccgccaccggccg

SEQ ID NO: 991608 - RNA, 16 nt, Mycobacterium avium subsp. paratuberculosis
ccgccaccggccgguc

SEQ ID NO: 991609 - RNA, 16 nt, Mycobacterium avium subsp. paratuberculosis
ccgccagcagaugccg

SEQ ID NO: 991610 - RNA, 11 nt, Mycobacterium avium subsp. paratuberculosis
ccgccagcagc

SEQ ID NO: 991611 - RNA, 15 nt, Mycobacterium avium subsp. paratuberculosis
ccgccagccgcgucu

SEQ ID NO: 991612 - RNA, 13 nt, Mycobacterium avium subsp. paratuberculosis
ccgccagcaccac

SEQ ID NO: 991613 - RNA, 12 nt, Mycobacterium avium subsp. paratuberculosis
ccgccagcaccu

SEQ ID NO: 991614 - RNA, 12 nt, Mycobacterium avium subsp. paratuberculosis
ccgccagcagca

SEQ ID NO: 991615 - RNA, 21 nt, Mycobacterium avium subsp. paratuberculosis
ccgccagcagcagccgcgccg

SEQ ID NO: 991616 - RNA, 24 nt, Mycobacterium avium subsp. paratuberculosis
ccgccagcagcagcgccgccaccg

SEQ ID NO: 991617 - RNA, 12 nt, Mycobacterium avium subsp. paratuberculosis
ccgccagcagcg

SEQ ID NO: 991618 - RNA, 14 nt, Mycobacterium avium subsp. paratuberculosis
ccgccacggcgcca

SEQ ID NO: 991619 - RNA, 15 nt, Mycobacterium avium subsp. paratuberculosis
ccgccacgccguugg

SEQ ID NO: 991620 - RNA, 14 nt, Mycobacterium avium subsp. paratuberculosis
ccgccacgcggcgc

SEQ ID NO: 991621 - RNA, 16 nt, Mycobacterium avium subsp. paratuberculosis
ccgccacggggcccgc

SEQ ID NO: 991622 - RNA, 22 nt, Mycobacterium avium subsp. paratuberculosis
aaacccagcaccaacagcggcc

SEQ ID NO: 991623 - RNA, 21 nt, Mycobacterium avium subsp. paratuberculosis
ccgccgagggcccgggcaggc

SEQ ID NO: 991624 - RNA, 14 nt, Mycobacterium avium subsp. paratuberculosis
ccgccgagucgcgc

SEQ ID NO: 991625 - RNA, 17 nt, Mycobacterium avium subsp. paratuberculosis
ccgccgagucgcgccgc

SEQ ID NO: 991626 - RNA, 20 nt, Mycobacterium avium subsp. paratuberculosis
ccgccgagacggcguggcug

SEQ ID NO: 991627 - RNA, 16 nt, Mycobacterium avium subsp. paratuberculosis
ccgccgacuccccgcc

SEQ ID NO: 991628 - RNA, 16 nt, Mycobacterium avium subsp. paratuberculosis
ccgccgacgguggccc

SEQ ID NO: 991629 - RNA, 23 nt, Mycobacterium avium subsp. paratuberculosis
ccgccgagauccaccgcgcggcc

SEQ ID NO: 991630 - RNA, 19 nt, Mycobacterium avium subsp. paratuberculosis
ccgccgagccgcuccaccg

SEQ ID NO: 991631 - RNA, 20 nt, Mycobacterium avium subsp. paratuberculosis
ccgccgagccgcuccaccgc

SEQ ID NO: 991632 - RNA, 13 nt, Mycobacterium avium subsp. paratuberculosis
ccgccgagccggc

SEQ ID NO: 991633 - RNA, 21 nt, Mycobacterium avium subsp. paratuberculosis
ccgccgagcucggccaccagc

SEQ ID NO: 991634 - RNA, 19 nt, Mycobacterium avium subsp. paratuberculosis
ccgccgaugaugguggcgg

SEQ ID NO: 991635 - RNA, 22 nt, Mycobacterium avium subsp. paratuberculosis
ccgccgaucgugacgccguccg

SEQ ID NO: 991636 - RNA, 18 nt, Mycobacterium avium subsp. paratuberculosis
ccgccgauucaaccccgc

SEQ ID NO: 991637 - RNA, 22 nt, Mycobacterium avium subsp. paratuberculosis
ccgccgauucaaccccgcgcgc

SEQ ID NO: 991638 - RNA, 18 nt, Mycobacterium avium subsp. paratuberculosis
ccgccgauuccggccggc

SEQ ID NO: 991639 - RNA, 16 nt, Mycobacterium avium subsp. paratuberculosis
ccgccgcaacagccgg

SEQ ID NO: 991640 - RNA, 20 nt, Mycobacterium avium subsp. paratuberculosis
ccgccgcaacagccggcccg

SEQ ID NO: 991641 - RNA, 17 nt, Mycobacterium avium subsp. paratuberculosis
ccgcccuugcucgcggc

SEQ ID NO: 991642 - RNA, 21 nt, Mycobacterium avium subsp. paratuberculosis
ccgccgaaacccgcugucaau

SEQ ID NO: 991643 - RNA, 15 nt, Mycobacterium avium subsp. paratuberculosis
ccgccgaaagccucc

SEQ ID NO: 991644 - RNA, 18 nt, Mycobacterium avium subsp. paratuberculosis
ccgccgaaagccuccgcg

SEQ ID NO: 991645 - RNA, 17 nt, Mycobacterium avium subsp. paratuberculosis
ccgccgaagccggcucg

SEQ ID NO: 991646 - RNA, 15 nt, Mycobacterium avium subsp. paratuberculosis
ccgccgaagcggcgc

SEQ ID NO: 991647 - RNA, 18 nt, Mycobacterium avium subsp. paratuberculosis
ccgccgaaccccagcucc

SEQ ID NO: 991648 - RNA, 15 nt, Mycobacterium avium subsp. paratuberculosis
ccgccgaacccgccc

SEQ ID NO: 991649 - RNA, 18 nt, Mycobacterium avium subsp. paratuberculosis
ccgccgaacccgcccucg

SEQ ID NO: 991650 - RNA, 15 nt, Mycobacterium avium subsp. paratuberculosis
ccgccgaacgccucc

SEQ ID NO: 991651 - RNA, 20 nt, Mycobacterium avium subsp. paratuberculosis
ccgccgaacgccuccgccgc

SEQ ID NO: 991652 - RNA, 14 nt, Mycobacterium avium subsp. paratuberculosis
ccgccgacaccacc

SEQ ID NO: 991653 - RNA, 16 nt, Mycobacterium avium subsp. paratuberculosis
ccgccgacaccagggu

SEQ ID NO: 991654 - RNA, 16 nt, Mycobacterium avium subsp. paratuberculosis
ccgcccgucagccccu

SEQ ID NO: 991655 - RNA, 14 nt, Mycobacterium avium subsp. paratuberculosis
ccgcccguccagcg

SEQ ID NO: 991656 - RNA, 19 nt, Mycobacterium avium subsp. paratuberculosis
ccgcccguccgggccggcc

SEQ ID NO: 991657 - RNA, 22 nt, Mycobacterium avium subsp. paratuberculosis
ccgcccgucggggcccggcccg

SEQ ID NO: 991658 - RNA, 13 nt, Mycobacterium avium subsp. paratuberculosis
ccgcccggggcgc

SEQ ID NO: 991659 - RNA, 14 nt, Mycobacterium avium subsp. paratuberculosis
ccgcccggggcggc

SEQ ID NO: 991660 - RNA, 12 nt, Mycobacterium avium subsp. paratuberculosis
ccgcccggcccg

SEQ ID NO: 991661 - RNA, 18 nt, Mycobacterium avium subsp. paratuberculosis
ccgcccggaucagcugac

SEQ ID NO: 991662 - RNA, 15 nt, Mycobacterium avium subsp. paratuberculosis
ccgcccggcaacacg

SEQ ID NO: 991663 - RNA, 16 nt, Mycobacterium avium subsp. paratuberculosis
ccgcccggacaccccg

SEQ ID NO: 991664 - RNA, 14 nt, Mycobacterium avium subsp. paratuberculosis
ccgcccggaccggc

SEQ ID NO: 991665 - RNA, 15 nt, Mycobacterium avium subsp. paratuberculosis
ccgcccggaccggcu

SEQ ID NO: 991666 - RNA, 14 nt, Mycobacterium avium subsp. paratuberculosis
ccgcccucgccccg

SEQ ID NO: 991667 - RNA, 15 nt, Mycobacterium avium subsp. paratuberculosis
ccgcccucucacggc

SEQ ID NO: 991668 - RNA, 21 nt, Mycobacterium avium subsp. paratuberculosis
ccgcccucucacggcgguagc

SEQ ID NO: 991669 - RNA, 12 nt, Mycobacterium avium subsp. paratuberculosis
ccgccccagccg

SEQ ID NO: 991670 - RNA, 17 nt, Mycobacterium avium subsp. paratuberculosis
ccgccccagccgaccag

SEQ ID NO: 991671 - RNA, 23 nt, Mycobacterium avium subsp. paratuberculosis
ccgcccaucagcaggaccaggcc

SEQ ID NO: 991672 - RNA, 16 nt, Mycobacterium avium subsp. paratuberculosis
ccgcccaucggcagcc

SEQ ID NO: 991673 - RNA, 12 nt, Mycobacterium avium subsp. paratuberculosis
ccgccccgccgc

SEQ ID NO: 991674 - RNA, 15 nt, Mycobacterium avium subsp. paratuberculosis
ccgccccgccgcgcc

SEQ ID NO: 991675 - RNA, 18 nt, Mycobacterium avium subsp. paratuberculosis
ccgccccgcgcgaucagg

SEQ ID NO: 991676 - RNA, 12 nt, Mycobacterium avium subsp. paratuberculosis
ccgcccccgccc

SEQ ID NO: 991677 - RNA, 20 nt, Mycobacterium avium subsp. paratuberculosis
ccgccccgaacagcgccagg

SEQ ID NO: 991678 - RNA, 23 nt, Mycobacterium avium subsp. paratuberculosis
ccgccccgacgugcagcgccagc

SEQ ID NO: 991679 - RNA, 13 nt, Mycobacterium avium subsp. paratuberculosis
ccgcccgcccggc

SEQ ID NO: 991680 - RNA, 14 nt, Mycobacterium avium subsp. paratuberculosis
ccgcccgcccggca

SEQ ID NO: 991681 - RNA, 16 nt, Mycobacterium avium subsp. paratuberculosis
ccgcccgcccggcacg

SEQ ID NO: 991682 - RNA, 15 nt, Mycobacterium avium subsp. paratuberculosis
ccgcccgaaccgcgu

SEQ ID NO: 991683 - RNA, 23 nt, Mycobacterium avium subsp. paratuberculosis
ccgcccgaucccgucgucggcgc

SEQ ID NO: 991684 - RNA, 16 nt, Mycobacterium avium subsp. paratuberculosis
ccgcccgcggugugcu

SEQ ID NO: 991685 - RNA, 23 nt, Mycobacterium avium subsp. paratuberculosis
ccgcccgcgcgaugcgggcgccg

SEQ ID NO: 991686 - RNA, 22 nt, Mycobacterium avium subsp. paratuberculosis
ccgcccggcgagcacaggaacg

SEQ ID NO: 991687 - RNA, 13 nt, Mycobacterium avium subsp. paratuberculosis
ccgcccggcgccg

SEQ ID NO: 991688 - RNA, 15 nt, Mycobacterium avium subsp. paratuberculosis
ccgcccggcgccggc

SEQ ID NO: 991689 - RNA, 16 nt, Mycobacterium avium subsp. paratuberculosis
ccgcccggcgcgcagc

SEQ ID NO: 991690 - RNA, 22 nt, Mycobacterium avium subsp. paratuberculosis
ccgcccggcgcgcagcccagcc

SEQ ID NO: 991691 - RNA, 16 nt, Mycobacterium avium subsp. paratuberculosis
ccgcccggcggccacc

SEQ ID NO: 991692 - RNA, 14 nt, Mycobacterium avium subsp. paratuberculosis
ccgcccggcggcgc

SEQ ID NO: 991693 - RNA, 15 nt, Mycobacterium avium subsp. paratuberculosis
ccgcccgggccaggc

SEQ ID NO: 991694 - RNA, 17 nt, Mycobacterium avium subsp. paratuberculosis
ccgcccgggccaggcgc

SEQ ID NO: 991695 - RNA, 18 nt, Mycobacterium avium subsp. paratuberculosis
ccgcccgggccaggcgcg

SEQ ID NO: 991696 - RNA, 12 nt, Mycobacterium avium subsp. paratuberculosis
ccgcccgggccc
